United States Patent 8,445,666 (RIBONUCLEIC ACID INTERFERENCE MOLECULES) - sequence listing, part 3

SEQ ID NO: 44882 - DNA, 94 bp, Homo sapiens
ggagcatgatggctgcatcatatggtaagagtatatttagttttataagaaactgccaaactgtcttccaaagtggctgtactatttgcattcc

SEQ ID NO: 44883 - DNA, 125 bp, Homo sapiens
cattgtgtgtgtgtatatatattctatatatatatattccattgtatatatatattcaggattgcatatatacacacaaaatgcaggattttatttataaatatatatacaatggaatatgtata

SEQ ID NO: 44884 - DNA, 58 bp, Homo sapiens
tgagacagggtctcactctgtcacccaggctggggggcagtggcaagctctctgctca

SEQ ID NO: 44885 - DNA, 87 bp, Homo sapiens
gctttacctctctgaggctcagtgactgttacattataggaataataggaagacattcacatcatgacgttctagtgaggattaagt

SEQ ID NO: 44886 - DNA, 106 bp, Homo sapiens
gacactgccattgcttctatatttttgcttcatgaacaaggctgctatgtatatttttgtatatgcttcctggcataaaagagcaagagtttctttagggtatgtt

SEQ ID NO: 44887 - DNA, 61 bp, Homo sapiens
tgcttaacacagagctctggatatgggaaaattcctgtgtggatttttgtgtggctgagta

SEQ ID NO: 44888 - DNA, 98 bp, Homo sapiens
atatatagtgtgtacatacacaatatattgtgtatatatgtatatatagtgtatacatacataatatattgtgtatatatgtatatattgtgtataca

SEQ ID NO: 44889 - DNA, 85 bp, Homo sapiens
tccgcctcagcctcccgagtaactgggcctacaggcgctcgccaccaggcccagctaatttttgttacttttagtagaggcaggg

SEQ ID NO: 44890 - DNA, 97 bp, Homo sapiens
ccaatacaatgtgataggagggagatgtgtaactgcaagaccatgtcttaaaagatctaaaggttccatcttcacctcttggaacactgctccttgg

SEQ ID NO: 44891 - DNA, 103 bp, Homo sapiens
gtaggtaacagatactgttatgtcatatatatacatatatattacaaatataaaagatattaagtatatgtatggaggtgtatgtgcatttcttttgttttac

SEQ ID NO: 44892 - DNA, 96 bp, Homo sapiens
gtatgagtttatttatatacacatacatatatatacatatacacatatatgtatttgtatatatatacgtatgaatgtgtgagtttatgttcttac

SEQ ID NO: 44893 - DNA, 109 bp, Homo sapiens
gtcttggctgcctccatggctcttttctaccctcaaataaatgaggtgtttgttttgtattttattcatcttttttgattgcttttagtggagtatcatgtcagttgac

SEQ ID NO: 44894 - DNA, 119 bp, Homo sapiens
ggggtttcaccatgttggccaggctggtctcaaactcctgacctcaagtgatctgcctgtctcagcctctcaaagtggagccaccatgcctggcctgtttattacaggtgtgagccact

SEQ ID NO: 44895 - DNA, 72 bp, Homo sapiens; identical to SEQ ID NO: 44873

SEQ ID NO: 44896 - DNA, 80 bp, Homo sapiens
tatacttgtgtgggtgtatgtatatatatgtgtatatatatatatacacattcccatatatatgcacatacacatatata

SEQ ID NO: 44897 - DNA, 106 bp, Homo sapiens
tctgtgcctgagctgttttatctgtgttttactgtctgctttttctggctgcttgtggttagaaaagaagtgatttttttgaaatgcatgaggctagaaagggagc

SEQ ID NO: 44898 - DNA, 86 bp, Homo sapiens
gtatagggtactttggaatggtctatggggttgatgatctgtttttattttacttttttaccccagagtgttctctctctctctgc

SEQ ID NO: 44899 - DNA, 103 bp, Homo sapiens
ttgagacaggatctcgctctgtcacccaggatggagtacagtagtgtgatcatagctcactgcagccttgacctcctgggctcaagccattctcttgccttag

SEQ ID NO: 44900 - DNA, 90 bp, Homo sapiens
tggggaggatcaccatggaattcaaatgtctggacacacacacactcacaatctacagtaatattccagaattgttcatgctcttcctta

SEQ ID NO: 44901 - DNA, 116 bp, Homo sapiens
caaatatatacatatatatgtgtgtgtatatgtagagagacatatatatgtgtatatatatgtgtgtgtgtatatatatgcgcgcacgtgtgtgtgtgtgtgtatacacacacaca

SEQ ID NO: 44902 - DNA, 56 bp, Homo sapiens
cgccagatgtagggaccagccccacagggtcggtgggtctctccctgtgtgtggcg

SEQ ID NO: 44903 - DNA, 62 bp, Homo sapiens
tctgcactctctcactcacatgctccatcctgcaaaggggtgagtgtggtgggccgagtaga

SEQ ID NO: 44904 - DNA, 85 bp, Homo sapiens
gctattctggttgtcatgtgcatttgttctattttggagcccttgggtgcttcaggacatgaacacatggccttttgtgatctgc

SEQ ID NO: 44905 - DNA, 117 bp, Homo sapiens
ttagctcagtttagagatgagcacactgaggcgggagagggtgcagtcaaggagctgagacacagcagagtgaggccatctgggctctccaagaagcaggtgctgagacagagttgg

SEQ ID NO: 44906 - DNA, 108 bp, Homo sapiens
atagtatatatgtagtatatatggtagtgtgtgtatgcatatatacacatactatcttatatttatacatatactatcttatatatatactatatatacacatactat

SEQ ID NO: 44907 - DNA, 82 bp, Homo sapiens
gagaacctgcatttctaactaggtcccaggcagcaccaaggctgctggaataacaaggttgaatagaaatgtgatagttctt

SEQ ID NO: 44908 - DNA, 110 bp, Homo sapiens
agtggccatacagatgcctccccagtcctcacagcagccctgtgagatacatgtcactgtctgtctcatatagatgaggaaactgaggctgagtaaaatgtgtttccatt

SEQ ID NO: 44909 - DNA, 135 bp, Homo sapiens
tgactccgtgagattctgcttcttagcatttttttcttttcctttttttttttttttgagacagagtctcactctgtcacccaggctggagtgcaatggcatggtctcggctcgctgcaacctccgcctcctggg

SEQ ID NO: 44910 - DNA, 118 bp, Homo sapiens
ccgcgtccttcccagtagtttaggtcagaaatcttggagtcatcctggccacttctctttctctgtctttcacctcaattccaatctgtcctcaaatctacctcccagagggatccgg

SEQ ID NO: 44911 - DNA, 59 bp, Homo sapiens
ggtgtgagaggttagggaaagtaaagatgtaatttctttcccatccaagttctcagacc

SEQ ID NO: 44912 - DNA, 134 bp, Homo sapiens
gcaacacagcgagagcttgtctttacaaaaactttttttggtattattttttttgagacaagagtctcactctgtcgcccaggctggagtgcagtggcacaatctgcgctcactgcaacctctgcctcccgggt

SEQ ID NO: 44913 - DNA, 75 bp, Homo sapiens
gtctcctttcatgctgagtgtctgtgtgtctctgattcttagaaagacataggagggcttaccatggagggagat

SEQ ID NO: 44914 - DNA, 58 bp, Homo sapiens
tgagacagagtctcactctgtcgcccaggctggagtgtagtggtgcgatctcggctca

SEQ ID NO: 44915 - DNA, 147 bp, Homo sapiens
gaggccataaaatgtcatagatgaggagccctaattcaaatatgtgtgtataaacaagagtgtgtgcacagggattagggaaaacccctcaaggagatgactctttttttcttttttttttgagacaaagtttcctgttgcccaggc

SEQ ID NO: 44916 - DNA, 73 bp, Homo sapiens
acctgggtcgacagccagagctatttattttgttttctttttttgagatagagtctcactctgtcgcctaggt

SEQ ID NO: 44917 - DNA, 93 bp, Homo sapiens
acgggctccacagcgctgggacacacagactcactgggagaatagaggaactggcacttggggtgggttttgaaggaaggctgtgacttttgt

SEQ ID NO: 44918 - DNA, 82 bp, Homo sapiens
ggtcttccctctgtgtgtgtctgtgtcctaatctcctcttcttaggagaagttatattggattagggcccacctatatgacc

SEQ ID NO: 44919 - DNA, 112 bp, Homo sapiens
tacacatatgtgtgtgcataatatttctgtatatataatttttgtataattatatataatttttatataattatatatatacatagaatataaagcaaaagcaattggagta

SEQ ID NO: 44920 - DNA, 75 bp, Homo sapiens
gcttggttgagatggtgagaggatttttttttattttttattttttgagacagtgtctcactctgtcacccaggc

SEQ ID NO: 44921 - DNA, 63 bp, Homo sapiens
tgtgtgtgtatatatatacacatacatattatatatatgtgtgtgtatatatatacacataca

SEQ ID NO: 44922 - DNA, 61 bp, Homo sapiens
gagcctggtatgatgtctgactccagcaagggcccggcagtcagcatcctaaccgtggctc

SEQ ID NO: 44923 - DNA, 85 bp, Homo sapiens
ggaggctgagtgagtgcctggctccgtgctctgcatgttactctgtgtgtggcttccactgccctgtctcatcctctcagtagcc

SEQ ID NO: 44924 - DNA, 115 bp, Homo sapiens
gttagagccaggcatgtaatcaccactctctatggatgagctactgttgtctgctcatacggcaggacaatctcattgagtagtcagggcgagatcatgaccccatctgcagctc

SEQ ID NO: 44925 - DNA, 116 bp, Homo sapiens
gggctttgtccccacacacccacagcctctctgctgcctgcctgcctgtctgcctgtgatcactgtggagaacagggacctctgggtaagggaggtcagcaggaacagagcttggg

SEQ ID NO: 44926 - DNA, 104 bp, Homo sapiens
cagggtgagtctatcttgggtggcccctcatctcacggcctctctgcctctgttggacaggggtcctgtggctgtctgtggtctccgaggtgctgtacattctg

SEQ ID NO: 44927 - DNA, 131 bp, Homo sapiens
aaattagctgggtttggtggcgcactcccatatttccatctacgtgagaggctgaggtggtaggatggcttgagcccaggaatttgaggctgcagtgaaccgtgattgcaccactgcactccagcctgggt

SEQ ID NO: 44928 - DNA, 62 bp, Homo sapiens
tatatgtatatatgtatatatgtatatatgtatatatgtatatatatatatatatatatatg

SEQ ID NO: 44929 - DNA, 96 bp, Homo sapiens
atatatatatacgtatatatatatgtatatatgtatatatatgtatatatatgtgtatatatatgtatatatatgtgtatatatgtatatatgtat

SEQ ID NO: 44930 - DNA, 86 bp, Homo sapiens
ccacctccaagagacggaggcaaacactgatctattttttttttttttttttttgagacagggtctccctctgtcacccaggctgg

SEQ ID NO: 44931 - DNA, 63 bp, Homo sapiens
ctgattctgccacatagtggctgtgtcaccttgggtaggtcactctgcctctgtgagccttag

SEQ ID NO: 44932 - DNA, 94 bp, Homo sapiens
tcttgccggacaagcagctctctaagcttcccacagacactctcagagtgtcatttctggggtttatttggtagttgtttactgtctgggaaga

SEQ ID NO: 44933 - DNA, 79 bp, Homo sapiens
gggggcattactcagtctctgacagtcagggtcccctctggagtggtggaggggcctatgggtggagcctggggctccc

SEQ ID NO: 44934 - DNA, 81 bp, Homo sapiens
agcgtgcctgtagtcccagctacttgggaggctgagatgagaggattgttggatcccaggagttggaggttacagagagct

SEQ ID NO: 44935 - DNA, 117 bp, Homo sapiens
tttggcctgaagagatggttgtgcccattactgagatagagaagactgaggtgggaagaggtttttgtttgtttatttagtgggaaggaagcgatcttaaattcagacctggccggg

SEQ ID NO: 44936 - DNA, 100 bp, Homo sapiens
gaattatatcaggcactccatccggatatagtatcttttttttttctttttgagagagggtctcactttgtcacccaggctggagtgcagtggtgtgatc

SEQ ID NO: 44937 - DNA, 114 bp, Homo sapiens
aatagattccttcccacgatgtgcagcaggacctggccctccgtggcctgaagtctcgctggaggacagggaggtggggtctcatgatggattggctgggtgagaatagaggtt

SEQ ID NO: 44938 - DNA, 121 bp, Homo sapiens
ccagaacatttctctgcacatccagcctttgtgtgtgtgactatcctgtttgtcatttatctttattttattttttgagatggggtctcactctgtcacccaggctggagtgcactggtgt

SEQ ID NO: 44939 - DNA, 95 bp, Homo sapiens
gccctctagtggccgtttcgccgtagtgcaggacgatctgagggaccgcggcgcgcgctctgtctctgtctctgttctatctggttctcgagggc

SEQ ID NO: 44940 - DNA, 95 bp, Homo sapiens
gggagacagaggttgcagtgagccaaggttgtgccactgcactccagcctgggcgacagagtgaaactctgtctctctctctatatgtgtgtgtg

SEQ ID NO: 44941 - DNA, 87 bp, Homo sapiens
atatagatagatgtattgtatgtgtgtatgtatatatatatgtgtgtgtgtatatatatatattcaatatatgtatatgaattatat

SEQ ID NO: 44942 - DNA, 116 bp, Homo sapiens
tgctgggattacaggcgtgagccaccgtgcctggctgagattcattttttaaatttttttagagatggattctcgctatgttgtccaggctggtctcaaactcctgggctcaagta

SEQ ID NO: 44943 - DNA, 58 bp, Homo sapiens
tgagatagagtctcgctctgtcacccagggtggagtgcagtggtgtgatctcggctca

SEQ ID NO: 44944 - DNA, 58 bp, Homo sapiens; identical to SEQ ID NO: 846

SEQ ID NO: 44945 - DNA, 58 bp, Homo sapiens; identical to SEQ ID NO: 34097

SEQ ID NO: 44946 - DNA, 67 bp, Homo sapiens
cagcccagggaggtatagccggaggaagtccatcctgtctgtctctgtctgtgtgtccagaaagctg

SEQ ID NO: 44947 - DNA, 69 bp, Homo sapiens
gcctggggcgaatccacagtatgggagcttttttttttttaagacagattctcactctgtcacccaggc

SEQ ID NO: 44948 - DNA, 80 bp, Homo sapiens
ttgtatatacacacacacacacacatatatacgtatatatatgtgtgcgtatatgtgtgtgtgtgtatatatatatatag

SEQ ID NO: 44949 - DNA, 165 bp, Homo sapiens
atatatgcatatatatacgtatatatacacatatatacgtatatatatgcatatatgtatatatatacacatatatgtgtgtatatatatacgtgtatatatatacgtatatatatatatacgtatatatatacatatatatatacacacacatatatatataca

SEQ ID NO: 44950 - DNA, 69 bp, Homo sapiens
agagagtgagcctcactctgtcacccaggctggagtgcactggtgggatctcggctcactgcaacctct

SEQ ID NO: 44951 - DNA, 71 bp, Homo sapiens
gcctcactctgtcactcaggctggtgtgcagcggtgcaatcacagcttattgcagccttgacctcccaggc

SEQ ID NO: 44952 - DNA, 58 bp, Homo sapiens; identical to SEQ ID NO: 34097

SEQ ID NO: 44953 - DNA, 58 bp, Homo sapiens; identical to SEQ ID NO: 846

SEQ ID NO: 44954 - DNA, 58 bp, Homo sapiens
tgagactgagtctcactctgtcacccaggctggagtgcagtggtgctatctcagctca

SEQ ID NO: 44955 - DNA, 58 bp, Homo sapiens; identical to SEQ ID NO: 44943

SEQ ID NO: 44956 - DNA, 104 bp, Homo sapiens
ttgagatggagttttgctcttgtcacccaggctggagtgcaatggtacagtctcagctcactgcaacctccgcctcccaggttcaagcaattctcctgcctcag

SEQ ID NO: 44957 - DNA, 116 bp, Homo sapiens; identical to SEQ ID NO: 44942

SEQ ID NO: 44958 - DNA, 87 bp, Homo sapiens; identical to SEQ ID NO: 44941

SEQ ID NO: 44959 - DNA, 95 bp, Homo sapiens; identical to SEQ ID NO: 44940

SEQ ID NO: 44960 - DNA, 58 bp, Homo sapiens; identical to SEQ ID NO: 34097

SEQ ID NO: 44961 - DNA, 58 bp, Homo sapiens; identical to SEQ ID NO: 846

SEQ ID NO: 44962 - DNA, 58 bp, Homo sapiens; identical to SEQ ID NO: 44954

SEQ ID NO: 44963 - DNA, 58 bp, Homo sapiens; identical to SEQ ID NO: 44943

SEQ ID NO: 44964 - DNA, 58 bp, Homo sapiens
tgagatagggtctcgctctgtcgctcaggctggagtgcagtggcgagatcacggctca

SEQ ID NO: 44965 - DNA, 58 bp, Homo sapiens; identical to SEQ ID NO: 293

SEQ ID NO: 44966 - DNA, 73 bp, Homo sapiens
agtgcatcatctcagaactttgtgaggccaaggtaggaagatagcttgagcccaggagtttcaagactagcct

SEQ ID NO: 44967 - DNA, 58 bp, Homo sapiens; identical to SEQ ID NO: 3701

SEQ ID NO: 44968 - DNA, 87 bp, Homo sapiens
gtgccaggcccatcatgggtcagatcgtatctttttttttttgagacagggtattgctctgtcacccaggctggagtgcagtggtac

SEQ ID NO: 44969 - DNA, 78 bp, Homo sapiens
gtctcagactcacaagtagctgggattactggtgtgcaccaccatgcccggctaattttttgtatttttagtggagat

SEQ ID NO: 44970 - DNA, 58 bp, Homo sapiens
tgagacagagtctccctctgtcactcaggctggagtgcaatagagtgatctcggctca

SEQ ID NO: 44971 - DNA, 94 bp, Homo sapiens
cactgtttttattctgagtgtctctgtgcctcgctaaaaaccatgggttctagtaccacagaaggaggaagaatggatgtgaaggaataaggat

SEQ ID NO: 44972 - DNA, 105 bp, Homo sapiens
aaggcaggagagggtgtctggaatggggagaggtgtgttttacttgttcacaactttgggacttgtgggagaggcaaagctagagccaagccctttttcttcctt

SEQ ID NO: 44973 - DNA, 107 bp, Homo sapiens
agtagcctgcctgtagtctcagctgctcaggaggctgaggtgggaggatgattgcttgagcctggaaggtctgctgcactacagcctgggcaacagagcaggaccct

SEQ ID NO: 44974 - DNA, 64 bp, Homo sapiens
cgggcatggtttcacgggcctgtagtcccagctacttgggaggctgaggtaggaggatcgcttg

SEQ ID NO: 44975 - DNA, 58 bp, Homo sapiens
tgagatggagactcactctgtcactcaggctggagtgcagtggtgtgatctcagctca

SEQ ID NO: 44976 - DNA, 103 bp, Homo sapiens
gcacagacattatacttagcatacttgccatacttagcagctggcagaatcaccacactggctctctgactggtaaggtaagtactattatggtgagaaaggc

SEQ ID NO: 44977 - DNA, 91 bp, Homo sapiens
gtaggtagcaggccagagaccccatccctgtctttttctttctttcttttttttttttttttgagatggagtctcgctctgtcacccaggc

SEQ ID NO: 44978 - DNA, 72 bp, Homo sapiens; identical to SEQ ID NO: 44598

SEQ ID NO: 44979 - DNA, 58 bp, Homo sapiens
tgagacagagtctcactctgtcgcccaggctggagtgcagtggctcgatcctgtctca

SEQ ID NO: 44980 - DNA, 82 bp, Homo sapiens
ccagcattgcctgatcccggagaggagacagtgtggacacagacgctcagcacctcctgatccttgagaggagacagcttgg

SEQ ID NO: 44981 - DNA, 86 bp, Homo sapiens
ggtgagggctctcctctgtgtcactgtggctcagagggcagcaagccttgtctgccagccatggtgagggtgggagagcacccatc

SEQ ID NO: 44982 - DNA, 113 bp, Homo sapiens
gatgctggcttgcttggcagagcactgattcttttaagtctgtgaaccaaaaataattttttttttttttgagacagagtctcgctgtgtctacagtggcactagctcggctc

SEQ ID NO: 44983 - DNA, 59 bp, Homo sapiens
gactgtgtgtccgtgtgtcttggcccctggctgtctcactctcacgctgcacacacgtc

SEQ ID NO: 44984 - DNA, 64 bp, Homo sapiens
actgactctcggtcagtaccgtgtagatatcattagtgctgcatcacactgacactcggtcagt

SEQ ID NO: 44985 - DNA, 93 bp, Homo sapiens; identical to SEQ ID NO: 44776

SEQ ID NO: 44986 - DNA, 74 bp, Homo sapiens
ctgtgtctctcaggctctgtggttcttgcgcactcccagtgtgcccaacagggcctgaaatggactctaatcag

SEQ ID NO: 44987 - DNA, 61 bp, Homo sapiens
tgttttgtttttgaggggtggggtggggacaaggtctcactctgtcacccaggctagagca

SEQ ID NO: 44988 - DNA, 67 bp, Homo sapiens
tttagggatcgagacagaagacagtcttgagggacctgccctcttgctggtttttgttattcctggg

SEQ ID NO: 44989 - DNA, 77 bp, Homo sapiens
gggtggggtccaggaatctgttttaacaagccaggtgattttttttttttttgagacagggtctcgctctgtcaccc

SEQ ID NO: 44990 - DNA, 81 bp, Homo sapiens
ttgagaatggtagaatggtggggtttttattttttttatttatttttggagctggagcctcactctgtcacccaggctgga

SEQ ID NO: 44991 - DNA, 81 bp, Homo sapiens; identical to SEQ ID NO: 44990

SEQ ID NO: 44992 - DNA, 133 bp, Homo sapiens
gcagtgaccagagagcagagggggcctgtgtgtgttttgccccagggtcttcaggctgcctggctgcctctatctgcccccctggggtgtccagcacccccctggggtatccagcacctgtaacctgtagccc

SEQ ID NO: 44993 - DNA, 122 bp, Homo sapiens
caaaaactagcccagcgtggtggtggtgcacctgtagtcccagctgctggggaggctgaggtagaaggatcacctgagctggggaaggttgaggctgcagtgagctgagatcacaccactgc

SEQ ID NO: 44994 - DNA, 74 bp, Homo sapiens
agaggcgtctctctgtccctgtccctacccgggtctctccggggggaatctggccgggggcgttctcagtctct

SEQ ID NO: 44995 - DNA, 72 bp, Homo sapiens
gggtgtagatctaatgaagaaagtggtgatccatcattaggattgcttttttttttttttgagacaggactc

SEQ ID NO: 44996 - DNA, 62 bp, Homo sapiens
ggatggggtgagactggacacaggggccacacaaaaggcctcctccaggctcagatgttcca

SEQ ID NO: 44997 - DNA, 64 bp, Homo sapiens
ggtgtggtcaggagtttggcttttttttttttttggagatggagtctcactctgtcaccaggct

SEQ ID NO: 44998 - DNA, 104 bp, Homo sapiens
tgtactccctcaggtactggagactgctctttttaattttttatttactattatgtatatttttttgagatggagttttgctcttgtcgcccagttggagtgca

SEQ ID NO: 44999 - DNA, 85 bp, Homo sapiens
ggtaagctgtcagacaggcactctgagtaaggggaagctcagagttgggcacatcaaacccagcagacccagagcttgggggcct

SEQ ID NO: 45000 - DNA, 76 bp, Homo sapiens
gctttagggaggctttaagggttttgtttgttttgtttttttttatagagacagggtctccctctgtcacccaggc

SEQ ID NO: 45001 - DNA, 58 bp, Homo sapiens
tgagactgagtctcgctctgtcacccaggttggagtgcagtggcgtgatctcagctca

SEQ ID NO: 45002 - DNA, 59 bp, Homo sapiens
tagacggagtctcgctctgtcactgggctagagtacagtggcatgatcttggcttactg

SEQ ID NO: 45003 - DNA, 58 bp, Homo sapiens
tgagacaaagtctcactctctcacccaggctggagtggagtggtgtgatctcagctca

SEQ ID NO: 45004 - DNA, 84 bp, Homo sapiens
gggcgacagagcaagatcttatctcaaaattaatgtattattatcattattaattttttgagacagagtcttgctctgtcaccc

SEQ ID NO: 45005 - DNA, 76 bp, Homo sapiens
cccgagtgctcctggtctgtctgtctgtgccacagggggccccgacgtgaagagaggcagcaatggccagctgggg

SEQ ID NO: 45006 - DNA, 79 bp, Homo sapiens
gggtcggtatggagacaggtgtgtgcgagaggccagcaggtgggcactggctctgtgtgtctctctctcttgccagccc

SEQ ID NO: 45007 - DNA, 74 bp, Homo sapiens
tgagagtaggagaggcagaaggagtgaggaggagtagcacccctctgcagttattttctttttcttttttttta

SEQ ID NO: 45008 - DNA, 91 bp, Homo sapiens
cagcctcctaagtagctagaattacaggcatgagccaccatgccctgcctgttgtgtcatctgtctgtctgtctgtctgtctgtctgtctg

SEQ ID NO: 45009 - DNA, 58 bp, Homo sapiens
tgagacagagtctcccactgtcacccaggctggaatgcagtggtgcgatctcggctca

SEQ ID NO: 45010 - DNA, 94 bp, Homo sapiens
ggtgatccactcctctcagtctcagtctcccaaagtgctgggattccaggcatgagccaccacacccagccccctgggcacttctgttgtcacc

SEQ ID NO: 45011 - DNA, 81 bp, Homo sapiens
tgagacaagagtctcactctgtcaccctggctggagtgcagtggtgtgatctcaactcactgcaacctctgcctcctgggt

SEQ ID NO: 45012 - DNA, 58 bp, Homo sapiens; identical to SEQ ID NO: 3701

SEQ ID NO: 45013 - DNA, 159 bp, Homo sapiens
tgggtcaggggagaggcagttcccagagaaggaaatcttgacttgagttttatttatttattttaatttttatatttttgagatggagtctcactctgtcacccaggctggagtacagtggtgcgatctcggctcgccgagccaccacacctcgccagg

SEQ ID NO: 45014 - DNA, 73 bp, Homo sapiens
tgacatgggcctgaaatctcttttttaaaattaatttatttatttatttttgagacagagtcttgctctgtca

SEQ ID NO: 45015 - DNA, 65 bp, Homo sapiens
tgggggccgtgcaagaccctggcagagttcccgccggtctctgtctcagtctgtctctgccctta

SEQ ID NO: 45016 - DNA, 94 bp, Homo sapiens
gcaagtcagagagtaggaattataaatcagtacgtttttctatgttggggtagtagaggtactttttttttttttttaattttctagttcttgc

SEQ ID NO: 45017 - DNA, 81 bp, Homo sapiens; identical to SEQ ID NO: 44990

SEQ ID NO: 45018 - DNA, 72 bp, Homo sapiens
ttgttttttgagatgcagtctcgctctgtcacccaggctggagtgcagtggcatgatcttggctcatagcaa

SEQ ID NO: 45019 - DNA, 74 bp, Homo sapiens
agcctgggcaacatagtgagacccctgtctcccttttttttttttttagacagtctcgctctgtctcccaggct

SEQ ID NO: 45020 - DNA, 72 bp, Homo sapiens
ctgtccctcggtctctctctgcctttgcgtcctctgtgactcagggctctgatgtgagtctctggctcaggg

SEQ ID NO: 45021 - DNA, 114 bp, Homo sapiens
gcctgggcgacagagtgagtgagaccctgtcttgagaaaaaaagaaaaaagaaaaagaaagaaatcaagaaaagaaagtggccaggcgcggtggctcacgcctgtaatcccagc

SEQ ID NO: 45022 - DNA, 58 bp, Homo sapiens; identical to SEQ ID NO: 10174

SEQ ID NO: 45023 - DNA, 56 bp, Homo sapiens; identical to SEQ ID NO: 10175

SEQ ID NO: 45024 - DNA, 81 bp, Homo sapiens
ttactgcaaggactggcagagcccattgccccaggttacatctgagtgtgtgtctgtctgtgttctgcccctagtcagtgg

SEQ ID NO: 45025 - DNA, 75 bp, Homo sapiens
caagccagtcaggtgagtgtgaggtgaggttccagacagcgggaactgcaagcacaaaggatcttgatttgtttg

SEQ ID NO: 45026 - DNA, 102 bp, Homo sapiens
gtaatcccagcactttggaagctgaggcaggaagattctttttttttttttgaaacggaatttcactctgccgcccaggctggagtgcagtggcatgatctc

SEQ ID NO: 45027 - DNA, 81 bp, Homo sapiens
cctgcttaggcaatatagtagaaactcttttttttttttttttttttttgagacggagtctcactctgtcgcccaggctgg

SEQ ID NO: 45028 - DNA, 109 bp, Homo sapiens
ttagcctcctggatagtggggactataggcacacaccatcacacctggctaatttttttttttttttttttttttttgagatggagtctctctctgtcaccgaggctgg

SEQ ID NO: 45029 - DNA, 80 bp, Homo sapiens
gagattctgattcaatagatgaggaactgggcccagggagtagctagttttttttttttttttttttgagacagagtctc

SEQ ID NO: 45030 - DNA, 64 bp, Homo sapiens
tctctaaaatgaagagaagctggactgtcgccagccatcttttcttcttcttttttttttgaga

SEQ ID NO: 45031 - DNA, 110 bp, Homo sapiens
gcctagcctacatgcagagtcttttaaaaagaaaaactatagaaacggaatctttttttttttttttttttttttgagatggagtcttgctctgtcacccaggctagagt

SEQ ID NO: 45032 - DNA, 113 bp, Homo sapiens
tgagccactgcgcttggctgggacttacgtttctaacactgcataattttaattcttttttttttttttttttttttttttgagatggagtctcactctgtcatgcaggctgg

SEQ ID NO: 45033 - DNA, 202 bp, Homo sapiens
gggtgactgggttggtgggcgggcaggagcgcacctgggtccgtcctctcagggctcgctcgctcgctcgctcgctcaggcacgcgtgcgcagaagggcgggaagggagaggagacacgccggggcccagcgccggccggcctgaccccctcagtctgtctctatgggcgcgcgccgacagcctcgcgcaccggccccgggg

SEQ ID NO: 45034 - DNA, 92 bp, Homo sapiens
ggctgcctgggttgaggaatgtatcagaatgctcagaaggttgggagcttgctgaccatactctctctgattctctctgtctctttgcagcc

SEQ ID NO: 45035 - DNA, 92 bp, Homo sapiens
aggttttcttctgccatctgtgacagcttcttgatctgtccccaggtgggtggctgtgttcgacaggtgttgctcgtgacagttggggtcct

SEQ ID NO: 45036 - DNA, 83 bp, Homo sapiens
ctgggattacaggtgtgagccacctcgccaaaccatcttttttttttttttttttgagatgagagtctcgctctgtcacccag

SEQ ID NO: 45037 - DNA, 71 bp, Homo sapiens
gggtgagcctctcagtccctccgtcttctccctcagagttggagagaggagctgggaagggcagggcaccc

SEQ ID NO: 45038 - DNA, 109 bp, Homo sapiens
tcatggctgtcttacttctggaagtgattttggagggagcataattttattttattttttttgagatggagtctcactctgttgctcaggctggagtgcagtggcatga

SEQ ID NO: 45039 - DNA, 114 bp, Homo sapiens
gccacctagagtcctactgccagtaccttgaattggtgttttattttatttttattcatttattttttaaagatacaagatctcattctgtcacctgggctggactgcagtggc

SEQ ID NO: 45040 - DNA, 57 bp, Homo sapiens
tgatctgagtctcgctctgtcacccaggctggagtgcagtggcgcgatctcggctca

SEQ ID NO: 45041 - DNA, 69 bp, Homo sapiens
gtggggacagaaggaagtgagcacacggcacacccgctgttggattggttgctatttctcccgtcccac

SEQ ID NO: 45042 - DNA, 119 bp, Homo sapiens
ggagtaggcaggggagaggcagtgttggactactgtaccctagagagatagcagaattggaatttttttttttttttttttttgagacagagtctcactctgtcccccagctggagtgc

SEQ ID NO: 45043 - DNA, 80 bp, Homo sapiens
atcttgaggaaggtgctgagtctcgtggccttcttggtctcggtggtgatgacagcggcctttttttttttttttgagat

SEQ ID NO: 45044 - DNA, 57 bp, Homo sapiens
actgagagagagtctcactctgtcgcccaggctggagtgcagtggcgcaatctcagt

SEQ ID NO: 45045 - DNA, 90 bp, Homo sapiens
tcacttgtttgctcgctcactcactcactggctaacgtgcagtaagcacgtcctgcatggctggtcctgtgctgggctgagccacaggga

SEQ ID NO: 45046 - DNA, 75 bp, Homo sapiens
cctgggcaacacagtgagacaccatctctaaaattttttttttttttgagacagagtctcactctgtcactcagg

SEQ ID NO: 45047 - DNA, 76 bp, Homo sapiens
gcgagtggcccggagtcagtagagtgtgacctgaatgaagaggggctcaggggctgtgctcaggtggcgactaagc

SEQ ID NO: 45048 - DNA, 75 bp, Homo sapiens
ggggaagcagggtgatgggatagaaggggtttgggaggtggcccttccctgataccagtctgtctctgggtccct

SEQ ID NO: 45049 - DNA, 58 bp, Homo sapiens
tgagacagggtctcactcagtcacccaggctggagtgcagtggtgtgatcactgctca

SEQ ID NO: 45050 - DNA, 105 bp, Homo sapiens
agccaaggtagggcagggacaagtcacagtggtagaatgttgtaatgttggttaatcacttaaggcaggaaccggctgttatacttctttgtggtttttttggct

SEQ ID NO: 45051 - DNA, 113 bp, Homo sapiens
gggtgaccttagtgcttcctcatcttgttttttttgagacagagtctcgctctgtcacccaggctggagtgcagtggcacgacctcagctcactgcaacctctgccttctggg

SEQ ID NO: 45052 - DNA, 73 bp, Homo sapiens
ataatatataaacacatataaaatatatatgtttagatataaaacatatgtttttcatatgtgtgtatattat

SEQ ID NO: 45053 - DNA, 95 bp, Homo sapiens; identical to SEQ ID NO: 68

SEQ ID NO: 45054 - DNA, 93 bp, Homo sapiens; identical to SEQ ID NO: 69

SEQ ID NO: 45055 - DNA, 105 bp, Homo sapiens
atatatataaatatatatacatacacatatatatgtgtgagtgtatatatacacatatatatgtgtgtgtgtgtatatatacacatatatatatatatatatata

SEQ ID NO: 45056 - DNA, 89 bp, Homo sapiens
actgaggcttatggaacctagattacttaccttgaaaaaaatttttttttttttgagatgaagtctcactctgtctcccaggctgtagt

SEQ ID NO: 45057 - DNA, 88 bp, Homo sapiens
ctgtgcatgtttctacctctatgtgaaaccacttctaaagttctggttttgcctcatgtcagaagtgtgtgaggagagtgatggacag

SEQ ID NO: 45058 - DNA, 66 bp, Homo sapiens
tgacctcacactcacacagtgtgaccttgcacatccccaaggtcacctcacatgtgccctgagtca

SEQ ID NO: 45059 - DNA, 65 bp, Homo sapiens
ccctcctctgcctgacagtccgtgtctctgaaagaggctggggctgggagggagcacagagaggg

SEQ ID NO: 45060 - DNA, 76 bp, Homo sapiens
ggagttgatcagaagcagcagttgaaagcaccaactaaaccagctggggtgagttcactgtcattctctcagaacc

SEQ ID NO: 45061 - DNA, 81 bp, Homo sapiens
gggcgacagagtgaaatcctgtcttgggggtggggggaatctttctgtctgtctgtctgtcagtttgtctctctctctctc

SEQ ID NO: 45062 - DNA, 112 bp, Homo sapiens
tgtcctggtcagagctgtagctggagaagggtttccttttatttttggtactagattgtatcattaattattcaccattcattccttaaatatattctttgttccagaaaca

SEQ ID NO: 45063 - DNA, 110 bp, Homo sapiens
tcttgttaatctacaaagtatatttataggttaggaaatatactttttaaaatgtcagataatgatatttttattttctattttatattattattatttttgatacaagg

SEQ ID NO: 45064 - DNA, 95 bp, Homo sapiens
gctctcctggagatgaagagaagtgttttactttgccatttttttttttttttttttttgagatggagtttcgctcttgttgcccaggctggagt

SEQ ID NO: 45065 - DNA, 84 bp, Homo sapiens
tccatcactggggctcagatttctctgtctttatttatttatttatttttttgagacagagtttcgctcttgtttgaatttgga

SEQ ID NO: 45066 - DNA, 62 bp, Homo sapiens
ggcccttggttctgcagattgtacacaatgcatagtgtcagcatctgcttgtggtgagggcc

SEQ ID NO: 45067 - DNA, 119 bp, Homo sapiens
atgtggtgtatatatatatgtgtatatacacacacacatatatgtgtatatatgtatatatgtgtatatacacatatatatgtgtgtatatgtgtgtatgtgtgtatatatatactcac

SEQ ID NO: 45068 - DNA, 56 bp, Homo sapiens
acagtctccctctgtcacccaggctggagtgccatggtgtgatcttggctcactgt

SEQ ID NO: 45069 - DNA, 71 bp, Homo sapiens
gagcaaaggtaggagaaaggtcatggcaggccccccaggctctgtgcgtgactcattgactgagttgactc

SEQ ID NO: 45070 - DNA, 75 bp, Homo sapiens
gaagagatttcagtctcagtctgggtttaattttttttttaaacagaagatacataagaactttgatgtctcttc

SEQ ID NO: 45071 - DNA, 58 bp, Homo sapiens; identical to SEQ ID NO: 2442

SEQ ID NO: 45072 - DNA, 94 bp, Homo sapiens
tagatagatgaatagagagcgatgatagatgatttaaaaattttttttagagatgagatctcactatcttgcccagtctggacttgatctgcta

SEQ ID NO: 45073 - DNA, 99 bp, Homo sapiens
tcataggaatcctcatgggggcaggcccaagtgctcacagtggctctcactgaaaccagggcaggtgtttttgtctgtgttcattgggtccagcctaga

SEQ ID NO: 45074 - DNA, 79 bp, Homo sapiens
gtggacacggggctggcgtgtgtggatagatgtgtggaaaggtgtgtccacagcacagactcagctgctgccagtccat

SEQ ID NO: 45075 - DNA, 110 bp, Homo sapiens; identical to SEQ ID NO: 45063

SEQ ID NO: 45076 - DNA, 112 bp, Homo sapiens; identical to SEQ ID NO: 45062

SEQ ID NO: 45077 - DNA, 81 bp, Homo sapiens; identical to SEQ ID NO: 45061

SEQ ID NO: 45078 - DNA, 79 bp, Homo sapiens
ggtaaattcatatatatatatacacacgtgaatcagtctgtatgcatgtatgtgtgtgtaaatgtaactggatgcatcc

SEQ ID NO: 45079 - DNA, 92 bp, Homo sapiens
tagctaggacaacaggtgcacatcaccatgcccacttttttttttttattatactttaagttttagggtacatgtgcacattgtgcaggtta

SEQ ID NO: 45080 - DNA, 66 bp, Homo sapiens; identical to SEQ ID NO: 45058

SEQ ID NO: 45081 - DNA, 65 bp, Homo sapiens; identical to SEQ ID NO: 45059

SEQ ID NO: 45082 - DNA, 101 bp, Homo sapiens
ggttctgcagtggggaaaatgaggggagtgataggattttttgtgttttttgtttgtttttttgagacgaagtctcactctgccactcagtctgcagtgcc

SEQ ID NO: 45083 - DNA, 116 bp, Homo sapiens
tagtatctttgtattagtgtgaatgtgtgcttgtatctattatgtacatatatatatatatttttgttatgtgttatggctacaaggtacaaaattgactttaaaataaataacta

SEQ ID NO: 45084 - DNA, 76 bp, Homo sapiens; identical to SEQ ID NO: 45060

SEQ ID NO: 45085 - DNA, 79 bp, Homo sapiens; identical to SEQ ID NO: 45078

SEQ ID NO: 45086 - DNA, 81 bp, Homo sapiens; identical to SEQ ID NO: 45061

SEQ ID NO: 45087 - DNA, 112 bp, Homo sapiens; identical to SEQ ID NO: 45062

SEQ ID NO: 45088 - DNA, 110 bp, Homo sapiens; identical to SEQ ID NO: 45063

SEQ ID NO: 45089 - DNA, 62 bp, Homo sapiens; identical to SEQ ID NO: 45066

SEQ ID NO: 45090 - DNA, 137 bp, Homo sapiens
gggtcagggcttcgggacttgtttctcctaaatctttttttttttttttttttttttttttgagacagtctcgctctgtcacccaggctggagtgctgtggcgcgatctcggctcactgcaagctccacctcccggg

SEQ ID NO: 45091 - DNA, 83 bp, Homo sapiens
ccctgctgcatgagagacatgagacagaggacagaaacatatttactttgttgaatctgtttaattgttttaatgtattgggg

SEQ ID NO: 45092 - DNA, 76 bp, Homo sapiens
gggcaacagaatgaggccttctctctctctctctcttttttttttttttttgagacacagtctcactgtgttgccc

SEQ ID NO: 45093 - DNA, 68 bp, Homo sapiens
gcttcacagtgtgattttgttttattttatgtatttatttatttagagagggagtctcgctctgaagc

SEQ ID NO: 45094 - DNA, 102 bp, Homo sapiens
ctgggcaacagagtgtgatcttgtctcaaaaataaataaaataaatacatttttaaaaagtatatattttttaagagacaggggtctcagtatgttgcccag

SEQ ID NO: 45095 - DNA, 104 bp, Homo sapiens
tggtgtggtggtgcatacctgtagttccagctgcttgggaggctgaggtaggaggatcacttgagttcgggaggttgaggctgcagtgagccatgatagcacca

SEQ ID NO: 45096 - DNA, 80 bp, Homo sapiens
gcttgcaatcttaaaaagtaagttggagtccaggtgcagtggttcatgcctgtaatcccagcactttgggaggctgaggc

SEQ ID NO: 45097 - DNA, 111 bp, Homo sapiens; identical to SEQ ID NO: 9033

SEQ ID NO: 45098 - DNA, 59 bp, Homo sapiens
gggctcagaggttattgacctgtgacagacctgtctcactgtctctgtctctgttgccc

SEQ ID NO: 45099 - DNA, 103 bp, Homo sapiens
gcagagagttgggacttaaaaaaatctatgtgaacagtatatttttaattgaggagttttatttatttacatataaggttattttgaatctctgtttctatgc

SEQ ID NO: 45100 - DNA, 116 bp, Homo sapiens; identical to SEQ ID NO: 45083

SEQ ID NO: 45101 - DNA, 105 bp, Homo sapiens
ggttctgcagtggagaaaatgaggggagtgataggattttttgtgttttttgtttgtttgtttttttgagacgaagtctcactctgccactcagtctgcagtgcc

SEQ ID NO: 45102 - DNA, 66 bp, Homo sapiens; identical to SEQ ID NO: 45058

SEQ ID NO: 45103 - DNA, 95 bp, Homo sapiens; identical to SEQ ID NO: 68

SEQ ID NO: 45104 - DNA, 93 bp, Homo sapiens; identical to SEQ ID NO: 69

SEQ ID NO: 45105 - DNA, 109 bp, Homo sapiens
ccttcctggggtttctgacactctcaggatgtgggtttttgcactgtgtctctcacacagtaatacatgaccatgtcttcagatctcaggttgctcagctccatgtagg

SEQ ID NO: 45106 - DNA, 82 bp, Homo sapiens
ggactacagatgcgcacaaccacctctggataatattttatttttcatagagacgtggtctcattatgttgtccaggttggt

SEQ ID NO: 45107 - DNA, 107 bp, Homo sapiens
gtctgacaacagcagaaaggtgagtatgacgttgcaactctttatttatttatttattttaagaaggagtctcactcactctttcgcccaggctggagtgcagtggc

SEQ ID NO: 45108 - DNA, 60 bp, Homo sapiens
gagacagagtctcactcactctacagccggggcggtagtgcagtggcgtgatctcggctc

SEQ ID NO: 45109 - DNA, 75 bp, Homo sapiens
agactctttctgtgtctctgcctgggacgtctgaccagttgttggtctttttcccggcggttccagtttgggttt

SEQ ID NO: 45110 - DNA, 118 bp, Homo sapiens
gcagtttagaagtgttccctgttcaccacgtccacaccaacatctactgctttttaattttttgattatggccattgttgcaggagcaaagtggtatcgcactgtggttttgatttgc

SEQ ID NO: 45111 - DNA, 95 bp, Homo sapiens; identical to SEQ ID NO: 68

SEQ ID NO: 45112 - DNA, 93 bp, Homo sapiens; identical to SEQ ID NO: 69

SEQ ID NO: 45113 - DNA, 84 bp, Homo sapiens
ttctgctgagttccagggagcaagcgattttacttcccttattaagtagcacgaagtccttcactctctgtctctaaaccagaa

SEQ ID NO: 45114 - DNA, 70 bp, Homo sapiens
gaagctgatgtggaactgagacactgtccattgtgctgccgcccagccagagcctcagttcagctgcttt

SEQ ID NO: 45115 - DNA, 102 bp, Homo sapiens
tgcctgatctgcaccacctgggaagcagaaaatccctgggaactttttttttttttaagtcagagtctcactctgttgcctgggctggagtgcagtggtgca

SEQ ID NO: 45116 - DNA, 138 bp, Homo sapiens
catgctgtgcccttttgttgtctatgtgacaggtgagtgcttttttttattttcagacatggtctcactctgtcactcaggctggagtgcagtggcacagtcatggctcactgcagccttgacctcctgggctcaagt

SEQ ID NO: 45117 - DNA, 100 bp, Homo sapiens
gtgtgtgggtgagtgtgtgtgtgtattattcaagatgaaaacaacataatgacaattatttctatttttatttttttgagacagaatctcactctatcac

SEQ ID NO: 45118 - DNA, 72 bp, Homo sapiens
tcattgtctatgtgacaggtgagtgcttttttttcttttgagacatggtctcactctgtcactcaggctgga

SEQ ID NO: 45119 - DNA, 107 bp, Homo sapiens
ttgcttaggattgtcttggctctttttagttccatatgaaatttaaagtagtttcttttatttctttgaagaaagtcagtggtgtcctctcttatttccttgagcag

SEQ ID NO: 45120 - DNA, 107 bp, Homo sapiens
cctatgaatgtaaaaaatgtggtaaagccttcggatatagtagttccctatgaaaacatgacagaactcatactggagagaaaccctatgagtgtaaggattatagg

SEQ ID NO: 45121 - DNA, 86 bp, Homo sapiens
gacatgtagcaatcccatctgtatgcatgctaggctcacacatgagagtcagatcactcagatgttaggcaaaggtatgtgtcaca

SEQ ID NO: 45122 - DNA, 73 bp, Homo sapiens
accagtacagcatcacaagtgggattgttgttctcatgaatggattcagaccactgttgagactgttactggt

SEQ ID NO: 45123 - DNA, 58 bp, Homo sapiens
tgagacagagtctcactctatcacccaggctggggtgaggtgacttgatctctgctca

SEQ ID NO: 45124 - DNA, 95 bp, Homo sapiens; identical to SEQ ID NO: 68

SEQ ID NO: 45125 - DNA, 93 bp, Homo sapiens; identical to SEQ ID NO: 69

SEQ ID NO: 45126 - DNA, 115 bp, Homo sapiens
gctgtcttatctatgttttactattagctcttttctggctgcctgtagttagaagagaagtgattttcttgaaatgcatgaagctggaaaggcagctgaaacttaaagtgacagt

SEQ ID NO: 45127 - DNA, 132 bp, Homo sapiens
ttgggaaggaattgacgagactcctgagctcagagggcacttttttttttgagtcagagtctcgctctgtcacccaggctggagtgcaatagcgtgatctgggctcactgcaacctctgcctctcgggcaca

SEQ ID NO: 45128 - DNA, 70 bp, Homo sapiens
tgctggtcacggagtagttgcatatttaattttattagaaactgcctaactgctctccgtagtggctgta

SEQ ID NO: 45129 - DNA, 95 bp, Homo sapiens; identical to SEQ ID NO: 68

SEQ ID NO: 45130 - DNA, 93 bp, Homo sapiens; identical to SEQ ID NO: 69

SEQ ID NO: 45131 - DNA, 81 bp, Homo sapiens
gtataggaataaattttgatatacatgtatgcacatttaaggaattacgtatatatgtatataaatgttttatttatatac

SEQ ID NO: 45132 - DNA, 95 bp, Homo sapiens; identical to SEQ ID NO: 68

SEQ ID NO: 45133 - DNA, 93 bp, Homo sapiens; identical to SEQ ID NO: 69

SEQ ID NO: 45134 - DNA, 95 bp, Homo sapiens; identical to SEQ ID NO: 68

SEQ ID NO: 45135 - DNA, 93 bp, Homo sapiens; identical to SEQ ID NO: 69

SEQ ID NO: 45136 - DNA, 82 bp, Homo sapiens
ttgttgttgttttgagacatggtctcactctgtcgctcaggctggagcgcagtgatgtcatcatggctcattgcagcctcaa

SEQ ID NO: 45137 - DNA, 74 bp, Homo sapiens
tgagacggagtctcactctgtcacccagactggagtgcagtggcgctggagtgcagtggtgcgatctcggctca

SEQ ID NO: 45138 - DNA, 100 bp, Homo sapiens
ggcagggaaagctgggcctgttggtcaggcatggaggagctgtgtggtcactggccactggctctcttctgcaccaccgccggctctgacagtgcctgct

SEQ ID NO: 45139 - DNA, 74 bp, Homo sapiens
ggagctgacagagcagaggtctgagggtgagcttgtctttggagtttattctcacggatctttggtgcttctcc

SEQ ID NO: 45140 - DNA, 88 bp, Homo sapiens
aacctgtatgtgtgtgtttttatttcttttggaaggagtcctaaatctaggatttctaggctaaagggtatgtgtgttttgtttggtt

SEQ ID NO: 45141 - DNA, 75 bp, Homo sapiens
gggacaggagaatttcctttgccagtttccaacggagtaaggttttggtatttctgagggtctcactctgtcacc

SEQ ID NO: 45142 - DNA, 111 bp, Homo sapiens
ctgctgcaaacatccttgtgtgtctgtctctaggccttagtgttctccattacattttttttttttttgagatggagacttgctctggttgcccaggctggagtgcagtgg

SEQ ID NO: 45143 - DNA, 115 bp, Homo sapiens
ttgggacagtagttctaatggaatacagtctgtttttcctcccacattactgtaaaagttttttctttagtatattgtgatggctaaatttcttgtgttttagggcacatttcag

SEQ ID NO: 45144 - DNA, 70 bp, Homo sapiens
cactgtgggaggcagaggttggaggatcacttgaggccaggagtttgagaccagcctgggaaacatagtg

SEQ ID NO: 45145 - DNA, 58 bp, Homo sapiens; identical to SEQ ID NO: 1435

SEQ ID NO: 45146 - DNA, 112 bp, Homo sapiens
gatgaaggttatggttactttgtccagaaaaaatgcacataaaaacaacttttgattttttgttgttgttgtttcgttgcttggtttttttgagacagagtctggctctctc

SEQ ID NO: 45147 - DNA, 74 bp, Homo sapiens
cgcatatgcatgtatttattatatacatatatgtataaggtacatatttgtatgtgtatatccgtgcatatgtg

SEQ ID NO: 45148 - DNA, 76 bp, Homo sapiens
gtgctgggattacggacttgagccactgcccctggtcagtatatattcttttgtggctgcctctgtcactcagtgt

SEQ ID NO: 45149 - DNA, 68 bp, Homo sapiens
gtttttttgcgacagagtctcactctgtcacccaggctggtgtgcagcagtgtgagctcaagcaatgc

SEQ ID NO: 45150 - DNA, 82 bp, Homo sapiens
cctgtctcagcctctgagtaactgggattacaggtgcgcaccaccatgcccggctaatttttgtatttttagtagagacagg

SEQ ID NO: 45151 - DNA, 58 bp, Homo sapiens
tgagatggagactcactctgtcactcaggctggagtccagtggcgtgatcttggctca

SEQ ID NO: 45152 - DNA, 109 bp, Homo sapiens
ccaggtctcacctgggctcttccaggagctcactgtgtgtttataaaggaagagtattcaattttttttttttttgagatggagtttcgttcttgttgcccaggctgga

SEQ ID NO: 45153 - DNA, 58 bp, Homo sapiens; identical to SEQ ID NO: 1190

SEQ ID NO: 45154 - DNA, 56 bp, Homo sapiens; identical to SEQ ID NO: 1191

SEQ ID NO: 45155 - DNA, 144 bp, Homo sapiens
tatatatagtctatgtataggcctatatatatgtctatatatatagtctatatatataggtctatatatatgtctatatatagtctatataggtctatatatatgtctatatatgtctatatatatctatatatgtctatatat

SEQ ID NO: 45156 - DNA, 145 bp, Homo sapiens
ggtctatatataggtatatatatgtctatatgcatataggtctatatatatgtctatatatataggtctatatatgtctatatatataggtcttatatatgtctatatataggtcttatatatgtctatatataggtcttatata

SEQ ID NO: 45157 - DNA, 106 bp, Homo sapiens
tgtgtgtgtgtatgtgtgtctatatatatgtctatatatatataggtctatatatataggtctatatatatataggtctatattggtctatatatataggtctata

SEQ ID NO: 45158 - DNA, 58 bp, Homo sapiens; identical to SEQ ID NO: 37427

SEQ ID NO: 45159 - DNA, 67 bp, Homo sapiens
ggcaacacagtgagactctgtctctaaaaataaataaataaaaagatagggtagcttaggggttgcc

SEQ ID NO: 45160 - DNA, 82 bp, Homo sapiens
gagcagtgtcagcacacagtcagcactccataaatactgacgtacacccccggtgctcaccccatgtgcaacgaggctgagc

SEQ ID NO: 45161 - DNA, 72 bp, Homo sapiens
tggacccaggagagccccagcctggccacctcccttggtgggtcagtcactagctctgtgcctcagtttcca

SEQ ID NO: 45162 - DNA, 58 bp, Homo sapiens
tgagacggagtctcgctctgtctcccaggctggagcgcagtggcgcgatctctgctta

SEQ ID NO: 45163 - DNA, 98 bp, Homo sapiens
ctcaaagtctgtgaccctcagtgtaaaccatttatttatttatttaattttttttttttagagacagggttttactgtgtctggagtgcagtggtgag

SEQ ID NO: 45164 - DNA, 95 bp, Homo sapiens; identical to SEQ ID NO: 68

SEQ ID NO: 45165 - DNA, 93 bp, Homo sapiens; identical to SEQ ID NO: 69

SEQ ID NO: 45166 - DNA, 68 bp, Homo sapiens
gttgagcctatgtgtgtctctgtatgtgagatgggtttcctgaatacagcacactgatgggtctggac

SEQ ID NO: 45167 - DNA, 112 bp, Homo sapiens
gggtggggacacagagccaaactatatcagtgggtatcattttgaatattaaaaaaattaaagttctgtggtaattgaatgtagtcatttaagatgttctctgtccttgctt

SEQ ID NO: 45168 - DNA, 111 bp, Homo sapiens
gtaagtgacaatggatgcaattgtaggtcatatagtagttgcatgtttaggttttttttttttaaagaaaccgctaaaatgttttcagagtagttgtaccatcctactagc

SEQ ID NO: 45169 - DNA, 83 bp, Homo sapiens
tgccttccctagaatgtcatgtaattgcaatcatacagtattcacactctatgattctatttatatgaaacctagaaaagaca

SEQ ID NO: 45170 - DNA, 117 bp, Homo sapiens
actcttgtcctcatggagctcacggtcgttttttttttttttttttttttttttttttttttttttttttttttttttaaagagatgagcgtctcactctgtcacccaggctggagt

SEQ ID NO: 45171 - DNA, 91 bp, Homo sapiens
gtgctattcccatttttttcctcaggtgagcagctttagttttttattttttttgagagagtcttcctctgtcacccaggctggagtgcac

SEQ ID NO: 45172 - DNA, 157 bp, Homo sapiens
atatatatatatgtatatgtatatatatatagcccacatatatatgtatgtgtatatatatatatagcccgcatatatgtatgtatgtgtatatatatgtgtgtatatatatatgtgtgtgtgtatgtgtatatatatgtgtgtgtgtgtgtgtgtg

SEQ ID NO: 45173 - DNA, 71 bp, Homo sapiens
gggattgcaaaagttgtgatgttcttgtccaaacatggagaaacatgagctggggacttgtgtgcgattgt

SEQ ID NO: 45174 - DNA, 76 bp, Homo sapiens
tctagcctcatggtgctgctcactgcccaagctgctctcctggcatgggtgtgagtcagcacacactgaggtgaga

SEQ ID NO: 45175 - DNA, 79 bp, Homo sapiens
cacagggctaggcagaggctagattgtatagggctttgtaaaccagagtaagaagtttggattttgtttgtaaactgtg

SEQ ID NO: 45176 - DNA, 115 bp, Homo sapiens
ctatttgataattctttttacaggatctagggtggtgatggtggtggtggtgtgttttttgttttttgttttccagggcagaggttgtggggaaggaactttttattttaaatag

SEQ ID NO: 45177 - DNA, 58 bp, Homo sapiens
tgagacagagtctcactctgtcatccaggctggagtggactggtgcaatctctgctca

SEQ ID NO: 45178 - DNA, 78 bp, Homo sapiens
ggccttgcccaggcatctaaagctcgattccagagagctcactgggagagttgagctgttccctctgaaggtatagcc

SEQ ID NO: 45179 - DNA, 58 bp, Homo sapiens; identical to SEQ ID NO: 6617

SEQ ID NO: 45180 - DNA, 56 bp, Homo sapiens; identical to SEQ ID NO: 6618

SEQ ID NO: 45181 - DNA, 141 bp, Homo sapiens
tccaggtgttcgaggttgcagtgagttatgactgtgccactgcatgccagcctgggtgatggagctaagactgccttttttttttttttttttttgagacagagtctcgctctgtcgcccaggctggagtgcagtggcaca

SEQ ID NO: 45182 - DNA, 141 bp, Homo sapiens
gccactggaggatcaggagcaggagagacagggttgcatttactttttgtttctaagatggagtctcactctgtggctcaggctggagtgcagtggcgcgatctcaactcactgtaacctccacctcctgggctcaagtga

SEQ ID NO: 45183 - DNA, 76 bp, Homo sapiens
gtgtgcatgtgtgcgtgtgtgtgcgcgtgtgtgtatgcacgtgtgcgcgtgtgcgggtgcatgcgtgcctgtgcat

SEQ ID NO: 45184 - DNA, 61 bp, Homo sapiens
ggaggaggagctgagagaggtgagtgagcagaggttcctctgccttccctgctcccctacc

SEQ ID NO: 45185 - DNA, 115 bp, Homo sapiens
ctcatgaattaactcaagtggtaaagaatactatatgggatgtatattttctctctcagtttcacactgggtcacatccaatataacactttttactatgatctgatgtcaaagg

SEQ ID NO: 45186 - DNA, 87 bp, Homo sapiens
gggctgtatagccaaggcaggtgacactttttttttttttttttttttttgagatggagtctcactctgtcccccaggctgcagtgc

SEQ ID NO: 45187 - DNA, 117 bp, Homo sapiens
tcatgcttgtatatgatatatatcatatgtatatacatatatacacatacatatatatgtatatgtgtatttgtatatatgatatatatatcatatatatatagagagagagcatgg

SEQ ID NO: 45188 - DNA, 115 bp, Homo sapiens
acccagcaggttcagcctcctggtgggggccggcaagttggggcctctctctctgtgaccctgggtgccttctctcctgcccacgggctgagcctcgggtggtggctggaggagg

SEQ ID NO: 45189 - DNA, 96 bp, Homo sapiens
tcatcagcgcctgtaaatagacactggggatgaagacagaggaaattaaagtttttcatattttctctgttgttagtagttgaaggaggtgtgtga

SEQ ID NO: 45190 - DNA, 80 bp, Homo sapiens
gagagagctaatagcctgatggaatttatgcagaactcaaggcgaccagtgcttttgtatacattcactctgtctctctc

SEQ ID NO: 45191 - DNA, 61 bp, Homo sapiens
tgctctgttttctctctgactcctggtacagatgactgtatagcacagagaaaggagagcg

SEQ ID NO: 45192 - DNA, 119 bp, Homo sapiens
ctggtgataaaatttgaaattatggttaacctcagctgtgatcttatgtatgtaaagcaaaatttaaatatataattataggttgattacaaaatccataatgtcattttattttagtc

SEQ ID NO: 45193 - DNA, 69 bp, Homo sapiens
gcgacgtgttggggaaggaatagtttttaaatttttgcatttagtagctatggattcagaatgtgtcgt

SEQ ID NO: 45194 - DNA, 95 bp, Homo sapiens; identical to SEQ ID NO: 68

SEQ ID NO: 45195 - DNA, 93 bp, Homo sapiens; identical to SEQ ID NO: 69

SEQ ID NO: 45196 - DNA, 60 bp, Homo sapiens
tgagagacagggtctctctctgccactcaagctagagtgcagcagtgcgatcatggctca

SEQ ID NO: 45197 - DNA, 119 bp, Homo sapiens
gtttcattttttatggtcaaataatattccattctgtataggtacattttctttatgaatttattcattaagggacacttagattggttccttatcttgggtattgtgaataatgaggc

SEQ ID NO: 45198 - DNA, 102 bp, Homo sapiens
atatatatccatatatatccatatatgtatatatccatatatatatatccatatatgtatatatccatatatatatccatatatgtatatatccatatatat

SEQ ID NO: 45199 - DNA, 111 bp, Homo sapiens
gcaatggcagggaggcccggcttactttattttttattttttaaattgttttttgagatggagtctcactctgtcacccaggctggagtgcagtggtgcgatcttggctca

SEQ ID NO: 45200 - DNA, 58 bp, Homo sapiens; identical to SEQ ID NO: 2595

SEQ ID NO: 45201 - DNA, 71 bp, Homo sapiens
tgcacactcacactctctgacagcctggctcctaggagcacctggactatctgtcctgtggggtgagggca

SEQ ID NO: 45202 - DNA, 110 bp, Homo sapiens
cttagggctacacagtgccaggagggaggaaatcagagtgggcatggaggcgaaaggctgtgactctatctgacactcagttccctgccccggggacttgtgagtcggag

SEQ ID NO: 45203 - DNA, 84 bp, Homo sapiens
cacctgagtcttcagtgttagttgttgtcattttgctggtggagtgtcttgtctcaatattaatggttgatgactgatcaggtg

SEQ ID NO: 45204 - DNA, 85 bp, Homo sapiens
ccatcacttttagaagttactgaagagcagaatgtagtgtggtggcaaatgtaatggtctggtaattttatctgggagttgttgg

SEQ ID NO: 45205 - DNA, 68 bp, Homo sapiens
tcagtctcccaactttgtctctgactctttctgatgggggatcacgctgagccaaggtgagatgctga

SEQ ID NO: 45206 - DNA, 85 bp, Homo sapiens
gggctcagctccaggcccttggggcaccagaccttattctagactgtgagagatcatggtgagactgaagagtgtcggctggctt

SEQ ID NO: 45207 - DNA, 85 bp, Homo sapiens
tgcatcttccctagttcatttgtgtgtatatatatatgatagtagttatatggtgacatgggaaagaacattgggcaaggaagta

SEQ ID NO: 45208 - DNA, 60 bp, Homo sapiens
tggtgtgcctgtggtcccagctactcaggatgctgaggtggaaggatgacttgtactcta

SEQ ID NO: 45209 - DNA, 110 bp, Homo sapiens
tgtggccacattgttccaatctctgcctccaaagttgcatcgtcttctcttctgtgtgtgtcacataagaaaacttgtaattgggtttagggtccaccagtatatccgca

SEQ ID NO: 45210 - DNA, 80 bp, Homo sapiens
cagcatccagtggctgctggcatacagcctcatccccacgtcccaacccctctcctgtgtgtctgtgaccctgtgcgctg

SEQ ID NO: 45211 - DNA, 95 bp, Homo sapiens
gcagtttcatgctgcagaaaagaggacaagagcttaatgagaagacctatgttctggtcccaactctctctcttactttctgcttgcccctatgc

SEQ ID NO: 45212 - DNA, 71 bp, Homo sapiens
ttgttttttgagatggagtctcactctctcacccaggctggagtgcagggtgtgatctcagctcactgcaa

SEQ ID NO: 45213 - DNA, 70 bp, Homo sapiens
gcctgtgtttataaacctgccaacagcccacaatctgggagtgacctttgctggttgtaaacacaaatgc

SEQ ID NO: 45214 - DNA, 78 bp, Homo sapiens
ggaaaggacactgggtaagtgcaggattttgatggagctctctgaagagagatgtcagcgaggaccttgtctcttttt

SEQ ID NO: 45215 - DNA, 63 bp, Homo sapiens
tggagactgtgtttcactctgtggctcaggctggagtgcagtggtgtgattcatagctcacca

SEQ ID NO: 45216 - DNA, 97 bp, Homo sapiens
agaagaaaggcaagagccagcatgagttctgattctgtcaggatagaagtcagcctgcgaggaaagaatcttattagacactggttttctatcttct

SEQ ID NO: 45217 - DNA, 141 bp, Homo sapiens
tcctgttactgtcctgcctgggactgggcggggctctgtgacttttgtcttttttgttttctgagacacagtctcactctgtcacccaggctggagtgcagtggcgagatcttggctccctgcaacctctgcctcccgggt

SEQ ID NO: 45218 - DNA, 118 bp, Homo sapiens
gcaggccatgtggttactgcatccttactttctgccttaatggtgacagcccattgctgcacactgtgtttctgtctggcttctgcatggatgctgaaggtggcttcacaaaggctgt

SEQ ID NO: 45219 - DNA, 73 bp, Homo sapiens
gcacctgtagagggaagagagtgaggttaggatatttcttcctgctgtctccgtgcttccctgcagagagtgt

SEQ ID NO: 45220 - DNA, 58 bp, Homo sapiens
tgagatggagtctcactctgtcacccaggctggagtgcagtggtatgatctcaactca

SEQ ID NO: 45221 - DNA, 83 bp, Homo sapiens
gcaaaatttaaggaggtgttcactctcagactcacacaagtgcatgattcgcatctgagagtgagtgcttccttaaatttggt

SEQ ID NO: 45222 - DNA, 58 bp, Homo sapiens; identical to SEQ ID NO: 6359

SEQ ID NO: 45223 - DNA, 73 bp, Homo sapiens
gcctgcgcatctagtatcaggtcaagtcctgaggtcctggggctcagacacacacactgtaaatgggcgcggt

SEQ ID NO: 45224 - DNA, 116 bp, Homo sapiens
cacagagttgatgacccttgaactaggagaccagggtaccagctccctctgccactgactcactgtgtgaccttgggcaagctcctgcccctttctgagcctcagtaaaaactgtg

SEQ ID NO: 45225 - DNA, 77 bp, Homo sapiens
tgtattctgtgtatctggtgcatatatgtaatatatatgtgtatatatctatatatgcctctatacatctatataca

SEQ ID NO: 45226 - DNA, 86 bp, Homo sapiens
cctctaagggacaagagtgaggtctgtgaatggcagagaaatttttttttttttgagacaaggtcttactctgtcacccagactgg

SEQ ID NO: 45227 - DNA, 81 bp, Homo sapiens
ctgggacagcagaggcagcttgtgtggagagccttgtagggaaaccacaggtctgtgatgtgtgtgtgtgtgtgtctgcag

SEQ ID NO: 45228 - DNA, 102 bp, Homo sapiens
gtcacatggcatttcagcagcccccagagctggctggagaagggcaggcctggtcagtctctgtctttgagatgtccagtgacctctgagtcttttttctcc

SEQ ID NO: 45229 - DNA, 116 bp, Homo sapiens
gggattacaggtgtgagccactgtgtctggcttttgttgttgggagacagggtctcactctgtcacccaggctggagggcactggcacgattgttgctcactggagccttgaactc

SEQ ID NO: 45230 - DNA, 104 bp, Homo sapiens
cagcatacccacaggagggtcagaaaattggtgagaagtgattttctttttaaactcagaggtggaaaatctgcatttactgaaaaatgactaacttggtgttg

SEQ ID NO: 45231 - DNA, 93 bp, Homo sapiens
tgagtttgatctgggagctgaagctgctcatcttttttttttttttttttttaattgagacagggccttgctatgttgcccaggttggtctcg

SEQ ID NO: 45232 - DNA, 59 bp, Homo sapiens
ggctcaggttactcctggcccattagcatcgctggtgagagcttggagcttcttaagtt

SEQ ID NO: 45233 - DNA, 84 bp, Homo sapiens
gtgtgtgtctgtagtcccagctactcaaaaggctgaggtaggaggatggcttgagcccaggaggttgaggctgcagtaagctac

SEQ ID NO: 45234 - DNA, 76 bp, Homo sapiens
gtgggtctcgagagagatgtgactgtgctcctctgccacttccaagagcatgctaaaacatcctctggtcaaacat

SEQ ID NO: 45235 - DNA, 74 bp, Homo sapiens
tcctgcttgggtgctgtcacctcacttctttttttttttttgagatggagtctggctctgtcacccgggctgga

SEQ ID NO: 45236 - DNA, 105 bp, Homo sapiens
cagtgctaagatgacaggcatgagccaccgtccctggccattttttcttatgaaactttttttttgtaaattagagactgggtcttgtttatgttgttgaagctg

SEQ ID NO: 45237 - DNA, 99 bp, Homo sapiens
ggtcagaaccaggaggcaaacctcttcctgctgtgttcactcctcggctccctctgctgatgacacgcagcattgtggaggaagagcctgctaagggcc

SEQ ID NO: 45238 - DNA, 119 bp, Homo sapiens
cactttcagacccatctacagcttaaacttccaatcaaattttatcttattattttttatttttttattttagtttagtttttgagacggagtcttgttctgttgcccaggctggagtg

SEQ ID NO: 45239 - DNA, 85 bp, Homo sapiens
cctggcaaagttctgggattacaggcatgagccactgtgcccagtgacaggtggttttggattgtaaattagatatcacgttagg

SEQ ID NO: 45240 - DNA, 82 bp, Homo sapiens
gtatcgtctgtctgtctgtctgtctgtctgtttctgctattactgagcttggggcaagccagctaggggacagtgggagtac

SEQ ID NO: 45241 - DNA, 57 bp, Homo sapiens
aggctgtagtgagctatgtagtgagctaagtgagctatgttcactgcactccagctt

SEQ ID NO: 45242 - DNA, 105 bp, Homo sapiens
gctgaataatattgccttgtaggtattataccacattttgttgatctcttcatctgttgatggacacttgggttacttctacaacttggatattgtgaatacggc

SEQ ID NO: 45243 - DNA, 82 bp, Homo sapiens
atctatctctctctctctctcagcaggatgcagtggctcatgcctgtaatcccagcactttggaagactgaggtgagaggat

SEQ ID NO: 45244 - DNA, 92 bp, Homo sapiens
gcaggttgtgtttgtagtacagctccccaagaggctgaggtagaaggatcacttgagccgaggaggcacaggttgtagtgagccgagattgt

SEQ ID NO: 45245 - DNA, 98 bp, Homo sapiens
tttgaatgttttcatcttacttatctttgttttttttttacttagtattaatgtatattttcaggaaagacaaagatatgcttgaagataagtttaaa

SEQ ID NO: 45246 - DNA, 81 bp, Homo sapiens
acacatatatactaacatacatatatacaaggatacttcggtgtatccttgtatgtatgtatgtatgtatgtataaggtgt

SEQ ID NO: 45247 - DNA, 69 bp, Homo sapiens
ccaggtcactgctctgtgtgtctgcctgtcaagataagaaggcagaggcagatgctgctaattacctgg

SEQ ID NO: 45248 - DNA, 72 bp, Homo sapiens
ccaggtatagtggtactcacctgtagtctcagctacttgggaggctgaggtaggaggatcacttgagcctgg

SEQ ID NO: 45249 - DNA, 96 bp, Homo sapiens
gcatgaattttactccatcatcttaggtgtgtgtgtttttttaaagtcattattgtatttttctaaatcaaactaaggttggagagtgatgtcagc

SEQ ID NO: 45250 - DNA, 82 bp, Homo sapiens
gcctgggtgacagagtgagactcagtctcaatcaatcaataaagcaggtcgggctgtgtctactgaggctctgactcctggc

SEQ ID NO: 45251 - DNA, 56 bp, Homo sapiens
gatgtctgccccaggacagggtctcctctgtgggtccctccctggctgcctgactc

SEQ ID NO: 45252 - DNA, 110 bp, Homo sapiens
tttttttcatcattgcctttgcacattggttttctatagaactatattgcttttaaataaatgtttctatttctctcataggaaacaattgctatcaaagatggaagaga

SEQ ID NO: 45253 - DNA, 98 bp, Homo sapiens
gttaggtgttttttgttgtttgtttgtttgtttgttttgttttgtttttttaaggacaattcatattgaacaaattcagaatcattaaaatataagac

SEQ ID NO: 45254 - DNA, 102 bp, Homo sapiens
tgggggtgcctgtgggggatctcaggtgggatggatgaacaggaggtacgggcaggaccctgacgctctctgggcctgagtttccccatgtgggcaccacca

SEQ ID NO: 45255 - DNA, 56 bp, Homo sapiens
gtgagggtcccaggaaaggtgtggatcccagaagtctcactcagtgtcaccctcac

SEQ ID NO: 45256 - DNA, 79 bp, Homo sapiens
agccagggctggatttttagcattactgctgccttttttttttttttttgaggtagagtctcactctgtcgcccaggct

SEQ ID NO: 45257 - DNA, 95 bp, Homo sapiens
ctgggactgcagagggaggaggactgttagttcatgtctagaacacatatcaggtactcactgacactgtctgttgactcttttggccttttcag

SEQ ID NO: 45258 - DNA, 83 bp, Homo sapiens
ggcactgtggttttgtcagagatgcttgctctcatttgcacagaaaggagttcatgcaagtctttttattattattacatgtc

SEQ ID NO: 45259 - DNA, 70 bp, Homo sapiens
cccaggccacagaactgcagggtgagaccagggtaggatgagacactgcctctcactgtctgagcctggg

SEQ ID NO: 45260 - DNA, 118 bp, Homo sapiens
gtcagatgatgaaatgcctcccaatgctgggcagggcccctcagtgggagaaactggtcgagttcagagatgagagtgtcgaggggactgtggttggtgggagagttcaagccctgtc

SEQ ID NO: 45261 - DNA, 78 bp, Homo sapiens
tgggggagggagaagggactccttgagaaggtctttttttttttttttttttctggagacaagtctcactgtcaccca

SEQ ID NO: 45262 - DNA, 58 bp, Homo sapiens; identical to SEQ ID NO: 34358

SEQ ID NO: 45263 - DNA, 73 bp, Homo sapiens
gtcctgagcctgggcctctctctctctgtttctgaatcactgaaggaagacaaaggtcactgaggttcaggtc

SEQ ID NO: 45264 - DNA, 107 bp, Homo sapiens
cctgagaactgagcaaactgctgtgggtgctggagaagggatggccaggattatttcctccacagtctctccgtgtgtctcacacaggatttggccacgagcacagg

SEQ ID NO: 45265 - DNA, 124 bp, Homo sapiens
tgttagacatacttcatcttttaatctgccagccaccctctgagataggtatttattattatttccattttgcagattaactgagttgaggtttggagcagtaaagctacctactcaaagtggc

SEQ ID NO: 45266 - DNA, 63 bp, Homo sapiens
agggacctggctctggcactagcttgccatgtgatgtcggcctgcctgtgagcctctgtttct

SEQ ID NO: 45267 - DNA, 113 bp, Homo sapiens
gcttggaccataaaaattaatgtctcatacatgtccattttgggtcagttgggggctttgttctctgtctctataatctggcatgtaggctgacatgtcaagtgttgctgggt

SEQ ID NO: 45268 - DNA, 123 bp, Homo sapiens
atgaatactattccattgtatgtatgtatgtgtgtgtgtatatatatatatgtcatgtatatatatatgtcatgtatatatatatatgtcatatatatttgtcacattttcttattcattcat

SEQ ID NO: 45269 - DNA, 115 bp, Homo sapiens
gtaattagtgagaggcatagctgaaacaagaacccaagaagaacccaagattctgaattttgttttgtttttttttttttttttttaagacagtgtcttgctctgtcacccaggc

SEQ ID NO: 45270 - DNA, 106 bp, Homo sapiens
agtcactgaaacttggatggagctggacatcattattctgagtgaagtcactcaggactgaaaaactaaatatcctatgttcttgcttctaagtgagagttaagct

SEQ ID NO: 45271 - DNA, 113 bp, Homo sapiens
ggtattttatcttatgtatattttatcacaatttgtattgctttttttaaaagtttttgttttagattcagggagcacctgtgcaagtttgttacatgggtatgttgtgtgtc

SEQ ID NO: 45272 - DNA, 118 bp, Homo sapiens
gtgatggcaaatgagctccatgagatctgatggttttataagtgtttgacacctcctccttcacacactttctctctcctgctgccatgttagacgtgcctgcttcctcttccaccat

SEQ ID NO: 45273 - DNA, 85 bp, Homo sapiens
tttattctgccaaggcaataagaggaaaataccacaaccttgtttggttttttggtttgtttctttgattatctaggagtatgag

SEQ ID NO: 45274 - DNA, 114 bp, Homo sapiens
ccagggaattccaggtgttttctcagaaagttggctttttctgtgcctcactctgtcccataggccagagtacagtggcatgatcatagctgactgcagcctcaaactccttgg

SEQ ID NO: 45275 - DNA, 69 bp, Homo sapiens
aactttaggtagtcaaaggttagtccttgtggtctaaggttgcattgataatctttggtatttaaagtt

SEQ ID NO: 45276 - DNA, 65 bp, Homo sapiens
agagagagagagagagtgaaaggggaagtgccacacacttttttttttttttttttttttttttt

SEQ ID NO: 45277 - DNA, 85 bp, Homo sapiens
ctgtattctctgtctctctggggctgaaatcctgtgaattccatcacccagatttccatgccagctgggttccagataggttcag

SEQ ID NO: 45278 - DNA, 108 bp, Homo sapiens
tctgttgacatataaaaatactactgatttttgtgcattgattttgtatcctgcgattttactgaatttgtttatcaattctaatagtgtttttgtggagttcttagg

SEQ ID NO: 45279 - DNA, 93 bp, Homo sapiens
tgttgagcatattgtatgtatgtgtgtatatatatatgtgtgtgtgtgtgtgtatatatatgtatgtatatgtatatttaaatatgttaccca

SEQ ID NO: 45280 - DNA, 107 bp, Homo sapiens
tataaatatcttctaagtgattttacagataatgtatgtgtatatatattataacatgtatataatagtgtactatatatatgtgaaattaaaatagctaccttgta

SEQ ID NO: 45281 - DNA, 60 bp, Homo sapiens
gaaactttgagtccagacactttctgcttccccaaggtagtaaaggtctgggttcatttc

SEQ ID NO: 45282 - DNA, 70 bp, Homo sapiens
aaatcatgactagatgtatgtatgtatacatttttgtatatgtatcatatcatgcatacttggatgattt

SEQ ID NO: 45283 - DNA, 94 bp, Homo sapiens
gccctaagatgcctgagagtgaggtgattgcagaagttttgtttgctaatgttatgtaatattgtgactgtcttggtatcctcttatcaggggc

SEQ ID NO: 45284 - DNA, 98 bp, Homo sapiens
tgctaatggttaatagggtcagccacccaagcagcagccagacctggaattttccactctcactctctgcctgacattcactagaggccacatgtgca

SEQ ID NO: 45285 - DNA, 81 bp, Homo sapiens
gcagattggctgaggaagttgtttctcttctaaaacctggtcagtagagactggaggagatgactgcttctttaaatgagc

SEQ ID NO: 45286 - DNA, 94 bp, Homo sapiens
ggtaaaagcttattgattccattggtgatcctagaattcacacattccctctgtgtgtctcaagttccagctctctaaggtcattggcgactcc

SEQ ID NO: 45287 - DNA, 82 bp, Homo sapiens
caccatcctgtttttagcatccttgtattttgccctctggtaagtagggggctgatagagagatctgtgagtgaagatggcg

SEQ ID NO: 45288 - DNA, 117 bp, Homo sapiens
tgcatgtatgtatgcttaatatatatttgtgtgtgtttaacatatatttaatatgtatatatgtattaatatatcaatacctttaaatatatacaaatacatatttatctgcatata

SEQ ID NO: 45289 - DNA, 119 bp, Homo sapiens
gtattgatttctatttttgttgcatcatgatcagagagtgtgcttgagtatgatttgatttttttgaatttattgagacttgctttatgaccgagcatgtggttgatcttagaatatat

SEQ ID NO: 45290 - DNA, 193 bp, Homo sapiens
tgtatgtatgtgatacatatataactatgtatgtatgtgatacatatataactatgtatgtatgtgatacatatataactatgtatgtattatagttacatacaatatagttatatatgtatatatacatatagttatatataatacatatataactatatatgtattacagttacatacattatagttatat

SEQ ID NO: 45291 - DNA, 82 bp, Homo sapiens
cacacatatacatatatatatatgtgtatatatagacatacctatatacatgtacatatatatatgtgtatatctagtagtg

SEQ ID NO: 45292 - DNA, 57 bp, Homo sapiens
gtaagtggtagagctgggctatgaatttggatgtttctggctcactcattcacttat

SEQ ID NO: 45293 - DNA, 116 bp, Homo sapiens
gaacaggatctcagccggctccatccttcctcagctgggtgaccgtggccaatgacttgctctctgtgcctgagttgctccatctgtgaaatgaagattgtcacagtccctgcttc

SEQ ID NO: 45294 - DNA, 101 bp, Homo sapiens
tgggattacaggcatcagcagctgcacctggctgttacttttatttttgatgttcaaattatccctaacatggccagtgggagctaatgcctgtgagacca

SEQ ID NO: 45295 - DNA, 80 bp, Homo sapiens
tctgcttggtgtatctggtgctgctgcctgaagagacagaggagtttctgcagaccagcagaaaggtgacacttggtagg

SEQ ID NO: 45296 - DNA, 98 bp, Homo sapiens
tttgatttgcatttccttgatgattcgttatgttgagcattttttttcatatatttgttggacatttgtatgtcttctttgagaagtgcctattcaga

SEQ ID NO: 45297 - DNA, 110 bp, Homo sapiens
ttattattggccactgtctctcactgatctttgggtcgtttttattctggctttttttttttttttcctttttgattagatggagggatcagtagcttggccatgagtaa

SEQ ID NO: 45298 - DNA, 65 bp, Homo sapiens
agcacaggagaaagatgtaggctggggggctaagcaagtctagtcttcatgttcttctgcctgct

SEQ ID NO: 45299 - DNA, 77 bp, Homo sapiens
cttgcagagatggaagacttggcatctttaaaccaatgggaagggactgtcaggaagtctgcgtctgtctctgtgag

SEQ ID NO: 45300 - DNA, 71 bp, Homo sapiens
ttgtttttgagatacagtctcactctgtcacccaggctggggtgcagtagtgcgatctcagctcactgcaa

SEQ ID NO: 45301 - DNA, 99 bp, Homo sapiens
gtgatccacctgccttggcctcccaaagtgctgggattacaggcatgagccactgtgcctgactcccaccctcatttcttactcaaggtgttgggtcac

SEQ ID NO: 45302 - DNA, 83 bp, Homo sapiens
gacaaatcagaatcaagttaatttgtgagtagacagagtcctccaaattctacttggatgctcaggaaattttgatgtttgtc

SEQ ID NO: 45303 - DNA, 73 bp, Homo sapiens
ttgtttgtttttgagacagtctcgctctgtcacccgggctggagtgcagtggcacgatctcggctaactacaa

SEQ ID NO: 45304 - DNA, 124 bp, Homo sapiens
ccagcctgagtgacagagcaagactctgtccccccaaaaaaagaaagagacagggtctcactctgtcacccaggctggagttcagtggcaccatcacagcttactgtggccttgaactcctggg

SEQ ID NO: 45305 - DNA, 58 bp, Homo sapiens
tgagacagagtctcactctgtggcccaggctggagtacagtggcacaatcttgtctca

SEQ ID NO: 45306 - DNA, 103 bp, Homo sapiens
ggtgtcagagtgagactctgcctccaaaaaaatatataaaattttgcttatttagtttattgtttgtttttgttttttagacacagggtctcactctgtcacc

SEQ ID NO: 45307 - DNA, 103 bp, Homo sapiens
ggtgacagagtgagaccctgtgtctaaaaaacaaaaacaaacaataaactaaataagcaaaattttatatatttttttggaggcagagtctcactctgacacc

SEQ ID NO: 45308 - DNA, 69 bp, Homo sapiens
gtttttgagctgagtctcactctgtcgcccatgctggagtgcagtggtacaatttcggctcactgaaac

SEQ ID NO: 45309 - DNA, 68 bp, Homo sapiens
ttgtttttgagatggtctcactctgtcaccctggttggagtgcagtggtagatctcagcttactgcaa

SEQ ID NO: 45310 - DNA, 69 bp, Homo sapiens
cagggcgagactctctgtctcagaaaaaaaaagaaaaagaaaaaaactttcagacagagtctcactctg

SEQ ID NO: 45311 - DNA, 58 bp, Homo sapiens
tgagacagagtctcgctctgtcagccaggctggagtgcagtagcgtgatctcggctca

SEQ ID NO: 45312 - DNA, 58 bp, Homo sapiens
tgagacagagtctcgcactgtcacccaggctggagtgcagtgacgtgatctcggctca

SEQ ID NO: 45313 - DNA, 58 bp, Homo sapiens
tgagatggagtctcactctgtcacccaggctggaatgcagtggtgagatctccgttca

SEQ ID NO: 45314 - DNA, 105 bp, Homo sapiens
gttatatatacagttaatatatattattaactgtataacatacagttaatatatattattaactgtataatatacagttaataataattacagttaatatattac

SEQ ID NO: 45315 - DNA, 119 bp, Homo sapiens
gtgctgggattacaggcatgagccacgacatctggctggcattacgttgttctttatctttcattatacttttaatgtatactagtaatgtgtcatttcttttcctgattattctgtac

SEQ ID NO: 45316 - DNA, 92 bp, Homo sapiens
ggtgtgtttaggtggaaatcaggggtggaggtgtcactggggaggtgcaacattcctagtgacacaagtcactgaggaaccaggccatcacc

SEQ ID NO: 45317 - DNA, 78 bp, Homo sapiens
acagagaaggactgtgtctcaaaaataaataaacaatagtaagtttttttttttttttgagacagagtctcactctgt

SEQ ID NO: 45318 - DNA, 60 bp, Homo sapiens
gactctgtctcaaaaaaaaaaaaaaacttactattgtttatttatttttgagacacagtc

SEQ ID NO: 45319 - DNA, 73 bp, Homo sapiens
ggccatgggggctggtgggacctcctgcctctactacaaggcctgactctgtgtccctgagtccctctgtgcc

SEQ ID NO: 45320 - DNA, 58 bp, Homo sapiens; identical to SEQ ID NO: 18547

SEQ ID NO: 45321 - DNA, 56 bp, Homo sapiens
gagacagattctcactctgtcacccaggctggagtgcagtggcggaatctcggctc

SEQ ID NO: 45322 - DNA, 117 bp, Homo sapiens
ctcccaagtagctaggactacaggcatgtgccacaagacctgtctaatttttaattttattattattttttaattttttttttgagacagaatctcaccctgtcacccaggctggag

SEQ ID NO: 45323 - DNA, 95 bp, Homo sapiens
tggagtgtgtgtaacagagcatgtgtggaggtagggagtatatgggaaatctctgtgcctgtctcacaattttgccagaacctaaacctactcta

SEQ ID NO: 45324 - DNA, 98 bp, Homo sapiens
tagacaatatacatatatgttatctatatacatgtgtatatgtatctatatttacatatagatatatgtatatacatatacatatatgtacatgtgta

SEQ ID NO: 45325 - DNA, 116 bp, Homo sapiens
gtgtggaaacctggattctgcctctggttctgcctctccctagagctcagtctcactgtgtgtaatatgaagagatttggaccgtgtctggggtttcaaattcagttgccaacagg

SEQ ID NO: 45326 - DNA, 95 bp, Homo sapiens; identical to SEQ ID NO: 68

SEQ ID NO: 45327 - DNA, 93 bp, Homo sapiens; identical to SEQ ID NO: 69

SEQ ID NO: 45328 - DNA, 105 bp, Homo sapiens
atatcctttactaagtttataagtttacatatacatatatgtgtatttgtatataagtttacatatacatatatgtgtatttgtatatgtaaactttagatgtaa

SEQ ID NO: 45329 - DNA, 96 bp, Homo sapiens
ggacgctctactgatggaaggaccagtgcaagcagggtgactgagcctggctccctgtaaacaaaagactggggtctcctttcttgtccagggtcc

SEQ ID NO: 45330 - DNA, 87 bp, Homo sapiens
tgtgtatgttatatatacacatattacataatatatgtatatactatatactatatgtgtactgtatatgtatatataatatacata

SEQ ID NO: 45331 - DNA, 87 bp, Homo sapiens
tgtggctttgggcaagtctcttcctctctctgggactcagggacctgggagatgaagcctgggttggaattagcgtttcttgaagtt

SEQ ID NO: 45332 - DNA, 81 bp, Homo sapiens
agagcatcttgtggaacttactttgggaaatgctgggctctatgagatcttctccaaggtgtttctgcatctggatgtttt

SEQ ID NO: 45333 - DNA, 120 bp, Homo sapiens
caggatgcatatatatatatatatgcatcctgttatatatatatatatatatatatatatatatatatatatatatatatatatatatcaccatatatatatatatatatatgcatcctg

SEQ ID NO: 45334 - DNA, 105 bp, Homo sapiens
atgcatatatatatatatatatatggtgatatatatatatatatatatatatatatatatatatatatatatatatatatataacaggatgcatatatatatata

SEQ ID NO: 45335 - DNA, 101 bp, Homo sapiens
tccaggcactcctgactcatacgagtgggtcagtcatgtgagaaaagaggcaatttcaggtctctgacactctggcaatcagtaggagtagggagtgagga

SEQ ID NO: 45336 - DNA, 111 bp, Homo sapiens
tccaaattatccagagctcccgggctgtaggtttaactgcaatttttgtctttcttaaaataggttcagtggttagtgagacactcgtggggtgcgcagagtgagttgaga

SEQ ID NO: 45337 - DNA, 92 bp, Homo sapiens
attggtccatctggagctgttgatacaatcttacctaagacaataggttgtaaagataaatttttcagcattactaatccagccttgccaat

SEQ ID NO: 45338 - DNA, 98 bp, Homo sapiens
gctggacgtgggaactatagagtcagccctccctactcacgcagactgtgtgtgtgagagtgaaaggagtaggcaggaccccatgcgtgtaaaccagc

SEQ ID NO: 45339 - DNA, 72 bp, Homo sapiens
gtatgggtccctgtctgtcagcctgtgtgcttgcactgtagcacagagcctaaaagacttcctcctgcttgc

SEQ ID NO: 45340 - DNA, 84 bp, Homo sapiens
atggggaaagagttactgagagaaaatcatgactctgccatttataagttcagtggctctgagtctctgtgcctcagtttcctc

SEQ ID NO: 45341 - DNA, 86 bp, Homo sapiens
gggctaggattgtgtattttattttattttgagacagagtttcactctgtcacccaggctggagtgcagtgtcgtgatcttggctc

SEQ ID NO: 45342 - DNA, 68 bp, Homo sapiens
ctctgggaggctgaggtaggaggatcacttgaggtcaggagttcaagaccagcctgggcaacatagag

SEQ ID NO: 45343 - DNA, 89 bp, Homo sapiens
atatctgtgtatgcgtgtctgggtctgtgtcccagtgggtatatatctgtgaatatgtgtgggcatggatgtaggagatgtgtgtacat

SEQ ID NO: 45344 - DNA, 93 bp, Homo sapiens
tattctgatgtgcagggctacccctttgtggttaccttgtttgaattcagagaagaaacttcctgggggcctcaggccactgaaagttgagta

SEQ ID NO: 45345 - DNA, 67 bp, Homo sapiens
atgttttgagacagtctccctctgtcacccaggctggagtgcagtggtgtgatctcgactcattgca

SEQ ID NO: 45346 - DNA, 114 bp, Homo sapiens
atgtatgtgtacatatatgtgtacaaatatacacatatatacacatttatacacatatgtatatatgtgtatatatatgtgtgtatatatatacacatatatgtacatacacat

SEQ ID NO: 45347 - DNA, 85 bp, Homo sapiens
tggaagctctatgtgtatatatatgtgtgtatatatatacacatatatgtacatacacataaatgtacatattttggaagctcta

SEQ ID NO: 45348 - DNA, 115 bp, Homo sapiens
ggccaggtgtaaatattaactccaccagttaatagttgtacagatgtgagtaagttgtatctttttttctaagtcccaattctccacctgtaaaagtgggctatttatacctccc

SEQ ID NO: 45349 - DNA, 120 bp, Homo sapiens
ggagttcacagcccaacaggaaagacagacatggaacgtgaatttatataaatagtaggctctcaatttatgtgtttagtagatgtgtactctctgaatgttggttaataatgaggaccc

SEQ ID NO: 45350 - DNA, 79 bp, Homo sapiens
tgagacagagtctcactctgtcgcccaggctggagtgcagtagtgtgatctcgactcactgtaacctccacctcttggg

SEQ ID NO: 45351 - DNA, 61 bp, Homo sapiens
ttgagatgggtctcactcactctgtcgccaggctggagtgcaatggtgcgatctcagctca

SEQ ID NO: 45352 - DNA, 75 bp, Homo sapiens
ggccttctccctgtgtgagtgtctgtgtccaagcttcccctttttataaggacatagttttatgggattagggcc

SEQ ID NO: 45353 - DNA, 113 bp, Homo sapiens
gggcatggtggtgcacacctgtagtcccagctacttgggaggctgaggtaggaggatcacttggacctttatagttgaggctacagtgagctgtgagcttaccactgcactcc

SEQ ID NO: 45354 - DNA, 73 bp, Homo sapiens
ccgggtgtgttggcacatacctgtagtcccagcttctaggaaggctgaggtgggaggatgttttgagcccagg

SEQ ID NO: 45355 - DNA, 108 bp, Homo sapiens
gaatggcattatttcattctttttaatggatgagtagtattccacggtgtgtgtatatatatatatacaccacattttcttcatccacttgttaattgatgggcattc

SEQ ID NO: 45356 - DNA, 115 bp, Homo sapiens
agtcaggtgtggtgatgtgtgcctgtagtcccagctacttggaaggctgaggtaggaggatcacttgagcccaggaggtggaggttgcagtgagcggagatcacactgctgcact

SEQ ID NO: 45357 - DNA, 108 bp, Homo sapiens
gactcctgagatgggagggatatcaggaacttgagtgaacaaagggaggactacatctcaattgccctctgaccttaccagctctgaccctgcccagaacttactgtc

SEQ ID NO: 45358 - DNA, 99 bp, Homo sapiens
ggtgtcaaaagtgtgtgtgtatatatatagtgtgtatatagagtgggtatatatgtgtatatatatgatatatgatacatacatcacattttctttacc

SEQ ID NO: 45359 - DNA, 83 bp, Homo sapiens
acacacgatgcattatatatctatatatatgaggcattacatatatatctcatatatatatatataaaatatgtctgtgtatc

SEQ ID NO: 45360 - DNA, 112 bp, Homo sapiens
agcattcgtgtttatagttttcggctgctgaatttttgagtactttgaaagcagtaatagataattaatacaaagaggtttagaaaagttcatgcagatcgtatacgcagct

SEQ ID NO: 45361 - DNA, 99 bp, Homo sapiens
gtgtgtgatgggtagaggttgggttagtatagataaaaagattggtgatgtgttaaatatttttttaatttttaattcataatttttctgtgtacatac

SEQ ID NO: 45362 - DNA, 114 bp, Homo sapiens
tttaacgtatatgtgtgtgtgtgtgtgtgtgtgtgtgtgtgtatatatatatatatatatatatatatatatatatatatatatatacacatacacctgtgtggttatgttgag

SEQ ID NO: 45363 - DNA, 127 bp, Homo sapiens
tcagggcctctccaggctatggggcaccggctgagccacagggcatccatgcaggcctggctcactctctggcacagtgttcacccctagactggagaaagggccattagaactgaaggctgccttg

SEQ ID NO: 45364 - DNA, 71 bp, Homo sapiens
agtagacactcaaaaaatgtctgttgaatgaatgatacgtgtctttctttccagacagtctgtgtgctact

SEQ ID NO: 45365 - DNA, 79 bp, Homo sapiens
atatgtatatatattcacacacacgtgtatatgcatgcatgtgtgtatatatataaatatgtatgtatatgtgtgtgtg

SEQ ID NO: 45366 - DNA, 110 bp, Homo sapiens
catgcccagcctgcatgttgatttttaagagactggaatacttagagcacagacacaccatctctcactctacacgtttatttctctctctctctcctctggctggaatg

SEQ ID NO: 45367 - DNA, 84 bp, Homo sapiens
gtgtgcgtgtggatatatatgtgtgtatgtgtatacgtgtgtgtgtatgtatgtttatatatgcgtgtgtgtgtgtgtgtgtat

SEQ ID NO: 45368 - DNA, 92 bp, Homo sapiens
gggtccagtttggctttttttagaggagatttcaactaaattccacagatttttttttttttgagcacctactgtatgctaagcacaggccc

SEQ ID NO: 45369 - DNA, 86 bp, Homo sapiens
ccttatacacatacccactttccatgctaggcttgttttctcagtctctgtgagtgatttagcagagggaagtttgatgggaaagg

SEQ ID NO: 45370 - DNA, 80 bp, Homo sapiens
tatatgtatatgtatatgtatatgtatatatgtgtgtgtatatatgtacatatatacatgtatatatatgtatatatatg

SEQ ID NO: 45371 - DNA, 58 bp, Homo sapiens
tgagaccgagtctctctctgtcactcaggctggagtgcagtggtgtgatctcggctca

SEQ ID NO: 45372 - DNA, 92 bp, Homo sapiens
agcatcagatagggtcagtacatgcctctggttttcttttttctttttctttttttttttttgaggcagattctcactctgtcacccaggct

SEQ ID NO: 45373 - DNA, 100 bp, Homo sapiens
agcagtataaagctcatatatcttctgcaattcacagggttgagccctgtctcccctcagggtctctgtctgtgcctgcagaggccaggagaactctgct

SEQ ID NO: 45374 - DNA, 97 bp, Homo sapiens
tgactcagggttaacaccaactctaatctcaccctcactcacattctcagcgctcctgggagagggaaattgattggtggcttctcaacctagagca

SEQ ID NO: 45375 - DNA, 101 bp, Homo sapiens
cctgacttagggttaacaccaattctaatctcaccctcactcactgtctcagcgctcctgggagagggaaattgattggtggcttctcaacctagagcagg

SEQ ID NO: 45376 - DNA, 101 bp, Homo sapiens; identical to SEQ ID NO: 45375

SEQ ID NO: 45377 - DNA, 69 bp, Homo sapiens
ctagatatgtgtatatatgtatatacatatgtgtcatgtatatgtatatacatatagtaacagctttag

SEQ ID NO: 45378 - DNA, 73 bp, Homo sapiens
ttgtttttttgagacagagtctcactctgtcactcaggctagagtacagtggtgtgatctcagctcactgcaa

SEQ ID NO: 45379 - DNA, 84 bp, Homo sapiens
gagtctctgtctcactctgtcacccaggctggagtgcagtggtgtgatcttggctcactgcaacctccacttcccaggttcaag

SEQ ID NO: 45380 - DNA, 98 bp, Homo sapiens
ttctcaacatgtgttggcaattattctcatttatttgtctaaaatcattatttttgataaagtgttgatgaattctactcacagcaatctagtgagga

SEQ ID NO: 45381 - DNA, 106 bp, Homo sapiens
acacacacacacacacagaggcgacagagacagaaagagactgagagagagagagagacttgcaggacttggtggttgctcagatgcaccttgtgcttggtgatgt

SEQ ID NO: 45382 - DNA, 78 bp, Homo sapiens
tgtctctctctctcattgcccctccttgacccaatcaccatgaccaagggggctgaggggttcctgggataagagtga

SEQ ID NO: 45383 - DNA, 66 bp, Homo sapiens
ctctaggacatttcccgccttgtagttatttttatctttaacataaggtggaggcagtgactggag

SEQ ID NO: 45384 - DNA, 99 bp, Homo sapiens
aaggtgcagatcacgttgcttccaggatctcagagctttgggcttcaggtcactctgcctctgactggctttgggaccctgggcaagtctcttctcctt

SEQ ID NO: 45385 - DNA, 88 bp, Homo sapiens
ctgaagatagtgtgaggatgacttcagatagtgtggagtctgatccttgacctaggctgtttttggatcactattccactatccctag

SEQ ID NO: 45386 - DNA, 82 bp, Homo sapiens
ctcagtctctgggtctgtgagatggggtgatggctgtgattgccctcgcctccctcaccaggtgctatgaagagggaatgag

SEQ ID NO: 45387 - DNA, 114 bp, Homo sapiens
ggggaaccagggggaaagcagaagaggtttaaggggtgcctgtattggttgggtatttatcacagtgcctcttgttcttccatagtctctgaaacaatatcccctgcctccacc

SEQ ID NO: 45388 - DNA, 115 bp, Homo sapiens
gcccagccagtgctttggaaggtcattggttcattcgttaattagttaatctttattgattgattgaacaaatttgaactgagaacctgttcctgagacaggcactgtagtgagc

SEQ ID NO: 45389 - DNA, 81 bp, Homo sapiens
cagtactgctaaattctgtgagttcatgtttataattattactgtaacacaagcatccctggaattttgttagcagtagtg

SEQ ID NO: 45390 - DNA, 75 bp, Homo sapiens
tatttgactgtttcttcttctgtaaatggggatagtagtctctacttcagaggattatgaggaccaagtgaaata

SEQ ID NO: 45391 - DNA, 128 bp, Homo sapiens
ccaagattaggttatcacagactgaggcttcctacttgggcactcctctagcactctgtctctcactatctcttggatcacacagccttgggtaagccagctgcctgagagttgtccttttagagatg

SEQ ID NO: 45392 - DNA, 104 bp, Homo sapiens
ttgagacgaagtctctctcttgtcacccaggctggagtgcaatggtgcaatcttgtctcactgtcacctccgcctcccgggtttaagcgattctccggcctcag

SEQ ID NO: 45393 - DNA, 71 bp, Homo sapiens
tgtactctcaaagacttctcagtttcttcatctgcaggatggagagagtgataatgtcttccctaggtaca

SEQ ID NO: 45394 - DNA, 78 bp, Homo sapiens
atgtgaggctctcttctcttcttcaaatcatcagacttgatcatgaaaatagagaaaaaaaagggatttccttcacat

SEQ ID NO: 45395 - DNA, 58 bp, Homo sapiens
tgagactgagtctcactctgtcgctcaggctggagtgcagtgatgctatctcggctca

SEQ ID NO: 45396 - DNA, 91 bp, Homo sapiens
tacatccttgtcaacacttggtataatcagactttctaatttttttttttttttgcagaaatgggggtctcactatgttggccaggttgtg

SEQ ID NO: 45397 - DNA, 88 bp, Homo sapiens
gggaccagagctgggagaagacctctgtaaaaagcattttaaaaaatgttattgtgaagtgtgtgagtgtcactctctctgctgtccc

SEQ ID NO: 45398 - DNA, 64 bp, Homo sapiens
tactctagaggacagtgctcccctgcataggcagcctctgcacacactgtctctctggtttgtg

SEQ ID NO: 45399 - DNA, 101 bp, Homo sapiens
aatcccgcctctgtcactttagctgtgccttgcaacctctctgtgtctcagtctcctcccctgtaaaaggtgcataataatggcatctggcatgtaggatt

SEQ ID NO: 45400 - DNA, 120 bp, Homo sapiens
tcagtcttatccatatgtagaagatagccagaaaagtatatatgtgtgcatgtgtatgtatgtatatatatatgcttattacacttatggattgcttttgtcattgcccatggttgagct

SEQ ID NO: 45401 - DNA, 157 bp, Homo sapiens
gctaataacttttgagccatcgttgactgctgtctttctttttcttttctttcctttttttttttttcttttgagacagtctccctcggtcgctcagtctggagtgcagtggtgcgatctcgtgtcatcgtgtgactgcaacctctgcctcccaggc

SEQ ID NO: 45402 - DNA, 85 bp, Homo sapiens
ttggcggggaagtgcactctgtatatctgtctgtctgtctgcaactgtggctatcagaataatgtctcagcccttttcctgtcag

SEQ ID NO: 45403 - DNA, 78 bp, Homo sapiens
gccctaaggatttcgagcaccatggagccagtcctctgggggacctgtgtgaactctgtgagcccaagcccgagaggc

SEQ ID NO: 45404 - DNA, 79 bp, Homo sapiens
tgagacggactctcgctctgtcacccaggctggagtgcagtggcgtgatctcggctcactgcaacctctgcttcctggg

SEQ ID NO: 45405 - DNA, 68 bp, Homo sapiens
gatgcccccactcactgtgggtgacacctgcatccttcttccggggtcgcctttgcctggtgggcatt

SEQ ID NO: 45406 - DNA, 58 bp, Homo sapiens; identical to SEQ ID NO: 31764

SEQ ID NO: 45407 - DNA, 92 bp, Homo sapiens
tgcctgagtagaaaaagcaatttgaaatacattttgtcaacaggggtcctgttagcagtgatgcatatgaaatgttttgaaaatgctctgca

SEQ ID NO: 45408 - DNA, 80 bp, Homo sapiens
tggtgctgacttcctatctcacactgtgacttagaatgccttaaccatctgggaacacagctcagtaggtctcagtctca

SEQ ID NO: 45409 - DNA, 114 bp, Homo sapiens
gcaaggtatgaagaactcatgtactgtgattaaaagcaggattatgataagccaaacgtcttttatttattatctttattattatcattttttttttagagacagagatcttgc

SEQ ID NO: 45410 - DNA, 87 bp, Homo sapiens
gccggtaaggagagccgggatcgaagccagacagctgggctccagagttcatgctgttagccactacccatgctctgctgggatggt

SEQ ID NO: 45411 - DNA, 58 bp, Homo sapiens
tgagacagggtctcactctgtcactcaggctggagtgcagtagtgtgatcatggctta

SEQ ID NO: 45412 - DNA, 123 bp, Homo sapiens
cgcagatcagtgaggttatgatgtcttgtgtgtatgtgttctgtgtatatgttcttataatctttttttattcttttacagatcaatgaggttatgatgtcttgtgcgtatatgttcgcataa

SEQ ID NO: 45413 - DNA, 66 bp, Homo sapiens
tgagatagagtctcacagtctcactatgttgcccagcctggaaggctgtgtcacagtctcggctca

SEQ ID NO: 45414 - DNA, 58 bp, Homo sapiens; identical to SEQ ID NO: 2540

SEQ ID NO: 45415 - DNA, 153 bp, Homo sapiens
gtgtgtatatatatggatgtgtatgtagtgtgtatatatatgtatgtataactatagatgtatgtgcatatctatgtgtatatatatgaatatttatgtaacatgtgtctgtatatgtgtgtatatatggatgtgtatgtagtatgcatgtgt

SEQ ID NO: 45416 - DNA, 116 bp, Homo sapiens
gtatatgtgtgttctgtgtgtatatgtgtctgtgctctgcacatgtgtgtctgtgtgtgtgcgcacatgcccagttcctcccagatgtacataagcgctcaggagaccacccgtgc

SEQ ID NO: 45417 - DNA, 120 bp, Homo sapiens
gcagcactcccggcccacattggtccctcgagctgcagggagaggagcggggcaggggtgtctgtgagtgtctgcgtgtgtgttgcggggacctctggggggtgttcgtggaagatctgc

SEQ ID NO: 45418 - DNA, 79 bp, Homo sapiens
gggagacaggaagaggcctcatctcttcttttttttttttttttttttttttttgagataagttctcactctgtcaccc

SEQ ID NO: 45419 - DNA, 86 bp, Homo sapiens
ctgggatcccggccagagcccacactcctttattgtttttatttattattattatttttgagacaatgtgtgtctgtgtcacccag

SEQ ID NO: 45420 - DNA, 78 bp, Homo sapiens
agcccttacttctgaatctctctgtgcctcaggatcctccccatggagcaaatatcttagagggttgctgtgggggtt

SEQ ID NO: 45421 - DNA, 72 bp, Homo sapiens
aaccagttgcagtattcagtgcctaggctgtgtgacactgggcaggcacctgacctctctgtgtctcaggtt

SEQ ID NO: 45422 - DNA, 91 bp, Homo sapiens
agaggtgatccaccagcttcagacatagctggatccagggatggatctgatgcccttgtggctcagtctctctccgtctcagcaatggtct

SEQ ID NO: 45423 - DNA, 83 bp, Homo sapiens
cctgcccctttgtctacctcagttctccctctgtcaggtgtcctgcaggagcctggaaactcagagagaagaatgagcaggac

SEQ ID NO: 45424 - DNA, 58 bp, Homo sapiens
tgagacagggtctcgctctgtcacacaggctggagtgcagtggtgtgatcttggctca

SEQ ID NO: 45425 - DNA, 137 bp, Homo sapiens
cccatgcatgagtgtgcatatgtgtgtgcatgggtgtgtgtgcccgtgcatgagtgtgtgcatgtgcatgaatgtgtgaggagtgtgtgacgagtgtgtgtgcccatgcattagtgtgcatatgtctgtgtgcacat

SEQ ID NO: 45426 - DNA, 82 bp, Homo sapiens
cgtgcatgtgtgtgcttgtgcatgagtgtgtgaggagtgtgtgatgagtgtgcgtgcccatgcatgagtgtgcatgtgtgtg

SEQ ID NO: 45427 - DNA, 111 bp, Homo sapiens
ctcttaaactcagactccacgtgtgttctccggcttgtggccgatgactgcctctgtcactgtggccagctgccgcgccacgcaggatgaggttctgtctgtgtctgtgag

SEQ ID NO: 45428 - DNA, 76 bp, Homo sapiens
gggatcatacaaaacagttttggcatggagggaatatgcagcctcctagcctgtccctctctctgaatgtggttct

SEQ ID NO: 45429 - DNA, 57 bp, Homo sapiens
gagtctcgtcactcctgtcttggctgtttctctcacagtcagactgtgatgcctctc

SEQ ID NO: 45430 - DNA, 77 bp, Homo sapiens
gctctccctggggcctacagaggttctgggctggggccagctggcgaccagtacagtctgaagcctcagaggtcagc

SEQ ID NO: 45431 - DNA, 70 bp, Homo sapiens
gtacatatatacatatgtacatatatatgtgtatatatatgtatatgtatgtatatatgtgtgtatatat

SEQ ID NO: 45432 - DNA, 104 bp, Homo sapiens
cacactgacaatgatttgttttaaagcatgtgcaattgtagattaggtagatctcctgcatgtctctagattgtgagctctgaggaagaaggatggtcactgtg

SEQ ID NO: 45433 - DNA, 74 bp, Homo sapiens
tgtgtgtgtgtgtatgtgtgtgtgtgtgtgtgtgtgtatatatacacacacacacacatacacacactcttaca

SEQ ID NO: 45434 - DNA, 72 bp, Homo sapiens
gccgggttggagaggggctgtggggaggctgcccttgggctccctgcccatgtctgtctgtctgtccctggc

SEQ ID NO: 45435 - DNA, 65 bp, Homo sapiens
atatgtaatatgtatgtgtatatgtatatcaaatatatatatgtatgtgtatatatattatatat

SEQ ID NO: 45436 - DNA, 113 bp, Homo sapiens
gatagaatgagactctgtctcaaaaaaaacaaaacaaaacaagaaagaatccaatccaacctgtaattttttttttttttttttttttttgagacagagtgtcttgttctgtc

SEQ ID NO: 45437 - DNA, 101 bp, Homo sapiens
atgtgagtcagtatgtggtataccaggagcatttttgttttgctttttctttttttaagttagcagaacttaatttgttaaagtatgtgtatgttttacat

SEQ ID NO: 45438 - DNA, 90 bp, Homo sapiens
tatggggccactttacagtctctctgaaactgtcacctactgggaatgagcagttcccccaaacaaatcagggttttgttggcataagta

SEQ ID NO: 45439 - DNA, 110 bp, Homo sapiens
gcttccccccagctctggatgtcaactgaaggtgttttaagtatggaagtttgtatcttcccgagaaggcagtattctggttgctatggaagagagctgagtggacagac

SEQ ID NO: 45440 - DNA, 115 bp, Homo sapiens
cagcctgggcaacagagtaagactccgtctcaaaaaaaaaaaagacattttattgatttatggtttattaaattcttttttttctagatggagtgtcactctgtcacccaggctg

SEQ ID NO: 45441 - DNA, 128 bp, Homo sapiens
atgattacccttggaggtgcagtgactggaaggggatgcaaggcccctagttgttctgtttcttgatcttggtgctggttataagaatatgttaacttgaggaactttccaatatatgctacatttta

SEQ ID NO: 45442 - DNA, 100 bp, Homo sapiens
ccttattctggatcttctggtgataagtctcagtttctgtctgtgtcacagatgcccaagaccaacccagatttgatgattcactaagaggactcaaagg

SEQ ID NO: 45443 - DNA, 73 bp, Homo sapiens
ggtcgaggcaggtggataacttgaggtcagaagtttgagaccagaagggccaacagtgaaacctgtctctact

SEQ ID NO: 45444 - DNA, 71 bp, Homo sapiens
ggcatgcagaagcactgagtgactcaagttcaaacagcagtcagttccactctgtgtctgtctgttctgtc

SEQ ID NO: 45445 - DNA, 58 bp, Homo sapiens
tatatgtgtatatatatatgtgtgtgtgtgtatagatatgtgtgtgtgtatatatgta

SEQ ID NO: 45446 - DNA, 62 bp, Homo sapiens
tatatatacacacacatatatgtatatatatacatatatgtatacatgtacgtgtatatata

SEQ ID NO: 45447 - DNA, 108 bp, Homo sapiens
agaggctcaggcctgtaatcccagcacttaggaaggctgaggtaggaggatcacttgcacccagaagttcaagaccagtctgggcaacagagcaagactgatctctac

SEQ ID NO: 45448 - DNA, 108 bp, Homo sapiens
catggcagttttgaatggtaaacttggaaatcttcattttttttcttaaagatattctggaaatgtgatttgaagaaactttaaaaggtagccctttagaggggtgtg

SEQ ID NO: 45449 - DNA, 119 bp, Homo sapiens
ctcagaagaaagtatagccctttacgctgataaagtacagaaagtgatgatctctctctctctctggctatcttgctacagtgggtgctagggactagttttgagtgatcactcccctg

SEQ ID NO: 45450 - DNA, 116 bp, Homo sapiens
tttggtaaggaatttttttgttttgttttttagatggagtttttttttttttttttttttgagatggaaaaatagttttgatcatagagttaggcattatggaaattcaagccaga

SEQ ID NO: 45451 - DNA, 110 bp, Homo sapiens
acagagtgagactccgtctaaaaaaaaattcataatatttcattaaaaagtacgatatttatttatttatttatttatttatttatttttgagtcacagtctcactctgt

SEQ ID NO: 45452 - DNA, 99 bp, Homo sapiens
ccagcctgggcaacaaagcaagaccctatctctaaaaaaattttatttatttatttatttattttttgatgtggagtctggctctgtcgcccaggctgg

SEQ ID NO: 45453 - DNA, 117 bp, Homo sapiens
cattgcactccagcctgggcaacaagagcaaaactccgtctcaatctatatatatagatagatagatagattggttgagacagggtcttgctctgtcacccagtctggagtgcagtg

SEQ ID NO: 45454 - DNA, 111 bp, Homo sapiens
tgcactccagactgggtgacagagcaagaccctgtctcaaccaatctatctatctatctatatatatagattgagacggagttttgctcttgttgcccaggctggagtgca

SEQ ID NO: 45455 - DNA, 210 bp, Homo sapiens
gtagatatatatacacgtatatatatatatatatatatgtgtgtgtgtgtgtatatatatatgtgtgtatatatatatacgtatatatatacgtatatatatatacgtatatatatatacgtatatatatatacgtatatatatacacacacatatatatatacatatatatacgtatatatatatatgtatatatatatgtatgtatat

SEQ ID NO: 45456 - DNA, 117 bp, Homo sapiens
gttgctggggtgactggaagcttgctaatatacacagttttttaaattctttttttattttaattttttagttctagggtacatgtgcaggatgtgcaggtttgttacataggtaat

SEQ ID NO: 45457 - DNA, 101 bp, Homo sapiens
actcaacagttttgtggaagcagatggatttttttttcttttcctttatgaaggacttgagtgagggaccagggttcactctgccgcacatcacagggagt

SEQ ID NO: 45458 - DNA, 74 bp, Homo sapiens
gcagagaaatctgagacagagagagagaatgtgtgtgtgtgtgtctatgtgtgtctgtgtctgtctgtctctgt

SEQ ID NO: 45459 - DNA, 95 bp, Homo sapiens; identical to SEQ ID NO: 68

SEQ ID NO: 45460 - DNA, 93 bp, Homo sapiens; identical to SEQ ID NO: 69

SEQ ID NO: 45461 - DNA, 79 bp, Homo sapiens
tgttgttgttgttgctgctgctgtttagatacagggtctcactctgtcacccaggctagcatgcaatagtgtaatgata

SEQ ID NO: 45462 - DNA, 58 bp, Homo sapiens
tgagacggagtctcactctgtcaccccggctggagtgcaagggtgtgatcttggctca

SEQ ID NO: 45463 - DNA, 80 bp, Homo sapiens
agcagcatatatacacctacaaagtgtgcaccactttctctcaaacaagacagagatgacacattgtattataagctgct

SEQ ID NO: 45464 - DNA, 93 bp, Homo sapiens
agaaacgagatggagtcagttatgtcatatttctcttactgtcataattttgcaaaggaggtttcagtgagatgtaacctaccaactcagtct

SEQ ID NO: 45465 - DNA, 95 bp, Homo sapiens
atgtacatgtgccttcgtgtgtgtgtgtgcatgcatgcatgtgtgtatgtgcatgtgcatgtgtgtgtgagtgtgcattgcatgcgtgcatgtgc

SEQ ID NO: 45466 - DNA, 88 bp, Homo sapiens
ggcaaattacttgtcctctctgtgcctcagtgtcttcatccgtaaaatggggtaagagtatcaaatgggcattgacaagtaaacagtc

SEQ ID NO: 45467 - DNA, 87 bp, Homo sapiens
ttgctttttgcctgtctataaggagatttttttttcttttcacaagaaagtgtcactgaagggaaatccaatttgtgaggcaagcaa

SEQ ID NO: 45468 - DNA, 93 bp, Homo sapiens
tccagcatattcaagacaggcattcaactcagatttatctttttttttttttttttttttgagatggagtctcactctgtcacccaggctgga

SEQ ID NO: 45469 - DNA, 95 bp, Homo sapiens; identical to SEQ ID NO: 68

SEQ ID NO: 45470 - DNA, 93 bp, Homo sapiens; identical to SEQ ID NO: 69

SEQ ID NO: 45471 - DNA, 112 bp, Homo sapiens
acgatggtataaacataaagacagatatatggataaatgaagcaaaatggtatttctggtttatctattttgatttatttatccatatctatctttatgtttatatcatcgt

SEQ ID NO: 45472 - DNA, 82 bp, Homo sapiens
tcagtaacatgagtgtgagcatacagggcacaggagatgtattttgcttgaggggattgtggctaaagcagtgtagtactga

SEQ ID NO: 45473 - DNA, 98 bp, Homo sapiens
ggagatgatacaactggaactgagtcttgaaggatctgtgtttttgaagttcacatgtgacatgcattttctttcaggcaatgcatagttcatctacc

SEQ ID NO: 45474 - DNA, 118 bp, Homo sapiens
atgaggttttgtgcaaggtttaatgtctggctttggttttgttaatattattttgtacatcattattatttaatagagtgttcagtgtttctggattatttcttgtaaagactatcgt

SEQ ID NO: 45475 - DNA, 114 bp, Homo sapiens
tgctcaaccttatgtatatatgtgtatatatgtatatatgtgtatacatacacatatgtgtgtgtgtatatatatatatatgtgtgtgtgtatactgatatatttttttttgca

SEQ ID NO: 45476 - DNA, 134 bp, Homo sapiens
tatatatatacacacatatgtgtgtgtatgtgtatatatgtgtgtgtatatatatatatttttgaatatatacacacatatgtatatatgtgtatatatatgtgtgtgtatgtatatatatatgtgtgtgtata

SEQ ID NO: 45477 - DNA, 116 bp, Homo sapiens
cttctcttgcagactgtgagtacatgtaaccaatacattaataatttattttatatatatatatatttgtattatactttaagttctagggtacatgtgcacaacgtgcaggttag

SEQ ID NO: 45478 - DNA, 112 bp, Homo sapiens
gtgatttacatgaaaatcatgaaagggctcatttcgtgtgtttttatttatctatttatttttaataagcatatgtatatttattaccttttagggtagttatgtaatccat

SEQ ID NO: 45479 - DNA, 89 bp, Homo sapiens
acagcatattgttcatgttgatcatggtgaatgcttgttttctcattgtaaaataatttactagtcatcagcatccccacagacgctgt

SEQ ID NO: 45480 - DNA, 87 bp, Homo sapiens
tatacatatgtgtgtgtatatatatatgtgtatatatgtgtatatatatgtgtgtgtgtctgtatgtgtatatatatatatatatat

SEQ ID NO: 45481 - DNA, 95 bp, Homo sapiens; identical to SEQ ID NO: 580

SEQ ID NO: 45482 - DNA, 93 bp, Homo sapiens; identical to SEQ ID NO: 69

SEQ ID NO: 45483 - DNA, 103 bp, Homo sapiens
gaggccagagaatcacttgaacctgggaggcagagtttgcagtgagcagagaccgtgctactgcactccagcctgggcaacagagtgagtgagactccatttc

SEQ ID NO: 45484 - DNA, 87 bp, Homo sapiens
cacaatctgggcttagtgcaacttctgactcctgggctcaagcgatcctcccacctcagcctctgagtcactgggaccacaggtgtg

SEQ ID NO: 45485 - DNA, 58 bp, Homo sapiens
tgagatggagtctcactgtgtcgctcaggctggagtgcagtggcatgatctcagctca

SEQ ID NO: 45486 - DNA, 115 bp, Homo sapiens
gcatatagacacgtatatatgtatgcgtgtatatatgtatacatatatacacacatatatgtatatatgtatatatgtgtatatatatatacacacacgtgtatatatatatata

SEQ ID NO: 45487 - DNA, 86 bp, Homo sapiens
gtgtgtgtatgtatacgtgtgtgtatatatatgtatacatatgtgtgtgtatatatgtatacatatatatatgtacatatatatat

SEQ ID NO: 45488 - DNA, 109 bp, Homo sapiens
gagagaaagaaggaaagagaggccgggggagagatgtagatataaatacaggcatactggttttattgtacttcactttattgtgcttctcagatattgcattttttac

SEQ ID NO: 45489 - DNA, 112 bp, Homo sapiens
ggattttcttggctatatgggctcctttttggttccatatgaaatttaaagtagttttttctaattctgtgaagaatgtcaatggtagcttgatgggaatagcattgaatcc

SEQ ID NO: 45490 - DNA, 142 bp, Homo sapiens
gtgtgtgtttgtgtgtgtgtttgtgtgtgtgtgtgtgtattagctgatgtgtatatatacacatacatatatatgtgtatatatgtgtatgtacacatacatatatatgtgtatatatatgtgtatgtgtgtatatgtgtgt

SEQ ID NO: 45491 - DNA, 77 bp, Homo sapiens
gtgtatacgtatatatacacatatatgtatatacgtgtatacatgtatatatgtgtatatatgtatatactatatgt

SEQ ID NO: 45492 - DNA, 116 bp, Homo sapiens
gtatacgtgtctatatatacatatgtacgtatacgtgtgtatatatacatatgtatatatgtgtgtatataagtgtgtgtatacatatagtacatacatatatgtatatacatata

SEQ ID NO: 45493 - DNA, 86 bp, Homo sapiens
atatataaataagcaactatatatcatacagttatatataaatatgtaactatatatcatatagttgcctgcaaatatttatatat

SEQ ID NO: 45494 - DNA, 73 bp, Homo sapiens
tatagttatatggttacatatttatatgtaagtagtatagttatatatagttacatatctccatataactata

SEQ ID NO: 45495 - DNA, 58 bp, Homo sapiens
gtggaacgtaaaggtctaacattcctgatgtggaatgtaaagatcttcgtgtatcctc

SEQ ID NO: 45496 - DNA, 74 bp, Homo sapiens
gagtatataggatatgatatgtattggtgagcacatctttgtaaaataccatttgctatcacatccgtatactc

SEQ ID NO: 45497 - DNA, 107 bp, Homo sapiens
acaaaacctatatatatatgtgtgtgtgtatacatatatgtgtgtatatatatatatgcatatatacacatatatttatatagatgtgtgtgtatatatgtgtatgt

SEQ ID NO: 45498 - DNA, 95 bp, Homo sapiens; identical to SEQ ID NO: 68

SEQ ID NO: 45499 - DNA, 93 bp, Homo sapiens; identical to SEQ ID NO: 69

SEQ ID NO: 45500 - DNA, 162 bp, Homo sapiens
atatactgtatatatatatacagtatatatatatactgcatatatatatgcagtatatatatactgtatatatatatatgcagtatatatatatatactgtatatatatatgcagtatatatatatatactgtatatatatatgcagtatatatattctgta

SEQ ID NO: 45501 - DNA, 110 bp, Homo sapiens
cagaatatatatactgcatatatatatacagtatatatatatatactgcatatatatatacagtatatatatatatactgcatatatatatatacagtatatatatactg

SEQ ID NO: 45502 - DNA, 114 bp, Homo sapiens
gatcccaggagactagatcttgaataattaatgtaacaaacattttattttaaaataattatgtgcattttgaatacaattttaattgagatttttcttcatttaatgggggtt

SEQ ID NO: 45503 - DNA, 115 bp, Homo sapiens
cactgttgagtagtattcctttttatgactataccatagtttgcctatttaaaagtagaaggatgtttagatttttaaagtttttggtattataaaggagctataaacatttgtg

SEQ ID NO: 45504 - DNA, 113 bp, Homo sapiens
gtatgagtgtggaacatgtttcttgttttctgctacattttgcttattgaatgaatagaatttatgtgtgtatgtgaggattaaacagaataatcatgtaaaaatactaccac

SEQ ID NO: 45505 - DNA, 76 bp, Homo sapiens
gcatatgttgaaccagccttgtatcccagggatgaagccaacttgatcatggtgcataaggttttcgatgtgctgc

SEQ ID NO: 45506 - DNA, 73 bp, Homo sapiens
gtgacagcttagctgggttatgaaaggtgacacctcttccacctgtctgcctgtctgcctgtctgtctgtctc

SEQ ID NO: 45507 - DNA, 92 bp, Homo sapiens
gtgtgtgtgtgagagagagagacagagacagagtgaagctggtagaaaacttggagttttgttcagtattgttttctagctcatagaatcat

SEQ ID NO: 45508 - DNA, 60 bp, Homo sapiens
tgagacagggtctcactctgtcacccaggctggagtgtgcagtggtgcaatcttggctca

SEQ ID NO: 45509 - DNA, 118 bp, Homo sapiens
aggctagcggttgaatacagatatttgcaatctttggtggtagagagaagacacccagcactacgcttgttccgttccctccctgggatgcacttccctgtcttctttaccctcccct

SEQ ID NO: 45510 - DNA, 77 bp, Homo sapiens
gagtgaagacagagaggactgttcagaaagtttccactaatgaattgctaatgactcctgagcctccttcttcactc

SEQ ID NO: 45511 - DNA, 56 bp, Homo sapiens
tgagacagtctcgctctgtcacccaggctggagtgcagtagcgtgatctcggctca

SEQ ID NO: 45512 - DNA, 116 bp, Homo sapiens
tcataaatgtaagacagtagtggcaggggacataagcaagattttttcttttttcttttttttttttttgtgatggagtctcactctgtcacccaggctggagtgcagtggcatga

SEQ ID NO: 45513 - DNA, 125 bp, Homo sapiens
gtgtatgaatatatgtacatatataatatatatgtgtgtatatatgtgtgtatatatatgtatgtgtgtggatgtatagatatatatatgtgtgtgtatgtgtgtgtgaatatacatatatatat

SEQ ID NO: 45514 - DNA, 112 bp, Homo sapiens
ggatgagtgggcctttgtgttatgtagatgaaaattagatatatagactattaatcctcaatatatttatgttttatccttagtaagactttctggggtctccttgctgtct

SEQ ID NO: 45515 - DNA, 108 bp, Homo sapiens
cacatctactttcatgaactctcttaatctctctccctgtctttataaaattattttattttgtaatacttttagatttacagaaagattatgatgagttcccatgtg

SEQ ID NO: 45516 - DNA, 115 bp, Homo sapiens
ctctggagtctctaccttcttggaacttgtacattagtgagaagattggctttttatttttttagtatttattgatcattcttgggtgtttctcagagagggggatgtggcaggg

SEQ ID NO: 45517 - DNA, 114 bp, Homo sapiens
aaacaataggtataacacgttttaaaatttctttatagagtatatgaatatatgtatatgcaaacatgtattaaaccaaatatgtattttataatctgtttggtacttatgttt

SEQ ID NO: 45518 - DNA, 85 bp, Homo sapiens
gtgtatgtacacacactatttatatatatgtgtttatgtgtatgtacacacactatttatatatatgtgtgtgtgtatgcttcac

SEQ ID NO: 45519 - DNA, 122 bp, Homo sapiens
tggaggaacaaaggggagtcagaagtccctgatctaatccttagaattgtaaagaagtcaggactattttgaggcatttgattttgtggaaatggcatctgtgctccacatgactgaggttt

SEQ ID NO: 45520 - DNA, 159 bp, Homo sapiens
atatgtgtgtatacatatacacatatatgtgtatatatatgtgtgtatacatatacacatatatgtgtatatatatgtgtgtatatatatacacatatatgtgcatatgtatatttgtgtgtatatatatatatacacacacacacatatatatatgga

SEQ ID NO: 45521 - DNA, 100 bp, Homo sapiens
atatgtgtgtatacatatacacatatatgtgtatatatatgtgtgtatacatatacacatatatgtgtatatatatgtgtgtatacatatacacatatat

SEQ ID NO: 45522 - DNA, 100 bp, Homo sapiens; identical to SEQ ID NO: 45521

SEQ ID NO: 45523 - DNA, 100 bp, Homo sapiens; identical to SEQ ID NO: 45521

SEQ ID NO: 45524 - DNA, 94 bp, Homo sapiens
gaaactgtgtacttgcatgagtatgatagttaatatcttaatatatttccaatatgattgtattgtctgttctgctcacatagtggactttttc

SEQ ID NO: 45525 - DNA, 58 bp, Homo sapiens; identical to SEQ ID NO: 1847

SEQ ID NO: 45526 - DNA, 108 bp, Homo sapiens
tatgtatacatatatacacatgtgtatgtaaatatgtgcttgtatatacacacatacatatgtatatacatatatatttatacatacatatatgtacatgtatatata

SEQ ID NO: 45527 - DNA, 117 bp, Homo sapiens
tagagattgtatatatgtatatatgttacataatatataaatatatataacatatacatatatacatatctatatgtatctatacatagatatatatctatatatgtatatatgtat

SEQ ID NO: 45528 - DNA, 84 bp, Homo sapiens
ctgggaaaagatagttgaattctatagaagtaaagggacttttcttaatcccacagcagtaagagtttatttattttttgacag

SEQ ID NO: 45529 - DNA, 100 bp, Homo sapiens
tagagaagcaaaatacatttcccttcacagtttcttcatctgacaaatcagggagttattagagacaatgaatgggacaacatatgtaaatcagtctcta

SEQ ID NO: 45530 - DNA, 92 bp, Homo sapiens
gagtagctgggattacaggtgtcagccaccatgcctgactaattttatatttttagtgcagacggggcttcgccatgttggtcaggctggtc

SEQ ID NO: 45531 - DNA, 94 bp, Homo sapiens
gtcaagggtgttgtgatgaagagtcctggatattgctaataagttctaatttaacatagtttgtttttgtctctgcataatatgcatccttatc

SEQ ID NO: 45532 - DNA, 58 bp, Homo sapiens
tgagatggactctcgctctgtcacccaggctggagtgcagtggcgcgatctcagctca

SEQ ID NO: 45533 - DNA, 152 bp, Homo sapiens
gtatatatatatgtattcagtatatatatatatgtatacacacattcagtgtatatatatatattcagtatatatatattcagtatatatatattcagtatatatatatattcagtatatatatatatattcagtatatatatatatatgag

SEQ ID NO: 45534 - DNA, 116 bp, Homo sapiens
atatatatataaccaaaagagaatagtggtggatatatatatatatatatataacatatatatgttcaatgtatatatattcaatgtgtgtgcatatatattctatatataaatat

SEQ ID NO: 45535 - DNA, 126 bp, Homo sapiens
atatgcaacttgtggctacatatatatatgtgtgtatatatatacacatatatacgtatatatatatgtatatatatatacacacacatatatatgtatatatatatatacatatatatatatggc

SEQ ID NO: 45536 - DNA, 77 bp, Homo sapiens
ggtgatttttttttttttgagacggactctcactctgtcattcaggctggagtgcagtggtgcgatctcggatcact

SEQ ID NO: 45537 - DNA, 102 bp, Homo sapiens
gtctacttgatcaatatctgatagaagtgtatgcaaaactccgattataattgtgattttgttcatttccagtctgtcagggttttgtttggttgtgtttgc

SEQ ID NO: 45538 - DNA, 86 bp, Homo sapiens
gttcagaagttagatggttgtatagaaatattagcatacatccatggagcaaaagattaatctatcagccatttcaatttcagaat

SEQ ID NO: 45539 - DNA, 65 bp, Homo sapiens
ttctgagaaatgcattgttaggtgactttgttattgtgaaaacatcctagagtgcatttacagaa

SEQ ID NO: 45540 - DNA, 119 bp, Homo sapiens
atatatatatatacacacatatatacatatatacatatacatatatatgtatatgtatatatggtgatacgtatatatgtatatgtatatgtatatatggtgattaaaggtgatatatg

SEQ ID NO: 45541 - DNA, 73 bp, Homo sapiens
gtggtgacagagggcatttttgtctggtaccagttttcaaggggaatgcttccagcttttgcccattcattat

SEQ ID NO: 45542 - DNA, 56 bp, Homo sapiens
tgtagcacatattgtgtgtacacacacacacacatgcacacacacatatgtgcaca

SEQ ID NO: 45543 - DNA, 62 bp, Homo sapiens
tgagacagagtctcattcactgtctcacccaggctggagtgcagtggcatgatctctgctca

SEQ ID NO: 45544 - DNA, 86 bp, Homo sapiens
catacatgaagtgtatttcttgtaggtaacagattgttgagtcattcagccactctgtgtctttcaattggggcatttagtgtatg

SEQ ID NO: 45545 - DNA, 101 bp, Homo sapiens
ggaagtgttccatgcttgtccttggctgaagaatgatagtttatgactcttttcctctcattggttatctagcagctttaattcatggcactctctagtcc

SEQ ID NO: 45546 - DNA, 112 bp, Homo sapiens
cagtgattaggttgttctatgtgcttttactgattttttttttttttttcagataaaagatgaacagaaaaatgatgatagtcttgagcaatgcatttcctcttccattctg

SEQ ID NO: 45547 - DNA, 111 bp, Homo sapiens
gttgttgattgtctactgagtaaaagacattatgtttggttttctaagtgaattaatatttaaagagtttgagatacaatgtagtaagccaagggtagagaatatgtaaac

SEQ ID NO: 45548 - DNA, 104 bp, Homo sapiens
ttcacttttttttggtggtggttggggggactccatatgctattctgttggctgtgcatgatttcacccattttaggaggctgctcaccgtgttaagtagcgaa

SEQ ID NO: 45549 - DNA, 101 bp, Homo sapiens
atggttcataatttgtttataagtacaaatatatagatatatttatacatatttatgtataaatatttatatgtgtatatgagtaaattctgttgagtcat

SEQ ID NO: 45550 - DNA, 67 bp, Homo sapiens
tgtgtgtatatatatctggtgtatatactatatatatagtgtatatacacacacacacacacacaca

SEQ ID NO: 45551 - DNA, 102 bp, Homo sapiens
agcaatgttgggaggatagaacttatttggagaacgtttatggcctaatagcttggtaaaatgtgaatcttcatgaaagtggtttgccaactctaaattgct

SEQ ID NO: 45552 - DNA, 104 bp, Homo sapiens
cattcacaatatgagccaaatggactgagagcactcccctgtatatacatatttcttacgatagagaatttcttgttgtccatttgatagtgcatgtatgattg

SEQ ID NO: 45553 - DNA, 83 bp, Homo sapiens
tatatatatatgtatgtatgtgtatatatatataaatatatatatgtatgtgtatatatatatgtatgtatgtgtatatatat

SEQ ID NO: 45554 - DNA, 112 bp, Homo sapiens
ctgccttttctaagattctagtgtaagttttatttgtgatgagcatatatatatatatacatgttacattaaaataatgatcagcaactttagagtacaagaaagggaggca

SEQ ID NO: 45555 - DNA, 101 bp, Homo sapiens
aactcgttcctttttatagctgcatagtattccatggtgtgtatatatgtatatataccacattttctttatccagtctatcattgatgggaatttgggtt

SEQ ID NO: 45556 - DNA, 148 bp, Homo sapiens
ccaaagggtctgggtgacttggctgtttttatcttatttttattttatttatttatttatttattcttttaagacagagtctcgctctgtcacccaggttggagtgcagtggcatgatttccgctcactgtgacctctgcctcctggg

SEQ ID NO: 45557 - DNA, 93 bp, Homo sapiens
ggaaaagtatccttgtaaaaagagaaatattcttattttaattgtgtgaaactctatttttttttttggagggggcgttcaatttttttttcc

SEQ ID NO: 45558 - DNA, 95 bp, Homo sapiens; identical to SEQ ID NO: 68

SEQ ID NO: 45559 - DNA, 93 bp, Homo sapiens; identical to SEQ ID NO: 69

SEQ ID NO: 45560 - DNA, 118 bp, Homo sapiens
cgaggtgcagctgcctgtgtgtctgcctgctagggtctcgggttttgttttgtttttgtttttgttttgagacgagtctccctctctcgccaggttggagtgcagtggcaagatctcg

SEQ ID NO: 45561 - DNA, 62 bp, Homo sapiens
tatatgtgtatatatgtgtgtgtatacatatatatgtgtatatatatgtgtgtatatatata

SEQ ID NO: 45562 - DNA, 80 bp, Homo sapiens
cactatatatatgtgtgtgtgtatgtatgtatatatgtaaacatatacatacataaattgtgtttttatatgtgtgtgtg

SEQ ID NO: 45563 - DNA, 87 bp, Homo sapiens
tacatatatacaagaaaggacatatatgtgtgtatatatttatacttgtatatatacacatatatgctttctttttgtatgtgtgta

SEQ ID NO: 45564 - DNA, 95 bp, Homo sapiens
ctattgccagagtcctcacagagtaaagtgtactgattttgttgaagtagagtttatcaatttttcatggtacggattgtgattttggtatctag

SEQ ID NO: 45565 - DNA, 114 bp, Homo sapiens
aatgtgtcactctaagtaaattggcactgtttatcacatatatatatatgtgtgtgtatatatatatatatatatatatctcagagtcttagagctaattgcttctttcatgtt

SEQ ID NO: 45566 - DNA, 93 bp, Homo sapiens
tgtgtgtgcgtgtacatgcatatgtataaataaaaaatatatattttataatatttaggtgtttattagtttatgcatatacacacatacata

SEQ ID NO: 45567 - DNA, 84 bp, Homo sapiens
taaaatgtatgaaatgtatagcttcctgtgtctggatttactttttttttacattaatgaagttgtacattgtgtattattttg

SEQ ID NO: 45568 - DNA, 88 bp, Homo sapiens
cccataccatagctttggttctctaagtgtatatatatgtatacatgtgtccccaagtagcaagtgaggttaggattgtggaagtggg

SEQ ID NO: 45569 - DNA, 97 bp, Homo sapiens
tgtttctgtggttcctggccagtggcatgatgaagggcatatattttatttttatctgcccacaatcttgttattgttgtcaagattaggagagaca

SEQ ID NO: 45570 - DNA, 83 bp, Homo sapiens
gaagctatttatttatactttatactacatcattatggttcaaaaccaaaaggaatcgtgtggtataaaatgaagtatgtttc

SEQ ID NO: 45571 - DNA, 83 bp, Homo sapiens
tctcataggaacaatgatgattgcgggcgtgtgggctcctgttgctcactgctttcacagtcagcacacaaagacctagtagg

SEQ ID NO: 45572 - DNA, 89 bp, Homo sapiens
gcagacagccaccttctctctgtgtccttatgagagagagacagagacagagacagagagagacacagagagaaataagaacctgatgc

SEQ ID NO: 45573 - DNA, 74 bp, Homo sapiens
cctttgtgttctgacattgatgttactgtcagttgacagtgagctttatcatcaatcccttcaagtacaaaagg

SEQ ID NO: 45574 - DNA, 62 bp, Homo sapiens
tgtgtgtgtgcatgtgtgtgtgtgtgtgtgtgtgtgtatatatatatatatgtacctataca

SEQ ID NO: 45575 - DNA, 92 bp, Homo sapiens
ccatttatttatttacttatttatttaactttacgttctgggatacacatgcagaatgtgcaggttacatagatatacatgtgccatggtgg

SEQ ID NO: 45576 - DNA, 120 bp, Homo sapiens
gagccaggcatccttgtttgtggggatgggtgtggcatgattgtcagtgggtgttgaatttcatttcaattccaacaaggtctcgcatacacacccacaggattgaggatagcttccttc

SEQ ID NO: 45577 - DNA, 88 bp, Homo sapiens
tgagattattgaatccttggttgttagtcgatgtagctagaaaagttttaattatgacgactttacacataggaaaaataacatctca

SEQ ID NO: 45578 - DNA, 105 bp, Homo sapiens
atgtgtacatatatgtgtgtgtgtatatatatatgtatgtgtgtatatatatacatgtatgtatataaatatatatatgtatgtatataaatatatatatatata

SEQ ID NO: 45579 - DNA, 58 bp, Homo sapiens; identical to SEQ ID NO: 1936

SEQ ID NO: 45580 - DNA, 74 bp, Homo sapiens
tctgctgactgttttctgtcagacattcttttttattatatgtcagagagaatgtgttaagaaaacagtaaaga

SEQ ID NO: 45581 - DNA, 74 bp, Homo sapiens
gtgagacagagtctcgctctgtcacccaggctggagggctggagtgcagtggtgtgagtgcgatcttggctcac

SEQ ID NO: 45582 - DNA, 80 bp, Homo sapiens
ggtgtgagcctctgtgtcctgataaaaattgaggttttttttttttttttttttgggagacagactcttgttctgtcact

SEQ ID NO: 45583 - DNA, 68 bp, Homo sapiens
atgtatatatatgtatatatatgtgtgtgtgtgtatatatatatatatatatatatatatatatatat

SEQ ID NO: 45584 - DNA, 105 bp, Homo sapiens
ctaagtggcaatgctatgataaatgtggtgtatgatttgtatgtatatcatataaatatgaatatacatatatatatatgacctatatggcaagcattgctctag

SEQ ID NO: 45585 - DNA, 80 bp, Homo sapiens
tataaatatacatatatatgtgtatatagatagcttatatatacatacatatatatgtgtgtgtatatatatatgtgtgt

SEQ ID NO: 45586 - DNA, 96 bp, Homo sapiens
tcctatcgctctgcccgggctcatcattttctgttttgaatatttgttattcattatgatgagatgaatgcatagcctgtctgccaggtccttgga

SEQ ID NO: 45587 - DNA, 59 bp, Homo sapiens
tgagacaagagcctcactctgtcactcaggctggagcgcagtgaggtgatcttggctca

SEQ ID NO: 45588 - DNA, 92 bp, Homo sapiens
ggtgattagaaggaagatgaagtcggccaggtcagatctctgtcactgtctcagttacaattctgcaatggtggttttcatattctgtggcc

SEQ ID NO: 45589 - DNA, 108 bp, Homo sapiens
ggaaattggaacctagtacttctttcaagggcagtgtttggatgtggatgccatggggtttgaatactgtttttgtagatgaaagcttggagaaattcctaagtttct

SEQ ID NO: 45590 - DNA, 74 bp, Homo sapiens
gaattagcatgtttatatatgcatatatacatatatatatgtgtgtgcgtgtatatataatatatggtactttc

SEQ ID NO: 45591 - DNA, 63 bp, Homo sapiens
tatctatttatctatctatctctacctatcacttatctgttgatagatagatatctatagata

SEQ ID NO: 45592 - DNA, 95 bp, Homo sapiens; identical to SEQ ID NO: 6311

SEQ ID NO: 45593 - DNA, 56 bp, Homo sapiens
gtgtgtgtgtctgagtgtgtgtgttttaaggcacggtgtcactctatcactcaggc

SEQ ID NO: 45594 - DNA, 102 bp, Homo sapiens
tgttagaatatagtcgtactttttgtactctacaagtaaatgaaaattaagattttttttgtactttaaatgtattataagaagttacacactggtctgata

SEQ ID NO: 45595 - DNA, 115 bp, Homo sapiens
agcatcttgaaaactggtccttgttcttaatggtggctgtttgttgaaagtctaaaaactgtgtttatctttttaaaaattaggatttgctacctgagatcaagccagagaagct

SEQ ID NO: 45596 - DNA, 84 bp, Homo sapiens
gatagatgcctgaatagaacaaaaggtgaggtaagagagaatttcctctctctgcctgactgcttttgagctgagacattgctc

SEQ ID NO: 45597 - DNA, 78 bp, Homo sapiens
catcttacccgcagcattccatgccaatttgtcatttgattgtgtgtgcatgtgtatctgtgtgtctgtgtaagtatg

SEQ ID NO: 45598 - DNA, 56 bp, Homo sapiens
tgagagagtctcgctctgtcacccaggctggagtgcagtggtgtgatcttgactca

SEQ ID NO: 45599 - DNA, 80 bp, Homo sapiens
gtgagaacatgtgatatttggttttcttcctgttttagtttgcaaaggataatggacttcagctctatccatgttcttgc

SEQ ID NO: 45600 - DNA, 102 bp, Homo sapiens
gattagctaaaattgcattgaaggtatttacatttatattaatgaagtgtattggactgtccttttcatttattgtaagtccttgtgtgattcaggttgatt

SEQ ID NO: 45601 - DNA, 111 bp, Homo sapiens
tgagatagtagtgaaggagaagaattcaagaaataattactagatagaatcattcatttattgaatattttagaaaacaataaatacctcttgagttctgactgtgtctta

SEQ ID NO: 45602 - DNA, 110 bp, Homo sapiens
gttagattagaatttcagataaacagcaaataattgttttaatataagtatgtccgccaaactgtagatatactgaaagctattgctgtttatttgaatctaaatttaat

SEQ ID NO: 45603 - DNA, 104 bp, Homo sapiens
gtgtgtgtatatatacgtgtctatatctacatatatatacatatgtatatatgtgtgtgtatatgtagatatagacatatatatttatgtgtgtatatatgtgt

SEQ ID NO: 45604 - DNA, 119 bp, Homo sapiens
gcaattattattacagttattttggtatggcaatgtcctaaatctctacttgagtttttttattttttaataatagattcagggggtacatgtacatgcttattgtatgtgtattttgc

SEQ ID NO: 45605 - DNA, 117 bp, Homo sapiens
tcacccatggcatgtgtggggtggtgccaagtgccttatgtataccccttctttaatcttcagggcaatgctgtgagtttgtcattagagataccactttgcagatgtggagactga

SEQ ID NO: 45606 - DNA, 93 bp, Homo sapiens
tatattatatagtatactctttatatatatctctctccacatatatatatgtagagagacagaatatatatatatagaatactatataatgta

SEQ ID NO: 45607 - DNA, 97 bp, Homo sapiens; identical to SEQ ID NO: 1307

SEQ ID NO: 45608 - DNA, 88 bp, Homo sapiens; identical to SEQ ID NO: 1308

SEQ ID NO: 45609 - DNA, 81 bp, Homo sapiens; identical to SEQ ID NO: 1309

SEQ ID NO: 45610 - DNA, 77 bp, Homo sapiens; identical to SEQ ID NO: 1310

SEQ ID NO: 45611 - DNA, 85 bp, Homo sapiens
tctgggttctgatatccccttgccagctctatttccatttgatttttatttataagtagacaagatggtacatggcaggtccaga

SEQ ID NO: 45612 - DNA, 117 bp, Homo sapiens
ggtatgtgcattcgaatcacatagcagtgactggagtcctgagctgtgtctgaagactgtgagatcacgtttggagctgctgattggttttcagtgatggccctgttgcacagtgcc

SEQ ID NO: 45613 - DNA, 95 bp, Homo sapiens; identical to SEQ ID NO: 68

SEQ ID NO: 45614 - DNA, 93 bp, Homo sapiens; identical to SEQ ID NO: 69

SEQ ID NO: 45615 - DNA, 115 bp, Homo sapiens
tataacacttttgccacctattgatagagcgaaaagtttgtttaactttgatttttcattcagaattgtgtaagctgaactaattgagatgtctaggtattggctattgtttata

SEQ ID NO: 45616 - DNA, 118 bp, Homo sapiens
ttgtgtctcaaatctgtttgttctcaacaaagagccagaagacactgagaagctggaccaagttttatttttcattaagtggggttatgagaataaacaagaaatattgctaacataa

SEQ ID NO: 45617 - DNA, 109 bp, Homo sapiens
gttgcagtggaatggttgcacatttacattgctgatggcagtaagtttttataaatcttttctaggaagcatgttgtcaaatggtgtaaatatattcctatttagtaat

SEQ ID NO: 45618 - DNA, 200 bp, Homo sapiens
tatacatgtatatatatacaaagacatatatacatgtatatgtatatatatacacacgtatgtatatgtatatatgtatatacgtatacatgtatatatgtatatatgtatatgtgtgtatatatgtgtatatatatgtgtatatgtgtatatatgtgtatatatgtatatatatgtgtatatatgtatatatatgtgta

SEQ ID NO: 45619 - DNA, 105 bp, Homo sapiens
gacaaagattgagtgtctagaggcaaggtcagcatgatgtttagaaatcagtgttttacaaaacttatggatcatcagaatcacttttttttgtcacactgaatc

SEQ ID NO: 45620 - DNA, 76 bp, Homo sapiens
catacagtgagtgagtagacaaggaggaaccttttccattcttcttggctgtctgctttacttctaatttgatatg

SEQ ID NO: 45621 - DNA, 64 bp, Homo sapiens
tgccaggagcacttccctgtcagagccacactctgtgtctgccacaggaaagcttctcttggca

SEQ ID NO: 45622 - DNA, 103 bp, Homo sapiens
tatatgtgaaagtgatacatagatatgtatacgtgcatgagagtgtttacaagtgtatataaacatgtatgtacatatatgtatgtgtatacatacatatata

SEQ ID NO: 45623 - DNA, 95 bp, Homo sapiens; identical to SEQ ID NO: 68

SEQ ID NO: 45624 - DNA, 93 bp, Homo sapiens; identical to SEQ ID NO: 69

SEQ ID NO: 45625 - DNA, 72 bp, Homo sapiens
ccacagagccactgtctgtctgctcacctgctgacaggatacaagcagatcacgcaggcttggggcaggtgg

SEQ ID NO: 45626 - DNA, 80 bp, Homo sapiens
ggaccttcaacaagcctctgcctctctctgggtcccatctgagaaacagggaggaggtgttgtactgaagaactaggtct

SEQ ID NO: 45627 - DNA, 118 bp, Homo sapiens
tatgtatgcatatatatgtatatatgtatatatgtacatatatacagatatatatgtatatatatctgtatacagatatgtatatatgtatatatgtgtatatatgtatatatgtata

SEQ ID NO: 45628 - DNA, 221 bp, Homo sapiens
catgctatatatgtatgtatacatgcatgtgcgtatgtatgtatacatttatgtaaatatatagatgcatgaatacacatatgtatatgtaaatatgtatatgtacataaatgtgtatgtacacttatataggtgtatatgcatgtacatatgtatgtgtatatgtatatgtgtatatctacatatgtatatgtgtatatatacctttatgtacatatata

SEQ ID NO: 45629 - DNA, 58 bp, Homo sapiens; identical to SEQ ID NO: 1101

SEQ ID NO: 45630 - DNA, 56 bp, Homo sapiens; identical to SEQ ID NO: 1102

SEQ ID NO: 45631 - DNA, 85 bp, Homo sapiens
tgtacatgtgtgtgtatgtatatgtgtgtgtgtatatatacatatatatacacacacacacatatatatatatgacacatatata

SEQ ID NO: 45632 - DNA, 66 bp, Homo sapiens
gcatatgcatgtgtatgcatgtaggtatgagtgtacatgtatgtatgtgtatatatatgtatgtgt

SEQ ID NO: 45633 - DNA, 92 bp, Homo sapiens
gtatatatgtgtgtatgtatgtgtgtatgtatatgtgtatatatatgtgtgtatgtatatgtgtatatatatgtgtgtatgtatatatgtat

SEQ ID NO: 45634 - DNA, 176 bp, Homo sapiens
atatatgtatgtgtatatatatgtatatatgtatgtatctatatatgtatatatgtatgtgtgtatatacacatatatgtgtgtgtatatatgtatatatgtacatatgtgtatatatgtatatatgtgtatatatgtatatatatgtgtgtatatatgtatatgtgtgtatatat

SEQ ID NO: 45635 - DNA, 115 bp, Homo sapiens
agccaggacttatagcccacatggcattgagtgtttcctaactgtttaccactctgcctctcactgtgaccacagagatggaaaaatcaaagacatgaaactgcatgtccaggtt

SEQ ID NO: 45636 - DNA, 118 bp, Homo sapiens
tcagggatatagtttattttacatctcctcaaatctgacttctcctacagttttttctattttgaaaattttatatttttcatgtttgggagaacatggtaagtgtatatatttatga

SEQ ID NO: 45637 - DNA, 118 bp, Homo sapiens
aggtaccattgtcatcacctagaccactgtccccccttttttttttagacagagtctcactctaagagtctcgctctatcacccaggctggagatcagtggcatgatcttggctcact

SEQ ID NO: 45638 - DNA, 93 bp, Homo sapiens
tgtactccagcctgggctgagagtgtgagtccctgtctcactaaaaaacaaaaacaaaaacaggagactgaatattctctcttagtgggtaca

SEQ ID NO: 45639 - DNA, 81 bp, Homo sapiens
gtcatcataggacagtttatctcatgaagtttggggtctgttccattgtcataatgtcagatgagcctgtgcagtggtgtc

SEQ ID NO: 45640 - DNA, 108 bp, Homo sapiens
agcaaatttgtctacattcccgttagagtgtgatttatttattttttttttagctgggcatggtggcatgtgcttatagttccagttccttgggtggcagaggcggga

SEQ ID NO: 45641 - DNA, 58 bp, Homo sapiens; identical to SEQ ID NO: 1409

SEQ ID NO: 45642 - DNA, 80 bp, Homo sapiens
gtctgtacagagactgacttgaggtttttttttttttttttttttttttttgagacagagtctcgctctgttgcccagac

SEQ ID NO: 45643 - DNA, 77 bp, Homo sapiens
gtgtgttttttttttttttgagacggagtctcactctgtcgcccaggctggagtgcagtggccggatcttggctcac

SEQ ID NO: 45644 - DNA, 85 bp, Homo sapiens
gaggcttgatgagctggggagggccagaagcagcctggtccagcctgaaggtctctctctctctctccagttcacctatgacttc

SEQ ID NO: 45645 - DNA, 163 bp, Homo sapiens
cccaggctggagtgcagtggtgcgatctcagctcacttcaacctccacctcctgggttcaagagtttctcctgcctcagcctcccaagcagctgggattacaggcacatgccaccacacccagctttcaccacgttggccaggctggtctcaagctcctgacc

SEQ ID NO: 45646 - DNA, 131 bp, Homo sapiens
tgccagagttgagggcattgacctgaaaacttttacaagctttgtattttgtgagacagtgtctcactctgtcacccaggctggagtatagtgggacagtctcggctcactgcagcctctgcctcctgggt

SEQ ID NO: 45647 - DNA, 78 bp, Homo sapiens
ctagtcatgttctaacagtggacaacctgcttttatttttttttttgagacagggtctcactctgtggctcaggctgg

SEQ ID NO: 45648 - DNA, 56 bp, Homo sapiens; identical to SEQ ID NO: 2604

SEQ ID NO: 45649 - DNA, 81 bp, Homo sapiens
tgcacaccaccacgtctggctaattgttactttttcttttttcaatatagagtcacattctgttagccaggctggggtgca

SEQ ID NO: 45650 - DNA, 123 bp, Homo sapiens
gtgtgtatatatatatatacacgtatatatgtgtatatatacgtatatgtgtgtgtatatatgtatatatgtgtgtgtatatacgtatatgtgtgtatgtatatacatatatatgtatatata

SEQ ID NO: 45651 - DNA, 87 bp, Homo sapiens
tggaaggggctgctggggtagctgtcaaaggtttatttatgtattatttatttatttcctaaaggcaggatctcactctgtcatcca

SEQ ID NO: 45652 - DNA, 100 bp, Homo sapiens
ttgtaccctgctcagagctaaccacccagtgactggttttgttttgtttttttgagacacaatctcactgtgtcacccaggctggagtgtagtggtgcaa

SEQ ID NO: 45653 - DNA, 62 bp, Homo sapiens
cccaacaggaaagagtgtctgcacagagggtggggacagctgggcgacacttccctgagggg

SEQ ID NO: 45654 - DNA, 80 bp, Homo sapiens
gtgtgtaagcaaaaatgtgtgcatgtgcatatatgtgtgtgtgcatgtatgtgcatgtgcatgtgtgtgtgcatgaacac

SEQ ID NO: 45655 - DNA, 119 bp, Homo sapiens
tctgtatagccccagcactgtacccagagccaagtatgtatgaatgtatgtatatatgtgtatgtatgagcatatgaatggatggatggatggatggatagatggatggagatacatga

SEQ ID NO: 45656 - DNA, 73 bp, Homo sapiens
ttgtttttttgagacagagtctcactgtgtcatccaggctggagtacagtggcgagatctcggctcactgcaa

SEQ ID NO: 45657 - DNA, 96 bp, Homo sapiens
ctggcatctttcttacttcatctatacactctactttctttgctgaggccgcactggcctccctgaggttccttgtacatgaaaagtatgttccag

SEQ ID NO: 45658 - DNA, 103 bp, Homo sapiens
gagggactacaggcacgcaacaccatgcccagccaatttttgtatttttaatcgagacggggtatcactatgttggtcaggctggtcttgaactcctgacctc

SEQ ID NO: 45659 - DNA, 107 bp, Homo sapiens
ggtgctcagtgtcttacctcacctacgggcagcagctgtcttcacctgagtgtgtgcacacaggtgtatcagccccatgggcagtgatggacgagggctgaggcact

SEQ ID NO: 45660 - DNA, 110 bp, Homo sapiens
gctgggattacaggcgtgagccactgcatccggctgtgaaacttttttttttttttttgagagagtctcgctcagtcacccaggctggagtgcagtggcgcgatctcggc

SEQ ID NO: 45661 - DNA, 117 bp, Homo sapiens
ctgtatttttgtacgcttgttctttgtatcctcttttatttccttatttatttttgagacagggtcttgctctgtcgcccagactgagtgtagtggcatgctcacggcttactgcag

SEQ ID NO: 45662 - DNA, 115 bp, Homo sapiens
cacagcctcactggtgataaactgaattctatactttattttatttctattttattttattttatttatttattaagatggagtctcactctgtcatccaggctggggtgctgtg

SEQ ID NO: 45663 - DNA, 105 bp, Homo sapiens
gtgctgggattacaggcatgagccaacgtgcccagccaatccagataatctttgtattttttgtagagatggggtttcgccatgttggccaggctggtctcaaac

SEQ ID NO: 45664 - DNA, 91 bp, Homo sapiens
ctcagagccttgaggtctcagaacagattctgcacatgatgagtcagtcatcacacctggaggagctggtgctggagacctgcagcctgag

SEQ ID NO: 45665 - DNA, 116 bp, Homo sapiens
gctactgcactccagctaagtgacaaagcaagaccctgtttttttttgttgttgttgttgtttttttttttttgagacgaagtctcgctctgtcgcccaggctggagggcaatggc

SEQ ID NO: 45666 - DNA, 118 bp, Homo sapiens
gagtagctgagaatacaggcttgcaccaccacacctggctaactttttatatttttggtagagacggggtttcaccacgttggccaggctggtctcgaactcctgacctcaagcgatc

SEQ ID NO: 45667 - DNA, 68 bp, Homo sapiens
atctggttgttggccttgtggatattatggtcagttctgactgtgtgtgcacttggcaacaatttggt

SEQ ID NO: 45668 - DNA, 143 bp, Homo sapiens
ccagtagcaggtggctttgtgcggttgctgtcttagagattattggcatgtagatgggtttcttttttctttttttttttttttgagacggagtctcgctctgtcacctaggctggagtgcagtggcatgatcttggctcagt

SEQ ID NO: 45669 - DNA, 115 bp, Homo sapiens
gtggtggtggcctaggctgggtccagattttgagactttggtgtttgtttatttatttatttatctgagacagggtcttactctgtctcccagactagtgcagtggcacagtcac

SEQ ID NO: 45670 - DNA, 114 bp, Homo sapiens
gggtgacttgaccaggagagtttttgtttttctctcgagacggagtctctctctgtcacccaggctggagtgctgtggtgcgatgtcggctcactgcaacctccgcctcctggg

SEQ ID NO: 45671 - DNA, 58 bp, Homo sapiens; identical to SEQ ID NO: 14682

SEQ ID NO: 45672 - DNA, 111 bp, Homo sapiens
gggattacaggcgtgagccaccgcaccgggccgaatatttttttctatatatatgttagtatacagacacaaaaatgagaggtgacagcgtgctggcagccctcacagccc

SEQ ID NO: 45673 - DNA, 67 bp, Homo sapiens
ctggtgtgggtgctggggatcacttttttttttttaagaccgagtctcgctctgtcacccaggctgg

SEQ ID NO: 45674 - DNA, 69 bp, Homo sapiens
gctggaaccttgaagaagggaagcctgctcttgataacaggagagattttcttcatttgaatttctgac

SEQ ID NO: 45675 - DNA, 57 bp, Homo sapiens
tgagacagagtctcactctgtcacccaggctggagtgcagtgtgcgatcttggctca

SEQ ID NO: 45676 - DNA, 81 bp, Homo sapiens
cctggaggagcagctagcgggtctctgggaaaaacttttttttttttttttttttgagacagtctcgctctgtcacccagg

SEQ ID NO: 45677 - DNA, 112 bp, Homo sapiens
ttcggctacaatgaaaaactgaatctcattacctctggatttacatcgactccaatttcaaagattatatttatttcagaggggatgaaaaagcatttttcactaggaagaa

SEQ ID NO: 45678 - DNA, 117 bp, Homo sapiens
caaagggagctattttgagtgaaagggaggaccatgagtgatatttttattttatataatgaggtttatttcgctcataattgttaagcctctttttgaaaaaggaagaactgccct

SEQ ID NO: 45679 - DNA, 125 bp, Homo sapiens
ggagcaagccgtgagcaagggaggaacaggtgtggtggtgggacagaaagggaactgagagtggactcagggaggtggagccacttagggaatcctgccttgccagggccatgcctttgaggacc

SEQ ID NO: 45680 - DNA, 56 bp, Homo sapiens
ccagtgtacactggacattggtatggctggatgcctgtctttgcccagtagcctgg

SEQ ID NO: 45681 - DNA, 86 bp, Homo sapiens
gtcacagctgggtttcacagtgtctctttttttttccacttttttttttttttttgagacagggtctcactctgtggcccaggctg

SEQ ID NO: 45682 - DNA, 70 bp, Homo sapiens
agtcaggtcatctctctgttgactgggtccagggcttttatgggctcagaatggggagtgtgtgctgatt

SEQ ID NO: 45683 - DNA, 95 bp, Homo sapiens; identical to SEQ ID NO: 68

SEQ ID NO: 45684 - DNA, 93 bp, Homo sapiens; identical to SEQ ID NO: 69

SEQ ID NO: 45685 - DNA, 58 bp, Homo sapiens; identical to SEQ ID NO: 6359

SEQ ID NO: 45686 - DNA, 58 bp, Homo sapiens
gggcacacctgtggtcccagctactcagcaggctgaggtaggaggatcatttgagccc

SEQ ID NO: 45687 - DNA, 58 bp, Homo sapiens
tgagacggagtctcgctctgtcgctcaggctggagtgcagtggcgggatctctgctca

SEQ ID NO: 45688 - DNA, 103 bp, Homo sapiens
agaaagcagggcctgagtggagagggtagaatgttggatccctgaatcccacagctattaataacaagctctcccggccccccaccccaagagtgcttagtct

SEQ ID NO: 45689 - DNA, 77 bp, Homo sapiens
tttccttaaaataagaaaggataacagatgagggttttttttttctttcaatttttactttttttattttttggaaa

SEQ ID NO: 45690 - DNA, 58 bp, Homo sapiens; identical to SEQ ID NO: 1725

SEQ ID NO: 45691 - DNA, 114 bp, Homo sapiens
ggcagtggtgactaaatgggcactttttctttctttcttttttttttttaatttttctgagacagagtctcgctctgtcacccaggctggagtgcagtggcgcgatcttggctc

SEQ ID NO: 45692 - DNA, 98 bp, Homo sapiens
attttcaaatactgaattagtattgtattactggactattcctcattaggttggggtgcataagtctttttatatattgttagattctatttgaaaat

SEQ ID NO: 45693 - DNA, 84 bp, Homo sapiens
ggatctcactctgtctgtcaggctggagtgccttggcgtgaccatagctcactgcagcctcaacctcccgggctcaagtgatcc

SEQ ID NO: 45694 - DNA, 58 bp, Homo sapiens; identical to SEQ ID NO: 2248

SEQ ID NO: 45695 - DNA, 71 bp, Homo sapiens
ggctgaggtaggaggatcatttgagcactggagccacttcactccagcctggattcacttctggctctgcc

SEQ ID NO: 45696 - DNA, 60 bp, Homo sapiens
cacagtggctcacacctgtaatcccagcactttgggaggctgaggtaggtggatcacttg

SEQ ID NO: 45697 - DNA, 118 bp, Homo sapiens
ggaaagctgtcacagtgacatccctgtagtcccagctagctgggaggctgaggtagaagcatcacccgagcccagaagtttgaggctgcagtgtactatgatcacttctgtgaatagt

SEQ ID NO: 45698 - DNA, 108 bp, Homo sapiens
gtattatgcatataccatcatatgtgcatatgttaatgtatgtatatattaacatgtatgtgcatacacacatacattaacatatacacatgatggtacaattaatgc

SEQ ID NO: 45699 - DNA, 111 bp, Homo sapiens
ctaatgggtgtgaaggggtatctcattgtgatttgatttgcacttcactcatgactagtgatgttgaagatctttttatgagttcattgcccatttgtaaatcttcattag

SEQ ID NO: 45700 - DNA, 81 bp, Homo sapiens
caggtgagtgctccaagttaatgagcaagtctgtccctacagaagttttttgtttgttttttgagaaggagactcactctg

SEQ ID NO: 45701 - DNA, 58 bp, Homo sapiens; identical to SEQ ID NO: 6967

SEQ ID NO: 45702 - DNA, 86 bp, Homo sapiens
catgtttgtgtatagatccttcagtcactcgagcttttggaaactgcgttttggttcctgtggatctagtcaccccagagagcgtg

SEQ ID NO: 45703 - DNA, 90 bp, Homo sapiens
attttgtatgtatttctataatagtgcttaatatactgagtcataattatttattcattagtagagtatagtaatggttacatgcttgat

SEQ ID NO: 45704 - DNA, 119 bp, Homo sapiens
gctcaaaaacgaccatttgcttctggagtgggaagcctactgacttaaatattgatccctgatcattttttttttaaagtctggatatctgacatagaaaaagtgagttatttctgagt

SEQ ID NO: 45705 - DNA, 80 bp, Homo sapiens
cgtgccatggcacccagctaagagctcctcttttttttttttttttttgagatggagtctcgctctgtctcccaggcagg

SEQ ID NO: 45706 - DNA, 112 bp, Homo sapiens
taccaattatttaagccattaaagtttttaagtcatacgagaactttatgaaggcactttatatgtctgtagttttgatgatatgaagactaagaagcagtaaatataggta

SEQ ID NO: 45707 - DNA, 66 bp, Homo sapiens
ctttgggaggctgaggtaggaggatctcttgaagccaggggctccagaccagcctgggcaacaaag

SEQ ID NO: 45708 - DNA, 100 bp, Homo sapiens
gtgtatatgtatatatactatcctatacaatagaactatatatatataatcatactcaatagaactagatatatataggatgtagcaatatgcatagaac

SEQ ID NO: 45709 - DNA, 89 bp, Homo sapiens
tgcccgggggcatggcatgcactcacatgtgtgttcgcgcttgtgagcagtgtgtgtgctcactcccagctcccattatgttccaggca

SEQ ID NO: 45710 - DNA, 105 bp, Homo sapiens
tttgacagaagagcctcagcagtttccttttattttttaacattttttatttaattaaattaaatagagagagagtctcactatattgcccaggctggtctcaaa

SEQ ID NO: 45711 - DNA, 60 bp, Homo sapiens
gtgagacagagtctcacactgtcgcccaggctggagtgcagtggtgtgatctcagctcac

SEQ ID NO: 45712 - DNA, 71 bp, Homo sapiens
gcgtgggcacagcttgaggaggagaggaacctggcaaggttgatcaatccacagatgagtgtgtccagagt

SEQ ID NO: 45713 - DNA, 58 bp, Homo sapiens; identical to SEQ ID NO: 605

SEQ ID NO: 45714 - DNA, 58 bp, Homo sapiens
tgagactgagtctcactctgtcgcccaggctagaatgcagaggtgtgatctcagctca

SEQ ID NO: 45715 - DNA, 160 bp, Homo sapiens
ggcaggaaacatccagcacagaagaaagatgtagactgggaggctaggccagtctagccccacttatttttttttttttttttggtgaggtgagtctctgtcacccaggttggagtacagcggtgtgatctcggctcaccgcaacctctgcttcctgggt

SEQ ID NO: 45716 - DNA, 58 bp, Homo sapiens
tgagacagggtctcgcactgtcgctcaggctggagtgcagtggcgcgatctcggctca

SEQ ID NO: 45717 - DNA, 105 bp, Homo sapiens
tacagtttcccacactttggattttgctgtgtgtctccctaaagtgtgggtctgtgtgtctctctgtccctcatgggcagatctagaggctgagactgaccttgg

SEQ ID NO: 45718 - DNA, 58 bp, Homo sapiens
tgagatagagtctccctctgtcacccaggctggagtgcagtggcgtgatctcagctca

SEQ ID NO: 45719 - DNA, 89 bp, Homo sapiens
gactgatgagcaaatggatgcattcaccctgagctactaggtccaatacttattgctcccggatagaaggacccattctcatacaagtt

SEQ ID NO: 45720 - DNA, 83 bp, Homo sapiens
caatctgggattcccttgatttccattttgaactgtatttcatgttctctgcagtgcagcaaagaagaacaaggtctcagttg

SEQ ID NO: 45721 - DNA, 118 bp, Homo sapiens
gcgccctgtgtgtgtctctctctgtgtcctgccagtggttttaccctatggtaggttacgtcatgctgttctaccacagggtagaaccacggacaggataccggggcaccctctgcgt

SEQ ID NO: 45722 - DNA, 117 bp, Homo sapiens
actgcactccagcctgggcaacagaatgagactctgtctaaaaaaaaatcatgtctatttgatttttaaatttttcttgagacgaagtctggctctgttgcccagctggaatgcagt

SEQ ID NO: 45723 - DNA, 105 bp, Homo sapiens
ttttgctggtgtataatacatataaaatctctctggaagaatacacaagaaactggtaatgtctgtctctagagaagaaaacacggtagggagatagaggtagga

SEQ ID NO: 45724 - DNA, 93 bp, Homo sapiens
gcattatactatactaaggatgattatatattgtattttatataatatattttatataatgtatagtatataatacacttatatattataagt

SEQ ID NO: 45725 - DNA, 69 bp, Homo sapiens
accaccacgcccaggtgattttttatatctttagtagagatgggatttcaccatgttggacaggctggt

SEQ ID NO: 45726 - DNA, 94 bp, Homo sapiens
agagagagagagagagagtgtgtgtgtgtatgtatgtgcatatatacatatatatatatatatatatatatatatatttttttttttttttttt

SEQ ID NO: 45727 - DNA, 102 bp, Homo sapiens
ggcgtggtggtgcattcctgtagtcccagcagtttgggaggctgaggtagaaggatcacttgaacactgaaggttgaggctgcagtgagccaggatcatgcc

SEQ ID NO: 45728 - DNA, 87 bp, Homo sapiens
tgagcactttaaaaggcacagatgtgatttggagattatgggtaatttttagattgcatctttgttaatatttacattagtttatca

SEQ ID NO: 45729 - DNA, 109 bp, Homo sapiens
ccatgggcttttcctgtctgccactgccacctcccaaagagcaagctctctggctcacttactctcagggaggttgtagtatacccattttatagatggaaaagttagg

SEQ ID NO: 45730 - DNA, 85 bp, Homo sapiens
gctgcagttgcttcacagtacccagagtttggaaagctggacacatacttattgccacgctccctgggtccctggcctctgcagc

SEQ ID NO: 45731 - DNA, 117 bp, Homo sapiens
actgcactccaggctgggcaacagaatgagactctgtctaaaaaaaaatcatgtctatttgatttttaaatttttcttgagacgaagtctggctctgttgcccagctggaatgcagt

SEQ ID NO: 45732 - DNA, 93 bp, Homo sapiens
ggcctttgagaatggtagaatggtggggtttttatttttttattttatttttatttatttttggagctggagcctcactctctcacccaggct

SEQ ID NO: 45733 - DNA, 58 bp, Homo sapiens; identical to SEQ ID NO: 315

SEQ ID NO: 45734 - DNA, 69 bp, Homo sapiens
ggaagctcagagacccgaattctaagcctggctccagctttgtggccttgtcactctgagtgtctgtcc

SEQ ID NO: 45735 - DNA, 91 bp, Homo sapiens
cgagcctgtgcaacatagggagaccctgtctctaaaaaaaaaaaaatttttttttttttaagacagagtctccctctgtcacctaggctgg

SEQ ID NO: 45736 - DNA, 97 bp, Homo sapiens; identical to SEQ ID NO: 1307

SEQ ID NO: 45737 - DNA, 88 bp, Homo sapiens; identical to SEQ ID NO: 1308

SEQ ID NO: 45738 - DNA, 81 bp, Homo sapiens; identical to SEQ ID NO: 1309

SEQ ID NO: 45739 - DNA, 77 bp, Homo sapiens; identical to SEQ ID NO: 1310

SEQ ID NO: 45740 - DNA, 60 bp, Homo sapiens
gggtctttttaggatctgacctcaggcggccgtgtgggtgcctgtgtccctgggaggccc

SEQ ID NO: 45741 - DNA, 115 bp, Homo sapiens
atttttggtagaattggggctttgccatgttggccaggctggtctcgaatcacttgagatcagaagtttgaaaccagtttggctgtcagggtgaaaccctgtctgtactaaaaat

SEQ ID NO: 45742 - DNA, 171 bp, Homo sapiens
acatatatatatgtgtgtgtatatatatatgtgtgtatatatatatatatacacacatatatgtgtgtatatatatacatatatgtgtgtatatatacatatatgtgtgtatatatgtgtgtgtgtatatatatatacacacacacacacacatatatatatgtttgtttg

SEQ ID NO: 45743 - DNA, 79 bp, Homo sapiens
ttgaagagctcaaagtctgagttctgtaccctcttgcagtggtgacaggtagagacagtacagagagtgggcccgtcag

SEQ ID NO: 45744 - DNA, 95 bp, Homo sapiens; identical to SEQ ID NO: 68

SEQ ID NO: 45745 - DNA, 93 bp, Homo sapiens; identical to SEQ ID NO: 69

SEQ ID NO: 45746 - DNA, 83 bp, Homo sapiens
ccctagagtcagggtctcactgtgtcacccaggctggagtgcagtggcacagtctttgttcactgcggccttgagctcccggg

SEQ ID NO: 45747 - DNA, 58 bp, Homo sapiens; identical to SEQ ID NO: 1839

SEQ ID NO: 45748 - DNA, 58 bp, Homo sapiens
tgagacagggtctcactctgtcacccaggctggagtgcagtggtatgatcttggttta

SEQ ID NO: 45749 - DNA, 89 bp, Homo sapiens
tgcaccacccatctcaccctctgtctgtgtccacattccacagaacatggaccccagtggatgctctgtggagggggagtctgtggtca

SEQ ID NO: 45750 - DNA, 58 bp, Homo sapiens; identical to SEQ ID NO: 31434

SEQ ID NO: 45751 - DNA, 66 bp, Homo sapiens
gccttcctccaggggagatttttttttttttttttttgagatggagtctcactctgtcgcccaggc

SEQ ID NO: 45752 - DNA, 261 bp, Homo sapiens
atatatatatatatatatatatagatatatatatacatatagatatatacatgtatatatatgtgtatatatatacatatgtatatatatgtatatatgtatatatgtgtatatatgtatatatgtatatatacatatgtatatatacatatgtatatatgtatatatacatatgtatatatgtgtatatatatacatatgtatatatgtgtatatatatatacatatgtatatatatgtgcgtgtgtgtgtatatgtata

SEQ ID NO: 45753 - DNA, 83 bp, Homo sapiens
cactctgagccagtgactgagctactcttttttttttttcttcctttgagatggagtctcgctccctcgcccaggctggaatg

SEQ ID NO: 45754 - DNA, 102 bp, Homo sapiens
ctgagagcaggatttaacagggcttcacaaactactccttcttttataattttttctttttttttttttaagatggagtctcgctctgtcaccaggctgcag

SEQ ID NO: 45755 - DNA, 96 bp, Homo sapiens
catgttcacaggatgtggtttgataagaagttagaagtgatggttgccatggtaaccacgtctttatcgatgtctttatcgatgcccatccgcatg

SEQ ID NO: 45756 - DNA, 86 bp, Homo sapiens
cactatgggaggctgaggtaggaggatcacttgaactcaggagtttggagatcagtctgggcaacatagtgagaccccatctctac

SEQ ID NO: 45757 - DNA, 84 bp, Homo sapiens
cttcatcaaagggttaggaagtaagattctttttttttttttttttttttgagacagagtcttgctctattgcctaggctggag

SEQ ID NO: 45758 - DNA, 70 bp, Homo sapiens
gccggtggtggccagagcaggggtggggtggcattcctgtgtctctgccactcactggctgtgtcaccac

SEQ ID NO: 45759 - DNA, 87 bp, Homo sapiens
ttctgttggatcctgtgccttttccttcttcagcattttccatttttttttaagtaaggaactgagtgctataggaacaactaagaa

SEQ ID NO: 45760 - DNA, 85 bp, Homo sapiens
tctgtctctctgagtttatggagttggttagaaatgtcgtatttctttttctttctttatactccagattccctgtgaggtcagg

SEQ ID NO: 45761 - DNA, 124 bp, Homo sapiens
atacgtatacatatgtgtatatatacacgtatacgtatatatatgtgtatatatatacatatatacacatatatatatacgtatatgtgtgtgtgtgtgtgtgtgtgtgtgtgtgtgtgtgtgt

SEQ ID NO: 45762 - DNA, 96 bp, Homo sapiens
tatatatatatacatatacgtatatatatatgtgtatatatatacgtatacgtatatatatgtgtgtatatatatacgtatacgtatatatatgtg

SEQ ID NO: 45763 - DNA, 95 bp, Homo sapiens; identical to SEQ ID NO: 68

SEQ ID NO: 45764 - DNA, 93 bp, Homo sapiens; identical to SEQ ID NO: 69

SEQ ID NO: 45765 - DNA, 104 bp, Homo sapiens
gacttccaggagagagagtgcttaaggagagtttttaggaatgagtaggactgtaatccttcctttttttttttttttttttgagatggagtcttgctccatgg

SEQ ID NO: 45766 - DNA, 80 bp, Homo sapiens
cacagtggagggacacaggagctcctttcaaactttttaataagagcatgaatcctattcacaagggctctcccctcgtg

SEQ ID NO: 45767 - DNA, 58 bp, Homo sapiens
tgagatggagtctcactctgtcacccaggctggagtgcagtgtcgagatctcagctca

SEQ ID NO: 45768 - DNA, 112 bp, Homo sapiens
cagttttggtttgcttcaaatgcttgtgagacctactatagtccatgtaaatttgaatatatatgcatatggtaatttctctccaaaccagccaacggacatagcaatgctg

SEQ ID NO: 45769 - DNA, 118 bp, Homo sapiens
tatgggcttaggagcactttaaaatttgtggtgggaatagggtcattaataactatgaatatatcttttagaaggtgaccattttgcactttaaagggaatcaattttgaaaatcatg

SEQ ID NO: 45770 - DNA, 114 bp, Homo sapiens
ggttgagatggtgtctgctgggtctgtccactgtaaagtcattattttttcttttgtaattaaaaatattttggcagatattttgagactatgtaaatatcctattctcagact

SEQ ID NO: 45771 - DNA, 110 bp, Homo sapiens
attgtcagctttggtattccctgttgtttgttggaaaagggtataactcttctatcttaagagaagagatttttttctctatttgaggttgtatgttttaaagctataat

SEQ ID NO: 45772 - DNA, 83 bp, Homo sapiens
ccagcctgggcaacatggcaagaccctgtctccactttttgagacggagtctgtctctgtctcccaggctggagtgcagtggc

SEQ ID NO: 45773 - DNA, 58 bp, Homo sapiens; identical to SEQ ID NO: 1725

SEQ ID NO: 45774 - DNA, 65 bp, Homo sapiens
tacggagacgaaagagattggtatcaagccttaccctgggatgggccactctctctgtgtctgta

SEQ ID NO: 45775 - DNA, 66 bp, Homo sapiens
gtatgtgtgtgtgtatatatacagtcatccctcagtatccagtgtatatattatatatacatatat

SEQ ID NO: 45776 - DNA, 93 bp, Homo sapiens; identical to SEQ ID NO: 69

SEQ ID NO: 45777 - DNA, 110 bp, Homo sapiens
ggtgtggtggtggcacatgcctgtggttcaaactactcaggaggctgaggtaggaggatcatttgagcttgggaggttaaggctgcagtgagctgtgaccacagcacagc

SEQ ID NO: 45778 - DNA, 85 bp, Homo sapiens
gaggatagatagtaaaaaaaaatatatatatatataaacaccaagagtgaatatatatatgtgtgtatgtatacttcctgtcttc

SEQ ID NO: 45779 - DNA, 58 bp, Homo sapiens
tgagacagagtctcactgtgtcatccaggctggagcacagtggggtgatcttggctca

SEQ ID NO: 45780 - DNA, 89 bp, Homo sapiens
atgtatgtgtatatgtgtataggtatatatgcatatttatataaatatatccatatgtatactatatacatgtacatgtatacatacat

SEQ ID NO: 45781 - DNA, 110 bp, Homo sapiens
acacaggatatgggatctgtaagaaacggccgggatgctgtcaattgctttgtgtctctgtgtgatatgtggtcctatagcagaccagaccatgaagcaggacaaattcc

SEQ ID NO: 45782 - DNA, 85 bp, Homo sapiens
taggacctaatgtgatccgacagccctgatttctctagatatatattaaaacaacatgcccagtgctgatggctcagaggtcctg

SEQ ID NO: 45783 - DNA, 118 bp, Homo sapiens
ggatgttgggagtctaacagccaagagtgctccttgactttttttttttttggacagaatctcactctgtcacccaggctggaatgcaatggtgtgatcttggcttattgcaacctct

SEQ ID NO: 45784 - DNA, 86 bp, Homo sapiens
taggtgtgtgcgtgcatgtgtgtgtgtgtgcacatgtgtacctgtgtctgcgtgtgtgcatgtgcatgtgtgcacgtgcatgtgtg

SEQ ID NO: 45785 - DNA, 69 bp, Homo sapiens
gcttacagtctacagtagtgtgcagtaatggcctaggccgtcacactcactcactggcacacctagagc

SEQ ID NO: 45786 - DNA, 98 bp, Homo sapiens
gggcgggcagggtaggaggtagggtggtgatgtctctgtctcacactgactctcatacttgttctgtccccaagccccacatcactctccttttcgcc

SEQ ID NO: 45787 - DNA, 112 bp, Homo sapiens
ctcagtggctttcatcagatgttctctgtacaaggaaaagaaaaaaaaatcgttctatctttttatttttactttgctttaatcttatttgatgatgtctcaacaggctggg

SEQ ID NO: 45788 - DNA, 76 bp, Homo sapiens
tacattatattaatacattatatgtgtgtgtatgtatatatatatatatatataatctgtataatatatatttgtg

SEQ ID NO: 45789 - DNA, 65 bp, Homo sapiens
ctgttcctctgtgtctgtgacttgtctcccacctggaaatgcaaacgctcatgtgtgagggacag

SEQ ID NO: 45790 - DNA, 119 bp, Homo sapiens
gttatttggggagaaattcttacctaggctttttgacacttgcaatgattttttttttaaagggcaatgtggtgttttaaaattttaatttagttaaagaaaactcaaccccaaaaagc

SEQ ID NO: 45791 - DNA, 92 bp, Homo sapiens
attagcaagacaagtgtagattaaatctttattacaataaagtaacattctttgtcaatactttttgttttaaaatctatacttttgctaat

SEQ ID NO: 45792 - DNA, 58 bp, Homo sapiens; identical to SEQ ID NO: 9046

SEQ ID NO: 45793 - DNA, 129 bp, Homo sapiens
tgtgtgtgtgtgtgtatatatatgtttgtatgtgcttgtgtatatgtgtgtgtttgtgtgtatgtatatatgtatacatattttatatatatatgtatatatatatgttatatatataagttgctttca

SEQ ID NO: 45794 - DNA, 58 bp, Homo sapiens
tgagacagagtctcactgtgtcgcccaggttggagtgcagtggagtgatctctgctca

SEQ ID NO: 45795 - DNA, 78 bp, Homo sapiens
gttctggaggctagaagtctgagatcaaggtgtcagcagcgctgctttgattctgaggcctctccttggcttgcacac

SEQ ID NO: 45796 - DNA, 61 bp, Homo sapiens
ttgagacagagtctcactctgtcgcccaggctggagcgcagtggcgtgattttgatcttgg

SEQ ID NO: 45797 - DNA, 58 bp, Homo sapiens
tgagatggagtctcactctgtcacccaggctgcggtgcagtggtgtgatatcaactca

SEQ ID NO: 45798 - DNA, 95 bp, Homo sapiens; identical to SEQ ID NO: 68

SEQ ID NO: 45799 - DNA, 93 bp, Homo sapiens; identical to SEQ ID NO: 69

SEQ ID NO: 45800 - DNA, 88 bp, Homo sapiens
agtggccctcccttgactcctgtctctctctgcctatcagccacctggtacaaggggaagagattcaaatggaagtctgtagatcatt

SEQ ID NO: 45801 - DNA, 108 bp, Homo sapiens
tgtaggtcagtcaggtagaattcattcaagatatgtgtcctttttttttttttttttgagactctgtcgccaggcttgagtgcaatggcgtgatctcggctcactgca

SEQ ID NO: 45802 - DNA, 95 bp, Homo sapiens
tcacccttccctttcaaactgccaggcaataaatgaagaatgaagattctttttactttatgatgtagagcaaactctctgagagaatagggaga

SEQ ID NO: 45803 - DNA, 105 bp, Homo sapiens
tattctcttttcctgtttcttttctctactgtctgacactgtgtatgttagggattaactttacagctgagtctgtagataatagaatactgaagagtgagagta

SEQ ID NO: 45804 - DNA, 100 bp, Homo sapiens
ttgctgtcacaaccagccttattttagacatgacggtaatttttttttttttttttttgagaaggagtctcactctgttgcccaggctggagtgcagtgg

SEQ ID NO: 45805 - DNA, 78 bp, Homo sapiens
tggggattagaatttcaatatatgaattttggagggatctaagcactcagttcatagttagttgagaccttttcccta

SEQ ID NO: 45806 - DNA, 83 bp, Homo sapiens
gagtggtagatggcaaaatgggaaaggcatgaatgacccttggagtgagagagaacagtgtgtagtttccagttttctcactc

SEQ ID NO: 45807 - DNA, 113 bp, Homo sapiens
gcagaatgcttcagaaatccctgagaaatgacaggtgttttttatttttattatgtatgtatttatttttgagatggaatctctctctgttgctcaggctagagtgcagtggc

SEQ ID NO: 45808 - DNA, 122 bp, Homo sapiens
cctgcaagttagaggcagtgtgattctttattattattttttctaagatggagtctcactctgtcacccaggctggtgtgcagtggcacgatctcagctcactgcagcctccgcctcctggg

SEQ ID NO: 45809 - DNA, 133 bp, Homo sapiens
gggaagggagtgcataaaggatggggaaattgaacgctttgtttcatggtgcacttctttttttttttttgagctggagtctcactctgtcacccaggctggagtgcagtggtgcaaccttggctcactgaaa

SEQ ID NO: 45810 - DNA, 72 bp, Homo sapiens
tggcctgcagtcagccattcccagaggggaacccaaaagtgcctctagagagtcaggactgagcatgtgcca

SEQ ID NO: 45811 - DNA, 108 bp, Homo sapiens
gagattgtaacacagtaggtctggggttgggcccagaaacctgaatttttattatttttttgagacagggtctctgtcgcccaggctggagtgcagtggtacaatctc

SEQ ID NO: 45812 - DNA, 147 bp, Homo sapiens
cttgcttctacccagtggcacatggcccaggtgatgggatgtcacttctgtgattcagttgtaatctgtctcactgactctctcccttgcctgctggcatgtgtgctctgatggcgcaagctgctgagttaggcccatgtggcatgg

SEQ ID NO: 45813 - DNA, 90 bp, Homo sapiens
ggcccttctcagacagctgatcagcagtgcccaggaatgcctgccccaccaggcactgtccctctcactggccagattagcctggggacc

SEQ ID NO: 45814 - DNA, 101 bp, Homo sapiens
gttgcacacatgtgccctgtgtggcttccccttctgtcaggaatgtagtcagcattcatgctgctgcctgcctttcatgacacccacagtcaaattgcagc

SEQ ID NO: 45815 - DNA, 110 bp, Homo sapiens
cgtgaggcactgcacccggccagaaagtttttatactgtatgcaaatgttatgttagattataactttttcttctgtagcttgcttttttgcttaattttatgctttggg

SEQ ID NO: 45816 - DNA, 88 bp, Homo sapiens
ggcacgagtgtctcagaaaggcttgattcttgtcttagtttatttatttatttatttagagacagagtctctttctgtcacccaagct

SEQ ID NO: 45817 - DNA, 74 bp, Homo sapiens
ttgcttgttttgagatggagtctcactctgtcacccaggctggagtgcaggggcgcaatctcggctcattgcaa

SEQ ID NO: 45818 - DNA, 115 bp, Homo sapiens
tatgtttattctgtattattctggagagagaaggagagaggaaagatatttatgtattattattattttgtgacggaatcttgctctgtagcccaggctgtagtgcagtggcatg

SEQ ID NO: 45819 - DNA, 108 bp, Homo sapiens
cagggagacctctgtctctactaaaaataaaaacattttaaagggctcatttaaacttttttcttttctttttttttttttttttttttgagacggagtctcactctg

SEQ ID NO: 45820 - DNA, 120 bp, Homo sapiens
ctctccattatgtgtccatttaaattatttctaaagtatttgcatgtgttaatgtactctcacagtctgtgcattagaaaacattcaaatgccgtgtaaaggtgagataaagcctgcgta

SEQ ID NO: 45821 - DNA, 116 bp, Homo sapiens
cagcctgggagcaggggggtgggggtcctgggagcaagcaggcaaggccactgggtttctctctgtgcctgtgaccagggtgaagggcccaaaggaagctgtggcttctgccatgt

SEQ ID NO: 45822 - DNA, 70 bp, Homo sapiens
aggcagggagtttggagtctgttcaaagggcaaaagtgcgatggattctgttgtctctatctctgtgtct

SEQ ID NO: 45823 - DNA, 72 bp, Homo sapiens
gtgatgtgtgtgagcagacactgctgctttgccgagaggcggccagtctctgcagtaacccgggcagatgac

SEQ ID NO: 45824 - DNA, 56 bp, Homo sapiens
gagacagactcttgctctgtcactcaggctggagtgcagtggcatgatctgggctc

SEQ ID NO: 45825 - DNA, 61 bp, Homo sapiens
gtgggaacaaggtctctctctgtcacccaggctggagtgcagaggtacagtcttggctcac

SEQ ID NO: 45826 - DNA, 114 bp, Homo sapiens
gcagggcaggattgtgaaagatggactcacagacaaaagcagtaaaagaagtattttccttttttttttcttttttttctttttttttttttttgagacggagtcttgctctgt

SEQ ID NO: 45827 - DNA, 56 bp, Homo sapiens; identical to SEQ ID NO: 324

SEQ ID NO: 45828 - DNA, 58 bp, Homo sapiens; identical to SEQ ID NO: 315

SEQ ID NO: 45829 - DNA, 120 bp, Homo sapiens
cccggatggatatagtccagtccagggtaaaggattagagctgacttttttttttttttttttttttgagacgaagtctcactctgtcgcccaggctggagtgcaatggtgcgatcttgg

SEQ ID NO: 45830 - DNA, 82 bp, Homo sapiens
gtgttcagagaatgaactatgtcttgaatatctttttttttctttttttttttttttttgagacagagtctcgctctgtcac

SEQ ID NO: 45831 - DNA, 58 bp, Homo sapiens
tgagacagagtctctctctgtcgcccaggctggagtgcagtggcatgatctctgctca

SEQ ID NO: 45832 - DNA, 101 bp, Homo sapiens
catttagaatgtcctttgacttttgtgcacattatctcatgagaccctcactatgactctgagaggtaagcaggacaggcgtcttctacattttacagatg

SEQ ID NO: 45833 - DNA, 79 bp, Homo sapiens
attccaagaactcacacctctgactcttaagtctttttttaaattagaaaaggtaacatgcagcaggtgaggttgggat

SEQ ID NO: 45834 - DNA, 99 bp, Homo sapiens
gtggttgcacaggccgcccccgggagggctggcacttccactctgtggggctgatgctgagtgtgagaagacagtgtccctggaggcctgtgtccctgc

SEQ ID NO: 45835 - DNA, 66 bp, Homo sapiens
tgggttaggaggtgagacccttctctttttttttttttttgagacagggtctcactctgtcaccca

SEQ ID NO: 45836 - DNA, 80 bp, Homo sapiens
ccacgcctggctgacttggagtgtctcatctttatttactttattcttgaaacagagtctcactctgtcgcccaggctgg

SEQ ID NO: 45837 - DNA, 90 bp, Homo sapiens
gctgcagagaggcctccctgctgtctgttctgcttcttgcttcccatctgtgaagtgagtgtggccactccagctcctcctgtgcccctt

SEQ ID NO: 45838 - DNA, 73 bp, Homo sapiens
tggctgcagggtctcctctgagcctgcctgcatgccacaagtactgcctggacaggtggtggagctcaagcca

SEQ ID NO: 45839 - DNA, 84 bp, Homo sapiens
cacaggctagcaaataaaagataatacagcttccacctggcatgcttccacctggcatgctctgtctgtctgtctgtccctgtg

SEQ ID NO: 45840 - DNA, 82 bp, Homo sapiens
agatgggagacagctctccagggccatttttttttttttttttttttttttgagatggagtctggctctgtcgcccaggctg

SEQ ID NO: 45841 - DNA, 78 bp, Homo sapiens
aagactgtgtgtctgagtaactagaataggtttttttgtttctttgtttttgtttttgttttttggagacagggtctt

SEQ ID NO: 45842 - DNA, 75 bp, Homo sapiens
agtgctgggattacaggcgtgagccaccgctttttgtatttttttgaggtggagtctcactctgtcacccaggct

SEQ ID NO: 45843 - DNA, 97 bp, Homo sapiens
ctgcagcctgagtgacagaatgagaccctgtctcaaaaaaaaaaaaaaaaaaaagaaagaaaagatttggttgttttgtggttcaggaaacctggag

SEQ ID NO: 45844 - DNA, 58 bp, Homo sapiens; identical to SEQ ID NO: 1435

SEQ ID NO: 45845 - DNA, 84 bp, Homo sapiens
gagaaaatgtgtatagaaagctgagtgatgagactctggaaatttgcagagaagtatttggactgagtgtttctattagagctc

SEQ ID NO: 45846 - DNA, 74 bp, Homo sapiens
ggtcttccctctgtaactgtctgtctcctaataggctcttcttatgaggacaccagtcacatgggattagggcc

SEQ ID NO: 45847 - DNA, 95 bp, Homo sapiens; identical to SEQ ID NO: 68

SEQ ID NO: 45848 - DNA, 93 bp, Homo sapiens; identical to SEQ ID NO: 69

SEQ ID NO: 45849 - DNA, 113 bp, Homo sapiens
agcttgtgaaaaataaagtagaaacagcaaagagtgccttggaaagatactcagtagaaacagagcagaggtcttggggaggggttgatgtgattttacttttaggttctgct

SEQ ID NO: 45850 - DNA, 103 bp, Homo sapiens
acattcaaaggtacacctgtatgtatgtatgagcgtatgtgtgtatatatatgtatatacatgtatatgcatatatatttagagcaagagggtacatggatgt

SEQ ID NO: 45851 - DNA, 72 bp, Homo sapiens
tgttaaatggttgtatagtttcagtttttcaagaccaaaaagttctagagggctgttgtacaaccatatgca

SEQ ID NO: 45852 - DNA, 75 bp, Homo sapiens
acacagacacaaagagatatacagaaaagccatataaataaatatatgcatgtgtgtgtgtgtgtgtctgtgtgt

SEQ ID NO: 45853 - DNA, 121 bp, Homo sapiens
tagcggtgttccagatactcagcaccttccagtatctgtatcttcatgcttgattcagtctggaagactactctgcctgtatccatagaagactggaagtgctttggaattagctaacacc

SEQ ID NO: 45854 - DNA, 128 bp, Homo sapiens
ttcattaatttagccacttctcaatgtgtcagtgtttcttgactaatgcatacatttttatttttatttcagtgtttatagggagtgctgaaaaatgctgaaagtgttagtttttgaaaatgcagtca

SEQ ID NO: 45855 - DNA, 133 bp, Homo sapiens
gccacacagtatgtgatgaacattttgactggaaaggcctgcctttgccatttttaagtggagtctcactctgtcacccaggctggagtgtagtgacatgatctcagctcaccgcaacctctgcctcccgggt

SEQ ID NO: 45856 - DNA, 92 bp, Homo sapiens
caccaataaagtctatctctcacagtcagtctttctcccagtggtggactgaggaactgggaacaaggctgtaaagtgatggcactgtgctg

SEQ ID NO: 45857 - DNA, 114 bp, Homo sapiens
tttagcctatatgatagcaatgcccacatttattcagcagcagcagtggtctttggttaagactgacattctgactgactgaataggcttcattcagctacatatttacttaga

SEQ ID NO: 45858 - DNA, 114 bp, Homo sapiens
agcatgtgctcactttgtgtctctgtgtcacattttggtaattcttgcaatatttcaagcttttaaattattattatatgttacggtgatctgcaatcagtgatgtttgatgtt

SEQ ID NO: 45859 - DNA, 100 bp, Homo sapiens
ctctagcttgggcgacagagccagaccttgtctcaaaaaaatattatttatttatttatttattttgagccagagtctcgctctgtcgcccaggctggag

SEQ ID NO: 45860 - DNA, 79 bp, Homo sapiens
cagtattttgtgttggcactattttttttttaaatcttagtccttttgagaggtgtaaagtggtgcctcattgaggatg

SEQ ID NO: 45861 - DNA, 94 bp, Homo sapiens
atagggaaattatatggctgtgttatatgtatgtatataacaaaatcctgtgtgtgtgtatatatataatttaattggcacctgaagtacctat

SEQ ID NO: 45862 - DNA, 100 bp, Homo sapiens
ttctttcaaattcagggaagggtgttggaaacatgacaattaggagaattattacaaagtttatgtattccaaagctcatccagagaattctgtttagaa

SEQ ID NO: 45863 - DNA, 101 bp, Homo sapiens
gtgtgtgtgtgtatatatgtatgtgtgcatatatgtacatatatatgtatatacatatatacatacatatacacgtatcatacgtatatacgcacacacat

SEQ ID NO: 45864 - DNA, 91 bp, Homo sapiens
tgtgcgtatatacgtatgatacgtgtatatgtatgtatatatgtatatacatatatatgtacatatatgcacacatacatatatacacaca

SEQ ID NO: 45865 - DNA, 109 bp, Homo sapiens
ccatacagttcaaaataatatatgtatttgtgtgtatatatatatatatatatatatatatatatatatatatatatcttatacattttattattgttattgaaaaagg

SEQ ID NO: 45866 - DNA, 99 bp, Homo sapiens
tctacatatactttttgttttctgtacacacacgtgtatatgtatatgtatatatgtgtatatataagtgtgtgtgtacagagaacaaatatatataga

SEQ ID NO: 45867 - DNA, 95 bp, Homo sapiens; identical to SEQ ID NO: 580

SEQ ID NO: 45868 - DNA, 93 bp, Homo sapiens; identical to SEQ ID NO: 69

SEQ ID NO: 45869 - DNA, 58 bp, Homo sapiens; identical to SEQ ID NO: 2595

SEQ ID NO: 45870 - DNA, 75 bp, Homo sapiens
tggtgggaagagtcacagtctcagtgagtctatcaggtgaaaacttcctgctggaccttctgtgtctcccatcca

SEQ ID NO: 45871 - DNA, 60 bp, Homo sapiens
atatatatatatatatgtatagatgtatagatgtgcatagatatgtatagatatgtgtat

SEQ ID NO: 45872 - DNA, 72 bp, Homo sapiens
gggggtctcatcccaaccagcttttaggagattgtatttttttataatcagctgcagttttttttttccccc

SEQ ID NO: 45873 - DNA, 71 bp, Homo sapiens
gttttgttttgagatggagtctcactctgtcacccaggctggagtgcaatggtgcgatcttggttcactgc

SEQ ID NO: 45874 - DNA, 112 bp, Homo sapiens
ggtctccaacctggatcgtcattggctctctaggtctataaggttcagtgttctcggctgtgactgcctcccactttgcctgctgcctgtctcccattgtcgcttgttggcc

SEQ ID NO: 45875 - DNA, 75 bp, Homo sapiens
tcttcatgctagactagaggatttctcctggaactctctctctgtcccagtgctcacttctgtcattgctgagga

SEQ ID NO: 45876 - DNA, 65 bp, Homo sapiens
gagaggtggtcaagagaaggttttttgcatgcctgccatctgtgtgtatctctgaatcaccttac

SEQ ID NO: 45877 - DNA, 94 bp, Homo sapiens
gaaaaggttcagaggcagagaaaatgcaactgatgaagatcatttattctattatttgattcaagcctttgtatttttttacctttccttattc

SEQ ID NO: 45878 - DNA, 95 bp, Homo sapiens
agtgaaggaggcctcatcagaaatggcacctgccatgtaatgcatatttattaatttattgcgtgactgctgtggatcaggtattgtcctaggct

SEQ ID NO: 45879 - DNA, 63 bp, Homo sapiens
agggttgtcactctgtcagtctgggctctggtactggcctcatctgagaaatggggaatccct

SEQ ID NO: 45880 - DNA, 96 bp, Homo sapiens
atagatggtttgggaactcgagatgaggccgtggggcgggggatactgacacccacttactctctctgagttcaggagcatttacccagcctctgt

SEQ ID NO: 45881 - DNA, 73 bp, Homo sapiens
agttgcaaagatgcatgggaaatgtgtgctttcccaggtggggtagcacactcactcactgcctcctttagct

SEQ ID NO: 45882 - DNA, 107 bp, Homo sapiens
tttaaagggctacatttttccctggttttccttttgttatgaagtatctttataaatttttcatatggctgtctggaagaaagacagttgagttgtctacttttgaa

SEQ ID NO: 45883 - DNA, 72 bp, Homo sapiens
ctgtccagacagaacactctcaccagacttgcattatggtatttgagtgtattttgccctgtaattggatag

SEQ ID NO: 45884 - DNA, 97 bp, Homo sapiens
gggggctccctgggccgggactggagcgcaaacggttgggagactgtcggtgtctgcccgcccgtctgtgcgtctgtctgtgtcggtgtgagcgtct

SEQ ID NO: 45885 - DNA, 98 bp, Homo sapiens
agcaacctcacctgcatctgttgtttcttgactttttttaaaatttttttattttactttaagttctagggtacatgtgcacaatgtgcaggtttgtt

SEQ ID NO: 45886 - DNA, 95 bp, Homo sapiens; identical to SEQ ID NO: 68

SEQ ID NO: 45887 - DNA, 93 bp, Homo sapiens; identical to SEQ ID NO: 69

SEQ ID NO: 45888 - DNA, 58 bp, Homo sapiens; identical to SEQ ID NO: 43428

SEQ ID NO: 45889 - DNA, 91 bp, Homo sapiens
ttatatattagtgcttatattaatgtatatatgcacgtattagtgtatattaatgtgtgtatatatgtatattagtgctacgtacatgtga

SEQ ID NO: 45890 - DNA, 97 bp, Homo sapiens
gtgtgaaaatggacttaatactccaggtttgtaggattctgtccctggctctgtatctctcagtcctgcttaaatgtgtattgctccattcttgaac

SEQ ID NO: 45891 - DNA, 77 bp, Homo sapiens
agtgccaccttttgtatacacctgtgtaatcttctccccctgagggtgagtgaaatgagtgaatacaataggttact

SEQ ID NO: 45892 - DNA, 57 bp, Homo sapiens
tgagtcaggtctcactctgtcacccaggccggagtgcagtggtgcaatcatggctca

SEQ ID NO: 45893 - DNA, 116 bp, Homo sapiens
gcattgcatgtgcctgtttatctagttggtcattgtgagcaaagtttattttttatcttaaggatttaactcaatcatttccacagtggaactgagcaggcaggaagatgaggtgc

SEQ ID NO: 45894 - DNA, 97 bp, Homo sapiens
taacaatgcatttattcctcagagggtctctgtgtatgttaaatgagctgatgcttgggagacactaaacataggaccaggcataaagtaagtgtta

SEQ ID NO: 45895 - DNA, 74 bp, Homo sapiens
tggagtcaggcaaaccggagtttgcagcctagctatggcactgacaggctgtgtgactctggaaagctacttca

SEQ ID NO: 45896 - DNA, 91 bp, Homo sapiens
ctgggtgtagagcaggatttctccatcggcactattgacttttttttttttttttttttttttagagatggagtctcactctgtcactcag

SEQ ID NO: 45897 - DNA, 76 bp, Homo sapiens
ctcagttccaggtggctgtagtgccagagcttgtgatctttctagcacccacactgactctcacaaaggaagtgag

SEQ ID NO: 45898 - DNA, 118 bp, Homo sapiens
agctgttttatttgtgttttactatttgctctttctggctgcttatagttagaagagaagtgatttccttgtaatgcttgaggctagaaagggagctggaacttaaagtggtgatgct

SEQ ID NO: 45899 - DNA, 60 bp, Homo sapiens
ttgagacagactcactgtgtcgcccaggctggagtgcggtgcaatgtcatctgtctgcaa

SEQ ID NO: 45900 - DNA, 97 bp, Homo sapiens
gatgtggtggtgtactcctgtagttccagctactcagacggctgaggtaggaggatcgcttgagccctggaggttgaggctgcagtaagccacagtc

SEQ ID NO: 45901 - DNA, 80 bp, Homo sapiens
cctcttacagagagcacacaccctgctctcctgcactgtcttgaacatgctgcatgaatggggtctgccctctgcgaagg

SEQ ID NO: 45902 - DNA, 71 bp, Homo sapiens
ctgtgagaatgacaagtgtttttgaacacccagctactagggagtatctagcatttctagttcttttgcag

SEQ ID NO: 45903 - DNA, 65 bp, Homo sapiens
gtgtgtatatatatatgtgcaagctacaagcagaaatgtacgtttgtatatatatatatatttat

SEQ ID NO: 45904 - DNA, 86 bp, Homo sapiens
gccccgttttctttatttaaatatgaatgggggctgatgtgcctccatctcctccctctttttttaattatgccaaatggattggc

SEQ ID NO: 45905 - DNA, 115 bp, Homo sapiens
cctaagcatggaaaagcctccggaccgggtctggagtgcaacagaggcccctgaccttgtctctagctctctgtctgcatcttcagcgtggcttcactggtttctaagtctctgg

SEQ ID NO: 45906 - DNA, 82 bp, Homo sapiens
tgatatacatacatgcatgtatatgtataatgcatgcatatgtatgataaactatatatgcatgtatatatgtatcacagta

SEQ ID NO: 45907 - DNA, 85 bp, Homo sapiens
ctgtgtgtgtgtgtgtctgtatataaaaaaaaagtatgtatacatatacgtatatgtatgtgtatagataaaaatgcgtgtatgg

SEQ ID NO: 45908 - DNA, 98 bp, Homo sapiens
ggaacttttttttgtttgttttttgagatggagtctcactctgtctgccaggctggagtgcaatggtgccatctcagctcacttcaacctccacctcc

SEQ ID NO: 45909 - DNA, 79 bp, Homo sapiens
ctctgcctttggaagaaaagtgaatatgttctctgtgtgagaataagggagcaaaaggtacttgttgtccagatgtgag

SEQ ID NO: 45910 - DNA, 71 bp, Homo sapiens
gaggcagagtttgcagtgagccgagatcaagccactgcattccagcctgggtgacactgagactctgtctc

SEQ ID NO: 45911 - DNA, 93 bp, Homo sapiens
cttgggacactgacatactccagcaagagcctgagtcaatttttttttttttttttgagacagagttttgctcttgtcacccgggctggagtg

SEQ ID NO: 45912 - DNA, 114 bp, Homo sapiens
cgaagactgtggaatatgtagctaagagtcttactaaaatcctctctagtgtatttatatatttaagcgtttggtagtacttttttagccatcagcgttctctatattaggttg

SEQ ID NO: 45913 - DNA, 110 bp, Homo sapiens
tattagtctccccagagggttaattatgtcgctccgtattttaagaagaatgtaaattgccagtttcaacagatgttcttttaaaagaattggttatctgggaaatgatg

SEQ ID NO: 45914 - DNA, 95 bp, Homo sapiens; identical to SEQ ID NO: 68

SEQ ID NO: 45915 - DNA, 93 bp, Homo sapiens; identical to SEQ ID NO: 69

SEQ ID NO: 45916 - DNA, 91 bp, Homo sapiens
ggatgtctagaatggactcagatgtcactgtgcaggtgactcacgcctagaatcctctgcctatcgtgacagggagaagcctgtgtgaccc

SEQ ID NO: 45917 - DNA, 68 bp, Homo sapiens
gtgtgtgtgtgtatgtatatatgtatgtatatatatgtatagataaatgtatatatgtatagacatat

SEQ ID NO: 45918 - DNA, 79 bp, Homo sapiens
actcactcgctctctctcatttgcctttcttgtttaagcatgccagggatgcacacacgtgaaagagggcagattaagt

SEQ ID NO: 45919 - DNA, 72 bp, Homo sapiens
gtgtgtgtgtgggtgggtgggtgtgtgtgaaaggtaggatcacctctctgtgcctcagtctccccatcatcc

SEQ ID NO: 45920 - DNA, 115 bp, Homo sapiens
gggtgctttagcctggctctggaaagaaataagagatgtgttgaaggatgtgtgtgagactgacagacacagacagacaaagtttatatgggtcaaataaggaaaaagtgaatct

SEQ ID NO: 45921 - DNA, 112 bp, Homo sapiens
tagcattgtgacttggggacagatactttatttatttatttatttatttatttatttatttatttatttatttatatttttgagacagagtctcgctctctagcacaggcta

SEQ ID NO: 45922 - DNA, 77 bp, Homo sapiens
tgagacggagtctcactctgtcgctcaggctggagtctgtcgcccaggctggagggtagtggtgtaatctcggctca

SEQ ID NO: 45923 - DNA, 115 bp, Homo sapiens
gccactcattgctgtgtgagctctggctggtcagtaagaacctttgatcccatgtttctttatcttcttctttttttttttttttttagccatagtctcactctgtcacctaggc

SEQ ID NO: 45924 - DNA, 66 bp, Homo sapiens
tctgcaattcctgtaggatcttgggatactctgaatctctgggtctcagtttccttaggttgggga

SEQ ID NO: 45925 - DNA, 91 bp, Homo sapiens
tatttaaaaatctttatatatatctttatacatatatacagaaaaatgtgtgtgtgtatgcacttgtgtgtttatagatctatattgaata

SEQ ID NO: 45926 - DNA, 163 bp, Homo sapiens
tatataatctatatatagatatctatataatatatataatctatatatgatatatatatcttattatatattatatatatagatagatatctatatacagatatctgtatacagatatctatatatatagatatctatatatatagatatctgtatacagata

SEQ ID NO: 45927 - DNA, 79 bp, Homo sapiens
gtggccaaaagcctcactggagagggacatgggctataaaatgcatgacagtcagcactcacagtgtggccggcacaac

SEQ ID NO: 45928 - DNA, 71 bp, Homo sapiens
ttgtttgcgagacagggtctcactctgtcactcaggctggagtgcagtagtgcaatcttggctcactgcaa

SEQ ID NO: 45929 - DNA, 90 bp, Homo sapiens
aaaaacataggtgtgtgtgtgtatatgtatacaaggattttatatatgcacataggtatataaatatatatacatatacaccttgttttt

SEQ ID NO: 45930 - DNA, 88 bp, Homo sapiens
atatgtattgtatgtgtatatgtatatgtgtatgtacacaatttatgtatgtgtgcgtgtatacgtacacacatgcatctatacatgt

SEQ ID NO: 45931 - DNA, 90 bp, Homo sapiens
gccagacgtctgagaccacagtgtggacagggccatgctccttctctagagaactctccttgctcctctcgcttccggtggttcagtggc

SEQ ID NO: 45932 - DNA, 93 bp, Homo sapiens
tctttattgcatgcaaatctatattgtgacacatagtggaaagcttttggattctgtgtggaagagttgacagagatttgcaggtgaaaaaga

SEQ ID NO: 45933 - DNA, 119 bp, Homo sapiens
agctaggggctggggtctcctttcaaggttcaactggggagacatccacttacaagctcgctcagtcactcagagttcttggcgggattcagctccttgtgggttttgggtggcaggtc

SEQ ID NO: 45934 - DNA, 101 bp, Homo sapiens
gtctctgggctctgtgactctgagattctgggtctctgtgactctgagattctgggtgatcattctgcatagagatgcagcatttaaagtcacagttatgc

SEQ ID NO: 45935 - DNA, 91 bp, Homo sapiens
ggagttggtgaactacagcctgtgggccatttgtttttgtaaataaagttttattggaatacagtcacactcactggttcacataatggct

SEQ ID NO: 45936 - DNA, 63 bp, Homo sapiens
ttatacacacaccaaagcaaatacataggctccaagggtgtgtgtgtgtgtgtgtgtgtgtaa

SEQ ID NO: 45937 - DNA, 102 bp, Homo sapiens
ggcatggtggtgcacacctgtagttccaggtgctagggcggctgaggtaggaggatggctccagccctggaagcagaggttgcagtgagctgagatcatgcc

SEQ ID NO: 45938 - DNA, 68 bp, Homo sapiens
tatgcatgtgtgagtgtgtgtgtctgtgtatgtgtgcatgcatatacttctatattcatttaaccata

SEQ ID NO: 45939 - DNA, 82 bp, Homo sapiens
atgataccatatgatatgatatgatatatgttactatattatatagtaatatactatattatatgatactatactatatcat

SEQ ID NO: 45940 - DNA, 93 bp, Homo sapiens
ggttcattcatgttgtagcttataatggaactttatttctttttgtgaccaaataatattccattgtatggatacagcatattttgttgatcc

SEQ ID NO: 45941 - DNA, 76 bp, Homo sapiens
gaatgtgtctagagttgctcagcaaaatgaagaaatagaatccaattttcacgctgaatgactctcagactcagcc

SEQ ID NO: 45942 - DNA, 70 bp, Homo sapiens
ggtctggaagaggagtaacttcccagggagggaactgctaaatggaaaagttgagtttttcttcttgact

SEQ ID NO: 45943 - DNA, 95 bp, Homo sapiens; identical to SEQ ID NO: 68

SEQ ID NO: 45944 - DNA, 93 bp, Homo sapiens; identical to SEQ ID NO: 69

SEQ ID NO: 45945 - DNA, 80 bp, Homo sapiens
ttctcatcagactgtttctgtcactgagaggttgaaagaggtctgaatgagcatccagagacagaattagatagatagaa

SEQ ID NO: 45946 - DNA, 70 bp, Homo sapiens
tttgggtatgagtctcactgcctcacttactaggtgagtgaacttaggtaagtgactgaacacctccaag

SEQ ID NO: 45947 - DNA, 68 bp, Homo sapiens
aggataggaggctgcaggtctcagtgctgggtgcccaggacacacacagacacacagtctactgtgct

SEQ ID NO: 45948 - DNA, 76 bp, Homo sapiens
atgctcccgcatcagcgtgtgtgtgtgtgtctctctctaggggctgggggctcaagtgttgaagttggttcagcgt

SEQ ID NO: 45949 - DNA, 69 bp, Homo sapiens
ctcagggatcctggagttgagtgtcagctctctggcttgagtacagcagtctccatggatatcactgtg

SEQ ID NO: 45950 - DNA, 102 bp, Homo sapiens
ggtctggggaaggcagaaacagcaagctgctgttcaatgagtataaatttttagttatgcaagaggaataagttcttgacatctgttatatcgcacaatgcc

SEQ ID NO: 45951 - DNA, 72 bp, Homo sapiens
tgtgtgtgtatatatatgtatgtgtatatatatatatatgtgagtatatacatacatgtatatatatatata

SEQ ID NO: 45952 - DNA, 88 bp, Homo sapiens
tgagctcccgcagataacattatttgttttttacctggagcatgaccattctactgccttagtgggaaacagtttgtggaggagctgg

SEQ ID NO: 45953 - DNA, 101 bp, Homo sapiens
tagtcctcccttgtttcagcttatgttctagagagaagatacagacaagatagatatagctagctagatgaatgatggatggaaggagggacggttggcta

SEQ ID NO: 45954 - DNA, 71 bp, Homo sapiens
atggggcttgagggcgtgaagccaattgtgggtctccctaagaacaatggcagccacactgtctgtctgat

SEQ ID NO: 45955 - DNA, 116 bp, Homo sapiens
gcctatgcaattttatgacaatgaggtgttaacatttgacataagtgagtttttctttttaaaaaaaggaaaacagatttacagttattctttataataatctcacagggtctggc

SEQ ID NO: 45956 - DNA, 95 bp, Homo sapiens; identical to SEQ ID NO: 68

SEQ ID NO: 45957 - DNA, 93 bp, Homo sapiens; identical to SEQ ID NO: 69

SEQ ID NO: 45958 - DNA, 83 bp, Homo sapiens
tgagactgagtctcactgtgtcacccaggctggggtgcagtggcacaatcttggctcactgcaacttctgcctcctgggttca

SEQ ID NO: 45959 - DNA, 109 bp, Homo sapiens
tctcatttgtttgcaattctgagtaaactggctttttttttttttaattgcctatggcagcctgtatgccacgctaaatttcctaaaggtcagtttgaaaaacatgaga

SEQ ID NO: 45960 - DNA, 88 bp, Homo sapiens
tatatatatgtgtgtgtgtatatatatgtgtgtatatatatatgtgtgtgtgtgtatatatatgtgtgtatatatatatgtgtgtgtg

SEQ ID NO: 45961 - DNA, 80 bp, Homo sapiens
tgtgtgtatatatatgtgtgtatatatatgtgtgtgtgtgtgtatatatatgtgtgtgtatatatatgtgtgtatatata

SEQ ID NO: 45962 - DNA, 116 bp, Homo sapiens
gtaaatatttatattcaatatatatccattagtaatatatatgactatatatgttatatatatgactatatatacatataactaatggatatatattgaatatatgtattatatac

SEQ ID NO: 45963 - DNA, 123 bp, Homo sapiens
ctgaatacctttttgatccattcatatatatatatatatgtgtgtgtgtgtgtgtatttatgtataaatatatatacatatatattttcagcatatgtgtgcttaagaagtgacagaagtgtt

SEQ ID NO: 45964 - DNA, 116 bp, Homo sapiens
atatatacacacacatatacatacatgtgtgtatatgtatatgtgtgtgtatatatatgtatgtatatgtatatgtgtgtgtatacatatatatgtatatacatagtgtgagtgtg

SEQ ID NO: 45965 - DNA, 84 bp, Homo sapiens
tcccttgcacgacggcattgtctcaaatcagtgtgcacagaagctttgtttccaggctgtctgcagaggatgtcgtccgaggga

SEQ ID NO: 45966 - DNA, 64 bp, Homo sapiens
tgtcactaggatgcattgcagtggcgtgatctcggctcactgcagtctctgtctcccaggttca

SEQ ID NO: 45967 - DNA, 96 bp, Homo sapiens
gacccctgtgagcctggatgcagtgagtattgaatttgttcttttgaattgctggaagaaaactgaataaaaactcaggagtcctgggttcctgtc

SEQ ID NO: 45968 - DNA, 100 bp, Homo sapiens
gtatgctgattttatatcctgcagctttgctgaatttgttgatcagttctaacagatttttggtggagtctttaggttttctcaaatataggatcatatc

SEQ ID NO: 45969 - DNA, 76 bp, Homo sapiens
ggccatctttggaagggagacgctaatgagcctaccacatctgcttcatctggtctctgtctttatctctggggtc

SEQ ID NO: 45970 - DNA, 58 bp, Homo sapiens; identical to SEQ ID NO: 1391

SEQ ID NO: 45971 - DNA, 56 bp, Homo sapiens; identical to SEQ ID NO: 1392

SEQ ID NO: 45972 - DNA, 75 bp, Homo sapiens
cgatagtattgaagttctccgtcaatcaagactttttttttgttttgttttttgagatggagtctcactctgtcg

SEQ ID NO: 45973 - DNA, 74 bp, Homo sapiens
tatatatatatatatatatgcatattgtatatatacaaatataaatatatactgtatatgtatatctatatata

SEQ ID NO: 45974 - DNA, 67 bp, Homo sapiens
gctccatgaggctggaaaaggactatagttgtcttgggcactgctgtgtctctgtcacctagtgagc

SEQ ID NO: 45975 - DNA, 110 bp, Homo sapiens
cacattcctaccttaatcttcagagatccttgaaatgtttagaagtttggatttgatagtacatccaaagctgaagcatttctagttctttcaagcagggaatgaaggtg

SEQ ID NO: 45976 - DNA, 105 bp, Homo sapiens
attcataaatgagatggctgttttgtttggtcttttatttattttttcttaacgaattgagaagtaggtaagtatggccttagccagagaagctactctctgagt

SEQ ID NO: 45977 - DNA, 89 bp, Homo sapiens
tggtttttgtctttcattcttaatgtgatgtattacatttattttctaatgtatgttgagccatatgtgaatcactgggataaatccca

SEQ ID NO: 45978 - DNA, 97 bp, Homo sapiens
acacccatatatatgtgtgtgtatatatatgtgtatacacatatatatatgtatgtatatatatgtgtgtatatatgtgtgtatatatatgtgtgta

SEQ ID NO: 45979 - DNA, 152 bp, Homo sapiens
agatgtgtgtatatagatgtgtgtgtatatatatgtgtatatatgtgtatatatgtgtatatatatgtgtgtacatatatgtgtatatacatgtgtgtatatatatgtgtctttgtgtctgtgtgtgtatatatatatatatatatatatat

SEQ ID NO: 45980 - DNA, 100 bp, Homo sapiens
cttaatcctgttggggagtcattgcagagttttaagagggcaaaaagacaatacaatttatattttagaaagctcatcctggcttctgagtggagatgag

SEQ ID NO: 45981 - DNA, 78 bp, Homo sapiens
atatattatatatattgtataacatatagtactatatattatatagtactatatgttatacaatatatattagtatat

SEQ ID NO: 45982 - DNA, 72 bp, Homo sapiens
cgggaggctgaggtggaaggatcacttgagcctgggaggtccaggctgcagtgagccatgatcatgccactg

SEQ ID NO: 45983 - DNA, 95 bp, Homo sapiens
ctggagtgtttcagaatacttcccagaggcagatgagggctactgtctaagaaaaagtttaagtctgtctgtgtctgtgtgtcaaacatctcaag

SEQ ID NO: 45984 - DNA, 75 bp, Homo sapiens
gtgaaactctgcctcaaaaaataaaataagtagagaaacttctttttttattattgttttgagacggactgtcgc

SEQ ID NO: 45985 - DNA, 107 bp, Homo sapiens
gacattttttatattggtaaaatcatgattcacatacaaatagaaaatgaatatctgccaaagatttttatttttttgtcagttcataagggagccagtaagatgtt

SEQ ID NO: 45986 - DNA, 61 bp, Homo sapiens
acattttagctgtgtggccttggggaagtcacgtgacctctctgagcctcagtgtctttgt

SEQ ID NO: 45987 - DNA, 65 bp, Homo sapiens
ttgcagtgaagtctcactctgtctccccagctggagtgcagtggtgttatctcagctcactgcaa

SEQ ID NO: 45988 - DNA, 58 bp, Homo sapiens; identical to SEQ ID NO: 1868

SEQ ID NO: 45989 - DNA, 81 bp, Homo sapiens
gtgtatgtctacagtttcagctactcaggaggctgaggtaggaggatctcttgagaaggtcgagaccatcctaggcaacat

SEQ ID NO: 45990 - DNA, 139 bp, Homo sapiens
ggagtgaccagggttattagggggttctttttcttttctttcttttttttttttttttttgagtcagagtctcgctctgtcacccaggctggagtacactggcatgatctcgactcattgcaacctccgcctcctgggt

SEQ ID NO: 45991 - DNA, 82 bp, Homo sapiens
gcatgatgtatttgtgcaaatgtatgcattctaaattagtttcaaaatgcttagaggggcgtgcatgagctcccacgcatgc

SEQ ID NO: 45992 - DNA, 116 bp, Homo sapiens
attacacctggcctaccaaaatgtgggtgccatttgtgattttatttatttattcatgattttaaatggacatgtaagattatatatatttgcggcatccagaaggatggtttgat

SEQ ID NO: 45993 - DNA, 116 bp, Homo sapiens
atatatgtatgtataagtatatattatatgtatgtatatgtatatatacatacatatatgtgtgtatatatgtgtgtatatatgtgtgtatatacatatgtgtatatgtgtatata

SEQ ID NO: 45994 - DNA, 89 bp, Homo sapiens
ctctgacagggaggcccctgagcgcagctgggctcttctgtctgtgtctctggggtccactggagcagaggaagctttgttggtgccgg

SEQ ID NO: 45995 - DNA, 95 bp, Homo sapiens; identical to SEQ ID NO: 68

SEQ ID NO: 45996 - DNA, 93 bp, Homo sapiens; identical to SEQ ID NO: 69

SEQ ID NO: 45997 - DNA, 58 bp, Homo sapiens; identical to SEQ ID NO: 1725

SEQ ID NO: 45998 - DNA, 122 bp, Homo sapiens
gtggaggggctctgcaatgagttagccaaatcccagtctaggaggctgtggactcaactgtcacactgtcacagactgagtactaacgccatcccagctcatcccccgcaacttactgaccc

SEQ ID NO: 45999 - DNA, 120 bp, Homo sapiens
tcatgcttagtattctttaatcgttggtcatcaagggtttgtggtcactctgtccctctgctttacaggtcagggaggtgaggcagcccaaggtcacactgagagccagggcaaagctga

SEQ ID NO: 46000 - DNA, 66 bp, Homo sapiens
gggctttggactcaggtggagattttattattattttttgatacagtctcactctgtcgcccaggc

SEQ ID NO: 46001 - DNA, 110 bp, Homo sapiens
gtctctgctgtcacacggtgctcgtccctgtgtgtctctctgtgtctaagtttccctcatcttttacggacacagtcactggatttgggcccactctcctccagcatgac

SEQ ID NO: 46002 - DNA, 79 bp, Homo sapiens
gtcactctctctctgtgccaggcaggagctccagggactaggggtgacccaagagtgaaggcctgatggggaggaggac

SEQ ID NO: 46003 - DNA, 78 bp, Homo sapiens
ccactgctccgttctgagcctcggtgtatttttttagtctataaaatgtgctaacaatggcctcctggcaggtggtgg

SEQ ID NO: 46004 - DNA, 90 bp, Homo sapiens
gagtatgtttggtaggcagaattttgaaaggtggagtgctgtgggtggaatcgatgaggcggtcagtctgtgtctgtgccatatgtactc

SEQ ID NO: 46005 - DNA, 104 bp, Homo sapiens
gatgataatccttgatagattacctttttcttttttcctgtttttttgtttttgtttttgctaaaaggatgaagaaaccgaggtacacaagaggttagaaaatc

SEQ ID NO: 46006 - DNA, 114 bp, Homo sapiens
tggtccatctgccttggcctcccaaagtgagacagcctctcttttaaaactcacattctctctgaaagatgggcctttctgtcttcacttcacagatgaggaaattgaggccca

SEQ ID NO: 46007 - DNA, 68 bp, Homo sapiens
gtatgtggcacgggtgagacttgaacctagcatggtctgactctgagtctgtgcctttcctgacgtat

SEQ ID NO: 46008 - DNA, 60 bp, Homo sapiens
aggtggtggtggtggtggtggtgatggtgaccgtgactgtcacttactcatttcttatct

SEQ ID NO: 46009 - DNA, 105 bp, Homo sapiens
attgtggttttcatttgcatttccttgacgattagtgactttttttttttttttttttagacagaatctcgctctgtcacacaggctggagtgcagtggcgcgat

SEQ ID NO: 46010 - DNA, 110 bp, Homo sapiens
tggtggctaaaagtctgagaccccggggtcaaaagggttggtttcttctttattatttatttatttattgagaccgagtctcactctgtcatccaggctggagggcacta

SEQ ID NO: 46011 - DNA, 90 bp, Homo sapiens
tctcactctcacagagtttcttgtcctcagcactgtaggtacttggtgctgaatacttctttgacttttttttttttggtggggtggggg

SEQ ID NO: 46012 - DNA, 135 bp, Homo sapiens
agggggaaggaaggagaatgcctccagcctctttgggacatcttggccaggcaaagttgttttttttttttttcttttgagatggagtctcgctctgtcacacaggctggagtacagtggcgcgatctctgctca

SEQ ID NO: 46013 - DNA, 116 bp, Homo sapiens
gcagccacagatgatccgtaggcaaatgggcatggttgtattccaacaatattttgtttataaaaacaagtggtcagctatatttggtccataggtcatggtttgccagctcctgc

SEQ ID NO: 46014 - DNA, 115 bp, Homo sapiens
ggaatggtgcccttataaaagaggccaaagatatctccatgtcccagatggttatttataaataaataaatatttaaaaataaaagaggtcccagagagctgcctcaccctttcc

SEQ ID NO: 46015 - DNA, 95 bp, Homo sapiens; identical to SEQ ID NO: 68

SEQ ID NO: 46016 - DNA, 93 bp, Homo sapiens; identical to SEQ ID NO: 69

SEQ ID NO: 46017 - DNA, 115 bp, Homo sapiens
gatctcccaggttaggctgatcctctgggtcaggtcagccacgtaggttcaccccctctctctgtgtctctgcctcttggcctttgactcaggagattaatcagattgggctgtt

SEQ ID NO: 46018 - DNA, 117 bp, Homo sapiens
gcacgcagcccatttctcatggcccactgctgatggtgaaatctgttttatttcaggttaagagagaagagagtcagcaacagcaagttttactcatagaagctggggtatgtgtgt

SEQ ID NO: 46019 - DNA, 98 bp, Homo sapiens
gtatatgtgtataaacctgtatgtgtgtgcttgtgcacaggtgtacgtgtgtgtaggtgtgcctgtgtctgtgtgtgtgtaagtgagggtacgtatat

SEQ ID NO: 46020 - DNA, 114 bp, Homo sapiens
gttgaagatatgtggaaggttatgctctgtattgtgagttattttttgagagagcgtctcactctctcacccaggctagagtacagtgacatgaacacagcttactgcagtctt

SEQ ID NO: 46021 - DNA, 144 bp, Homo sapiens
acagcaattaactagatgcatatatatacatatatatgtttgtatatatacgtatatatttgtatgtatgtatatatacacatatatgtatatatgtgtatatatacacatatatgtatatatatcacattgtatgtatatata

SEQ ID NO: 46022 - DNA, 120 bp, Homo sapiens
tacatatatacacacatatatatgtgtatatatgtaaatacatatatacacatatatatgtgtgtgtgtgtgtgtgtgtgtgtgtgtgtatatatatatatatatatatatatatcacat

SEQ ID NO: 46023 - DNA, 160 bp, Homo sapiens
acacacatatatatgtgtatatatgtatttacatatatacacatatatatgtgtgtatatatgtatttacatatatatacacacatatgtgtgtatatgtatttacatatatatacacacatatgtgtgtatatgtatttacatatatatatacatatat

SEQ ID NO: 46024 - DNA, 97 bp, Homo sapiens
atgtgatatatatatatgtatatatatatgtaaatacatatacacacatatgtgtgtatatatatgtaaatacatatacacacatatgtgtgtatat

SEQ ID NO: 46025 - DNA, 95 bp, Homo sapiens; identical to SEQ ID NO: 580

SEQ ID NO: 46026 - DNA, 93 bp, Homo sapiens; identical to SEQ ID NO: 69

SEQ ID NO: 46027 - DNA, 65 bp, Homo sapiens
tgctaagtacagaaagaagcacatagaattaagtgtgtgtatgtgtgtctgtctttctgtctgca

SEQ ID NO: 46028 - DNA, 83 bp, Homo sapiens
tcagtctgactctagagcctgtgctcttcaccatgtcacccatccaaaacccagaagagtcagcactttgagaaacatactga

SEQ ID NO: 46029 - DNA, 72 bp, Homo sapiens
tgagccagagtctcactgtcactcaggctggagtgcaatggtgcaacttcagcttactgtggcctctacctc

SEQ ID NO: 46030 - DNA, 72 bp, Homo sapiens
agtaagtggtagagttgagatttaatcccaggactgactgattgcagaacctcaactcttaaccactatact

SEQ ID NO: 46031 - DNA, 76 bp, Homo sapiens
tagagttgggagatcctgtatgtggtcaatgtccagggatgctactctgtcacactcatactgcctcttgagtcta

SEQ ID NO: 46032 - DNA, 100 bp, Homo sapiens
cttgttttattactaagattaaaaaaatcaggatctaaaatgataggatcaaaagtttttgttttttggttttttttttgtttgtttgttttaagacagg

SEQ ID NO: 46033 - DNA, 181 bp, Homo sapiens
tatatatacatataagtatatataagtatatatatatatacttatatataagtatatatatatacttatatataagtatatatatatatacttatatataagtacatatatatacttatatatgtgtgtgtatatatacacatatatacttatatacgtgtgtatatatatacttacatat

SEQ ID NO: 46034 - DNA, 85 bp, Homo sapiens
cgagtgagcattcttgtctcattcctgatgtaggagtaaaataatatttaatctttcaccattaagaatgatgtaagagctttcg

SEQ ID NO: 46035 - DNA, 73 bp, Homo sapiens
gtatgcagagactcacagagcagactgagctccgctggggtgcaaagactgctctgcagagtctgttctcggc

SEQ ID NO: 46036 - DNA, 72 bp, Homo sapiens
attgtgtatgcacgtgtgtgtgtgtgtgtgtgtgtgcacgcacatgcatacaagcacatgtagtgtcattgt

SEQ ID NO: 46037 - DNA, 58 bp, Homo sapiens
tgagactgagtctcactgtgtcacccaggatggactgcagtggtgtgatctcggctca

SEQ ID NO: 46038 - DNA, 114 bp, Homo sapiens
tatgctatttcttggcaattttgctgtcaaaatggccccaagtggactgcagagtgctctctagtgtctctaagtgcaagaaggctgtgatgtgtctgactgagaaaatgcatg

SEQ ID NO: 46039 - DNA, 65 bp, Homo sapiens
ccctggggagcactgagacgaacaagacaggggccctgctgtcacactgtcagtgtctagcaggg

SEQ ID NO: 46040 - DNA, 112 bp, Homo sapiens
ggccaggtcttcctgcattgttgtttgagtcagtcacagtgagttggcattgctacaagtcactgagcaaaaggccctcgcctggctcattcgccaatgagtctcctgtgcc

SEQ ID NO: 46041 - DNA, 113 bp, Homo sapiens
gaataatgcatttgaaatgtgtccatggtgttgcatatatcagtagtttattcttttttattgttgagtagcattccattgtatggatatagtataccgtagcttatttattc

SEQ ID NO: 46042 - DNA, 58 bp, Homo sapiens; identical to SEQ ID NO: 1391

SEQ ID NO: 46043 - DNA, 56 bp, Homo sapiens; identical to SEQ ID NO: 1392

SEQ ID NO: 46044 - DNA, 136 bp, Homo sapiens
ataggaatgtgtgtgtatacatatatgtgtatatatatgtgtgtgtgtgtatatatatatatatatatatatgtgtatatatatatatatatatatatatacatatatatatatatatatatgtagaatgcaagac

SEQ ID NO: 46045 - DNA, 79 bp, Homo sapiens
atgtatatatatgtatatgtatacacgtatatggtatatacatgtacatgtatatgtatacacgtatatgtatatacat

SEQ ID NO: 46046 - DNA, 115 bp, Homo sapiens
cgccctgtcacccaggctggagtgcaatggtgcgatcttggctcactgcagtctctgtcttctgggttcaagcaattctgcctcagcctcccgagtagctgggattaaaggcgcg

SEQ ID NO: 46047 - DNA, 115 bp, Homo sapiens
tcagcctcttgaatagctgggatcacaggtgcatgccaccacacccagctaatttttgtatttttgatacagatggggtttcatcatgtgggccagactgttcttgagctcctga

SEQ ID NO: 46048 - DNA, 95 bp, Homo sapiens
ttgcatcctccatctgacctgagatgagagtcagctcaaatagggatacctggagactgctcacgcgtgcatggttcgggggtcaacatcggcag

SEQ ID NO: 46049 - DNA, 125 bp, Homo sapiens
tatataaacatgtatacaatacactatatataatacacataaagtatatatctgtatatgtatatgtatacataagtatatatacttatagtatatagtatatgtgcatgtatgtatatatacat

SEQ ID NO: 46050 - DNA, 113 bp, Homo sapiens
ggagggcttcactcaagcgtagctcccctgggacccatgtgccccctgaccccttccagtgtcacggtccctgagtcccaaggccagtgccgtgctgaagtcaaccctactcc

SEQ ID NO: 46051 - DNA, 86 bp, Homo sapiens
gtgtgtggtgtgtggtatgtgatgtgtggtgtgtgatgtgtggtatgtagtgtgtggtgtgtgatgtgtggcctcagaccagacat

SEQ ID NO: 46052 - DNA, 102 bp, Homo sapiens
ctgccacgaccagctgtaggacccttaggattctgtgcctcagtttctttatatataaaatagggatagtagtagtatcggccttaccaggttggtgggaag

SEQ ID NO: 46053 - DNA, 58 bp, Homo sapiens
gtggctgggattgaggccatggcagcagcctgctgtctctgccactctccctgcctgc

SEQ ID NO: 46054 - DNA, 78 bp, Homo sapiens
gtatatgtatatatgtatatgtgtgtgtatatatatgtatgtgtgtgtgtgtgtatacatatgtgtatatatatatat

SEQ ID NO: 46055 - DNA, 122 bp, Homo sapiens
tgagcaagttttagttaacagacttcatccagaaaggatacaatatgtgattcagttgtactgttttctttgaggagcttctggggatagggcatagacctcaaaggtacatgtatcagtgg

SEQ ID NO: 46056 - DNA, 81 bp, Homo sapiens
acaacacagatgtagaacatttccatcactgggtagagtatgattgacaaagtgtgtgtgtgtgtgtgtgtgtgtgtgtgt

SEQ ID NO: 46057 - DNA, 113 bp, Homo sapiens
tagaaattgtatatacacatgcatctatatatatatatatacacacacacacacacacacgtgtgtgtataacatatgcttatccttgatgtcatatttacccatgattttta

SEQ ID NO: 46058 - DNA, 120 bp, Homo sapiens
gttgaggctcttccttctcctgcttcagctacctcggctgaataaatatttttatttaattaaaaaattaaacagcaatgtgagtgattctgatgcatgtctaaggttgaactgagcacc

SEQ ID NO: 46059 - DNA, 76 bp, Homo sapiens
ggtatgttctcactttgtcttggtgcatttgatttctctgaagataccctcagatgctctaatttgagaaaatact

SEQ ID NO: 46060 - DNA, 94 bp, Homo sapiens
acaaagacataggacatggactcagagacgtccaggcatctaactctctgcctgtctgtctctctggggaagccaatggtttttttgtttttgt

SEQ ID NO: 46061 - DNA, 95 bp, Homo sapiens; identical to SEQ ID NO: 68

SEQ ID NO: 46062 - DNA, 93 bp, Homo sapiens; identical to SEQ ID NO: 69

SEQ ID NO: 46063 - DNA, 111 bp, Homo sapiens
ccttgagggaatatttaagaggttctaagtcagggaaccaaaaaaaggtgtggtcactagactccagtttccttaggcgaagaactgggataatgctgttaccttatcagg

SEQ ID NO: 46064 - DNA, 96 bp, Homo sapiens
ttagtttttatttttatattatatttcatattatatatgtgtgtatatatatatatatagtgcacacaaacatgatgtggaggctgaatgaaaatg

SEQ ID NO: 46065 - DNA, 119 bp, Homo sapiens
gaaaataccttggaagggaatgctagtggcagttgcggtaataattatgatcatgatgatgataataatagagtcacagataatatttattgagcacttgctttgtgccagggaatttc

SEQ ID NO: 46066 - DNA, 79 bp, Homo sapiens
ctatatatatgtgtgtgtgtatatatatatatgtgtgtgtgtgtgtatatatatgtgtgtatatatatgccatatatag

SEQ ID NO: 46067 - DNA, 101 bp, Homo sapiens
tgcttgatttgcaaacataagcaaaactgaacgtgagctatttctttctttttttttgagatggagtctcactctgtcaccccggctggagtgcagtggca

SEQ ID NO: 46068 - DNA, 74 bp, Homo sapiens
gccacaaccctcagtgagatgtgcaaggagaccgttctaggcttatgtgtcagcctctcacttagtaatctggt

SEQ ID NO: 46069 - DNA, 85 bp, Homo sapiens
ggaggtgtgtgcatttacagggaagggagccttctgaggtgctgggaaaattctttatttttatgtgagtggattacacagatct

SEQ ID NO: 46070 - DNA, 83 bp, Homo sapiens
gtgtgcgtgtgcacgagcgttctatgtggatcagtgcacgcctgtgtgcgtgtgcacgagcgtctctgtgtgtgtcagtgcac

SEQ ID NO: 46071 - DNA, 59 bp, Homo sapiens
ggcagagtgtgcatttattttatttattttatttttttgagatggagtctcactctgcc

SEQ ID NO: 46072 - DNA, 103 bp, Homo sapiens
gctttatactgtatgcatatggattgacacgcctttcatacacttactttttatttttttgagacagtcttgctgtgtcacccaggctggagtgcagtggtgc

SEQ ID NO: 46073 - DNA, 77 bp, Homo sapiens
agagcaggcaggatgtgtgtttcgcaggctgtgcagggtcaggcctgctaaccccctctctgtctctgtctgtctct

SEQ ID NO: 46074 - DNA, 116 bp, Homo sapiens
taattgctctggctattcgggcttttggttccatatgaattgtttttttctaattctgtggaaaaatatcattggtattttgataggaattggactgaatctgtagattgcttttg

SEQ ID NO: 46075 - DNA, 108 bp, Homo sapiens
tcatgtcttgggctcaagtatattattaaaatagtttcatctgtgtttctttttactttttaaacgcagctcctggaaaattttaaatgatgcctgtggttcccatga

SEQ ID NO: 46076 - DNA, 114 bp, Homo sapiens
cctgagaccccgctctcaggcccttcttttctcagtgggtgtcacatggtctcactgtctctgaatgagctccattctgcccccatccatgaggagctgagtgtggcactcagg

SEQ ID NO: 46077 - DNA, 112 bp, Homo sapiens
tggacatagtgccgtattgtagtccgtgcaacttggtaggctgaggtaggaggatcacttgagcctcagaggttgaggctgcagtgaaccatgattgtgccactgtcctcca

SEQ ID NO: 46078 - DNA, 93 bp, Homo sapiens
cctggcgttttgtgatggtgtgaggctgggatctcacacatctttttttttttttttttttttttgagacagagtctcactctgtcacccagg

SEQ ID NO: 46079 - DNA, 56 bp, Homo sapiens
tgagacagtctcccactgtcacccaggctggagtgcagtggcgtgatcttggctca

SEQ ID NO: 46080 - DNA, 79 bp, Homo sapiens
ggagaagcgcttgaacccaggagacagaggttgcagtgagtcaccgcattgtagtctgggtgatgaagtgagactctct

SEQ ID NO: 46081 - DNA, 56 bp, Homo sapiens
tgagacagtctcagtctctcacccaggctggggtgcagtggcgggatctcggctca

SEQ ID NO: 46082 - DNA, 110 bp, Homo sapiens
tatgggtctttttgttgcagcagcatagcctgttctctaactaatactttatttttttaatttttaggttcgggggtacacatgcaggtttgttgcacaggtaaattgta

SEQ ID NO: 46083 - DNA, 90 bp, Homo sapiens
gtgtcccggtctcatatgacctcaggaggcagacttcttttttttttttttttgagatggagtctcactctgtcgcccaggctggagcgc

SEQ ID NO: 46084 - DNA, 120 bp, Homo sapiens
atatatatgcatatgtatgtgtatgtatacatatgtatgtatatgtgtatatatgtatgtatgtgtgtatatatgtatgtatatgtgtatacacacacatacatttatatacatatatat

SEQ ID NO: 46085 - DNA, 117 bp, Homo sapiens
gggccctctcagtggagggggtgtaagtgtgcatatgctgcgagatctatatttagttttatatctgtctctctctgtatctccatatattccagtccaataaataccacagggttt

SEQ ID NO: 46086 - DNA, 116 bp, Homo sapiens
tgtgttccagcaagttctgtagaggactctgactgatgtgttcaaaggttgatactagtttttctttcttttttttttgagacagagtctcgctctttcacccaggctgcagtgca

SEQ ID NO: 46087 - DNA, 116 bp, Homo sapiens
atatcatatatatatacatatatgtatatatgtatatatatacacatatatatatcatatcatatatatatgtatatatgtatgtgtatgtatatatgtgtatatatatatatatg

SEQ ID NO: 46088 - DNA, 126 bp, Homo sapiens
atatatatatatatacacatatatacatacacatacatatatacatatatatatgatatgatatatatatgtgtatatatatacatatatacatatatgtatatatatatgatatagatatggaca

SEQ ID NO: 46089 - DNA, 95 bp, Homo sapiens; identical to SEQ ID NO: 68

SEQ ID NO: 46090 - DNA, 93 bp, Homo sapiens; identical to SEQ ID NO: 69

SEQ ID NO: 46091 - DNA, 71 bp, Homo sapiens
ttctaggaagacagccccacagctcaaaaggtttcttctccagccagccctgtgtctgtgtctcactagga

SEQ ID NO: 46092 - DNA, 99 bp, Homo sapiens
gcaatattggggtctttttctactaaaaaaaaagtatttgaaactcaaacttagctgggcttttttttttttttttttgacaggatctcactctgttgc

SEQ ID NO: 46093 - DNA, 66 bp, Homo sapiens
gttgttgttgttgttacagagtctcactctgtcgcccaggctggagtggagtggcacaatctcggc

SEQ ID NO: 46094 - DNA, 105 bp, Homo sapiens
gatctggaaatcattcgataaagttgcctggcatgtagtgatggaaattactaatattattattaattcatgtgacttcgtcatgaacatgaatgatttcttttc

SEQ ID NO: 46095 - DNA, 75 bp, Homo sapiens
gttaatatgtcttgagacaggctctcactctcacccaggctggagtgcagtggcactgtcacagctcattgcagc

SEQ ID NO: 46096 - DNA, 130 bp, Homo sapiens
acagaggagtgtatttggtctcaattggaaagaccttctttatgttgaccccaacactgtctctctgtaactggttttgttctgctctccagaggttcatgcaggaagatgaccatctgcggcaagagag

SEQ ID NO: 46097 - DNA, 89 bp, Homo sapiens
gggctattaggtattagcagctatgtggttcgacttttttttttttttttttgagacagggtctcactctgttgcccaggctggagtgc

SEQ ID NO: 46098 - DNA, 88 bp, Homo sapiens
ggcagggcagggcggggaagtggacagctttgcagtcaggccgcctgggccagaacccagcttcactctctctgagtctcccttgccc

SEQ ID NO: 46099 - DNA, 111 bp, Homo sapiens
gctgggtatggtggtatgcacctgtggtcccagctactggggcggctgaggtaggaggatcccttgagcctggaaggttgaggctacagtgagccatgatcacaccatcgc

SEQ ID NO: 46100 - DNA, 111 bp, Homo sapiens
ggcaaaatgtttactattgttggctctaagtagtgctatatatttcagcttttctctatgtttgaaaatttttataacaaaaaattggggaaaacaatacaatatagtgtc

SEQ ID NO: 46101 - DNA, 58 bp, Homo sapiens; identical to SEQ ID NO: 12594

SEQ ID NO: 46102 - DNA, 83 bp, Homo sapiens
tcttggggcaaagaggtcctgagaagcgaacaaagtagacaaactatcacaaagtcactctcacaggcagcctctctccttga

SEQ ID NO: 46103 - DNA, 118 bp, Homo sapiens
ttgaattattctctaaggaagattggtctcttctcccacattcatttattacttcatgtatttatttataactgtgtggacttgtggatatttattttacctctgggttataattcaa

SEQ ID NO: 46104 - DNA, 102 bp, Homo sapiens
gtcatggacctgcctctctttccagcctgctcagctgctgatggcaggatccatttctctgtgtctgtcactgcgcctgtagtatctggaatgttgtaagcc

SEQ ID NO: 46105 - DNA, 65 bp, Homo sapiens
cggtcactccctcagtctcacagcagccctgctgccgtgatcccattttacagaaagggagaccg

SEQ ID NO: 46106 - DNA, 79 bp, Homo sapiens
gtgctgcatgctcgactgtgacagctgccgttctaagagtcacgcgaacctggcaaacctgacacaagtcagtcagcac

SEQ ID NO: 46107 - DNA, 58 bp, Homo sapiens; identical to SEQ ID NO: 1409

SEQ ID NO: 46108 - DNA, 114 bp, Homo sapiens
tctggggaaagggtctttgcaggtgttaagaagttaaggattttgaggtgggatcattcttttttttttttttcttttttttttttgagacagagtctcgctctgtcgcccagg

SEQ ID NO: 46109 - DNA, 76 bp, Homo sapiens
gtttgtcttttgagacggagtctcgctctgtcgctcaggctggagtgcagtggcgggatctcggctcactgcaagc

SEQ ID NO: 46110 - DNA, 58 bp, Homo sapiens; identical to SEQ ID NO: 902

SEQ ID NO: 46111 - DNA, 117 bp, Homo sapiens
ttgtgtttacataagtgcagtttgcatttgtgtgtggtttttatgtgattttgagtgatcgtgagagatgattgtgtgcacatgtaattttgcatggctgtatgtgtgtttatgcaa

SEQ ID NO: 46112 - DNA, 85 bp, Homo sapiens
caggctgtggagtggaaggtggacagaggggagaggctggcagctgtcctcaggctttgtctgtctctctgagtcctggctttcc

SEQ ID NO: 46113 - DNA, 67 bp, Homo sapiens
gtgtgccatccatcacattcatcacgtcgtggagcagagaagcctgtgaggtcactgtgtgacacac

SEQ ID NO: 46114 - DNA, 74 bp, Homo sapiens
agggacacaagacgtagaaagtgtcatgggggtgcttctggcccttagacacctttctgaatcactctgtctct

SEQ ID NO: 46115 - DNA, 57 bp, Homo sapiens
ggaggatcaggagctgctcgttaaaagctggggacactcagaggctcttgtttttcc

SEQ ID NO: 46116 - DNA, 58 bp, Homo sapiens
tgagacagggtctcactctgtcacccaggctggagtgcagtggtgggatcagagctca

SEQ ID NO: 46117 - DNA, 258 bp, Homo sapiens
tataggcacatgccaccatgcccagctaatttctgtgtgtgtgtgtgtgtgtgtgtgtgtgtgtgtgtgtgtgtgtatatatgtatatatatgtatatatatgtgtatatatgtatatatatgcgtatatatgtatatatgtatatatatgcgtatatatgtatatatatgtgtgtatatatgtatatatgtgtatatatgtgtatatgtgtatatatgtatatatgtgtatatatgtgtatatgtgtatatgtgtgt

SEQ ID NO: 46118 - DNA, 75 bp, Homo sapiens
aagtctgtgtatccacgtgcatatcgtgtgcttgggaaaaatctatgcaggtgtgtgtgtgtgtgtcacgggttt

SEQ ID NO: 46119 - DNA, 68 bp, Homo sapiens
tgttttgagacggagtctcactctgacacccaggctggagtgcagtggtgagatcttggctcactgca

SEQ ID NO: 46120 - DNA, 75 bp, Homo sapiens
acggggtctgagtcaccacactgggggttcagctgggaagagcccatcctcttgtgaaggaggcgcgggccgcgt

SEQ ID NO: 46121 - DNA, 126 bp, Homo sapiens
tgtaggtgcgcatgtgtggatgtgtgtggtatgtacatatatacacatgtgtttatatatatgtaaggtatgcatggggtgtatgcgtgagtctatatgcatggatgtctgtgtacatgcatgtat

SEQ ID NO: 46122 - DNA, 115 bp, Homo sapiens
gtcctccatagctgacggcttccaggtctgggccccagggtggttttgttgtcataactttttggaaagtaaagcagtatcaagaatgggctgcagactcctcagattccaaggc

SEQ ID NO: 46123 - DNA, 56 bp, Homo sapiens
tgaccgagtctcactctgtcaccccagctggagtgcggtggcgtgatctcggctca

SEQ ID NO: 46124 - DNA, 74 bp, Homo sapiens
tcattcggcctctctgagtgtcagtgtttcaccccagcatgggctgaggagaaccactcagaggaccgctgtga

SEQ ID NO: 46125 - DNA, 67 bp, Homo sapiens
cagccagatgatggcgggtgtctttgtttttttgggaagacagggtctcactctgtcacccaggctg

SEQ ID NO: 46126 - DNA, 75 bp, Homo sapiens
ggacaccagagagcttgctctcactcactctctgcccatgtgaggacacagtgagaaagcagctgtctgcaagcc

SEQ ID NO: 46127 - DNA, 101 bp, Homo sapiens
cggttccccatgcgtggagagacgtgatggagggtttgttctgtgccaggcctggcccacggcttgttttctgctcacatgatcctgtgtggtagatgctg

SEQ ID NO: 46128 - DNA, 71 bp, Homo sapiens
cctggctaatttttgtgttttgtttttgtttttgtttttagtagagacagagcttcatcatgttggccagg

SEQ ID NO: 46129 - DNA, 58 bp, Homo sapiens; identical to SEQ ID NO: 1435

SEQ ID NO: 46130 - DNA, 77 bp, Homo sapiens
ggcgctgggttagaggaaggccggagtggccgtctgtctttgtggagggagggcctgtgtctgtctcgctcactgtc

SEQ ID NO: 46131 - DNA, 63 bp, Homo sapiens
aggccagagtcatccagaaacggagggagtgagctctctttctctctgtagatgcaccagcct

SEQ ID NO: 46132 - DNA, 70 bp, Homo sapiens
gagacctggcactagatgtgtaacctcagttaggtctcagccttgctgattcacagtctctgtgcctctc

SEQ ID NO: 46133 - DNA, 99 bp, Homo sapiens
gtgcagggaatagtgggtccaagtattggaggtagaaggagtgggtgcaatcttcttatcaagtcacagaaactgcttgggcagaagcaaaccgtgaac

SEQ ID NO: 46134 - DNA, 66 bp, Homo sapiens
cccagcatgactatgactgtgcagattttcaatgactgcctctcagtcactgtgtgacctcctggg

SEQ ID NO: 46135 - DNA, 103 bp, Homo sapiens
agagagttgaaactctgtccctcttcaaaactgcagaaactggagaagcctttttttctttttccttttttttttttttttttgagacagggtcttgctcttt

SEQ ID NO: 46136 - DNA, 72 bp, Homo sapiens
gactggggttgtaaagagaggcatcatccaggaaagcactggagaagtgaagcagcatttgaaacccgtgtc

SEQ ID NO: 46137 - DNA, 72 bp, Homo sapiens
tgtaggtcagtctgtggctctggcagtgacaagataattgtcatcaagctcatggttcaccgtctacctcca

SEQ ID NO: 46138 - DNA, 73 bp, Homo sapiens
tggagggttttggtaagggctggcgggggccgcagggccctcagtgtccgtctgtcacacgcagagttcttca

SEQ ID NO: 46139 - DNA, 84 bp, Homo sapiens
tgagatggagtctcactctgtgactaggatggaatgcagtggtgcaacccctgcctccctagttcaagagattctcctgcctca

SEQ ID NO: 46140 - DNA, 112 bp, Homo sapiens
gctgccagatagcctacagtgcatgggagagcccctcatatcagtatttttttttttactcatttattttttgagatggagtctcgctctgtcacccaggctggagtgcagt

SEQ ID NO: 46141 - DNA, 83 bp, Homo sapiens
ggtattagatgagagaagactgagagcctctaggtttgcaggaatgcacttggctgttcttaggtttttgtgtatctttaact

SEQ ID NO: 46142 - DNA, 68 bp, Homo sapiens
ttactttgaaacagtctcgctctgtcgctcaggttggagtgcagtggcgtaatcttggctcactgtaa

SEQ ID NO: 46143 - DNA, 94 bp, Homo sapiens
ggttggcaccttgggaacgtgtgtttgcctgggtccctggctgactctctcagtgggatgaaggtgggtaagtagagacctgaggttttatgcc

SEQ ID NO: 46144 - DNA, 128 bp, Homo sapiens
gcacatgtttgataacaaagtgtgtatacatatgtacacgtttatatatatgtatatacatatatatacatgaatgtgtaggggtgtgtgtgtgtatttgttctgtgtacatgaatgctcataaatgt

SEQ ID NO: 46145 - DNA, 86 bp, Homo sapiens
ctggctccacatggctctatccctgtgggaccttggacgtgaccctttcagtctctgggtctcagagttcccatctctagagctag

SEQ ID NO: 46146 - DNA, 109 bp, Homo sapiens
agctactcctgtcatcatccccttctccatcggtctcagtgactgactttctcctaacgtcaagactcgctttggaactggggctggtgctgagatgctatggtgggga

SEQ ID NO: 46147 - DNA, 84 bp, Homo sapiens
gtttttgagatggagtctcactctgtcacccaggctggggtgtaatagtgaggtcttggctcactgaaacctctgcctcccggg

SEQ ID NO: 46148 - DNA, 72 bp, Homo sapiens
aataacagacgtagcgtgttacaggggaaaagggggccagtgtgtgtctgcctgcctgtctggtctgttatt

SEQ ID NO: 46149 - DNA, 79 bp, Homo sapiens
agatcctggggaatgctgtctgcttgttgcttgtgggcttgggccccaagtgggtgtgatggagacagtggccagggct

SEQ ID NO: 46150 - DNA, 121 bp, Homo sapiens
ggcgtgcccttcgcgttggttgagagatgtgagtgagcaacttggctttttttttttttttttttttaagatgtcctctggttgctgcatttggcttctttgaagactgcatcgccctgag

SEQ ID NO: 46151 - DNA, 92 bp, Homo sapiens
gtgaccccgggagtggctgggagggtggggaggggaggacagacttcctctgccctggctgagaccttctctctcactctctagtgttgctt

SEQ ID NO: 46152 - DNA, 115 bp, Homo sapiens
gtgacataggagtcccatctcatgttttaacatagagtgtttaaatgacataactgaatttgttcatcttctgtggattttgctttgaaactagagctgttttcttgttaatcat

SEQ ID NO: 46153 - DNA, 84 bp, Homo sapiens
atagcatctggctcactgggtgtctgagagacttaaatagaatgtataggggacttagcacagcgctcaatgaatgatagctat

SEQ ID NO: 46154 - DNA, 58 bp, Homo sapiens; identical to SEQ ID NO: 1673

SEQ ID NO: 46155 - DNA, 84 bp, Homo sapiens
gtcattcactcatttactcactcattcagcaaacacaaaggacttcctgtgtgtcagggctagtgctgaaagttttgggtgtgc

SEQ ID NO: 46156 - DNA, 92 bp, Homo sapiens
gcagtgctggtttcgagaatttgtcactgggtgaactattaatgctaatagtaataataatagtgagtggttagaggagatgagaactttgc

SEQ ID NO: 46157 - DNA, 90 bp, Homo sapiens
caggcgcccgtcaccacacctggctaattttttatattttcagtagagacagagtttcactgtgttagccaggatggttttgatcttctg

SEQ ID NO: 46158 - DNA, 109 bp, Homo sapiens
gagcttcccttgctgtgccctacacagatgctggtgacacacaggtacttgtatttggtgccctccgccacctgattgtatttgtagtttggggacagcttgtcacctc

SEQ ID NO: 46159 - DNA, 66 bp, Homo sapiens
tgttttgagacggtctcactctgtcattcaggctggagtgcagtagtgcgatctccactcaatgca

SEQ ID NO: 46160 - DNA, 103 bp, Homo sapiens
tggaaaagcagccatggctatatatgatgagaaaagatctgtgattttgttggtgacaaaatgacagattctgctaacgtgattggcttgttgcctatgtcca

SEQ ID NO: 46161 - DNA, 159 bp, Homo sapiens
tgtgtgtgtgtgtgtgcatgtatctgtgtgtgtgtatatatatatgtgtgtatatatatacgtgtatatatgtgtgtgtatatatatgtgtgtgtatatatatgtatatatatgtgtgtatatatgtgtgtgtatatatatatatatatatatatatat

SEQ ID NO: 46162 - DNA, 87 bp, Homo sapiens
gggcaggagtggacctgggtctctgtgacagttcaactagagagcatgaaaaacctctgtctctctcacacccatttctctctgctc

SEQ ID NO: 46163 - DNA, 75 bp, Homo sapiens
tcaggcagacagaggccttcaggaagtgaggcaggcacggtctgtctgtctgtctgtctgccaccctctgcttga

SEQ ID NO: 46164 - DNA, 97 bp, Homo sapiens
tatgacatagtatgtgtgtgtatatatatttatgacatagtacatattcctatgtgtaccctattatatactcatacattcatatattcatggcata

SEQ ID NO: 46165 - DNA, 99 bp, Homo sapiens
cccagcaaacaagcagctgggctctgctgggtgttctccatggcaccgtgtttggcagacattaaccacggaacaaccaggagtgctggtgtggctggg

SEQ ID NO: 46166 - DNA, 58 bp, Homo sapiens; identical to SEQ ID NO: 1215

SEQ ID NO: 46167 - DNA, 56 bp, Homo sapiens
gacagtgttggttttgctgagagtccctctcaggagactctcacagagtccctgtc

SEQ ID NO: 46168 - DNA, 68 bp, Homo sapiens
ttgtttttgagacagggtctcactttctgtcagccaggcgacagactgagactccgtctcaaaaataa

SEQ ID NO: 46169 - DNA, 108 bp, Homo sapiens
gccaaagctcttgtccactttcatgctgcttcttggtccagatcctttattcctttcttctagagacaaaagtgagtgcacagaagacgagaggagcttcatgtccgc

SEQ ID NO: 46170 - DNA, 102 bp, Homo sapiens
ggtgatttgggcagtgcaggcttagaaccatccccagagcgtgtgcacagagcaggtccttgctctaggagaggttcgtgtatgttaggagaagaagttgcc

SEQ ID NO: 46171 - DNA, 106 bp, Homo sapiens
tttgggacatttgcataaaagcatcaatagaattaccagaaagaaattatatccttaggtttctttttttttttttttgagacgtagtcttgcgttgtcacccagg

SEQ ID NO: 46172 - DNA, 60 bp, Homo sapiens
tggttttctcactgtgtaatgcgtaatgccttgcagcattgctgtgtggctcgaggacca

SEQ ID NO: 46173 - DNA, 137 bp, Homo sapiens
tatatatatgtgtatatatatacatcatcatatatgtatatatatgtgtatatatatacacatcatcatatatgtgtatatatatgtgtgtgtgtatatatacatcatcatatatatatacatcatcatatatatat

SEQ ID NO: 46174 - DNA, 117 bp, Homo sapiens
gtaaacagtgtggccaggtggaaaaaggctggggtggagttagtgccgaacactgtcagtctgtctcccaggcctgagctccaccgtctgtaaaatgggcacgacacatggacgtac

SEQ ID NO: 46175 - DNA, 81 bp, Homo sapiens
gagggttcaggaatgacccacctgcccagcaccgactgtgtgctccaatagtcacagctgtcactgtcaccccacttcctc

SEQ ID NO: 46176 - DNA, 61 bp, Homo sapiens
cctctctctgactcagtctcctcatctgcaacgaggggagggcggctgtgcagatcacagg

SEQ ID NO: 46177 - DNA, 80 bp, Homo sapiens
cacgcctggggttccgtcccctctggccacttgtctgtcaccttggacacgttgcctggcagcctctgagcctcagtgtg

SEQ ID NO: 46178 - DNA, 98 bp, Homo sapiens
tagttatgccttaagggagggagatgaaaggggactgcaggtgaagaaactaaaatggagtctgtccggctctctctctgctaggagagagtaggcta

SEQ ID NO: 46179 - DNA, 144 bp, Homo sapiens
caagaggcagcagatgcccacagagaaacaggtgtttgtgtgtgtgtgtgtgtgtgtgttttgagacagtctcgctctgtcacccaggctggagtgcagtgggacttggtccatctcagcacccagtgtctgtgaccagctggc

SEQ ID NO: 46180 - DNA, 106 bp, Homo sapiens
agatggtatctcattgtggttttgatttgcatttctctaacagtgatattgagttttttttcttatgtttgttggctgcatgtatgtcttctttgggaaagtgtct

SEQ ID NO: 46181 - DNA, 83 bp, Homo sapiens
agaaagaaagaaaagaaaaaaaagttgtggcactctcgcttgagctggttgggagaatactttcttttctttttttttttttt

SEQ ID NO: 46182 - DNA, 170 bp, Homo sapiens
gtgtgtatatatatgtgtatatatgtgtatatatacgtatatatgtatatatgtgtatatacatatatgtatatatatgtgtgtatatatgtgtatatatatgtgtgtatatatgtgtatatatgtgtgtatatatatgtgtgtatatatatatatatatatatatatat

SEQ ID NO: 46183 - DNA, 113 bp, Homo sapiens
gcccagcgtggtggtggtgcacctgtagttccagctgccggggaggctgaggtagaaggatcacctgagatcaggaaggttgaggctgctgtgagctgagatcatgccactgc

SEQ ID NO: 46184 - DNA, 100 bp, Homo sapiens
ggactccaaaacggggccagcaccggcactaagggaacccgcagcctggccgtcatgcttgggagggtccctgtctgcctgcaccagggcccgttggtcc

SEQ ID NO: 46185 - DNA, 99 bp, Homo sapiens
gctataactgagtatctgagactggtaatttattacataaaggaaaaaaatgtgctttctttttttttttttttttgagaccaagtctcgctctgtagc

SEQ ID NO: 46186 - DNA, 74 bp, Homo sapiens; identical to SEQ ID NO: 44986

SEQ ID NO: 46187 - DNA, 126 bp, Homo sapiens
ggtttgggggaaggagcaaggcccattcactgacgtgcatgaaaatactgccttgactgacactctcactacctaacggagatgtggggagaaactggcagttttcgccaaggaactggggcaagc

SEQ ID NO: 46188 - DNA, 95 bp, Homo sapiens; identical to SEQ ID NO: 68

SEQ ID NO: 46189 - DNA, 93 bp, Homo sapiens; identical to SEQ ID NO: 69

SEQ ID NO: 46190 - DNA, 60 bp, Homo sapiens
gtctgctgggtgggcagagagcgagtctcccccagctctgcctgtgtctgtctgggaggc

SEQ ID NO: 46191 - DNA, 136 bp, Homo sapiens
gcctgggcaatatagtgagaccctgtctcttattttatctatttatttatttatttttgagacagagtctcgctctgtcacccaggctggagtcagtggcgcgatctccgctcaccacaatctccgcttcccgggt

SEQ ID NO: 46192 - DNA, 77 bp, Homo sapiens
gcagacagggtgggcacatttcttttctttctttctttctttttttttttttttgagacagagtctcactctgtcgc

SEQ ID NO: 46193 - DNA, 113 bp, Homo sapiens
gtgagtcacaatctgctttctgtctctgtggacctgtggccttctgtgctcccttctgtcactcagcacgtcttcaaagtttgtccacattgtggcatgagccagtgcttcat

SEQ ID NO: 46194 - DNA, 127 bp, Homo sapiens
aggcggggctggcggctggggcttgtaatttacatgagaaccgtgctggtcactagcgctgtctgtgtctgtctgtcctgcgggacttctgctctggggagggaggctgggattcagcgtcgttgtc

SEQ ID NO: 46195 - DNA, 76 bp, Homo sapiens
ctggtgggctgtgtggggtcagccttgtggttttacgaaacagactttctctctgctgtctctgtgtgtctgtcag

SEQ ID NO: 46196 - DNA, 64 bp, Homo sapiens
gcagaagccatattgtcagcccacgtgggtgtcccacagtcagtgacacggtggctcctctcgc

SEQ ID NO: 46197 - DNA, 117 bp, Homo sapiens
tggggccctgagggcgaccaggcaggcacagaggttgggtggtcaggctggtttcaagtgctgcccgtgcagggctggggcccagcaccagcctcagtgtcctcctctcctccccca

SEQ ID NO: 46198 - DNA, 113 bp, Homo sapiens
ccggtgtttggggtacttaaaatgcagccaacttctggcctccccatggttctgactcagtcagtcacggtggggcgtaggaatctgtgtttctgacaagcccccaagaccgg

SEQ ID NO: 46199 - DNA, 91 bp, Homo sapiens
gtgacaggaggaggctggatggggtgaatttggagaaaagtggcaggtttttgttttttatttttttgagacagggttctctgtctgttac

SEQ ID NO: 46200 - DNA, 74 bp, Homo sapiens
tgcagctcccagggaatagcaaggaaggcggggcccagagagggcagatcttcactcaggctcactgggactca

SEQ ID NO: 46201 - DNA, 75 bp, Homo sapiens
gctggggcaatgggtgagaccatctgcatctgggcagcagaggctgtctgacgagagtgacctcatgctcccggc

SEQ ID NO: 46202 - DNA, 110 bp, Homo sapiens
gagggagaagcagcattcagagtcatccaggtggcctcaggcaggcctggagcctctctgagcctgtgtctgccactgcaaagtgactgcctgtcccgcctgccaccctc

SEQ ID NO: 46203 - DNA, 88 bp, Homo sapiens
gacacaggtctgacagctaccatccggcccctttgcaggcacccttggggctgcctgtctgtctgtctgtggcctcagacgtcttgtc

SEQ ID NO: 46204 - DNA, 70 bp, Homo sapiens
ttgttttgagagggagtctcactctgtcacccaggctggagtgcagtggcacgatttcagttcattgcaa

SEQ ID NO: 46205 - DNA, 66 bp, Homo sapiens
gcgcctgcccagagtagtcagtgaccacccctaggtcccacctgacggccctgcctggccaggtgt

SEQ ID NO: 46206 - DNA, 100 bp, Homo sapiens
ggaccctgcagatgacatagctgactctgcctctgtgcctcggtttcctgtcctgaaaaggggaggggttagtaaaaaggacagctgcctctcagggtgc

SEQ ID NO: 46207 - DNA, 57 bp, Homo sapiens
tgagaggagtctcactctgtcacccaggctggagtgtagtggtgtgatctcggctca

SEQ ID NO: 46208 - DNA, 82 bp, Homo sapiens
gccgtcctgcgtggccagtgaggccagcggccacaccccgagggcctgcgtccctgtatctcacacgggtctgcaggatggt

SEQ ID NO: 46209 - DNA, 78 bp, Homo sapiens
gccagaggctgggagtcctgggcccaggcctgtccacagcctgagttcaccaggtcacagcagccacagagccttggc

SEQ ID NO: 46210 - DNA, 172 bp, Homo sapiens
gccgtgatatttgcagctttgatggccatggcactggtcactgtctctcactgacccgccaccttgcgtcatttgctgccctgccaatcaccgcctctctgcctctcactgtcttctcttcatccctttgtggccgccaaggtgatgtagggcagctgagccccaaaattgc

SEQ ID NO: 46211 - DNA, 65 bp, Homo sapiens
caaccttcttagggagtgacgttttttccaaagtggttgtgaaacagcatctccttggggtgttg

SEQ ID NO: 46212 - DNA, 116 bp, Homo sapiens
gggccgtctgctacctcctggctccatgctgtgggactttgggcccatttctcagcctgtctgtgcctctcagccctttcatccataaagctctgctgtgtgaggagctgtggccc

SEQ ID NO: 46213 - DNA, 109 bp, Homo sapiens
ttttatttggagcacctataaatggtactgtctttatttcatgtttttatttgattattgctagcatgtagaaatagaatggtactgtgtatttcttgttttcatagga

SEQ ID NO: 46214 - DNA, 118 bp, Homo sapiens
agtaaaagttttttggtttttcgcgtgtcctccgttgacttgtcagtgttgagagttactttttattttgtatctgaaggagcagcttagaggaatagttattccaggaagaagagct

SEQ ID NO: 46215 - DNA, 109 bp, Homo sapiens
ggagatcagcctgggcaacagtgagaccctgtctctgcaaaacatttttttatttaattaattttttttttcgagacagagtctcactttgtcactcaggctggagtgc

SEQ ID NO: 46216 - DNA, 91 bp, Homo sapiens
ccgtcagtagtttctgcagagaaacttaaaatcatgaaaagggtcatcaatcaacagatctcagaagtcactgtgcagggactactgaggg

SEQ ID NO: 46217 - DNA, 111 bp, Homo sapiens
ccatctgattgctgaggcttttcatccaggcctcggggctggagaaagcccgggcctgtctccatctctctctggttctggggcaggtggccggcattcacaagaaggtgg

SEQ ID NO: 46218 - DNA, 69 bp, Homo sapiens
cagaagacatggggatgccagctcagaccagggcaccctggcactctctctggctgcctcttgtccatg

SEQ ID NO: 46219 - DNA, 79 bp, Homo sapiens
gctcgtcagtgtatagggagctgcctcgttgttgttttttttgtgtggcggggacagagtctcgctctgtcactgaggc

SEQ ID NO: 46220 - DNA, 59 bp, Homo sapiens
ggtagaagggtgagtgctcttttttttttttttttgagacggagtctcactctgtcacc

SEQ ID NO: 46221 - DNA, 152 bp, Homo sapiens
gcacttcaagcctgggcaacacagtgagacccccatctcttttaatttttactttaaacaaattttttttttttgagacaagtctcgctctgtcacccagactgcagggcagtggcgtgatcttggctcactgcagcctctgccccctgggt

SEQ ID NO: 46222 - DNA, 79 bp, Homo sapiens
gtgctatttgatagtggtttcgatttgcacttccctaatgggtagtgattttgaacatctttccattttcttattggcc

SEQ ID NO: 46223 - DNA, 95 bp, Homo sapiens
ccctgtgggctttttttttttgagacagagtctcgctctgtggctgtggactgcagtggcgcgattttggctcgctgaaacctctgccccctggg

SEQ ID NO: 46224 - DNA, 80 bp, Homo sapiens
tgatgctgagtctcactctgtcacccaggctggagtgcagtggtacaatctcggctcactgcaagctctgcctctcgggt

SEQ ID NO: 46225 - DNA, 69 bp, Homo sapiens
ttgtttgagtcagagtctcactcacttgcccatgctggagtgcagtggcgtgatctcagctcactgcaa

SEQ ID NO: 46226 - DNA, 121 bp, Homo sapiens
acctgagggctcatgccgattgtatgaagcaagaagagaggcaggaggagggaaaactggcgtctctctcactttctctatatcgtcttgacagtacggttgcttttcttggtgtgattct

SEQ ID NO: 46227 - DNA, 86 bp, Homo sapiens
cctgagggacaaaatgatgaggttctagtatttcttttttttttttttctttttttttgagacagagtctcactttgtcacccagg

SEQ ID NO: 46228 - DNA, 89 bp, Homo sapiens
cagcctgggtgacagtgagacactgtctcaaaaaaataaaagttatttatttttttttgagacggagtctcactctgtcacccaggctg

SEQ ID NO: 46229 - DNA, 84 bp, Homo sapiens
caaaggcaggccgacagtggtgtgtgtgctgagtgtgagcatcagcagaaaaactcagtctaaacccctttgttcttctcttgc

SEQ ID NO: 46230 - DNA, 119 bp, Homo sapiens
gagggcagggacactcagggcagagctgtggtctgggagggctctgggccctggctgggtgtttcccactcaggttcttcacgccctcccttcccctgttgaatgacgtctgtttcctt

SEQ ID NO: 46231 - DNA, 98 bp, Homo sapiens
ttagccaaatgtggtggtgcctgtgtatagtctctctccctctcttttttttttttctaactttttgtgacatggtctggctctgtcacccaggctga

SEQ ID NO: 46232 - DNA, 86 bp, Homo sapiens; identical to SEQ ID NO: 2169

SEQ ID NO: 46233 - DNA, 66 bp, Homo sapiens; identical to SEQ ID NO: 474

SEQ ID NO: 46234 - DNA, 105 bp, Homo sapiens
gcccacattttagtgaaggaaacagatgccagacacattcttcttttttttttttttcttgagatggagtcttgctctgtcacccaggctggagtgcagtggcgc

SEQ ID NO: 46235 - DNA, 86 bp, Homo sapiens; identical to SEQ ID NO: 2671

SEQ ID NO: 46236 - DNA, 118 bp, Homo sapiens
caaggcttgcccagattagggtaaagaggcaaagaggctccttttcttttcttttcttttcttttttttttttttttgagtcagaatctctctctgttgcccaggctggagtgcagtg

SEQ ID NO: 46237 - DNA, 68 bp, Homo sapiens
gggcacagtggctcacacctgtaatcccagtactttgggaggctgaggtggaaggatcacttgagctc

SEQ ID NO: 46238 - DNA, 83 bp, Homo sapiens
ggcatgaaacactgcacctggtctatttatttattttgagacagaatttcctactctcacctgggcgggagtgcagtggtgcc

SEQ ID NO: 46239 - DNA, 112 bp, Homo sapiens
gcctgggtaacatagtgagaccccattcctacaagaaattttattttattttattttatttatttatttattttttttttttgagagggagttttgcttttgttgcacaggc

SEQ ID NO: 46240 - DNA, 120 bp, Homo sapiens
gctaggattacaagcgtgagccactgcacctggccggttgttatttttcacatagaagagagagaccagtgagaagggtagcagctgcaggagcaagtgaggtctgaagtagggtggcct

SEQ ID NO: 46241 - DNA, 85 bp, Homo sapiens
gtggcagagtgagactctgtctcaaaaaaaaaaaaaaaaaagttaaaaaaatttttttttttgagacagagtctcgctctgtcac

SEQ ID NO: 46242 - DNA, 124 bp, Homo sapiens
ctggtaatgatgagggggtgggggttctttttttttttttttttttgagatggagtctcgctctgtctcccaggctggagtgcagtggcgcgatcttggctcactgcaagctctgtctccgggg

SEQ ID NO: 46243 - DNA, 87 bp, Homo sapiens
gagatgcctgcagatgcttgctctgggcatgcaggggcccctggggaaggatccgcgcctggctccctctctccatctgtccctcgt

SEQ ID NO: 46244 - DNA, 59 bp, Homo sapiens
ggtcgcctgggtctctgtctcagtgctcagcagggcgaggacaggacagaacgggcccc

SEQ ID NO: 46245 - DNA, 66 bp, Homo sapiens
ccaggaagctccagatggtttttgttggttttctcagacagaggctcgctctgtcgctcaggctgg

SEQ ID NO: 46246 - DNA, 116 bp, Homo sapiens
gtagttgtgtctacagttgagtgccatcactcctggctaattttttcattttttgtggaggtggggtcttgctatgttgcccaggctggtcttgaactcctggactcatacacagc

SEQ ID NO: 46247 - DNA, 85 bp, Homo sapiens
gcatgctttgggtatgtatgtacatttgcatgtatacatgtatgtatgtatgtatggaggtatatgcatattatatgagttttgc

SEQ ID NO: 46248 - DNA, 81 bp, Homo sapiens
ctgtctgatcctctcagtgaccctgtgaggcagacattattatgctcattttgcagatggagttcactgagacccagagag

SEQ ID NO: 46249 - DNA, 118 bp, Homo sapiens
gtgtgtttgtgtgtatatatatatgtgtgtgtgtgtatatatatatgtatatatgtgtgtgtatatatgtatacatgtgtgtatatatacatgtatatatatgtgtgtgtttatatat

SEQ ID NO: 46250 - DNA, 73 bp, Homo sapiens
gactctgtcgttggctctgactctgtcattggctctgactctgtcgttgtctctgactctgtcgttggctgac

SEQ ID NO: 46251 - DNA, 65 bp, Homo sapiens
gtcgttgtctctgactctgtcattggctgactttgtcattgtctctgactctgtcgttggctgac

SEQ ID NO: 46252 - DNA, 119 bp, Homo sapiens
aggtttgtcggtgtgtgcctgtagtcccagctgcttaagaggctgaggtaggaggatcaattgaacccagggaagttgaggctgcagtgaaccatgatcgcaccaccgcactccagcct

SEQ ID NO: 46253 - DNA, 117 bp, Homo sapiens
ccaggtgtgtgaagggaatgaggaaggggattgggcaggtgctcactgaagaaagacatctccacaggggccagcccaccaacgaacaccttcttcctgattccagctgagccttgg

SEQ ID NO: 46254 - DNA, 107 bp, Homo sapiens
gagaacctactaagtgccaggcatttgagttagatggatgaaaagatattactgtcttctccttataaactcacaaagcaatggggaaaatagataagtaggtggtc

SEQ ID NO: 46255 - DNA, 80 bp, Homo sapiens
catgtgaacagcgcttgtgtttagctgggccatatttcaatttgattgtcttgcccacgacacactgactgtctcacatg

SEQ ID NO: 46256 - DNA, 75 bp, Homo sapiens
tgggctctctgaccttagagaagctgtgtggtcttttgggacagagaggaagcaacacagtgatcagagagcaca

SEQ ID NO: 46257 - DNA, 73 bp, Homo sapiens
gttgttgttgttgactcagagtctttctctgtcactggagtgcagtggtgcaacctcgggtcactgcaacctc

SEQ ID NO: 46258 - DNA, 74 bp, Homo sapiens
gaatggaaagaagagagatgtataattgggaaatttcagtccccctctgtttctctggctgtctgtgtccattc

SEQ ID NO: 46259 - DNA, 78 bp, Homo sapiens
gacaacatagtgagaccctatctcaaaacaaattaaaattaatttttttttttttttgagacagagtctcactctgtc

SEQ ID NO: 46260 - DNA, 69 bp, Homo sapiens
gtttgttgagatggagtctcactcactctgtcgccttggctggagtgcagtggtgcaatctcagctcac

SEQ ID NO: 46261 - DNA, 69 bp, Homo sapiens
taggtctgcctttcttgttggtgcatctgctgggttttgctgccagcatgttgaaaactggcagttctg

SEQ ID NO: 46262 - DNA, 67 bp, Homo sapiens
ggataggcaggtctgaagatgagaaaggggtcagggctgaggcttgagatttagaagttgtctatct

SEQ ID NO: 46263 - DNA, 95 bp, Homo sapiens; identical to SEQ ID NO: 68

SEQ ID NO: 46264 - DNA, 93 bp, Homo sapiens; identical to SEQ ID NO: 69

SEQ ID NO: 46265 - DNA, 114 bp, Homo sapiens
tatgtaacaaacctgcacatgctacacatgtatcctggaacttagagtaaaatttttttttattatactttaagttttagggtacatgtgcacaatgtgcaggtttgttacata

SEQ ID NO: 46266 - DNA, 90 bp, Homo sapiens
gtgaggaggtagtgctgggccagactgatgagagagagaaccccaagagggaggtaaaatgcagagacttggcagttctacctctatcgc

SEQ ID NO: 46267 - DNA, 77 bp, Homo sapiens
gttcttctgctggtctgtctcagtgtctctcatgcagttgcaatcagatggtggctggggcagagtcttggaggctc

SEQ ID NO: 46268 - DNA, 107 bp, Homo sapiens
aactttgctcaaatgctactgatgcctttaggagagattttgttgttctctggacctgaaagcaatctaatgtacttttataaggccaggctcttgctgacaatgtt

SEQ ID NO: 46269 - DNA, 186 bp, Homo sapiens
atggataaatggataaagaaaatgtgtatatacatatatatgtatatatatatacacgtatatatctcgtatatatgtatatatatacacgtatatatccatatatacgtatatatatgtatatatctcgtatatatgtatatatcaccacaatgtgcatatatatgcaaatgtacatatatatgc

SEQ ID NO: 46270 - DNA, 81 bp, Homo sapiens
tccattgctgctgtggggagtagcttgcttttcttttcttttttttttgagatggagtcttgctctgtcacccaggctgga

SEQ ID NO: 46271 - DNA, 86 bp, Homo sapiens
tcctcataagtaagcagaactgtatgtagaattagaaggtcaacagaaagatttatctaaaaagttctgtttttcttgtagaagga

SEQ ID NO: 46272 - DNA, 136 bp, Homo sapiens
cttgccaaaaacagaagggattcttggctcatttttatcccaacaagactactatttttttttttttttttttttttttgagaaggggtctcactctgtcacccaggctggagtgcagtggtgcgatctcggctca

SEQ ID NO: 46273 - DNA, 72 bp, Homo sapiens
atatatatacgagagaaatatatgtgtatatatatgaaacatatatatccatatatatatttgtatatatat

SEQ ID NO: 46274 - DNA, 136 bp, Homo sapiens
ggtggcaagggtgtttcctttgtttttttttatttatttatattttgattgattgattgagacagagtctctctctgtcgcccaggctggagtgcaatggcacgatcttggctcactgcaacctccgcctcccggg

SEQ ID NO: 46275 - DNA, 76 bp, Homo sapiens
cacagaccgtctgtctctgtggcttgcatattcttcagaacttgtgcccaagtttccatttccagggacgggtgtg

SEQ ID NO: 46276 - DNA, 103 bp, Homo sapiens
catttgccatcctactgtaggtttttatgaagacagagatccattgtaatgaaataagatctatgtttaaaatttatcataagttctaaagtatagtgaaatg

SEQ ID NO: 46277 - DNA, 76 bp, Homo sapiens
ttctgttggcaaagctgtcataacacacacactcacacttttctggtgggtggaaaattgtgcaactgctacggag

SEQ ID NO: 46278 - DNA, 66 bp, Homo sapiens
cctgggaggtgagaattcttttttttctttctttctttgagacggagtctcactctatcacccagg

SEQ ID NO: 46279 - DNA, 103 bp, Homo sapiens
ctcttatgtaggctagaggtaaagtctggctctgtctgactgtggggacatagcgaaaaggaatgtgggttaatatcagatgacctcccctgcagatacagag

SEQ ID NO: 46280 - DNA, 119 bp, Homo sapiens
gggtgctcagaggcgattggcaaggaggcattctggggtggtgtctgaagagcagaggaatgaaatgatgactgtttattgggtgttcactacatgcctgaagctgatctaagcacttt

SEQ ID NO: 46281 - DNA, 95 bp, Homo sapiens; identical to SEQ ID NO: 68

SEQ ID NO: 46282 - DNA, 93 bp, Homo sapiens; identical to SEQ ID NO: 69

SEQ ID NO: 46283 - DNA, 58 bp, Homo sapiens
tgagacagagtctcgctgtgtcactcaggctggagtgcaatggcatgaccttggctca

SEQ ID NO: 46284 - DNA, 79 bp, Homo sapiens
tgtgtgtctctgaagaaaggaggaaaacattttcatctttgttagtttttctttttccagacacagcatatggcataca

SEQ ID NO: 46285 - DNA, 105 bp, Homo sapiens
gcattaataaaacttggtaagagaatagcagggacatggcaggacattggatctcaataatgtgtatttgttattcacacaacaggtttcgtatctattatgtgc

SEQ ID NO: 46286 - DNA, 69 bp, Homo sapiens
gtgtgagaagagtctgtgcccacttggcatctgtttgcctgtttggtaggccacgctctattcctccac

SEQ ID NO: 46287 - DNA, 70 bp, Homo sapiens
gcttgtcgatgtcagggtgtggtctgacctaggcagcccagtgtccaggactcactctctcactggctgc

SEQ ID NO: 46288 - DNA, 79 bp, Homo sapiens
agtggctgctctcctcactctgtggctctgtgtaccttccattcacagatgctcacactgccggtggagcggaatcact

SEQ ID NO: 46289 - DNA, 66 bp, Homo sapiens
aggtatctctgcctcagtgtctctgggttttgcccagcctcgtgcaggtgcaagccagaagtgcct

SEQ ID NO: 46290 - DNA, 95 bp, Homo sapiens; identical to SEQ ID NO: 68

SEQ ID NO: 46291 - DNA, 93 bp, Homo sapiens; identical to SEQ ID NO: 69

SEQ ID NO: 46292 - DNA, 80 bp, Homo sapiens
agtatgtgtatatatatatgtatgtatcttatgtgcatatatacgtatgtatatatactatatatatatataacacatac

SEQ ID NO: 46293 - DNA, 113 bp, Homo sapiens
ggagaacgtaagattggatctgttatcagttcagaaagtattggttcagcatcaccatgtgccaggcacggagctaggaactgagatacaaagacgactgaaatgcgatttcc

SEQ ID NO: 46294 - DNA, 77 bp, Homo sapiens
gcctctggttgagaagagattgattgttttttttttttttttttttttgagatgcagtctgactctgtcacccaggc

SEQ ID NO: 46295 - DNA, 116 bp, Homo sapiens
agccagactttatgcttgccatgagcatgcctgcactgcttggaacccttctgatgtgtgtttgttgaactgaagaggtttcaagaatggggtggctatggccgggtgtggtggct

SEQ ID NO: 46296 - DNA, 71 bp, Homo sapiens
tcaagcaagggaagttgacttaggggcaaggtctgtccaggactctgtctgtgtgtctgtctgtgtcttgg

SEQ ID NO: 46297 - DNA, 100 bp, Homo sapiens
tgattctacatgatggtgagttgtataattatttcattgtatattacaatgtaataataatcgaaataaagtgtacaataaatgtaatgtgcttgaatca

SEQ ID NO: 46298 - DNA, 102 bp, Homo sapiens
ctcacatgtgcaattcacaatggggttcatgctctcatgagaatccagtgctgccactgatctgacaggagacagagctcaggcaataatgcaggtgatggg

SEQ ID NO: 46299 - DNA, 117 bp, Homo sapiens
tgttgggccaacttttcttttctggaaaaagaatgcagcctccagctacttcgatgaaatgtatttgtgttttcttatcaaaataaagaagagtttaaaatatggcaatgtccaccg

SEQ ID NO: 46300 - DNA, 81 bp, Homo sapiens
tactcactggagcttcataaggttgaattttttttttcttttttgagatggagtttcactcttgttgcccaggctggagtg

SEQ ID NO: 46301 - DNA, 114 bp, Homo sapiens
agtttaaataataatatttaatggaatgtggaaattatgtgaagttcaaattttattgttcataaataagatttaattgaccatagccatgatcattaggtattatctatggct

SEQ ID NO: 46302 - DNA, 58 bp, Homo sapiens; identical to SEQ ID NO: 2540

SEQ ID NO: 46303 - DNA, 58 bp, Homo sapiens; identical to SEQ ID NO: 2442

SEQ ID NO: 46304 - DNA, 115 bp, Homo sapiens
cagtggcactgcctgtcacccagtatttccgttttaacagcacgactgtcttttgtctttttttttttgttgttgagacggagtcttgctctgccgcccaggtttgagtgcaatg

SEQ ID NO: 46305 - DNA, 100 bp, Homo sapiens
ttttttggatgctaatgagttgactgatgactggcagcacctagcttcaggatgagggctggtgaccagaaagaccagcaaattaattaaccccaaagga

SEQ ID NO: 46306 - DNA, 97 bp, Homo sapiens
gtgtgatggtgtgcgcctgtggtcccagctacttgggaggctgaggtagaagggtcagttgagccctggaggttgaggctacagtgtaccactgcac

SEQ ID NO: 46307 - DNA, 68 bp, Homo sapiens
aaacatacatatatatattatatatatatatagcgtgtgtgtatatgtatttatgtatacatgtgttt

SEQ ID NO: 46308 - DNA, 86 bp, Homo sapiens
tcccagtgttgttcaggggagatcttcagttttcctgatgactcaatgctgtgtgttctcagtctctctctgttaaaatattggga

SEQ ID NO: 46309 - DNA, 112 bp, Homo sapiens
tccctgccaacagtgtatgagccttcccctttctccacagccagcatcattattttctttttgatagtagtcattttaactggagtgagatgatatctcactgtggttttga

SEQ ID NO: 46310 - DNA, 83 bp, Homo sapiens
gcaggaggctgcctgatactattaagattttttttttctttttgagacagagtctcttgatggcttattagaattctttttgt

SEQ ID NO: 46311 - DNA, 101 bp, Homo sapiens
actacttaataacaattgcatatcattgtgttcacatgtctgtgtgtctacgtgtgtgtgcgtatttgtattgttgggcctgtaacacatagaaatgtaat

SEQ ID NO: 46312 - DNA, 305 bp, Homo sapiens
tatatatacgtatatatacgtgtgtgtgtatatatacgtatatatacgtatatatgtatatatatacgtatatatacgtatatatgtatatatatacgtatatatacgtatatatgtacatatatacgtatatatacgtgtgtgtgtatatatacgtatatatacgtatgtgtgtgtatatatacgtatatatacgtatgtgtgtgtatatatacgtatatatacgtatgtgtgtgtatatatacgtatatatacgtatgtgtgtgtatatatacgtatatatacgtatatatgtatatatgatg

SEQ ID NO: 46313 - DNA, 138 bp, Homo sapiens
ggcaagatgcccttaaccgatgtgggctgtgggacagctcactcagattacctgctgcttgtctctcactctgtcctacttcactgtatcttactgtgtgtgtggccaatccgactgaggtaggggtgtgtgtgtgtg

SEQ ID NO: 46314 - DNA, 144 bp, Homo sapiens
ccagccatgcagaactgtgagtcaattaaacctcctttgtttctttattttttattttatttatttatttatttatttatttattttgagacagagtctcgctgtgtcgcccaggctggagtgcagtggtgtgatcctggctca

SEQ ID NO: 46315 - DNA, 62 bp, Homo sapiens
tagggagctcattgtccccttccaccatgtgaggacacagtgagaagacagtgggtcatctg

SEQ ID NO: 46316 - DNA, 111 bp, Homo sapiens
aatgaaatgcacttggttgtgatgtcatattctatgaatttattggtgaattacatattttttattttattttaagttccaggatacatgtgcagaacgtgcaggtttgtt

SEQ ID NO: 46317 - DNA, 95 bp, Homo sapiens; identical to SEQ ID NO: 68

SEQ ID NO: 46318 - DNA, 93 bp, Homo sapiens; identical to SEQ ID NO: 69

SEQ ID NO: 46319 - DNA, 114 bp, Homo sapiens
tggctgcattaaattatattttgtagatatactagaagttaattattcgtctcttattgaatatatatatttggcttctgtatatcatgttgcaatgaagatcttaatagacca

SEQ ID NO: 46320 - DNA, 101 bp, Homo sapiens
cagcctgggcaacaagagaaaaactctgtctcaaaaaataaaaaataaataagagtttttatatatttgggacacaagtcatttcttgcatgtatagtttg

SEQ ID NO: 46321 - DNA, 114 bp, Homo sapiens
cagcctcccgagtagctgggattacaggtgcctgccaccacgcctggctaattttatatttttagtacagatggggtttcaccatgtttgtcagactgatctcgaacttctggc

SEQ ID NO: 46322 - DNA, 86 bp, Homo sapiens
aacatttttctattattaatattgatgtgcagtgggaccggcggttggtcagtttctctgtctcagttatttaatcggtaaatgtt

SEQ ID NO: 46323 - DNA, 105 bp, Homo sapiens
ttaaagaatggttaatatacctacatttatatatatgtatatgcatatgtttgtatatgatatataacatatatatagtatgagagaggtaaagattatctttga

SEQ ID NO: 46324 - DNA, 85 bp, Homo sapiens
gtggggaaaagattgagaggttggatgcttgccgtgtctgtgtagaaagaggtagacatgggagacttctcattttgttctgtac

SEQ ID NO: 46325 - DNA, 72 bp, Homo sapiens
ggcgtgcaccaccacgcccagctaatttttatatttttcgtagagatggggtttcaccgtgttggtcaggct

SEQ ID NO: 46326 - DNA, 98 bp, Homo sapiens
tatacacacgtatatatacacatatgtatatacacatacatatgtgtatatatgtatacatatgtgtatatatatgtgtgtgtgtatatatatatatg

SEQ ID NO: 46327 - DNA, 89 bp, Homo sapiens
gtatgtataaatatatgtgtgtgtatgtgtatatatatatatacacatacacacacacagttaaaaaatatatatatatacacacacac

SEQ ID NO: 46328 - DNA, 137 bp, Homo sapiens
gggtgacagagtgagactctctctcaaacaaacaaaaagaataaagacaatataacattgaggtatttatttatttatttgagactgagtctcgctctgttacccaggctggagtgcagtggcgtgatctcggctca

SEQ ID NO: 46329 - DNA, 109 bp, Homo sapiens
tgatgatgctgggatagataaaaatagctactgtgtatatttctttttaaagggaactggagggaaacacatcagcatgttagtaagtggtctgttgtccaggtggtga

SEQ ID NO: 46330 - DNA, 100 bp, Homo sapiens
agtggggctatggttgtttcagttttaaatgtgtttaaatatggaagggttttttttttattaattaattaatttatttattttgagacagagtctcact

SEQ ID NO: 46331 - DNA, 102 bp, Homo sapiens
gcaaggtataaatgttaggtatttattttataattaactttaatagctttgtatatttatattagctataatcatttttaagttggatatcttgggctttgc

SEQ ID NO: 46332 - DNA, 99 bp, Homo sapiens
aacatatgatttaacagtgtgatctaaccttgttttttttttaatgagtcaccagttgggagtcaacaaggagtgagatgacattaaatgaataatgtt

SEQ ID NO: 46333 - DNA, 101 bp, Homo sapiens
cccctatgcaggggtggcaggttctacacgtgggagagtccgaggtttcggtgggaagcccctcgcactgtgagtgtgagagcatgtggtgtttgtggggg

SEQ ID NO: 46334 - DNA, 117 bp, Homo sapiens
tcattctgatttcctgctctgcttcccgccaaaccactcaccctgtcactgtctttaaattagccaattggaattagtttagcctgtgtggtctaatcctagccaataggggaatga

SEQ ID NO: 46335 - DNA, 114 bp, Homo sapiens
aaggtgccaacacatacaagtctatcatcataatccacacactgcccagggaacattcccctctggaaacaagagctctggggtctggagtcctagtacttggcctggaatctt

SEQ ID NO: 46336 - DNA, 77 bp, Homo sapiens
tggagcagtcacttctctgtgtctgatataaaataggagcattttatatcagtaattgcatggggtggtggtgacca

SEQ ID NO: 46337 - DNA, 150 bp, Homo sapiens
aagcgttttatatatatatatgtgtgtgtgtgtatatatatgtatatatatgtgtgtgtgtttatatatatgtgtatatatgtgtgtgtgtatatatatatgtgtatatatatgtgtgcatatatatatatgtatgtatgtatatataga

SEQ ID NO: 46338 - DNA, 118 bp, Homo sapiens
agtcagggcagggcatagatcacattgttcatctccagctcagagtctgtttgtcaatttctttttttttttctttttttttttttttgagagggagtcttgcactgttgcccaggct

SEQ ID NO: 46339 - DNA, 162 bp, Homo sapiens
agcaagtttcattctcaaacaagaagaaggaggaagccaggctactagtgtcttgttttttgtttttttttttggggttgaagtctcactctgtcgctcaggctggagggcagtggtgcgatctcggctcactgcaacctgcacctcccgggttcgagcgat

SEQ ID NO: 46340 - DNA, 101 bp, Homo sapiens
ggcgctcggctctcactctgcttctctgagcagccttccttccatccctccagcattgctgagggaaccaggcgaaggggagtgatgggagtaggggctgc

SEQ ID NO: 46341 - DNA, 290 bp, Homo sapiens
gtatatatatatgggaagtatatatatatacttgtatatatatgggaagtatatatatatacttgtatatatatatgggaagtatatatatatatttgtatatatatgggaagtatatatatatacttgtatatatatatggaagtatatatatatacttgtatatatatatgggaagtgtatatatatacttgtatatatatgggaagtatatatatatacttgtatatatatatgggaagtatatatatatacttgtgtatatatatgggaagtatatacatatactt

SEQ ID NO: 46342 - DNA, 90 bp, Homo sapiens
aagtgtatatatatacttgtgtatgtatatataggaagtgtatatatatacttgtgtatatatatatataggaagtgtatatatatactt

SEQ ID NO: 46343 - DNA, 587 bp, Homo sapiens
tgtatatatataggaagtgtatatatatacttgtgtatatataggaagtgtatatatatatacttgtatatatataggaagtgtatatatatacttgtatatatatataggaagtgtatatatatatatacttgtatatatatataggaagtatatatatacttgtgtatatatatatacttgtatatatatataggaagtatatatatacttgtatatatatataggaagtatatatatacttgtatatatataggaagtatatatatatacttgtatatatataggaagtatatatatatacttgtatatatataggaagtatatatatatacttcgtatatatataggaagtatatatatacttgtatatatatatacttgtatatatataggaagtatatatatatacttgtatatatatataggaagtatatatatacttgtatatatatataggaagtatatatatacttgtatatatataggaagtatatgtatatacttgtatatatataggacgtatatgtatatacttgtatatatatatataggaagtatatatatatacttgtatatatatagga

SEQ ID NO: 46344 - DNA, 298 bp, Homo sapiens
tatatatatatacaagtatatatatatacttccatatatatatacaagtatatatatatacttccatatatatatacaagtatatatatacttcctatatatatatacaagtatatatatatacttctatatatatatacaagtatatatatatacttcctatatgtatacaagtatatatatatacttcctatatatatacaagtatatatatatacttcctatatatatatatacaagtatatacatatacgtcctatatatatacaagtatatacatatacttcctatatatata

SEQ ID NO: 46345 - DNA, 92 bp, Homo sapiens
tccagaggttcttttagctctgacactctctaactctgggaatcactaagtcaatggagttcagagggtcatagttgagcaaagcctcagga

SEQ ID NO: 46346 - DNA, 85 bp, Homo sapiens
gagtgagacatcaagttaggaacaaaggttgggaaagatttttgaagattattattatttttatttttgagacggagtctcactc

SEQ ID NO: 46347 - DNA, 56 bp, Homo sapiens
ccctgtctgtgtgcctgtgtcccttctattaaggatacaggtgattggatttaggg

SEQ ID NO: 46348 - DNA, 119 bp, Homo sapiens
agataggcaccccttttcatctgtaggaatgttgatgttccaagcagagaagaactgtgactctgtctctcatgcaagcctgaacctggagggtgctccttttgtggggatgcagtcac

SEQ ID NO: 46349 - DNA, 111 bp, Homo sapiens
gccaggtatggtggtgggcacctgtagtcccagcaactcaggaggctgaggtagaagaatgacttgaacctgggaggcagaggttgcagtgagccaagatcatgccactgc

SEQ ID NO: 46350 - DNA, 69 bp, Homo sapiens
gaggtttctgatgagtgagaggacatgtgaaagctcctaggggctggcattgttctatttcttgatctt

SEQ ID NO: 46351 - DNA, 60 bp, Homo sapiens
tgaaagagacctcacacagtgtgtttgtcatgggctgctctctgtgtgtgactcatttca

SEQ ID NO: 46352 - DNA, 112 bp, Homo sapiens
atataagtgtgtgtgtgtatttctatatagcactggttatatgtatttctatattctatatagaaatatacgcatttctatattctatatggaaatatacgcatttctatat

SEQ ID NO: 46353 - DNA, 127 bp, Homo sapiens
aaccagtgctatatagaaatacacacacacacgtgtgtgtgtatttctatatagcactggttatatttatttctatattctatatagaaatatatgtatttctatattctatgtagaaatatatgta

SEQ ID NO: 46354 - DNA, 84 bp, Homo sapiens
gaagccttgttaaaacacatgttgctgactcccaccctctgtttctgggatagggcctggaaatcagcatttgtaacaagtttc

SEQ ID NO: 46355 - DNA, 88 bp, Homo sapiens
ggagtcttgctcagttccccaggctggagtgcagtggtgcaatctcggctcactgcactctctgcctcctgggttcagtccattctcc

SEQ ID NO: 46356 - DNA, 66 bp, Homo sapiens
tgagacaaggtctcactctgtcgctctgtcgcccaggctagagtgcagtggcacgatcttggctca

SEQ ID NO: 46357 - DNA, 98 bp, Homo sapiens
acatgttatgtatgtatgtttatatgtgtgcatatatatatgtgtatatatgtgtatatatatgtgtatatatatgtgaatatatatatatattctgt

SEQ ID NO: 46358 - DNA, 73 bp, Homo sapiens
gaggtcaaggctgcaatgagctgtgatcaggccactgtacttcagcctgggtgacacagtgtgactctgtctc

SEQ ID NO: 46359 - DNA, 87 bp, Homo sapiens
ctccagtatgggactccctctgtgactccttccaattcccccttacaatctagaggaagaagcgtcatcatggatcctatgccagag

SEQ ID NO: 46360 - DNA, 120 bp, Homo sapiens
ggggtggaatgatatggtttggctctgtgtccccaccaaatcccatctcaaattgtaattctcatatgtcgagggagggacctgctgggaggcggttggatcacgggtgtggtttcccct

SEQ ID NO: 46361 - DNA, 97 bp, Homo sapiens
atggcctcctctcccagcctgttctgtctgcctcggtctctgaagtccgtgtaggattcacagtatcatgggggacagaagtgctataggttgttga

SEQ ID NO: 46362 - DNA, 70 bp, Homo sapiens
tgactctgtgtgtgtgtgtgtacgtgtgtgtgtgtgcacgcacgtgtgtgcgtgtgtgtgtgcattttca

SEQ ID NO: 46363 - DNA, 70 bp, Homo sapiens
caatctgctctgttgtgtttttctccagctgcttaaatacaagaagagagacagcacacagtgtgggttg

SEQ ID NO: 46364 - DNA, 88 bp, Homo sapiens
atagcaccttctcaccacatgaccatatgtatgcatgtatgtaagtatgtatgcatacatttcctgtctgcccttgctagattgttgt

SEQ ID NO: 46365 - DNA, 102 bp, Homo sapiens
gcttagttcttctgccaatgcaaaaggtgtgtttttctcacgtgtctgtgagcaaagtgacaggtgagagagggcattctagtcattggggaaaaactgagc

SEQ ID NO: 46366 - DNA, 68 bp, Homo sapiens
cctattactaggggcacagaagggtatggttcctgataagtccctgtgtgggtccctcggtgggtagg

SEQ ID NO: 46367 - DNA, 58 bp, Homo sapiens; identical to SEQ ID NO: 3701

SEQ ID NO: 46368 - DNA, 108 bp, Homo sapiens
gaagtgttcttgctaaccatatatatatatatatatatgtgtatatatatatatgtatatatacatacacacacatataatatgtatatttggattcaggttagattc

SEQ ID NO: 46369 - DNA, 110 bp, Homo sapiens
tcatgcataataatgatcctggaatttgtatctatttaaattagtacaaaggtgataaaaagcactatttatttatttatttatttatttttcaggaaaaaaatgcatga

SEQ ID NO: 46370 - DNA, 101 bp, Homo sapiens
ttctcttgcatttctttctaaaagttgtatagtttagattttcatattttgcttatctattcaattgtaatttaactttttggatggtgtggagtagagaa

SEQ ID NO: 46371 - DNA, 111 bp, Homo sapiens
gctaggtattatggcatatgcctgtagtcttagctactggggaggctgaggtaggaggatcacttgagcctgggaagttgaggctacagtgagccgtgatcacaccactgc

SEQ ID NO: 46372 - DNA, 58 bp, Homo sapiens
tgagttggagtctctctctgtcacccagcctggagtgcagtggcacgatctcggctca

SEQ ID NO: 46373 - DNA, 111 bp, Homo sapiens
cctttttctcatcagttgctcttaaagtgtactgaaacccatgattaaaataggtacttttttttttcaaggtttcaatactcaatattctaagaatgaagtgacatcagg

SEQ ID NO: 46374 - DNA, 108 bp, Homo sapiens
agtctaggcaggcgtcagattttactttattttttaaatatttaattaattaattaatttatttatttattatttttggagccatagtctcactctgtcgcccaggct

SEQ ID NO: 46375 - DNA, 89 bp, Homo sapiens
ggaaatgtgtgtgcctatacattatatatttatttgtagaatgaatatactatataataaatatgtatgtgtaatgcattctttttttt

SEQ ID NO: 46376 - DNA, 61 bp, Homo sapiens
ttgagacggagtctctcgctctgtcgctcaggctggagtgcagtggcgcgatctcggctca

SEQ ID NO: 46377 - DNA, 107 bp, Homo sapiens
aggacagaaggctccacattgatgtgtgtatgtatgtgtgtgcatttatacatgttatacattttatatatataacataatgaagggtaggagtgaatgcctgttct

SEQ ID NO: 46378 - DNA, 110 bp, Homo sapiens
tggagttcccagagccagaatatgcagactcctgtgtctcagtgcctgactgagtggctgcccactcaagcaactgccatgagtctgcacagctctgtgcttgggaccca

SEQ ID NO: 46379 - DNA, 72 bp, Homo sapiens
agtggtttggcttggcaggctgatgagcagagaataagggaagccgctctctctttgccacaccattctcct

SEQ ID NO: 46380 - DNA, 80 bp, Homo sapiens
gcttcctccctgaactcagacgctgtctgcctgcctccctttgggcacctggcctgctctgccttccaagggagtgattc

SEQ ID NO: 46381 - DNA, 300 bp, Homo sapiens
cttatgtcaggtgggctggaatcgaggggagagggtactgtagagagtcagctcaggtggaattgaggggagagggtactgtacagagtcagctcaggtggaatcgaggggagagggtactgtacagagtcagctcaggtggaatcgtggggagagggtactgtagagagtcagctcaggtggaatcgcagggagagggtgctgtacagagtcagcttaggtggaatcgcggggagagggtgctgtacagagtcagctcaggtggaatcgcggggagagcgtgctgtacagagtcagctc

SEQ ID NO: 46382 - DNA, 60 bp, Homo sapiens
gcctggctgtatacgttccttgacacctatcaagagtgagagaacagtgtggggaggggc

SEQ ID NO: 46383 - DNA, 105 bp, Homo sapiens
gggcctgggtgatagccgtggaggtggtaaatgttggagcaccccaggactcagattggtttctctttatctatatatacttcctaggtgacctcacccagtctc

SEQ ID NO: 46384 - DNA, 86 bp, Homo sapiens
tccagcctgcacatgctgaggctctcttcaggaggaaactgcctggaagtgtgacaagggcctctagccctcagcaagaacctggg

SEQ ID NO: 46385 - DNA, 58 bp, Homo sapiens
tgagacagagtctcactctgtcgctcaggctggagtacagtggtgcgatctctgctca

SEQ ID NO: 46386 - DNA, 92 bp, Homo sapiens
tacatatatatgtgtgtgtgtatatacatatatttttatgtatatatatatacatgtacatatatgtatatgtgtatatatatatgtgtgtg

SEQ ID NO: 46387 - DNA, 58 bp, Homo sapiens; identical to SEQ ID NO: 1435

SEQ ID NO: 46388 - DNA, 109 bp, Homo sapiens
agcatccctgccagtgacttgatccagcttctagaactgtgaggaaatgagtttctgttgttgaagccaaccagtgtatggttctttgctatggcagccctggcaagct

SEQ ID NO: 46389 - DNA, 58 bp, Homo sapiens; identical to SEQ ID NO: 1725

SEQ ID NO: 46390 - DNA, 90 bp, Homo sapiens
tctgtgttatgcttttcattttatatatatatatatatatatatatatatatatatatatatatatatatatgaacaaagccaaaacaga

SEQ ID NO: 46391 - DNA, 90 bp, Homo sapiens
tgctaaatctaaggggaaattttgatgaggaacaggatatttgcatagaattgaagtatcttttccagagattgcttgttatgattagca

SEQ ID NO: 46392 - DNA, 58 bp, Homo sapiens; identical to SEQ ID NO: 1265

SEQ ID NO: 46393 - DNA, 93 bp, Homo sapiens
cctggctgagccgcagtagttcttcagtggcaagctttatgtcctgacccagctaaagctgccagttgaagaactgttgccctctgcccctgg

SEQ ID NO: 46394 - DNA, 78 bp, Homo sapiens
gggattacaggtgtgagccatggtgcccgagtgattttttatttattttttttgacacagggtctcactctgtcaccc

SEQ ID NO: 46395 - DNA, 57 bp, Homo sapiens
tgagacagtctcgctctgtcattccaggctggagtgcagtggcacgatcttggctca

SEQ ID NO: 46396 - DNA, 119 bp, Homo sapiens
tacaaatgttgaaccacccttgcattcctgagatgaaccccacttgatcatgatatattatacttttatagattaatggattcaatttgctatatttgttaagggtttttgtgtctgta

SEQ ID NO: 46397 - DNA, 67 bp, Homo sapiens
tgtgtgagacacagtctcactctgttgcccaggctggagtgcagcggtgtgatcctggctcacggca

SEQ ID NO: 46398 - DNA, 103 bp, Homo sapiens
tccagtagcactgagcaaatctacccaaatcttggtttttatatataattctccactaaaaggaaccaagactctttggaaaatggctagtactcaaactgga

SEQ ID NO: 46399 - DNA, 58 bp, Homo sapiens
catgcccggctaatagtttttctatttttagtagagatactaaatgttagtcaggctg

SEQ ID NO: 46400 - DNA, 73 bp, Homo sapiens
tatatgtatatatctgtatgtatatatacatgtatgtatatatctgtatgtatatatacatgtatgtatatat

SEQ ID NO: 46401 - DNA, 135 bp, Homo sapiens
tatatgtatgtatatatacatgtgtatatgtgtatgtatatatacatgtgtatatgtgtatgtatatatgtgtatatgtatatatacgtgtatgtgtatatatacacgtgtgtatatgtgcatgtatatacatat

SEQ ID NO: 46402 - DNA, 60 bp, Homo sapiens
gatgggactcgctctgttgtgcaggttggtctcaaactcctggcctcaagtggtcctatc

SEQ ID NO: 46403 - DNA, 82 bp, Homo sapiens
ccaacctggccaacatggcgaaaccccgtctttttttttttttttttttgagacggggtctcactctgtcgcaccaggctgg

SEQ ID NO: 46404 - DNA, 58 bp, Homo sapiens
tgagacggagtctcgctctgtcgctcaggctggagtacggtggcgtgatctcggctca

SEQ ID NO: 46405 - DNA, 58 bp, Homo sapiens; identical to SEQ ID NO: 1265

SEQ ID NO: 46406 - DNA, 56 bp, Homo sapiens
gagacagggtctcactctgtcacccaggctggagtgcaatggtgggatcatagttc

SEQ ID NO: 46407 - DNA, 84 bp, Homo sapiens
tagggtgttctcatctctgtgtgtctccgtccaagttcccctcatcttacaaagacactagccattggattagagcccacccta

SEQ ID NO: 46408 - DNA, 92 bp, Homo sapiens
cagtttggggactggaaacaaaatggagttgtttgggtgagatctcttccactgtctcagtcacaattttgcagtgacagtttcaaaagctg

SEQ ID NO: 46409 - DNA, 97 bp, Homo sapiens
ggagtgacaggcagctttttttttttttttttttttttgctgagacagagtcttgctctgtcacccaggctggagtgcagtagcatgatcttggctc

SEQ ID NO: 46410 - DNA, 115 bp, Homo sapiens
ctacgaagagggaaagagaaatggagcagtggctaaaggaaagaatggagtcaagaaaaaatacttgttttatttttgaaatgggagctgctatgacatgtttgagtgctgatag

SEQ ID NO: 46411 - DNA, 113 bp, Homo sapiens
ttatttattcagtgcctactactgtgttagatgccctctggaaccgtatagtgatcatttattatgttaaatatgtgccagacactttatgtggtgaggaatgaaagctgtaa

SEQ ID NO: 46412 - DNA, 58 bp, Homo sapiens; identical to SEQ ID NO: 8823

SEQ ID NO: 46413 - DNA, 58 bp, Homo sapiens; identical to SEQ ID NO: 10482

SEQ ID NO: 46414 - DNA, 116 bp, Homo sapiens
ctcatggttttcagtatattctaatatagaaatatggatgaatataagcatgtatgtttgtatatttatccatctagctgtatttttctgctctgttcactgaggaagcctatgag

SEQ ID NO: 46415 - DNA, 58 bp, Homo sapiens; identical to SEQ ID NO: 1265

SEQ ID NO: 46416 - DNA, 84 bp, Homo sapiens
tccaggcagctgtcagtgcctcagtctgacttgtgaaccaatggccaagggtcacctgatatgggagcactgcctctagcagga

SEQ ID NO: 46417 - DNA, 85 bp, Homo sapiens
tttttttgagatggagtctcactctgtctcccaggctggagtgcagtggtgcgatctcggctcactgaaacttctgcctcctggg

SEQ ID NO: 46418 - DNA, 58 bp, Homo sapiens; identical to SEQ ID NO: 2441

SEQ ID NO: 46419 - DNA, 70 bp, Homo sapiens
gggggcggggacaggccctctggtcagcttggcatctgctgtctggtcagtcaggcactgtctctctgtc

SEQ ID NO: 46420 - DNA, 85 bp, Homo sapiens
ggtgaaaatgtttctctcctggatcctgagtggtggtgtcactgactacacacactctctggaaggggatttggtaacatgaatc

SEQ ID NO: 46421 - DNA, 116 bp, Homo sapiens
ggcctcccaaagtgtagggattacaagcatgagacactgcacctgaccaatttttttctttaaaatcgggccaggtgcagtggctcaggcctgtaatctcagcactgtgggaggct

SEQ ID NO: 46422 - DNA, 111 bp, Homo sapiens
ctctggccgagccttggttttctcagttgtaaaatgggcctgactctgtccctgtctttcatggatggggcatcagctgacccgacaacatacaggaaaagctctgcagag

SEQ ID NO: 46423 - DNA, 58 bp, Homo sapiens
tgagactgagtctcgctctgtcgctcaggctggagtgcagtggcgcgatctcggctca

SEQ ID NO: 46424 - DNA, 81 bp, Homo sapiens
gcatgaggaagtgaggagtgggtgctgactgtcagtgactcgaaccctgactgccccagcatccaacactcacacgcatgc

SEQ ID NO: 46425 - DNA, 85 bp, Homo sapiens
gaagagactgctttcgtgatcaaagccagctctggccaaagaatcatcaactgactggctgtgtgactgcgtgcagaaactcttt

SEQ ID NO: 46426 - DNA, 87 bp, Homo sapiens
tggtggtgtgattgcacccagtgaggggcctgggtcatgcagtagtaggatagacggtgtcctcacttgtcagtgtgtatactatta

SEQ ID NO: 46427 - DNA, 86 bp, Homo sapiens
ggttcaaggctgcagccctcgcttctgttgggcaggtgcctgtaggtgcagaagcaggcctccagctccatgcaggccactggccc

SEQ ID NO: 46428 - DNA, 118 bp, Homo sapiens
agctgcactttcgttcttttctcgtgtcccgttttcaacagaccatggatttttttttttttttttagatggagtctcgctctgtgccaggctggagtgcagtggcacgatctcagct

SEQ ID NO: 46429 - DNA, 103 bp, Homo sapiens
atgttgttatcgcgagtgaaggtttcactgtgcttattcaccaggtttcggagttctgaggggttgttggttgaatacacttgtgctaactcgtggtatgcat

SEQ ID NO: 46430 - DNA, 131 bp, Homo sapiens
gctatgggagattagaatgtggtgctctctcttttttttttttcttttttaagagtctcacactgtcacccaggctggagtccagtggcgtgatcttggctcactgcaacctccgcctcctggactcaagc

SEQ ID NO: 46431 - DNA, 110 bp, Homo sapiens
tctgaaaataactcttttttgaactgttcaagtctatctatctatctatctatctatctatcttgttagagagtggatatagattctgattaattctagatgttggtaga

SEQ ID NO: 46432 - DNA, 73 bp, Homo sapiens
ggattaatgaaggatagagtcagctcacagggtcttcaaatggcccggagggcaggcctgcagccagaggtcc

SEQ ID NO: 46433 - DNA, 78 bp, Homo sapiens
aacattatccctcagggtctctctgtgagccccgaaggccagtcaggggctcccggaggccgtgtggggattagggtt

SEQ ID NO: 46434 - DNA, 87 bp, Homo sapiens
tgctctgagccataagggagtggccggggtcacagtcacagtgtctgtcccaggcccacagaggacagtcccactggacacagagta

SEQ ID NO: 46435 - DNA, 61 bp, Homo sapiens
gttactctgtgtccagtgggactgtcctctgtgggcctgggacagacactgtgactgtgac

SEQ ID NO: 46436 - DNA, 89 bp, Homo sapiens
agtttgaaatcaggaagtgagtcctccaactttggttttttgtttttttgtgtttttttgagatggagcctcactctgtcacccaggct

SEQ ID NO: 46437 - DNA, 70 bp, Homo sapiens
ggaaatctaggcacaggtcatactgctggaaggcttgtctgtctctcccagtctcagggccagagcttcc

SEQ ID NO: 46438 - DNA, 119 bp, Homo sapiens
cacatgtatccccagcttgttcctttttgtggctacgcaggattctttggtgtggacgtgccacagtccgtgtgtccctgccccagctgagggactgctcgtgggattttgctactgtg

SEQ ID NO: 46439 - DNA, 109 bp, Homo sapiens
ggtgaccttgccagctccagcagccttcttgtccactgctttgattctctcagtcactgagaggaccatggagggccctaacaagaactgtggatttgtcttttccacc

SEQ ID NO: 46440 - DNA, 57 bp, Homo sapiens
tgagacacagtctcactctgtcgcccaggctggagtgcagtggtgagatcttgctca

SEQ ID NO: 46441 - DNA, 81 bp, Homo sapiens
gagtctccctcagtcgctcaggctggagtgccatggtgtgatcttggctcactgcagcctctgcctcacggggagggactc

SEQ ID NO: 46442 - DNA, 83 bp, Homo sapiens
tctgctttggcaggtctagcacagcctgctttgttctggcgaaaaccaaaacgggatctgtcctggggcttgccggggtgggc

SEQ ID NO: 46443 - DNA, 88 bp, Homo sapiens
gtacacctgtctctctccctctgtgccacgaaaatagccctaatggctgttgttctgtctgcccaggtcctgagtgacatcagtgagc

SEQ ID NO: 46444 - DNA, 93 bp, Homo sapiens
gtgctgtttcaaacagtggtcagggaaggcttattgagaaggtgacagaggtgacagaggagccaagacttggagccagggtagaagctgtgt

SEQ ID NO: 46445 - DNA, 93 bp, Homo sapiens
cagggagggaggaatgcagacggacaggcagggagggggtactggtaatagcaccccctcactgtctctgtctctctttaaataatgtttctg

SEQ ID NO: 46446 - DNA, 92 bp, Homo sapiens
ctgtaggtgttgggtaagtcactgtctcactctgttctttactctcctgatcggtaaactggtgtagtgggtggtaaacccaatgcccacag

SEQ ID NO: 46447 - DNA, 74 bp, Homo sapiens
gtggcagaaaaccaaatccctctttatctaattgccatggtagttgtcaggagagaggcagcagagtctgtcac

SEQ ID NO: 46448 - DNA, 120 bp, Homo sapiens
ccctgcccttatggcaagagcacatattttaggagtgggggaaaaatgttttctttttaatttattattattttttttagatggagttttgctcttgtcacccaggctgaagtgcagtgg

SEQ ID NO: 46449 - DNA, 118 bp, Homo sapiens
tgcaaaattacgggtaacatccaatggatatgtagcttccaggaattgatatgaaatatttttctttaataggaagactcttgagtgcaaagttgaatggattattgatgtggtggca

SEQ ID NO: 46450 - DNA, 87 bp, Homo sapiens
cagcctgaggagccctgtgcaaccttggagagaggctgcttgctggggcctcagtctctgggtctgtaagttggggagaacagcctg

SEQ ID NO: 46451 - DNA, 85 bp, Homo sapiens
ctggaggcatgcaagctgagggtggaggcctctgcaggagaatgatcagattctctgtgtctctgcttttgaatgcccttcccag

SEQ ID NO: 46452 - DNA, 96 bp, Homo sapiens
cagagaagcagagcaaggaggcacatgtctgggagatggtgggcctgggcttgtcagcctcagtctccctctgggacagggctggctgtgcctctg

SEQ ID NO: 46453 - DNA, 109 bp, Homo sapiens
gggattgagtggggaaggcctatgtgtgtgccctaaagtccatctgtgtccctcagactcaccctccagccctttcttccacccagaatgcccttccctcttctcacct

SEQ ID NO: 46454 - DNA, 139 bp, Homo sapiens
cagagaaagagagacagagagagagagagagtctcagtatgttgccaagtagccttttttttttttttttttttttttttttggagactgtgtctcactctgtcgcccaggttggagtgcgggggtgtgacctcagctc

SEQ ID NO: 46455 - DNA, 116 bp, Homo sapiens
gttggcaggtggggaggtgggaggatgccttcggggtccaggcagaaagctacccctctctgggcctctgtctccctgtgtctgggaggagtcaaaagcctctgcctagctgatcc

SEQ ID NO: 46456 - DNA, 76 bp, Homo sapiens
tggtttttgagaaggagtctctctcactgtcgctcaggctggagtgcagtgatgagatctcggctcattgtaacca

SEQ ID NO: 46457 - DNA, 88 bp, Homo sapiens
acccaggtaccccactctgctgggtctcccagggtccttcccatggaggccagatccagagacacagcacagaggcagcagggtgacc

SEQ ID NO: 46458 - DNA, 58 bp, Homo sapiens; identical to SEQ ID NO: 15894

SEQ ID NO: 46459 - DNA, 114 bp, Homo sapiens
ggcggctgcaggtgctcatggtgctgaggagggaggtgagtgagcgagcagttggctgagtgaagagaaggtgctcaggtaaattggaaagggatgcgagtgctttatactcat

SEQ ID NO: 46460 - DNA, 116 bp, Homo sapiens
ctcatggttttcagtatattctaatatagaaatatcgatgaatataagcatgtatgtttgtatatttatccatctagctgtatttttctgctctgttcactgaggaagcctatgag

SEQ ID NO: 46461 - DNA, 58 bp, Homo sapiens; identical to SEQ ID NO: 1725

SEQ ID NO: 46462 - DNA, 111 bp, Homo sapiens
gttgggaatgaagtgaatacctaaggcaagctcatgacagacttttttttgagacaaagtctcactctgtcacccaggctggagtgcagtggcgttcgcttggctcactgc

SEQ ID NO: 46463 - DNA, 113 bp, Homo sapiens; identical to SEQ ID NO: 46411

SEQ ID NO: 46464 - DNA, 90 bp, Homo sapiens; identical to SEQ ID NO: 46391

SEQ ID NO: 46465 - DNA, 107 bp, Homo sapiens
tgcgcccactgcttgaggcagtgacagaaggcaaataagtccaactcttttttttttttttgagacggagtcttgctctgtcacccaggctggagtgcagtggtgca

SEQ ID NO: 46466 - DNA, 100 bp, Homo sapiens
actacatatatatgtgtgtgtgtatatacatatatttttatgtatatatatacatgtacatatgtgtatatgtgtatatatatatgtgtgtgtgtatatg

SEQ ID NO: 46467 - DNA, 119 bp, Homo sapiens
caggttgggcgtggtggctcatgcctgtaaccccagaactttgggaggctgaggtaggaggatcgcttgaggccaagagttggaggttacagggagttattattgcgcccctgtactcc

SEQ ID NO: 46468 - DNA, 110 bp, Homo sapiens
gtgcctttctgacaggcagaccaaagttttgcttggaatcaggaaaattttttctgttaaatctttgcatttatttatgttctatggtttgacctttcattttgaagtac

SEQ ID NO: 46469 - DNA, 113 bp, Homo sapiens; identical to SEQ ID NO: 46411

SEQ ID NO: 46470 - DNA, 111 bp, Homo sapiens; identical to SEQ ID NO: 46462

SEQ ID NO: 46471 - DNA, 106 bp, Homo sapiens
ctgtctcaaaaaaaaaacataaaatttttcaggtaaaattaaagtctctattatttttttaatttgttagagtatttttgttttcttttttgtttttttgagatag

SEQ ID NO: 46472 - DNA, 58 bp, Homo sapiens; identical to SEQ ID NO: 315

SEQ ID NO: 46473 - DNA, 58 bp, Homo sapiens
tgagacaaggtctcactctgtcacccaggctggagtgcagttgtgcgatcatggctca

SEQ ID NO: 46474 - DNA, 95 bp, Homo sapiens
gatacagatgccaggtgacctagagatcagacacagccccacggacaaagtgggggtgtgtgagaagtcagggtgcactcaccggccaccacgtc

SEQ ID NO: 46475 - DNA, 80 bp, Homo sapiens
tcaggtatggtggcgagcacctctggtctcagctacttgggaggctgaggtgggaggttgacttgagcccaggagtttga

SEQ ID NO: 46476 - DNA, 70 bp, Homo sapiens
gagacagagtctcactccatcactccagtctgcacactaggctggagtgcagtggtgtgaacactgtagc

SEQ ID NO: 46477 - DNA, 73 bp, Homo sapiens
ggaggctgaggtgggaggatggatggcttgagcccgggaggtggaggctgtcaagattgtgccactgcactcc

SEQ ID NO: 46478 - DNA, 114 bp, Homo sapiens
cgcgcgccccgcccccgcgtctccagggcaaccgtggctttcgattgttactgtgggaactggaggtaacagtctacagccatggtcgccccgcagcacgcccacgcgccgcgc

SEQ ID NO: 46479 - DNA, 94 bp, Homo sapiens
cggacagcgcgccggcaccttggctctagactgcttactgcccgggccgccctcagtaacagtctccagtcacggccaccgacgcctggccccg

SEQ ID NO: 46480 - DNA, 70 bp, Homo sapiens; identical to SEQ ID NO: 46476

SEQ ID NO: 46481 - DNA, 80 bp, Homo sapiens; identical to SEQ ID NO: 46475

SEQ ID NO: 46482 - DNA, 80 bp, Homo sapiens; identical to SEQ ID NO: 46475

SEQ ID NO: 46483 - DNA, 70 bp, Homo sapiens; identical to SEQ ID NO: 46476

SEQ ID NO: 46484 - DNA, 58 bp, Homo sapiens
tgatacagggtctcactctgtcacccaggctggagtgcagtggtgtgaccatggctca

SEQ ID NO: 46485 - DNA, 117 bp, Homo sapiens
ggctgcgtgtggtggtgtgcgcctgtacttccagctactaggcaaggctgaggtagaaggatcgtttgaacctaggagttcgaggctgcatgggccatgattgtgccacaatgctcc

SEQ ID NO: 46486 - DNA, 75 bp, Homo sapiens
ggctgtgtgggtccccagtctcttaggctttcccaacccactgatgggcactgcctcgctgcctccctgacagcc

SEQ ID NO: 46487 - DNA, 71 bp, Homo sapiens
tcccatcagctggtgaccttaggcaagtctcggccctctctgagcctcagtctcacttctgcaaaatggga

SEQ ID NO: 46488 - DNA, 58 bp, Homo sapiens
tgagatggagtctcactctgtcacccaggctggagtacagaggtatgatctcaggtca

SEQ ID NO: 46489 - DNA, 58 bp, Homo sapiens
tgagacagagtctcactctgtcgcccaggctggagtgcagtggtgggatctcaactca

SEQ ID NO: 46490 - DNA, 82 bp, Homo sapiens
ctgtgcgacagagtgaaactccttctcaaaataaataaataaaataaaataaatagggacagggtctcactctgtccctcag

SEQ ID NO: 46491 - DNA, 112 bp, Homo sapiens
tagctggagttagctggttatttcctgtttaaggtggttcaggtgagcttgtagtttctatgtactgagaacactggatttgaaagaggaagccagtagcttgcttttacta

SEQ ID NO: 46492 - DNA, 83 bp, Homo sapiens
gggtctctctctgtcactcaggctggactgcagtagcacaatcatagctaactgcacctcgatatcctgggctcaagtgatcc

SEQ ID NO: 46493 - DNA, 56 bp, Homo sapiens; identical to SEQ ID NO: 324

SEQ ID NO: 46494 - DNA, 92 bp, Homo sapiens
ctcattttcatttctgattttggtaatctatgtctaactctctttgttttttggttttattttaccaagatcagatccttggtaagcgtggg

SEQ ID NO: 46495 - DNA, 96 bp, Homo sapiens
cttcaagtcttccttccatgtctgtctctgtccaaattctctctattttttttttttttttttgagatggagtcttgctatgttgccaggctggag

SEQ ID NO: 46496 - DNA, 81 bp, Homo sapiens
atctttaagactctcactgtgtgaacatcatgtgcatcaattatgcctacaggtaactgcattatggtggaagtctaggat

SEQ ID NO: 46497 - DNA, 108 bp, Homo sapiens
ttcttacccaagagcattatcctggttagggtttggtttggttttgttttgttttttaatgtttgccacaaactaacactagatgttagttctttcatcaagtgagga

SEQ ID NO: 46498 - DNA, 83 bp, Homo sapiens
ccagcctgagcaacacagcaagactccatcatttaaaaaaaaaattttttttgagatggagtctcactctgtcaccatgcagg

SEQ ID NO: 46499 - DNA, 113 bp, Homo sapiens
tagaactagggatgaggttaaaaaagagagagaaaagaaatgtaataaagatttaataacaccgtttttttttttttttctcttttttttttgagacagagtctctctttctg

SEQ ID NO: 46500 - DNA, 74 bp, Homo sapiens
tatatatgtatatatgtgtatgtgtatatacacacacgcgcgcacacacacacacacacatatatatatgtata

SEQ ID NO: 46501 - DNA, 86 bp, Homo sapiens
ttagcagttgtgtgtctgttggatctttatctctcgtatctaacttttttttttgagatggagtctcactctgtcacccaggctgg

SEQ ID NO: 46502 - DNA, 58 bp, Homo sapiens; identical to SEQ ID NO: 1673

SEQ ID NO: 46503 - DNA, 93 bp, Homo sapiens
ggcacacacagagggataaccatgtgaagatacaaggtgaatatatatatatatacacacatatagtttgagacagggtcttgctctgttgcc

SEQ ID NO: 46504 - DNA, 56 bp, Homo sapiens
cagtttctgtctctgtcacacaggctggagtgcagtggcagggtcagagcttactg

SEQ ID NO: 46505 - DNA, 76 bp, Homo sapiens
gcctgagtgtcactgtgtgtgcctgtgctgccctctgtgttgctctgatggctctaatgggtcacagccgctcagc

SEQ ID NO: 46506 - DNA, 88 bp, Homo sapiens
ctgggactacaggcaagcaccagcacactttgctaatctttcgtattttttttttttagtagagatggggtttcgccatgttgcccag

SEQ ID NO: 46507 - DNA, 100 bp, Homo sapiens
attcaaaagcacctcaaagtctagaatttgagtctttgaagagagaatttgattttttttttttttagacaaatccttgagacttgagagtgctctgagt

SEQ ID NO: 46508 - DNA, 71 bp, Homo sapiens
taggcctaggtatgaatgggaactgagtggtgtctggacttgctgttcccttctgtgcctctgtgggtctg

SEQ ID NO: 46509 - DNA, 113 bp, Homo sapiens; identical to SEQ ID NO: 46411

SEQ ID NO: 46510 - DNA, 116 bp, Homo sapiens; identical to SEQ ID NO: 46460

SEQ ID NO: 46511 - DNA, 79 bp, Homo sapiens
agtgtgaggtggcagactccctcagtctctagggcagagaagagagagcctctgagaagggtctgtgactttgaacact

SEQ ID NO: 46512 - DNA, 91 bp, Homo sapiens
gcactccagccggggccacagagcaagactccgtctcaaaaaaaaaaaaaaaaagagacggagtctcactctgtctccccggctgaagtgc

SEQ ID NO: 46513 - DNA, 117 bp, Homo sapiens
tcagccttcccaagtgctagggttacaggcgtgagccactatgcctggcctacccatgaattttattttattttttaaattttaaggcgaggtctcactctgtcacctaggctggag

SEQ ID NO: 46514 - DNA, 83 bp, Homo sapiens
ttaattgataaattgtgtgtatttgtggtgtaccacattatacatatatacacacacacagacacgcattgtagaatagttaa

SEQ ID NO: 46515 - DNA, 114 bp, Homo sapiens
tgcctgtgacctggtcatcacatgaggcattttcctgccactctctctctctctgatgtctgtcaattaaaacattacctgggggcaggtaatgtctttccccaggtaagggca

SEQ ID NO: 46516 - DNA, 99 bp, Homo sapiens
cagttcaagtgaagggtcagactaatgtgtttctaaatgtcattactctatttttttttttcctttttcagacacagtcttgctctatcacccaggctg

SEQ ID NO: 46517 - DNA, 58 bp, Homo sapiens; identical to SEQ ID NO: 2224

SEQ ID NO: 46518 - DNA, 56 bp, Homo sapiens; identical to SEQ ID NO: 335

SEQ ID NO: 46519 - DNA, 73 bp, Homo sapiens
actgtgaggaatgtacacattcatatgcacatacatgtatttatgtatgtatatacgaaactgaccccatagt

SEQ ID NO: 46520 - DNA, 79 bp, Homo sapiens
ctattctctctctgtcccttcaggaacagtttaaaacatttatttttgtttccttttgcgatggtcagagtagagagag

SEQ ID NO: 46521 - DNA, 65 bp, Homo sapiens
tttctctggaagggaattgggggaaagtcctgtatttccgttttctctcactctctcagtagaaa

SEQ ID NO: 46522 - DNA, 94 bp, Homo sapiens
cagactcactcactgggctttcggcttcatatctttctttttttctttttttgagatggagtctcagtcttgttgcccaggctggagtgcaatg

SEQ ID NO: 46523 - DNA, 84 bp, Homo sapiens; identical to SEQ ID NO: 46416

SEQ ID NO: 46524 - DNA, 144 bp, Homo sapiens
agatacattcatagaaaaaaagtaaagtaggtattacataccagacctatatgtagatattttatatttatatatgtatgtatgtctgtttatatatgtctatacatatatgtgtgtatgtatatggacatgtaactaaataga

SEQ ID NO: 46525 - DNA, 98 bp, Homo sapiens
ggcagcgttttccccaaggacttgctggcgcccgcttcagggatgcgcgtaagctcccgaggctgtcagtcagtccctcggtcgctccggaaatttga

SEQ ID NO: 46526 - DNA, 58 bp, Homo sapiens
tgagacagagtctcacactgtcatccaggctggagtgcagtggtgtgatctcggctca

SEQ ID NO: 46527 - DNA, 84 bp, Homo sapiens
ttagccacgtgtggctctgaggaactgaggtttcatttatttatttattttatgagacaggtctggctctgtcacccaggctgg

SEQ ID NO: 46528 - DNA, 79 bp, Homo sapiens
cagatggcagtgtggagccctgaaatgaagtaatgatgactggaacttcgattcactgcacacacacactgcctcactg

SEQ ID NO: 46529 - DNA, 68 bp, Homo sapiens
cagggcagagtcctgagggcgagagtgcaggcaaatcccggtctcaccacagactctctctctccttg

SEQ ID NO: 46530 - DNA, 75 bp, Homo sapiens
gtttagggaagagactgggctgagggcagggctgctagaactggtctctgctctgtggctcactgcctgagggac

SEQ ID NO: 46531 - DNA, 58 bp, Homo sapiens
gtgacagagtctcgctctgtctcccaggctggagtgcagcggcgtgatctcagctcac

SEQ ID NO: 46532 - DNA, 99 bp, Homo sapiens
gaatggatgacaaggcagcagtccttgccagcacactcaagcagggtcagagaagacacattgcagtgggtggaatcacggcccctgaattatccaggc

SEQ ID NO: 46533 - DNA, 79 bp, Homo sapiens
ctaaagtctctctctctgtcctgtgttctatgttctagggtgtatgaagaaagggcttcagcagaaacagaggctgaag

SEQ ID NO: 46534 - DNA, 65 bp, Homo sapiens
gcagcagtctgaccagactggggactcaagacgcatgaggcccaggtggcactctctctgtctgt

SEQ ID NO: 46535 - DNA, 117 bp, Homo sapiens
ttacatttcagaagggccaaccatgcagatggcttcaaatgtagtggtgcaggtgatgggtacaatgtatttattttacttttatgtgagtctgtgtatgtgtgtgtgtctgtgtaa

SEQ ID NO: 46536 - DNA, 79 bp, Homo sapiens
gggatgagccacagagccaggtcttttttttttttttttttttttttttttttgagggagagtctcgctctgtcgccca

SEQ ID NO: 46537 - DNA, 58 bp, Homo sapiens; identical to SEQ ID NO: 5571

SEQ ID NO: 46538 - DNA, 101 bp, Homo sapiens
gtgagccactgtgcttggctggttttgaaatatatttgttcttataagttgagtgagtgagtgttgttcagttcagagaattagttcagtgtagtgccgac

SEQ ID NO: 46539 - DNA, 110 bp, Homo sapiens
acgatgataaaggagggagggggagaaaaagaggttgatacagatggttatatgccaaatctgactttttttttcttttttttgagatggactctcgctctgtcacccgt

SEQ ID NO: 46540 - DNA, 106 bp, Homo sapiens
catggcgggttccagcccagatgcaggggtcagcgaggggtgatgtgacagtgagcacagaccctgggtggtggtgacagtggctgtcatggggaggaaaggaatg

SEQ ID NO: 46541 - DNA, 113 bp, Homo sapiens
cagaccagaacttttgtagaccatatatatgtatgtaatatagacaaattatacatgataaatatatgtatattgatatatgcttatatataactatatataaaatttgtctg

SEQ ID NO: 46542 - DNA, 58 bp, Homo sapiens; identical to SEQ ID NO: 315

SEQ ID NO: 46543 - DNA, 89 bp, Homo sapiens
gggcatctcaatgagttaaatttttctttagattgaggaggttggaaacactctttttgtagaatctatgaagggacatcttggagctc

SEQ ID NO: 46544 - DNA, 74 bp, Homo sapiens
ctagatagcagagtgagacactgtctctcagaatttaaaagggtgtgataaagtgtggaaactttgatgtctag

SEQ ID NO: 46545 - DNA, 117 bp, Homo sapiens
ccaaagtgctaggattacaggagtgagccaccgcacccaacctatatttgtatatacattaaattgtatatgttaggctgggcacggtggctcatgcctgtaattccagcattttgg

SEQ ID NO: 46546 - DNA, 74 bp, Homo sapiens
cagagtgagactctgtctccaaaaaaaacagaaatttcccttctttttttcttttttgagactgtctcactctg

SEQ ID NO: 46547 - DNA, 102 bp, Homo sapiens
gctagcttcgtgctcagaacagagttgttgcttggtaaaaatttaatctagtgatttattttttaaagatagccacagtgttctgggtattggagatctagc

SEQ ID NO: 46548 - DNA, 75 bp, Homo sapiens
gtcaaactacatctacaaagtgtcagtatcaagcagcggcttcgaagccgaagtggtacttggatgtaaaatgat

SEQ ID NO: 46549 - DNA, 58 bp, Homo sapiens; identical to SEQ ID NO: 1725

SEQ ID NO: 46550 - DNA, 72 bp, Homo sapiens
ccaggcatggtagtgcacgcctgcagtcccagctactcagcaggctgaggtaggaggatcacttgagcctgg

SEQ ID NO: 46551 - DNA, 68 bp, Homo sapiens
tagatatctatctagatataggtagatggttctctatatagacctatctatatatctatatatgtcta

SEQ ID NO: 46552 - DNA, 114 bp, Homo sapiens
atatatgcatatatatatatatattgcatgcatgtggaggcaggttgtatataatataatatgtatatatattacatatgtatagtgtgtgtgtgtgtatatatatatatatgt

SEQ ID NO: 46553 - DNA, 95 bp, Homo sapiens; identical to SEQ ID NO: 68

SEQ ID NO: 46554 - DNA, 93 bp, Homo sapiens; identical to SEQ ID NO: 69

SEQ ID NO: 46555 - DNA, 87 bp, Homo sapiens
gaatgtgtatacatgaatagaatatatatatatatatatatatatatatatatatatatatatatataaacaagtacacctgcattc

SEQ ID NO: 46556 - DNA, 127 bp, Homo sapiens
gtgagtgattccaaactgctgaagttaaaaaaaaaaaaagtttgttgtgcttttttttgttgttttttttgagatggagtctctctctgtcacccaggctggagtgcagcagcgtgatctcggctca

SEQ ID NO: 46557 - DNA, 78 bp, Homo sapiens
aaacaagctatcagtgaaaatgctttgtgatgtgtggattcatctcagagagttaaagttttttttgtttgtttgttt

SEQ ID NO: 46558 - DNA, 66 bp, Homo sapiens
caggctggacggggggaggggggtctgctgggtcagctttgactctgactctctcctctgagcatg

SEQ ID NO: 46559 - DNA, 58 bp, Homo sapiens; identical to SEQ ID NO: 1763

SEQ ID NO: 46560 - DNA, 85 bp, Homo sapiens
acccagctttattatacagagagagagacagacagatagacagacacagagtcttgctatctctcccagaatggagtgcaatggt

SEQ ID NO: 46561 - DNA, 111 bp, Homo sapiens
accccttaattgtctgacaagagcagaaaggtgagtatgactttggaagtttttttttttttttttttttttgcgtaggagtctcactcactctttcgcccaggctggagt

SEQ ID NO: 46562 - DNA, 99 bp, Homo sapiens; identical to SEQ ID NO: 46532

SEQ ID NO: 46563 - DNA, 91 bp, Homo sapiens
tctgcttctgctgaagatgctgtgaacattttgaaatgacaacaaaggatttggaatgttacataaacttagttgataaagcagcagcagg

SEQ ID NO: 46564 - DNA, 91 bp, Homo sapiens
tccattctctgggttgtttcttcatttttaaaaatttttaatttaatttaattttttttagatggagtctcattctgtcgctcaggttgga

SEQ ID NO: 46565 - DNA, 79 bp, Homo sapiens
tgtgtgtgtgtgtgtgtgtatcatagatctttatatagtgtatatataggtagatctagatatatatctttataatata

SEQ ID NO: 46566 - DNA, 95 bp, Homo sapiens; identical to SEQ ID NO: 68

SEQ ID NO: 46567 - DNA, 93 bp, Homo sapiens; identical to SEQ ID NO: 69

SEQ ID NO: 46568 - DNA, 95 bp, Homo sapiens; identical to SEQ ID NO: 68

SEQ ID NO: 46569 - DNA, 93 bp, Homo sapiens; identical to SEQ ID NO: 69

SEQ ID NO: 46570 - DNA, 74 bp, Homo sapiens
ttagagaggagtgtttttagaaaaagcaaatggggaacaaaatcactatgtctttttctaaatctctttcatga

SEQ ID NO: 46571 - DNA, 92 bp, Homo sapiens
ggggtctttatcagaatttgttttaggaagcaagacaataactttttttttttttttttagtcttgtatctgacaaagtcagagaggattct

SEQ ID NO: 46572 - DNA, 85 bp, Homo sapiens
gagcaatagagatggggggcctctgcttactctttttttttttttttttttttttgagatagggtctcactctgtctcccaggct

SEQ ID NO: 46573 - DNA, 74 bp, Homo sapiens
ttggttatttatttatttttttttttgagacggagtcttgctctgtctcccagagcagagtgcagtggcgccaa

SEQ ID NO: 46574 - DNA, 94 bp, Homo sapiens
gctagaacccagtatgttggtcaaggatcttttttaaaaatgtatttatttttcacagacagggtcttgttttgttaccaggctggagtacagt

SEQ ID NO: 46575 - DNA, 78 bp, Homo sapiens
tttctctgtgcctggctctctctcaagcatcggtagctcatttctggtctggagctcgggccatgtggttcagggaga

SEQ ID NO: 46576 - DNA, 70 bp, Homo sapiens
ttattttgagacccagtctcactctgtcacccaggctggtgggcaacggcgtgacctcggctcactgtaa

SEQ ID NO: 46577 - DNA, 64 bp, Homo sapiens
agcaatgtgagagggccctgtggggtctggccatgatggcagacactgcctctctcccattgct

SEQ ID NO: 46578 - DNA, 108 bp, Homo sapiens
acaagatgaggggtgagaacagtacagtaagatattttgagagagagaagagagaccacattcctgtaactttcattatagtgtattgttataattgctctattttgt

SEQ ID NO: 46579 - DNA, 85 bp, Homo sapiens
tctgagctgtagtagaaggagccctggactaagaaatctggggtttgaactccatctcagctcagattctcactcactctgtggc

SEQ ID NO: 46580 - DNA, 106 bp, Homo sapiens
gttacgatatggttaaccttattttatgtgtatttgaaggtataagataatcccatttataaatttatatatttcagtcagtcgtcctgaggtaaacttgagtaac

SEQ ID NO: 46581 - DNA, 81 bp, Homo sapiens
gcctttctgactgagtccctccctccctttgggatatttttgaagtctgggaggggaggagagaagcaagtttagaattgc

SEQ ID NO: 46582 - DNA, 95 bp, Homo sapiens
acagctagtatgtagtggaaccaggacttggactgaattccctagggcctccctctctgtctcacttccttctacacttatttacagcaagctgt

SEQ ID NO: 46583 - DNA, 73 bp, Homo sapiens
ggttgtagaaccaccctggcgtgtcaaaggactctggattccaaatggcatgtttagaagtgtgtttactgcc

SEQ ID NO: 46584 - DNA, 71 bp, Homo sapiens
ttgtttttgagagggaatctcactctgtctcccaggctggagtgcagtggagtaatcttggctcattgcaa

SEQ ID NO: 46585 - DNA, 60 bp, Homo sapiens
gtgagacggtgtctcgctctgtcgcccaggctggagtgcagtggcgcgatctcggctcac

SEQ ID NO: 46586 - DNA, 94 bp, Homo sapiens
aaaggtaacaatgtgaggtgatggatgtgttaatttgattgtagtaatcatttaacaatatgtatatatatcaaatcatcatattgtacacttt

SEQ ID NO: 46587 - DNA, 116 bp, Homo sapiens
ggattacaggcatgagccaccacgcccagcctccatgcttattgatttattttctatttcctgtcactagaatgtgagctctatgagggcaagggttttgcctgtttgttcactgc

SEQ ID NO: 46588 - DNA, 89 bp, Homo sapiens
ttgagtatatgtgcatgtgtgtgtgtgtatatatatgtaattacatatatatacaaatatatattattatttgtataaaaattatttgg

SEQ ID NO: 46589 - DNA, 58 bp, Homo sapiens
tgagacggagtctcactctgtcactcaggctagagtgcagtggtgcgatcctggctca

SEQ ID NO: 46590 - DNA, 69 bp, Homo sapiens
gacttatgggagtggtagaacattcttgagccgtggcctttttgggagagttaggccccttgaaaagtc

SEQ ID NO: 46591 - DNA, 58 bp, Homo sapiens
tgaggtagagtctcgctctgtcactcaggctggagtgcaatggcgtgatcttggctca

SEQ ID NO: 46592 - DNA, 157 bp, Homo sapiens
tgggtgacagagcaagactctatctcaaaaaaaacaaataaaaaacacccaagttttttgttttttttttttttttttgagactgagtctcactctgtcacccaggctggagtgcagtggcacaatcttggctcactgcaagctccgcctcccaggt

SEQ ID NO: 46593 - DNA, 117 bp, Homo sapiens
cttacctgctcagtgaagcaggtcggcgtgggggcccgggtctggggggccaggagctctgtccgtctgtcagtccgtcagctcggccgtcctgtgtctgtgctgacatcaggtgag

SEQ ID NO: 46594 - DNA, 88 bp, Homo sapiens
caggactcagcctggctctgtccctgcctggctcaccctggacccctcacagagccacaagagaaagggaccaggataggaggccctg

SEQ ID NO: 46595 - DNA, 65 bp, Homo sapiens
ctgtgtagctctctgtgcctcactttccgcatctgagaaatggggcacacagacccacctcgcag

SEQ ID NO: 46596 - DNA, 79 bp, Homo sapiens
gaggtgaggggggctggtgggcatgtggagtaggcactgctgaggctacgcccactcagtcactgcctcagggacctcc

SEQ ID NO: 46597 - DNA, 81 bp, Homo sapiens
ctcccgggttcaagtgattcttctgccccagcctcccaagtagctggacccattacaggcaccagccatcatgcccggctg

SEQ ID NO: 46598 - DNA, 99 bp, Homo sapiens
ggtctaggtctctcccgctgactggttagcctgagtcaccactagctcccctcagtctcatctctctctcaggctctctactcctttcagccttggtcc

SEQ ID NO: 46599 - DNA, 75 bp, Homo sapiens
gctgaaaggagtagagagcctgagagagagatgagactgaggggagctagtggtgactcaggctaaccagtcagc

SEQ ID NO: 46600 - DNA, 98 bp, Homo sapiens
agtgctgggattacaggcgtgagccaccatgcccagctgagaaaacttttttttttttttttttttttgagatggagtctcgctctgtcacccaggct

SEQ ID NO: 46601 - DNA, 89 bp, Homo sapiens
tagaagggcaaacttgttttttgacagaagcaagttgaaattgtacagcctccaactggtttttttttgtttttgtttttgtttttttg

SEQ ID NO: 46602 - DNA, 114 bp, Homo sapiens
gcttcctgtgcccccagtggggccctggctgggatatcatcatatactgtaagtttgcgatgagacactacagtatagatgatgtactagtccgggcacccccagctctggagc

SEQ ID NO: 46603 - DNA, 58 bp, Homo sapiens
cagtctgcagttccagctccaggtaagtgcaccttctctgggtctgtctgcctgtctg

SEQ ID NO: 46604 - DNA, 73 bp, Homo sapiens
ctgggattacaggcgtgagccaccatacccgtctattattatttttgggacagggtctcactgtgtctcccag

SEQ ID NO: 46605 - DNA, 76 bp, Homo sapiens
ctcggcctcgcaaagtgctgggattacaggtgtgagccaccgcacctggcctatttatttatttttagaggcagag

SEQ ID NO: 46606 - DNA, 117 bp, Homo sapiens
ctgggattacaggtgtgagccaccgtgcccagctggatcttcacttttattttattttattttattttatttatttattttattttttggaacatggagtctcactctgtcgcccag

SEQ ID NO: 46607 - DNA, 81 bp, Homo sapiens
aagattgtgaggagaatggaatgagttataggtgtcaggtacttaggcaactcttagttttttcttttcttttcttttctt

SEQ ID NO: 46608 - DNA, 112 bp, Homo sapiens
tatgcaccttcccttcagttagctgctaggatgatagatctatcttttttttttttttttttttttgagatggagtctcactctgtcgcccaggctggagtgcaatggcatg

SEQ ID NO: 46609 - DNA, 72 bp, Homo sapiens
gctaggttgaggtagaaggatcacttgagcctgggaggtcaaggctgcagtgacctgtgatagcaccattgc

SEQ ID NO: 46610 - DNA, 104 bp, Homo sapiens
tgggctatgcgttagtctccgtcagcttggcctctgtgtcgctgtcactcagataactgtgggagtatcgcggtctggaggtgttgtcgagagggtcgtgctca

SEQ ID NO: 46611 - DNA, 100 bp, Homo sapiens
gcctcccgagtagctgggactacaggtgcccgtcaccatgcccagatactttttttgtatttcagtagagatggggtttcaccatgttgcccagggtggt

SEQ ID NO: 46612 - DNA, 135 bp, Homo sapiens
ctctaggccctggggaacaagcagctgcatttttttttttttttttttttaagatttgagatggagtctcactctgtcactcaggctggagtgcagtggagcgatcttggctcactgcaacttctgcctcctggg

SEQ ID NO: 46613 - DNA, 107 bp, Homo sapiens
gggaacttgaaaaaaatactgatgcctggagcccaccctttccctctcagtttctgacataattggtctgggagcaggggcctgggcactgggatttttttgttttt

SEQ ID NO: 46614 - DNA, 89 bp, Homo sapiens
gcagcagagggactagctgtagttgcatgtgaagctgagtggagacaggcacactgacagacgagtgacagctgatggcctaatgaggt

SEQ ID NO: 46615 - DNA, 117 bp, Homo sapiens
ctcagcctcccaaagtgctggggttacaggcatgagccatggtgcccggcaaattttttttttaattagctgggcatgtgggacacacctgtagtcctagctactcaggaggctgag

SEQ ID NO: 46616 - DNA, 115 bp, Homo sapiens
tacttataatgtgtagatgtactactacccaggttttgtcaaatcatcttttttaaagtttttttttttttaattggttcaggacctttgtaggagaggctaatatgtttaagta

SEQ ID NO: 46617 - DNA, 112 bp, Homo sapiens
gagtatactaaccagcacacaggtgttccttatcatttattaaattaataagtatttttatatgcttgaattttgtcatttgctagacttgtgattttggttactgtgattc

SEQ ID NO: 46618 - DNA, 80 bp, Homo sapiens
tgtgagcagagattgagatcctgctgctgcactccagcctaggtgacagagaaagactccatctcactgactctgtttca

SEQ ID NO: 46619 - DNA, 137 bp, Homo sapiens
tatacgtatatatatacactgtgcatatatatacgtatatatatactgtgcatatatatagtgtatctatatatgtatatatatactgtgtatctatatatgtatatatatactgtgtatatatatactgtgtatat

SEQ ID NO: 46620 - DNA, 126 bp, Homo sapiens
atatagtgtatatatatatgtatatatatatactgtgtatatgtatatgtatatatatatgcatatatatatacactgtgtatatatgtatatatatactgtgtatatatatgtgtatatatatac

SEQ ID NO: 46621 - DNA, 58 bp, Homo sapiens; identical to SEQ ID NO: 1725

SEQ ID NO: 46622 - DNA, 102 bp, Homo sapiens
tgtgtcagtgactgccttccaggcactgggctaaatgctttaatttttcatttaatatttacaacacagtcctttgaaataggttcttttgttatctgcaca

SEQ ID NO: 46623 - DNA, 57 bp, Homo sapiens
ttgagatggagtctctcactctgtcgcccaggctggagtgcaatggcacgatctcag

SEQ ID NO: 46624 - DNA, 57 bp, Homo sapiens
catgtatacatgtatatatgtatattcatgtatgatacatgtatacatgtatacatg

SEQ ID NO: 46625 - DNA, 91 bp, Homo sapiens
tatacatgtatattcgtgtgtatatatgtatattcatgtatgtatatatgtatatacatgtatatatatgtgtatatatatatatgtatgt

SEQ ID NO: 46626 - DNA, 104 bp, Homo sapiens
gctgagtaaggtggtgtgtgcctgtagtcccagctactcgggaggctgaggtaggaggatggcttgagcctgggagagctgagattacaccactgcattccagc

SEQ ID NO: 46627 - DNA, 105 bp, Homo sapiens
aaagactactgacaaagttctagaattgggataatgcaattttatagttttattttgaaaaagttaaatcattgatattttgccaagatgggtctttgtctcttt

SEQ ID NO: 46628 - DNA, 96 bp, Homo sapiens
tggactacggtactacagtatagcatggacatatatatatatatattttttagatgaagtcttgtgttgttgtccaggctggagtgcagtggcaca

SEQ ID NO: 46629 - DNA, 83 bp, Homo sapiens
ggcctcactctatcactcaggctgaagtgtagtagcataattatagctcactgcagcctcaaactcctgggctaaagggggtc

SEQ ID NO: 46630 - DNA, 72 bp, Homo sapiens
ccagctgggtaacagggcgagtgcctgtctcaaaaaatatgttacagggtctcactctgtcacccaggctgg

SEQ ID NO: 46631 - DNA, 60 bp, Homo sapiens
tgagacaaagagtctcgctctgtcacccaggctcgagtgcagtggcgcgctctcggctca

SEQ ID NO: 46632 - DNA, 152 bp, Homo sapiens
tagctgggatgacagttgtgtgccaccatgcttggctaatttttttattttttattttttttaatttattttttgagatggagtctcactctgtcacccaggctggagtgcagtggcacgatctcggctcactgcaacctctgcctcccggg

SEQ ID NO: 46633 - DNA, 133 bp, Homo sapiens
cagaaatcaagggaatataattaagtagtaattgctagagaaaagatatgggtgtgtgaagacagtcagctgaatttgagagtagcagatatggctctattttcctcacttctgtgttcctagcttgctctac

SEQ ID NO: 46634 - DNA, 78 bp, Homo sapiens
gcctctcctttgtccccactgagccctgggccccaaaggcagccaggtcagggtaacagtagacagggtggagagagc

SEQ ID NO: 46635 - DNA, 58 bp, Homo sapiens
tgagacagcgtctcactctgtcacccaggctggagtgcagtagtgtgatcacagctca

SEQ ID NO: 46636 - DNA, 82 bp, Homo sapiens
ggtggggggacgaaacagggagaatagctgtttttctttttcttttttttttgagatggtgtctcgctctgtcaccctggct

SEQ ID NO: 46637 - DNA, 72 bp, Homo sapiens
acacacacacacacacacacacacctatgtatgtatatatatacgtacgtgtgtgtgtgtgtgtgtgtgtgt

SEQ ID NO: 46638 - DNA, 58 bp, Homo sapiens
tgagactgagtctccctctgtcacccaggctggagtgcagtggcacgatctcagttca

SEQ ID NO: 46639 - DNA, 101 bp, Homo sapiens
cagtaacaacagggcaacaggttttgactcttgtgggatttattcgttgtttgtttgtttgtttgttttttagatggagtcttgctctgtctcccaggctg

SEQ ID NO: 46640 - DNA, 80 bp, Homo sapiens
ggttgttttttttttgagactgtgtctcactctgtcgcccaggctggagtgcagtggcacaatcttggctcactgcaacc

SEQ ID NO: 46641 - DNA, 87 bp, Homo sapiens
gttaattaagttcagctactgagccttattttttttttaatcttaccgtggttatagaactaggtctcgtggaaacttgattttggc

SEQ ID NO: 46642 - DNA, 68 bp, Homo sapiens
ctgtctgtggttgacagaagtttggctgctgtgattggctcacactcagctacttgttacaacagtag

SEQ ID NO: 46643 - DNA, 112 bp, Homo sapiens
ctattcaagggcctctgcagtttcatattaatctgaggatcactttttctatttctgtgaaaaagactattggaattttgattgcattgaatctgtagatcactttgggtag

SEQ ID NO: 46644 - DNA, 89 bp, Homo sapiens
gcacatctatctcccacttattgactacatgtgcattatttatttttaaaaatgcaaatggggctgcaatgagaatggaaattttaagc

SEQ ID NO: 46645 - DNA, 98 bp, Homo sapiens
gcgggttaggaagcaagactgaggggcctcagaccgagcttttggaaaatagaaaagtctcgctctctgcccctcagcctaacttcctttatttcctc

SEQ ID NO: 46646 - DNA, 72 bp, Homo sapiens
gtcactgtcactgattgactttagagtattaggatgtaactgacatttaatctatcagtcagagatttgggc

SEQ ID NO: 46647 - DNA, 75 bp, Homo sapiens
acatacagatacatatagtttatatatacatatagtgtatacagacacatatatacactgtatgtatctgtatgt

SEQ ID NO: 46648 - DNA, 116 bp, Homo sapiens
gaattaatgaggtttaaaaaatttttgaaaacaggtacatgcaactcccaagtgtgtctctcacactaactagaacatgcaaggacctctctcacatgtattttgccttttgtttc

SEQ ID NO: 46649 - DNA, 94 bp, Homo sapiens
tttatgggaaatataatttgaagttgattctctctcatttttttttttttactgatataggagaattttgtgagtagagtcatatccccatgag

SEQ ID NO: 46650 - DNA, 76 bp, Homo sapiens
ttctaaacaccaggtcaactgagagctatttttttttttttgagacggagttttgctcctgttgcccaggctggag

SEQ ID NO: 46651 - DNA, 118 bp, Homo sapiens
gtggggcgaaggtggggtaggtgcatgatagatcatgctgagacttcttgatttttaaaaaatttacagttattttgcagtttcaggatcttttgtgatgccaacagtgtggttttgt

SEQ ID NO: 46652 - DNA, 85 bp, Homo sapiens
gtacagagggcagtcagagcacagaggggccatcttattcctgctagcagtcagggaaagctgcttgcttttattgtgtgtgtat

SEQ ID NO: 46653 - DNA, 57 bp, Homo sapiens
ggcacaagtgatcacatggtcagtgtcaagattcactgaactgagtgatcacaggcc

SEQ ID NO: 46654 - DNA, 121 bp, Homo sapiens
catacgtgtgtgtatgtatatgtatatacatacatacgtgtgtatgtatatgtatacacatacatatgtatgcatgtatatacatatacatacatatatatgtatatatatatatatatat

SEQ ID NO: 46655 - DNA, 129 bp, Homo sapiens
acacgcattccctcccaggccaccttagggcatgaagcacagtgagagtgtgtgtgtgtgtgtgagtgtgtgtgtgtgcaggtatatgcacgtgtatttatgtgcatgtgtgcgtgtgtgtgcgttcat

SEQ ID NO: 46656 - DNA, 65 bp, Homo sapiens
ggtggtcaggcccaggtgacaccaggagtccaggccctgactcctctgtgtctcagcttgacccc

SEQ ID NO: 46657 - DNA, 58 bp, Homo sapiens
ccctctctctctccgtgtgtgtgtacatatatatgtattttacttgagattgaggggg

SEQ ID NO: 46658 - DNA, 95 bp, Homo sapiens; identical to SEQ ID NO: 68

SEQ ID NO: 46659 - DNA, 93 bp, Homo sapiens; identical to SEQ ID NO: 69

SEQ ID NO: 46660 - DNA, 70 bp, Homo sapiens
ttgttttctgagacagtctcactctgtcacccaggctggagtgcagaggtgcgatcttggctcactacaa

SEQ ID NO: 46661 - DNA, 111 bp, Homo sapiens
taggttgggggcagggagtaattccaactgtgttcttttattttattttattttattttatttttattttttttttttgagatggagtctcactctgtgtcatccaggctg

SEQ ID NO: 46662 - DNA, 73 bp, Homo sapiens
tccccggtgttggcagagtgggtcttcctgccctcaaagcctcgcacgcactcactctcaaaggcctggagga

SEQ ID NO: 46663 - DNA, 73 bp, Homo sapiens
gctaggattacaggcatgagcgtgcctggcttttttttttttttgaaagggagtctcgctctgtctcccaggc

SEQ ID NO: 46664 - DNA, 148 bp, Homo sapiens
gggcgacagagcaagactccgtctcaaaaaaaagtgaaagttaacgagaccatttttcttttttcttttctttttttttttttttttttttgagacagagtctcgctctgtcccccaggttggagtgcagtggcgcgatctcaactca

SEQ ID NO: 46665 - DNA, 80 bp, Homo sapiens
caataactatatatatttaaaaactgactgggtgcggcggcttatgcctgtaatcccagcagtttgggaggttgaggtgg

SEQ ID NO: 46666 - DNA, 95 bp, Homo sapiens
agaccctaaaaagagagagcctgaggtcagctgcgtttgatgcattctcttttttttttttttttgagacagggtctccctctgttgcccaggct

SEQ ID NO: 46667 - DNA, 84 bp, Homo sapiens
cccatacaatgcatagattttttttttttttgagatagggtctcactctgtcacccaggctaagtaaagtggtgcaatgagggg

SEQ ID NO: 46668 - DNA, 88 bp, Homo sapiens
tagttcaaagttatgtattaagtaaaggggtaacttcctttcaaatgctgttgaaaggatgtcttttacttcttctgatactgaactg

SEQ ID NO: 46669 - DNA, 78 bp, Homo sapiens
gtgcccagcctatttatttatttatttgagacagggtctcgctctgtcacccagactagagtgtaatggcatgatcac

SEQ ID NO: 46670 - DNA, 103 bp, Homo sapiens
cgagtatacatccttgagtgaaggtatatgcctttgtgtgattttttattttcatattataggtacacaacataattttcattttcttcaagattgtaacttg

SEQ ID NO: 46671 - DNA, 110 bp, Homo sapiens
gcttttgtatcttgttaatacctactttaaagtatgttaatatttcattttgtttaagaaaaatgaaattttacactatgaatgaatttaggatcaaaagatttaaaagt

SEQ ID NO: 46672 - DNA, 99 bp, Homo sapiens
gtatatattcagtattcgctgagttccccgactgtatgagaagagagtagaactcttctgatcatcaatcttatttctgctctgtgcaaatgcttgtac

SEQ ID NO: 46673 - DNA, 101 bp, Homo sapiens
gcgacagagtgagaccctgtcccaaaaaaacaaaaacaaaaaaactggtaattagtgtttttttttgtttgtttttttgagatggagtctcactctgtcgc

SEQ ID NO: 46674 - DNA, 115 bp, Homo sapiens
gcaagggaatgaaaggatgtgcttgctttagtctcttccctgctagaaatcaggtttagatatcagtgaaatagggacccagaagaaagtcagaaagacattcacttaccacagc

SEQ ID NO: 46675 - DNA, 58 bp, Homo sapiens
tgagactgagtctcgctctgtcacccaggctggagtgcagtggtacagtctcggctca

SEQ ID NO: 46676 - DNA, 84 bp, Homo sapiens
gagagcggtgggtggcaggagtggggcagtgtgtgcctgggccctccacaggcttgaatggcctcactcagtccctcagtcctc

SEQ ID NO: 46677 - DNA, 90 bp, Homo sapiens
ggatgggagctgagggctgggtctttgcgggcgagatgagggtgtcggatcaactggcctacaaagtcccagttctcggcccccgggacc

SEQ ID NO: 46678 - DNA, 58 bp, Homo sapiens
caccgtctgtgacagcttcttgatttgtccccaggtaggtggctgtgtttgacaggtg

SEQ ID NO: 46679 - DNA, 66 bp, Homo sapiens
ctgattacaggactggtagaaggttcttttctaaagaatatgggctccttctcagtccccaatcag

SEQ ID NO: 46680 - DNA, 119 bp, Homo sapiens
tctgggatcaggtagtgacagtggggatggagagaagtggacagagtcaagagactgagcatttctggagctctctctgcacagttctctcctctctggtactctgtcctgtgagatcc

SEQ ID NO: 46681 - DNA, 101 bp, Homo sapiens
ttcaagtagctgggactataggagtataccaccacacctggctaattttttattttttgcagagatgggggtctcactatgtttcccaggctggtcttgaa

SEQ ID NO: 46682 - DNA, 58 bp, Homo sapiens; identical to SEQ ID NO: 2626

SEQ ID NO: 46683 - DNA, 86 bp, Homo sapiens
gattacctatgtccatggaggtgtggggcggcactctgcctaggaaggtactgtctgattcactctcaatgggacgtggcaaagtc

SEQ ID NO: 46684 - DNA, 83 bp, Homo sapiens
gctgttcacagtttgtataggtagttttatgttttttttttttttgagacagtctcgctctgttgcacaggctggagtgcagt

SEQ ID NO: 46685 - DNA, 108 bp, Homo sapiens
attatgccagtatactgaaagttacgtgaatgtgttctctctcaaaatatcttttttttttgaaacggagtctcgctgtgtcaccaggctggagtacagtggcacgat

SEQ ID NO: 46686 - DNA, 88 bp, Homo sapiens
gaaatgcgcaaaactgcttttgttcatgtcagaggccagaggcccctgctgggatctttgtaatgaactgagggatttttctgttttc

SEQ ID NO: 46687 - DNA, 167 bp, Homo sapiens
cagatgtgaaccactgcctcgcccttaattatctttggaaagtgatttaatttttattttgtaataatgtagaataaaggcagaggggatatataacctggataaggctttcaatttttatatttaagctgttactcagttgttttcccccaatatttgaggtgttt

SEQ ID NO: 46688 - DNA, 80 bp, Homo sapiens; identical to SEQ ID NO: 46665

SEQ ID NO: 46689 - DNA, 56 bp, Homo sapiens
tgagagagtctcactctgtcacccaggctggagtgcagaggtgcgatcttggctca

SEQ ID NO: 46690 - DNA, 81 bp, Homo sapiens
ggaggtcagggcaaagtgctttcgccaggagataagaggatccatctttatgcctagtgacacagcctctctctgagttcc

SEQ ID NO: 46691 - DNA, 142 bp, Homo sapiens
tatatatatatatatatatacacgtatacatgtatacgtgtatatatgtatacatgtatatacatatacacgtatatgtatatgtatatacataaaaatatatgtatatacataaaatatatatatatacatatatatgtat

SEQ ID NO: 46692 - DNA, 116 bp, Homo sapiens
atatatatgtgtatgtgtgtatatatatgtgtgtgagtgtatgtatgtatgcatgtgtgtatacacacacacacacacacacacacacatatatatatatatatatatatatatat

SEQ ID NO: 46693 - DNA, 76 bp, Homo sapiens
tgcgcggtgtgtctctctctcaatgaactttttaaaaaaaggaaatcatggcccggagcagtggctcacgcctgta

SEQ ID NO: 46694 - DNA, 116 bp, Homo sapiens
ctccacccctgacctaagtttgcttggaatgtcagcatctagggatttctttttgttcttgagatctttagttaaaatacaacataagcagcacttgaactgtttcttggtggtag

SEQ ID NO: 46695 - DNA, 85 bp, Homo sapiens
gcaattccaatggccatatatgctagtgaccaaattttttttttttttgagaaagaatctcactctctcccccaggctggagtgc

SEQ ID NO: 46696 - DNA, 67 bp, Homo sapiens
gtgacctctgaagtgtgggtggacagagccctggaccaggagcccagtcagctcaccattcactcac

SEQ ID NO: 46697 - DNA, 92 bp, Homo sapiens
gaagaaatccagataagaatagaagaaagggttgttgggggggactctattacttcctttctttctttttttatttttatttattttttttt

SEQ ID NO: 46698 - DNA, 71 bp, Homo sapiens
ttatttttgagatggagtctcactctgtcacccaggctggagtgcagtggtgtgatctcagctcactgtga

SEQ ID NO: 46699 - DNA, 58 bp, Homo sapiens; identical to SEQ ID NO: 1215

SEQ ID NO: 46700 - DNA, 93 bp, Homo sapiens
atatatatatatatatatatgtgtgtgtgtgtatatatatatgtgtgtgtacatatatatatatgtatatatatatatatatatatatatata

SEQ ID NO: 46701 - DNA, 121 bp, Homo sapiens
agcctaagtaacagagttagatgttgtctctttatttttttttttgagccgagtctcactctgtcactgaggctggagtgcaatggcgcaatctcagctcacggcaacctccgcctcgtgg

SEQ ID NO: 46702 - DNA, 82 bp, Homo sapiens
gggtggcgctcatgagggcttcacgtgctgcttctctcactcaataatgcttcgccagagtcaactgactgagctctgatcc

SEQ ID NO: 46703 - DNA, 109 bp, Homo sapiens
ctgatttgtgtacactgatttcatatcctgagactttactgaatttgtttatcagatctaggagcttttttgataaagggtcttaggggttttctaggtatatgatcag

SEQ ID NO: 46704 - DNA, 77 bp, Homo sapiens
ccagtctgatagggttaaaggagtctattttttttttttttttttgaggtggagtcttgctctgtcgtccaggctgg

SEQ ID NO: 46705 - DNA, 97 bp, Homo sapiens
aggaatatgtcatttgggaaaaaatgctatcacattggaaaaacagcttgcaaacaactgttttagatgattttttttccagaaggcttttattctt

SEQ ID NO: 46706 - DNA, 95 bp, Homo sapiens; identical to SEQ ID NO: 68

SEQ ID NO: 46707 - DNA, 93 bp, Homo sapiens; identical to SEQ ID NO: 69

SEQ ID NO: 46708 - DNA, 120 bp, Homo sapiens
cttcacgtgagtggtatataagtcagagttctccagagaaatagaaccaataggatatctatctatctatgtatctatgcatctatctatctatctatccattttcatactgctatgaag

SEQ ID NO: 46709 - DNA, 110 bp, Homo sapiens
tgcattgttctgaatctccattgtctattattccagtcctttttttttgagatggagtctcactctgtcacccaagctggagtgcagtggtgcgatttcagctcactgca

SEQ ID NO: 46710 - DNA, 58 bp, Homo sapiens
tgagacggggtctcactctgtcacccagaccggactgcaatggtgtgatcttggctca

SEQ ID NO: 46711 - DNA, 88 bp, Homo sapiens
ctttccaccaggatctcaaggctggggctgcgactctggtccgtgttactgtcgctgtcccacactcactgagcttctaagatgaaag

SEQ ID NO: 46712 - DNA, 103 bp, Homo sapiens
agtctgggaattatgcctcagctcacttgacagaacagagtctgaggtgcagagaaaggaccgcagcttctgcctctgtgcttgattgagggactccttcact

SEQ ID NO: 46713 - DNA, 73 bp, Homo sapiens
gccacacactccctcactctgcttcaagcacactgacctccttgcccttcgtcaagcaggctgggggtgtggt

SEQ ID NO: 46714 - DNA, 94 bp, Homo sapiens
tgtttcatagttttaatataatactattgtaaatggttttttattttaatttccaaccgtttatatagtgaacccattatactatattgaaaca

SEQ ID NO: 46715 - DNA, 59 bp, Homo sapiens
ggatatcaggcagtagacacaacaaatatccacaacaggctgtctccctgcctgactcc

SEQ ID NO: 46716 - DNA, 117 bp, Homo sapiens
gaatctgttgggaggggagatcaatgtaagtgaacacggttttctgtttttgtaatacaattttcagagctgacacttgtgtggcttgatcaggtttcactggatccctcagtgttc

SEQ ID NO: 46717 - DNA, 61 bp, Homo sapiens
ggtaaagtgagaggttgaaccaggtccctccagggcctccctggctctgtgcctctcagcc

SEQ ID NO: 46718 - DNA, 84 bp, Homo sapiens
tcaccattctgactggcatgagatggtatctcactgtgattttgatttgcatttctctaatgatcagtgaagacactgtggtga

SEQ ID NO: 46719 - DNA, 76 bp, Homo sapiens
tctggaggaaatgcaggagtggaacttttttttaaaaaaattattttttagacagagtctcactctgtcacccagg

SEQ ID NO: 46720 - DNA, 101 bp, Homo sapiens
ccaccaagtgagaaggacaagggcagtgctgagttttctctctgagggcaggtgtcagggtggagatgcgcagcacccaaccacagcccagtcctaggtgg

SEQ ID NO: 46721 - DNA, 77 bp, Homo sapiens
ctccctgtctgtcagtgtgactttatttggaaataggggtctttgcagatgtaattaggtcattctagagcagggag

SEQ ID NO: 46722 - DNA, 94 bp, Homo sapiens
cactcacacaccctaatgacttaggtctttgtctagtttttttttttttttttgagacggagtcctgctttgtcacccaggctggagtgcagtg

SEQ ID NO: 46723 - DNA, 95 bp, Homo sapiens; identical to SEQ ID NO: 580

SEQ ID NO: 46724 - DNA, 93 bp, Homo sapiens; identical to SEQ ID NO: 69

SEQ ID NO: 46725 - DNA, 58 bp, Homo sapiens; identical to SEQ ID NO: 315

SEQ ID NO: 46726 - DNA, 59 bp, Homo sapiens
tgagtcagggttctctctctgtcactttgtctgaagtgcagtggcaggatcacagctca

SEQ ID NO: 46727 - DNA, 135 bp, Homo sapiens
atacatgtatgtatatctgtagatacgtatatgaatatgtatatatgtgtatatatgtgtgtatatgtgtatatgtatgtatatctacatatatgtatatatacatatatgtgtgtgtatatatgtgtatatata

SEQ ID NO: 46728 - DNA, 114 bp, Homo sapiens
gattgactggaggaaagcctacttaagctacagtggtctggctcatgctgagtagtgagtcaggacaaaggccaagaccttctgctttgtggtggggattcctctctctatgtc

SEQ ID NO: 46729 - DNA, 58 bp, Homo sapiens
tgagactgagtctcgctctgtcacccaggctggagtgcagtggcgggatcttggctca

SEQ ID NO: 46730 - DNA, 84 bp, Homo sapiens
cccacctccaccaagcctgagaggggacagctagaggcctcctgcatggctgtctccctgcctcagtgactctgggaggctggg

SEQ ID NO: 46731 - DNA, 71 bp, Homo sapiens
ctgcagtgagctgagactgtaccactgtactccagcctagaccacagtgcaagaccctctctctctctcag

SEQ ID NO: 46732 - DNA, 66 bp, Homo sapiens
gtgtgtgtgtgcatgtgtctgcctggaggcatgtgtgtgtctgtgtgtgtgtgtgtgtgtgtgcat

SEQ ID NO: 46733 - DNA, 111 bp, Homo sapiens
tgtatgaagagctggaagccacaagtatagacatccagccagattgggctgctcagcacccactggctgtctctctgacttcctggaagagctatcaagactccccttaca

SEQ ID NO: 46734 - DNA, 102 bp, Homo sapiens
ccttcttgcttttccagccctgcttctgtgcccttcccactcttcctgtctcactctctgactataatacaaggttgttgaaggtgtgaagcaagcaagtgg

SEQ ID NO: 46735 - DNA, 61 bp, Homo sapiens
tctctctcaccctcacagaccttcccagagccacctgcttggttttagagtgtgggacaga

SEQ ID NO: 46736 - DNA, 76 bp, Homo sapiens
gtttctctctgtgtcaccctctgtgtcgtctgtgtgttccatgtgtgttcaggcagacagaggaacagctgagtgc

SEQ ID NO: 46737 - DNA, 81 bp, Homo sapiens; identical to SEQ ID NO: 7982

SEQ ID NO: 46738 - DNA, 76 bp, Homo sapiens
ctacaggtgtcagccattgtgcctagcctggttatcgccattttaaaggtaggcagtgacactgagacactgatag

SEQ ID NO: 46739 - DNA, 76 bp, Homo sapiens
tctcttaaccaagtatcaagcaccaggaggctgagtcctaattcactctccctcactctgttacttgggaaactga

SEQ ID NO: 46740 - DNA, 64 bp, Homo sapiens
ctgggcacagactcactttgcctgaaacactgtatgacagtggctgagtggctggctgtctcag

SEQ ID NO: 46741 - DNA, 93 bp, Homo sapiens
tgaccccaccactaagatcctctgcatgaaccttggtcatcgctgcagactcccactcagtgtcaggggtgaaaaaaagaggaagtaaaagtg

SEQ ID NO: 46742 - DNA, 109 bp, Homo sapiens
ctgagtatcaatgcatatggtgatattttagtttttttttttattccaactcactgtgtgcttctacacttggttagagttttagagttcactcctgattggtatttgg

SEQ ID NO: 46743 - DNA, 80 bp, Homo sapiens
actctgtgtgtatatctgtgtgtatatacatatgtgtgcatatatatgtacataggtatgtatatataaatatacaaaca

SEQ ID NO: 46744 - DNA, 86 bp, Homo sapiens
ccaaattggccagtgtgagactcttcaggttggctcttttttttttttttttttgagtcggagtcttactctgtcacccaggctgg

SEQ ID NO: 46745 - DNA, 107 bp, Homo sapiens
ggtgccaggggaactgggctaataagtgactcactagctctcagtgactgcctttgtcctggggtgtaagctttgagtcagggtggtggtgcagattctctgcctcc

SEQ ID NO: 46746 - DNA, 81 bp, Homo sapiens
acattgctgtctttggtattcttgcagtgttttcatttatgagaaaacctgcagaagaaactgcttgaaccaaagcaaagt

SEQ ID NO: 46747 - DNA, 95 bp, Homo sapiens
ctaaggaagaagtacaggtagtaggttgcgtagtttgaggacagggattttatccacaaggaggtaattatatgacctgctgctacctttcttag

SEQ ID NO: 46748 - DNA, 86 bp, Homo sapiens
gtatatgtgtgtacatgcttgtgtgtgtgtgtgtgtatatatatatatatatatttatgcattcatttatgtaagtacacatacac

SEQ ID NO: 46749 - DNA, 69 bp, Homo sapiens
accacccgcctcttgggccatgtgagcatgcaatggagttgcacacaggctcactgacactggcctggt

SEQ ID NO: 46750 - DNA, 90 bp, Homo sapiens
gtgtgtatgagagagagagagagagacagagagagatctggcatgcagtgtgctatctgcactgtctggctgtgagtctgtggtgtgtat

SEQ ID NO: 46751 - DNA, 65 bp, Homo sapiens
gcctgagcctcactcactgtcagagcaaggcttcccaagtgtggtggagggagtggggagggggc

SEQ ID NO: 46752 - DNA, 70 bp, Homo sapiens
gggccgcggactagctgcatcttatgccacacttgacctgtgagtgtgcacacagcctgtcatgaggccc

SEQ ID NO: 46753 - DNA, 97 bp, Homo sapiens
ccagggccaagtcaaagctgtcactcacactgactcattagccctaagttcgtctttggggcatgaggtacaagctgagggcagagccatagccagg

SEQ ID NO: 46754 - DNA, 114 bp, Homo sapiens
catttcagaggcaaaatctcaggctggcattggaattcatttcagcccctgaccactctcactgactcccagggccatgaggatttctcgctaggcctcaggaatgatctttga

SEQ ID NO: 46755 - DNA, 81 bp, Homo sapiens
cttggggttagtaacaagtattacctggctgtgaccctccttaggcagcgattggtgagagcagagagtgatgaccacaag

SEQ ID NO: 46756 - DNA, 115 bp, Homo sapiens
gatgttttgactgcttattctgtcaattactgagtgaaatgtataaatatctttcaatattattttgtacctgtttatattttactttagttttgagagttttgctttatatatc

SEQ ID NO: 46757 - DNA, 63 bp, Homo sapiens
caggttggatttgaggcagtgttcacgaaagggctgtttaactgtctcagtcactcccttctg

SEQ ID NO: 46758 - DNA, 79 bp, Homo sapiens
ggattttatgtatgtatgcatgtgtgtgtgtgcttatacatatatactgtatatagacacgtgtctgtatattaaatct

SEQ ID NO: 46759 - DNA, 106 bp, Homo sapiens
agacacactactatgactcaataaatgtttattattgagtgtgtatttattaagtatttatttagtaaatgccatatttacatttatgatgatgatgatgatgtct

SEQ ID NO: 46760 - DNA, 105 bp, Homo sapiens
catattccatatgtgtgtgtatatatatatatatatatatatatatacatatatgtatatacgtgtgtgtatatatgtgtgtgtgtatatatgtatatatacaca

SEQ ID NO: 46761 - DNA, 144 bp, Homo sapiens
tgtggtgtgtgtgtgtatatatgtgtatacatatgtgtgtatatgtgtgtgtattatatgtgtgtatatatgtatatatatgtatgtgtgtatatatacatatatacacacacacatatatacacacacgtatatacatatatg

SEQ ID NO: 46762 - DNA, 110 bp, Homo sapiens
tgcttaagattgtcttggctatacgggctcttttttggttccatatgaaatttaaagtagttttttctaattctgtgaagaaagtcaacagtagcttgatggggatagca

SEQ ID NO: 46763 - DNA, 95 bp, Homo sapiens; identical to SEQ ID NO: 580

SEQ ID NO: 46764 - DNA, 93 bp, Homo sapiens; identical to SEQ ID NO: 69

SEQ ID NO: 46765 - DNA, 116 bp, Homo sapiens
cattttaatttccccgcgcagtgtatgagggttctggttgctccaaattttttttttattattatacttgtaagttttagggtacatgtgcacaatgtgcaggttagttacatatg

SEQ ID NO: 46766 - DNA, 100 bp, Homo sapiens
atatgtatgtgtatatatatatgtgtatatatatgtgtatatatatgtgtatatatatatgtatatatatgtgtatatatatacacatatatatatattc

SEQ ID NO: 46767 - DNA, 80 bp, Homo sapiens
ggattggagagattagacagtgaagacaatgtgcctttgcgcgtgctatttcctctacctggtttatctttctcccatcc

SEQ ID NO: 46768 - DNA, 82 bp, Homo sapiens
gggctgagaacctttgcattcaagagtcaggagacacagtgctaagcccaactttgtcactgactctgtgaactttgagcct

SEQ ID NO: 46769 - DNA, 120 bp, Homo sapiens
ccatttttcaactgccacagaacatgagtattactgtggaagaggaagtaggtgaacaggtgtgagcctctctctctggcagtgattcttgaccttgactgcacgttagaaaacacctgg

SEQ ID NO: 46770 - DNA, 76 bp, Homo sapiens
aggcctgcatcagtctccctcccactctgtgtcctgaccccacaaagggcctctgaggttggagacgcctgtgcct

SEQ ID NO: 46771 - DNA, 82 bp, Homo sapiens
tgtcacagagtgaagagagtcagtgtaaataggtgctgtaagacatttattccctttctgtttttctttatgttttgagaca

SEQ ID NO: 46772 - DNA, 84 bp, Homo sapiens
tgagactgagtctcactctgtcgcccaggctggagtgcagtggcgtgatctcggctcactgcaagctctgcctcccaggttcac

SEQ ID NO: 46773 - DNA, 112 bp, Homo sapiens
gtgattgttttgatggatctaggcaaagtaaattgaaaaggagtttcttttttttttttttttttttttgagactcagtcttgctctgtctcccaggctggagtgcagtggc

SEQ ID NO: 46774 - DNA, 144 bp, Homo sapiens
gccatcctgggaagatgagcttgggctggggaggcagctcgtttttttttttttttttttttttgagacaagagtctctctctgtcgcccaggctggagtgcagtggcacgaactcggctcactgcaagctccgcctcctgggt

SEQ ID NO: 46775 - DNA, 92 bp, Homo sapiens
tattttatgtcttgatgatttctgtgaagctctgtttagattttttttttttctttgagacggagttttgctttgttgcccagactggagta

SEQ ID NO: 46776 - DNA, 92 bp, Homo sapiens
ctgctctaaatcttgtctcggtctctcactctgccttatacccctcagttgaattatttcttctgaggaggcaagaactgaggctgctgcag

SEQ ID NO: 46777 - DNA, 68 bp, Homo sapiens
tgttttgacacagggtctcactctgtcacccaggctggagtacagtggtgtgatcataggtcactgca

SEQ ID NO: 46778 - DNA, 56 bp, Homo sapiens
gagacagactctcgcactgtcacctgggctggtgtgcagtggcacgatctctgctt

SEQ ID NO: 46779 - DNA, 56 bp, Homo sapiens; identical to SEQ ID NO: 46778

SEQ ID NO: 46780 - DNA, 85 bp, Homo sapiens
tgttttgttttgttttgagatggagtctcactctgtcacctaggctggagtgcagtggctcaatctcggctcactgcaacataca

SEQ ID NO: 46781 - DNA, 116 bp, Homo sapiens
cctgggcaacaatagtgaaactctgtctgaaaaaataaaaatatgactggaccttttattaccttttttttttttttttttttttttgagatggagctttactcttgttgcccagg

SEQ ID NO: 46782 - DNA, 74 bp, Homo sapiens
ggtgtgaggttgaatgagataatgtggcatggtgcttagcagagtgcctggcacactgtatgccctcgataacc

SEQ ID NO: 46783 - DNA, 116 bp, Homo sapiens
tcctgaccccatcgctccttgccttctagggcactgtttggcaggcatttacatttactctggctgtgcctctcactataaaccccagatggtatttggaatgagagccaatagga

SEQ ID NO: 46784 - DNA, 75 bp, Homo sapiens
ccccataagttcttcccaaagaaatgaggttcctacctccctctgaatctcactgggacaccacatcttttgggg

SEQ ID NO: 46785 - DNA, 112 bp, Homo sapiens
tagtcaggcatggtggcacacatctgtggtctcagctactcaggaggttgaggtggaaggatggcttgagcctgggaggcagaggctgcagtgagcctagatcgtgccactg

SEQ ID NO: 46786 - DNA, 67 bp, Homo sapiens
ctgccagtctgtctgtctgtccatatttaggggtgtggtgggagtgaacagaggttaaagctggtgg

SEQ ID NO: 46787 - DNA, 98 bp, Homo sapiens
ggggactggtggacacgcaccgtggggctggccaggcgcctgggagagccaccctcccatctgtcactgtcacttcaaacgcggtcgactacctcccc

SEQ ID NO: 46788 - DNA, 71 bp, Homo sapiens
ctggatctggtggtgcatgcctatagtctcagcttccagggaggctgaggtaggaggatcacttgatccag

SEQ ID NO: 46789 - DNA, 114 bp, Homo sapiens
aatttaaaaattagccagccttggtagtgcatgcctgtggtcccagctactcaggaggctgaggtgcaaggatggcttgagcctgagaggtcaaggctgctgtgagctgagatt

SEQ ID NO: 46790 - DNA, 111 bp, Homo sapiens
gttgcagaatctcagaaccctggcatagagcagggctttagaagtctgtcactcagtgagtatttattgaggaactatgtgccttgtgctatgcttggtgcaagatgcagc

SEQ ID NO: 46791 - DNA, 81 bp, Homo sapiens
ttttccctgattggggtagtgtaggcatctgacctaaaggcagctaaccctcacactggctcagtgaatggtcaaggagaa

SEQ ID NO: 46792 - DNA, 115 bp, Homo sapiens
cttatatattgtcatttaatattcctaacagcttcatgaagtagggcattattattttcattttataaatgaccaaactgaggctgggaaatgctaggaaaatggcggttaggag

SEQ ID NO: 46793 - DNA, 61 bp, Homo sapiens
gtggcttatgtctgtaatctctgcagtttgggaggcagaggtggaaggatcaatggagccc

SEQ ID NO: 46794 - DNA, 58 bp, Homo sapiens
tgagatggagtctctctctgtcacccaggctggagtgcagtggtgcgatctcaactca

SEQ ID NO: 46795 - DNA, 69 bp, Homo sapiens
ttcacctccctagttagctgtattcacagatattttattctttttgtggcagttgtgaatgggagtgga

SEQ ID NO: 46796 - DNA, 70 bp, Homo sapiens
tttttttgagacagggtctcgctctgtgactcaggctggagtgcagtggcatgatctccgctcactgaaa

SEQ ID NO: 46797 - DNA, 83 bp, Homo sapiens
cattgctaaaacccctccaacgtgactgcctctctcagtcttaccatttaatccaaagagagcagagtttgaggcttagaatg

SEQ ID NO: 46798 - DNA, 96 bp, Homo sapiens
tgtatttttgactcccagtgaagttgaatgtttttatataatctatctgcaagtatttttaagaatgttaattgcttggctgggcgcagtgtttca

SEQ ID NO: 46799 - DNA, 109 bp, Homo sapiens
caggtgaaccaatgggatttgtgagtgtgggtcttctataacaaggacgagtgtcttatctgtaggaccaaatcaaaactctgaggagcctgtttgagtattgtacctg

SEQ ID NO: 46800 - DNA, 64 bp, Homo sapiens
gcgactccgtctgagactctgtctcaaaaaaaagagtcaaggtagtctctaaagactgacccgc

SEQ ID NO: 46801 - DNA, 89 bp, Homo sapiens
tgggatcacaggcacatgccaccatgtcaggctaatttttatatctttagtagagatgggttttcatcatgttggccaggctggtctcg

SEQ ID NO: 46802 - DNA, 105 bp, Homo sapiens
ttggcagtactgtttttgttgttgttttgagccagagtctcactctgtcgcccaggttggaatgcactggccagatctcaactcactacaaccttcgactcccag

SEQ ID NO: 46803 - DNA, 68 bp, Homo sapiens
gggcatggtggcacgtgcctatagtcccagctactggggaggctgaggtaggaggatcacttgagccc

SEQ ID NO: 46804 - DNA, 103 bp, Homo sapiens
gccaatctcatttaagtgttctctaatgatgcagttctcttactaatttgttactttttcaagttaccattgggctgtctagtcttaggatgtttaaggaggc

SEQ ID NO: 46805 - DNA, 75 bp, Homo sapiens
cccctgagtagctgagactacaaggtgtgcaccaccatgcccggctaattttttgtatttttagtagagatgggg

SEQ ID NO: 46806 - DNA, 120 bp, Homo sapiens
tcttttctcatctatggctattacaaattcatatggctatcatctaaagagtgtgacacagacactctgttttaatgtgctagttttgtcttcttaaatagactataatcaccttgaaga

SEQ ID NO: 46807 - DNA, 60 bp, Homo sapiens
ttggtacagtgtctcactctgtcacctaggctggagtgcagtggtgtgatactgggtcaa

SEQ ID NO: 46808 - DNA, 109 bp, Homo sapiens
ctgcctgggaaacagagcaagagcctgtctctgaaataaataaataaagtcaattcattctttttttttttttttttggaaacagggtcttactctgtcactcaggctg

SEQ ID NO: 46809 - DNA, 70 bp, Homo sapiens
ttgttttgaaacagggtctcactctgtcgctcaggctggagtgcagtggtgtgatctcagctcaccgcaa

SEQ ID NO: 46810 - DNA, 112 bp, Homo sapiens
atatatatatatatatatatatatatacacacacacacacacacacacacacacacacacacactctatatatatatgtactatgtatatgtgtactatatatgtatatata

SEQ ID NO: 46811 - DNA, 58 bp, Homo sapiens
tgagacagaatctctctctgtcccccaggctggagtgcagcggtgggatcttggctca

SEQ ID NO: 46812 - DNA, 110 bp, Homo sapiens
cgaggtcttgcttgttgtccagttgggttttttagacttttttttttttttttttttggagatggagtcttgctctgttgcccaggctggagtgcagtggcatgatctcg

SEQ ID NO: 46813 - DNA, 58 bp, Homo sapiens; identical to SEQ ID NO: 2441

SEQ ID NO: 46814 - DNA, 85 bp, Homo sapiens; identical to SEQ ID NO: 46780

SEQ ID NO: 46815 - DNA, 99 bp, Homo sapiens
tggggggtttttttgtgttttttttgaccgagtctcgctctgtcacccaggctggagtgtggtggcgcggtctcagctcactgcaagctccgcctcccg

SEQ ID NO: 46816 - DNA, 65 bp, Homo sapiens; identical to SEQ ID NO: 46656

SEQ ID NO: 46817 - DNA, 56 bp, Homo sapiens
gagacagagtctcactctgtcacccaggctggagtacagtggtgtgatttctgctc

SEQ ID NO: 46818 - DNA, 65 bp, Homo sapiens; identical to SEQ ID NO: 46656

SEQ ID NO: 46819 - DNA, 99 bp, Homo sapiens; identical to SEQ ID NO: 46815

SEQ ID NO: 46820 - DNA, 85 bp, Homo sapiens; identical to SEQ ID NO: 46780

SEQ ID NO: 46821 - DNA, 86 bp, Homo sapiens
tgttttccattttaatttgctgtctgcatgtgcatatgtggggggggtgcgtgtgtgtgtgtgtgtgagagagagagagagagaca

SEQ ID NO: 46822 - DNA, 113 bp, Homo sapiens; identical to SEQ ID NO: 5035

SEQ ID NO: 46823 - DNA, 119 bp, Homo sapiens
ggataacttaatttgtcataataatatgtgagctatagattggatagattgatggatagatacatagttttatttatgtggggatagcaatatgacattatgcacataaaaatgtggcc

SEQ ID NO: 46824 - DNA, 58 bp, Homo sapiens; identical to SEQ ID NO: 26792

SEQ ID NO: 46825 - DNA, 94 bp, Homo sapiens
gcgatctcgaggtgggggtggcacagtgtctccctgagtcccagtgctctgggtgtctctggcctgctgtcagtcaccccctgcagcgggtcgt

SEQ ID NO: 46826 - DNA, 88 bp, Homo sapiens
tgggacagggtctcactctgtctccctggctggagagcaatctctgctcattgcaacctctacctcccaggctcaggtgatcctccca

SEQ ID NO: 46827 - DNA, 65 bp, Homo sapiens
ttggggtgccacagaggcctgggttccagccctggctctgccactgagtctctgagtggccttga

SEQ ID NO: 46828 - DNA, 65 bp, Homo sapiens; identical to SEQ ID NO: 45059

SEQ ID NO: 46829 - DNA, 58 bp, Homo sapiens; identical to SEQ ID NO: 5055

SEQ ID NO: 46830 - DNA, 114 bp, Homo sapiens
ctgtcatctgaagtgggggagacagagccagagtgagctggggtatccaggagggtcacacacattcactgccacattcacacatttggacgtatggggattccatcagagaag

SEQ ID NO: 46831 - DNA, 90 bp, Homo sapiens
tgtctcaaaaataaataaatagaataataaaaataaaaataaatctagagatattttcattccttatttatttatttatttattgagaca

SEQ ID NO: 46832 - DNA, 79 bp, Homo sapiens
caaggccttcatcaggcaggtcttccccgtgtcggaggccgtcagcttgtgcatgaggaagtctgcaggcagggccatg

SEQ ID NO: 46833 - DNA, 129 bp, Homo sapiens
tcaatggctggggagctgggggcagtgaagggagttggggagactggggactgtggctggctggctgattgaggagggctcctcgtatccctcttagcatccctagaatgggaagccagagagtcctcc

SEQ ID NO: 46834 - DNA, 80 bp, Homo sapiens
ggtgtgtgtctctcactgtgagtgggcacccgtgtctctgtttctgtgactgtggtgttttgagggtgagtgtgaatgcc

SEQ ID NO: 46835 - DNA, 99 bp, Homo sapiens
ccacgccctgccagtatttttttacagtgttttttttttcgttttgtttttgttttttgagacggagtctcgctctgttgccaggctggagtgcagtgg

SEQ ID NO: 46836 - DNA, 64 bp, Homo sapiens
gttagtgagagtgcacaggtacaagtcactcagcacagtgactggtatgcactcaacactcaac

SEQ ID NO: 46837 - DNA, 105 bp, Homo sapiens
ctgctgccgtctggtgggggtcagacagaaagggattcttttttttttttttttttttgagatggagtctcgctctgtcaccaaggctggagtacagtggcgcag

SEQ ID NO: 46838 - DNA, 82 bp, Homo sapiens
ccagcctgggaaacatagggagactctgtaaacaatttttttttttttttgagatggagtctcgctctgtcacccaggctgg

SEQ ID NO: 46839 - DNA, 70 bp, Homo sapiens
tccccatgccactctagggaccttgggggcaggctctgtgtctttgtgtctctggaacagagctctggga

SEQ ID NO: 46840 - DNA, 75 bp, Homo sapiens
gctgcgtgactgagtttctgtctctctggcttcattgcaaggggtagatgcagtgagcttaaggttgctggtggc

SEQ ID NO: 46841 - DNA, 92 bp, Homo sapiens
gctgggctgggcagggaggaggaggtggctggcagggtggcagggctgggagccttgtcgctgactgactcacactcggacgccccgctggt

SEQ ID NO: 46842 - DNA, 58 bp, Homo sapiens; identical to SEQ ID NO: 10

SEQ ID NO: 46843 - DNA, 78 bp, Homo sapiens
tctcaaagtgctgagagattacaggcgtgagccaccatgcccagccagtaatctttttttttttttttttttttgaga

SEQ ID NO: 46844 - DNA, 58 bp, Homo sapiens
tgagatggggtctctctctgtctcccaggtggaagtgcagaggtgtgatctcggctca

SEQ ID NO: 46845 - DNA, 74 bp, Homo sapiens
gatatgtatgtgaggctttatgacttgtcttttttttttcattttgagacagagtcacggagtctcactctgtc

SEQ ID NO: 46846 - DNA, 58 bp, Homo sapiens; identical to SEQ ID NO: 35266

SEQ ID NO: 46847 - DNA, 263 bp, Homo sapiens
atatatatatatacatatatatgtgtatatatatacatatatgtgtgtatatatatgtgtatatatatatacatatatgtgtgtatatatatacatatatgtgtgtatatatgtgtatatatatacatatatgtgtgtatatatatgtgtatatatatacatatatgtgtgtatatatatgtgtatatatatacatatatgtgtgtatatatatgtgtatatatgtgtgtgtatatatatgtgtgtgtgtgtgtgtgtgtata

SEQ ID NO: 46848 - DNA, 64 bp, Homo sapiens
actgcattttttttgtttgtttttgagacagggtctcactctgtcacccaggctagagtgcagt

SEQ ID NO: 46849 - DNA, 59 bp, Homo sapiens
tgagacagagtctcgctctgtcacccaaggctggagtgcagtggcgcgggctaggctca

SEQ ID NO: 46850 - DNA, 67 bp, Homo sapiens
gtctagggatccagatgggacttaaggacaatttttttttgacacagtctcattctgtcttccaggc

SEQ ID NO: 46851 - DNA, 57 bp, Homo sapiens
ttgagagagtctcactcactctgttgcccaggctggagtgcagtggtgcgatctcag

SEQ ID NO: 46852 - DNA, 77 bp, Homo sapiens
gtggttgggggatcacagcacggaacattttagggagagggtccctgaaggtcagttgtgtggctcctggtaggccc

SEQ ID NO: 46853 - DNA, 110 bp, Homo sapiens
ttccatttctttcagcaccaagagaggcagtggggttgaggggaaagatctctgcttttggagctagatgaaacctgactctatcccttcttggctgtgtgaccttggga

SEQ ID NO: 46854 - DNA, 91 bp, Homo sapiens
tgagcccaggaggggagcagagaggaggccaggaaggagagctacccacccctctggggccccctctctgtccctgacagggatgatctca

SEQ ID NO: 46855 - DNA, 58 bp, Homo sapiens
tgagactgagtctcgctctgtcacccaggctggagtgcagtgggatgatctcggctca

SEQ ID NO: 46856 - DNA, 75 bp, Homo sapiens
ttgtttttttttgagtcggagtctctctctgtcgcccaggctggagtacagtgacccgatctcaactcactgcaa

SEQ ID NO: 46857 - DNA, 91 bp, Homo sapiens
gtgacagagagagaccctgtctcataaaaaataataaatatttaaatttatttattattatgttttttgagacagagtctcgctctgtcac

SEQ ID NO: 46858 - DNA, 82 bp, Homo sapiens
gctagtctgtctccctgtctgtttccctggctctttgactctgcgtgctcccatcaggggggagagggggagctacgctggt

SEQ ID NO: 46859 - DNA, 89 bp, Homo sapiens
tgatagggacacttgtatgctcttgaaagaaaaaacatttttttttacaattttttttttttcccctgagatggagtctctctctgtca

SEQ ID NO: 46860 - DNA, 85 bp, Homo sapiens
ggcaaggtgttgaagagatgttgatcaaaggaattttttttttttttttttttttgagacagagtctcgctctgtcacccaggct

SEQ ID NO: 46861 - DNA, 80 bp, Homo sapiens
gtgagagagagatgccatctacaaatcattcttcttccaaattttttttttttttttgagatggagtctcactctgtcgc

SEQ ID NO: 46862 - DNA, 58 bp, Homo sapiens; identical to SEQ ID NO: 1868

SEQ ID NO: 46863 - DNA, 133 bp, Homo sapiens
ctccttgagcagttacagcatgctggcacatgcctgtagtcctagctacacaggaggatgaggtggtaggatggcttgcacctgggagtttgacgcttcagtgaactgtgattctagcctgcactctagcctg

SEQ ID NO: 46864 - DNA, 56 bp, Homo sapiens
gagacggagtctcactctgtcacctaggttggagtgcagtggtgcgatctcgtctc

SEQ ID NO: 46865 - DNA, 83 bp, Homo sapiens
tttctccatgccttagttttctcacttatacaacctatttcagaggactgttgtgaagatggaatgacttaaggtaggcgaaa

SEQ ID NO: 46866 - DNA, 75 bp, Homo sapiens
ctgagattacaggtgtgagccactcctggcccaattttttttttttttgagacagggtctcactctgttgctcag

SEQ ID NO: 46867 - DNA, 75 bp, Homo sapiens
gtccaggtgacagagcaagactccatctcaaaaaaagaaataatcttagactgagtctcactctgtcgcccaggc

SEQ ID NO: 46868 - DNA, 58 bp, Homo sapiens; identical to SEQ ID NO: 315

SEQ ID NO: 46869 - DNA, 92 bp, Homo sapiens
ggaaggatttaccaaaagttaggaaatgaagtaaaggaatgaggtgtcttctccttttttttttttttttttttttgagatgaagtctcgct

SEQ ID NO: 46870 - DNA, 77 bp, Homo sapiens
cagccaggccttgaaaattgtaagaactttttttttttttttttttgagaaggagtctcactctgtcacccaggctg

SEQ ID NO: 46871 - DNA, 115 bp, Homo sapiens
catttccaggggcaatgggtggggggcaggtaggaatgcagggacaaatttttttttctttttttttgagatggagtcttgctcttgtcgcccaagctggagtgcagtggcagtg

SEQ ID NO: 46872 - DNA, 90 bp, Homo sapiens
tggggagggagtgagagtgggaggtaggggggaaagtggagggtttttttttttttaacttttttgagacagagtctcgctctgtcacca

SEQ ID NO: 46873 - DNA, 75 bp, Homo sapiens
gtctgtctttccctctgactttctctctccttggggacaggacttggatggcagcagcttgggtgtgagacgcac

SEQ ID NO: 46874 - DNA, 65 bp, Homo sapiens
gttcgctgacagactgtgtctgtgttgcccagtggttacaaggactcagtagggtcgtgctgagc

SEQ ID NO: 46875 - DNA, 121 bp, Homo sapiens
cagccagggcgagcgctgcaccagcacctggcactgcccctgctggtggtaggtctcatgtctctgggtgtcctcctcatgcagggagcagctggggagaggggaggggcagtgagctcct

SEQ ID NO: 46876 - DNA, 110 bp, Homo sapiens
ggtgtggtggcaggcacctgtaatcccagctactcgggaggctgaggcaggagaattgcttgaactcagagggcagaggttgcagtgagctgagatcttgccactgcact

SEQ ID NO: 46877 - DNA, 90 bp, Homo sapiens
cttgcccaaggtgacatgactgatatggaatagagtcaagatttttttttttttttttgacacggagtctcactctgtctcccaggctgg

SEQ ID NO: 46878 - DNA, 63 bp, Homo sapiens
ggcctggatgggatggcgtctgcaaattttttttttttgagacggagtttcactcttgttgcc

SEQ ID NO: 46879 - DNA, 91 bp, Homo sapiens
actcatcaaactgtgtgataagagtctgtgcattttatttatttcattttattttttgagatagagtctcactctgtcagcaggctggagt

SEQ ID NO: 46880 - DNA, 127 bp, Homo sapiens
ccagaggttaaaggagagggtgtgggcatagtcatggtgtggccatgagttgacactggctgttgatattggttgaagcttggtgacaggtactggctatgtggggatttgttaaattatcctctcc

SEQ ID NO: 46881 - DNA, 96 bp, Homo sapiens
gttcactcagtgctttttattcctgcctcaccatgcatttggcaaacatattgcaaatgctatgaataaaaaaagactgtagagagcacagtgttc

SEQ ID NO: 46882 - DNA, 58 bp, Homo sapiens; identical to SEQ ID NO: 2595

SEQ ID NO: 46883 - DNA, 103 bp, Homo sapiens
tccttcaggttgtactagttctctctctctctcagactgtaaagaaaagataattctttattttcttattttgtcttacgagagaactcacattcctgaatga

SEQ ID NO: 46884 - DNA, 79 bp, Homo sapiens
cccaagtctttatttttgtttagcatccaatgagtgctgggaatatcacagccactttactgaatacaaaagatttggg

SEQ ID NO: 46885 - DNA, 78 bp, Homo sapiens
ggattacaggcatgagtcacctcgcctggcctatctttttatatatagtagaagccatgagttcatgccagtacatcc

SEQ ID NO: 46886 - DNA, 99 bp, Homo sapiens
gatacccaaaaatcctgatgaaaacatgatgctaagtatatatttgtatacatacatgtatgttcatttaaaaatattttatctggatatttggatatc

SEQ ID NO: 46887 - DNA, 189 bp, Homo sapiens
gtgtgtgtgtgtgtgtgtatatatataatatatagtatattatatatgtatatatactatatgcatatatactatatagcatattatatatgtatatatactatatgtatatatactatatagcatattatatatgtatatatactatatgtatatatactatatagcatattatgtatgtatatatac

SEQ ID NO: 46888 - DNA, 72 bp, Homo sapiens
gactcacagatctctgacaagagtgatatttaatttaatttatttatttgtttttgtttttgagatggagtc

SEQ ID NO: 46889 - DNA, 76 bp, Homo sapiens
ggaggctgaggttggaggatcacttgcggtcaggagttcaagactagcctggacaacatggtaaaaccccgtctct

SEQ ID NO: 46890 - DNA, 101 bp, Homo sapiens
gcctggcctgtgagcaaattttttactgtgtctgagtctgtctcaatttattcctctgtaaaatggggctaaaaatcaatgtgctgcccactgtatagggc

SEQ ID NO: 46891 - DNA, 57 bp, Homo sapiens
ctcagaaccgcacagcaggtgccaggtctggctctcactgactgcccgtggtctgag

SEQ ID NO: 46892 - DNA, 114 bp, Homo sapiens
ggtcttcttgcccttacgaaatataacaagtcatcactggctggctctgtgtctcaggggagcaaacgctgctgggaaggcggggctacctggatggactcgaaggccaggacc

SEQ ID NO: 46893 - DNA, 68 bp, Homo sapiens
tctccctccctttcttttcttttgacagagtctcactctgtcacccaggttagagtgcggtggcaaga

SEQ ID NO: 46894 - DNA, 120 bp, Homo sapiens
tctagtaggggaagagaaaaatttcaattctctacattgggattcacctttattttatttttttaatttaattttttttttctttttgagatgaagtttcactctgtcacccaggctgga

SEQ ID NO: 46895 - DNA, 102 bp, Homo sapiens
ggtaggctaaaactgtccttattccctgtggttctcttctgatttgtaaaaggagaacagaatagccaaaaacattcagtaagacagtcaaaaaccaaaacc

SEQ ID NO: 46896 - DNA, 102 bp, Homo sapiens
gatagggagaccctatctcaaaaaaaaaaaaaaaaaaaggacaacgaagatgatgagaagcaattttttttctttttttttgagacggagtctccctctgtc

SEQ ID NO: 46897 - DNA, 90 bp, Homo sapiens
gcgcccctgaggactccatggggcaggcttttttttctttttttttttttcttttgagatggagtctctctctgtcgcccaggctggagt

SEQ ID NO: 46898 - DNA, 84 bp, Homo sapiens
gatgctgggaaatgtagtctttattcttgtgcccaggagggagcagggagactccctcgctgtcacagatctgcttctggcatt

SEQ ID NO: 46899 - DNA, 114 bp, Homo sapiens
gcagaggggtgtgaaggaaagcccagaggtgcagtggtttggaagggcctagggacaaggtgacagacaagactgtggaggcttccttcttcctccagagcagctaatgggggc

SEQ ID NO: 46900 - DNA, 121 bp, Homo sapiens
ataccatagagttgcatgtgagactagtttggagtttgaagactttgtgtagtccaactctctctgcctctgccagtttttcttcagtcatcttcacaacaaatttcacagtggtatctgt

SEQ ID NO: 46901 - DNA, 106 bp, Homo sapiens
ggacttgaatattgggctagcttagtataaaggaggttaaattagtttttaatgtttgattattataattttgaggatactgagttttacagtttggtatttttcc

SEQ ID NO: 46902 - DNA, 86 bp, Homo sapiens
aattcaggtcaactaatatttaacatacagattgacctaggcaccctcactcagtctgtttgttggccaattatgtcccctgaatt

SEQ ID NO: 46903 - DNA, 71 bp, Homo sapiens
ggtgtcgttgggaaaagggtatcaagtgtgcatggctcagcctgttcctggctctctctctgggactgacc

SEQ ID NO: 46904 - DNA, 79 bp, Homo sapiens
gccagggggcaatgccagtgtgcgtgtgtgtccccgaggggaacctgccggagcgcatgtgcgtgtggagcccgctggt

SEQ ID NO: 46905 - DNA, 91 bp, Homo sapiens
ggcacttggtgaggcacactttctgtctgtttctggatggagaaacagaactttgtaaagtgagggtctttgttcctgccgagttcaggcc

SEQ ID NO: 46906 - DNA, 84 bp, Homo sapiens
gggctggtactggggatttctgcacagagtcctgtgatgtgaactgtctctgggtctctcagccgtggataccagtacctgttc

SEQ ID NO: 46907 - DNA, 103 bp, Homo sapiens
ccttaagagaaataaaatctctagcctggcaaaggaggtaaggtggtttgttatttcactaattgtttttgtttttgaacctgggaagttgtttttgtggtgg

SEQ ID NO: 46908 - DNA, 64 bp, Homo sapiens
gtttgtttgagacagtctcgctctgtcgctcatgctggagtgcagtggcatgatctcagcttac

SEQ ID NO: 46909 - DNA, 109 bp, Homo sapiens
agatttatatgcttatctttctcactgttgaaagtaggtagaaaagttaataagtacccaatacgaaagctgtcttacttttgattaaagagaaatgctttatcaattt

SEQ ID NO: 46910 - DNA, 70 bp, Homo sapiens
gcatgccccagggccactgcaggtaggctgagcaccccagtctgtccctgtcactgtccctggggtgagt

SEQ ID NO: 46911 - DNA, 83 bp, Homo sapiens
gtgtatgtatgtgtgggtatatattacctatatgcagtgtatgtatatatacacatatatatgtatatatgtgttcacaacat

SEQ ID NO: 46912 - DNA, 110 bp, Homo sapiens
atggagttgacattctagtggatcatggtatttatataaatttaggatggattttattttattttttatttatttatttatgtatttattgagatggagtctcactctgt

SEQ ID NO: 46913 - DNA, 90 bp, Homo sapiens
ttttaaaagagaagtcagagagaacacagagaatgggagagggtcttcttcatatattctacttgccaagccactggcttctagatgaga

SEQ ID NO: 46914 - DNA, 92 bp, Homo sapiens
ggtggtatcaggtccttgagccagaagagtgtgtgcactggggagatgagagcacacctgttaattcagggatatcttgggcctgcacggcc

SEQ ID NO: 46915 - DNA, 72 bp, Homo sapiens
caccaagcatagaagttggaggttttgtacgatatgcatttaaatttttgcttttaaaatagttgcttggtg

SEQ ID NO: 46916 - DNA, 85 bp, Homo sapiens
ctatcttatctgtgttttactgtctgctgtttctggctgcttgtagttagaagagaagtgatttccttgaaatgcatgaggctag

SEQ ID NO: 46917 - DNA, 84 bp, Homo sapiens
atgtgtgtgtatgtgtgcgtgtgtgtgtgtatatatatatatatatatatatatacacacacacacgcacacatacacacacat

SEQ ID NO: 46918 - DNA, 84 bp, Homo sapiens; identical to SEQ ID NO: 46917

SEQ ID NO: 46919 - DNA, 103 bp, Homo sapiens
ttgtcactttcttcttgttggccagctctggtttgctctcacgctcactctcattgggtttgatgaagccagctgctataagagacagagatccatgtggtaa

SEQ ID NO: 46920 - DNA, 95 bp, Homo sapiens; identical to SEQ ID NO: 68

SEQ ID NO: 46921 - DNA, 93 bp, Homo sapiens; identical to SEQ ID NO: 69

SEQ ID NO: 46922 - DNA, 99 bp, Homo sapiens
aggcaggagaatcacttgaacctgggagcacagaggtgtcagtgagctgagatcgcgccattgcactttagcctgggcaacaagagtgaaactctgttt

SEQ ID NO: 46923 - DNA, 58 bp, Homo sapiens
tgagacagagtctcgctctgtcacccaggctgtagtgcagtagcgtgatcttggctca

SEQ ID NO: 46924 - DNA, 98 bp, Homo sapiens
cgcaagtaataattaccgcctagtcattttgcactcttcatgtcagcagattagaaggcagagaacagagttggtgaggggtaattatcctgaaggcg

SEQ ID NO: 46925 - DNA, 93 bp, Homo sapiens
agcccagctcctgtgcacccatctactgcaggagaacctgctaccaccccacgagtgtctgcctgcctggttgcctaaatcagagctgtggct

SEQ ID NO: 46926 - DNA, 84 bp, Homo sapiens
ggccagccaggcaggagactgaagagagacagtgccactctgtggataggtgtttgaatccagcagctcagcccctatggctgg

SEQ ID NO: 46927 - DNA, 65 bp, Homo sapiens
acccagttggtttcagaggattgttttgtgggaggacacagaactgttctatgttgagcatgggt

SEQ ID NO: 46928 - DNA, 73 bp, Homo sapiens
gagacggactctcgctctgtggccgagactgaagtgcaatggcgcaatctcggctcactgcagcctccgcctc

SEQ ID NO: 46929 - DNA, 94 bp, Homo sapiens
aatgtctgtggtttagtgttacttaagaaattatttactttaattaacaagaaatactaaatacattcttataaaacttaaaaccatagagatt

SEQ ID NO: 46930 - DNA, 117 bp, Homo sapiens
tgcgtggaatccattcactcattcaccaactgtgagagcccagaagacactgtgcagactctggcttttaagaaatacgtggatcgggggaacacagcatctttgaaaaacacagtt

SEQ ID NO: 46931 - DNA, 73 bp, Homo sapiens
ttgtttctttgagaccaagtctcactctgtcacccaggctggagtgcagtggtgtgatctgggctcactacaa

SEQ ID NO: 46932 - DNA, 106 bp, Homo sapiens
taccctccaactgggcatgcggtgctattttattttattttatttatttatttatttattttttgagacaaagtctcactgtcacccaggctggaatgcaatggtg

SEQ ID NO: 46933 - DNA, 96 bp, Homo sapiens
gaggatctgaggagaagggagagtagtcaggtcattggatgggggtggctgagcccacaccagggttctgagcagatcttcctgcctcagggcctc

SEQ ID NO: 46934 - DNA, 91 bp, Homo sapiens
ccccaacttagcgctgtagcttctccatcactgtctgtgagtctggcagggcccctggatggtgattggggaaggaaacttcaagtttggg

SEQ ID NO: 46935 - DNA, 69 bp, Homo sapiens
ttgtttgagaccgggtctggctctgtcactcaggctggagtacagtggtatgatctcagctcactgcaa

SEQ ID NO: 46936 - DNA, 90 bp, Homo sapiens
attgccaattgaacagttattgggaggtggggcgcttttttttttttttttttggagactctgtcacccaggctggagtacagtggcagt

SEQ ID NO: 46937 - DNA, 111 bp, Homo sapiens
aggaccctcccctggctgcccactttcctacgtctgtgcctgtgtctcagccttggtggctgattgagatcccagttcccttctgtgcctgagcctatgggtgggggttct

SEQ ID NO: 46938 - DNA, 78 bp, Homo sapiens
ttgagatggagtctcgctctgtcacccaggctcactgcaacctccgcctcctgggttcaagtgattctcctgcctcag

SEQ ID NO: 46939 - DNA, 58 bp, Homo sapiens; identical to SEQ ID NO: 315

SEQ ID NO: 46940 - DNA, 79 bp, Homo sapiens
gccagcagtatgccttcattgttactatatagtttatttaaaccagactatgataatacagagaagagactgaggtggc

SEQ ID NO: 46941 - DNA, 81 bp, Homo sapiens
tggggtttttttcagtctcagaagagtctgaggcctcaaagaggttaagagccactgccttagagagactttaagacctca

SEQ ID NO: 46942 - DNA, 58 bp, Homo sapiens; identical to SEQ ID NO: 47

SEQ ID NO: 46943 - DNA, 119 bp, Homo sapiens
tcatttgaggcaaagagtttgagactagcctggccaacatactgagactccgtctctacttatttatttatttagagacagggtctcgctctgtcacccaggctggagtgcaggggtga

SEQ ID NO: 46944 - DNA, 112 bp, Homo sapiens
ctgggattacaggcgtgagccactgtgcctggccttccattgcaacttatttatttatttaatttttttttgttgttatgtttttgagacatggtcttactctgtcacccag

SEQ ID NO: 46945 - DNA, 63 bp, Homo sapiens
gactgacagtcagtctcacagaagttataattccctgtatgtttctgttggacagacttagtc

SEQ ID NO: 46946 - DNA, 81 bp, Homo sapiens
tggttaacactggaattgaaggcaatctggtggtggcatctgtcactcactcactgccagggtcaattcatctgatagcca

SEQ ID NO: 46947 - DNA, 92 bp, Homo sapiens
cccagtcacagcctcacttctcccacctgcttcagttgggtctctgaattgacctggagctgacagagagcacagtggaaggcagggctggg

SEQ ID NO: 46948 - DNA, 127 bp, Homo sapiens
ggcaggctcacactacctgtgctggagagctgtgtagcccagtttctgtctgcctgtctgcctgtgtgtccatcaatgtggagctggggggtgggttggggggagcacgcaggcagggctctggggt

SEQ ID NO: 46949 - DNA, 77 bp, Homo sapiens
cccactcgtagggtctctggctctgtgtgtcgcatacctcagatctgtgtggtgcctcattggccctgacgtgtggg

SEQ ID NO: 46950 - DNA, 95 bp, Homo sapiens
gggccgctccggcagctctcagctgtctctgtctccctccattcctgctggcgtggaaggaatcaaaggggcaatgtggagcctgtgaggggtcc

SEQ ID NO: 46951 - DNA, 101 bp, Homo sapiens
tggcaggagacagtcacatctgtggtgccgaaagccagtgcctgtgctcactctctctctgccagatgctctagccctggctgtgcttcagtgggtgtgct

SEQ ID NO: 46952 - DNA, 80 bp, Homo sapiens
gggtctgcaaccagctagaagcctggatagtcctgctgtgagtctgtcctctgtttctgtgtgctggcagtggttttccc

SEQ ID NO: 46953 - DNA, 112 bp, Homo sapiens
tctcgatttcctttgggggaggggggtcgtctgggtgagaccgttccacacgcacagaagtgtgtgtgcgctcccgcaactccttacttcctctctttcctcaagccagaga

SEQ ID NO: 46954 - DNA, 68 bp, Homo sapiens
ttgtttgagcagggtctcactctgtcacccaggctggagtgcagtggtgtgatcactgctcactgcag

SEQ ID NO: 46955 - DNA, 98 bp, Homo sapiens
tccacctgagcaacatagcgagaccctatctctataaaaaaaatatatatatatatatttttttatagacggagtctcactctgtcacccaggctgga

SEQ ID NO: 46956 - DNA, 58 bp, Homo sapiens; identical to SEQ ID NO: 1265

SEQ ID NO: 46957 - DNA, 117 bp, Homo sapiens
ttgttatgtgttttacagtcttttctccatgtctaatctaagaaacttatatattcattgtatatatatctactggttgtcagcattgaaccttgcctgtgccctagcatgttgcag

SEQ ID NO: 46958 - DNA, 76 bp, Homo sapiens
gctggcagcagagtctgtctctctctaacttgtcatatggggtgacgggtgtggggtatggcctctgtgtgtcagt

SEQ ID NO: 46959 - DNA, 95 bp, Homo sapiens
gtgtgtatatatatgtgtgtatatatatacatatatgtatatatatacacatatatatgtgtgtatatatacacacatatatatgtgtatatata

SEQ ID NO: 46960 - DNA, 117 bp, Homo sapiens
tgtatatacatatatatgtgtgtatatatacacatatatatgtgtgtatatatacacacatatatatgtgtatatatatacatatatgtatatatatacacacatatatatacacac

SEQ ID NO: 46961 - DNA, 95 bp, Homo sapiens; identical to SEQ ID NO: 68

SEQ ID NO: 46962 - DNA, 93 bp, Homo sapiens; identical to SEQ ID NO: 69

SEQ ID NO: 46963 - DNA, 99 bp, Homo sapiens
gttcttgaacagcccaggcaatataatgagaccctgtctttacaaatatttttttttttttgagatggagtctcactctgtcgccccaggctggagtgc

SEQ ID NO: 46964 - DNA, 79 bp, Homo sapiens
ggaattgacagagtctggtttgagaacctgtacttttttttttttttctttttttgagacaggtctcactctgtcgccc

SEQ ID NO: 46965 - DNA, 62 bp, Homo sapiens
tgagatggagtctcactctgtctcccaggctggttggtgtgcggtagtaagatctccgctca

SEQ ID NO: 46966 - DNA, 101 bp, Homo sapiens
gtgggttgcttttgtttttgttttttttgtttttttgagacagagtctcactctgtctgcactcagacagtggattaccaactggcagattaccaacttac

SEQ ID NO: 46967 - DNA, 112 bp, Homo sapiens
tgtcaggcttctcatcagaggaaaaaatggttcagtgttgatccttttgaaatcagtacagatttccctcagaggaattacagtgccaagactaaggtgggaggaaggtaca

SEQ ID NO: 46968 - DNA, 113 bp, Homo sapiens
aagtgctaggattacaggcatgagccaccgcgcccggcccaacacttgtaattttcttattgcctttttagtgggtgtgatgtggtatctcattgtggttttcatttgcattt

SEQ ID NO: 46969 - DNA, 58 bp, Homo sapiens
tgagacggagtctcactctgtcacccaggctggagtgaagtggtgtgatctcggctca

SEQ ID NO: 46970 - DNA, 117 bp, Homo sapiens
gctgatgggcaagagtggaatcaagaaaactagttaggaggctactgctgtaattgaagggaaagatgacagtgtgcagtctcgaatagggtgattttggaatatgctttgatgagc

SEQ ID NO: 46971 - DNA, 89 bp, Homo sapiens
ggaacaggtaataactggggaaggctgaaagtggcctggagtgaggagctagccaggcctctgtgctcagttgtctgtctgtgttgtcc

SEQ ID NO: 46972 - DNA, 118 bp, Homo sapiens
gctgatttacattttaagccagcttcagacaaagtatcctaaaacacagatttttattttttttgaaacaaggtcttgctctgtcactcaggctggagtacaatggtgtgatctcggc

SEQ ID NO: 46973 - DNA, 57 bp, Homo sapiens
gaggcggagtctcgctctgtcacccaggctggagtgcagtggcgcaacctctgcctt

SEQ ID NO: 46974 - DNA, 60 bp, Homo sapiens
gtcggtctgtcagtctgtccctgcctggcgggctttctctgggaaccgctgcagacgcgc

SEQ ID NO: 46975 - DNA, 58 bp, Homo sapiens; identical to SEQ ID NO: 3380

SEQ ID NO: 46976 - DNA, 115 bp, Homo sapiens
gtgagccactgcacccggcccagaagaagcagaagccactcttttttttttttttttttgagacagagtctcggctctgttgcccagtctggagtacagtggtgtgatagctcac

SEQ ID NO: 46977 - DNA, 66 bp, Homo sapiens
gagtgtgagaagatagaacagggtgagcactcactgagcttcctcctgatccagtctctcagcctc

SEQ ID NO: 46978 - DNA, 115 bp, Homo sapiens
tgtggctgtggctgtggctgtgttcagctatttgttcttccgactctgaaaggaactttttttttttttggagataagagtcttgttctgccacctaggccggagtgcagtggca

SEQ ID NO: 46979 - DNA, 98 bp, Homo sapiens
gcctgggcaacagagcaagactccgtctcaaaaaagtaaatataactttttttttttttttttttttttgagacaaagtctcgctctgtcacccaggc

SEQ ID NO: 46980 - DNA, 78 bp, Homo sapiens
ctgggattacaggtgtgagccactgtacctggcccttttttttttttaaatgagacagtgtctcactctgtcacccag

SEQ ID NO: 46981 - DNA, 103 bp, Homo sapiens
agtcatggtagtgtgcgcctgtggtcccagctacttgggaggctgagctgggaggatggattgagcccaggaggttgaggatgcagtgagttgtgatcatgct

SEQ ID NO: 46982 - DNA, 73 bp, Homo sapiens
cctcccctctctctgaccctcactcacagctttgaggacagcaagtaagggattgaccagacagagatggagg

SEQ ID NO: 46983 - DNA, 74 bp, Homo sapiens
agaaatggcagtaggacaagtctgtgtgttttttttttttttttgagacgcagtcttgcactgtcgcctgggct

SEQ ID NO: 46984 - DNA, 119 bp, Homo sapiens
ggggcttcaggtctagagggatttgctctgtacagagaatgggcagtagaagataagccttctctaattgtagttctcatagcaatgcaagatttagattttaaaactggatatcaccc

SEQ ID NO: 46985 - DNA, 105 bp, Homo sapiens
ccagcccaggcaacatagcaagatccccatcagatacaccaaaaagacagatttcttttttttttttttttttgagacagagtctcgctctgtcgcccaggctgg

SEQ ID NO: 46986 - DNA, 113 bp, Homo sapiens
ggagttcaagactggcctgagcaacatagtgagaccctgtttcctttttttttttttaagtgaaagttatctctgagatattcttcagtgttgcttctccatttctcaactcc

SEQ ID NO: 46987 - DNA, 56 bp, Homo sapiens
aagacaaggtctcactctgtcacccaggctggagtgcagtggcgagaccatagctt

SEQ ID NO: 46988 - DNA, 101 bp, Homo sapiens
agctgggaccacaggagccaccatgcacagctaatttttctttttgtaaagacaggatcttctttagttgcccaagctggtcctgaactctgagttcaagc

SEQ ID NO: 46989 - DNA, 108 bp, Homo sapiens
ccagcctgagcaacatagcaaggcctcatctctactaaaaaactcttttatttatttatttgtttatttatttattgagacagagtctcgctctgtcgcccaggctgg

SEQ ID NO: 46990 - DNA, 85 bp, Homo sapiens
gtggggaaaagactgagaggttggatggttgccgtgtctgtgtagaaagaggtagacatgggagacttctcattttgttctgtac

SEQ ID NO: 46991 - DNA, 74 bp, Homo sapiens
acagtactcatataaaatgtgtgtgcgtgtgtgtgcatatatttgtacttgcttgtatacatataagatattgt

SEQ ID NO: 46992 - DNA, 69 bp, Homo sapiens
cctctcttaggacagtcttacagtcacatttttctcagaaagaggttgaaggtaggattgatattgagg

SEQ ID NO: 46993 - DNA, 58 bp, Homo sapiens; identical to SEQ ID NO: 315

SEQ ID NO: 46994 - DNA, 90 bp, Homo sapiens
agccaaagctgaccccatagccttcacagatgtcagtgaggatataaacatttgttgctgtaagccactgggatttgtgggtcacgagct

SEQ ID NO: 46995 - DNA, 58 bp, Homo sapiens
tgagacagagtctcgctctgtcacccaggcgggagtgcagtggtgtgatcttggctca

SEQ ID NO: 46996 - DNA, 88 bp, Homo sapiens
tcatcacagtgaattttgactcctgtggccgctgccctctgcttggatgagagggcaggtcagagaagccacagagccctgtgagtgg

SEQ ID NO: 46997 - DNA, 57 bp, Homo sapiens
tgagacagagtctccctctgtcacccaggctggagtgcagtggcgaatcttagctca

SEQ ID NO: 46998 - DNA, 131 bp, Homo sapiens
ttgctttccttttattttttctccctagtatagctcaggcactatagtgtgattttaaagaagtaagtgcttgtgaaggcatattatttatgattgtcattttaggagagtaagcgaggtgttattaaatg

SEQ ID NO: 46999 - DNA, 98 bp, Homo sapiens
cccacaagtagctgggatcataggcatgcaccaccacacctggataatttttaatttttttgtagagatgggggtctcgccatgttgcccaggtgggt

SEQ ID NO: 47000 - DNA, 80 bp, Homo sapiens
tgtgtgtgttatatgtatgtatgtatgtaagtgtatatagatatatacacacaacacacacacacacacacacacacaca

SEQ ID NO: 47001 - DNA, 100 bp, Homo sapiens
atgtatacgtatatatgtatacatatatgtatatatacatatgtatacatgcatgcatatatgtatatatacgtatatgtatacatatatacatatacgt

SEQ ID NO: 47002 - DNA, 70 bp, Homo sapiens
gtacagatgagtgtctgtgtgactgtggctggtgtgggtctccaagtttgtctactgtgtctctttgtac

SEQ ID NO: 47003 - DNA, 58 bp, Homo sapiens
tgagacagggtctcactgtgtcacccaggctggagtgcagtggtgcgatcttggctca

SEQ ID NO: 47004 - DNA, 106 bp, Homo sapiens
tgttattcaccccttcgctcttgtctagtagaccttgactttttttttttttttaagacaaggtctccctctgtcacccaggctggagtgctgtggtgtgatcaca

SEQ ID NO: 47005 - DNA, 86 bp, Homo sapiens
ttatagcctggtagggccagaatggcagccagtcttgaaagattatatatatattgctgctgtatttgtctctctccatgtcctag

SEQ ID NO: 47006 - DNA, 62 bp, Homo sapiens
tgagttggagtctcactctgtcacccaggccggctggagtgcaatggtgagatctcagctta

SEQ ID NO: 47007 - DNA, 58 bp, Homo sapiens
tgaaacagagtctcgctctgtcacccaggctggaaggcagtggcgggatctcagttca

SEQ ID NO: 47008 - DNA, 95 bp, Homo sapiens
acgcattttatgtatctgtgtgtgtgtgtgtatatatatgtgtgtacgtatgtgtgtgtatatatatatatacacacacacatacatatgtgtgt

SEQ ID NO: 47009 - DNA, 105 bp, Homo sapiens
aggaaaacattttcagatcatcatagcaaaagttgatttatatgtatatataaatatatatttttttttgccaaagccaagtgttctgaaaaagttgatttttct

SEQ ID NO: 47010 - DNA, 57 bp, Homo sapiens
ggtggagtctcactctgtcacctaggctggagtgcagtgacacggtcttggctcact

SEQ ID NO: 47011 - DNA, 100 bp, Homo sapiens
ggtgtccagctttacctcctgccactttatactttggtagactagtgatcatgattggtgatcctgattcccaagggtaggtgaagggaatgcttctacc

SEQ ID NO: 47012 - DNA, 101 bp, Homo sapiens
aaccttggcggagagtaggctttcaccttgaccgatagtttatttatttatttatttatttattattttttgagacagagtctccctctgtcatccaggtt

SEQ ID NO: 47013 - DNA, 118 bp, Homo sapiens
gctgctctgaagccttgagggatagggtgtaggcattttttcccagagcctcctaactcttttttttttttttttttttgagacggagtcttgctctctgtcacccaggctggagtgc

SEQ ID NO: 47014 - DNA, 78 bp, Homo sapiens
ccgggccagagaccagagagcctgctcactacgagaactggatcctgaagcctcgagggctgctcgggctctggcagg

SEQ ID NO: 47015 - DNA, 75 bp, Homo sapiens
ctaggtgggattactgtgtcagtctgtgtgtatgtacacatatatatgttgtacaggtgcttcccttctccctag

SEQ ID NO: 47016 - DNA, 111 bp, Homo sapiens
tgtactacatatacatatgtacatgtgtgtatgtatatgttcatatatatatatacacatatatatatacacatatatatatatacacatatatatacatatatatataca

SEQ ID NO: 47017 - DNA, 115 bp, Homo sapiens
ttttgcctatttattggtaattcatggaacgtggtgctgcggttgtggtgtttttttttttttttacatcatcactatatgcagtgcccagaacagtgccttgaatatagtagaa

SEQ ID NO: 47018 - DNA, 75 bp, Homo sapiens
ttgtttgtgagacagggtctcactcactctgttgccccagctggagtacagtggcgtgatctcagctcactgcaa

SEQ ID NO: 47019 - DNA, 84 bp, Homo sapiens
tgggcatgaccagccagggagctgcagcacttgacagataacattgttagactgtgactcactctctgcagtctggaaagctca

SEQ ID NO: 47020 - DNA, 112 bp, Homo sapiens
ttcttggggataggctttttaaaatgaaacccataatttatttttgttacaaaaggaaatgtttacgtccctgttaaagtataaaaagggtctcattagtgtatctgaagag

SEQ ID NO: 47021 - DNA, 112 bp, Homo sapiens
gttcagaggcttagttttctgtggttctaatgcagtgcttttcaaccttttttttttttttttttttttaaggcagcagaacttcagtatataaaacaagtaaaatcagggc

SEQ ID NO: 47022 - DNA, 135 bp, Homo sapiens
gggtgacacagcatgaccctgtctcaaaaaaaaagagaaactttttttttttttctgagacagtgtctcgctctgtcacccaggctggagtgcagcggcgccatctcagctcactgaaagctctgcctcacgggt

SEQ ID NO: 47023 - DNA, 88 bp, Homo sapiens
gccaggatatttaggggttacttgtcaggctcggggtggggtccaggggagaaaccacatgagcaggactctggcctgtgggcttggc

SEQ ID NO: 47024 - DNA, 58 bp, Homo sapiens
tgagatagagtctcacactgtcacccaggcgggagtgcagtggcgtgatctcagctca

SEQ ID NO: 47025 - DNA, 96 bp, Homo sapiens
gcctagcagctctggctcatagtggggagtagttttttttttttttttttttttttttgagacggagtctcactctgtcgcccagcaggctggagt

SEQ ID NO: 47026 - DNA, 69 bp, Homo sapiens
gcaccatgccagggcactgggggctacgatgatgtgaatctgtgactgcctctctggaaatcatggtac

SEQ ID NO: 47027 - DNA, 94 bp, Homo sapiens
ctgtaaagtcttcttggactcctctgggcagggcattattattattattattattgaaatggagtctcgctctatcacccaggctgaagtgcag

SEQ ID NO: 47028 - DNA, 90 bp, Homo sapiens
cttcccccatgtctctctgtttctctcatcccctgctcaagtgggctagccaagagaggggacaagtgggactctgagatcttcgggagg

SEQ ID NO: 47029 - DNA, 69 bp, Homo sapiens
gcaacagagacatgagtctgtgtcttttttttttttttttttttttgagacgtagtctcgctctgtcgc

SEQ ID NO: 47030 - DNA, 89 bp, Homo sapiens
agcaggtgctgaacagtgtagagcgtgtgctatcatttgtgtcacacacacacgcacatatacacagcatatgctccaaatagctctgc

SEQ ID NO: 47031 - DNA, 116 bp, Homo sapiens
cttggaggtaagccctgtactgccccccagactgaactgcctgcccacggcagagtatggctgagtggttagcagcatgagtgctggggtcaggtagacctgggtttaaatcctgg

SEQ ID NO: 47032 - DNA, 65 bp, Homo sapiens
gtgggaagctgaggtactaggttgaagcattcctccttctgaatctgcctcactggtcttcccac

SEQ ID NO: 47033 - DNA, 81 bp, Homo sapiens
gcttctctctgagactctgtctgggggcccacgatctgcagtcaaggacttgcagattcccctttaaatctcacaagaagc

SEQ ID NO: 47034 - DNA, 56 bp, Homo sapiens; identical to SEQ ID NO: 24883

SEQ ID NO: 47035 - DNA, 87 bp, Homo sapiens
aggacagaacagctgggacagtttccctctttgccttcaggggcctccccaggtccagacagaacacacccagcttagttcctttct

SEQ ID NO: 47036 - DNA, 85 bp, Homo sapiens
ggttttttttttttttttttgagtcggagtctcactctgtcatccaggctggagtgcagtggcgtgatatcggctcactggaacc

SEQ ID NO: 47037 - DNA, 70 bp, Homo sapiens
tttttttgagtcggagtctcactctgtcatccaggctggagtgcagtggcgtgatatcggctcactggaa

SEQ ID NO: 47038 - DNA, 102 bp, Homo sapiens
ggacaagcaaggtgcaaaatttacggagacactcactctcagccgcaccagtgcacgccggcacctgataatgactgcctccttactttgcatcctaggtcc

SEQ ID NO: 47039 - DNA, 108 bp, Homo sapiens
actgcatgacacacagatgaggaaactgaggcacagagaaagtgatacacagttgcatagtcactttctctgtgcctcagttacctcatctgtcaaactgatgatagt

SEQ ID NO: 47040 - DNA, 68 bp, Homo sapiens
gttacttagcctctctgtgtctcaggaataattcctacttcctagggctgttaggaggactaaatgac

SEQ ID NO: 47041 - DNA, 82 bp, Homo sapiens
tcctttaccagtccctctctgtctcttattccttaggtcctgtgatggctctttagaagggaggcacagggctaggccagga

SEQ ID NO: 47042 - DNA, 85 bp, Homo sapiens
tttgggaggccgaggcgggtggatcacctgaggtcaggagttcgagaccagcctgagaacatggtgaaaccctgtctcttctaaa

SEQ ID NO: 47043 - DNA, 163 bp, Homo sapiens
ggctgcagtaagagtgagagatgtgacacagaagaaggatcagagagatgtaacgttgctggcttttttttttttttttttttttgagacagggtctcactctgtcacccaggctggagtgcagtagcgacatctcagctcactgcaacctccatctcctggg

SEQ ID NO: 47044 - DNA, 80 bp, Homo sapiens
ggggctgtacgggagtgaggcactcagtagggagtgagcccaatcctcctggctgccctgtcccatcctaaaacggctct

SEQ ID NO: 47045 - DNA, 92 bp, Homo sapiens
gggtaagccccagagacccccaggcagtcaaggccctgctgggtgccccagctgacctgtgacagaagtgagggagctttgcgtgtttatcc

SEQ ID NO: 47046 - DNA, 117 bp, Homo sapiens
ctgggactaaaggcatgcaataccatgctgggctaaattttttttttttttttttttttaattttaaattttattttaagagatggagtcttactgtgttgcccaggctagtctcag

SEQ ID NO: 47047 - DNA, 75 bp, Homo sapiens
ttgttttgttttgagatggagtctcactctgtcacccaggctggagtgcaatggcgtggtctcagctcactgcaa

SEQ ID NO: 47048 - DNA, 112 bp, Homo sapiens
tatacttgtactattcttttcatggactttctgatgcttgctgtttgtgcacataggctttgctttttgtatttatttatattgtatgaatctaagaataaaagagagtgtg

SEQ ID NO: 47049 - DNA, 84 bp, Homo sapiens
catttcagagaagtcttggagtagatgggatttttttttttttttttaagatggagtcttgctcttgttgccccggctggagtg

SEQ ID NO: 47050 - DNA, 77 bp, Homo sapiens
gctctgttaagtatgagtttagatacacagtattttcttttttattaccgtgtataatttgtatttgtagcagcagc

SEQ ID NO: 47051 - DNA, 70 bp, Homo sapiens; identical to SEQ ID NO: 47037

SEQ ID NO: 47052 - DNA, 112 bp, Homo sapiens
ggcatagtggtgcctgcctgtagtttcagctacttgggaggctgaggtaggaggatcgcttgaccccaggagttcaaggctgcagtgagctaccatcgagccacttcacttc

SEQ ID NO: 47053 - DNA, 97 bp, Homo sapiens
tgagcccagtttccttatttgtttttgtttgtttgtttttgagacgcagtcttactctgtcacccaggctggagcacagtggcatgatctcggctca

SEQ ID NO: 47054 - DNA, 112 bp, Homo sapiens
acagaagcatctcaggacatgcatctcaaatgtttaaagaggcagaaggctccctaccgtcgtttttttttgttttttgttttctcttttttgagatggagtctcactctgt

SEQ ID NO: 47055 - DNA, 77 bp, Homo sapiens
agagtgagactttgactgcgaattaggcaaaaggtgtaagtcttttactttttttttttgagacggagtctcactgt

SEQ ID NO: 47056 - DNA, 58 bp, Homo sapiens; identical to SEQ ID NO: 1673

SEQ ID NO: 47057 - DNA, 70 bp, Homo sapiens
cttgacctagggcacagtagagtgtcaggaatcaaagataatcctgatgttttaagcctgggaaattggg

SEQ ID NO: 47058 - DNA, 62 bp, Homo sapiens
agatgatgatgatgatgatgatgatgatgatgattattattattatattattattattattt

SEQ ID NO: 47059 - DNA, 97 bp, Homo sapiens; identical to SEQ ID NO: 47053

SEQ ID NO: 47060 - DNA, 112 bp, Homo sapiens; identical to SEQ ID NO: 47054

SEQ ID NO: 47061 - DNA, 58 bp, Homo sapiens; identical to SEQ ID NO: 1673

SEQ ID NO: 47062 - DNA, 81 bp, Homo sapiens
ctgacaaatgtgtcttttcagagaggttcttgtatgtatgtttatataggctaacgtttactgaggactaacatgtaccag

SEQ ID NO: 47063 - DNA, 64 bp, Homo sapiens
ggtgacaatgggagcccagcagaactttttttttttttttgagactgagtctctctttgtcgcc

SEQ ID NO: 47064 - DNA, 82 bp, Homo sapiens
actctgctctaagtaaggtagtaaggagcctattcactgaggcactcagagtggccattttattatttttttgagacagagt

SEQ ID NO: 47065 - DNA, 73 bp, Homo sapiens
gacaggaggcggaccagaggtgagggtccaagctagtcctggctctgggacactctctgtgttgtccctgatc

SEQ ID NO: 47066 - DNA, 75 bp, Homo sapiens
tcctgccaagtagtgctggggtttgtttcgtgttttttttttttttgagacaggctctcactctgtcacccagga

SEQ ID NO: 47067 - DNA, 79 bp, Homo sapiens
tgaaagaagtcccgggtctgtctctctcactctcgctctcactgggggagggaaagaatggctttggtggctttgttca

SEQ ID NO: 47068 - DNA, 76 bp, Homo sapiens
ctattttgctttatgtaaatatgtatgtaggtaaatggggaaaagtctggaagcatgtatactaaatgcagagtag

SEQ ID NO: 47069 - DNA, 58 bp, Homo sapiens; identical to SEQ ID NO: 16930

SEQ ID NO: 47070 - DNA, 65 bp, Homo sapiens
gggacagaaaggggagagggaagctggtgccttggcatttctgtgtctgtgtatctgtctgtctc

SEQ ID NO: 47071 - DNA, 114 bp, Homo sapiens
ggggactgtgagttatttatctttatattcaagccaagtatgactgtgagttatttatctttatattcaagccaagtgtgtttagctataatggaaatgaatctcaaagtttct

SEQ ID NO: 47072 - DNA, 56 bp, Homo sapiens
gagacagtgtctcactctgtgctccaggctggagtacggtagtgcgatcatggctc

SEQ ID NO: 47073 - DNA, 174 bp, Homo sapiens
tgattgtatgattctacttatatgagatttatagaataagtgaattttttaattaattattaattttaattttattttatttatttgtttctttttgagacggagtctcactctgtcacccaggctggagtgtagtggaacgatctcagctcactgcaacctccacctcctggg

SEQ ID NO: 47074 - DNA, 92 bp, Homo sapiens
tcttatttggtctctcagaatccaggtaaaaaagacttcttcaaaagtatagaagataatacttttgtaactgattttggggttgggagggg

SEQ ID NO: 47075 - DNA, 96 bp, Homo sapiens
attatttagagatgggatctcactctgtcacactggctggagtgcagcagcgtgatcacagctcactgtggccttgaactcctgggctcaagtgat

SEQ ID NO: 47076 - DNA, 58 bp, Homo sapiens; identical to SEQ ID NO: 2051

SEQ ID NO: 47077 - DNA, 58 bp, Homo sapiens; identical to SEQ ID NO: 3270

SEQ ID NO: 47078 - DNA, 98 bp, Homo sapiens
caggcgtgagccaccgcacccggctgagcaattttttaaaattaattttttttatttcaatagcttttggggtacaagtggttttggttacatggatg

SEQ ID NO: 47079 - DNA, 85 bp, Homo sapiens
ctcctgtgggttatggtaaaatgtgaaactctgttgggatacctttttttcgagacagagtctcactctgtcgctcaggctggag

SEQ ID NO: 47080 - DNA, 119 bp, Homo sapiens
ggataacttaatttgtcataataatatatgagctatagattggatagattgatggatagatacatagttttatttatttggggatagcaatatgacattatgcacataaaaatgtggcc

SEQ ID NO: 47081 - DNA, 114 bp, Homo sapiens
cagcctaagcaacatagtgagaccaactcaaaaaaaaaagaagttgataaacagaaaaaatggctttttttttttttttttttgagatggcgtctcaccctgtcacccaggctg

SEQ ID NO: 47082 - DNA, 85 bp, Homo sapiens
cgcgtgcaaagtctgggaagtgtgtgtgcccacacggctggcacagccagagtgtgaggcccatgaaggggtgtgatgggatgtg

SEQ ID NO: 47083 - DNA, 84 bp, Homo sapiens
gccatgtacagggatagggaagactgctgtagaaacatttttttcttttaaagatacagagtctcgctctgttgccgaggctgg

SEQ ID NO: 47084 - DNA, 89 bp, Homo sapiens
gtactccagcctgggcacagagcaagaccttgtctcttttttttttttttttgagatgtggtctcgctctgttgcccaagctggagtac

SEQ ID NO: 47085 - DNA, 69 bp, Homo sapiens
gtgtgcatcctggccatgcagtggccccgtgggaacctctgtctctgtgtgtatgcctggctgtcacgc

SEQ ID NO: 47086 - DNA, 75 bp, Homo sapiens
gggaggagtgggggagttctcagttcactgttctctccttcccacagtgcgttcacagctctctcactgtctctc

SEQ ID NO: 47087 - DNA, 63 bp, Homo sapiens
ctagtcttctgtcctgggtttagggatgtcttctgtcactctggctctctaacagaattctag

SEQ ID NO: 47088 - DNA, 65 bp, Homo sapiens
cagagtctcactcagtcgcccaggctagaatgcagtggcatgatcttggctcagtggaacctctg

SEQ ID NO: 47089 - DNA, 100 bp, Homo sapiens
ctgaaggcctcttcggacttgcagtgtccctgtgtcgctgtgtcggtaggagtggtcacagtgatgcgagcctggcatactccctgtgagtgcctatcag

SEQ ID NO: 47090 - DNA, 98 bp, Homo sapiens
ttcctctggccagcttggatggtggaggcaggggtgggacagagatgagacactgcagaaagatccttcctcaccttccttttgagtcgttcatggag

SEQ ID NO: 47091 - DNA, 111 bp, Homo sapiens
ccctggtcctgccacttatgggctgtgtggccttaggcaagtcactgtgtgtctctgagcctcagtatccggatgtggaaagtggggatgataatggcacctgccttatgg

SEQ ID NO: 47092 - DNA, 58 bp, Homo sapiens; identical to SEQ ID NO: 2442

SEQ ID NO: 47093 - DNA, 73 bp, Homo sapiens
gctatatttttattactttatggtctgtgtgtttgctcacagccacactgactatggggtgtggtgtgtgtgc

SEQ ID NO: 47094 - DNA, 92 bp, Homo sapiens
ctctactggactctgggtggggaggtggcagctggtgttcttttttttttttttttttaagacaaagtctcactgtgtcactcaggttggag

SEQ ID NO: 47095 - DNA, 72 bp, Homo sapiens
gttgttttgagacagagtctcactctgtcacccacgctggagtgcagtggtgtgatctcggctcactacaac

SEQ ID NO: 47096 - DNA, 115 bp, Homo sapiens
gctcggcccgctgtcccccccggcccaggttctgtgatacactccgactcgggctctggagcagtcagtgcatgacagaacttgggcccggaaggaccttctgcacccaacgggc

SEQ ID NO: 47097 - DNA, 107 bp, Homo sapiens
ctcccaaagtgctgggattataggcgtgagccaccgcacctggcaacaagaaaaataaattttttttttttttcagacggaggctcacactgtctcccaggctggag

SEQ ID NO: 47098 - DNA, 67 bp, Homo sapiens
ttattctagtgcagacaagtgagtgagcactattgagtgtgtgcacacatgtgtttgcaaagcatgg

SEQ ID NO: 47099 - DNA, 68 bp, Homo sapiens
gggactgggccaaggcagtccctgagccagtgctctggactcaggcacactcactcctactcaccccc

SEQ ID NO: 47100 - DNA, 108 bp, Homo sapiens
cagtgctgtgccctgtgctttcctggaaaagagcttgtgattacactgccttctatctgcctgtctttgtctcagtgtcaatcactagttggaaagttctgaggactg

SEQ ID NO: 47101 - DNA, 86 bp, Homo sapiens
tatttgagcagaatgtgtatgatttcacaggctgagatcagggggatggtctaggtagaagaaacaacatgattctagttttggtg

SEQ ID NO: 47102 - DNA, 107 bp, Homo sapiens
gtgtggtggcacaaacctgtagtcccagctacttggaggctgaggtaggaggatctcttgagtccaggagttcaaggctgcagtgagctgtgattgaaccacttcac

SEQ ID NO: 47103 - DNA, 117 bp, Homo sapiens
gcctcggcctcccaaagtgctgggattacatgcgtgagccaccatgcccggccaaaaaaaatttttttttttgatgcagagtctcactctgtaacccagactggagtgcagtgatgc

SEQ ID NO: 47104 - DNA, 67 bp, Homo sapiens
gagtctcactctgtcacccaggctggagtgcagcctgtcatccaggctggagtgcagatctcggctc

SEQ ID NO: 47105 - DNA, 93 bp, Homo sapiens
ttcatctgcatgtctaacatacctatagcaacattacttaatatatgagtatgtgaagtatattttattatagtagtagacaagcaaactgaa

SEQ ID NO: 47106 - DNA, 105 bp, Homo sapiens
tgtggcattaagcacattcacattgtgccacaactataaagtttttttttttttattatactttaagttttagggtacatgtgcacattgtgcaggttagttaca

SEQ ID NO: 47107 - DNA, 89 bp, Homo sapiens
gtttggaggaggggaggttattaatttttatttcatacatctttgtgttgtttgaattgtgacaatgaccatgcattacttctgtaaac

SEQ ID NO: 47108 - DNA, 72 bp, Homo sapiens
cccagcagaggacctgaagaccaaagaggttgctgactctgacattctctgtttttgattggttctcttggg

SEQ ID NO: 47109 - DNA, 74 bp, Homo sapiens
ggagtttaaggaaagaggctgtggggtcctcctttgatgcagctacatttccctctgagcctctgtctgtttcc

SEQ ID NO: 47110 - DNA, 81 bp, Homo sapiens
tagattcctcttttttttttttttttttcttaaggctagtcaagcgaagcagtgggagtggagaaggaacaaagaaatctg

SEQ ID NO: 47111 - DNA, 116 bp, Homo sapiens
gattgcctttttaccctgttgactgtgtcctttgatggagcaatgactttttttttttttttttttttgagacggagtctcactctgtcgccaggctggagtgcagtgaggccatc

SEQ ID NO: 47112 - DNA, 73 bp, Homo sapiens
gttgttgtgtaatgggtatagagctccagtttttcaggatgaaaagaactctggagattggttgcacaataat

SEQ ID NO: 47113 - DNA, 63 bp, Homo sapiens
cccaacactttccagatgagggagaagtagaactgcttgcctctcacactgaatgtgtgtggg

SEQ ID NO: 47114 - DNA, 95 bp, Homo sapiens
ggctgtgcctgaacttgcaacagtccagtcaccccagtgcttttgtctggcgtcaaggcctctgtgggtctgactgccccagcttcagcacctcc

SEQ ID NO: 47115 - DNA, 82 bp, Homo sapiens
gtgcagtgttttggtcacggtaacacacacacactctccctcatctttcgtgcccattcactgagggccagaatgactgctc

SEQ ID NO: 47116 - DNA, 116 bp, Homo sapiens
aagaagatctgtctgtcttctgtatataccctgtagatccgaatttgtgtaaggaattttgtggtcacaaattcgtatctaggggaatatgtagttgacataaacactccgctctt

SEQ ID NO: 47117 - DNA, 69 bp, Homo sapiens
tctggttaggctcaggggtagattggggtggatttctcggcaactctctgactctgagtcctaataagg

SEQ ID NO: 47118 - DNA, 118 bp, Homo sapiens
gtgagctcttgacctagagcttgaattggaactgctgagtgaattaggtagtttcatgttgttgggcctgggtttctgaacacaacaacattaaaccacccgattcacggcagttact

SEQ ID NO: 47119 - DNA, 73 bp, Homo sapiens
tctagctatatatatgtatgtatatatgtgtgtgtgtgtatatatacatatgtgtatatatgtatgtgtgaga

SEQ ID NO: 47120 - DNA, 73 bp, Homo sapiens
ttgtgtttttgagatggagtctcgctctgtctcccaggcaggagcgcagtggcgtgatctcggctcaccacaa

SEQ ID NO: 47121 - DNA, 101 bp, Homo sapiens
agactggaagccatcttgccctctctggatgcaagaatggagagtcaaacactgtcactgcatcacttgagtccaggagttcaagaccagcctggccaaca

SEQ ID NO: 47122 - DNA, 104 bp, Homo sapiens
acttgcttcttgttgttgagatagagtcttgctctgtctctcagagtggagtgtagttcactgcagcctcaacctcctcccaggctcagtgatcctcccacctc

SEQ ID NO: 47123 - DNA, 80 bp, Homo sapiens
atctcagcactaatgtcttcagctgagaccacctgagaggcaggtactgtgtctcagtgtctgagatcctggtcctggat

SEQ ID NO: 47124 - DNA, 63 bp, Homo sapiens
tatatatatatatatatatggcaacaaagtgagaccttgtctccatatatatacatatatata

SEQ ID NO: 47125 - DNA, 63 bp, Homo sapiens; identical to SEQ ID NO: 47124

SEQ ID NO: 47126 - DNA, 117 bp, Homo sapiens
gccagaattagccaaatagaaatgacttttgttttattttttaaatttttatttatttatttttatttatttattttttttgaaacggagtctcactctgttgccaggctggagtgc

SEQ ID NO: 47127 - DNA, 64 bp, Homo sapiens
gcagccctggcatcttagttttctcttcctctatatgagatgtgagaagatagtcaggtgcggt

SEQ ID NO: 47128 - DNA, 111 bp, Homo sapiens
ggggtgggctgctctgaaggccaatgtacttcattttgtttattaatttagagacggagtctcactctgtctcctaagctggagtgcagtgacacgatctcagctcactgc

SEQ ID NO: 47129 - DNA, 119 bp, Homo sapiens
aactctgtctcaaaaaaataaataaataaataaacaaaaataaagtgcagcaagaataattattttttacataggcattttattttattttattttatttattttattttgactgagtt

SEQ ID NO: 47130 - DNA, 76 bp, Homo sapiens
tgtgatctcggctcactctctgcctctgattctcctgcctcagcctcccgagtagctgggattacaggcatgagcc

SEQ ID NO: 47131 - DNA, 119 bp, Homo sapiens
acagtgttgccctccagcccatgcggtgttgacaatgtgccattctttatttatttatttattattatactttaagttttagggtacatgtgcacaatgtgcaggttagttacatatgt

SEQ ID NO: 47132 - DNA, 79 bp, Homo sapiens
ggattacaggcatgatccaccatgcccggtgaatttttttttttaattggatgggcatggtggcacaaacctgtagtcc

SEQ ID NO: 47133 - DNA, 87 bp, Homo sapiens
ccagcctggtcaacatagtgagaccccaactctattaattcttttttttttttttgagacggagtctcacactgtcacccaggctgg

SEQ ID NO: 47134 - DNA, 132 bp, Homo sapiens
ctggaacatcttctctcttaagttatcgtgatctggtctctgtaagagttgccaagagatgtctttgctgatctaggtgttttggggattgtccacttgcagtagagttaactgtgatcacgacaccactta

SEQ ID NO: 47135 - DNA, 82 bp, Homo sapiens
atttgtatgtataatagtgttgtaccaattagtgtgtataataatatatattaattatatataacattaattatatataaat

SEQ ID NO: 47136 - DNA, 97 bp, Homo sapiens
tagatgtatatatgtaggtatgtgtgtgtgtatatatgtatgtgtgtgtgtatatatatatatatatacacatatatatacatatatgtatattctg

SEQ ID NO: 47137 - DNA, 89 bp, Homo sapiens
aggaatggtgttaagtgtgctcacatctctgtctaccctaagaaagtgtggtggactctgtgttgtgtttagaaaaacctacctattcc

SEQ ID NO: 47138 - DNA, 125 bp, Homo sapiens
tgcccctttccaggagagcttcttgcagttggttcggctcttgaaagttactcacctgcttcagcaactgcagctgctgtacccgacaaatggcaaaagacaagacaccaaccacacgagatccc

SEQ ID NO: 47139 - DNA, 106 bp, Homo sapiens
gcatttatgtgagccaagcagtctgattgggccaaaccctgggaaatgtaaatatatttattcttattttactatttggcacagcctgttgtctcccaataactgt

SEQ ID NO: 47140 - DNA, 71 bp, Homo sapiens
acaggtgtgagacactgtacccagacaaattctttaaaattttttttttttgagacagagtctcgctctgt

SEQ ID NO: 47141 - DNA, 58 bp, Homo sapiens; identical to SEQ ID NO: 25073

SEQ ID NO: 47142 - DNA, 59 bp, Homo sapiens
tcccaccctccctgaatcccacgtggaccccacagtccctgctttcacttagggtgggg

SEQ ID NO: 47143 - DNA, 79 bp, Homo sapiens
caggcaagagggctcaggtaaggcaggagccactgaagctagagagctggctcttagcccacactcactctctcagatg

SEQ ID NO: 47144 - DNA, 79 bp, Homo sapiens
gcctgtgcctgtctctgaggctcagcctcagcccctgctggttgtttggccaagtcctccggggagactggcttgtggt

SEQ ID NO: 47145 - DNA, 84 bp, Homo sapiens
gagaaaggtttatttatttatttatttggaggcagagtcttgctctgtcacccagactggagtgcaatggtgcgatctcagctc

SEQ ID NO: 47146 - DNA, 58 bp, Homo sapiens; identical to SEQ ID NO: 87

SEQ ID NO: 47147 - DNA, 56 bp, Homo sapiens; identical to SEQ ID NO: 88

SEQ ID NO: 47148 - DNA, 114 bp, Homo sapiens
gcctcccaaggtgctggaattacaggcatgagacactgtgcccagctgttttgtcattttattttactttattttatgagttggagtctcagtctgtcaaccaggctagagtgc

SEQ ID NO: 47149 - DNA, 97 bp, Homo sapiens
ttagtcttgctgtattatatatgtatctatatctatctgtatctctatatagatatatttatatagatacagatatctgtaataactagtatcctgg

SEQ ID NO: 47150 - DNA, 58 bp, Homo sapiens
tgagactgagtctcgctctctcacccaggctggagtgcaatggtgcgatctcggctca

SEQ ID NO: 47151 - DNA, 144 bp, Homo sapiens
tgtgtatatatatatgtgtgtatatatatgtgtatatatatatgtgtgtatatatgtgtgtgtgtatatatatgtatgtgtgtatatgcatgtatgtatctatatgtatgtgtgtatatatatgtatgtatgtgtatatatata

SEQ ID NO: 47152 - DNA, 108 bp, Homo sapiens
gtgacagagtgacaccctatctcaaaaaaaaaaacttttttttatacgtctatactttttaaacacttttttcttttttttttttgagacagagtctcgctctgtcac

SEQ ID NO: 47153 - DNA, 86 bp, Homo sapiens
gtgggactgctggggtgaggggcgagggagtgggatccagagccaggagctctctcacactgtggttcttgtatcccatgacccac

SEQ ID NO: 47154 - DNA, 58 bp, Homo sapiens; identical to SEQ ID NO: 2540

SEQ ID NO: 47155 - DNA, 60 bp, Homo sapiens
ctgtctctgtctctctctcgacagagttttgctctgtcgcccaggctggagtgcagtggc

SEQ ID NO: 47156 - DNA, 111 bp, Homo sapiens
catgtggctctgcccactccctgcaccccattgtgtgtgtccgcctgcctgtgtgcgtgtcttctgtgggttcatgtgtgcacatgcggtgtctgtgtgcctagctccctg

SEQ ID NO: 47157 - DNA, 115 bp, Homo sapiens
gtggaggggaagggttgctctgtggagcccccaggatctgtcagtctgtttctctggctgggggatgagagatgggcttaggtgaggtgggcaaggaggggagtttgcccattgt

SEQ ID NO: 47158 - DNA, 97 bp, Homo sapiens
tgtatatgtatacatatatgtgtatatgtagacatacctatatgtgtatatatgtatacatatatgtatatatacgtgtatatatacatatacttgt

SEQ ID NO: 47159 - DNA, 108 bp, Homo sapiens
tgtgtataaacacatatgtgtacatgtatacacatatacgtgtacatgtatacacatatatgtgtatatgtatatatgtgtatatatgtatacatataagtatatata

SEQ ID NO: 47160 - DNA, 119 bp, Homo sapiens
tatacatacatgtatgtgtgcatgtgtgtatacacataggtgtgtatatatgtatatgttatatatgtatatacacatatatgtatacatatatacacatatatacatacatatgtata

SEQ ID NO: 47161 - DNA, 67 bp, Homo sapiens
atatgtatgtatatatgtgtatatatgtatacatatatgtgtatatacatatataacatatacatat

SEQ ID NO: 47162 - DNA, 58 bp, Homo sapiens; identical to SEQ ID NO: 2263

SEQ ID NO: 47163 - DNA, 88 bp, Homo sapiens
tccattgagagggcctgggagccatgacatattaataataatgagtgtagttagcacccaagccttttttttttttttttgagatgga

SEQ ID NO: 47164 - DNA, 96 bp, Homo sapiens
ggctgcttagaggcactatgatttgaggaagaatgtgatctctgccagcctgaatccctcacccactgctcacactcattctctgcctttacagct

SEQ ID NO: 47165 - DNA, 102 bp, Homo sapiens
gactaaaggcctgtgcgagctgtccccatctggctcagcagccagaaggaactactttgcctctggctgtctctgtcccagtctctctggcctctttaggtc

SEQ ID NO: 47166 - DNA, 112 bp, Homo sapiens
cacaaagaaacatctgtcttgcttcatgtcatggagttgcttgtatagtttaagtttcgagtacttgtctgagcaagtctgtcttttcatggatggctgaaaatgctttatg

SEQ ID NO: 47167 - DNA, 68 bp, Homo sapiens
ctgtgcctggccttagtattttttgaatgaatgaatgaatgaatgcaaagcttttggcataggcacag

SEQ ID NO: 47168 - DNA, 117 bp, Homo sapiens
catgtgatgttacccagtgaggtatgcagggccacctttaattctttcattttattatttattattttttgagacagagtttttgctctgttacccaggctggagtgcaatggcatg

SEQ ID NO: 47169 - DNA, 116 bp, Homo sapiens
gcttatatagaatgtgagacttagtcagagttcatttttgttgttgttgttgttgttattttttattttttttattttttatttttcgagacggagtctcgctctgttgcccaggc

SEQ ID NO: 47170 - DNA, 92 bp, Homo sapiens
gagagacagagtctgaaagcctggtagagaaaagagccacggccaccgtgccaaggaaagctgagcctctgtgtgcctcagtgtctgtgtcc

SEQ ID NO: 47171 - DNA, 70 bp, Homo sapiens
aggcctgagtgtctgggtccctgagagcgtgcagggattgggggacagggattcaaacacttacttgctt

SEQ ID NO: 47172 - DNA, 58 bp, Homo sapiens; identical to SEQ ID NO: 1763

SEQ ID NO: 47173 - DNA, 66 bp, Homo sapiens
ttagccaagtcagggtcactgggtcactgaccaagtcaggggacagaaggtcatcatctaggttaa

SEQ ID NO: 47174 - DNA, 92 bp, Homo sapiens
ttccaggcttccctctaagccagacaccttcagatttttttttttaaaaagtagagatgaagtctcaatatgttgcccaggctggtcttgaa

SEQ ID NO: 47175 - DNA, 83 bp, Homo sapiens
tctgtccctctgtctggctctgtcgttggcctcttggtgacatggaagaaaggctgaatgtggagtcgttagcctgggactga

SEQ ID NO: 47176 - DNA, 60 bp, Homo sapiens
gtggtagtgagtgtggagacagacgccagactgcctgggtttgtatgccagctttgccac

SEQ ID NO: 47177 - DNA, 65 bp, Homo sapiens
ctcactatctctgtcacatactaggtcaagcatgtgctactcagctatgggcagtgagtacggag

SEQ ID NO: 47178 - DNA, 86 bp, Homo sapiens
cacttgtgagaactgtgccaggacagtgggctctaactgaccttgtgggaaagtcctccctttgtgccttatgggcttctccggtg

SEQ ID NO: 47179 - DNA, 102 bp, Homo sapiens
ctacaaaatggcatgatatctgagttgagtaaataactcctttttttttttttcttttttgagagggagtcttactctgtgacccaggctggagtgcagtgg

SEQ ID NO: 47180 - DNA, 88 bp, Homo sapiens
ctcctgcctctctcccaagtagctgggactacaggcgcccgccaccatgcccggtaatttttttttgtatttttagtagagatggggg

SEQ ID NO: 47181 - DNA, 112 bp, Homo sapiens
ggccagcctcagaccctgtgcctgacccagggctcctttgcaaaacaagttcttttttttttttttaatactttaagttctagggtacatgtgcacaacgtgcaggtttgtt

SEQ ID NO: 47182 - DNA, 77 bp, Homo sapiens
agggtgagccaggtttcatgagcaaggaaaacctccacttcatttccagtctctccataaagcctgatgttcctcct

SEQ ID NO: 47183 - DNA, 116 bp, Homo sapiens
ttcagacaagtgatggaagtctggcttttttttttttttttttggagtctcactctgtcactcaggctggagtgcagtggtatgatcttggctcactgcaacttccacctcctggg

SEQ ID NO: 47184 - DNA, 58 bp, Homo sapiens; identical to SEQ ID NO: 1409

SEQ ID NO: 47185 - DNA, 110 bp, Homo sapiens
ttcatagaagactccctcccccaatagttttaaactttttcaatatttgttatgtgtgaaaatgaatggcttatattttgatttctattagtgtgagggagtcttatgaa

SEQ ID NO: 47186 - DNA, 98 bp, Homo sapiens
aggaacagtctggttaatttgttttatttcatgcatcagagttcagctttttgtttatttgatgataaataacatcttaaaattaacttacatttcct

SEQ ID NO: 47187 - DNA, 100 bp, Homo sapiens
tagatttgctgatggattggatatgtgaggtactagagaaacagaagagtcaaagctgactccagagttttggtcctgagtaactgaccacagtaattta

SEQ ID NO: 47188 - DNA, 114 bp, Homo sapiens
tatatatatcactatatgtatatcactatatatatatcactatatgtatatatcactatatgtatatatcactatatatatcactatatatatatcactatatatatatataca

SEQ ID NO: 47189 - DNA, 116 bp, Homo sapiens
ggcgccaaagcgatactcggtctcaaaaagaaaaaaaagaaaacaggagaataatgaaattttacttatttattttatttattttttatttttttgagaccgagtctcgctctgtc

SEQ ID NO: 47190 - DNA, 66 bp, Homo sapiens
tccacatctgtgtgtgtctctgatgtgtgtgatatgcgtcatacagtgcagtaccacagagctgga

SEQ ID NO: 47191 - DNA, 105 bp, Homo sapiens
gtgtatgtgtatgtgtatatatatatgatgtgcatatatacatatgtgtgtatgtatatatatatgtgtgtgtttatacatatatatacacacatacacacacac

SEQ ID NO: 47192 - DNA, 120 bp, Homo sapiens
atgggtctatatatagatatctatagatacatatagagtgtatatatatatctatagatttacatacctatagatatgtcaatatctatatagatatctacagaatctatatatatctat

SEQ ID NO: 47193 - DNA, 94 bp, Homo sapiens
gaacaggcaaggggtgagcagctgtgattgaaaacagtgacgacagactttggagcaagaagcaagggcagtatgctgactggatgttctgttt

SEQ ID NO: 47194 - DNA, 94 bp, Homo sapiens
gaggtttacacaaatgttcagctctgtttattttttctaatttacttttcagcagtcagtaagaacttaatgagctctcatttatggcttcctc

SEQ ID NO: 47195 - DNA, 58 bp, Homo sapiens; identical to SEQ ID NO: 1673

SEQ ID NO: 47196 - DNA, 121 bp, Homo sapiens
tgcccgagctgtcttatctgtgttttactgtctgctctttctggttgcttgttgttagaagagaagtgatttccttgaaatgcatgaggctagaaagggagctggaacttaaagtggcagt

SEQ ID NO: 47197 - DNA, 95 bp, Homo sapiens; identical to SEQ ID NO: 68

SEQ ID NO: 47198 - DNA, 93 bp, Homo sapiens; identical to SEQ ID NO: 69

SEQ ID NO: 47199 - DNA, 107 bp, Homo sapiens
ccactgtgtgcccttcacctggcttgtagtatatactcaacagttattggatgaatgaaatgaaatgaagtttgtatgaccattagctaggagggatttcatgaagg

SEQ ID NO: 47200 - DNA, 114 bp, Homo sapiens
ggtgacagagtgagatcctgtcttttttttttttttgagacagagtctcactctgtcacccaggctggagtgcagtggtgtgatctcagctcactgcaacctccacctcccggg

SEQ ID NO: 47201 - DNA, 58 bp, Homo sapiens; identical to SEQ ID NO: 605

SEQ ID NO: 47202 - DNA, 104 bp, Homo sapiens
tctaattatcagttgctggctggcacaaggacttatatcttgagagcattgttgtcttctaatatctcaaggataatgtgtatgaacttaattgaaatattaga

SEQ ID NO: 47203 - DNA, 96 bp, Homo sapiens
gcattgacacagattcaagggctatgttcaggctcagtgggacagaatgtcacaattgctcagtgagtctgtcacaggcacagaaaggggcaatgc

SEQ ID NO: 47204 - DNA, 58 bp, Homo sapiens
tatatatacatgtatacatgtatatatgcacatatatgcatgtatatatacatatata

SEQ ID NO: 47205 - DNA, 154 bp, Homo sapiens
atatatacgtatatatacatgtatatatacgtatatatgtatacatatatgcatgtatatatgtatatgtgtatatatatacacgtatatatatgtgtgtgtatatatatatatatatatatatatatatatatatatatacaggatagaatac

SEQ ID NO: 47206 - DNA, 83 bp, Homo sapiens
acattatgatgagttgtgtaattgtttcattatatgttacaatgtaataataatagaaataaagtgcacaataaatgtaatgt

SEQ ID NO: 47207 - DNA, 201 bp, Homo sapiens
ttatatgtatttatgtatatatgtgtatatttatgtatatatatgtgtgtgtatatatataaatataaaaacttagttttttatatatatacatatatgtatatatatatacatatatgtatatatatatatacatatatgtatatatatatatacatatatgtgtgtgtatatatatatatatatatatatatatatata

SEQ ID NO: 47208 - DNA, 66 bp, Homo sapiens
gggagtggaaggtgttgtctagctaagcccaccccacaggcagcagtcagtctcacagcctctctc

SEQ ID NO: 47209 - DNA, 111 bp, Homo sapiens
cattttcacccactggtaaaaatgaaatcatgtaccttcatcttatgatattgtatgtaaatgtttcatgtgggttagagcatgcatgtttcagagctaagggccagaatg

SEQ ID NO: 47210 - DNA, 102 bp, Homo sapiens
ttcttgcctttaagtttcccttcctaggcacaattatgagctatttatttactttaataaaagcaaacatttcaccctgtgctatctaggaaaggtaatgaa

SEQ ID NO: 47211 - DNA, 135 bp, Homo sapiens
gaatgagcaagatgttatacttattttagaaatatgcagctgactttcttattaactgggtaattttgttgttctgattcctaaataggtaggtacttctctctgtgtcttttggtttgggttccagttaagaaa

SEQ ID NO: 47212 - DNA, 117 bp, Homo sapiens
gtctagttacctttgagcttctctctatttattttaatatttatttatttatttatttatttatttatttatttatttatttatttttgagatggagtctcgctctgtcacccaggc

SEQ ID NO: 47213 - DNA, 95 bp, Homo sapiens; identical to SEQ ID NO: 68

SEQ ID NO: 47214 - DNA, 93 bp, Homo sapiens; identical to SEQ ID NO: 69

SEQ ID NO: 47215 - DNA, 112 bp, Homo sapiens
ctgaagacagcaggaatttctttgttgccaaaatgaaaatagatttttttaatctttaaaaatttttaagatcattttgttgttaaagtaatacatgcttgtaaagaattca

SEQ ID NO: 47216 - DNA, 110 bp, Homo sapiens
ggaaataacttgttttaccgtgtgccagatatgactggtgactaagacagggcaagagtccagtttttctagttcaaaaacaattttgtacaggtcagaggagtctttct

SEQ ID NO: 47217 - DNA, 58 bp, Homo sapiens; identical to SEQ ID NO: 1391

SEQ ID NO: 47218 - DNA, 56 bp, Homo sapiens; identical to SEQ ID NO: 1392

SEQ ID NO: 47219 - DNA, 86 bp, Homo sapiens
caggcagcatggatttaagaagagggtcaggcagcagagtcaagtggtctggaagtcagaggttcttggttttaatcttttccctg

SEQ ID NO: 47220 - DNA, 70 bp, Homo sapiens
agagagccccagacgtttttggaatgaaatgtagactgcactcattttaaatgtgtggagcctgctctct

SEQ ID NO: 47221 - DNA, 91 bp, Homo sapiens
atatacttgtatgtatgtgtatatatatgtatgtgtgtatatatatgtgtgtgtataaatatgtatgtgtgtatatatgtgtgtgtgtata

SEQ ID NO: 47222 - DNA, 98 bp, Homo sapiens
gtttcatttttattgatatatcttcattttgtacatattttataacttttttaataaaaatgtatattgaaaatatattcagttcaataaaaatgtac

SEQ ID NO: 47223 - DNA, 78 bp, Homo sapiens
gagggaaaatgcacatgaaagagatgtttcattgtttatttacttgtaattccctttttaaaggtgtttttatccctc

SEQ ID NO: 47224 - DNA, 81 bp, Homo sapiens
gcattagattctcaaaaggtgcatgcaacccttgcaagtgcagttcactatagggtttacattcctatgagaatctaatgc

SEQ ID NO: 47225 - DNA, 56 bp, Homo sapiens
gagacagagtctcgctctgtcactcaggctggagtgcagtggtgtgatctcagctc

SEQ ID NO: 47226 - DNA, 92 bp, Homo sapiens
atatatatatgtgtgtatatatatatgtgtgtgtgtatatatatgtgtgtatatatatatgtgtgtatatatatgtgtgtatatatatgtgt

SEQ ID NO: 47227 - DNA, 93 bp, Homo sapiens
ataagcagatgataccgtttgaattgtcaaaaaaatacctcaggaaataaaaataatttttttattttttaaatggatgttaatattgcttgt

SEQ ID NO: 47228 - DNA, 61 bp, Homo sapiens
gtgtttcacagatgagtgtatgcattctggagagatcatattagattcatttctgaagcac

SEQ ID NO: 47229 - DNA, 102 bp, Homo sapiens
agcttggtctatgttggtgtatagaagaactactgctttgtatacatttattttgtatacggaatctttggtgaattcttatatcagttctaaataggagct

SEQ ID NO: 47230 - DNA, 75 bp, Homo sapiens
ctgacttggaaggctggatatgtggatttttttttttttttttttttgagagagtcccactcttgcccaggccag

SEQ ID NO: 47231 - DNA, 71 bp, Homo sapiens
tggggacacagcaggatttgttttttttttgttttttttttttttgagactgagtcttgctctgtcaccca

SEQ ID NO: 47232 - DNA, 131 bp, Homo sapiens
ataatattccatcctgtgtgtgtgtatatatatatatgtatacatacatatatatatgatggaatattatatatatgtgtgtatatatatgatggaatattatatatatgtatatatatgatggaatatta

SEQ ID NO: 47233 - DNA, 112 bp, Homo sapiens
gtgtgtgtgtgtgtgtgtgtgtgtatgtgtgtgtatatatatatgtatatatgtgtatatatgtgtgtatatatgtgtatatatacgtatatatacgtatatacgtatatat

SEQ ID NO: 47234 - DNA, 71 bp, Homo sapiens
tatatatatatatatatatacacatatatatatattccatagtttatatggtgtatatatatatatatgtg

SEQ ID NO: 47235 - DNA, 118 bp, Homo sapiens
gaaataacccattaatttgataatgcattgttacccgttgttcatgatgtcaatatataaatatatctctttaaaaagtgacatacaaagtgacacgttttcatttttagattgtttc

SEQ ID NO: 47236 - DNA, 95 bp, Homo sapiens; identical to SEQ ID NO: 68

SEQ ID NO: 47237 - DNA, 93 bp, Homo sapiens; identical to SEQ ID NO: 69

SEQ ID NO: 47238 - DNA, 115 bp, Homo sapiens
ctgttatagctaagtaagagctttgttattaaatagattgtgttagaagaacttcttgtttatttatttattttattttttttgttttgagatgaagccttactctgtcacccag

SEQ ID NO: 47239 - DNA, 65 bp, Homo sapiens
tgtgtatatatatatatgacagatatatacactattatatatataaatatgtatatgtatacaca

SEQ ID NO: 47240 - DNA, 110 bp, Homo sapiens
atatatatatatacacagtatatataaacacacactctgtgcatatatatggaatgtatatatatatgtcatatatgtgtatatatatacagtatggatatcagagagcg

SEQ ID NO: 47241 - DNA, 86 bp, Homo sapiens
atagatacattatgtgtatacatatgtatgtgtactatatatgtatatatggtatatatgcaattctatataaaatatatgtctat

SEQ ID NO: 47242 - DNA, 91 bp, Homo sapiens
aaaagaaatgcatatgtatatatatgtacatatatacacatacattttataaacatttgtatatataaagatatatatgcacatttttttt

SEQ ID NO: 47243 - DNA, 82 bp, Homo sapiens
gtatttccataggtgaccattgtcatgaatttgttctttattattctcatgaatattttatacttttttacctatggtgtgc

SEQ ID NO: 47244 - DNA, 65 bp, Homo sapiens
ggcatataatgaggaggaaagtttgactaggagtaaattctggggctgtgtctttgcctcttgcc

SEQ ID NO: 47245 - DNA, 120 bp, Homo sapiens
ctgactagtatttcattgtgtatctatctatctatctagatatatatattctgtatatattaatatatagctatgtagatagatatatgattttatagatacatatatagatatatgcag

SEQ ID NO: 47246 - DNA, 108 bp, Homo sapiens
acttcatatctttttatatatagatatatatatgcatatatagatatagatatatatatatgcatatatagatatatagatatatatagagagagtaatggctgaagt

SEQ ID NO: 47247 - DNA, 106 bp, Homo sapiens
tctgttgtatctccctgatgtgtaaccagatttgggctgggactgcagcctctctcactctcattattctcccggtctttctcacttgagggtgatttcttaaaga

SEQ ID NO: 47248 - DNA, 86 bp, Homo sapiens
tgtgtaatactccataatatggatgtactacaaatttaaataattatttaaataatttataatatatccatattatgaaatacata

SEQ ID NO: 47249 - DNA, 95 bp, Homo sapiens
agagtagctgggactacaggcatactccaccactcccaactaatttttctatttttggtagagatggggtttcaccatgttggccaggctagtct

SEQ ID NO: 47250 - DNA, 84 bp, Homo sapiens
atatatacatatgcatatatatacatatataatatatacacatgcgtatatatacatatataatatatacacatatgtgtatat

SEQ ID NO: 47251 - DNA, 95 bp, Homo sapiens
agtgctgggattacacacgtaagccactgagctagtctaaatttttaaatatcgttattaaatagattatccttatggtgtttttccaaatcact

SEQ ID NO: 47252 - DNA, 115 bp, Homo sapiens
gtgagtttatgtgtaaaaagctgtaatacatgtgtatcttgcttttttttaaaattatactttaagttctggggtacatgtgcagaatgtgcaggtttgttacataggtatacac

SEQ ID NO: 47253 - DNA, 92 bp, Homo sapiens
tgaatgtattatactttataatacataaatattgaatgtattatactttataatacatacatattgaatgtattataatttataatacttta

SEQ ID NO: 47254 - DNA, 111 bp, Homo sapiens
tggatatatactcagtagtggagttgctggatcatgtgccaattctatttttagttttgtaaggaagcaccataatgttttccataatggccacactaatttacgtttcca

SEQ ID NO: 47255 - DNA, 115 bp, Homo sapiens
gaatcgggaatgagtagctctcttctgtcaacctgataccagcatggaatgagtagacacagtccacacaagtcagcctttaaagggagacggatggagatgcatctggagagtc

SEQ ID NO: 47256 - DNA, 105 bp, Homo sapiens
atgtgcacgttgtgcacatgtaccctagaacttaacaaataataataatcatttatttttaacatttgtgggtacagaataagtgtatatatttatgaggcacat

SEQ ID NO: 47257 - DNA, 200 bp, Homo sapiens
atatatatatgtataaagagaatatatacatgtgtgtgtatatatatgtgtgtgtatatatatatgtgtgtatatatgtgtgtgtatatatatacatatatgtgtgtgtgtgtatatataaacatatatacacatatatgtgtgtgtatatatatatgtatatatatgtgtgtgtatatatatatatacacatatatata

SEQ ID NO: 47258 - DNA, 83 bp, Homo sapiens
taagttttagggtacacgtgcacaacgtgcaggtttatatatgtatatatgtgccatgttggtgtgctgcacccattaacttg

SEQ ID NO: 47259 - DNA, 109 bp, Homo sapiens
ttagaattgtcttggctattcgggctctttttttggttccatatgaattttaaagtatttttttctaattctgtgaagaatgtccgtggtagtttgggaataatattga

SEQ ID NO: 47260 - DNA, 114 bp, Homo sapiens
cacattctttattacagatatggctcttctagacacatagctagcatgcaatcagtatattgcatttgaaatgtatggtttactaatatccatctgtgacaataagtcagtgtg

SEQ ID NO: 47261 - DNA, 58 bp, Homo sapiens; identical to SEQ ID NO: 16930

SEQ ID NO: 47262 - DNA, 66 bp, Homo sapiens; identical to SEQ ID NO: 35156

SEQ ID NO: 47263 - DNA, 58 bp, Homo sapiens; identical to SEQ ID NO: 35157

SEQ ID NO: 47264 - DNA, 111 bp, Homo sapiens
cctatcaacaaatcttatagggctagtgggaatgcagctttcagagctgactgcctcaaactctgtgtctcaatttcccctctgtctttatttctctgagatttgattagg

SEQ ID NO: 47265 - DNA, 80 bp, Homo sapiens
tgcacaaactttttttttttttttttgagaaggagtcttgctctgttgctcaagctggaggactggaggacagtggtgcg

SEQ ID NO: 47266 - DNA, 116 bp, Homo sapiens
ccttaagggagggaggtgaaagggggctgccagtggagaaactaaaatggagtctgtccggctctctctctgctaggagagagtcactcaggttaaaacaaagtagggtatcacac

SEQ ID NO: 47267 - DNA, 88 bp, Homo sapiens
tcatgacaatgccacatgtatatatacatatgtctgaacatatatatgtttgtatgtgtgtatatatatatatatgacattgtcttga

SEQ ID NO: 47268 - DNA, 89 bp, Homo sapiens
gcaacggaacaccttggcttgaacttgatcctgtctttttcttttttcttttttttttttttttttgagttggagtctggctctgtcgc

SEQ ID NO: 47269 - DNA, 58 bp, Homo sapiens
tgagactgagtctcattctgtcactcacgctggagtgtagtggcacaatctcagctca

SEQ ID NO: 47270 - DNA, 92 bp, Homo sapiens
agtgagttctacaggggatattacgctgtataagacacagtagagacacagctgtcatctcttgcttctctcagtgtccctgttcctctcct

SEQ ID NO: 47271 - DNA, 75 bp, Homo sapiens
attgtagccattttatagttgagtaaactgagatcttaagtctcctagtctactgaatttcatatggtgtataat

SEQ ID NO: 47272 - DNA, 120 bp, Homo sapiens
cactcaaaaaatgtttgttggaatgtagggtcattagtgtgaaaggagttgcagatgccatgttttgtttgttttttttttgagatggagtctcgctctgtcgcaggctgaagtgcagtg

SEQ ID NO: 47273 - DNA, 58 bp, Homo sapiens
gtgtatgtgttgtgtatatgtatattcatatttatatatatatacacaacacatacac

SEQ ID NO: 47274 - DNA, 58 bp, Homo sapiens
tgagacagggtttcactctgtcactcaggctggagtgcagtggtgtgatctcggctca

SEQ ID NO: 47275 - DNA, 115 bp, Homo sapiens
ctggtcttatatttcccatgcacataaaagagcctgaagtgcagcttagaaattatatataatttttaattttgattttcaagttatattttagaatgtggttgatgtcagtcag

SEQ ID NO: 47276 - DNA, 58 bp, Homo sapiens
tgagacagactctcgctctgtcacccaggctggagtgcagtggcgtgatcttggctca

SEQ ID NO: 47277 - DNA, 117 bp, Homo sapiens
ctccactgactcattttgctcctctgcggtttgttgttgttgttgttgttttatgttttttgttttttgagacaaaattttgctcttgttgcccaggctggagtgcaatggagcagt

SEQ ID NO: 47278 - DNA, 58 bp, Homo sapiens
tgagacagagtctcactctgtctcccaggctggggtgcagtggtgcaatctctgctca

SEQ ID NO: 47279 - DNA, 95 bp, Homo sapiens; identical to SEQ ID NO: 68

SEQ ID NO: 47280 - DNA, 93 bp, Homo sapiens; identical to SEQ ID NO: 69

SEQ ID NO: 47281 - DNA, 76 bp, Homo sapiens
tcattattattaggtaggcttaaataggaaattttatttatttccctgtgcctggctgcctgaatctaatagttga

SEQ ID NO: 47282 - DNA, 206 bp, Homo sapiens
tcagtatgagatttgggtgggatacagccaaaccatattggtatctgtatagacctctcactctctctgatatatagtgtgtgtgcatatatataaatatacatatatattgtgtgtatatatacatatatagtgtgtgtatatgtatgtgtatatatacatgtgtgtatatgtatgtgtatatatacatactatatatgtatatt

SEQ ID NO: 47283 - DNA, 116 bp, Homo sapiens
gggtcaaacatataaatgaggggagcggagcacattactctgagacactccgtctgtgacgtcaatcactgctgggtttggacagaggctctctcttgtgcagcagtcagggaccc

SEQ ID NO: 47284 - DNA, 118 bp, Homo sapiens
tcagatctttggtgacacctggctaatccccaacagtgctaaccttttctttttctttctttttttagacagggtcttgttctgtcactcaggctggagtacagtggcacaattatgg

SEQ ID NO: 47285 - DNA, 109 bp, Homo sapiens
taataaagggtcattgtagggaatttggaaaacacagaatgacagtccctctaattttgtatatttttgcattctcctgttttaccaattctttacatgtgaagtattg

SEQ ID NO: 47286 - DNA, 68 bp, Homo sapiens
agattcagggggtacatgtacgggtaaattattctaatatgagtgtgtgtctgtctctccctgggtct

SEQ ID NO: 47287 - DNA, 117 bp, Homo sapiens
tgacgacatcccagctggactgtggaagtgaagctgtccagccaagggttttattatttttatttaaaagtgtgaatcatcagacaggcaatgctctccagccaggtgctgtattca

SEQ ID NO: 47288 - DNA, 95 bp, Homo sapiens
aaaaatcttagtggcatttttcttattcacaacccagtccaatgaggggctggtgtgtgttggagagagaagagtgtttgcaccaagtaattttt

SEQ ID NO: 47289 - DNA, 110 bp, Homo sapiens
ccctgctcagccatttactgatataattatggaaaacttgctgaaactctcaaagtctctgtccttgtcctctgtaaaatccagaaaatggtaacttccacctcacaggg

SEQ ID NO: 47290 - DNA, 102 bp, Homo sapiens
catatattatgtatgtatacttacatatgtgtatatatatttctgggtgaatatacatattcatacatacacaaacatgtataaaatatatacatacctatg

SEQ ID NO: 47291 - DNA, 113 bp, Homo sapiens
ggtttcaatttctctgcagtctcaccaacatttgctgtcttttatttttttgataatggctattacagcaaatgtgatatctcactggttttgatttgcatttccctgattct

SEQ ID NO: 47292 - DNA, 122 bp, Homo sapiens
tggagtggagagttattccagtggaaggggcactatttgtagagggatgacagaatattgagtggacttctgttttatctattctccagcttagcttgtacttctccttactcacaaactct

SEQ ID NO: 47293 - DNA, 137 bp, Homo sapiens
tataattatatacctgtgagatatctcacagatacatatatatatatttatgtgtctatatgtatatctctctctcacacaggtatataattatacatagagtgatacatacacacatatctcacgtctatctatct

SEQ ID NO: 47294 - DNA, 91 bp, Homo sapiens
taattatatacctgtgtgagagagagatatacatatagacacataaatatatatatatgtatctgtgagatatctcacaggtatataatta

SEQ ID NO: 47295 - DNA, 95 bp, Homo sapiens; identical to SEQ ID NO: 68

SEQ ID NO: 47296 - DNA, 93 bp, Homo sapiens; identical to SEQ ID NO: 69

SEQ ID NO: 47297 - DNA, 88 bp, Homo sapiens
gggtgaatgtcttttgtgctaacgcttgagtatttgatgtacagcagtgggatcaatttattctagagagcaaacaaaaaaccaaccc

SEQ ID NO: 47298 - DNA, 89 bp, Homo sapiens
caggtgaccttttcaatatatgactctacgaataagatcaagacatgatacacactctgtgggtcagaatgtccgataagggtcatttg

SEQ ID NO: 47299 - DNA, 99 bp, Homo sapiens
gatgttaatttgcatttccttgatgtctaatgaatttcagcacttaaaaaatgtgctgctaattatttttatatcttctgtgaagtgtttgttcaagtt

SEQ ID NO: 47300 - DNA, 110 bp, Homo sapiens
acttctacaatggaccaggtggttcttttgaaggagattatcaaaatgaatctcagaggctgttgttttgaagttcaaccagctgaaaatcttgttctggaagctgcttg

SEQ ID NO: 47301 - DNA, 89 bp, Homo sapiens
ccccaaatgacagagttttcattttctttattttaattttatattgttgtatttttttgagacggagtctcactctgtcaccaggctgg

SEQ ID NO: 47302 - DNA, 107 bp, Homo sapiens
ccattaatcacactttgataaaaagtagtttatcattagaagtatctataatttttagttagaagtgttttcctctgtgatagctaggttcagagttttgatgatgg

SEQ ID NO: 47303 - DNA, 93 bp, Homo sapiens
ggtgtgagggacgttacaggaagatatgtatatgtttaaaaaataaaccaatctctgctttatttttttaaacattaatattttcctggcact

SEQ ID NO: 47304 - DNA, 108 bp, Homo sapiens
tgtattgcaatgttaatattttctctcagttttcgggattgttgtgtgcatcctctggaatgttaaaactaattgtgttgactgttgactgatatggtgaggtagaca

SEQ ID NO: 47305 - DNA, 92 bp, Homo sapiens
agaacaggaacaacaagaagaggagaaagttagaattgcctgtctctgggcagaggaagagtacagtttttgctcttgatgcagcctgttgt

SEQ ID NO: 47306 - DNA, 86 bp, Homo sapiens
gagcaaagaaagacttagagtagagacggagcagtgtccaccaagtgccttctccacactcatcctttgtgtcttctgaggtgctt

SEQ ID NO: 47307 - DNA, 63 bp, Homo sapiens
ttgctgaagtctgcagatttcataggccaaggtggaggcctagttgaaaagggggctcaggga

SEQ ID NO: 47308 - DNA, 73 bp, Homo sapiens
ctctttctcaggggaaatgtgggatagaagtgattttttctttttcttttttttttttttttttgagatggag

SEQ ID NO: 47309 - DNA, 171 bp, Homo sapiens
cagaagtggaacttagagaacaaaaagcctgaaagaagagaaaatagaaagcagtctgcttaaatttctttcttttttttttttttgagaaggagtctcactctgtcacccaggccggagtgcagtcgtgcgatcttggctcactgcaagctccgcctcccgggttcacag

SEQ ID NO: 47310 - DNA, 76 bp, Homo sapiens
tgagtctcactctgtgtcccaggctgcagtgcagtggctcactgcagcctcgacctcctgggctcaggtgatcctc

SEQ ID NO: 47311 - DNA, 119 bp, Homo sapiens
caccttagcctcctgagtagctgggactacggtcatatgtcatcatgcctggttgttttgttatttttgttttgttttgttttttgtgatggagtctcgctgtctcccaggctggagtg

SEQ ID NO: 47312 - DNA, 71 bp, Homo sapiens
aaaggcttggttgcagagtaggactcaaggagaacgtctctctggctctttctcagactgcaaggcacttt

SEQ ID NO: 47313 - DNA, 80 bp, Homo sapiens
cctgctgattggagagctgagtcacctgttttattttttattttatttgagacagagtctcactctgtcacccaggctgg

SEQ ID NO: 47314 - DNA, 58 bp, Homo sapiens; identical to SEQ ID NO: 1305

SEQ ID NO: 47315 - DNA, 81 bp, Homo sapiens
acagaggtttttgttcagtgtggtttttatttttttaaagaacaaataaattgagacttttgttttgggcaaaaatcctgt

SEQ ID NO: 47316 - DNA, 113 bp, Homo sapiens
tcaggaagagctgtcagaaacgccattcttctcctagacagggactcagggcaggagaccagactggagtcagtgaggtcagtgtgaggagggcgaaggtgagatgagcctgg

SEQ ID NO: 47317 - DNA, 111 bp, Homo sapiens
gtcaggctaatatagtttattaaaatatgtacttatatatatgcaatatggtatctgatatctatttttatatatgtatatgcccagttgataaaaatatatctatctgac

SEQ ID NO: 47318 - DNA, 87 bp, Homo sapiens
tgtgtatgtatgtttttgtgcatgtctctgtgcctgtgtgtgagcacacacataacggatacgtgcatatgaggtacatgttccaca

SEQ ID NO: 47319 - DNA, 79 bp, Homo sapiens
tggggcacagcctttaggcgcagcagtaggtgaccctttgtagggcaagggtctctctctgagtgtgggttctgtccta

SEQ ID NO: 47320 - DNA, 100 bp, Homo sapiens
cttctttttggttatcattgttagattttgtatcgggtttatgtcagtttttgttgttgttattttgagacggaatctcgctttgtcacccaggctggag

SEQ ID NO: 47321 - DNA, 92 bp, Homo sapiens
cgtgtgtgcgcctgtgtgtgcgtgtgtgcgtgcgtgtgcgtgcatgtctgtgtgcgtgtgtgcatgcatgcgtgcgtgtgagtgtgtgtatg

SEQ ID NO: 47322 - DNA, 112 bp, Homo sapiens
gatgtattaatctttacaaaagcaatgagacagggacacatgagcattcacactcacacacacactaatcacattgccattttgtctcactttgcgggtgtgtggctacatt

SEQ ID NO: 47323 - DNA, 93 bp, Homo sapiens
cttgtttttgctcaagaacgctttatcagtgacgtttgttagaattttgttttttgttttttttttttaaattgtttttgggctagaaatgag

SEQ ID NO: 47324 - DNA, 81 bp, Homo sapiens
ttgttagtttgagtcagagtctctctctgtcactcagcctggagcgctggagtgcaatggtgtgatcttggctctctgcaa

SEQ ID NO: 47325 - DNA, 96 bp, Homo sapiens
gctttcccccaccccatgcacttaataagagctgacagcctgcattgttctgccacgacaaggtacgctgcagcccagtgatagggcgagagcagc

SEQ ID NO: 47326 - DNA, 57 bp, Homo sapiens
ggtggagtctgtctctgtcacccaggctgcagtgcagtggcgagatctcggctcacc

SEQ ID NO: 47327 - DNA, 87 bp, Homo sapiens
atgtggtcttaaacatcttcctgttcagtctgacatgtctgaatccctttcagactcagtgtctttgatgtctgtgcttttctacat

SEQ ID NO: 47328 - DNA, 93 bp, Homo sapiens
acagagggagaccctgtctccaaaaaaaaaaaaagttttgtttttttctgatctaagtatttttttttttttcgagatggagtctcactctgt

SEQ ID NO: 47329 - DNA, 71 bp, Homo sapiens
gctgtcccccagcccaggcaccctgtttcccagacccctcttctctgagggatagggctttgggctgcagc

SEQ ID NO: 47330 - DNA, 119 bp, Homo sapiens
cttttgctttcatgtagtgtggctcttcccttcctcagagtgatcccttctgttttttttttttcttttttagacagagtctctcgctctgttgctcaggcttgagtgcagtggcgtga

SEQ ID NO: 47331 - DNA, 70 bp, Homo sapiens
caagagagagagcaagagagagagagaaagtgggaggtcccagactcttttttttttttttttttttttg

SEQ ID NO: 47332 - DNA, 63 bp, Homo sapiens
ctttggctgcctgtgcatgcatgtgtgtgtgtacacacacactcacactcaggcagaccaaag

SEQ ID NO: 47333 - DNA, 113 bp, Homo sapiens
gatgggatgattgacttctgcttatggaaaacaaatattagaattggacataatgcacatagaaagtattagatatggagaggtttttcaaagtgaaggggacacatcacatt

SEQ ID NO: 47334 - DNA, 73 bp, Homo sapiens
ctgggtttaagatgactccagctcaggcaatatgggccttgcctgggtcagtgtctctcttcctttgacccag

SEQ ID NO: 47335 - DNA, 115 bp, Homo sapiens
gtcttctcagtaagattttaagctcctcgagggtagagcctattttttttatttttgtctatgactctgtaggtctctgcaaggaacaggtattcaataaatgtttttgaaagat

SEQ ID NO: 47336 - DNA, 87 bp, Homo sapiens
caggcagcagggagcttgaaggtgggagagggggactatggggacccatgtggactccctttctgtctgtctgtccctgtgtttctg

SEQ ID NO: 47337 - DNA, 113 bp, Homo sapiens
cgccgacggacagacagacagtgcagtcacccataaagtagaaagcactactaacagcactggagggtgtagtgtttcctactttatggatgagtgtactgtgggcttcggag

SEQ ID NO: 47338 - DNA, 75 bp, Homo sapiens
tacaccctccagtgctgttagtagtgctttctactttatgggtgactgcactgtctgtctgtccgtcggcgtgta

SEQ ID NO: 47339 - DNA, 120 bp, Homo sapiens
aggtccccctaccctgctgtctgaagctgctccttcccttccctcacgctcactctgtaacacaagagctcagtttgcaggaagaagagtgcataggccggaagcagcacacaggggctt

SEQ ID NO: 47340 - DNA, 104 bp, Homo sapiens
tcagcagtgctaacttgtctgtgttactcctatgcaggtattagattataggttttttttttttttttatgctaggaatatatggataaaattcactgaaatga

SEQ ID NO: 47341 - DNA, 75 bp, Homo sapiens
gcccaccaagaacaattactgcagtcgctgtagcttgcagctcggctgtctcagtctctggcaaaggtgtttggc

SEQ ID NO: 47342 - DNA, 58 bp, Homo sapiens; identical to SEQ ID NO: 2626

SEQ ID NO: 47343 - DNA, 107 bp, Homo sapiens
agaagatagaatgtatgggtgcaggggtatgcttaacttctcaatttgtatatgtatatataataggattacgggaaattttcaccatctgtattcttctatgtttt

SEQ ID NO: 47344 - DNA, 65 bp, Homo sapiens
ggggcagggcatctcaggaggctttttttttttttttttttgagacagagtctcgctctgtcacc

SEQ ID NO: 47345 - DNA, 58 bp, Homo sapiens; identical to SEQ ID NO: 18119

SEQ ID NO: 47346 - DNA, 114 bp, Homo sapiens
ggatgaccctgggctacacttgagtttagaaaatgatcttttcattaattaatttttagtttttaatttttaattattatttttttgagacagagtctggctctgttgcccagg

SEQ ID NO: 47347 - DNA, 76 bp, Homo sapiens
ggaggctgaggtaggaggatcacttgagcccaggagttcgagatcagcctgggcaacatagtgagacctcatctct

SEQ ID NO: 47348 - DNA, 58 bp, Homo sapiens; identical to SEQ ID NO: 6327

SEQ ID NO: 47349 - DNA, 80 bp, Homo sapiens
tagggaagccgacgtaggaggatcacttgaggtcagaagtttgagaccagtctggccaacatgatgaaactctgtctcta

SEQ ID NO: 47350 - DNA, 117 bp, Homo sapiens
cagcctaggcaacatagtgagacctcatctctacaaaaaacttatttatttatttattttggagctagagtctcactgtgtctcccaggctggagtgcaacagtgtgatcttggctc

SEQ ID NO: 47351 - DNA, 133 bp, Homo sapiens
acgtatagatgtatatacatatgtatatatgtgtataagtatagatgtatatacatatgtatatatgtgtatacatatagatgtatatatgtatatacgtgtatgtatatatgtgtatacgtatagatgtata

SEQ ID NO: 47352 - DNA, 123 bp, Homo sapiens
tatatatgtatatgtatgtgtatatatatgtgtgcgtgtgtgtatatatgtgtgtgtatatatgtgtatatatatctttatatatatgtctgtgtgtgtgtatatatatgcatatatatatat

SEQ ID NO: 47353 - DNA, 68 bp, Homo sapiens
ttgaaacggagtctcgctcgctctgtctccaggctggagtgaagtggcgcgatctcgactcactgcaa

SEQ ID NO: 47354 - DNA, 109 bp, Homo sapiens
actgggaatgatttatgaagaaggtattatagtttagaagtatgtttatgctttcatatctttatatattttaaacttgatttaattggccttgtgttggaagaccagt

SEQ ID NO: 47355 - DNA, 62 bp, Homo sapiens
tttgagacagactctcgctctgtggcccaggctggagtgcagtggcgtgaccttggctcaag

SEQ ID NO: 47356 - DNA, 99 bp, Homo sapiens
ggtgcaatagtgcaagcctgtagtcccagctactaagggaggctgaggtaggaggatcacttgagcccaggagttaggagttggagtctaggctgggca

SEQ ID NO: 47357 - DNA, 58 bp, Homo sapiens; identical to SEQ ID NO: 10998

SEQ ID NO: 47358 - DNA, 100 bp, Homo sapiens
gattcacaggcatacagatgtgcatgtgtatatgtatatgtatatgtagatacatatgtcatatgtatatgtatgtgcatatgtgtgcttctatggaatt

SEQ ID NO: 47359 - DNA, 84 bp, Homo sapiens
ccactaccgcaatcaagatacaaagctgtggccgggcacggtggctcatgcctgtaatcccagcactgtgggaggccgaggtgg

SEQ ID NO: 47360 - DNA, 58 bp, Homo sapiens
tgagatggagtctcactctgtcacccaggctggagtgcagtggtgcagtcttgactca

SEQ ID NO: 47361 - DNA, 93 bp, Homo sapiens
gcatacaaaaggtactaaataaaggttaactgaattccttccttcaaagtagggttgaagttgtctagtcattttgttgagcctaaggtatgc

SEQ ID NO: 47362 - DNA, 96 bp, Homo sapiens
gggagttgcaattgcccgctttcaatgatttggggagccttactcaagaagccaggagtgtcagatgagacagagggcccaggacctgcaaacccc

SEQ ID NO: 47363 - DNA, 97 bp, Homo sapiens
caataagtttggggtttttgttttgttttgttttgttttgacagggtctcactctgtcacccaatctagagtgcagtggtgtgacctcggcttactg

SEQ ID NO: 47364 - DNA, 115 bp, Homo sapiens
gcatgttcctaggaaatacagaagcagagaagagatactgaacgaccaaagacaagaaaatgattttttttttcttttttgaggcagtctcactctgtcacccaggctggagtgc

SEQ ID NO: 47365 - DNA, 77 bp, Homo sapiens
gctgttttttttgggaacagggtctcactctgtcactcaggccggagtgcagagatgtgatatcggctcactgcagc

SEQ ID NO: 47366 - DNA, 105 bp, Homo sapiens
gtcagtcactcactcagtccctgagtgcctattaagttttattattattatttttttgaaacggagcctcgcactgtcgcccaggcttgagtgcagtggcgtgat

SEQ ID NO: 47367 - DNA, 72 bp, Homo sapiens
ctgggcatagtggtacgcatctgtgctcccagctactcaggaggctgaggtaggaggatcatttgagcccag

SEQ ID NO: 47368 - DNA, 69 bp, Homo sapiens
gtatgtatatatattttatgtcaaagacatagtagtatatgtcaaagacgtaatagtgtatatgtatat

SEQ ID NO: 47369 - DNA, 74 bp, Homo sapiens
ttgctttgagcaggaaatggagtaggaggtacatactatattcctattcacactttttgtttttttagagacag

SEQ ID NO: 47370 - DNA, 86 bp, Homo sapiens
gctcagtttttttttctttaagttcagtttttaaattcagtaataaactgagggtctaaatttgcaactagatagaggaatttagc

SEQ ID NO: 47371 - DNA, 58 bp, Homo sapiens
tgagacagagtctccctctgtcacccaggctggagtgcagtggcgagatcttggctca

SEQ ID NO: 47372 - DNA, 112 bp, Homo sapiens
tctccatggctgtaccaccttgtcgggtagcttatcagactgatgttgactgttgaatctcatggcaacaccagtcgatgggctgtctgacattttggtatctttcatctga

SEQ ID NO: 47373 - DNA, 99 bp, Homo sapiens
caggaagttgaaagagcattattattcttgtgtgtgtgtgagacagagtctcactctgtcacccaggctggagtgcagtggtgtaatctcagctcactg

SEQ ID NO: 47374 - DNA, 58 bp, Homo sapiens
tgagatggagtctcactctgtcacttaggctggagtgcagtggcgagatctcggctca

SEQ ID NO: 47375 - DNA, 98 bp, Homo sapiens
tctgatttcatcttaaagtctgggggaagaggtatacacttaccacacactcaggtcagaggggttagtactctgcctccaggataattaaaatcaga

SEQ ID NO: 47376 - DNA, 84 bp, Homo sapiens
tgagaccgagtctcactcactctgttgcccaggctggagtgcagtggcacgatcttggctcactacaaactccacctcccgggt

SEQ ID NO: 47377 - DNA, 74 bp, Homo sapiens; identical to SEQ ID NO: 47369

SEQ ID NO: 47378 - DNA, 69 bp, Homo sapiens; identical to SEQ ID NO: 47368

SEQ ID NO: 47379 - DNA, 74 bp, Homo sapiens
gattatatatatttatgtcaaagacataatagtatgtatatatattttatgtcaaagacatagtagtatatgtc

SEQ ID NO: 47380 - DNA, 56 bp, Homo sapiens
gggacagatgaagaccttttttttttttttttgagacagggtctccctctgtcacc

SEQ ID NO: 47381 - DNA, 74 bp, Homo sapiens
ctgagctccgtgtctgactcagtctgatgcccgccaccccggcctaggtttggaggtcaggcagcccggggttt

SEQ ID NO: 47382 - DNA, 91 bp, Homo sapiens
gtgatcatctcagaatatgcctggcaaacagtaggagctcagaacttgatgttttttcctacagcaactgcatgtcttttggggatagcac

SEQ ID NO: 47383 - DNA, 74 bp, Homo sapiens; identical to SEQ ID NO: 47381

SEQ ID NO: 47384 - DNA, 72 bp, Homo sapiens
tcacctctgcctaatttctgactcacatactgactggtttcatgtactgtcgaagttgatggatggaggtga

SEQ ID NO: 47385 - DNA, 109 bp, Homo sapiens
cttgggtagttttttggttttgttttgttttgagatggagtctcactctgtcacctaggctggagtgcagtggcgtgatctcggctcactgcaacccccacctcccagg

SEQ ID NO: 47386 - DNA, 74 bp, Homo sapiens
ggtaaatgatggagctgtgattcatgctcaggtctgtctgactctgaagtctgactccttttcttttctttacc

SEQ ID NO: 47387 - DNA, 102 bp, Homo sapiens
gagttctcatggtgtcctcacatggtagatagagagcacagagaggaagcaagccctcttacatctctccttatgtgggcactaatcccatcatgggggctc

SEQ ID NO: 47388 - DNA, 98 bp, Homo sapiens
actgaaatgtttattttaaaagggtgaattttatgggatgtgaattatgtctcaatagaacttattttttaaaattctgatgacatagacatagtagt

SEQ ID NO: 47389 - DNA, 99 bp, Homo sapiens
tatatatatatatgtgtgtatatatatatgtgtatatatatgtatatatataatatatatatatatatataatatatatatatatatatatatatatat

SEQ ID NO: 47390 - DNA, 90 bp, Homo sapiens
tagctgccttttgactaaggtgttttttgtttttttttttcctctcctgagggaaagaaggatacttggaaacattttttaatatagttg

SEQ ID NO: 47391 - DNA, 74 bp, Homo sapiens
ttgttttgttttagacagggtctcactctgtcacccaggctggagtacagtggggccatgtcagttcactgcaa

SEQ ID NO: 47392 - DNA, 81 bp, Homo sapiens
tggaggagtaggaggcaaatagtccaagggacagataaaaaccttttttttttttttttgagacagggtctccctctgtca

SEQ ID NO: 47393 - DNA, 113 bp, Homo sapiens
ccttggccccccaaagtgctgggattacaggtgtgagccattgcgcccggtctttttttttttttagacagggtctggctctgtttctgtcacccaggttggagtgcagtggc

SEQ ID NO: 47394 - DNA, 124 bp, Homo sapiens
gtcatcctgaaaccccccatacgcccatccttctgctttcctgctaagccaggctgagtaatattctttttatttactgcataaggttctagaaggtgagctggaaaggggaggaagatgctgc

SEQ ID NO: 47395 - DNA, 84 bp, Homo sapiens
cattagctgggtgtggtgacatgtgcctgaagttccagctactagggaggctgaggtagaaggatcacctgtgcccaggaggtg

SEQ ID NO: 47396 - DNA, 65 bp, Homo sapiens
ggggccataggcaggtgaaagatggtttcattcagcagctctcttacactgtctgtctctgtctc

SEQ ID NO: 47397 - DNA, 79 bp, Homo sapiens
ccctgtgtctcattcactggctctgcatctcgtcttcagcctctcaaacatggtgccattgctgttgaagtcaataggg

SEQ ID NO: 47398 - DNA, 85 bp, Homo sapiens
ggttcatggaacatattttataaagagcatcccactagccggctgtgtggtagaaggctgtttactgatagtagcatcctaaacc

SEQ ID NO: 47399 - DNA, 73 bp, Homo sapiens
ttgagtcttactctgtcacccaggctggagtgcaacctctgcctcctgggttcaagtgattctcctgactcag

SEQ ID NO: 47400 - DNA, 70 bp, Homo sapiens
tgtcataggagcaaaagaaatgcctaaaacttggaaatatgattaggtttttttttttgtttttgagaca

SEQ ID NO: 47401 - DNA, 71 bp, Homo sapiens
aggactacattgctgatgtcatgtccttctccgtatatcacatgaggagagacagtgtgtcagtcagtcct

SEQ ID NO: 47402 - DNA, 68 bp, Homo sapiens
atatgtatatgtatatgtgtgtgtgtgtatatatatatatacacacacacacatatacatatacatat

SEQ ID NO: 47403 - DNA, 68 bp, Homo sapiens; identical to SEQ ID NO: 47402

SEQ ID NO: 47404 - DNA, 79 bp, Homo sapiens
gttctttatactataagcagttattgtattactttttcctcatatgagtgacattgactgtttatatatatatatgagc

SEQ ID NO: 47405 - DNA, 119 bp, Homo sapiens
gaaattctttgtccttttcttcagtgtccattggtcctaaagtctatatatatatgtgtttttcagtaaagcatattcatatctatgattagatcgagatcattttagaaacgagtttc

SEQ ID NO: 47406 - DNA, 117 bp, Homo sapiens
ccaagatcaaggcactgcactccagcctgggcgacagagcaagactccaacttttttttttttttgagatggagtctcactgtgtcaccaggctggagtgcagtgtctcaatcttgg

SEQ ID NO: 47407 - DNA, 66 bp, Homo sapiens
acagagggaactttattttattttattgatatatttatttatttttgagatggagtctctctctgt

SEQ ID NO: 47408 - DNA, 77 bp, Homo sapiens
ggcaacacagtgagaccttgtctcaatttttaatgatcaataaattttttttttttgagatggaatctcactctgtc

SEQ ID NO: 47409 - DNA, 103 bp, Homo sapiens
gcaagactctatctcaacattccccactgcctgcaaatgtgtatatatatatatatatatatataaaatgtgtcagtggaaatctgaagtataaaatctatgt

SEQ ID NO: 47410 - DNA, 101 bp, Homo sapiens
catagattttatacttcagatttccactgacacattttatatatatatatatatatatatacacatttgcaggcagtggggaatgttgagatagagtcttg

SEQ ID NO: 47411 - DNA, 114 bp, Homo sapiens
ataaaaacaaggggatatatatatatatatatgtatgtatgtatgtatgtgtgtgtatttgtatttatataaatatatgtgtgtgcatatatatatatatatatatattttttt

SEQ ID NO: 47412 - DNA, 59 bp, Homo sapiens
cagatggagtctcactctgtcacccaggctggagtgccatggcagatctgggctcgctg

SEQ ID NO: 47413 - DNA, 58 bp, Homo sapiens
tgagactgggtctcactctgtcacccaggctggagtgcagtggtgagatctgggctca

SEQ ID NO: 47414 - DNA, 58 bp, Homo sapiens; identical to SEQ ID NO: 12142

SEQ ID NO: 47415 - DNA, 95 bp, Homo sapiens; identical to SEQ ID NO: 68

SEQ ID NO: 47416 - DNA, 93 bp, Homo sapiens; identical to SEQ ID NO: 69

SEQ ID NO: 47417 - DNA, 118 bp, Homo sapiens
gcacatcagacttagcattggcaaccttgggggatgagttgtaaaactgataggaaagaatgattctttctttatataactctgtattctttgactgtgccctatttggtgctcattc

SEQ ID NO: 47418 - DNA, 96 bp, Homo sapiens
cccagttgctcagcaggctgaggtaggaggatcacttgagcccagcaatttgaggttacagtgggctgtgattacaccacagcactctagcctggg

SEQ ID NO: 47419 - DNA, 113 bp, Homo sapiens
gtatagtgaagaatcatgggtaaaaagacacaatagtgaatgactttcttaggatactttgtggtagaatgttgtaaattgttgaaacttggtaattggtagattccttatac

SEQ ID NO: 47420 - DNA, 103 bp, Homo sapiens
taaatatcttaccttttgtattctaagtagaagactagattagttgcagatgaacttttttgatatctagctgtttctctggggatattttagaaagaatttg

SEQ ID NO: 47421 - DNA, 115 bp, Homo sapiens
gtagagacactcagaaggtttagaaaactgtgtgtgtgtgtaatttatattaatacatctcacacacacacacagaagtttttgtattatttccagagcttgatatattctctgc

SEQ ID NO: 47422 - DNA, 80 bp, Homo sapiens
gaagcactcacttgagacactttcagcaggatattcagtcgtttataatggagagtcctttgtattctctgagctgtttc

SEQ ID NO: 47423 - DNA, 56 bp, Homo sapiens
gagatggagtctcgctctgtctcccaggttggagtgcagtggtgtgatctcagctc

SEQ ID NO: 47424 - DNA, 119 bp, Homo sapiens
agcagagtgttctgaaatatcagcgatctactactgggagaaccaaccaaaatatatatttgaatatactagagaagtggatttacctattatatcctgaaaagcacagagatctgact

SEQ ID NO: 47425 - DNA, 69 bp, Homo sapiens
ccccaaggcaaaggacagactgagagagttttgtcagatgagtagctgtctctctgtctctgccagggg

SEQ ID NO: 47426 - DNA, 105 bp, Homo sapiens
gttgctgatgggaattttttgaatgtttgactctgtgtctctgtggaccacaacaggaccacaggctgttacacagttagcatttaacttacattatgaagtgac

SEQ ID NO: 47427 - DNA, 115 bp, Homo sapiens
gtacctgcctctccacttgaagggttactgaaaggatcagatagaacaggaagtgtccatacgctcactctctctgtaaattctaaactgccgtatttggggaaataccaggctc

SEQ ID NO: 47428 - DNA, 110 bp, Homo sapiens
gtgtcctgtttccctgggaggggatgcctggtttgagaggggcctgctccaatgaagagagggtccctgtctgcctgaagtgcctcctttctcctttcctcttaggcccc

SEQ ID NO: 47429 - DNA, 128 bp, Homo sapiens
ggcagcatggctcagtgcccaagtccacagtttcttcgatgggggatagtgagagtgaagtgagtgtccagcttccccagcctcacaggttgttacccaagaggctcacttctgcctcaccccaccca

SEQ ID NO: 47430 - DNA, 94 bp, Homo sapiens
ctgcccaagccctgctgggactctggcttcacactctgcctctctgcctggtggaagagaacgcagggtggtgttaagtggggctgtggggcag

SEQ ID NO: 47431 - DNA, 65 bp, Homo sapiens
tggtgaagagtgagtaggtggaagctggagaagttgtctccacactcacacactctttctttcca

SEQ ID NO: 47432 - DNA, 58 bp, Homo sapiens; identical to SEQ ID NO: 9775

SEQ ID NO: 47433 - DNA, 113 bp, Homo sapiens
ctaatgcggtcagtgcagatcaaatgtttagattgataaatgcggcttactggtgtgagagactcactcattgacagagcccagaatccaaaggtgattagttgactaaagag

SEQ ID NO: 47434 - DNA, 58 bp, Homo sapiens
tgagacagggtctgtctctgtcacccaggctggagtgcagaggcacaatctcggctca

SEQ ID NO: 47435 - DNA, 85 bp, Homo sapiens
gtccaacttgaacagtttgggtgagatttatctgcaggagtggcaggcttatttcccctgacaatttttttatgtttcattggtc

SEQ ID NO: 47436 - DNA, 115 bp, Homo sapiens
tagaattgtcttggctatacgagctcttttttggttccatatgaaatttaaagtagttttttctaattctgtgaagaaactcaatggtagcttgatggggatagcattgaatcta

SEQ ID NO: 47437 - DNA, 103 bp, Homo sapiens
gctttgtttttgtttgtttgtttgggtttttttgggtttgttttttttttttttttgagatggagtctcgctctgtcgcccagtgcagtggtgcagtcttggc

SEQ ID NO: 47438 - DNA, 56 bp, Homo sapiens; identical to SEQ ID NO: 1392

SEQ ID NO: 47439 - DNA, 119 bp, Homo sapiens
caccaagtgtactaaatgcatcagaatataggtctcatttggctagtaaggaatatatttatatatatcctaactgcctttttgcacaaactatttcaggtagtgcactgaagactgtg

SEQ ID NO: 47440 - DNA, 95 bp, Homo sapiens
gtgcttggggtcattgagctttttggatctatggttttatagttttcatcaaattatgaacaatttgagccatttaaaaatattttcttaagtac

SEQ ID NO: 47441 - DNA, 58 bp, Homo sapiens
tgaggtggggtctcactctgtcgctcaggctagagtgcagtggtgcgatctcaactca

SEQ ID NO: 47442 - DNA, 89 bp, Homo sapiens
cttagtatgttgtgtaagctgtgttgaatttatatttgtaaactaaaatattgtttcatttttttccaacagttttaacacaggctaag

SEQ ID NO: 47443 - DNA, 91 bp, Homo sapiens
gtgggcgtgggaagggagatgtcagaaacactcttactcacttaaaagtatgtttgtgctccaaagtgatgatatcaaattttttaactac

SEQ ID NO: 47444 - DNA, 58 bp, Homo sapiens; identical to SEQ ID NO: 1409

SEQ ID NO: 47445 - DNA, 58 bp, Homo sapiens; identical to SEQ ID NO: 616

SEQ ID NO: 47446 - DNA, 109 bp, Homo sapiens
gcacagatccctggctttaaagcatgggtgtatttttattttatttattattattatttttgagatttgttctgtcaccctggctggagtacagtggcacaatcatggc

SEQ ID NO: 47447 - DNA, 228 bp, Homo sapiens
atatatatatatatatatatatatatatatatatatatatgtgtatagtgtgtatgtgtgtgtgtgtgtatatatatacacacacacatacacactatacacatatatatagtgtgtgtgtatatatatagtgtgtatgtatatatatagatatatatagtgtgtgtgtatatatatatagtgtgtgtatatctatattatatatatatataaaattagactgatgtg

SEQ ID NO: 47448 - DNA, 82 bp, Homo sapiens
ttgaggaaccctctgcccttcatcatcagatatatatatataactgtatattatttcacagtgaaaataaggagttcctcaa

SEQ ID NO: 47449 - DNA, 82 bp, Homo sapiens
ttgaggaactccttattttcactgtgaaataatatacagttatatatatatatctgatgatgaagggcagagggttcctcaa

SEQ ID NO: 47450 - DNA, 83 bp, Homo sapiens
cccctattagactgtgtctgtatctgtgtctctagcacccagcaattatccagggcaaagggccacaaactatagtccagggg

SEQ ID NO: 47451 - DNA, 77 bp, Homo sapiens
ttgcttttttttttgagatggagtctcactctgtcacccaggctggagtgcaatggcacggtctcggctcactgcaa

SEQ ID NO: 47452 - DNA, 71 bp, Homo sapiens
tatatgtatttattactaatatgtatgtacatattaaatatatgtacatattatatgtgtatttatatata

SEQ ID NO: 47453 - DNA, 97 bp, Homo sapiens
taagacgtgttgtatataagacagacagtttgtgtgtgtgtttatttataaatatattattttgaaataatgttgtcgacatatgttgcaggtctta

SEQ ID NO: 47454 - DNA, 113 bp, Homo sapiens
cagtcacgtggactgttaagcgctcgagatgtggttagtgtgagtgagaataatgcatttttaatttttatttaatttaatttatttattttgagaaacggtctcactctgtc

SEQ ID NO: 47455 - DNA, 73 bp, Homo sapiens
gaggcagggtctcactctgtcacccaggctggagtgcagtggtgtgatctcagctcagtgcaacctctgcctc

SEQ ID NO: 47456 - DNA, 97 bp, Homo sapiens
ttatgatggtcagtagccacgtgtgaaatgtatctaatgggactgagaaactaaatttttaatttaagtagccacaggtagctagtgattaccatag

SEQ ID NO: 47457 - DNA, 110 bp, Homo sapiens
gcgacagagtgagaccttatctttaaaaaatgtatatatatagtgctaattttgagtctattttattatttatttatttattactttgagactgagtctcactctgtctc

SEQ ID NO: 47458 - DNA, 72 bp, Homo sapiens
gctctctgattctgtctggtagagacatatgtgagaaaacacccaatccatacccaccaggcctcagagtgc

SEQ ID NO: 47459 - DNA, 69 bp, Homo sapiens
ttgtttgagacagggtctcactctgtcacccaggctggagtgtagtggtgcgatcttggctcaccacaa

SEQ ID NO: 47460 - DNA, 59 bp, Homo sapiens
ggtcccagttcccggaggaaggatgacaaatgagtgtgggtcgctccctctgtgggacc

SEQ ID NO: 47461 - DNA, 66 bp, Homo sapiens
gggctggaacacatgaacccagggaaagtacggaagtgtcacactgggtctcacagaacatagctt

SEQ ID NO: 47462 - DNA, 131 bp, Homo sapiens
gggtcccaatgtggatgctggtctctacagtgattttttgtgtgtgtgagactgaatctcactctgtcacccaggccggagtgcagtggtgcgatctcggctcactgcaacctctgcctcctgggttcaag

SEQ ID NO: 47463 - DNA, 69 bp, Homo sapiens
ctgaagttggcaatctgtcaactctttgagatatgggaaggcccagagttgagagagagcacacttgag

SEQ ID NO: 47464 - DNA, 68 bp, Homo sapiens
gcccaagtgacagaggcaccctgtcttctttttttttttgagacagagtctccctctgtcacccaggc

SEQ ID NO: 47465 - DNA, 66 bp, Homo sapiens
tgtatatatacgtgtatatgtatatatgtgtgtatatacgtatatacgtatatatgtacgtataca

SEQ ID NO: 47466 - DNA, 114 bp, Homo sapiens
ctagtggcaagatggttgaacagattaggatgctgcttactttattttttaaaaagaggctaacatcaggcatagtggaaaatggcagtcccttaggtttcagatctaaattag

SEQ ID NO: 47467 - DNA, 98 bp, Homo sapiens
tgttgcatctttgaagactgcctcagtcccagcttcaatccttccaaaaagacctgtcatgtgtgtgagtgagagacggggtagttcaagtacagaca

SEQ ID NO: 47468 - DNA, 70 bp, Homo sapiens
tcagtttaggtgataggttattttatttttttctttttgagatgaagtctcgctctgtcacccaggctgg

SEQ ID NO: 47469 - DNA, 93 bp, Homo sapiens
gtgcaagaatcctgggccaatggaacatacaacttggtgagaaacctattaaactgaagtttgtcacctctgtcctccatttcagggtggtat

SEQ ID NO: 47470 - DNA, 83 bp, Homo sapiens
ggaattgtcataccagctgctctgcctgactctgggctgggactctggggagacagctgagagaggacacctggcgtggttcc

SEQ ID NO: 47471 - DNA, 75 bp, Homo sapiens
gggtatggagagtggatgtcaggtgggggcaagaggggccatgtccttctgactctgcctccctgtctcatgcct

SEQ ID NO: 47472 - DNA, 115 bp, Homo sapiens
tgctttattagcagccagacaagtgggctttctcagcctcagctgttagcagtgaaaagtcacagaacagacaggggtcagaggcagcgagtgtcattgcagcacaggagaagca

SEQ ID NO: 47473 - DNA, 76 bp, Homo sapiens
tgggcaacagagtgagactctgcctcaaaaaaaaaaaaaaaaaaaaaaaaaagaagagttctcactctgtcaccca

SEQ ID NO: 47474 - DNA, 102 bp, Homo sapiens
agtactggaggtataaacagataagggcccattcttacactattttcatatgttattcagtctgactgtgtgagttctcccttgctataactcatttgtatt

SEQ ID NO: 47475 - DNA, 112 bp, Homo sapiens
gagccaccatgcccagcccaatgttattattattgagatgagatggagtctcgctctgtggctcaggctggagtgcaatggcgcaatcctggctcactgcaagctccgcctc

SEQ ID NO: 47476 - DNA, 122 bp, Homo sapiens
gtgatagccactagccacttgtggctatttcgatttaaatgaggtttaaaattcagtcccacagtctcactggtcaccttctaaatgctcgacagccacacagtctcatggctcccacgcta

SEQ ID NO: 47477 - DNA, 99 bp, Homo sapiens
ggtggccctagagcagacacaggctcaggtttccttcccagctctaccacctggagctttgtgaagtgactgagctgactaccacttatccttgctgcc

SEQ ID NO: 47478 - DNA, 93 bp, Homo sapiens
atggggcttctgtcccagagctcctgctgcttcaaagaccctggtgccctcttttctgtgcctgtgtctggggctctggggctgaaaacccat

SEQ ID NO: 47479 - DNA, 58 bp, Homo sapiens
atatgtatatatatgtgtgtgtatatatatgtatgtacatatagatatgtatatatat

SEQ ID NO: 47480 - DNA, 112 bp, Homo sapiens
gagtacagtggcacacacctgtagtcccaggtacttgagaggatgaggtaggaggttcacttgagcccagaagttcaaggccagcctgggcaacatagtgaaaccctgtctc

SEQ ID NO: 47481 - DNA, 72 bp, Homo sapiens
gagagagacagtggctgtgactctggctcttaaaccacaatggagggattcaagttagcttaggtagctctc

SEQ ID NO: 47482 - DNA, 89 bp, Homo sapiens
agagcactgacatgtgtgtgcctgagtgccagccaccgtgtgaactctttggaggttttgcattttaggtaaataactgtctgtactct

SEQ ID NO: 47483 - DNA, 66 bp, Homo sapiens
aaggaggtcaggcagagaggcttgctcagtcacatgaacaaatcttctgagtttcctgatgtgctt

SEQ ID NO: 47484 - DNA, 69 bp, Homo sapiens
tttctggagtcagagtctcactttgtcacccacgctggggtgcagtgccacagtctcagctcactgaaa

SEQ ID NO: 47485 - DNA, 58 bp, Homo sapiens; identical to SEQ ID NO: 2595

SEQ ID NO: 47486 - DNA, 58 bp, Homo sapiens
tgagacagggtctctctctgtcacccaggctggagtgcagtggcgcaatcttggctca

SEQ ID NO: 47487 - DNA, 95 bp, Homo sapiens; identical to SEQ ID NO: 68

SEQ ID NO: 47488 - DNA, 93 bp, Homo sapiens; identical to SEQ ID NO: 69

SEQ ID NO: 47489 - DNA, 86 bp, Homo sapiens
tggcatgattttgagaaatgtgtcaggtctatggggaaaatgttttctttttcaatttaagacttcacctctggtttattatgcca

SEQ ID NO: 47490 - DNA, 101 bp, Homo sapiens
gtattgaataatttactgcccataacaactctggagtagctactatatttatttattgttgggaagctgatgtagagagggcaaggttacacagcaattac

SEQ ID NO: 47491 - DNA, 77 bp, Homo sapiens
gtgctacacgcgtgtgtgtgtgtgtgtatatatatatatatatatatacacacacacacacacacattaagtggcac

SEQ ID NO: 47492 - DNA, 126 bp, Homo sapiens
ccagctttgttctttttgcttaggattgtcttggctatgtgggctcttttttggttccatatgaaatttaaagtagtttttttcaattctgtgaagagagtcaatggtagcttgatggggatagca

SEQ ID NO: 47493 - DNA, 58 bp, Homo sapiens
tgagttggagtctcactctgtcacccaggctggagtgcagtggtgcgaccttggctca

SEQ ID NO: 47494 - DNA, 72 bp, Homo sapiens
ggaaatggagtgtgagaagtacacctgagccaggagaactggcagggaatctgtcaatcactctctttgtct

SEQ ID NO: 47495 - DNA, 82 bp, Homo sapiens
agttgagaaacacaggacatacacgctcactctctccgctattaattacctggctgaagtagtgtttgtcagtttctccact

SEQ ID NO: 47496 - DNA, 131 bp, Homo sapiens
ctcttctactgggtatctaaagttagcctgtagtcccagctacttgggaggctgaggtaggaggatcacttgaactcgggaggcagaggttgcagtgagtcaagatcatgtcactgcactccagcctgggt

SEQ ID NO: 47497 - DNA, 118 bp, Homo sapiens
tcttcattaaaacattcagagtatacgccagtaaacttggattttttttttttttttaggctgctgagaaactaggtgaaactgagaaacttagtataatgattgaagaatgtggagg

SEQ ID NO: 47498 - DNA, 73 bp, Homo sapiens
taggacgagtctctttttctcactgtgtctcagtatccccgtgctgaacctcaggttgtatgaaggactactg

SEQ ID NO: 47499 - DNA, 115 bp, Homo sapiens
tatatatataaaagacttcaatatgctgtatgtatatatataaatatatattatatataatatgctgtatgtgtgtgtatatatggcttcaatatgttgtgtctgtgtgtgtata

SEQ ID NO: 47500 - DNA, 67 bp, Homo sapiens
gattgtcactgtgtctgtgtcccccagagggagtgattcaaaggagggagatggaagcagtagtgtc

SEQ ID NO: 47501 - DNA, 109 bp, Homo sapiens
cttcagtttttttgtttttgtttttttttttgagacggagtctcgctctgtctcccaggctggagtgcagtggcgcaatctcggctcactgcaagctctgtctcctggg

SEQ ID NO: 47502 - DNA, 85 bp, Homo sapiens
tgagatagtctcgctctgtcgctcaggccggagtgcagtggtgtgaccatggctcactgcaacctctttctgccaggttcaagcg

SEQ ID NO: 47503 - DNA, 68 bp, Homo sapiens
gcatgagccactgtgcccagcctttttttttttttcttctttttttttgaggcacagtctcgctctgt

SEQ ID NO: 47504 - DNA, 84 bp, Homo sapiens
gtgtgaatccgtgtgtctgtctgtgtctgtgagggagtgagtggggctggggattcgttctgggtgtgggcagtgagttcaggc

SEQ ID NO: 47505 - DNA, 119 bp, Homo sapiens
ggtgacagcttctggtaagggatttttttttttttttttttgagacagagtctcgctctgtcacccaggctggagtgcagtggcctgatttcagctcactgcaagctccgcctcctggg

SEQ ID NO: 47506 - DNA, 107 bp, Homo sapiens
gcagtgcctagagctgggcaggagagaaggactcctcctaggtttatttttatttttatttttttagactgagtttctctctgttgctcaggctggagtgcagtggc

SEQ ID NO: 47507 - DNA, 86 bp, Homo sapiens
tccccccagtccagcctcactcgctgtgacagtcccagatccaggaaggtctagacttgctggtgctcagctgggctggatgggga

SEQ ID NO: 47508 - DNA, 65 bp, Homo sapiens
gccaacaggactttgcgtgacctgggccctgcctgcttccccggtctcagtctcagtctctgtgc

SEQ ID NO: 47509 - DNA, 93 bp, Homo sapiens
taacatcttcatgaaagaagtggataatgaaggcttgggtactggagagagttggagcatttgtttattttcttttcttttttggggcggttg

SEQ ID NO: 47510 - DNA, 103 bp, Homo sapiens
ttttttgtgtgtgaattaattctcctgagaaaattttttacttttataggtgtttctcaccaaaagtttctaggggtagaattgcttggtcaaatgcaaaaaa

SEQ ID NO: 47511 - DNA, 106 bp, Homo sapiens
gagcaaggacagcttaaaggttagaagcaagatggagtcagttaggttaaatctctttcactgtctcagttactagttataattttgcaaaggcagtttcagtctc

SEQ ID NO: 47512 - DNA, 56 bp, Homo sapiens
gagacagtgtctcactctgtcacccaggttggagtgcagtggcgggatcttggctc

SEQ ID NO: 47513 - DNA, 130 bp, Homo sapiens
gcctcaggtcgtgaaagggagccgctgaggcagtcagaaagaatttttttttttttttttttgtttttttctcccccttttctttttttaaccttctgcttctgactctgccagtctgtgtctctctctc

SEQ ID NO: 47514 - DNA, 80 bp, Homo sapiens
ctgagtgtgcaatgtgtgtgatgtgagtgtgcagtgtgtgtgtgtacacatgggcggactcctcttacgccttctctcag

SEQ ID NO: 47515 - DNA, 116 bp, Homo sapiens
agtgttaagtagtaggcagaggattaaaatagactgatatgctggtaagtaattgggtggtcactcccagtctctctataagcagatggcttttaaggtgaataatatgaataact

SEQ ID NO: 47516 - DNA, 118 bp, Homo sapiens
actttctgtgtgatcttgggcaagaacccgaacttctcttttttttatttatttttaaatattttttatttctataggtttttgggggaacaggtggtgtttggttacatgagtaagt

SEQ ID NO: 47517 - DNA, 94 bp, Homo sapiens
taaaggtactcaggagtcctgggtgtccctggcagtggctcagactctgacttttagggggcaacatccaggtcacccagactttgtatctttg

SEQ ID NO: 47518 - DNA, 88 bp, Homo sapiens
ttacaattctatacaactccatatatatatatatatatatatatatatatatatatatatatatatatgtatttttttgttgttgtga

SEQ ID NO: 47519 - DNA, 81 bp, Homo sapiens
tctgagcatctgtgtgtgtgtgagcatatgcatgtgtgtgtgcacacgtgtgtgagtgtctgcgtgtgagagagagaaaga

SEQ ID NO: 47520 - DNA, 56 bp, Homo sapiens; identical to SEQ ID NO: 324

SEQ ID NO: 47521 - DNA, 95 bp, Homo sapiens
atatacaccaacacacaacatatatatgtgtgtgtatgtatatatatagtatgtatgtgtgtatgtacatatatagtatgtgtgtgtatgtatat

SEQ ID NO: 47522 - DNA, 91 bp, Homo sapiens
gtggaaaacctttgcttctaggttgtaaaatttagcactagttttattaggttggtgcaaaagtaattgtggaagtaattgttgtgtttgc

SEQ ID NO: 47523 - DNA, 58 bp, Homo sapiens
tgagtttgagtctcactctgtcacccaggctggagtgcagtggtgtgatctcagctca

SEQ ID NO: 47524 - DNA, 58 bp, Homo sapiens; identical to SEQ ID NO: 276

SEQ ID NO: 47525 - DNA, 59 bp, Homo sapiens
tccagtgatctgtctctacaccagctgcctctcagaagtgagagaagagcctctctgga

SEQ ID NO: 47526 - DNA, 70 bp, Homo sapiens
ttgttttgagatggagtctcactctgtcacccaggctggagtgcagtggtgcaatctcggctcagtgcaa

SEQ ID NO: 47527 - DNA, 114 bp, Homo sapiens
ggattgtcttggctgtatgggctcttctttggttgcatatgaaatttaaagtagttttttctaattctgtgaaaaaaaagtcaatggtagcttgatggggatagcattgaatct

SEQ ID NO: 47528 - DNA, 70 bp, Homo sapiens
gttgtttgagatgagtctcgcactgtctcccaggctggagtgcagtggcacaatctcagctcactgcaac

SEQ ID NO: 47529 - DNA, 107 bp, Homo sapiens
tggtttctgacatgctttcaaattaattgaaactttaaactacatgaaggttttgttattttatatattttaaggcttcatgttgatgtggaacatgaatccaacca

SEQ ID NO: 47530 - DNA, 60 bp, Homo sapiens
tgagatggagtctcactctgtctcctaggctggagtacagtggtgtgatctctcagctca

SEQ ID NO: 47531 - DNA, 110 bp, Homo sapiens
ccagctttgttctttttgcttaggattgtcttggctatgtgggctcttttttggttccatatgaaatttaaagtagttttttctaattctgtgaagaaagtcagtggtgg

SEQ ID NO: 47532 - DNA, 80 bp, Homo sapiens
gtattttaatatctcataattcaatgtacatttaattttttaaatgtttgaatgtaattgaatttgagtatttgaaaggc

SEQ ID NO: 47533 - DNA, 95 bp, Homo sapiens; identical to SEQ ID NO: 68

SEQ ID NO: 47534 - DNA, 93 bp, Homo sapiens; identical to SEQ ID NO: 69

SEQ ID NO: 47535 - DNA, 111 bp, Homo sapiens
gtgaaaggagtagggagggggtgggccagggcttcagagcagttccacagtcatcaggaaccaggcttctgtgtctctgttgtaccatacaagcccagggcttccatgcac

SEQ ID NO: 47536 - DNA, 72 bp, Homo sapiens
gtagccagtgagtacccagcaaccatgccaccaaagaggaaatggtgctttgtgggttctctctctctctgc

SEQ ID NO: 47537 - DNA, 72 bp, Homo sapiens
aaggctcaattgtgtatacacatatatgtatatgtgtgtatgtgtgtgtatatgtatatataattgagtctt

SEQ ID NO: 47538 - DNA, 98 bp, Homo sapiens
tctatggtattaagttaaaccctttgaaattgctgttaaggtgggttagactgtcacactgtcacagcttagcagctgcaaacttttaacctattaga

SEQ ID NO: 47539 - DNA, 116 bp, Homo sapiens
aggtattggtaatctttttccctatattaggtggtggtataaaagtgttcattgtatcaatatttcttataccttctatctagtttataaatattaataaagattattttgtttct

SEQ ID NO: 47540 - DNA, 116 bp, Homo sapiens
cagatctgatgctacctccctgtggggcttgtcatgaggattaaatgagagaaggtttattgtatttatttatttatttatttttgagacggtgtctcactccgttgcccaggctg

SEQ ID NO: 47541 - DNA, 89 bp, Homo sapiens
gcccagaccacttcatgttgtatgattttatgtatatgaaatccgtgaatgtgcaaatctaatctacgataacatacagtggatcaggc

SEQ ID NO: 47542 - DNA, 110 bp, Homo sapiens
cgcctcatcacacatgattcaggtgtcctggggccacttcacgctcctggcttcctggcccaaagcccaggagaccgctgaaccccactgcctggcattatttgcgggcg

SEQ ID NO: 47543 - DNA, 67 bp, Homo sapiens
gggaacatcagcgtgtgtgtgtgtctgtctgtcataaataggggaccatctgcgtgtgtgtgtgtcc

SEQ ID NO: 47544 - DNA, 73 bp, Homo sapiens
ggggcagtgtggtggggagcgcgggcgtgtgtatgcgcgtgtgcgtgtgtctgtctgtccatctgtctgtccc

SEQ ID NO: 47545 - DNA, 57 bp, Homo sapiens
gaggcccagaggagtgtggggacttgtctaagctcacgcactgagtcactgggcctc

SEQ ID NO: 47546 - DNA, 57 bp, Homo sapiens
gggcgtcgggttgaaattttttttttttttttgagacagagtctcgctctgtcgccc

SEQ ID NO: 47547 - DNA, 117 bp, Homo sapiens
cagtcaattcttaacagccacatcttgagtgattccatttatacgaaatatccagtgtatttacagaaaaaagacagcagattcgtggttgccaggggctgaggggagaggggaatg

SEQ ID NO: 47548 - DNA, 58 bp, Homo sapiens; identical to SEQ ID NO: 1725

SEQ ID NO: 47549 - DNA, 73 bp, Homo sapiens
ctgggtgtggtctgcgcacgcttgcagtccctactacttgggaggctgaggtaggaggatcacttgagcccag

SEQ ID NO: 47550 - DNA, 80 bp, Homo sapiens
gagagccagttctgacacactgagtgaatgaggcacatgaacattgctgggctcatccttaaatctgtgtcactgttctc

SEQ ID NO: 47551 - DNA, 82 bp, Homo sapiens
gtctgtattgtaggtacctggctggctgtgtcccactgttgttgcggggaggagtatgagtccagctgtttcctgtatagac

SEQ ID NO: 47552 - DNA, 111 bp, Homo sapiens
atacatgcgtgtatatgtatatatgcgtatgtatataaattagaattatgtgatttatattcattatattgaattttatatacatagtatatatatgtatgtagtaagtat

SEQ ID NO: 47553 - DNA, 112 bp, Homo sapiens
ttccattccctgggccactctgtccctgtgggaaaaatccttagagacccaacttagtatcttctttttttcttttttgagacggaatctcgctctgttgcccaggctggag

SEQ ID NO: 47554 - DNA, 115 bp, Homo sapiens
tcagcctcctgagtagctgggattacaggtgtgtgccactgtgcctggctaattttttgtatttttagtagagacggggtttcaccatgttggccagctgctctcgaactcctga

SEQ ID NO: 47555 - DNA, 65 bp, Homo sapiens
gtgagactgtgtgtgtgtgtgtgaatgagtgtgtatgtgtgtgtgcgcacaggcgcctgtgtggc

SEQ ID NO: 47556 - DNA, 108 bp, Homo sapiens
aggtctcagcctctttttacccagcccctattcaagatggagtcgctctggtttaaacgcctctgacacactgagtaactgggcaggtttttgtggctgggtgttcct

SEQ ID NO: 47557 - DNA, 129 bp, Homo sapiens
ctcctgagaggtgacagcgtgctggcagccctggctcgctctctgcgcctcctctgcctgggtcccactttggcggcacttgaggagcccttcagcccgccgctgcactgtgggagacccgtcctgggc

SEQ ID NO: 47558 - DNA, 118 bp, Homo sapiens
gcctgaagcatgctgggacattccttacaaagtaaagatcaaaatactgtttattttctttttctttctttcttttttttcttttttttgggacggagtctcactctgtggcccaggc

SEQ ID NO: 47559 - DNA, 64 bp, Homo sapiens
ttggctggttgaggtagtggtttgtttgtttttgagacagggtctcactctgtcacccaggcgg

SEQ ID NO: 47560 - DNA, 111 bp, Homo sapiens
gctggacgtggtggtgcctgcctgtagtcccagtgactcaagaggctgaggtggaaggatcgcttgagcactgggggtcaaggctgcaatgagctacggtcatacctctgc

SEQ ID NO: 47561 - DNA, 66 bp, Homo sapiens
tcctctatgcctgcctgtgtccctgtctaagtttccctttattataaggacaccaggcattttgga

SEQ ID NO: 47562 - DNA, 78 bp, Homo sapiens
ttggtctgaggtggggttgaggcattgggattctttttttttttttgagatggagtctcactctgtcacccaggctgg

SEQ ID NO: 47563 - DNA, 100 bp, Homo sapiens
gcatttgatcatcatcaattctgtgtctgagtccctccctcccttccaaagaatggacagatggacagatgggatggagaagtgagatgacgtcaaaggc

SEQ ID NO: 47564 - DNA, 62 bp, Homo sapiens
tgagatggagtctcactcactttgtcacccaggctggagtgcagtggcatgatctcagctca

SEQ ID NO: 47565 - DNA, 118 bp, Homo sapiens
gtgctgggattacaggcgtgagccactgtgcctggcaggagctcctatcttttttttttttgagacggagtttcgctcttgttgcccaggctggagtgcaatggtgtgatcttggctc

SEQ ID NO: 47566 - DNA, 71 bp, Homo sapiens
ctcagtagagacgggatgtgagggtggtcccctactcaaagtcaggtggtctctcactcagtgtggctggg

SEQ ID NO: 47567 - DNA, 119 bp, Homo sapiens
ctgcacctggcctatatatatattttactactatatgtatatgtatatatgtgtatatatagcatatatatgtatatatgtgtatatatagcatatatatgtatatatactagtaacag

SEQ ID NO: 47568 - DNA, 91 bp, Homo sapiens
ggagacagaaagggactttgtcacaaaactaaattaattaaataaatttcttttcttttttttttttttgacagggtctcactctgtcacc

SEQ ID NO: 47569 - DNA, 112 bp, Homo sapiens
atgaacatataacagctagtgccacaggagaaactaacttttcattttacttaaattttttttttaagagatgggttctcactctgtcacccaggctggagtgtggtggcat

SEQ ID NO: 47570 - DNA, 90 bp, Homo sapiens
atatatgtagatatatatttatatgtatgtagatataggtatatatctacatacatctacatatatatagatatatgtatctacatatat

SEQ ID NO: 47571 - DNA, 117 bp, Homo sapiens
gagtgcatatgtcactgattcaataggcctagaatagagtctgagaacctgaatttttttttttctgagatggagtcttgctctgttgcccaggctggagtgcagtggcacgatctc

SEQ ID NO: 47572 - DNA, 114 bp, Homo sapiens
gattagattagcatgtttttctgtcactctccattctaaatataattacgtgaacacagcattatatttcatttttttgcagagacagagtctcactatgttgccaggctggtc

SEQ ID NO: 47573 - DNA, 70 bp, Homo sapiens
tatatatgtctgtgtgtatatatatatatgtacgtatgtgtatatatgtgtgtgtgtatatatatgtata

SEQ ID NO: 47574 - DNA, 119 bp, Homo sapiens
ggtgacaaagtgagaccctgtctttttttttttttttttttgagatggagtctcgctctgtctcccaggctggaatgcagtggcgcaatctcggctcactgcaagctccgcctcccggg

SEQ ID NO: 47575 - DNA, 96 bp, Homo sapiens
cttaggagatataggagattatgtttaacttagtatgtatgtatatatgtattttattattacgtttgtgggacaaggtctcgcttgttgcctagg

SEQ ID NO: 47576 - DNA, 94 bp, Homo sapiens
ctgtagcacctagtcctttgctaacagggcctttttttttttttttttttttgagacagggtcttgttgtgtcttccaggctggagtgcagtgg

SEQ ID NO: 47577 - DNA, 58 bp, Homo sapiens; identical to SEQ ID NO: 5571

SEQ ID NO: 47578 - DNA, 117 bp, Homo sapiens
gtgaaccctgcaagtatcaactatggactttactaataatgtatattaaatattattattaatattaattattatattgttaatgaagttaattataatgtatcagtattagtttat

SEQ ID NO: 47579 - DNA, 85 bp, Homo sapiens
ggccccgtctgtctgaatcactctctccgcagccaccaactctccagtgtgatgcaggaaggctctcctgtttcagaagtttgcc

SEQ ID NO: 47580 - DNA, 62 bp, Homo sapiens
tgacaagttgatgccactgctgtctgaggctgcctccggctcagtagtcagctcaatgctca

SEQ ID NO: 47581 - DNA, 118 bp, Homo sapiens
tgctgagttctgctgtgtgcccaccctggagggtcccaaggtgccaccaggtctcagacacactgagattctcagagtaagtgtggattcaacgggtgggcaacgcctagcgggggca

SEQ ID NO: 47582 - DNA, 63 bp, Homo sapiens
gctgtccctgcgtccctgcgtccctcccgcacgcggctctgggaatgctgggctggggctggt

SEQ ID NO: 47583 - DNA, 82 bp, Homo sapiens
gccgcctcactcggtctcaggctcttctgtggcgcatctcacgtgaccgcgctgcgggagagggatgaaacaagagggcggc

SEQ ID NO: 47584 - DNA, 70 bp, Homo sapiens
ctttcctggcatgagacaaggagatttttttttttttttgagatggagtctcactctgtcaccaggctgg

SEQ ID NO: 47585 - DNA, 111 bp, Homo sapiens
gaatccactctgtagattgctttgggtcatatataaataattctttttttttttttttttttttgagacagagttgctctattgcccaggctggagtgcagtggtgcagtc

SEQ ID NO: 47586 - DNA, 86 bp, Homo sapiens
tgggttgtcttttcattctttttttttttttttggaggcagagtctccttctgtcacccaggctagagtgaagtggcatgatctca

SEQ ID NO: 47587 - DNA, 58 bp, Homo sapiens; identical to SEQ ID NO: 884

SEQ ID NO: 47588 - DNA, 56 bp, Homo sapiens; identical to SEQ ID NO: 885

SEQ ID NO: 47589 - DNA, 77 bp, Homo sapiens
gcttcacaaagtaaaggacttttttgatgctccatttgaattctcttagcattaacgaagtccacactcactaaggc

SEQ ID NO: 47590 - DNA, 120 bp, Homo sapiens
gggtccctgatatagagcagaacacacataggagacgcctgtccatctgtctgcctgtctgtctctctgtccacctagtcctatgtccctgagtgggaaagatggccaggaggagctgac

SEQ ID NO: 47591 - DNA, 117 bp, Homo sapiens
agctgatggtatcttcaaggttaagagcacacggggctggcacctgtgggtcacactcagtctcccagagcatgcctgcagtgtcagtgaagacacttgagataagattctgaagtt

SEQ ID NO: 47592 - DNA, 74 bp, Homo sapiens
cttcagggatttggggagggacatcgggcatgcagaaagctagaagctgcctgtggctctcagtttctctgaag

SEQ ID NO: 47593 - DNA, 117 bp, Homo sapiens
cttcatctggactacacctaaaaccaaaaccactgagtaagattttttcattttgtgaaagttctgccaattttgcttaagtagctgtgtgattttaaaggttgccactagatggtg

SEQ ID NO: 47594 - DNA, 137 bp, Homo sapiens
gtgtatatatgtatatatgcatatatgtgtgtatatatgtatatatgcatatatgtgtgtatatatgtatatatgcatatatgtgtatataggtatatatgcatgtgtgtatatatgtatatatgcataaatgtgtg

SEQ ID NO: 47595 - DNA, 146 bp, Homo sapiens
atatatatatatatatatgtgtgtgtatacatatatgtgtatatatatgtgtgtatatatgtatatatgtgtgtatatgtgtgtatatgtgtatatgtgtatatatgcatgtgtgtatatatgtatatatgtatatatgcatatat

SEQ ID NO: 47596 - DNA, 71 bp, Homo sapiens
gcccgtgcacttcttgtgttcccatgtgagaacctctctggggctctcacacagcgttggaattgtcgggc

SEQ ID NO: 47597 - DNA, 81 bp, Homo sapiens
cagcataaaggtcttcatccttgtcattttcatgttgagtagacagaggagggggagaaggagaaggaagagaaggggttg

SEQ ID NO: 47598 - DNA, 116 bp, Homo sapiens
cttgattactgggatattcctaaaaatccactacattttttacttttttttaattttcattttaaattctagggtatatgtgcaggatgtgcaggtttgttacataggtaaacaag

SEQ ID NO: 47599 - DNA, 116 bp, Homo sapiens
tatgtgtgtgtgtgtatatatccatatatatgtgtgtgtatatatatccatatatataatatatatatccatatataatatatatatatatatggatatatatatatatatatata

SEQ ID NO: 47600 - DNA, 81 bp, Homo sapiens
gtattagtattctatgatcacttctgtttttcttcatattaggaaacattatgaaacggaagaatcgtacttcactaatat

SEQ ID NO: 47601 - DNA, 116 bp, Homo sapiens
aagaattttgttggtctcttctcttttctgatttgtattgtgaaaactacatattttaatgtttttcaaaagttcacagagcctaacatggattgagagacactaaactaaagctt

SEQ ID NO: 47602 - DNA, 61 bp, Homo sapiens
gagatggagtctcactctgtcactcaggctggcattcagtggagtacagtggtgcaatctc

SEQ ID NO: 47603 - DNA, 127 bp, Homo sapiens
tccagctttgttctttttgcctaggattgtcttggctatgtgggctcttttttggttccatatgaaatttaaagtagttttttctaattctatgaagaaagtcaacggtagcttgatgggaatagca

SEQ ID NO: 47604 - DNA, 106 bp, Homo sapiens
caggcatggtggcatggtctgtaatcccagctacttgggaggctgaggtaggaggatcacttgagcccagaagtttgggggctgcagtgagctataatcatgtctg

SEQ ID NO: 47605 - DNA, 107 bp, Homo sapiens
aagtaaaggacagatgtccctttttattggtgtggtataattgatgcaatatgtaattgtatcttaattaattagataaagatggccatggggattctccattattt

SEQ ID NO: 47606 - DNA, 70 bp, Homo sapiens
tttttttgagatggagtctccctctgtcaccctggctggagtgcagtggcgcgatcttggctcactggaa

SEQ ID NO: 47607 - DNA, 71 bp, Homo sapiens
tccaatacggtacagttgggagtctgagacctgcattgcagacttgtcactcattgtctgtgtcccttgga

SEQ ID NO: 47608 - DNA, 95 bp, Homo sapiens; identical to SEQ ID NO: 68

SEQ ID NO: 47609 - DNA, 93 bp, Homo sapiens; identical to SEQ ID NO: 69

SEQ ID NO: 47610 - DNA, 71 bp, Homo sapiens
gtctctcaagtagttgggactacaggtgcatgctgtcatgcccaactaattttcaatttttttgtagggac

SEQ ID NO: 47611 - DNA, 94 bp, Homo sapiens
ctagtgagaagtgttggggtgaaagtatggttcagtaacatgttaaccaagtttatctttcatgtatatttctttacttggccccaaatcctag

SEQ ID NO: 47612 - DNA, 88 bp, Homo sapiens
ctgttgagttgtttcagttccttgtatagtctggatattagtcccttgtaggatgaatagtttgcaaacattttctcccattcaacag

SEQ ID NO: 47613 - DNA, 77 bp, Homo sapiens
ggagagcggccggaaagactctataacccagttctgggaagaactccaagctgggagtcagtcacactgactctacc

SEQ ID NO: 47614 - DNA, 84 bp, Homo sapiens
gggttatcatcattgatggagcgctggccattgtccttgaaaaactctgtgaggattcttcagtgcttatgatgatggtagcct

SEQ ID NO: 47615 - DNA, 158 bp, Homo sapiens
actctctctctatatatatgtgtgtgtatatatatgtatatgtgtatatatatgtgtgtatatatacgtatatgtgtatatatatgtgtatatatatatgtgtgtgtgtatatatgtgtatatatatgtgtgtatatatgtgtgtatatatattcaca

SEQ ID NO: 47616 - DNA, 96 bp, Homo sapiens
gaagctagggaaactgaagtcagtccacaatatatatttgattcttatagaatcaagaaagaaagtatggtactactaattttaggtcccagtttt

SEQ ID NO: 47617 - DNA, 86 bp, Homo sapiens
tatatatggatatatctggatatatatatggatatatatatctggatatatatatggatatatatatctggatatatatatatata

SEQ ID NO: 47618 - DNA, 111 bp, Homo sapiens
tgtgtgtatatatatgtgtgtgtatatacttatatgtatatatatatcactatataatagtgaatatatgtatattattcactaatatacatatatgtatgtgtatatata

SEQ ID NO: 47619 - DNA, 58 bp, Homo sapiens
tgagacagggtctcactctgtcacccaggctggagtgcagaggtgtgatcatggctca

SEQ ID NO: 47620 - DNA, 129 bp, Homo sapiens
cctggcattgccacggggcctgcatggagcatgctcctgccagcacccaaagcggctgtctggaacactcactcactcatgtactccctcccacaataggttgagtgcagtgagccaaataaacagggc

SEQ ID NO: 47621 - DNA, 95 bp, Homo sapiens; identical to SEQ ID NO: 68

SEQ ID NO: 47622 - DNA, 93 bp, Homo sapiens; identical to SEQ ID NO: 69

SEQ ID NO: 47623 - DNA, 72 bp, Homo sapiens
agagaataggaaagacagggaaggatttcaataattaatgagatattatttttcttttcttttcttttcttt

SEQ ID NO: 47624 - DNA, 58 bp, Homo sapiens
tgagactgagtctcactctgtcacccaggctggagtgcagtggtgcgatctcggctca

SEQ ID NO: 47625 - DNA, 100 bp, Homo sapiens
ttttttctagttccttttaacaagcatttatttaatttttaacaagcaggcttttgcaattgttagatagagataacggaaatggggaaccctgagaaaa

SEQ ID NO: 47626 - DNA, 113 bp, Homo sapiens
caagctcttctgttcttttatctatctatcatctatctatctatctatctatctatctatttgtgtgggtacatagtaggtgtatatatttataaggtacatgagatactttg

SEQ ID NO: 47627 - DNA, 121 bp, Homo sapiens
tcctgctctctacttcttagcgttatgatatctgttaggtttctagctccatttgatttgtctggaaaataggatgataatgttgtaggaaacaatggcacttaatgtccttagtatgaga

SEQ ID NO: 47628 - DNA, 77 bp, Homo sapiens
ggctagaagtctgagatcaaggtgtcagcctggttgatttttttcctgaggcctctctttcaggcttgtaaatagtc

SEQ ID NO: 47629 - DNA, 107 bp, Homo sapiens
gagataaaataggagatgaaagaactgcattagagacaaatgagtgaactgacacaagcattttcattccatttgatttgcacaatgtttttattgagtatttgctc

SEQ ID NO: 47630 - DNA, 109 bp, Homo sapiens
tgccctctcatctggttcccataggtaaatgtaaatgttacataatatgcatggacagtgtgtatttatatttacatttacccacagtgctcaacccgtgtcttaggca

SEQ ID NO: 47631 - DNA, 112 bp, Homo sapiens
ccagtatgtctgattcagtggcttttaggtgaggcccaagaatttgcattttttttttttttttttttttgagatggagtctcgctcagtcacccaggctggagtgcagtgg

SEQ ID NO: 47632 - DNA, 89 bp, Homo sapiens
tcagagttccaatattatagttctttatttcaatatttctgccactttggcttataaatgtctatagtgatactgtaatgaattctaga

SEQ ID NO: 47633 - DNA, 109 bp, Homo sapiens
gtgaagagtacagaattccatttagattgaagtcaaaaaatagtttatttttcttatgctccgtaagagatttaaacctttaagagattatctgcatgagaagctttgc

SEQ ID NO: 47634 - DNA, 68 bp, Homo sapiens
atacatacatatacatgtatgtatatatgtgcgtgtgtatatatatatatgtgttgatatatatgtat

SEQ ID NO: 47635 - DNA, 66 bp, Homo sapiens
acacacacacgtatgtatatgtatatatatgtatgtatatatgtacatatatgtatatgtgtgtgt

SEQ ID NO: 47636 - DNA, 88 bp, Homo sapiens
cttcctcaggactgataacggagttcagtatgaaattttatattattattattttttcagcttttaaattctggggtccatgtcgaag

SEQ ID NO: 47637 - DNA, 58 bp, Homo sapiens
acatacctatatatatatgtgtgtatgtatgcttatatacatgtatatatatgtatgt

SEQ ID NO: 47638 - DNA, 99 bp, Homo sapiens
atatatgttaaatcatatacacacacgtgtgtgtgcacatgtatatagacatacatatgtacatatatatgtatatatatgattatatttaacgtgtat

SEQ ID NO: 47639 - DNA, 63 bp, Homo sapiens
gtgtgtgtctgtgtgtgtgagcgcgtgtgtgtgtacgcatgagaaagagacagagacatagat

SEQ ID NO: 47640 - DNA, 80 bp, Homo sapiens
gaggaatgaggaatgaatgtggcagctagggcggctgaaggattacgtctgcctctctgcctattttttttttttttttt

SEQ ID NO: 47641 - DNA, 68 bp, Homo sapiens
agacacagtcacagtctgacttgttctgttcctcagggtgcagaataaacagattctgatctgctgct

SEQ ID NO: 47642 - DNA, 103 bp, Homo sapiens
tatatatatatgtatatatgtgtatatatacacgtatatagtgtatatatatacgtgtatatatatacgtatatatatatgtgtgtatatatatatatatata

SEQ ID NO: 47643 - DNA, 87 bp, Homo sapiens
gctgctttgagcttttgttttagagaattctggagggccaggctctgtattttttttttaattttcacataatttgttcagaaaagc

SEQ ID NO: 47644 - DNA, 103 bp, Homo sapiens
gcttaggtaatgctgcgtgtgtaagtttgataagttgtatctatttctgtagatagttctgggccattttatattagatgttgctgacacttggctacctagc

SEQ ID NO: 47645 - DNA, 95 bp, Homo sapiens; identical to SEQ ID NO: 68

SEQ ID NO: 47646 - DNA, 93 bp, Homo sapiens; identical to SEQ ID NO: 69

SEQ ID NO: 47647 - DNA, 149 bp, Homo sapiens
tatatatataaaatgtatatctatatatatgtcacatgtatatactgtggtacatatatatctcacacacacacacatatatatactgtgatatatatgtatatttatatatatgtgcaggtgtgtaggtgtggtatgtgtgagatata

SEQ ID NO: 47648 - DNA, 116 bp, Homo sapiens
ttttatagtgatcattataaacctctccattgattcattttctatgtatgtatgtatatatggatatatgtatgtatgtatcttatgtgtctagttttgtggttctgatcttaaaa

SEQ ID NO: 47649 - DNA, 85 bp, Homo sapiens
acaaagatatatatatatagatagatatattcacacacacactatatatgtgtatatatatgtgtgtatatgtgtatatatatgt

SEQ ID NO: 47650 - DNA, 113 bp, Homo sapiens
tgatgtcaagtgcttcctgattgtctctttgaactgtttattttttgctttttaatgggccgtggtttggtaagagtgtgttgaatgaatgagatttttggatgttgacatta

SEQ ID NO: 47651 - DNA, 58 bp, Homo sapiens
tgagatggagtctcactctgtcacccaggctggagtgcagtggcgggatctcggttca

SEQ ID NO: 47652 - DNA, 95 bp, Homo sapiens; identical to SEQ ID NO: 68

SEQ ID NO: 47653 - DNA, 93 bp, Homo sapiens; identical to SEQ ID NO: 69

SEQ ID NO: 47654 - DNA, 71 bp, Homo sapiens
aaagacctgtttggatccagggagcggcagggacaacctgttgctcacactgtctcacgcccagaagcttt

SEQ ID NO: 47655 - DNA, 87 bp, Homo sapiens
tcaatacaatctgtattttaaaactaaacatttgagtaaatggagacattttatttatttggatattttgaaagggttgtaaagtga

SEQ ID NO: 47656 - DNA, 97 bp, Homo sapiens
cttatagaggctccagttgcagtaaacttacagtggatcacttttatttttataaggatttccctgccaagttctaaaacatggaaacttctattag

SEQ ID NO: 47657 - DNA, 128 bp, Homo sapiens
atatctatgtacacacacatatatgtgtgtgtatatatgtatatatgtatgtgtgtatatatatgtgtgtgtatatatatattatatatatatatatgtatatctttgcaaacacatataaatatgtg

SEQ ID NO: 47658 - DNA, 78 bp, Homo sapiens
atgtgttggtggacatcattttatatatatacacatatatatatgtatatatgtgtgtgtgtgtacacacctatacat

SEQ ID NO: 47659 - DNA, 111 bp, Homo sapiens
tgatatacaattgccctggaaatggcaagatcaatatcatgtgtcaggattggcagtcactctttttctgtcacactattctcatgcttctactctcatcaattgcaatca

SEQ ID NO: 47660 - DNA, 99 bp, Homo sapiens
tctctctctctctgtatatacatatacacatacatatacatgtatatggagagagagagagagagagagagagagagtgtgtgtgtgtgtgtgtgtgtg

SEQ ID NO: 47661 - DNA, 82 bp, Homo sapiens
tatgtgtgtatgcatatatgtatatatgtatgcatatgtgtgtatgcatacatatgcacatgtatacatatgtacacacata

SEQ ID NO: 47662 - DNA, 535 bp, Homo sapiens
atatgtgtatatacatatgtgtatatatgtgtatatacatatatgtgtatatatgtgtatatatgtgtatatacatatatgtgtatatatgtgtatatatgtgtatatacatatatgtgtatatatgtgtatatacatatgtgtatatatgtgtatatatgtgtatatacatatatgtgtatatgtgtgtatatatgtgtatatatgtgtatatacatatatgtgtatatatgtgtatatatgtgtatatacatatatgtgtatatatgtgtatatatgtgtatatacatatatgtgtatatatgtgtatatatgtgtatatatgtgtatatacatatatgtgtatatatgtgtatatatgtgtatatatgtgtatatacatatatgtgtatatatgtgtatatatgtgtatatatgtgtatatatgtgtatatatgtgtatatatgtgtatatacatatatgtgtatatatgtgtatatatgtgtatatacatatatgtgtatatatgtgtatatatgtgtatatacatatatg

SEQ ID NO: 47663 - DNA, 163 bp, Homo sapiens
tatgtgtatatacatatatgtgtatatatgtgtatatacatatatgtgtatatatgtgtatatatgtgtatatacatgtgtgtatgtatatatgtgtatatatgtgtatatacatatgtgtatgtacacatgtgtatatgtatgtgtacacatatatacacat

SEQ ID NO: 47664 - DNA, 102 bp, Homo sapiens
ggaacaggtttgccaattcacgtggtaagtatataattacttttataagaaacagtcaaactgttttttttttaagttgctgtatgattttgcaaccccacc

SEQ ID NO: 47665 - DNA, 77 bp, Homo sapiens
tttggatgtatagatagaactacatatatgtatctatagatacatagtatatgtatgtatttatttatagaaacaaa

SEQ ID NO: 47666 - DNA, 58 bp, Homo sapiens; identical to SEQ ID NO: 11865

SEQ ID NO: 47667 - DNA, 67 bp, Homo sapiens
agtatatacatcgtgtgtatatatgtatatatgttatatatacatatatacacaccatgtttatatt

SEQ ID NO: 47668 - DNA, 114 bp, Homo sapiens
tgcttaggattgtcttggctatacgggctctttattggttccatatgaaatttaaagtagttttttctaattctgtgaagaaagttagtggtagcttgatggggattgcactga

SEQ ID NO: 47669 - DNA, 87 bp, Homo sapiens
gcatatcattgtaaccattttaaatctctatctattgaaagatttttcttttttaggagacggggtcaaggtggcaggcaagatggt

SEQ ID NO: 47670 - DNA, 110 bp, Homo sapiens
tgtaaatcccacttcggccactcagtagatccaagtctcggggcagctgccttagcctctctctgtctcaggtacttttaattcgtattgtacagttaggtgaatttaca

SEQ ID NO: 47671 - DNA, 108 bp, Homo sapiens
ttgttggtggtggtggtggtggttgtggtggtggcggcagcaagtaggatgtttagtagcatcgctggcctccgcccattagttatcagtagcatttcctgccctcag

SEQ ID NO: 47672 - DNA, 110 bp, Homo sapiens
tatgatgggagagtagaaagatcataagacttaagcttaaatcatatcctgtccacttagctaattgtatgttatttaagctaagttttagtttcctactctacaaaata

SEQ ID NO: 47673 - DNA, 95 bp, Homo sapiens
agcctttagtgcatttagtccaaatttattttttcttagaaaaggaaattgccatccaagagattgtgaaacttgctggattcactcatctggtt

SEQ ID NO: 47674 - DNA, 83 bp, Homo sapiens
tatatacacacacacacacactcagagatatacatacacacatctgtatgtaaatatatagatgtgtagtatgtgtgtatgta

SEQ ID NO: 47675 - DNA, 108 bp, Homo sapiens
gagttttaccaaaaattcagagttcaaacactgttgctcattgggatattttattttttgtttacaagaaaaatcctgcagctgacattcaatttttgtactaaactt

SEQ ID NO: 47676 - DNA, 228 bp, Homo sapiens
tatgtatatatctatgtatatatctatgtatatatctatatacatatctatgtatatatatctatatacatatctatatatatatctatatacatatctatatatatatctatatacatatctatatatatatatctatatacatatctatatatatatatctatatacatatctatatatatatatctatatacatatctatatatatatctatatacatatctata

SEQ ID NO: 47677 - DNA, 56 bp, Homo sapiens
atgaagtggacacaagcagagagcaagctctctgcctgactctgaattcacttcat

SEQ ID NO: 47678 - DNA, 97 bp, Homo sapiens
gcaagtgatttaactcattaagcctcagtttttatttatgtaagctaggatagtagtgcatattccatagggttatgatgagtgaaatacatcatgc

SEQ ID NO: 47679 - DNA, 90 bp, Homo sapiens
atacatactatatagaatatgcattcatatacatattctatgtatacatatatacctattatatgtatacatattctatataatatgtgt

SEQ ID NO: 47680 - DNA, 90 bp, Homo sapiens
tgtatatatatatatgtgtgtatatatatatgtgcatatatatgtatgtatgtatggagatatatatatagatatatatagatggatata

SEQ ID NO: 47681 - DNA, 73 bp, Homo sapiens
ctctggagagctgtggatacaaggatgaatagaatagaatttctaaccttgaacaattcacagtctagtggag

SEQ ID NO: 47682 - DNA, 99 bp, Homo sapiens
tcctaggctgctgtaatatcttcacctaagaattcagtgttctatgggtgcaatgttgtttgcataggggaattctttcataagaaggggaagggagtc

SEQ ID NO: 47683 - DNA, 69 bp, Homo sapiens
tctctctctctctctttcttttgagacagggtctcactctgtcacgcaggctggagtgcagtgatgtga

SEQ ID NO: 47684 - DNA, 83 bp, Homo sapiens
gggtccctggtgggggtgtgtatcccagaggcaaaaactcttcccctctcacactctgggactcacagtccttcacctgactc

SEQ ID NO: 47685 - DNA, 70 bp, Homo sapiens
agtggcaaagtggtggggtggcacttccaagatcaggatacacaaaggctgtgcctctctccctctcact

SEQ ID NO: 47686 - DNA, 87 bp, Homo sapiens
ccaggtatgacggcatacacctacagtcccagctactcaggagagtgaggtagtaggatcacttgagcctgggaggttgggctgcag

SEQ ID NO: 47687 - DNA, 64 bp, Homo sapiens
gttttgagacagtctcactctgtcatccagcctggagcgcagtggtgtgatctcggctcattgc

SEQ ID NO: 47688 - DNA, 58 bp, Homo sapiens; identical to SEQ ID NO: 31002

SEQ ID NO: 47689 - DNA, 180 bp, Homo sapiens
atatacgtatatgcatatacgtatatacgtatatgcgtatatgtatatacgcatatacgtatatgtatatatgtatatatgtgtatatatgtatatatgtatatatgtatatattcatacatatatgtatgaatatatgtatgaatatatacgtatatatatatatgaatgatggaatac

SEQ ID NO: 47690 - DNA, 119 bp, Homo sapiens
gagtgagcgttaatgttctgtagggctggtggtgtgtggcttctgattatttatttatttatttttttgagatggagtctcgctctgtcacccaggctggagtgcagtggcgcgatctc

SEQ ID NO: 47691 - DNA, 79 bp, Homo sapiens
ggctctgaacactgtgtgtctgtgagtggctctccaggtggggaccaagcagttgttgcatgattacactttcttggcc

SEQ ID NO: 47692 - DNA, 58 bp, Homo sapiens
tgaggcggagtctcgctctgtcactcaggctggagtgcagtggcgcgatctcggctca

SEQ ID NO: 47693 - DNA, 70 bp, Homo sapiens
gggagagtctctgtctctcactccatctttctggaccgaggccaggcaggtgctgtgggcatggctgccc

SEQ ID NO: 47694 - DNA, 90 bp, Homo sapiens
tctgttttgagttactctgacctcatctcccagaggcctctgtccctcccttgattgggtctctgcctcagtgtctcctcctcaaacaga

SEQ ID NO: 47695 - DNA, 87 bp, Homo sapiens
tgtaatcttggttgccagtcagcctgccatcgtgcgcctggggcgaagggacatgatgctgctggcttctttggcgggagatgggca

SEQ ID NO: 47696 - DNA, 77 bp, Homo sapiens
gatctgggcagctgtggcttccacaggtggggatttctgtgtctcacacagtgtgaagtccgggtggctgtcagttc

SEQ ID NO: 47697 - DNA, 97 bp, Homo sapiens
cccaccagggtgggagcctttggaggagacagtggagcggtgtcagagagcagtgacagcacaggtcctgctccagcagcacctggaccagggtggg

SEQ ID NO: 47698 - DNA, 86 bp, Homo sapiens
caacacattatatatatatatatatatatatatatatataaaatatatatattggatatatataggatatatatatacacacattg

SEQ ID NO: 47699 - DNA, 92 bp, Homo sapiens
gctcacatactttggactggatttgggagccttatgagtagaaccatcacaggttattccacactcactctcccagtgtctagggtctgagt

SEQ ID NO: 47700 - DNA, 98 bp, Homo sapiens
cactcatttatttttgtttgtttgtttgagttggagtctcgctccgtcactctgtcacgtggactggagtgccatggtgtgatatcggctcactgcaa

SEQ ID NO: 47701 - DNA, 68 bp, Homo sapiens
tctccctgtggcttcacatggtctgtctttttatcgagacagagtctcactgtgtcacccaggctgga

SEQ ID NO: 47702 - DNA, 56 bp, Homo sapiens
gagactgagtctcgctctgtcacccaggctggagtgcagtggtgtgatcttggctt

SEQ ID NO: 47703 - DNA, 82 bp, Homo sapiens
aaggtcaggcctaggaagtcaggcctgagtgatgctggggacggatctgctcttggtccaagcactctctggctctctcctt

SEQ ID NO: 47704 - DNA, 120 bp, Homo sapiens
ctttgttgcccacacccagcttccctggctctagcagcacagaaatattggcacagggaagcgagtctgccaatattggctgtgctgctccaggcagggtggtgaaaactaccgaggagg

SEQ ID NO: 47705 - DNA, 107 bp, Homo sapiens
gtgtatatgtgtgcatacatttgggtgtatttatatagatataaacgtatgtatatgtatgtgtatgtatgtgtgtatacatctatatctatatatgtttgcatatg

SEQ ID NO: 47706 - DNA, 58 bp, Homo sapiens
cgagacggagtctcgctctgtcactcaagctggagtgcagtggcatgatcttggctcg

SEQ ID NO: 47707 - DNA, 86 bp, Homo sapiens
tgtctctctctctcattcatatatatatatgtctctctctctcacattcatatatatatatatatagagagagagagagagagaga

SEQ ID NO: 47708 - DNA, 114 bp, Homo sapiens
gcactccagcctgggtgacagagcgagatcctgtctcaaaaaataaagaaataaaaattctttttttttttttttttgagacagagtctcgctctgtggcccaggctggagtgc

SEQ ID NO: 47709 - DNA, 102 bp, Homo sapiens
tgaggttggcaagactggaatatgacagaagtgagacaagacagggataagaaattacatcactcactttcacaactgcactgctccagacctggtagccca

SEQ ID NO: 47710 - DNA, 113 bp, Homo sapiens
gtatgtgtatgcagaatcccatttctcagtgtttttacttttcattatcttgttgtgaaaagagctcctgtggtgagagggaaggggagttgggtgttctggaacttttttac

SEQ ID NO: 47711 - DNA, 102 bp, Homo sapiens
gtgctgggattacaggcgtgagccaccgcgcccggccacttctttctttctttttttgagacggagtctccctctgtggctcaggctggagtacaatggcac

SEQ ID NO: 47712 - DNA, 117 bp, Homo sapiens
tgggctttttgtgggggagggggttggttttttgtttttttttgttttttttttttgttgttgttgttttgttttttttgagatggagtctcactctgtcgcccaggttggagtgca

SEQ ID NO: 47713 - DNA, 96 bp, Homo sapiens
caggatgggggtggggtctggacccaggtcctagagctgtccaggggggcctgaggtggcttctgtctctctgtccgtgaggacccgcccttcctg

SEQ ID NO: 47714 - DNA, 97 bp, Homo sapiens
cctgggagaggaatcttacaccagtcttttgattttaaaaataatttttattttatttattaattttttgagaccaggtcttgctctgtcacccagg

SEQ ID NO: 47715 - DNA, 107 bp, Homo sapiens
atttgcttcattgtggttttgatttttagggattgattttttaatttaattttattctataattacgttgaatatttacataataaagtcaaatccacaaagcaaat

SEQ ID NO: 47716 - DNA, 58 bp, Homo sapiens
acacatatatatatgtatatgtatatgttccaggatatatgtatatatgtatatgtgt

SEQ ID NO: 47717 - DNA, 80 bp, Homo sapiens
tgcatgtatgtatgcatgtatgtttgtatgatgtgatagatggttgcttatgtgcatatttacatgcacgtgtgcatgta

SEQ ID NO: 47718 - DNA, 108 bp, Homo sapiens
tatgcacgtttgcatgcatgcatgtttggtgggatgtatagttgtatgtatgtttacatatatgtgtacatgtatagtgggatggttgtatgtatgtacaagtgtcta

SEQ ID NO: 47719 - DNA, 115 bp, Homo sapiens
ggcacaggtgagggcagtagcttgactttgttttttatttgttgcttttttgagatggactctcactctgtcgcccaggctggagtgcaatggcgcaatctcggctcactgcaac

SEQ ID NO: 47720 - DNA, 60 bp, Homo sapiens
gtgatcccattgatgacagggaagaggacagaccctctgtgtgtcatttaggcatgtcac

SEQ ID NO: 47721 - DNA, 100 bp, Homo sapiens
accctctctcccccactgaacttacggcttcttgagtgcagggactgtcagctttctgcctgtctgtctctgggacccagcccagtgcctgtgatggggt

SEQ ID NO: 47722 - DNA, 81 bp, Homo sapiens
agaactgggaggtggggggcacaggcccccatgttctcttggtctccatactcctgcctgaccctccatctctctgtctct

SEQ ID NO: 47723 - DNA, 108 bp, Homo sapiens
cttattagttgaataactaacttgtattgtgtgcgtaaagcactcagaacagtgtctgacacttggggagcatgcaataaaagttcattattcaatcttcctgacaag

SEQ ID NO: 47724 - DNA, 86 bp, Homo sapiens
ttcctaaactagcttggctttgcagacatgtgtctctgacagcagaaaaagggcagggtccctgcatgccaggccagaaagaggga

SEQ ID NO: 47725 - DNA, 112 bp, Homo sapiens
ggaaccctccaccatgtgccatttcctcttcccaggactctctctgactctgccccaggcagggatgggaccgacccctgggaacctggtgtggcagcggtggggatcaccc

SEQ ID NO: 47726 - DNA, 113 bp, Homo sapiens
ctctgtgacttcctggctgtggctgcagtgagcagttgacttgtgtcacactcatcctcagtcatgattaggcacacccacactgtcccgctgaccacactccagaaaaagag

SEQ ID NO: 47727 - DNA, 58 bp, Homo sapiens; identical to SEQ ID NO: 3380

SEQ ID NO: 47728 - DNA, 105 bp, Homo sapiens
aggcaagctcaccagggctgagcagttgaatgtggctggtttctcactctctctggagcagtgaggcctccctctccaccagcagctccatggcaggtgtcacct

SEQ ID NO: 47729 - DNA, 107 bp, Homo sapiens
gaaaatgctatatatacatatatatataaattgtatgtgtacatatacatatatatgtgtatacacacacacacacacacatatatatatatatatatttttttttt

SEQ ID NO: 47730 - DNA, 114 bp, Homo sapiens
ctgcccctcagggaatggtccaggatgaagccaagattaatttaaattagcatttttttttttttttgagtcagagtctcgcactgtcacccgggctggagtataatggcgcag

SEQ ID NO: 47731 - DNA, 85 bp, Homo sapiens
ggaagacgggcagagtttataagagatcatgccaagaatgaattttttttttttttttttgagacagagtctcgctctgtcaccc

SEQ ID NO: 47732 - DNA, 69 bp, Homo sapiens
atctccacagactcactcactcactcttctcctgtgcagggaggagttagggtggcgtttcgggcagat

SEQ ID NO: 47733 - DNA, 139 bp, Homo sapiens
tggacacccagtcttcatagcaagggagtggtaggggaaggggcggccatctgggctgctgccacactttctctgtgtctgtggctccctgattatcattctgggccaagatagaagcagctgcgtggtggggggaaag

SEQ ID NO: 47734 - DNA, 80 bp, Homo sapiens
gacagatgcaaagcctctgtcatggaaatgttttttgttcttttttttttcttttttctgaggcagagtctcgctctgtc

SEQ ID NO: 47735 - DNA, 115 bp, Homo sapiens
attttatatattgctggatttgatttgctaattttcttaagagttttttttttaaagctatgctcataaggggtattagtctgtaatatcattttccagggttttggtacagagt

SEQ ID NO: 47736 - DNA, 94 bp, Homo sapiens
ctgcagcccaccatgaagtctgaggctagaggcacgatgggccactcagatctgggtggcctttctctctggctcactgacgggcggcgtgcag

SEQ ID NO: 47737 - DNA, 70 bp, Homo sapiens
ctgcaaggggaatggggtgctccctgactcccccgcaaggggaatggggcgctccctgtctcccaggcag

SEQ ID NO: 47738 - DNA, 80 bp, Homo sapiens
gtgcactcagctgggtctgactagagggtctgcacagagcagggtgactagaaagaccccaggtcagggcggggctgcgc

SEQ ID NO: 47739 - DNA, 66 bp, Homo sapiens
ctgagacagtgtctcactctgtctgccacccagggcccaggctggagtgcagtggtgcgatcttgg

SEQ ID NO: 47740 - DNA, 77 bp, Homo sapiens
aaaaacagggaagaatagagaaaaagaaatgtaaggctctcgttttcttttcttttctttctttctttctttttttt

SEQ ID NO: 47741 - DNA, 86 bp, Homo sapiens
tgagatggagtcccactcactcacccaggctggagtgtagtggcatgatcttggctcactgccacctctgcctgctggattcaagc

SEQ ID NO: 47742 - DNA, 80 bp, Homo sapiens
accttggcctcccaaagtgctgggattgcaggcgtgagccaccaagcctggccaacatttttatttttttgagacagggt

SEQ ID NO: 47743 - DNA, 117 bp, Homo sapiens
gagacgggacagtttcctctggctcctcattatttcctcaaatctatggctactcaggaggctgaggtggaaggatctattgagcttgggaggcagaggttgcacatgcctgtgatc

SEQ ID NO: 47744 - DNA, 82 bp, Homo sapiens
tgccagcgtcgtgctttacctgttaaacagttacgagtctggttggtacagccagactgtctctgtctgcatgagccgggta

SEQ ID NO: 47745 - DNA, 89 bp, Homo sapiens
tgattttgtgtcctgcaactttactgaatgtgttgatcagttctaatagctttttggtggagttttaggtttttccaaatataagatca

SEQ ID NO: 47746 - DNA, 115 bp, Homo sapiens
agggtcaggggatggtggagggcacctgggcctcccctggggaggtgactcactgcctgtcaccgtgtccccacagctccctgttcagcaatgtccgcttcctgctcctggtcct

SEQ ID NO: 47747 - DNA, 58 bp, Homo sapiens; identical to SEQ ID NO: 1868

SEQ ID NO: 47748 - DNA, 71 bp, Homo sapiens
caagcctcagtatctctgtatgtctctatctgctattatcagagggagccaagcagaactgggtcagcttg

SEQ ID NO: 47749 - DNA, 139 bp, Homo sapiens
gctacattcctcttccctgatgttctgtattcactcattttctaggatttgtccttaaaatttgagtttttattttgatagatggcgaatggcaggaaaggaggaggaagagggtgacggagaggtgaggagagagggc

SEQ ID NO: 47750 - DNA, 66 bp, Homo sapiens
ccccagtgcagcacagccaggtttgaagtgaggtcaccagcagtggttgtggctgaaccagagggg

SEQ ID NO: 47751 - DNA, 156 bp, Homo sapiens
ctagctgatgtgtggaactctgtctctcatggatgttaactttattttttattttttaattttaattttttttgtggggggacagagtctcactctgtcacccaggctggagtgcaatggtgtgatctcagctcactgcaacttctgcttcctggg

SEQ ID NO: 47752 - DNA, 67 bp, Homo sapiens
ctctctctgggtctgtctccctcccccaacactgggaaaggtgtcggaactgcctctctcaggagag

SEQ ID NO: 47753 - DNA, 143 bp, Homo sapiens
ggacagccgtggacaatgggaggggagcgggcagggtccataggagggccctgggccccggtgtctctgtgtctgcgtgtctgtgtgtccaagcacgccaaacgtggcatctccagtgcccgggactttggacagtaaacaga

SEQ ID NO: 47754 - DNA, 99 bp, Homo sapiens
cagtgggcctgagttacctgagagctttcttttttcttttaggcagagtctcactctgtcagccaggttagaaggcagtggcgtgatctcggctcactg

SEQ ID NO: 47755 - DNA, 89 bp, Homo sapiens
gcttgtgtgtgcacatgtgtgcctgtgcagcctgtgtgtgtgtgtgtgtgtggcatgggtgaggacacgcgcatctctgtgagcatggg

SEQ ID NO: 47756 - DNA, 58 bp, Homo sapiens
tgagacatggtctcactctgtcacccagattggagtgcaatggtgtgatcatagctca

SEQ ID NO: 47757 - DNA, 116 bp, Homo sapiens
gccccgggctgggcagagttagatccttgcgcgtgtgcatctgtgcgtgtgtgtgcgcgtgcgcatgtgcacgcgtgtgcgtgtgtgtgatgtggattgaggctgggcccttgagc

SEQ ID NO: 47758 - DNA, 115 bp, Homo sapiens
ggctttgggaaggcatgtggagaattctaagtggctgggaatctttttctaaaattttttaaacttatttttgagatgggatcccaggctggggtgtagtgtcataatcatagtt

SEQ ID NO: 47759 - DNA, 79 bp, Homo sapiens
gaaatcccactgtccctcactggctcgggcaccacagattccagagcagagactcagcaaagggagaggggacattttc

SEQ ID NO: 47760 - DNA, 134 bp, Homo sapiens
ctcaaactctgggctcaggcaatccacctctctgctcttcttttttttttttttttgagttggagtctcactctgtcactcaggttggagtgcagtggcgccatctcagctcactgcaacctctttctcccggg

SEQ ID NO: 47761 - DNA, 76 bp, Homo sapiens
agcctgggcaacaagagtgaaactccgtctcaaaaaaaaaaaaagagagacagtgtctcactctgtctctcaggct

SEQ ID NO: 47762 - DNA, 58 bp, Homo sapiens
tgagatagggtctcactctgtcacttaggctggagtgcagtggtgtgatcatagctca

SEQ ID NO: 47763 - DNA, 90 bp, Homo sapiens
ccatgggagggccgaggggcagaaggctcccatctctttagcgttttgggcagctcactcagtctctcatagccttgacttctcccatgg

SEQ ID NO: 47764 - DNA, 118 bp, Homo sapiens
tgtgtttagatatattttggtttagtttatttttttcaggcaaggtctcactctgtcacccagactggagtataacggtgtgatctctgctcactgcaacctccacgtcctgagctca

SEQ ID NO: 47765 - DNA, 117 bp, Homo sapiens
tcttcgcagaagctgagctgactatgcctccccgcatcccctagggcattggtgtaaagctggagacccactgccccaggtgctgctgggggttgtagtctgacccgactgggaaga

SEQ ID NO: 47766 - DNA, 59 bp, Homo sapiens
tgagacagggtctcactctgtcactcaggcaagagtgcagtggtgcgatcatggcttca

SEQ ID NO: 47767 - DNA, 81 bp, Homo sapiens
agccagggagaggaaggtgaagggtggggggcggtgcccctgtaaccccacccatcctatgcctctctctctctttgagct

SEQ ID NO: 47768 - DNA, 116 bp, Homo sapiens
ctgagcgatgcccattctgcctgttgacacaggaggcttctgtagcttttttttttttttttttttttaaacagagtctcactcacccaggctggagtgccgtggcacgatctcag

SEQ ID NO: 47769 - DNA, 85 bp, Homo sapiens
gcctctcaaagtgctagattacaggtgtcagccaccagcacttggccgtcttcctctaatttttaattttttcactttgagaagc

SEQ ID NO: 47770 - DNA, 71 bp, Homo sapiens
ccgtcctgggcaagattggcactctttttttttttgagatggagtctcgctctgtccctcaggctggatgg

SEQ ID NO: 47771 - DNA, 86 bp, Homo sapiens
caaaactaggggcatgcggtctctttttaagaattttttttttttttttttttttgagatggagtctcgctctgtcacccaggctg

SEQ ID NO: 47772 - DNA, 73 bp, Homo sapiens
ctgggcagggtggcaaacacctctagttgggagctactcaggaggctgaggtagtaggatcatctgagcccgg

SEQ ID NO: 47773 - DNA, 56 bp, Homo sapiens
gagactgagtctcacactgtcgcccaggctggagtacagtggtgcgatctcagctc

SEQ ID NO: 47774 - DNA, 58 bp, Homo sapiens
tgagactgagtctcgctctgtcacccaggctggagtgcagcggcacgatctcggctca

SEQ ID NO: 47775 - DNA, 145 bp, Homo sapiens
tatatatatatatatatatatatatatatatatatatatacacacacacacacatatatatgtgtgtatatatatgtatatatatacgtgtatatatgtatatatatacacgtatatatatgtgtgtgtgtgtgtgtgtatatat

SEQ ID NO: 47776 - DNA, 96 bp, Homo sapiens
acacacacacacacatatatatacgtgtatatatatacatatatacacgtatatatatacatatatatacacacatatatatgtgtgtgtgtgtgt

SEQ ID NO: 47777 - DNA, 89 bp, Homo sapiens
gccagcctccccattccctttcatgagtgcaactccctgtgcggcccccaaacagagtgctgagtgagaacagaagggagggcccgggc

SEQ ID NO: 47778 - DNA, 84 bp, Homo sapiens
tgcacagcacctgttgctgacccgccctcgccccttgtgtcgggtggaggagcagctgggcagagaacagagagagctggggca

SEQ ID NO: 47779 - DNA, 79 bp, Homo sapiens
gctacttgggaggctgaggtggaaggatcacttgagcctgggaggccaaggctacagtgaaccgaaatcatgccgtagc

SEQ ID NO: 47780 - DNA, 123 bp, Homo sapiens
tgacagttatcatggaagccagccatgtgtcagaaaaaacatgtgatgaacgatttattttataatttaaaaaaaagtattttattttagatttggtggtatatgtgcaggtctgttacatgg

SEQ ID NO: 47781 - DNA, 68 bp, Homo sapiens
gttataggaatttggagaagagaggcactgctgacgtgtcacttgctctctgagtgtcactagtggac

SEQ ID NO: 47782 - DNA, 118 bp, Homo sapiens
gatgaggaaactgaggctctgagagggccgaggcagctcccagtcatgcagacagaagtggctgagctgagacctaaaccccagtgccctgtcatgtcaccccttccagtgtcctttc

SEQ ID NO: 47783 - DNA, 66 bp, Homo sapiens
gaggctgcctggctccctgggtccccagcctgagggcttgccacggggtggcctaggcccagcctc

SEQ ID NO: 47784 - DNA, 83 bp, Homo sapiens
tgggcccagggaggcgagactttattacttttgagataattttttttttcttttttcgagacagagtctcactctgtcgctca

SEQ ID NO: 47785 - DNA, 131 bp, Homo sapiens
caggtggtcttgtgtgactggcttccttcactcaccataatattttcaaagttcattcttttttttttttttttgagacggagttttgcgctgtcacctgggctggagtgcagtggcacgatctctgctca

SEQ ID NO: 47786 - DNA, 91 bp, Homo sapiens
ggttcgcagctggagggcaggggtgggggaaacaggaagggagccactgctgggtgccctcaccctcacagcctcactctgtctgcctgcc

SEQ ID NO: 47787 - DNA, 85 bp, Homo sapiens
gttgctaacttcaaacgtggaacgctttgatgactgctggctctcatgctgtctcactgacatccacgtactatgctttagtggc

SEQ ID NO: 47788 - DNA, 81 bp, Homo sapiens
tttgagatggagtctcactctgtcacccaggctggagtgcagtggcgcaatctcagatcactgcaagctctgcctcccggg

SEQ ID NO: 47789 - DNA, 139 bp, Homo sapiens
ggtgacagagtgaaaccctgtctcttaaaaaaaaaaaagaaaaaaatttaaatagttttaacacaaacttttttttttttttgagatggagtctcactgtgtcacccaggttggagtacagtggtgtgatctccgctca

SEQ ID NO: 47790 - DNA, 171 bp, Homo sapiens
acatgctgtctcaaaaaatatatatatatatacgtgtatatatatatatgtgtatatatatatgtatatatatgtatgtatatatatacgtatatatatgtatatatatgtatgtatatatatacgtatatatatgtatgtatatatatatgtatgtatatatatatatat

SEQ ID NO: 47791 - DNA, 91 bp, Homo sapiens
gagagtgagactccgtctcacaaaaaataagagaaaatcaagacaaactttttctttttcttttttttttttgagacggagttttgctctt

SEQ ID NO: 47792 - DNA, 93 bp, Homo sapiens
ggtgggggaagatgctaatgagagaggctatggatgtggggaggtggggttacatggatctctgtatctttctctcagccttgctgtgaacct

SEQ ID NO: 47793 - DNA, 96 bp, Homo sapiens
tagtcacacaataataaagtcctagtccttttctaaaaattttaatttttaaatttttttttttagaggcagagtctggctgtgttgtgcaggcta

SEQ ID NO: 47794 - DNA, 59 bp, Homo sapiens
aattgagacagagtctcactccgtcacccaggctggagtgtagtgatgcaatctcggtt

SEQ ID NO: 47795 - DNA, 71 bp, Homo sapiens
ggctgtctctactgagagacaagagtgggaactccctccaatcttacctcttttggtaaccaaggactacc

SEQ ID NO: 47796 - DNA, 70 bp, Homo sapiens
agcggcagctggcgtgtctgactgcacagtggccggaccccactctcgctcacacaccccttgctgctcc

SEQ ID NO: 47797 - DNA, 92 bp, Homo sapiens
tttttttgagactgagtctcactctcactctatcacccaggctggagtacagtggtgcgatctcggctcactgaaacctgtgcatcctgggt

SEQ ID NO: 47798 - DNA, 103 bp, Homo sapiens
tgctgggattacgggtgtgagctaccacgcccaggcaagttttttgtagagacactctctcactatgttgcccaggctggtcttgaactcgtggtctcaagca

SEQ ID NO: 47799 - DNA, 69 bp, Homo sapiens
cactacagacaagcaatttgtttacaatgacacatttatttctgagcaaattgcttgtttatttatgtg

SEQ ID NO: 47800 - DNA, 89 bp, Homo sapiens
agtttggcaggagaaagcaaaagtaaggaagagtcaacccactttgtcttttttttttttttgagatggagttttgctcttgtcgccct

SEQ ID NO: 47801 - DNA, 91 bp, Homo sapiens
agcaatgggtcaacaatggagcaaactttatattttattttattttatttatttattttttgagatggagtcttgctctgtcacccaggct

SEQ ID NO: 47802 - DNA, 86 bp, Homo sapiens
tcccactcgccgctgctggcctcagcactgtgaccacacagggaaatggtttgccctggggcagtagctggggtctggcgagggga

SEQ ID NO: 47803 - DNA, 61 bp, Homo sapiens
caccttctctgcgtctgtctgtctgcatcccccctgcaggagaatgggcgcttagcatgtg

SEQ ID NO: 47804 - DNA, 112 bp, Homo sapiens
atatatatatatataaaaatatatatatataaaacatgtatatgtgtatatatatgtatacatgtatacatatatatgtgtgtgtatatatatatgaaatgtataaatgtgt

SEQ ID NO: 47805 - DNA, 84 bp, Homo sapiens
tttgagacagggtctctctctgtcaaccaggctggaatgcagtagtgcaatcacagctcacagcctcgaattcctggcctcaag

SEQ ID NO: 47806 - DNA, 76 bp, Homo sapiens
aacagagcaagactccatcactaaaaaataaataaataaataatttttttgttttgaggtggagtctcgctctgtt

SEQ ID NO: 47807 - DNA, 108 bp, Homo sapiens
tgaccaagacttggctatttgttacaagaatattctctcagctttaggttgtagtttgtttacaaaccaagttaggttacagttctctatctacagaggcagccttag

SEQ ID NO: 47808 - DNA, 94 bp, Homo sapiens
tgtgcatatatatgtaaatctatatgatatatatgtgtatatatctatatctatatatacaatatatctatatatacatatctctcatgctaca

SEQ ID NO: 47809 - DNA, 87 bp, Homo sapiens
tttgaattggagtctcactctgtcacccaggctggagtgcaatggcacgatctcagcttactgcaaagttcacctcccaggttcaag

SEQ ID NO: 47810 - DNA, 74 bp, Homo sapiens
tttacctggagtgggatggtaagccattggagggttcgagagaggactgacagtggtctaacttaaatggtaaa

SEQ ID NO: 47811 - DNA, 117 bp, Homo sapiens
agcttgagtccttttcccctctggcctctgtgatcaataatgggtattcttttttttttttttttctgagatggagtctcactctgtcgcccaggctggagtgcagtggcgcaatct

SEQ ID NO: 47812 - DNA, 65 bp, Homo sapiens
ccaaagctgcaggtatcaggctggagaggaccccaaagagcctctcacagactctgtagtaatgg

SEQ ID NO: 47813 - DNA, 58 bp, Homo sapiens; identical to SEQ ID NO: 1265

SEQ ID NO: 47814 - DNA, 103 bp, Homo sapiens
ggaagagcccagatctcagtccctctctgtctctacctctgtccctctctgctatgctgcttaaaagaggctgagaaaagaatagctgagccaggcattttcc

SEQ ID NO: 47815 - DNA, 72 bp, Homo sapiens
ggtggaggttgaggctccatctcaaaaaaaaaaaatttcctatttttagagtcagggtctcactctgtcacc

SEQ ID NO: 47816 - DNA, 84 bp, Homo sapiens
ggggatgggagagtgtgtgatctgagaggcagctttgaagagtagacgctgtgtgcctatctctagttacctctctctctcttt

SEQ ID NO: 47817 - DNA, 96 bp, Homo sapiens
atggtggtgtgtgtctgtagtctcagctattcaggaggctgaggtaggaggatcacttgagcccaggggtttggggctgcagtgagctatgattat

SEQ ID NO: 47818 - DNA, 86 bp, Homo sapiens
gacatggtgaaaccctgtccctactaaaaatacaaaagttattttgtattttgtattttttttttgagacagagtctcactctgtc

SEQ ID NO: 47819 - DNA, 68 bp, Homo sapiens
cctgggttcaggcgattcttttttttttttttttttttttgagacggagtctggctctgtcgcccagg

SEQ ID NO: 47820 - DNA, 87 bp, Homo sapiens
cagtgaggtacctcttgaggggggccccaatatttctcttctttttttttttttttgagatggagtctcgctctgttgcccaggctg

SEQ ID NO: 47821 - DNA, 58 bp, Homo sapiens
tgagatgcagtctcactctgtcacccaggttggagtgcagtggtgtgatctcagctca

SEQ ID NO: 47822 - DNA, 106 bp, Homo sapiens
tcaataataaatgtgaactatttaaagaaaagaatgtctttttcttattgtgaaacaacagtttcccttgaagagtttgagattcttaggagaatttagagattga

SEQ ID NO: 47823 - DNA, 93 bp, Homo sapiens
atatatatgtgtatatctgtgtacacattgtgtgcacacatgtgtatgtgtatatgtgtgcatgtatgtgtccacgtgtatgtgcatgtatgt

SEQ ID NO: 47824 - DNA, 105 bp, Homo sapiens
tgggttagggggcacggagggccagaaagtcccctttggagcgctggactctctcgctgactcctaccccaccccggcctggggtttcagagaaggggtccaggc

SEQ ID NO: 47825 - DNA, 85 bp, Homo sapiens
cactgtgtctctgtgtaggagtttgatgattcttgaaatagttcaaactttttcattattattatatctgctatggtgatctgtg

SEQ ID NO: 47826 - DNA, 62 bp, Homo sapiens
gcctgcacatgtgtgcacgtgtggacctgtgtggtgtgtgctgagtgtgtatatgtgtgtgc

SEQ ID NO: 47827 - DNA, 124 bp, Homo sapiens
ggggttggggttcttggagggtgaatgtacgggaagggagcccttttggagcactggttctgcctgggtccctctgtgcctaactctccttccctgctcctctctttctccccttcacagtggc

SEQ ID NO: 47828 - DNA, 95 bp, Homo sapiens
cagctggggacaagatactcgtacctgctgtgataaagatgtacaaataactcttttttttttttagacaggatctcactctgtcacccaggctg

SEQ ID NO: 47829 - DNA, 119 bp, Homo sapiens
gcatcttatcctggtctaagggatgaggtgactgggagtgtcagagacactctgggactggccatccaggtgctctgcatccagttccagcgttgagtgggcgagggtggacaacctgc

SEQ ID NO: 47830 - DNA, 61 bp, Homo sapiens
gctggaactggatgcagagcacctggatggccagtcccagagtgtctctgacactcccagt

SEQ ID NO: 47831 - DNA, 83 bp, Homo sapiens
ggccagcgactcagcctctctgtgcctcccgggttgctgtgagggttacaggagatgcacagagggccctgagcttggtggct

SEQ ID NO: 47832 - DNA, 113 bp, Homo sapiens
gttgcaactttccacaagcaggtaccttcaacatgcctttttactttttttcttttttttctttttttttgagacggagtctggctctgttgcccaggctggagtgtagtggc

SEQ ID NO: 47833 - DNA, 89 bp, Homo sapiens
ggcagaaaagagacaattgtttcatgaaaaccgagactttggaaagtctttttttttttttcttttttgagacagagtcttgctctgtc

SEQ ID NO: 47834 - DNA, 89 bp, Homo sapiens
gaggggcctcaccagttctcgttgttgatgtggtccccgaaccctggtgtgtcaatcactgtcagcttcatccggacgcctttctcctc

SEQ ID NO: 47835 - DNA, 73 bp, Homo sapiens
ggtggcagagaccatccctcctgaaacttttttttttttttttttttttgagatggagtctcgctctgtcacc

SEQ ID NO: 47836 - DNA, 96 bp, Homo sapiens
ggcatcattaggggagctgtctgtctctctatccctggctggcgtggcccggcaggaggcgaggctgatattttcaggagacctggtgatttgacc

SEQ ID NO: 47837 - DNA, 114 bp, Homo sapiens
tttttcgtagagtctggtctgtctggatttcaacaggctaatggccagaaagaaatcactgtctactgaacagaagctagtttacgtcctgataaatagaaagatacagaaggg

SEQ ID NO: 47838 - DNA, 73 bp, Homo sapiens
aggggcaggcccctcagtctctgtctgaccccagacatctcctctgatgcagactgtgctgtgcactgtccct

SEQ ID NO: 47839 - DNA, 76 bp, Homo sapiens
ccctgtgtctctgagtctcaaatcttctgcctttctctcatgaggacacttgttattggattcagggttcacttgg

SEQ ID NO: 47840 - DNA, 58 bp, Homo sapiens; identical to SEQ ID NO: 605

SEQ ID NO: 47841 - DNA, 67 bp, Homo sapiens
ctgtcacccaggctggagtgcagtggtgcaatcacagctcactgctgtctctgtctcctggactcag

SEQ ID NO: 47842 - DNA, 76 bp, Homo sapiens
tctgggtgggataagagggatttactttaaaaaaaaatttttttttttgagatggagtctcgctctgtcacccagg

SEQ ID NO: 47843 - DNA, 110 bp, Homo sapiens
ctgtgttgtagctattcctattgcagccaatttctttttttctttcgctctttttttttttttttttttttgagacagagtctggctgtgttgcccaggctggagtgtag

SEQ ID NO: 47844 - DNA, 86 bp, Homo sapiens
gcatgtgagagaagtgtgtgtgcatacatgttgcatgtacatgtgtgcatgtttctatgtgtgtgtgtcatgtgccacacatgtgc

SEQ ID NO: 47845 - DNA, 80 bp, Homo sapiens
cactcggctccactgacgacaggaacaggcagggaggctttgtgtatgcgtgtgtgcctgtgtgtgtgagggcttctgtg

SEQ ID NO: 47846 - DNA, 129 bp, Homo sapiens
gactgtcttggaagttttattgtagttcccctcgaagcagccgcaggtgctcactggctcactgacagcgaggaggtgatgcaatgggcgcagtcattcctcactgccatcggcgtgtgcagcttgggg

SEQ ID NO: 47847 - DNA, 113 bp, Homo sapiens
atgtatatgcatagaaatgaatatctgtatatgtgtgtgtagatatgaatatatgtatatgtgtgtaaactgatataaatatatgtatatgtgtgtagacaaatatgaatata

SEQ ID NO: 47848 - DNA, 96 bp, Homo sapiens
gccctgagtggggaagggctcggtgtgttgaaagaactgaaagtggtcagtgggctcggacagtggtgagcagggtgagccacgcaggcacagggc

SEQ ID NO: 47849 - DNA, 80 bp, Homo sapiens
agcaacttggatgcagctggaggccactatttttttttttttttttttttgagatggagtctcgctctgtctcccaggct

SEQ ID NO: 47850 - DNA, 83 bp, Homo sapiens
ccagctttctgtgttgctgttgccatttattatttttactttaaaaatttttaagttccaggtacatgcgcaggatgtgcagg

SEQ ID NO: 47851 - DNA, 117 bp, Homo sapiens
tacagtagtctgcagtggtgtatggtagcgtacagtagtctgcagtggtgtatagtagtgtacagtagtctgcagtaatgtatagtagtgtacagtagtccacagtagtctccagta

SEQ ID NO: 47852 - DNA, 71 bp, Homo sapiens
ggcgattcacctccaaagtccgctaatcccaagaggctccctctgtggttccagcttgttgtgtggttgcc

SEQ ID NO: 47853 - DNA, 68 bp, Homo sapiens
ttgacacacacacacacaccgcttggagacatgtctctaagtagacactgtgaggtgtgggtggccaa

SEQ ID NO: 47854 - DNA, 86 bp, Homo sapiens
tatctatgtgtgtgtgtatatatatgtgtatatatatgtatacatatatgtgtatgtatatgtatatgtgtatatatatatgaaga

SEQ ID NO: 47855 - DNA, 106 bp, Homo sapiens
ggccgagactctggaccggtgggcgagggcagggcagggtgggtgaattactggaagccccactggctctgtctctctgccaagctgcccactgcattctttggcc

SEQ ID NO: 47856 - DNA, 96 bp, Homo sapiens
gcagcagggttcattcactacctgttcttttttttttttttagatggagtcttgctctgtctcccaggctggagtgcagtggtgtgacctcggctc

SEQ ID NO: 47857 - DNA, 84 bp, Homo sapiens
ccagctacgctggaggctgaggcacgagaatctctcttttttttttttttttgagatggactctcgctctgtcacccaggctgg

SEQ ID NO: 47858 - DNA, 95 bp, Homo sapiens
gggaggaaatggctgcactgtcagggtgtgggaggggcatgggctaggcccttctggccctgatctgacagaggacaggcccccaggagcctcct

SEQ ID NO: 47859 - DNA, 80 bp, Homo sapiens
cagctgtgccagccgtactcgaggtgtgtgcagggtgtgtgtgaacacagtgcgtgcatgggtgcgtgtctgcaggggtg

SEQ ID NO: 47860 - DNA, 93 bp, Homo sapiens
gaggtgagaaagtcggcctgtctcgcaagcatgtgtctctcctggggcctgtgctacgcatatcagagacagcacacacaccgacccgcactc

SEQ ID NO: 47861 - DNA, 58 bp, Homo sapiens; identical to SEQ ID NO: 2263

SEQ ID NO: 47862 - DNA, 58 bp, Homo sapiens
tgagatggagtctcactctgtctcccaggctggagtgcagtggtgtgacctcagctca

SEQ ID NO: 47863 - DNA, 71 bp, Homo sapiens
gggaccagcatggttgggttctggtgaggaccctcacctgggttatagactctgacttcttgctgtgtcct

SEQ ID NO: 47864 - DNA, 98 bp, Homo sapiens
gcccaggttggtctcaaactcctggcctcaatctgtctgtctgcctgcctcggccttccagagcattgagattataggtatgagtcaacaaaccaggc

SEQ ID NO: 47865 - DNA, 65 bp, Homo sapiens
gacggagaagaaagagagctctgggagggacccaacatcagcaggactcttttttttttttttcc

SEQ ID NO: 47866 - DNA, 70 bp, Homo sapiens
ttgtctgtttgagacagtctcgctctgtcacccaggctggcgtacagtggcgcgatctcaatcactgcaa

SEQ ID NO: 47867 - DNA, 93 bp, Homo sapiens
gagaagtttcccactctgtctgcaagctacagacctggctacctgtggttctgagagctgagtgaggagaagctgggggtgggagaagtcctc

SEQ ID NO: 47868 - DNA, 81 bp, Homo sapiens
tcatggaagctcaatttctgacctaaaaaaagatgcagtgaatttctttttttgagtcagtgactgttgttttttttttga

SEQ ID NO: 47869 - DNA, 87 bp, Homo sapiens
gcagtggcgacatgggcgaggctgtggtttttacttttttttttttttttttttcccgaacagagtctccctctgtcgcccaggctg

SEQ ID NO: 47870 - DNA, 103 bp, Homo sapiens
accagcttgggcaacatagtgagaccctgtctctacaaaaaaattttggtttttttgtttttttttttgagacggagtcttactctgtcacccaggctagagt

SEQ ID NO: 47871 - DNA, 74 bp, Homo sapiens
agcctggatgtcccagctcttgcagagggagggtttgcctgcctctgcctctgtctctttgttctgtccgggct

SEQ ID NO: 47872 - DNA, 110 bp, Homo sapiens
tgcaaagtgctaggattacaggtgtgagccaccacatgcagcctagactagaatatttattttttagggtgggcgcggtggctcacgcctttaatcgcagcactttagca

SEQ ID NO: 47873 - DNA, 116 bp, Homo sapiens
cactgtctctctgtctggtttgcaaataaaactccaactcaatggacttaagtaagacagattttttttttttttgagatggagtcttgctctgtcacccaggctggagtgcagtg

SEQ ID NO: 47874 - DNA, 58 bp, Homo sapiens; identical to SEQ ID NO: 3380

SEQ ID NO: 47875 - DNA, 127 bp, Homo sapiens
cctgcaacatcaggttcacatactgtaattgtgtgactatccctgcaacatcaggttcacatattgtaattgtgtgactatccctgcaacatcaggttcacatactgtaattgtgtgactatccctg

SEQ ID NO: 47876 - DNA, 117 bp, Homo sapiens
ccatgtgagaagcagacacacaaacctgtggctgacatcatgatgatgatgatgatggtgatgatgatgatgatggtgatgatgattgccactgttgttgttgggtggactctaggg

SEQ ID NO: 47877 - DNA, 176 bp, Homo sapiens
atacatgtatacatatacatgtatatatatatgtatacatatacatgtatatatatatgtatacatatacatgtatatatatgtatacatatacatgtatatatatacatatacatgtatatatacatatatatgtatgtgtatatatatgtatatgtatacatatatatatagta

SEQ ID NO: 47878 - DNA, 98 bp, Homo sapiens
tatatatatgtatacatatacatatatatacacatacatatatatgtatatatacatgtatatgtatatatatacatgtatatgtatacatatatata

SEQ ID NO: 47879 - DNA, 78 bp, Homo sapiens
tgtatacatatatatatacatgtatatgtatacatatatatatacatgtatatgtatacatgtatgtatatatataca

SEQ ID NO: 47880 - DNA, 85 bp, Homo sapiens
ctgggaatacaggtgtgtgccacaatgcctgtctgatttaaaaataaattttttttttgagatggagtctcacactgtcacccag

SEQ ID NO: 47881 - DNA, 74 bp, Homo sapiens
gtgtacacgtgtacagggactgcatgtcttgtgagtgtgcatgaacagggctgtgtgtgtgtgtgtgtgtgcat

SEQ ID NO: 47882 - DNA, 61 bp, Homo sapiens
cctagaggccgacggcaacccaaccagcctcatcatcactgcgtgtcactgtgcctctggg

SEQ ID NO: 47883 - DNA, 82 bp, Homo sapiens
ggtctctccatcagttccagaagaacacgccagtccacgttgccccagcctcctggttctgtcactgactgactggtagatc

SEQ ID NO: 47884 - DNA, 71 bp, Homo sapiens
aggcagaggttgcagtgagccgagatcgcgccactgcgctccaacctgggtgacactgtgagactctgtct

SEQ ID NO: 47885 - DNA, 58 bp, Homo sapiens
tgagaccgagtctcactctgtctcccaggctggagtgcagtggtgcaatctcggctca

SEQ ID NO: 47886 - DNA, 85 bp, Homo sapiens
cgtcctccctttcctgaaagacactctctttgactcattggccagatctggggatcacctataggtaaggagaagagggagggtg

SEQ ID NO: 47887 - DNA, 101 bp, Homo sapiens
ggttagctctttctgcaattgttctatttcacttgttctatattattattctagagagaactgtgtgattgttagtgcggatctgtggtactgctcccacc

SEQ ID NO: 47888 - DNA, 96 bp, Homo sapiens
gtcattcttacagaagaacagactgttctcagccagtgtctctctctccactaaagtgagcctggggtcgtttcgtcttgagggactctgtcctga

SEQ ID NO: 47889 - DNA, 97 bp, Homo sapiens
gcatgtgtataggtacatgtgcatccatgtgtgtctgtgtgtctatgtgagcatctacgcatgcactgcatgtaggtgtatgtgtgcatccatgtgt

SEQ ID NO: 47890 - DNA, 83 bp, Homo sapiens
gcttctcaggggacagaggcaccaacttttaccaaacactggaatagaaggaagctccgtctgtctgtccctgggttaacagc

SEQ ID NO: 47891 - DNA, 107 bp, Homo sapiens
ccaaaggaaaccccatacccattagtggtcagtctgcatccccggcacccacccatttgctctctgtctctgtgggtctgcctatcctggacattgtgtatcagtgg

SEQ ID NO: 47892 - DNA, 110 bp, Homo sapiens
gtgcacacggtgccaggtgtgtgcagtgtgtgcgtgtgtgttgtgttgtgtgtctgtgtctgggtggggggatggggtggcaagcgcatgagtgtgcctgtgagtgtgcc

SEQ ID NO: 47893 - DNA, 80 bp, Homo sapiens
cctttatcaactgaacactcccacagccacacggacaggattccttccagtctgtgtctgtctgagcccagaaaaagagg

SEQ ID NO: 47894 - DNA, 67 bp, Homo sapiens
tgagatagagacagaagaaagattggaaggaaatccccaaagcttaacagtgtctgtctctgtgtca

SEQ ID NO: 47895 - DNA, 58 bp, Homo sapiens; identical to SEQ ID NO: 47

SEQ ID NO: 47896 - DNA, 73 bp, Homo sapiens
cagatgccagcctctggctctgtgtggctgtatgactacgggaccacccacggggagatggagggggtgcatg

SEQ ID NO: 47897 - DNA, 112 bp, Homo sapiens
cagttgatgttgcttggagtgtgaggggggaatgggaagttatcgggcttttttttttgctttttttttttgagatggagtcccactctgtcacccaggcggcagtgcagtg

SEQ ID NO: 47898 - DNA, 78 bp, Homo sapiens
gttgttgtttttttgagatggagtctcactctgtcacccaggctggagtgcaatggcgcgatcttggctcactgcaac

SEQ ID NO: 47899 - DNA, 56 bp, Homo sapiens
tgagacagagtctcactctgtcgcccaggctggagtgcagtggtgatctcggctca

SEQ ID NO: 47900 - DNA, 151 bp, Homo sapiens
gctgctgactgatgagggtggtggttgctgaaggctggggtggctgtggcaattttttttttttttttttgagacaggctctgactctggctctgtcacccaggccggagtgcagtggtgtgatcttggcttattgcaaattcagcctcct

SEQ ID NO: 47901 - DNA, 97 bp, Homo sapiens
agtgttacctggacgagtaagcccagtgtgggagtgtgggtgtgtgggtctgcagtcacaggctctgtctttgcgatgggatgccatgggaaacgct

SEQ ID NO: 47902 - DNA, 74 bp, Homo sapiens
ctgccccctggccactcagagagctgggggaggccgggatcttccccagaacactgagtgcacacacggggaag

SEQ ID NO: 47903 - DNA, 58 bp, Homo sapiens; identical to SEQ ID NO: 1725

SEQ ID NO: 47904 - DNA, 109 bp, Homo sapiens
ctgccgtcccacctgcttatgctgccacatagcatttatgtctgtgttgtgtttcccagagtgcagagtgaggactgtggcccggtgggggcgtctcctgcctctggga

SEQ ID NO: 47905 - DNA, 67 bp, Homo sapiens
gggtggaggtggtttcctgttttttttgttttttttttttttgagacagagtctcgctctctcaccc

SEQ ID NO: 47906 - DNA, 132 bp, Homo sapiens
catatatttgtacagattacagactgtatactttgtacatagtatacattgtagacatatttatatgtatatacagtgcataaaatgtattctctgtatgcatttgtatacattatgtattgtatacatata

SEQ ID NO: 47907 - DNA, 87 bp, Homo sapiens
ccagcctgggcaacatctcaagaccctgtctctacgaaaaaaaatttttttttttgagacagagtctcgctctgtcgcccaggccgg

SEQ ID NO: 47908 - DNA, 65 bp, Homo sapiens
gggatgctctggacagtcattctcatattgtggtcagggccagagagtagagagttagctttccc

SEQ ID NO: 47909 - DNA, 81 bp, Homo sapiens
acagcacagacagagctcagactggctgtgtgtggggtggcccacaagacagcgagcctgcttgcgctgccgttgtgctgt

SEQ ID NO: 47910 - DNA, 114 bp, Homo sapiens
agtttccaactcgtcttcatccttgctagacagcaaataatagtccatggagagaaatgtttagacaatgtgttgtagaaaatgaaagtgcaaatgggtgaaagttaggaaagt

SEQ ID NO: 47911 - DNA, 109 bp, Homo sapiens
tgatggtgcaactgcgtagagggaggggtttggttttcatggtgtatgagaaagcgcatagtgtctacaagtaacctttcgctgctattcatggggcagggtataagca

SEQ ID NO: 47912 - DNA, 112 bp, Homo sapiens
gcctgggtgacagagctagattctgtctcaaaataaataaattaattagttaattcacttgtttctttttttcaaattttttttagatggagtcccactctgtcacccaggc

SEQ ID NO: 47913 - DNA, 106 bp, Homo sapiens
agagtggaggggtcgccaggtggtctgggggcccatccctaggccggggatctgagtgcctctgtgcctgcccgatcacggactctcacggacactcctaggtgcc

SEQ ID NO: 47914 - DNA, 76 bp, Homo sapiens
cctgctcacagtgagcacacactccacggcagctgctgttactaggatgatgtgatgttgttgtgttgttggtagg

SEQ ID NO: 47915 - DNA, 73 bp, Homo sapiens
gctccaggttgctgacaggagagtgtgagtgaagggccttgcctgtccccagctccaggtcagcacccgcagt

SEQ ID NO: 47916 - DNA, 83 bp, Homo sapiens
gggacaaggttaggacaccctctgccccctcgaaatttctgtgtgtttgttttttttttgagagggagtcttgctctgtcacc

SEQ ID NO: 47917 - DNA, 77 bp, Homo sapiens
ccagtctggccaacgtggtgaaaccctgtctctatttttttttttgagacagagtctcgctctgtcgcccaggctgg

SEQ ID NO: 47918 - DNA, 95 bp, Homo sapiens
gtgttgacagacatgctatgtctacacacatgtagactgacagacactctgtctacatgcatgtagcacccctggcagacacattctgtgtacac

SEQ ID NO: 47919 - DNA, 96 bp, Homo sapiens
gcacacatgagctccagccctcatgcctagtccggcaggaccattcagcttggggtctgtgatgaggctgaggacagccatgggctcagaaggtgc

SEQ ID NO: 47920 - DNA, 58 bp, Homo sapiens; identical to SEQ ID NO: 21293

SEQ ID NO: 47921 - DNA, 85 bp, Homo sapiens
gaggccaagtgtggtgggaggctgaggttggtggatctctggagtccaggagtttgagaccagactgggcaacatgacgaaactc

SEQ ID NO: 47922 - DNA, 89 bp, Homo sapiens
ggggaccctcgtgtgactctctgtgaccctgagcaagtctctccacctcccttgcctcggtttccagaagtttaaatggagatggcctc

SEQ ID NO: 47923 - DNA, 72 bp, Homo sapiens
tagtgttcggctaccagatgtctccaccacccaaggttttaaggactgactctctgtgtgtagggaacacta

SEQ ID NO: 47924 - DNA, 76 bp, Homo sapiens
gtgagagtggccagtgactgggtgagcaggaagacggacctgtgtgaggacactgagcactggcccctcctggcac

SEQ ID NO: 47925 - DNA, 74 bp, Homo sapiens
tcctggcaggggggcatggggtcacagaacgtgggcccctggggagctctctctgtgcctgtggccccccagga

SEQ ID NO: 47926 - DNA, 78 bp, Homo sapiens
ctgagtggctccctccgtgtgtgcggcatctctgcgtctctgaaacgtggggccctgtgcagaagggaaggtccttgg

SEQ ID NO: 47927 - DNA, 96 bp, Homo sapiens
gccgcacggctgtcctctccaacaatatcctggtgctgagtgatgactcaggcgactccagcatcagtgattttgttgaagagggcagctgccagc

SEQ ID NO: 47928 - DNA, 129 bp, Homo sapiens
ggcaccatggcaacttgcagttccgaagagcgctggctgctttggagggcggggcctgttgagtgcctcgtgagcccctgcctgtgttcctgccgttcgggtatgagaacacagcggggcttacccggt

SEQ ID NO: 47929 - DNA, 80 bp, Homo sapiens
catgtgtgcggtgtgtacacacttgtgcacgtgtgtggtatgcacacatctgtgtgtgtgtgtacatgactgcatgtgtg

SEQ ID NO: 47930 - DNA, 68 bp, Homo sapiens
gcccagtgccagagccgggggcacagcatggcaaatgtcattcccagcctgcctggctgcctggcagc

SEQ ID NO: 47931 - DNA, 129 bp, Homo sapiens
acagctgcctgacactgccgccaccccgccagcctcctccttggcctgtgcggggggcagcagtcgctcagtcccactgtccgctggctctgctgtgtccactgggtcggctgggtcagtggcactccg

SEQ ID NO: 47932 - DNA, 111 bp, Homo sapiens
cagaaaagccactgtggatatgatctgaagctagaatagtagcatcgtctggtgtgttttgtttttgtttttgttttgtttttgttttttgagacagtctggctctgtctg

SEQ ID NO: 47933 - DNA, 58 bp, Homo sapiens
tgagacggagtctcacactgtcacccaggctggagtgcagtggcacgatctcggctca

SEQ ID NO: 47934 - DNA, 83 bp, Homo sapiens
gcgggggtggggcggggcaggggagtggggttgagggactctcggcctgagtgtctgtgtgcattcaagcccctaaccctcgt

SEQ ID NO: 47935 - DNA, 125 bp, Homo sapiens
gtgtgtgtgtgtgtgtgtgtgtgtgtatttgtgtatatatatgtgtgtatatatatgtgtgtgtatatatatatgtgtgtgtgtatatatacatatatatgtatgtatgtgtatatacatatata

SEQ ID NO: 47936 - DNA, 58 bp, Homo sapiens
tgagatggactctcgctctgtcacccaggctggagtgcagtggcgcgacgtccgctca

SEQ ID NO: 47937 - DNA, 69 bp, Homo sapiens
ctcacacctgactgagtcccgcagacttggctgtgcccacagcgcctgtctcactcagtgtaaaccgag

SEQ ID NO: 47938 - DNA, 93 bp, Homo sapiens
ctgggcaacagagcgagactccgtctcaaaaaaataaataaataaaaaataaatttttttttttttgagacggagtctcgctgtgtctcccag

SEQ ID NO: 47939 - DNA, 96 bp, Homo sapiens
cagaagtcaggatggtgggagagacagaaagggagccaggagtcagggcgggagaatctctgtctttatcactgtgccttcccctgcagctactcc

SEQ ID NO: 47940 - DNA, 84 bp, Homo sapiens
gggctgtgcttccttgaggcctctctctgcctctgtccgggttctgctccggcgcattttgaggccttgtgttttcctgagccc

SEQ ID NO: 47941 - DNA, 59 bp, Homo sapiens
tgagacagagtctcgctctgtcacccaaggctggagtgcagtggcgtaatttgggctca

SEQ ID NO: 47942 - DNA, 128 bp, Homo sapiens
tcctgctgagggtttgaggaagtgctcaatttttgtattttagattttttgagacagggtctcactctgtcactcaggatgtagttcagtggtgcaatcatagctcactgtggcctcaaactcctggg

SEQ ID NO: 47943 - DNA, 74 bp, Homo sapiens
ggaggaggcttccgggtcataggtaggtaagagacagatggttgcattcttttgaatttctgatgagcctctcc

SEQ ID NO: 47944 - DNA, 69 bp, Homo sapiens
gtcatttctcagagaagatactgtggtggaatggcgaagtgaaagccgccacgggcaatctgttgtgtc

SEQ ID NO: 47945 - DNA, 69 bp, Homo sapiens
ccctggctcacaccctgtctgccttccacctgtgagtcctgctgggtgctggaggccaggagtgaaggg

SEQ ID NO: 47946 - DNA, 120 bp, Homo sapiens
gaggggggcgttcaggctgggacccctctgtctctctgtctccagagagggggcgttcaggctgggaccccctcagtctctctgtctccagagagggggcgttcaggctgggaccccctc

SEQ ID NO: 47947 - DNA, 72 bp, Homo sapiens
tttctctctgtggctgcttctgtgtctctgtgggtgtttcctgagcacacacgggcgtctttataggtgaaa

SEQ ID NO: 47948 - DNA, 70 bp, Homo sapiens
ctgggcaacacagtgagacctcgtctctttttttttattttttgagacggagtctcactctgtcacccag

SEQ ID NO: 47949 - DNA, 110 bp, Homo sapiens
atgtagtcccactgtttctagaagtctcttttaagcattattttaaaaatatatatttttatagatgaatactcaggctaatctagtggatatgatcttgggacttccat

SEQ ID NO: 47950 - DNA, 58 bp, Homo sapiens
tgagatgatgtctcgctctgtcgctcacgctggagtgcaatggcgtgatttcagctca

SEQ ID NO: 47951 - DNA, 120 bp, Homo sapiens
tgtatagttgtttctctcttggtagagttggcgaccggttctttcgaattttgtatttatttatttatttatttttgagacagagtttcgctcttgttgcccagggtggagtacaatggc

SEQ ID NO: 47952 - DNA, 57 bp, Homo sapiens
tgagacagagtctcgctctctcacccagcctggagtgcagtgacgtgatctcgctca

SEQ ID NO: 47953 - DNA, 88 bp, Homo sapiens
ccagcctgaggaacacagcgtgaccctgaccctgcaaaaacaaaatttttttttttttgagacagtctggctctgtagcccacgctgg

SEQ ID NO: 47954 - DNA, 89 bp, Homo sapiens
gctccccacacagtgacacctgtctgtccgtccgtctgtccacaggagcaggaggggctgggcggggaggacgcagggtctgtcggagc

SEQ ID NO: 47955 - DNA, 82 bp, Homo sapiens
gagctgcctcactcctgaggaagagtgttcgggctctgggctttgatttaacctgcctgtctgtctctctgagttgacagcc

SEQ ID NO: 47956 - DNA, 79 bp, Homo sapiens
gcatggagcagaggaagccagtgtgagtgaggagagtgcccactgcctgaacccattcacacagagctttgggaaatgc

SEQ ID NO: 47957 - DNA, 72 bp, Homo sapiens
aggaatcaagggtgactcacacgctcagaggcttgcgcagtttgggcagtggagaggactgctgtggtactt

SEQ ID NO: 47958 - DNA, 97 bp, Homo sapiens
tgtcctcctgagagtgcgcctcccctctgcccagggcctgagcattcttcccccactgtctctctgtctggctggggtcaggctcacctcatagaca

SEQ ID NO: 47959 - DNA, 91 bp, Homo sapiens
tgtaactatatatatctagatatatatctatatatagatatagatagatagatagatctagatagatatagatatatatatatatatattt

SEQ ID NO: 47960 - DNA, 76 bp, Homo sapiens
ggaggctgaggtaggaggatcacttgaaccaaggaatgaaaggtagcagtgatttatgatcatgccgctgcactcc

SEQ ID NO: 47961 - DNA, 87 bp, Homo sapiens
acttcaagagctgagtcagtcactgcaacagcttctgcctctccaaggcccagtctggcatgttctgccccttccagcttgggaagt

SEQ ID NO: 47962 - DNA, 80 bp, Homo sapiens
gccagctcggatgcctttgatgtctgtctccaggatacttccctggaatctgtgcagaaaagagtgaaattggagtgagt

SEQ ID NO: 47963 - DNA, 78 bp, Homo sapiens
gagatggagtctcactctgtcactcaggttggagtgcagtggtgtgatctcaactcactgcaacctctgtctcccggg

SEQ ID NO: 47964 - DNA, 93 bp, Homo sapiens
tgagaaaccattgtcacttttaccttagtcactcctaaaagaaaatgtacctattattttgagagttgaaagtgaggccaggtaggtggctca

SEQ ID NO: 47965 - DNA, 64 bp, Homo sapiens
gggagacatgagacttctatcaaatacttttttttttttgagaccaagtctcactctgtcaccc

SEQ ID NO: 47966 - DNA, 66 bp, Homo sapiens
gccactgactctctgagtgaccttaggcaagtcccttctgctcgctgggtctcagggggagtgtgt

SEQ ID NO: 47967 - DNA, 113 bp, Homo sapiens
agtctagttcctgagttgggtgataggtgcaggcatattctttttttttttttttttttttttttttttttgagacaaatctcgctctgtcacctaggctggagtgcagtgac

SEQ ID NO: 47968 - DNA, 118 bp, Homo sapiens
tgagtctgctggtgccttgatcttaaagttcccggattctagaactgtgaaaaataaatttctgttttttataaattatccaatctcaggtactttgttatagagcacaaatggacca

SEQ ID NO: 47969 - DNA, 82 bp, Homo sapiens
ttcatccagatgcatcagttccacatttttttttaatttgtctttttttggtcaatatgcctgggataaaaatctggatgga

SEQ ID NO: 47970 - DNA, 71 bp, Homo sapiens
ggtgtgtgtatatatatatgtgtatgcgtatatataatgtatgtatatatacatttatttatacacactcc

SEQ ID NO: 47971 - DNA, 101 bp, Homo sapiens
aggcagatgggagagtgaggatgagtaagatgtgggctggaaaccgaggtggacacacctgtcagccactcactcactctgtggcactcttcactcagcct

SEQ ID NO: 47972 - DNA, 91 bp, Homo sapiens
ccagcctgggtgacagagcaagaccccatttcttttttttttccttttttttttttttttgagatggagtctcactgtgtcaccaggctgg

SEQ ID NO: 47973 - DNA, 101 bp, Homo sapiens
gggttcaagcgattctccttatatatatttttataagtaagatataaccataccatatttgcttttattttgctttgagatggagtctcgctctgtcaccc

SEQ ID NO: 47974 - DNA, 153 bp, Homo sapiens
tacatatatatatgtgtgtgtgtgtgtatattatatatatatatgtgtgtgtgtgtacatatatgtgtgtgtatatatgtgtatatatctatatatgtgtatatatatgtgcatgtgtgtgtgtgtatatatatatatatatagctacatatg

SEQ ID NO: 47975 - DNA, 139 bp, Homo sapiens
ggacaataagagcgaaactctgtctcaaaaaaataaataaaatgtatataatgtgtcggcttactttttttttttttttcttgagacagggtctcactctgtcgccaggctggagtgcagtggtgtgatcttggctcaa

SEQ ID NO: 47976 - DNA, 96 bp, Homo sapiens
tacatatatacgtgtgtatgtatatatacttatatatgtgtgtgtatatatgtatatatatgtgtgtgtgtgtgtgtgtatatatatatatatata

SEQ ID NO: 47977 - DNA, 69 bp, Homo sapiens
ctgagtccctgagtgactgtgtggagcagagccaccaggcccgcctggaccgtgcaccttgggacctag

SEQ ID NO: 47978 - DNA, 98 bp, Homo sapiens
cagttgttctatcagtggttgagagaaggatgctgaagtctccgattatttcttgttttttactgtttttaaattcgatcgcttttggggtacaggtg

SEQ ID NO: 47979 - DNA, 77 bp, Homo sapiens
agcacctcaaagtaaggagtgtgaagtgcctgaggacaaggtggcaggggcttccagttcctccttaggataaggct

SEQ ID NO: 47980 - DNA, 111 bp, Homo sapiens
cattgatcatcttttggtaggagccgggctaccaaactcatctttttttttttctttttctttttttttttgagatggagtctcactctgtcaccaggctggagtgcagtg

SEQ ID NO: 47981 - DNA, 68 bp, Homo sapiens
gaagctttagcctgaacagaacttttgatgggatgaaactcagtctgtcactcagaatgctggggctc

SEQ ID NO: 47982 - DNA, 105 bp, Homo sapiens
tatttcagtttttaaaattcataaggtggagaatagcttacaacaaaaaaacctttttttttttttttgagatggagtttcactcttgttgcccaggctggagtg

SEQ ID NO: 47983 - DNA, 80 bp, Homo sapiens
catgcttcacggaggctctgtcgctgtgtcccaagaagccaattctggtaagagagtagccacaggacctcaggaggatg

SEQ ID NO: 47984 - DNA, 63 bp, Homo sapiens
tgagacagagtctcactctgtcgcccaggccagtctggagtgcagtcatgtgatctcagctca

SEQ ID NO: 47985 - DNA, 103 bp, Homo sapiens
ctgaactcacacacgcgttcaccctttcacacactctgtcattttgccgcatacgtgggaagtgacacacagtactggaagctagtgggccagggagcttcag

SEQ ID NO: 47986 - DNA, 111 bp, Homo sapiens
gtttatactttaaccccagtgacatgaaaacactgagaattctatttcttttatttgtttgtttgtttgagatggagtctcgctctgtcacccaggctggagtgcaatggc

SEQ ID NO: 47987 - DNA, 79 bp, Homo sapiens
ttgagacggagtctcacactgtcacccaggctggattgcaatctctgcctcccaggttcaggtgtttctcctgcctcag

SEQ ID NO: 47988 - DNA, 120 bp, Homo sapiens
agttcaacaggtccacgaagaacccaataattctgaaagaaacatcgaaggctggaaaaacatgtcagatgattgtcaggagaatatatgttgcacatctcagtggtgcccatgtaagct

SEQ ID NO: 47989 - DNA, 58 bp, Homo sapiens; identical to SEQ ID NO: 1265

SEQ ID NO: 47990 - DNA, 60 bp, Homo sapiens
ttgagatggtgtctcactctgtcacccaggctggagtgcagtggtgcgatctcaactcaa

SEQ ID NO: 47991 - DNA, 56 bp, Homo sapiens; identical to SEQ ID NO: 324

SEQ ID NO: 47992 - DNA, 84 bp, Homo sapiens
tgtatatgtatgtagatatatatgtgtgtgtatatatatatatatatatatatatatatatatatatatatatgtacacatata

SEQ ID NO: 47993 - DNA, 58 bp, Homo sapiens
tgagacagagtctcactctgtcatccaggatggagggcagggatgagattgtgactca

SEQ ID NO: 47994 - DNA, 63 bp, Homo sapiens
cagctcagggaggagaggaggaagggtgtgattctttcactctgaggttttcttctgaggctg

SEQ ID NO: 47995 - DNA, 93 bp, Homo sapiens; identical to SEQ ID NO: 69

SEQ ID NO: 47996 - DNA, 101 bp, Homo sapiens
atgtgtgtgtggatgtgagcactatgtgtgcatgtggatgtgtgtgcataaatgtgcatgcgcaagtgtgtgtagacgtgtgtgtacatgtggatgtgtgt

SEQ ID NO: 47997 - DNA, 98 bp, Homo sapiens
aggtaggaggatcgcttgagcccaggaattgaaaactgtagtgagctatgatgacaccactatactccagcctgggtgacagagtgacactctctctt

SEQ ID NO: 47998 - DNA, 82 bp, Homo sapiens
gtgtgaacctgtgtagtcaccatcttacttttaaatattgagtttttgttgttgtggtggtggtggagacagagtctcactc

SEQ ID NO: 47999 - DNA, 89 bp, Homo sapiens
gaggctggagtgaggggcagcagggggtcattcacgctggctctgctctgttagctgaatgacagcctctctctctgagtctcactcta

SEQ ID NO: 48000 - DNA, 95 bp, Homo sapiens
gctgtgtcaggctgggagtcttagatcatcacatctataagttgacattatctgatggtgtcactgatgatagacagcataagccatgttatagc

SEQ ID NO: 48001 - DNA, 106 bp, Homo sapiens
ttagctaaggcagtacagagagttcccatgtctcttcactcagttttccctaacgtttttttttttttttttttgagacggagtctcgttctgtcgcccaggctgg

SEQ ID NO: 48002 - DNA, 99 bp, Homo sapiens
ctcctgagggtgaaccaaggcgtgaattcagatttttggactctgaggttcaagcttgtttcctctgtcacatttgaatactccttgcatctccagcag

SEQ ID NO: 48003 - DNA, 96 bp, Homo sapiens
tagtgacgtcatagcacagttactttatttttcaaatgcatttagtgtagcctaagtgtatccgtaaagtctgtagttgtgtacggtaatgtccta

SEQ ID NO: 48004 - DNA, 85 bp, Homo sapiens
tgtgctcagagagagagagagagggagctctgtgatgtctatttttttttttttttttttttttgagacagagtctcgctctgtc

SEQ ID NO: 48005 - DNA, 93 bp, Homo sapiens
gagactctgtctcaaaaaatccattcttgcaaagtggtgaaaacaaagtttttacttatttattgttccttggagtctttggacacttgtttt

SEQ ID NO: 48006 - DNA, 82 bp, Homo sapiens
caggttggggcagaagagtaaaggcagtagaatgtgaggactcattaaggactcatcaccctgctgcttctgccactccttg

SEQ ID NO: 48007 - DNA, 116 bp, Homo sapiens
gctcagctgaacagcatgagggaaatggctctgttcttttatttatttaatttaatttaattaattaatttttatttttttgagagggagtcttgctctgttgccccggctggagt

SEQ ID NO: 48008 - DNA, 100 bp, Homo sapiens
tatatatatgtgtgtgtgtgtgtgtgtatatatatatgtgtgtgtatatatgtgtatatacatgtatgcatgtatatacatatacatacatgtatgtgtg

SEQ ID NO: 48009 - DNA, 95 bp, Homo sapiens
cttaagtgaagacttgaaggtaggaaggtctaacttctgccttcgcagaaggcagaaaaaagtttttttatttttttattttttctttatttttg

SEQ ID NO: 48010 - DNA, 112 bp, Homo sapiens
cctgatctttgtctccatggtcacatcaccttctcctctgtatgtgttggcaaaatctccctctctctctcagaggcacagttgtgattgcatttaggacccacccagataa

SEQ ID NO: 48011 - DNA, 84 bp, Homo sapiens
gctgggccagctgcagaccaacaggctgggggtcatgctccaagctgtcctctgtctgtctgtctgtctggctggctggctggc

SEQ ID NO: 48012 - DNA, 115 bp, Homo sapiens
agatgagcactgtcagagtctaagggacccagctgatctctaaacccaacatttttttttttttgaggcaagagtctcactctgtcccctaggctggagtgcagtggtacaatct

SEQ ID NO: 48013 - DNA, 87 bp, Homo sapiens
gcccctccctcactctgcaagacttgagcccgtgaggcctgaccagaaacacacactcactccctggagagacccaatgggacgggc

SEQ ID NO: 48014 - DNA, 81 bp, Homo sapiens
cagatgtttaggggtctgactcagtgtgtgtgtgtgctccgttgagagcttatgtggcccgagtggtggtcctggaatttg

SEQ ID NO: 48015 - DNA, 110 bp, Homo sapiens
accttgggtttgggtcacagagggaaaaagaagacactggggaggggccagggtgttaccctgtgtctgtctctcagttctggacaatctgggctcaagtgcacacaggt

SEQ ID NO: 48016 - DNA, 124 bp, Homo sapiens
gaggtgtggtgttggagagttgtgggggggagcagtgtgggcagtacattgtagggcgctgaggatgttgtttgttttgatccataccttggaatcaggagtaacaaatatcgaaattgggccc

SEQ ID NO: 48017 - DNA, 101 bp, Homo sapiens
cttccttctgattaactggccctgagtgattctagccagtgttattagctgtgctctaaaaacaatgacactagtatcacccagccatcaacagaggtcag

SEQ ID NO: 48018 - DNA, 71 bp, Homo sapiens
ccaggagcaggagctggttctttttttttggactcctaggtgttaggctggctcagttctgcagcttctgg

SEQ ID NO: 48019 - DNA, 116 bp, Homo sapiens
agtacctgctaaccctgtgttttatctcaattcagctgtcctctgagattgttcttgtgtttaaatccctgtgggcccagtgaaaagggaactgacgcaattaagggaaagttgct

SEQ ID NO: 48020 - DNA, 73 bp, Homo sapiens
atgcttccagcttccactctgccatctgagcgttctctaatctcagctgcacagatgagagtgtggggagcat

SEQ ID NO: 48021 - DNA, 97 bp, Homo sapiens
tgctgtctcagaccatcttctggcatgagggcgcactcagcacacactgcttcagacagcagtcactgagcccagcgctcaggatgtggtagcagca

SEQ ID NO: 48022 - DNA, 106 bp, Homo sapiens
ctttctttaacatatatatatatatatatatatatatatatatatatatatacacacacacacacacacatatagagagagaggtgtgtgtgtgtgtgcgtgtgta

SEQ ID NO: 48023 - DNA, 117 bp, Homo sapiens
aaaaatgttcttattaatggtggcaataggcatttttcaattccaaattgaatgtacatatttatttaaaatgtttcagaggatttgacatgagtctatcgccagtgatgtattttt

SEQ ID NO: 48024 - DNA, 113 bp, Homo sapiens
ggattgtctgggctgtatgggctcttttttggttccatatgaaattcaaagtagtttttttctaattctgtgaagaaagtcaatggtagcttgatgggaatagcattgaatct

SEQ ID NO: 48025 - DNA, 65 bp, Homo sapiens
tgagaaagaggatcccttcagtgttgggccacaaagctggctctgacactcagtcctttgtcaca

SEQ ID NO: 48026 - DNA, 97 bp, Homo sapiens
cttggaaaaagtttcatgtgcagttaaatagaatgtatattctgtggttgttggatggaatgttctgtatatctctgttaagtccctttgttccagg

SEQ ID NO: 48027 - DNA, 112 bp, Homo sapiens
agcacttccatcagcatctagacagggcttggcaaacggaaggcactcaatcctgaatgaatgaatgaatgaatgaatgaacctgtccatatctgttgttgctacgtgtgtt

SEQ ID NO: 48028 - DNA, 56 bp, Homo sapiens
ggaactgtagtgtgtatgtgtatatatatatatacacatacatatatgtagattcc

SEQ ID NO: 48029 - DNA, 96 bp, Homo sapiens
ttccatcatatatgtatatatatacacacacatatatttatatatagattccatcatatatatatgtgtgtgtatatgtatacatatatgatggaa

SEQ ID NO: 48030 - DNA, 96 bp, Homo sapiens
ttccatcatatatgtatacatatacacacacatatatatatgatggaatctatatataaatatatgtgtgtgtatatatatacatatatgatggaa

SEQ ID NO: 48031 - DNA, 103 bp, Homo sapiens
cgccctgtttttatctcagtgcggagtgtttcattttgatcaaaattgcagttgcgtaattgacagatgagagtgagtgcttgcagatgtgaagactggggtg

SEQ ID NO: 48032 - DNA, 58 bp, Homo sapiens
tgagacagagtctcgctctgtcttccaggctggaatgcagtggcccgatcttggctca

SEQ ID NO: 48033 - DNA, 108 bp, Homo sapiens
cactgcactctctctgagcagctgaagttctgtctctgcatgttcatcttagaaggtggcatggatgccagagtgcagcttcttccgcctgcccctaataagacagtg

SEQ ID NO: 48034 - DNA, 95 bp, Homo sapiens; identical to SEQ ID NO: 68

SEQ ID NO: 48035 - DNA, 93 bp, Homo sapiens; identical to SEQ ID NO: 69

SEQ ID NO: 48036 - DNA, 75 bp, Homo sapiens
ttgttttgttttgagatggagtctcactcagtcacccaggctggagtatagtggtgcgatctcagcccactgcaa

SEQ ID NO: 48037 - DNA, 77 bp, Homo sapiens
tctatatatatatatatatatgtgtgtgtgtgtgtttatatatatttttaatatatcatatatataatgtatatagg

SEQ ID NO: 48038 - DNA, 97 bp, Homo sapiens
atgtcactgcttgggagctagtaggaagataagtacttacatataccatgagttgtattgtgaagtagtaggtctactttgaagagttgtgtgtcat

SEQ ID NO: 48039 - DNA, 85 bp, Homo sapiens
gtatacatatagtatatgtatacatgtatatatgcatatatttacacatgtatatatgcatatatgtacacatgtatatatatat

SEQ ID NO: 48040 - DNA, 64 bp, Homo sapiens
gtatatgtacatgtgtatatgtatatatgtatatacatgtgtatatgtatatatgtatatgtac

SEQ ID NO: 48041 - DNA, 75 bp, Homo sapiens
ccaggcacaaaacagtgtcagcacatggacagcatttaataaatgcttattgtatagacacttcagctgtgttgg

SEQ ID NO: 48042 - DNA, 87 bp, Homo sapiens
ggtcagaaaaagatatatgtgtggcatgtgcctgctctttgtgtacatatatatatatgtatagtgcattgactgctttcatatttc

SEQ ID NO: 48043 - DNA, 119 bp, Homo sapiens
ctgggtagaaatttggaactgtttttcttggagaggtagaaagtatattctatgtgtgagaagaaagtgtccataaatatttagattatagctataatgtaccatcagaagactgttct

SEQ ID NO: 48044 - DNA, 64 bp, Homo sapiens
ctgtgggcacctagaattccccacagttagccagactcagtgactcattctaaagggtccatag

SEQ ID NO: 48045 - DNA, 70 bp, Homo sapiens
ttgctttgagacagggtctcactctgtcacccaggtgggagtgcagcggtgtgatcatggctcaccgcag

SEQ ID NO: 48046 - DNA, 107 bp, Homo sapiens
cagtatacaggggttcccctttctccacatccttgtcagcatttttttttgtctttttgataataaccattctaactagggtgagaggataactcgttgtggttttg

SEQ ID NO: 48047 - DNA, 103 bp, Homo sapiens
agctcacctttctgtgcagattttctaagcttatgattataaatatttccaaatcacagtcatttattagtctaggatagggtgatgccaggtgggcgtggct

SEQ ID NO: 48048 - DNA, 56 bp, Homo sapiens
tgagacagagtctcactctgtcaccccggctggagtgcagtggtggcgctatctca

SEQ ID NO: 48049 - DNA, 95 bp, Homo sapiens
gagatcatgtagtatttgtttgtgtctagcttatttcacttaacgtaatgccctccctccatgtctagtcatattgttgcaaatggcatgatttc

SEQ ID NO: 48050 - DNA, 85 bp, Homo sapiens
ctccgtcctgaattttggggttgatctcacacacacactcacgaaacacctgtgatggattgtggtgacatttactaaagtggag

SEQ ID NO: 48051 - DNA, 87 bp, Homo sapiens
ccttctgctttgtaacactcaatcacagtatctcagtggcatacaaaaatcagcctttattgctcccttgtgtgttggggtaggggg

SEQ ID NO: 48052 - DNA, 58 bp, Homo sapiens; identical to SEQ ID NO: 9336

SEQ ID NO: 48053 - DNA, 95 bp, Homo sapiens
gaagatatattctgtcagtagtgatattcttcttgagaaaaatccatctcaagcatctaacagaagaagtcgaattagcagaatgctgtgtgttc

SEQ ID NO: 48054 - DNA, 128 bp, Homo sapiens
acatatgtacatacttgtatatacatatatatgtgtgtatgtgtgtgtatatgtgtatatatatgtctctgtgtgtgtatttttagagaattatggtctatacacacacacacacacatacacacaca

SEQ ID NO: 48055 - DNA, 58 bp, Homo sapiens
tgagaaggagtctcgctctgtcgctcaggctggagtgcagtggcgggatctcggctca

SEQ ID NO: 48056 - DNA, 110 bp, Homo sapiens
gctgaggagacaaatttgtattctgtaaccattggattaaatgttctttaaatatttaattaggtccatttgatctgtgttgcaaattaagtccaatgtttctttgttgc

SEQ ID NO: 48057 - DNA, 123 bp, Homo sapiens
ttggtttcaatagtactagctgtaaatgggctcctggagttaaggcatgatatatatatatattagcgtaggagcaatatatttgtcacaataatggctgtagcttgaaaacaaaggtagctc

SEQ ID NO: 48058 - DNA, 99 bp, Homo sapiens
taccatgtgatccagcaaagtcactctgagatatatccaaaggaaataaaacaagtatcttggagagacatctgcactcccctggacattgcaaaagta

SEQ ID NO: 48059 - DNA, 125 bp, Homo sapiens
tgagtaacccacagagtgacttaaaattcaggcttacctgtcatcttcagctaagaacaagaaagaagtgtgtgaggaaagctggttatggggaggtgactgggaaaggtatggtaaacaagagc

SEQ ID NO: 48060 - DNA, 97 bp, Homo sapiens
ggtttattccctgattaatggggacagtttgaattaaattctctctcattaaaatgagtactctttcaaatagtacctagatagtcgttgtgtatcc

SEQ ID NO: 48061 - DNA, 59 bp, Homo sapiens
ggtgcaatacctgtgatcctagctactcaggaggctgaggtaggaggatcacttgagcc

SEQ ID NO: 48062 - DNA, 117 bp, Homo sapiens
atccttgggaggagaaggaatatgaatctggcacgagccaaaataatttctcactattttatttttgtctgttgttatcttctgtgaacttttagcctcttcaaaagtaaagaggat

SEQ ID NO: 48063 - DNA, 83 bp, Homo sapiens
gggcattgagatgactgtagtttgcatgcaggaaggacatgagtcactgggggtgagagggcagactatggtagccagtttcc

SEQ ID NO: 48064 - DNA, 106 bp, Homo sapiens
tgcctatttctagtagacttgtttagcatgtttgcttaagactgatttcttttttttcttaacattttaggttcagaggtacatgtgcaggtttattatataggca

SEQ ID NO: 48065 - DNA, 66 bp, Homo sapiens
ttgcagccaggctgcaagggtctgtgtcccagatactcttcttactcagcctctcagtctctgtaa

SEQ ID NO: 48066 - DNA, 58 bp, Homo sapiens
tgagacggagtctcactctgtcacccaggctggagtgcagtggtgcgagctcggctca

SEQ ID NO: 48067 - DNA, 116 bp, Homo sapiens
tcaaagaatctgtgggcatattttaaagccatcacactcattatggttttatttaattaattaatttatttttttgtagagtcagggtttcgctatgttgcccaggctggtcttga

SEQ ID NO: 48068 - DNA, 119 bp, Homo sapiens
gagccctcctctgcatgagccaggtgtgagtgtcagcatattatctcactctttttttttttttttctgagatggagtctcactctgtcacctaggctggagtgcagtggtgtgatctc

SEQ ID NO: 48069 - DNA, 58 bp, Homo sapiens; identical to SEQ ID NO: 36524

SEQ ID NO: 48070 - DNA, 81 bp, Homo sapiens
gctgctgcatgttcacagaaaagagagatgggaactcagacagagagtctctgattctgactgtcctgtaggtccagctgt

SEQ ID NO: 48071 - DNA, 102 bp, Homo sapiens
tccctggattcttattttgctgagactttttcatttttacaaaatcagcaatgagtgttgaattgtatcaaatgcctgtatctgtcgagatgattctgtgga

SEQ ID NO: 48072 - DNA, 93 bp, Homo sapiens
ccagcttggacagcatagccagacctcatttctaaaaaaaaaaaaaaattttttttttttttgagacgaagtctcactctgtcaccaggctgg

SEQ ID NO: 48073 - DNA, 56 bp, Homo sapiens; identical to SEQ ID NO: 24883

SEQ ID NO: 48074 - DNA, 126 bp, Homo sapiens
gagattactattcaaggggcttttcaagggaaaattactcattgtggggattttttttttttttcttgagacagggtctcactctgtcacccaggctggagtgcagtggtgtgatcttggctcaag

SEQ ID NO: 48075 - DNA, 60 bp, Homo sapiens; identical to SEQ ID NO: 30273

SEQ ID NO: 48076 - DNA, 58 bp, Homo sapiens; identical to SEQ ID NO: 6617

SEQ ID NO: 48077 - DNA, 56 bp, Homo sapiens; identical to SEQ ID NO: 6618

SEQ ID NO: 48078 - DNA, 80 bp, Homo sapiens
acttattcacatgaaaacaaatttttagatttttacgtttgaatctgtctggtcagagttctgttttcttgttggtaagt

SEQ ID NO: 48079 - DNA, 118 bp, Homo sapiens
tttgaaattcttttatatatatgtgtatatatatgtgtgtgtatatatgtgtgtgtgtgtgtgtgtgtatatatatatatatatatatatattttttttttttttttttttttttgga

SEQ ID NO: 48080 - DNA, 58 bp, Homo sapiens
tgagacagagtctcactgtgtcgcccaagctggagtacagtggtgcgatctgggctca

SEQ ID NO: 48081 - DNA, 70 bp, Homo sapiens
gtttctgagacatgatctcactctgtcactcaggctggagtgcagtggtgtaatcatggctcactggagc

SEQ ID NO: 48082 - DNA, 95 bp, Homo sapiens
tctccatgcagtatgtgctttaaaatttttgtttaacatgtgtaaatagcaatagatagcgtaagtcttaaatgtcaaatctgctgaaatggaga

SEQ ID NO: 48083 - DNA, 79 bp, Homo sapiens
gtgtgtgtgtatatgtctatatatgtctatgtatttatgtaaacgttatatgtgcacacgtgcagacatgcgcacacac

SEQ ID NO: 48084 - DNA, 118 bp, Homo sapiens
gaaggcataggcttttctgtttcctgggacataaggggactcgtctaataaattttttttttttttttaaagacaatgtctggctctgttgcccaggctggagtgcagtggtaccatc

SEQ ID NO: 48085 - DNA, 83 bp, Homo sapiens
ccagcttgggcagcagaccgagaccccttctctacaaattttgttttttttgagacggagtctcgctctgtcacccaggctgg

SEQ ID NO: 48086 - DNA, 100 bp, Homo sapiens
atctttgggttttggctatcttactctgatgtggtttatttttatatattttgttttatagatttcatcttgggtttgctgagcttattgaatctatgat

SEQ ID NO: 48087 - DNA, 135 bp, Homo sapiens
ggacaataagtgtactaagccagctcgggctgttgtagaaagatgccacagactgggcggctcacacagtctcacagccctggagcctggaagcctaagacagagctgccatcagggctggtttctgatgaggcc

SEQ ID NO: 48088 - DNA, 72 bp, Homo sapiens
ggacggggcgctctctctccaggtgcgcacagagtagaggccatgtgaggacacagggaggagacattgtcc

SEQ ID NO: 48089 - DNA, 115 bp, Homo sapiens
gagactgggtgctagggtttgcttcactaaaactgggctagaagattctttttattttttgagagggagtctcgctctgttgcccaggctggagtgcagtggtgcgatctggctc

SEQ ID NO: 48090 - DNA, 121 bp, Homo sapiens
atatatatgtgtatatatatgtgtatatatacatatatatacgtatatatgtatatatacacgtatatatatgtatatatatacgtatatatatatgtgtatatatatatatatatatata

SEQ ID NO: 48091 - DNA, 101 bp, Homo sapiens
aggaaactatgcaaaggctatttcatccttgcaattctatttctttatctataaatacagaataagaggataatgaaggcagtggtagatcagagttttct

SEQ ID NO: 48092 - DNA, 127 bp, Homo sapiens
gtgagtgttgatgcatcctgccagccaaggtcacctacaggggagatttaatgatgatgatgatgatgatgttaacacctgacgcttgctatgtctgggcattattaccacgtctcttacattcctc

SEQ ID NO: 48093 - DNA, 57 bp, Homo sapiens
ttgagaccgagtctctcactctgtcgcccaggctggagtgaagtggcacaatctcag

SEQ ID NO: 48094 - DNA, 109 bp, Homo sapiens
gccaatgagctgtggcttcaggctgtgtgatctgtgcaaatgtattgtaattaattgagctttaaaaattgactttgaaggtctcaaggtcttggaaatggctgttggc

SEQ ID NO: 48095 - DNA, 77 bp, Homo sapiens
cttctgaacaaagtctgcactcaggtggaggtcaagtccgaaatggtcttcacaggaggtgtaggtccttcaaggag

SEQ ID NO: 48096 - DNA, 68 bp, Homo sapiens
cctttcttggctctgtctctgagtcaccctcctggggtcacagatcagctgcatgggcacaggttagg

SEQ ID NO: 48097 - DNA, 56 bp, Homo sapiens
gcctgaaggcttggggcttggatgaggctgtttccacagtgcctaagttctcctgc

SEQ ID NO: 48098 - DNA, 85 bp, Homo sapiens
caaagtgctgggattacacgcatgagccatcgcaccaggcctaacactggaagatgttttaagtatataagtttcttgtacagtg

SEQ ID NO: 48099 - DNA, 95 bp, Homo sapiens; identical to SEQ ID NO: 68

SEQ ID NO: 48100 - DNA, 93 bp, Homo sapiens; identical to SEQ ID NO: 69

SEQ ID NO: 48101 - DNA, 72 bp, Homo sapiens
gacggctgcatggcccagaccccagggaacacagtttccttgagcctgtctgtctgtctgtctgtctgggtc

SEQ ID NO: 48102 - DNA, 103 bp, Homo sapiens
cccaaggggtccggagtgagaggagaaacatgacgtgcctgtgtgtgcacaggacgcctgacactcgctcacacacgcatgtccctctctctgagagccaggg

SEQ ID NO: 48103 - DNA, 76 bp, Homo sapiens
gcccagtgctctgctatcccccagaggcagaggtcaagcccctgggctgggtgatgagaatgagcacagagggggc

SEQ ID NO: 48104 - DNA, 100 bp, Homo sapiens
acctttagtcactgtgtctccttaggctcctcttggctgtgacagtgtctttgactctgtttttgatgatcttgacaagtttgaggaataacaatcaggt

SEQ ID NO: 48105 - DNA, 75 bp, Homo sapiens
agccctcagagcccttctcagtttctattctttttttttttttttgagacagagtcttgctctgtcacccaggct

SEQ ID NO: 48106 - DNA, 57 bp, Homo sapiens
gagacagggtctcactgtgtcacccaggctggagtgcagtgatacaattctctgctc

SEQ ID NO: 48107 - DNA, 71 bp, Homo sapiens
gtgtgggagagtgtgtgagcgtggagggggggggggtgtgtttctgtctgcctcgttcactctctctctac

SEQ ID NO: 48108 - DNA, 99 bp, Homo sapiens
cacatttttgcaggtttaagtgctgttttttaagatattaaacatgttccttgtttcttttttctttttaaccactggagactatgtgaaaatcttgtg

SEQ ID NO: 48109 - DNA, 58 bp, Homo sapiens; identical to SEQ ID NO: 1409

SEQ ID NO: 48110 - DNA, 105 bp, Homo sapiens
gctgttgtaattttacagaaaatgagtgtaattttgacttttaaaaacatgttttaatgtttttaaacaccgggtgcagtggctcacttctgtaatcccagccgt

SEQ ID NO: 48111 - DNA, 58 bp, Homo sapiens
tgagacaaggtctcactctgtccctcaggctggagtgcagtggtgtgatcatggctca

SEQ ID NO: 48112 - DNA, 82 bp, Homo sapiens
gatgaatgttaaatttcaagtgcattttttgatctactgaatgtagaccaaaaataaaatttgaaggccccctgcaaccatc

SEQ ID NO: 48113 - DNA, 118 bp, Homo sapiens
ttttcatacacacagctttccatcttgcatcttactccttcctgaacatttttttttttaccatttcagttagcatgttaggtgtcaatggattcttgcaagttttgtttgctgaaaa

SEQ ID NO: 48114 - DNA, 73 bp, Homo sapiens
tcttcagaagtgacaagttcataatcgctaaggaaagtcctgtgagggcggggaactctgtctcactgtcaga

SEQ ID NO: 48115 - DNA, 117 bp, Homo sapiens
gcactaattagctcagagggaatgtgagtagaaaagggtgagaatactattttattttattattttattttttgttttttgagatggactctcgctctgtcgcccaggctggagtgc

SEQ ID NO: 48116 - DNA, 115 bp, Homo sapiens
gttgttgttttttgagatggaatttcactcttcctgcccaggctgaagtacagtggtatgatctcagctcaccacaacctctgcttcccaggttcaagcgattctcctgcctcag

SEQ ID NO: 48117 - DNA, 130 bp, Homo sapiens
tcctctctgaccatagtccctgacctccagctgcttcttctcatctcaatatccagacacttctctcttctgtgtgtgtgtccactgagtctggggcttgggattcttatgggcacaggatagggggtgg

SEQ ID NO: 48118 - DNA, 102 bp, Homo sapiens
ctatgttttcccactcttttactgtgaacttacttgtatctttataattaaggtttaagtctgttaaagaacacgtaattaagtcttgtggagaggaggtgg

SEQ ID NO: 48119 - DNA, 119 bp, Homo sapiens
acttccccagagctaatccttgagccgaaagagcttcctggtgaagcctcgcactctctgtaacagggcgtggggggaccgagacatgcgggctccagattagaccatctttacctagt

SEQ ID NO: 48120 - DNA, 103 bp, Homo sapiens
gtttgaacttggcagtatgagtgtgtatgtggaatataactgcatgtggatgtgtaaatataagtgtgtatgtgtgttaatgtgtgtaagtgtgtgaataagc

SEQ ID NO: 48121 - DNA, 111 bp, Homo sapiens
ggccacgtttttgtagagtggctatgctgtgtggggggttcacttcagcccctggtctcctcagacactctgaaactctaagactgaactggctgagtcatccaaacagca

SEQ ID NO: 48122 - DNA, 106 bp, Homo sapiens
aggacctgggccacacagcaagaggttagtggtagggagcaagtgaagcttcatctgtttacagccactctctgtcactcacattaccttctgagctcctcctcct

SEQ ID NO: 48123 - DNA, 102 bp, Homo sapiens
ttgagattgagtctcgctgtatcccccaggctggagttcagtggtatgatctcagttcactgcaacctccaccttctggttcatgcatttctcctccctcag

SEQ ID NO: 48124 - DNA, 94 bp, Homo sapiens
actaagaataagtgttagattctttgggttaaattgccataaggactaaatttatttttttaaccaattccctaaagaatcaactgattttagt

SEQ ID NO: 48125 - DNA, 68 bp, Homo sapiens
tcattctactttctctctctctgagttcagttttttttagctgagatatgagtgagaaatatgagtga

SEQ ID NO: 48126 - DNA, 63 bp, Homo sapiens
cttcactgtctcactgtgtccctcacatgatctcttcttggtgggtacttgcagagagtgggg

SEQ ID NO: 48127 - DNA, 148 bp, Homo sapiens
atatgtatatcataatacatatacatatgtatatatgtatatcataatacatatacatatgtatatatgtatatcataatgcatatacatatgtatatatgtatatcataatgcatatacatatgtatatcataatgcatatacatat

SEQ ID NO: 48128 - DNA, 62 bp, Homo sapiens; identical to SEQ ID NO: 45066

SEQ ID NO: 48129 - DNA, 95 bp, Homo sapiens; identical to SEQ ID NO: 68

SEQ ID NO: 48130 - DNA, 93 bp, Homo sapiens; identical to SEQ ID NO: 69

SEQ ID NO: 48131 - DNA, 112 bp, Homo sapiens
taattctgtgtatcactcacagagataatctgttaaagataatattaataaataatttctttttttactattttttaattttgtttttctgagatgaagcctcgcagggttg

SEQ ID NO: 48132 - DNA, 104 bp, Homo sapiens
gactagtttagtaatttttatgatttagttttatatatatatatatatatatatatatatatatatatatatatgtataatgttttttagttattgatctggtt

SEQ ID NO: 48133 - DNA, 104 bp, Homo sapiens
aatccgagaatattcaggggagcagagcagattgaagtttgactccaggccctcggcttaccagctggtgatctgggctagtcactgtgctttcctgtgggatt

SEQ ID NO: 48134 - DNA, 66 bp, Homo sapiens
ggagaattttccatatacacttgggaagaatgtatatattttttccattgttatgtagagtgctct

SEQ ID NO: 48135 - DNA, 82 bp, Homo sapiens
gtatgtgtatgtatatacacgtgtttatatatacacagatgtatatatacatatgtgtatgtatatgtatatatataggcac

SEQ ID NO: 48136 - DNA, 95 bp, Homo sapiens; identical to SEQ ID NO: 68

SEQ ID NO: 48137 - DNA, 93 bp, Homo sapiens; identical to SEQ ID NO: 69

SEQ ID NO: 48138 - DNA, 78 bp, Homo sapiens
gtgtatatgcatgtgtgtgtgtgcatgtgcatttgtatgtatatgtgcatgtgtatgtgcatgtatatgtgtacatgt

SEQ ID NO: 48139 - DNA, 95 bp, Homo sapiens; identical to SEQ ID NO: 68

SEQ ID NO: 48140 - DNA, 93 bp, Homo sapiens; identical to SEQ ID NO: 69

SEQ ID NO: 48141 - DNA, 84 bp, Homo sapiens
tgggttctgagtgattgtccctcacataggattccagaacactgctgctgggttctgagtgtttgtctctcacataggattcca

SEQ ID NO: 48142 - DNA, 82 bp, Homo sapiens
ccctcgtaacagtcttttgaatcctatgtgagggaaaaacattcagaccgtcacagtagtgttctggaatcttatttgaggg

SEQ ID NO: 48143 - DNA, 128 bp, Homo sapiens
tcccctgggacagggaatgttaaatctccatttttgtcactaaaagttgtccagatgtctctttttatttttttgagatggagtctctctctgtcacacaggctggagtgcaatggtgcgatcttgat

SEQ ID NO: 48144 - DNA, 101 bp, Homo sapiens
ggttggtagttatcttttactagtttcttacttcagaagtgtttttgttttaaagatgagaggaaaagcttcaattgagattcattcctagtactccaact

SEQ ID NO: 48145 - DNA, 58 bp, Homo sapiens; identical to SEQ ID NO: 884

SEQ ID NO: 48146 - DNA, 56 bp, Homo sapiens; identical to SEQ ID NO: 885

SEQ ID NO: 48147 - DNA, 90 bp, Homo sapiens
gcatagtgggtgtgtgtatatataaatatatagcatatatatagtatatagcatgtctatacttatactatatacatacatatagtgtgt

SEQ ID NO: 48148 - DNA, 66 bp, Homo sapiens
agaagtacagtgagatctttggtgatactggccagtctggtattccaactctctagctgagctcct

SEQ ID NO: 48149 - DNA, 66 bp, Homo sapiens
ggcctggtggtgcaggcttatagtcccagctactagggaggctgaggtaagaggatcactagagcc

SEQ ID NO: 48150 - DNA, 86 bp, Homo sapiens
acatatacacagctgtatatgtatatacatattatgtatatgtatatacatatacattatgtatatgtatatacatataataaata

SEQ ID NO: 48151 - DNA, 64 bp, Homo sapiens
atatacataatgtatatgtatatacatatacataatatgtatatacatatacagctgtgtatat

SEQ ID NO: 48152 - DNA, 170 bp, Homo sapiens
acacacacatatatatatattcataaagacatgtgcatatgtgtgtctatatatatactttattgagatataattcttgtatcgtgtgtgtgtgtgtgtgtgtgtgtgtgtccagacagagtctcgcactgttgcccaggctggagtgcagtggcgcgatctcagctcac

SEQ ID NO: 48153 - DNA, 74 bp, Homo sapiens
atatatatatatacacacaagtatacatatgtgtgtatatatatatacatatgtgtgtgtgtatatatatgtat

SEQ ID NO: 48154 - DNA, 119 bp, Homo sapiens
tgatggaagatttctttagtttctgataaggtttcttaagattttattttatttatttaattttattttttgagacttctgtcgcccaggctggagtatagtgatgtgatcttggctca

SEQ ID NO: 48155 - DNA, 58 bp, Homo sapiens; identical to SEQ ID NO: 2263

SEQ ID NO: 48156 - DNA, 94 bp, Homo sapiens
agtctgaggtgtagggtaggagaggccggagctcagagaagtgggactttttttttttttttttgagacggagtctcgctctgtcacccaggct

SEQ ID NO: 48157 - DNA, 58 bp, Homo sapiens
tgagacagggtctcactctgtcacccaggctggagtacagtggtgcaatcttggctca

SEQ ID NO: 48158 - DNA, 61 bp, Homo sapiens
ggtgtagatgaagactgcaactcttttttttttttttgagatgaagtctcactctgtcacc

SEQ ID NO: 48159 - DNA, 100 bp, Homo sapiens
ttctagcctggacaacaaagcgagactttgtctcaaaaaaaattttttttttcttttttttcgtggtagatcttgctctgttactcagtctggtctggaa

SEQ ID NO: 48160 - DNA, 113 bp, Homo sapiens
gtgtcactgccctggagcctgtgtggcagagcaagactccgtctttttttaaaattctatttttttttgagacggagtctcgctctgtcacccaggctggagtgcagtggcat

SEQ ID NO: 48161 - DNA, 85 bp, Homo sapiens
tcctggatagtaatgtagtaagtactttcattgctgaataatacagctccttgagggtgtgcttatgagcatagtatgttttaga

SEQ ID NO: 48162 - DNA, 84 bp, Homo sapiens
tcctggtagacttgctgggtggctagatccagaagagagataacagtcagtacagcttggctttcaggaagccacatccatagg

SEQ ID NO: 48163 - DNA, 96 bp, Homo sapiens
tgtgaatcctgaggggaaagacagtgacagacagacagacatggacagacaagcgacatctgccttgccttttgtgaccaaacctcagaattcaca

SEQ ID NO: 48164 - DNA, 86 bp, Homo sapiens
caatgctttgctagagctggtaaaatggaaccaaatcgcctcttcaatggatttggtccccttcaaccagctgtagctatgcattg

SEQ ID NO: 48165 - DNA, 83 bp, Homo sapiens
cctactcagagtacatacttctttatgtacccatatgaacatacaatgctatggaatgtaaagaagtatgtatttttggtagg

SEQ ID NO: 48166 - DNA, 76 bp, Homo sapiens
atgaggtcatcatgtatgctatatgtatgtttttaaaaagaaaggagataccaatacatacatgcgtgtatttcat

SEQ ID NO: 48167 - DNA, 76 bp, Homo sapiens
gggaatcaggtagggaggaggaatgctgtggagggcaacttgtaaacttcttcttctttttttttttttttttccc

SEQ ID NO: 48168 - DNA, 56 bp, Homo sapiens; identical to SEQ ID NO: 11815

SEQ ID NO: 48169 - DNA, 106 bp, Homo sapiens
gttggctggcccattggctaaggctcagagaactcagggacttgtgctcagccaagtgcactgactttcactcactgcctcttagaaagaactgaggttagctgac

SEQ ID NO: 48170 - DNA, 68 bp, Homo sapiens
tgaagtttctctctcattctctgtggtttcagggcagcagagtgaaataggaagagatggaggcttta

SEQ ID NO: 48171 - DNA, 111 bp, Homo sapiens
cattaataataacaatcaattgcatgcatgtacgtatgtgtatacatatatataaatgtatgtgtgcatacgaatgtatatatatacacttaggtattattttttgttttt

SEQ ID NO: 48172 - DNA, 73 bp, Homo sapiens
ccaggcgtggtggtgagtgcctgtaatcccagctactgtggaggctgaggtaggaggatcgcttgagcccagg

SEQ ID NO: 48173 - DNA, 85 bp, Homo sapiens
gaatgacattaatacataatattaattatatattaatatgtcattaatatattaatatccatgacattaatattaaatgtcattt

SEQ ID NO: 48174 - DNA, 61 bp, Homo sapiens
gttttctcactctatgtctgtgtgtagccattgtttggttcccacttataagtgagaagat

SEQ ID NO: 48175 - DNA, 138 bp, Homo sapiens
tgtatatatgtctgtgtatgcatatataaacatatatatgtatacacacatatagtttatatatatacatatacatacatatgtatacatgtatgtatatatacttatacatacatatgtatacatatgtatgtatat

SEQ ID NO: 48176 - DNA, 122 bp, Homo sapiens
acatacatatgtatacatatgtatgtataagtatatatacatacatgtatacatatgtatgtatatgtatatatataaactatatgtgtgtatacatatatatgtttatatatgcatacaca

SEQ ID NO: 48177 - DNA, 105 bp, Homo sapiens
gcatggtggcacatgtctgtagtcttagctacttgggaggctgaggtgggaggatgacttgagcatgggaggttgaggctacagtagccatgatcatgccactgc

SEQ ID NO: 48178 - DNA, 58 bp, Homo sapiens; identical to SEQ ID NO: 11671

SEQ ID NO: 48179 - DNA, 81 bp, Homo sapiens
ttagccccatttctgagacacactcttctggggtctctgttaattgccaggagtatttagtgaggtctcttctctggctga

SEQ ID NO: 48180 - DNA, 106 bp, Homo sapiens
atatatatgtgtatatgtatatgtgtatatgtatgtgtgtgtatatatatgtgtgtatatatatatacacacacatacatatacacatatatttcattagttatgt

SEQ ID NO: 48181 - DNA, 74 bp, Homo sapiens
tatatgtgtatatgtatgtgtgtgtatatatatatacacacatatatatacacacacatacatatacacatata

SEQ ID NO: 48182 - DNA, 221 bp, Homo sapiens
gagttaatacttaataaactcccctttatatatatatatgtatatatatatactcccctttatatatatacgtgtatatgtatatgtgtatatgtatgtgtgtgtataaactcccctttatgtgtataaactcccctttatatatatatgtatatatatatactcccctttatatatatatgtgtatatgtatatgtgtatatgtatgtgtgtgtataaac

SEQ ID NO: 48183 - DNA, 117 bp, Homo sapiens
gatgtacatggtccctgtgcaaggatgacatgcagatttgcgaagcgttctatatttttttatctacgcagcaaaccaccatggcacacgtttacctatgtaacaaacctgcacatc

SEQ ID NO: 48184 - DNA, 79 bp, Homo sapiens
gatagggaatacatggttaggaaggaatgaatgcaggcatggtcatttgttcactcactcactcattcattcatctatc

SEQ ID NO: 48185 - DNA, 95 bp, Homo sapiens; identical to SEQ ID NO: 580

SEQ ID NO: 48186 - DNA, 93 bp, Homo sapiens; identical to SEQ ID NO: 69

SEQ ID NO: 48187 - DNA, 149 bp, Homo sapiens
caataccttaagaaatgccttaaagaacaatatcttagtgaacaataccaatgtgaatgttatttttattgttattattattattattttttgagtcagagtctcgctctgttgctcaggctggagtgcagtggcgcgatctcggctca

SEQ ID NO: 48188 - DNA, 118 bp, Homo sapiens
attttaggtcctaaatgagaggtaacatttaaaatatggctattgttgtcaatttataaatatatagtctttcaggccattatatcatcttgttaaatatctttaggcactttgaaat

SEQ ID NO: 48189 - DNA, 83 bp, Homo sapiens
ctataaaacatccttggaaaggttgtctggaacaaagggctgtcagtgcctctgttcactagctgtgcaagagatgtatgtag

SEQ ID NO: 48190 - DNA, 96 bp, Homo sapiens
agaataaaatttttactttttgtagtcatattatgtgtgtatgtatatatatacatatatttgattcaatttaaagtatcccagtggattttgtct

SEQ ID NO: 48191 - DNA, 58 bp, Homo sapiens; identical to SEQ ID NO: 2758

SEQ ID NO: 48192 - DNA, 61 bp, Homo sapiens
ttgagatggagtctctcactctgtcacccaggctggagtgacagtgacagtctcagctcaa

SEQ ID NO: 48193 - DNA, 85 bp, Homo sapiens
agtatggtcttataatggtcttagaagcccaaaggtacataaattgtttctaagtttttctaaccatgacctagaagacagtact

SEQ ID NO: 48194 - DNA, 72 bp, Homo sapiens
tgggtcacactggctctctgattcttggcttcctgatcaacagggaagaggacagaaagccagcccttccca

SEQ ID NO: 48195 - DNA, 72 bp, Homo sapiens
gttggtcatatggggtgactctgtgtttaaaacttttttttttgagacagagtctcgctgtgtcgcccaggc

SEQ ID NO: 48196 - DNA, 104 bp, Homo sapiens
gcttcactcccagggcagagcccatgtctgtaggctccgcctgcatgaagaacagagggcagagtgagcacagacagcctggggtcagaggggaagtgtccggc

SEQ ID NO: 48197 - DNA, 158 bp, Homo sapiens
tgatagatatataatgtcatttatatataattcttgttttacatgttattatataacaagaattatatatattttattatattacattttattatatgaattatatataattatatataatgatatgttatataaatatatatatatataaattcttg

SEQ ID NO: 48198 - DNA, 105 bp, Homo sapiens
gcctcccaaagtgctgggattacaggcgtgagtcaccacacctggcctatttttatatttttttaaaaagacaaggtcttacccctgctgcccaggctggagtgc

SEQ ID NO: 48199 - DNA, 81 bp, Homo sapiens
aacagggacaaagtgagagaatgggttggagaatgcaggaaaggttcaggtccaagagttttttttgtttttgtttttgtt

SEQ ID NO: 48200 - DNA, 58 bp, Homo sapiens
tgagacagagtctcgctctgtcacccaggctggagtgcagtgatgtgatctctgctca

SEQ ID NO: 48201 - DNA, 81 bp, Homo sapiens
ttgcaaatatattcttgtccttttttttgagacagagtctcactctgtcacccaggctggagtgcgaggtacttagtgcag

SEQ ID NO: 48202 - DNA, 79 bp, Homo sapiens
ctggaaacatagcaagaccttgtctctctctctcttctttttttttttttttgagacagggtctccctctgtcactcag

SEQ ID NO: 48203 - DNA, 120 bp, Homo sapiens
tggtaccatctgattttccatatttaaaagtcttcatcttcaaaatgattcaggtaaagatgtatggcaccaggtgaaatgagagactacagagttgagagtcaggagctgtgggggcta

SEQ ID NO: 48204 - DNA, 94 bp, Homo sapiens
atactacatctatatgtagtatgtatgtgtatatatatatactacatctatagtatgtatgtgtatatatatatactacatctatatgtagtat

SEQ ID NO: 48205 - DNA, 106 bp, Homo sapiens
tgtatgctacatataggggttgtatatatgtatatatacatatatacacatgtatatgttttatatatgtatatatacatatatacacatgtatatgtagtatata

SEQ ID NO: 48206 - DNA, 93 bp, Homo sapiens
gctggaaacccttcctggctgcctgcttccctctgagctgtttctgtttactcagaggcacttgctaagctgtgccgtaaaggctgatccacc

SEQ ID NO: 48207 - DNA, 104 bp, Homo sapiens
ttccttcatgccctctctcttcagagtattagttgtgctcgctatgtgacctcagtcacttacacagtctctttgaattttggatttattgcatgtaaatggaa

SEQ ID NO: 48208 - DNA, 100 bp, Homo sapiens
ctgcatatcatactactatgaatgtttttgcatagaaattttttctatattcttcttaggatagattcttagaaacatttttaagtctcttgaaatgtag

SEQ ID NO: 48209 - DNA, 79 bp, Homo sapiens
gagtctcactctgacacccaggctgcagtgcagtggtcggctcactgcagcctccgcctcctgggttcaagtgattctt

SEQ ID NO: 48210 - DNA, 75 bp, Homo sapiens
tggatctcacacacactgtctttctctgacacacacacagtgtaccaggagaaaaatgaatgtgtgtacccttca

SEQ ID NO: 48211 - DNA, 74 bp, Homo sapiens
gtatgtgtgggtctacgggaaagagaaggtgcacacttacatgtgtgtgactctgtgtgtatacacacacatat

SEQ ID NO: 48212 - DNA, 92 bp, Homo sapiens
ttcagatcttggtgggctttctgaactatatctcaattttattttatatatttatttttgagatggagtctcactctgtcacccaggctgga

SEQ ID NO: 48213 - DNA, 69 bp, Homo sapiens
gcctccatggtggaccagagaaagacttttttttttttttgagatggagtctcactctgtcacccaggc

SEQ ID NO: 48214 - DNA, 71 bp, Homo sapiens
tctgtcttcccttccaggcacatatctttgttgttagttttttcattttgatacctggaaaggggttcaga

SEQ ID NO: 48215 - DNA, 75 bp, Homo sapiens
gccccaccggtgatgagcagtacaagccgagatttctcatctctctgcctcactgcctccatttgtaacacgggc

SEQ ID NO: 48216 - DNA, 114 bp, Homo sapiens
tgtgactgctaaggcttgtcttaattgaagtgtcccaggctctctttcttctatttttctttttttttttgagatggagtctcactctgtcacccaggctggagtacagtggca

SEQ ID NO: 48217 - DNA, 79 bp, Homo sapiens
tggtgtgttcttgaagttaacttggtcagtgtcttttgaagagaatgacagaagaatgaaaggtatttagagcacatca

SEQ ID NO: 48218 - DNA, 107 bp, Homo sapiens
atatacatacatttactatatgtgtgtgtgtatatatactatatactatatactatatatgtatatatactttactatatactatacatatgcatgtttgtgtatat

SEQ ID NO: 48219 - DNA, 56 bp, Homo sapiens
gaaacagggtctcgctctgtcactcaggctggagtacagtagtgcaatcttggctc

SEQ ID NO: 48220 - DNA, 65 bp, Homo sapiens
ctgggattcaaaaggcagggtgaagcttttttttttttgagacggagtctcactctgtcacccag

SEQ ID NO: 48221 - DNA, 69 bp, Homo sapiens
gtttcgatactgagtctcgctctgtcacccaggctggagtgcagtggcgcaatctcggctcattgcaac

SEQ ID NO: 48222 - DNA, 88 bp, Homo sapiens
tgaactcaagctgggcacaatggtgcatgcttgtagtcccagctactcggaggctgaggtagaaggatcacttgagcccaggagttca

SEQ ID NO: 48223 - DNA, 58 bp, Homo sapiens
tgagatggagtctcactctgtcactcaggctggagtgcagtagtgtgatctcagctta

SEQ ID NO: 48224 - DNA, 89 bp, Homo sapiens
aaatacctatatttattttatatttgtatgcattttaaatacctaatgaggtatttaaaatacataaatgtatgtaaatatatgtattt

SEQ ID NO: 48225 - DNA, 88 bp, Homo sapiens
agaggaccatgtgacagctgagagattggagtgacgtgtctgcaagcaaaaaatgccaaggattgccagcaaccacctatggtctcct

SEQ ID NO: 48226 - DNA, 113 bp, Homo sapiens
tgccagcattgtctttctcactagactatctctagctctctcacctgctctctctctctgattgaagccagctgccaagttgtgagatgctctctggaaaggcctatatggca

SEQ ID NO: 48227 - DNA, 113 bp, Homo sapiens
tataggatggatatatatatacacatacacacatataggatatataatgtatatctatatacacattatatgtaatatatacatatataggctatatatatactctatatata

SEQ ID NO: 48228 - DNA, 95 bp, Homo sapiens; identical to SEQ ID NO: 68

SEQ ID NO: 48229 - DNA, 93 bp, Homo sapiens; identical to SEQ ID NO: 69

SEQ ID NO: 48230 - DNA, 84 bp, Homo sapiens
ttgccaatcagagaagctcactagagactcagcacccaaagttttaactgggggctgatcatgtaggcagtctctacctggcaa

SEQ ID NO: 48231 - DNA, 69 bp, Homo sapiens
gcttaaacaatgagagaactgtgttacctgatgtagcaagaagtctgaaggtggccagttcccaagagc

SEQ ID NO: 48232 - DNA, 77 bp, Homo sapiens
gtggtcttccctctctgtgtgtctgtccttatcacctcttcttataagggcaccagtcatatagaattagggcccac

SEQ ID NO: 48233 - DNA, 61 bp, Homo sapiens
tgtataatatgtataacatatgtgtatatatgtattacatatatgtgtatatatatttgca

SEQ ID NO: 48234 - DNA, 84 bp, Homo sapiens
cccctcctgcgtgccaagagtgtggctggtctatgtgatacccaggcagctggcacacactggcactctctggggtcactgcag

SEQ ID NO: 48235 - DNA, 98 bp, Homo sapiens
ccagtgcattcttattggacggcctctgctctctgtgaagtgggtgaggtcatatgccgaaagtgaagggtgagcagggagtggggatgagagagcat

SEQ ID NO: 48236 - DNA, 84 bp, Homo sapiens
aatttatgatacagtatttgtaaatcttatttatactagcataaaatattttattctagtgttaaaggtgctgtgttctgaatt

SEQ ID NO: 48237 - DNA, 141 bp, Homo sapiens
aaatttatatgtgtataaatttacatgtatataaatttacatgcacataaatttacatgtatataaatttacatgtatataaatttatatgtatataaatttacatgtatataaatttatatgtatataaatttacatgta

SEQ ID NO: 48238 - DNA, 67 bp, Homo sapiens
gaatggtggaaagagcttggattttggcatcagccttgtttgggtccaagtgctggcttttctattc

SEQ ID NO: 48239 - DNA, 123 bp, Homo sapiens
atatatatatacgtatatatatatatatacgtatatatatatgtgtatatatacgtatatctatgtatatatatacgtatatatacacatatatatgtatatatgtatatatatgtatatata

SEQ ID NO: 48240 - DNA, 84 bp, Homo sapiens
gatattagaggctagatgatgaatgcctggcatcaagggaggtctcctgggaggataaaagatttcacagagtttttgcatatc

SEQ ID NO: 48241 - DNA, 83 bp, Homo sapiens
catagcatcttacttttgagtcattatctctctgccatacacacaagtcatagctggggatttcaactcacggtgaagctatg

SEQ ID NO: 48242 - DNA, 78 bp, Homo sapiens
gtatatatatatatgtgtgtgtgtgtgtgtgtataaagggacatgtatatgtgtctatatatatgtgtgtgtgtgtat

SEQ ID NO: 48243 - DNA, 84 bp, Homo sapiens
tgaaagccagacgagacatgtggaaaggactggttagaaaagcgacaaccacagcccccagtgacagtacagtctgagctccca

SEQ ID NO: 48244 - DNA, 86 bp, Homo sapiens
atgtagcatatacatatacaaatctatacatatgtatatatacatatatactagagtagtatatattttatcgtataatgctatat

SEQ ID NO: 48245 - DNA, 95 bp, Homo sapiens; identical to SEQ ID NO: 68

SEQ ID NO: 48246 - DNA, 93 bp, Homo sapiens; identical to SEQ ID NO: 69

SEQ ID NO: 48247 - DNA, 98 bp, Homo sapiens
tatatatgtgtgtgtgtatatatatatgtgtgtgtgtatatatatgtgtgtgtgtgtatatatatatgtttgtgtgtgcatgtgtgtctgcgtgtgtg

SEQ ID NO: 48248 - DNA, 72 bp, Homo sapiens
tgtatgtgtatatatatatgtgtatgtgtatctgtatatatgtacacatatatacatatatacaacatatat

SEQ ID NO: 48249 - DNA, 99 bp, Homo sapiens
gaatcccatttactctccacacagttttggatgtcactaaaacccagatgtttaataacatgtgtttttgaagctgttgataaggaatgacgagggttt

SEQ ID NO: 48250 - DNA, 92 bp, Homo sapiens
gggctcatctggacaattcttctgttccagttggcatcaactggggtcactctgtgtcactcaactggctgctatagatgtctagggtgtcc

SEQ ID NO: 48251 - DNA, 112 bp, Homo sapiens
acagctgtgtccaggaatcaggggagccagctggggctggtgagccactcaccctcacacagggtcaggggcttgctgaggctctgcagctctgctggccgcaacagcttgt

SEQ ID NO: 48252 - DNA, 113 bp, Homo sapiens
tttgacctgccccttgagatattggaataaaatgagatactgcaacaggatgtgtcgacgaaagttactgtcactcagttgtaaatccatcagctactcaagaaacaagcaaa

SEQ ID NO: 48253 - DNA, 85 bp, Homo sapiens
agctgggattacagatgtgcaccactacatccagatactttttgtatttttagtagagatggggtttcatcatgttggcctggct

SEQ ID NO: 48254 - DNA, 60 bp, Homo sapiens
gattatcagaaagatacatgtatatatatgtgtgtttgtgtgtgtgtctgtctgtgtgtc

SEQ ID NO: 48255 - DNA, 106 bp, Homo sapiens
gtgaaaggaaattaggtgtacttttcacttcttgctctctctctctcagaatacattattcaccctgagacctgaggagtggggaagtgtactactcctgctgcat

SEQ ID NO: 48256 - DNA, 100 bp, Homo sapiens
aaagcattttaattatatgttaccttttaataaagaagttcatggtgagttttattaatgaatttttttactagatgctagaggatgattgaagagtttt

SEQ ID NO: 48257 - DNA, 86 bp, Homo sapiens
aggcatccaaataggaagagaggaagtcagaatactcttgtttgtagatgacataattttttttttttctttttgtgatggagtct

SEQ ID NO: 48258 - DNA, 69 bp, Homo sapiens
gagactctgtctcagaaaaaaagaactagaatttttttttttttttttttttttgggagacggaatttc

SEQ ID NO: 48259 - DNA, 75 bp, Homo sapiens
gcctggcttcaagtgacaggctgactctcttattaggggctaaggcagctggtgactttaagtggaagccagtgc

SEQ ID NO: 48260 - DNA, 95 bp, Homo sapiens; identical to SEQ ID NO: 68

SEQ ID NO: 48261 - DNA, 93 bp, Homo sapiens; identical to SEQ ID NO: 69

SEQ ID NO: 48262 - DNA, 101 bp, Homo sapiens
tgaagtcagaggattgcttgagcccaggagtcagaggtgacagtgagctatgattgtgccactgcactctagcctgggcaacagagcaagaccctgtctca

SEQ ID NO: 48263 - DNA, 102 bp, Homo sapiens
gtggtgcgcaccatgtagtctcagctacctgggaggctgaggtaggaggatggtttgagcccagaaggttgaggctgcagtgagctatgatggtgccactgc

SEQ ID NO: 48264 - DNA, 211 bp, Homo sapiens
atatatatgtatatatatatgtatgtatatatgtgtgtatatgtgtatatatgtaagtatatatgtgtgtatatgtatatatacatatgcatgtgtgtatatgtatatatacatatacatatacacacacatacactcctgtatatatacatatatatacatatatgtatatacacacaaacatacatatatgtgtgtgtatatagataca

SEQ ID NO: 48265 - DNA, 161 bp, Homo sapiens
atatacacacacatatatgtatgtttgtgtgtatatacatatatgtatatatatgtatatatacaggagtgtatgtgtgtgtatatgtatatgtatatatacatatacacacatgcatatgtatatatacatatacacacatatatacttacatatataca

SEQ ID NO: 48266 - DNA, 137 bp, Homo sapiens
tcaactgtttgcttccttcccttcttgtccatagctgaatgagctgctgtccagcgtgaaagagtagggagagagcagaagctggtcacacccctctctggcagcaggcagctgccaaatgtaggcctaagcaagag

SEQ ID NO: 48267 - DNA, 70 bp, Homo sapiens
gtacatgggacgctcagagcatctgtgtaaatgtgattttatgttttgctcttgagccccagtgaggtac

SEQ ID NO: 48268 - DNA, 117 bp, Homo sapiens
gggatacaatggttaaaaattgtgtatacacacacacacatatatatgtactatatatatatatatgcaatcatgtgtatcatgtatatatatatttgcaatcatgtttatattccc

SEQ ID NO: 48269 - DNA, 85 bp, Homo sapiens
tgagagtcagacttttgctcatgggaatgttctctgcctggcctcagtgtaatatccctgacctaatgaaagcaaatggttctca

SEQ ID NO: 48270 - DNA, 83 bp, Homo sapiens; identical to SEQ ID NO: 14795

SEQ ID NO: 48271 - DNA, 120 bp, Homo sapiens
ctagcatctccgatttggagatctcgatatagttcaaagcagaatctaaaacttgactcttctgactctgactcctttacgtctctaggcctccatttacaggaactgaaagaaaatgct

SEQ ID NO: 48272 - DNA, 74 bp, Homo sapiens
ttgtgagtaggtgaatttgcagatatagaattcattaatgaggtttactgtatttgtaaatctcacattagcag

SEQ ID NO: 48273 - DNA, 100 bp, Homo sapiens
gaaaattaatcatttatatgtgatgtactctaagcatttttatttttattttttttgcttcttgactgcatgactaacaaaatataggtggttttatttc

SEQ ID NO: 48274 - DNA, 95 bp, Homo sapiens; identical to SEQ ID NO: 580

SEQ ID NO: 48275 - DNA, 93 bp, Homo sapiens; identical to SEQ ID NO: 69

SEQ ID NO: 48276 - DNA, 97 bp, Homo sapiens
tacatggcatgtgactctctctctctatatatatatgtgtatacccatacatacacacacacacatatatacatttgagaactttttaagctgtgta

SEQ ID NO: 48277 - DNA, 95 bp, Homo sapiens; identical to SEQ ID NO: 68

SEQ ID NO: 48278 - DNA, 93 bp, Homo sapiens; identical to SEQ ID NO: 69

SEQ ID NO: 48279 - DNA, 117 bp, Homo sapiens
gtatgtatgtacgtgtgtatgtatgtatctgtctatctaaccctaccatattatacacgttttatttatgtgtatatatatacatatatatatacatatatacacatacatatatac

SEQ ID NO: 48280 - DNA, 84 bp, Homo sapiens
aggacaaatgattttatcctcttctaccccaaattttctcgggcagaggtagttggaagaattggaaaaatgatcccgtgttct

SEQ ID NO: 48281 - DNA, 89 bp, Homo sapiens
gagaggttagtggtctaggctggctagaaaggtgctgaattttgttctggcagctggttaaattgctagtatatcctattgtatctgtt

SEQ ID NO: 48282 - DNA, 70 bp, Homo sapiens
gtgagacgttgagtagacattttaaagtcttctgagctaagagaagaaagattgctcttcaatgtctgcc

SEQ ID NO: 48283 - DNA, 95 bp, Homo sapiens; identical to SEQ ID NO: 68

SEQ ID NO: 48284 - DNA, 93 bp, Homo sapiens; identical to SEQ ID NO: 69

SEQ ID NO: 48285 - DNA, 95 bp, Homo sapiens; identical to SEQ ID NO: 68

SEQ ID NO: 48286 - DNA, 93 bp, Homo sapiens; identical to SEQ ID NO: 69

SEQ ID NO: 48287 - DNA, 95 bp, Homo sapiens; identical to SEQ ID NO: 68

SEQ ID NO: 48288 - DNA, 93 bp, Homo sapiens; identical to SEQ ID NO: 69

SEQ ID NO: 48289 - DNA, 90 bp, Homo sapiens
tgtctctgagttaattcttcgggtttggatgggtaaatgtgtgtttctcacagtcacttatctccttcaagcctcttgcagtaacagata

SEQ ID NO: 48290 - DNA, 86 bp, Homo sapiens
atgattgtatttgttcagtttgtgtgtgtgtgtatatatttttctgcatatatatttatatatatattttttgcccatataattat

SEQ ID NO: 48291 - DNA, 83 bp, Homo sapiens
aaacggcttttttgggggagacaatagcatccttttatattgccaaaaatgatgcaaatatttgctccttttgaaatctgttt

SEQ ID NO: 48292 - DNA, 118 bp, Homo sapiens
taagttttctgcattccaggttttgaactttttaccattattaaaagcagcattaaatatgttttatataatttatttggcccttatagtcaagtttatggaagtagaattgtacttg

SEQ ID NO: 48293 - DNA, 60 bp, Homo sapiens
ggccaggcacaccctagtcccagctactcaggagcctgaggtatgaggatgtcttgagcc

SEQ ID NO: 48294 - DNA, 92 bp, Homo sapiens
atatatacatatataaatatacacttatttatatatgtgtatatacaaatatacacatatataaatatacacgtatttatatatgtgtatat

SEQ ID NO: 48295 - DNA, 84 bp, Homo sapiens
tttggaaaacgtacaggactgtagtcgagctgcacatatgcacactctgtggctcagacattcaactcctgtgcacacaccaga

SEQ ID NO: 48296 - DNA, 116 bp, Homo sapiens
agtgtacatagagcagcctaatatgatctcaagcaggtagttggttggttagtaaatatcatttctcttctgcatgatgttccttcctgagttgaggtctgtggttctgtatcact

SEQ ID NO: 48297 - DNA, 58 bp, Homo sapiens
gtgtgtgtgtctgtgtctctgtatgcacacacatgcacagtgaggcagatacagacat

SEQ ID NO: 48298 - DNA, 86 bp, Homo sapiens
aataaaaggcaatttaaaggttacttaattttatatacatgtaaaaatgtctgactttgggtaagactcttaaaatgccagttatt

SEQ ID NO: 48299 - DNA, 80 bp, Homo sapiens
tctcaatttgtaagtgtgtctccctctctatactgagaagacagagagagctaagtcactagaaacttttacaatggaga

SEQ ID NO: 48300 - DNA, 115 bp, Homo sapiens
aatacatcttccacttttaatacagaatatctgcattataagctgtatgagtaaattcagtttatttttaatttgttgatgttttgtactagctaggaacatttattcatgtatt

SEQ ID NO: 48301 - DNA, 140 bp, Homo sapiens
tatatatataaaggagtttttatatatatactttatatatatataaaggagtttttatatatgtactttatatatatataaaggagtttttatatatatactttatatatatataaaggagtttatatatatatataagg

SEQ ID NO: 48302 - DNA, 83 bp, Homo sapiens
cagcctgggcaacagaaagagacccttttagccattctttttttttttttttgagagggagtctcactctgtcgcccaggctg

SEQ ID NO: 48303 - DNA, 95 bp, Homo sapiens; identical to SEQ ID NO: 68

SEQ ID NO: 48304 - DNA, 93 bp, Homo sapiens; identical to SEQ ID NO: 69

SEQ ID NO: 48305 - DNA, 83 bp, Homo sapiens
catgtatatgtgattatatgcatgtgtatagatatgtcatacataacatgtatttatacatgtatgtattttgcatatatatg

SEQ ID NO: 48306 - DNA, 82 bp, Homo sapiens
tcttctgtctggttgttgtttctattattgagagtggatgtattagtccattctcatgctgctatgaagaaatacccgagac

SEQ ID NO: 48307 - DNA, 95 bp, Homo sapiens; identical to SEQ ID NO: 68

SEQ ID NO: 48308 - DNA, 93 bp, Homo sapiens; identical to SEQ ID NO: 69

SEQ ID NO: 48309 - DNA, 117 bp, Homo sapiens
tgtatggatgattataaggtatgtatgaggtagttttttgtttatttttctatgtattactagtaagcatttgacagaataagtatctagtaagcatctagttttcatcaaaaggca

SEQ ID NO: 48310 - DNA, 60 bp, Homo sapiens
tatatatatatatatatgtgtgtgtgtatatatatgtatatatatgtgtgtgtatatata

SEQ ID NO: 48311 - DNA, 106 bp, Homo sapiens
tctagatatccatatagatatatgtttagatatcgaatgtatatatctatatgtcaatatagatagatatattaaatataaatacatagatcaatttttttttaga

SEQ ID NO: 48312 - DNA, 91 bp, Homo sapiens
agaaactagccaaatatttgtatatatatctagatatatatatatgtctaggtgtcacacgtgtgcatgcatgtttgtgtttattatatct

SEQ ID NO: 48313 - DNA, 114 bp, Homo sapiens
gataaagctaattttgagagataaagctatttctttgatatagattttaaagcaatttatctagttcagtaattccagaaaggcatgttatctagatcagtgtgtagtctcttc

SEQ ID NO: 48314 - DNA, 78 bp, Homo sapiens
gcttgattaatatttgaaggatagaaagctaggaggttgttatcctctctgtgattctgtctctataatatcagaagc

SEQ ID NO: 48315 - DNA, 86 bp, Homo sapiens
catgtgtgtgctctcgtgtgtacatatatacatatacatatatatatatatatatgtatacatacatacacacacacacacacatg

SEQ ID NO: 48316 - DNA, 109 bp, Homo sapiens
acctaggaaagaacaagggcagcttggaggttaaaggcaagatggagttgattaggtcagatctctctcactgtcataattgtctcactgttataatctttataaaggt

SEQ ID NO: 48317 - DNA, 58 bp, Homo sapiens; identical to SEQ ID NO: 1673

SEQ ID NO: 48318 - DNA, 85 bp, Homo sapiens
gaatgatcagctgagattagaacttttgtcccctgtgaaactagctagacacagggataaatatttctattttagctaagaattc

SEQ ID NO: 48319 - DNA, 84 bp, Homo sapiens
ttagaacacaactaactgaactcctcccaagaacaggcaatggtgggccctgcttacttctgattctgtctgttggttttctga

SEQ ID NO: 48320 - DNA, 60 bp, Homo sapiens
gcatatatatgtatatgtatatatatgtatatgtgtgtatatatatgtatatgtgtgtgt

SEQ ID NO: 48321 - DNA, 95 bp, Homo sapiens; identical to SEQ ID NO: 68

SEQ ID NO: 48322 - DNA, 93 bp, Homo sapiens; identical to SEQ ID NO: 69

SEQ ID NO: 48323 - DNA, 105 bp, Homo sapiens
gtaattatatatgtatatacacatatatatgtgtatatgtatatatatacacacacagacatatatacatacatatatgtatatatatggttataccttcatgta

SEQ ID NO: 48324 - DNA, 86 bp, Homo sapiens
catatctttttggctgcaatagtatttgaattttactttggtttgtaaggaagtgattcgagtattttgagcatgaaaatgatatg

SEQ ID NO: 48325 - DNA, 80 bp, Homo sapiens
gtgacagtgagtgagttgtcacaagatctgatggtttaaaagtgtgtggcacttccccctcagtctctctctcctaacac

SEQ ID NO: 48326 - DNA, 104 bp, Homo sapiens
taagctttctacttacagagtaaactggagggaaaatctgttatttttttttaaataagctgggatttgacttttgtttatgagtctataggttctgaaatttg

SEQ ID NO: 48327 - DNA, 91 bp, Homo sapiens
ctttggtgttccgtttatagagcagagtagatttttttttttttttttttttttttagacggagtctctcgctctgtcgcccaggccggag

SEQ ID NO: 48328 - DNA, 101 bp, Homo sapiens
gtttctggagtatgaaagcctggctgcctgacagagtgagagtgtgaaacactctcactctgtcataccggtgttcgctgtcttcatactaccagcagggc

SEQ ID NO: 48329 - DNA, 116 bp, Homo sapiens
acttcttctgctcctatttattatattttaatatattaacattttagatttaatgtttatttatgaaacattagttacttaaagtaaatattagaaagtggtaatgaacaagaggt

SEQ ID NO: 48330 - DNA, 96 bp, Homo sapiens
tatgtacaaatttgatcatgtcattttgttgttcactggttattatgcagacttcactaggtaacagctttatagcatcaatggtctatgtatgta

SEQ ID NO: 48331 - DNA, 108 bp, Homo sapiens
tgtgtatatatacacacatgtatatgtgtatatatacacacatgtatatgtgtatatatgtgtatatatacacacatgtatatgtgtatatatgtgtatatatacaca

SEQ ID NO: 48332 - DNA, 96 bp, Homo sapiens
atatgcacacatgtatatgtgtatatatgtgtatatatgcacacatgtatatgtgtatatatgtgtatatatacacgcatgtatatgtgtgtatat

SEQ ID NO: 48333 - DNA, 83 bp, Homo sapiens
atatgtatatatgtgtgtgcgtatataaaattacatatataacatatataattatttatatatgtgtatgtatatctatatat

SEQ ID NO: 48334 - DNA, 147 bp, Homo sapiens
gtatacaaacacacacatatgaatgtatgtataactgtgtatatttgtatataataacaaatatgtatagacatgtatatatatttgtatatatgtatatatatttgtatatttgtatgtaataacaaatgtgtatgtgtatatata

SEQ ID NO: 48335 - DNA, 67 bp, Homo sapiens
ggcctcaggtggcagacagatttttttttttttttttgagacggagtctccctctgtcgcccaggct

SEQ ID NO: 48336 - DNA, 58 bp, Homo sapiens
ttgagaaggtctcactctgtcacccaggctggagggcagtggcgtgatctcggctcag

SEQ ID NO: 48337 - DNA, 79 bp, Homo sapiens
cattacatatatatgtatatgtatgtatgcgtgtgtatatataggtatatatatgtgtatgtatatatatatagtgatg

SEQ ID NO: 48338 - DNA, 84 bp, Homo sapiens
ttcatgtatatatgcatatatacatatatgtatataaagatacatacaacatacatatgtatatgtgtatatatatacacggaa

SEQ ID NO: 48339 - DNA, 108 bp, Homo sapiens
gtatggcatatatattatgtaacgtattacataatatatgtatatatttgcatatgtgtatatgttatataatatattgtgtaatatgtgtatatactgcatgtatat

SEQ ID NO: 48340 - DNA, 113 bp, Homo sapiens
gatattttcattaaaaagagtagatagatttatccttgtgtgcatattatatatatgtaattatatatgtatgtatataataatctggttatatttttgaggattctaatatt

SEQ ID NO: 48341 - DNA, 116 bp, Homo sapiens
aatgagatttgcaagtggataaatagagtgattttgaaaatgttaataaattacaaactctggtactagctagaattgatattaagtcaccattctatgaagaacattggctcgtt

SEQ ID NO: 48342 - DNA, 93 bp, Homo sapiens
gaagagaggtatatatattgtgtgtgaaacatatacatatatatgtatatatatagtgtgtgtgtttcacacacaatatatatgcctctcttc

SEQ ID NO: 48343 - DNA, 115 bp, Homo sapiens
gctatctggtagttactcatccctgagttttcaaaatatctgtcccatatttggctattatgtatctttatttcaaggtgggcagaagggaaactaatgagaaaattatctttgc

SEQ ID NO: 48344 - DNA, 104 bp, Homo sapiens
atgccaaagagtataatttctggttatatggaagttgcttgtttagtttattaagaaactgtccattgtcaacttttagttaacttattttttgtataaggtat

SEQ ID NO: 48345 - DNA, 287 bp, Homo sapiens
acacactgtgtgaatatatatatttgtatatatatacacacacactgtgtatatatatatgtgtatatatacacacacactgtgtatatatataagtgtatatatacacacacactgtgtatatatatgtgtatatacacacacactgtgtatatatatgtgtatatatacacacacactgtgtatatatatatatgtgtatatatacacacacactgtgtatatatatatgtgtatatatacacacacacaatgtgtatatatatatgtgtgtatatattcacata

SEQ ID NO: 48346 - DNA, 102 bp, Homo sapiens
tatgggatatgtgcatatatatatgtgggtatatgtatgtgtatatatacacatatatatgtatatatatctcataacaccacacctgtgtatgtgtatgtc

SEQ ID NO: 48347 - DNA, 82 bp, Homo sapiens
gtcctttgaagccaggcattgacttctcctgtagagctataaaagttcctagacaggattttttgttttttcaataaaggac

SEQ ID NO: 48348 - DNA, 115 bp, Homo sapiens
gggttgtttctaatgtggtgtcattccaaaagtattgctatgcatatttttatatataacttgtggtgaatgcgtctgaacaattctggggtgtatacacagaaatagattgctt

SEQ ID NO: 48349 - DNA, 64 bp, Homo sapiens
tgtgtgtgtgtgtgtgtatacacatatatggatctgtgtgtttgtatatatatatacacacaca

SEQ ID NO: 48350 - DNA, 84 bp, Homo sapiens
atatatgtatatatatgtatgtgtgtatatatatgtgtgtgtatatacatatatactctgtgtgtgtatatatatatgtatata

SEQ ID NO: 48351 - DNA, 76 bp, Homo sapiens
ctcccactccaggtggtcactgggcacagtgtgtgcacacagcagccttggccacacattccagctgagaggggag

SEQ ID NO: 48352 - DNA, 102 bp, Homo sapiens
ctagctatttctacaactatgactaccacatatatatatatgtacacacatatatatatatatatatgtaaagtgaatttcttgtagacaacatgtagttgg

SEQ ID NO: 48353 - DNA, 167 bp, Homo sapiens
gtgtaaaaaatatatatatgtgtgtgtatatatatgtgtatatatgtgtatatatgtatatatgcgtatacacgtatatatgtgtatatatgtgtgtatgtgtgtatatatatgtatatatacatatacatatatatacacacacacatatatatgtatatgtatac

SEQ ID NO: 48354 - DNA, 79 bp, Homo sapiens
gttctgtctcactctgtgagatttcctgggaggtcttgtactgacctctaaggaaatccattcaacttgaaagcagaac

SEQ ID NO: 48355 - DNA, 86 bp, Homo sapiens
ccatgagaagagaagagagtctgcagagttacttgtaaaacagcactgcggtagtaatttttagttcctcatttgtcttcatttgg

SEQ ID NO: 48356 - DNA, 114 bp, Homo sapiens
tatatatatatatatagcgagagagagagagagagggagagggagagagagagagagagagagagaaattatatatagagataatctgtctctctctatgtatatgtgtatata

SEQ ID NO: 48357 - DNA, 57 bp, Homo sapiens
tgagacagagtctcgcactgtcacccaggctggagtgcagtggcgcatctcggctca

SEQ ID NO: 48358 - DNA, 92 bp, Homo sapiens
tgacacaggtgaaatatgtttcaagttttatatataatatatattttattttactttattttatttttttgagacatagtatcactctgtca

SEQ ID NO: 48359 - DNA, 91 bp, Homo sapiens
tacctggtgagatattttggggatatgatccaagtctaaatgcaaaatttatttatgtttcatatacacctcatatcatggcctaaaggta

SEQ ID NO: 48360 - DNA, 103 bp, Homo sapiens
ccctccccaggagcttctgtccctgtctgttggctgcgcaacattttaccttccagagaacagacagaccacaggatttagtatgggcacctgggaagatggg

SEQ ID NO: 48361 - DNA, 71 bp, Homo sapiens
gtgtgtctctatctctgtgtccaaatttcccctttatataaggacattagtcctgtgagattggggctcac

SEQ ID NO: 48362 - DNA, 115 bp, Homo sapiens
gcatgatttttaccttggtgcctcattgacacaattatctatcaaagtttttaaaaacatgcttttttacttgatgggcaggtgggtggaggggtcggtagggtggcagaaatgc

SEQ ID NO: 48363 - DNA, 92 bp, Homo sapiens
cgggcagccactcccagagcccctggaactctggcccaaggctctctgactgactccttcccagatcttcttggcttagtggctgaagactg

SEQ ID NO: 48364 - DNA, 104 bp, Homo sapiens
tgtgttcacttaagaaattataaaattgtgtgtattcatttggatgacaatcttatatataaatatttttcataattttggtggccagctcttaagttaatata

SEQ ID NO: 48365 - DNA, 103 bp, Homo sapiens
gcaatctgtttcttcacctcgttactggtgacatggtgttttcagtttgtgaagattcagtgcactcgtgatatgtgcacttttctggatgtatgttacacta

SEQ ID NO: 48366 - DNA, 104 bp, Homo sapiens
gagacgcagacgggtcggggatgcagggagtggaaatattgagggaatattccttttaatcattatctttatttttatttcattccagcttctcaatgtggatc

SEQ ID NO: 48367 - DNA, 58 bp, Homo sapiens
tgagacagagtctcactgtgacacccaggctggagtgcagaggggtgatctctgctca

SEQ ID NO: 48368 - DNA, 71 bp, Homo sapiens
gtaagcaatagaggtgaatggagcaagcactagactttagtgctgtctctttcactctctagctgtgtgac

SEQ ID NO: 48369 - DNA, 102 bp, Homo sapiens
tccacttggaatttttttgtatgatacaagggatcaaattttattttatttatttatttacttattttgagatggagtttcactcttgtcagctaggctgga

SEQ ID NO: 48370 - DNA, 103 bp, Homo sapiens
agggagctcaaataacttgttaaaatatagttaaaggcagagcttagatgtgactcaaggtctctctgactctaaagtctgtgatagtttttttatatgccct

SEQ ID NO: 48371 - DNA, 88 bp, Homo sapiens
gtttgtcacacgcgtccgtgtgaagagatcaccaaacaggctttgtgtgagcaacaaggttgtttatttcacctgggtgcaggcgggc

SEQ ID NO: 48372 - DNA, 113 bp, Homo sapiens
ttgagtatggagtggtggtagggagtggaggagccaaaaagaaatcttctacagtactggtgtttctttttcttttttttatatggagttttgctcttgtcacccagactgga

SEQ ID NO: 48373 - DNA, 117 bp, Homo sapiens
taactggtattttggctgtatcctcaataaatacttgttaagtgggtctgaatataattcttaatatgtatttgagaaataatagagttgggattttcagagaaagaccttaagttg

SEQ ID NO: 48374 - DNA, 58 bp, Homo sapiens
tgagacagtgtctcactctgtcatccaggctggagggcagtgctgtgattttggctca

SEQ ID NO: 48375 - DNA, 56 bp, Homo sapiens
tgagccagtctcgctctgtcacccaggctggagtgcagtgatgcgatcttggctca

SEQ ID NO: 48376 - DNA, 66 bp, Homo sapiens
gtcctttttatttgccactctccctgtttgggagacaggactcccaaacagggagagttgctggac

SEQ ID NO: 48377 - DNA, 58 bp, Homo sapiens; identical to SEQ ID NO: 2224

SEQ ID NO: 48378 - DNA, 56 bp, Homo sapiens; identical to SEQ ID NO: 335

SEQ ID NO: 48379 - DNA, 97 bp, Homo sapiens
tgctacatattattataacgtataatatagatgtatatagtctataataatatatggatttctatatgtatatttttataagcagagtagagtagca

SEQ ID NO: 48380 - DNA, 77 bp, Homo sapiens
cttcttatggctctctcaccgtctctaagcctccaattttggtgatatggagggtgggaggaggcgtattgagggag

SEQ ID NO: 48381 - DNA, 113 bp, Homo sapiens
aagctctttagagcccaacctggctcataggagattcttaatcaatcaatcaatcaatcaatgtatgttgagtctgaatctagtagtcacctgaggccaaaagaaacttgctt

SEQ ID NO: 48382 - DNA, 95 bp, Homo sapiens; identical to SEQ ID NO: 68

SEQ ID NO: 48383 - DNA, 93 bp, Homo sapiens; identical to SEQ ID NO: 69

SEQ ID NO: 48384 - DNA, 111 bp, Homo sapiens
aaattttttgccaaattttagtttgggtttagatttcaaaaatgtaattatatttcaaaaatgaaatatgattggagaagactccctgtgctatattggtaatactggttt

SEQ ID NO: 48385 - DNA, 84 bp, Homo sapiens
cctcctggtactaaaggagagaagggttgaagttgttctgacatctgctctaaataggttcactgtctctctgagagcttgagg

SEQ ID NO: 48386 - DNA, 98 bp, Homo sapiens
gtgcctttcaagaatggttcttgaatgaatggatgaatgaatgaatgtttgtcatgacagcaattcttcattcattcagttgctatttattgattgcc

SEQ ID NO: 48387 - DNA, 83 bp, Homo sapiens
ctagcaggatgcagtgacttctgcttgtaatcccagctactcaggaggctgaggtaggaggatcgcttgagccgaacagttag

SEQ ID NO: 48388 - DNA, 66 bp, Homo sapiens
ggattggctgtctccatccccatctgcccaggtgagaccaggagtgtggatgagtagagcttttcc

SEQ ID NO: 48389 - DNA, 73 bp, Homo sapiens
ggagtgtgatgacaggcagcaggtaggggcagcagacaatgcttctgaaagttgggctctgtcagggtagttc

SEQ ID NO: 48390 - DNA, 102 bp, Homo sapiens
atttgccttctatgcatcaaaatatcagtgcaatgttgtatgctattaggcaatacagaatcccagcactgtattatttcctgacattttagttgagcaaat

SEQ ID NO: 48391 - DNA, 72 bp, Homo sapiens
tgtgtgcgtatatatatgtgtgcttgtgtgtgtatatatatatatataggtgtgtatgtatatatgtgtgta

SEQ ID NO: 48392 - DNA, 102 bp, Homo sapiens
gtctaattgtcctatcaaactgtttctcttcaatgcattttcattgaactttacaagtcaaatgaatttgatgaattgaaactaatggcaaatcaatatggc

SEQ ID NO: 48393 - DNA, 111 bp, Homo sapiens
tttcccagtcaggctctttttgtagtggctgctattgtttgaacagagagagcagactctcccaccaatagagaggccatgcacatgtgagggctggggacacgtgggaaa

SEQ ID NO: 48394 - DNA, 64 bp, Homo sapiens
taatggaagcacattttgaagagggaagaaaactgactttttttctttataatggcatccatta

SEQ ID NO: 48395 - DNA, 95 bp, Homo sapiens; identical to SEQ ID NO: 68

SEQ ID NO: 48396 - DNA, 93 bp, Homo sapiens; identical to SEQ ID NO: 69

SEQ ID NO: 48397 - DNA, 58 bp, Homo sapiens
tgaggctgagtctcgctctgtcacccaggctggagtgcagtggcgagatctcggctca

SEQ ID NO: 48398 - DNA, 78 bp, Homo sapiens
cccaaaggcttgtatttctctgtgtcactctgacttgcaggaataatgaattcctgcttgtgacacagtgtcttgagg

SEQ ID NO: 48399 - DNA, 93 bp, Homo sapiens
atatagtacacagtgtgtcatgttatatatatgtatatacacatacgcatgcacattacatatatatgacatgtaaattctgtctctctgtat

SEQ ID NO: 48400 - DNA, 75 bp, Homo sapiens
ggacatcagttggatgacttggaggctaggggttagatttatcttcagctgactcactcactcacaattgatgct

SEQ ID NO: 48401 - DNA, 95 bp, Homo sapiens
tggaaaagttagtaagaggtattttatagttctatataaatatgacattttagcctggtagggaagtgtaagtgtgccattgtaataagtttcca

SEQ ID NO: 48402 - DNA, 105 bp, Homo sapiens
ttcagtacttcttcttttgcttttattttctcttttttttttttttttttttgagagggaggattaggaagcaaaaatgataggagaaatggagaaaataagagc

SEQ ID NO: 48403 - DNA, 126 bp, Homo sapiens
ttagtaaagtcaaagttcttagaaaaagggggtactgaagagcagaattgatttattgcatatgaaatcttatctaaagcagttgattctttttatcaggtacttgactttttagtaatagctgat

SEQ ID NO: 48404 - DNA, 83 bp, Homo sapiens
tagtcaatttcatacaacagttgatatgatgatgatcttcttgactcatttctctggttaactttttctgtgatatttggcta

SEQ ID NO: 48405 - DNA, 60 bp, Homo sapiens; identical to SEQ ID NO: 33693

SEQ ID NO: 48406 - DNA, 60 bp, Homo sapiens; identical to SEQ ID NO: 33693

SEQ ID NO: 48407 - DNA, 109 bp, Homo sapiens
gaaagtaaaatgacaaatactgaaggtgaggactgaatgtaaatcatatagtaaactatataaactatatttatattatctcattagtctataatgtcaatactatttc

SEQ ID NO: 48408 - DNA, 103 bp, Homo sapiens
gaactaggtgtattgaatttcttttaggcctactactggattcttaagatgtatttttaagtgtcacatactaagtctggggaggggaagggtgcttaaattc

SEQ ID NO: 48409 - DNA, 108 bp, Homo sapiens
atgtatatatgtgcatgtgtatagtatatatatatataatacacgcacatagtgtgtgtatatatatatcttatgtgtatatatatcttatttatgatatatatatat

SEQ ID NO: 48410 - DNA, 71 bp, Homo sapiens
agatgagatatgaaagaatttaggttattggggaaggagccagtcatttaatctcttttgtatttcagact

SEQ ID NO: 48411 - DNA, 58 bp, Homo sapiens; identical to SEQ ID NO: 1673

SEQ ID NO: 48412 - DNA, 209 bp, Homo sapiens
gtatagatacatatagagtacatatatctagtgacagtgtatctatatatatagatacactctctatatatctatatatatatactctatatgtatctgtatatatatactctatatgtatctatatatactctatatgtatctatatatgtatatatacagtatatatatagatatatatatggatacatatagagtatatatatata

SEQ ID NO: 48413 - DNA, 114 bp, Homo sapiens
agagtgtatatatatatatagatacactctctatatatctatatatatatatatatatactctatatgtatccatatatatatctatatatatactgtatatatacatatatag

SEQ ID NO: 48414 - DNA, 66 bp, Homo sapiens
tttgggtacattgttgaggtaattatttgatgtttttaaatattacctctattttagtagcctaaa

SEQ ID NO: 48415 - DNA, 84 bp, Homo sapiens
tatatatgtaaatatatattatgcatgtttacatatatgtgtatatgtgtatatacatatgtgtgcatatatgtgtatatgtgt

SEQ ID NO: 48416 - DNA, 58 bp, Homo sapiens
tgagacagagtctcactccctcacccaggctggagtgcggtggcgtgatctcggctca

SEQ ID NO: 48417 - DNA, 75 bp, Homo sapiens
tatatctatatagatacagagagatatacctacatatgtatatatagatatgtatctatatatctaatagatata

SEQ ID NO: 48418 - DNA, 91 bp, Homo sapiens
gctgtctgggcctgggctgcttctgtgtgtgaaaagcttttttttttttttgagatggagtctcactctgtcgcccaggctggagtgcagt

SEQ ID NO: 48419 - DNA, 56 bp, Homo sapiens
gtgtatatatgtgtgcatatgcatatatagtatatgttagtatatattatatacac

SEQ ID NO: 48420 - DNA, 86 bp, Homo sapiens
tatgtttgataaacagagtagagtgagagctgggggttccgggtaaatcccaaagctgaactctgaaagtctgggacaataacata

SEQ ID NO: 48421 - DNA, 80 bp, Homo sapiens
gtatgcacacacacacatatgttgtatatgttattagccaaactataaaattatatatatatgtgtgtgtgtgtacatat

SEQ ID NO: 48422 - DNA, 103 bp, Homo sapiens
gtgagtctccaattcaaagctgtttgatattgatattttagcatggattcctcagtggtattttttgtttttattgtttatttattttgagatggagtctcat

SEQ ID NO: 48423 - DNA, 114 bp, Homo sapiens
gtgctattggatgcttaggcatcctctctattttaaggacttatttttgttgacacacagcacagtatgagaggcaggaaggtcttggatgtctttacttcctattaagggcat

SEQ ID NO: 48424 - DNA, 112 bp, Homo sapiens
aatgtctccggactgcgtgggaagcttatgaaccagaggtgcctgtactgacagaagcctgtgagcaaagagggttccgagaactggttagctctttctagccgggaatatt

SEQ ID NO: 48425 - DNA, 84 bp, Homo sapiens
tttaattttatcttcaagttagttggtgttattatcctcattttgtagatgaggaaactcaggcttagagaagtgaaatttaaa

SEQ ID NO: 48426 - DNA, 110 bp, Homo sapiens
aaatgagcataggcagtcctactgacactcaaattttccatctgatggcatggaattttggatatgaaatgtaagccatcaggaagtacagctaactggatatgtaattt

SEQ ID NO: 48427 - DNA, 103 bp, Homo sapiens
ctgtttgagtttgaaatattcatacttacatactaaaactgcatggaaactttaaacatgtatgtattaatgtataaatggatatggctagtctcaatgatag

SEQ ID NO: 48428 - DNA, 101 bp, Homo sapiens
gattcagttaactattttctgttgtcagatttttaagtatttatatttgtgtctaacaagtttaatttctttgaaagtccatgatgtggtgctattgagtt

SEQ ID NO: 48429 - DNA, 119 bp, Homo sapiens
gcatgtcagagtttgttattttgtgatttttatactcatttttttgtgacagattctcactctgtcacccaggctgaagtgcagtggcatgatcacggctcactgcagcctccaactgc

SEQ ID NO: 48430 - DNA, 108 bp, Homo sapiens
ggttcaagtgagtaaaatcttaattcacttggggagatttgacactgaaaacacagtgttttttttttttttttaagtaacctactaagaaattatttattggtggcc

SEQ ID NO: 48431 - DNA, 56 bp, Homo sapiens
gagacagggtctcactctgtcacccaggctggagtacagtggtgtgatcttgcctc

SEQ ID NO: 48432 - DNA, 89 bp, Homo sapiens
catagatgtgtgtgtatatatatatacatgtgtgtatatatatatacatgtgtgtatatatgtatgtgtgtgtatatatacatgaagtg

SEQ ID NO: 48433 - DNA, 167 bp, Homo sapiens
aaagctagggaatgtaaagaatataatacatattataatatataatataatatataataaaatatatattgtattctttttctagctttatatatgtacatgtgttacatatttatatatgaacatatataaagctagaaaaggaatatatatttaactgtatatat

SEQ ID NO: 48434 - DNA, 82 bp, Homo sapiens
agtggttgctctaggtgttatatcacacacacacacatatatgtatgtgtatatatatatatacaacctattgtagtctact

SEQ ID NO: 48435 - DNA, 59 bp, Homo sapiens
taggttgtatatatatatatacacatacatatatgtgtgtgtgtgtgatataacaccta

SEQ ID NO: 48436 - DNA, 81 bp, Homo sapiens
acagagtgagattctgtctcaaaaaaaaaaaaaaaaattatatgcttttttttttttttttgagacaggttctctctctgt

SEQ ID NO: 48437 - DNA, 108 bp, Homo sapiens
gtgctgatgaaaatgaccaacttgatatgaagaattagataaagtgtactgttgttactgcttctacatctgaatgtttagtaggtattagttcttgtatttcagtat

SEQ ID NO: 48438 - DNA, 58 bp, Homo sapiens
tgagactgagtctcgctctgtcacccaggctggagagcagtggcgggatctcggctca

SEQ ID NO: 48439 - DNA, 90 bp, Homo sapiens
atttccagacctagtaccactatgtatatgtatatatgctatatatatgtaaaaaggttttctacatactggatcatactgtctgtgaat

SEQ ID NO: 48440 - DNA, 60 bp, Homo sapiens
gtgagtctgagtctcactctgtcacccaggctggagtgcagtggtgggatctcagctcac

SEQ ID NO: 48441 - DNA, 74 bp, Homo sapiens
tctttttatttagctctctgtctctagtcatattttatatatatgactagagagtatgatggccagtagtatga

SEQ ID NO: 48442 - DNA, 60 bp, Homo sapiens
tgaggcagagtctcacactgtcaccgaggctggagtgcagtgtggtgtaatcatggctca

SEQ ID NO: 48443 - DNA, 58 bp, Homo sapiens; identical to SEQ ID NO: 21849

SEQ ID NO: 48444 - DNA, 82 bp, Homo sapiens
ggtctctgagcagccagatagtatgactagatctcaaatctggaattctagattctcgatccaggtttctttgcacagtacc

SEQ ID NO: 48445 - DNA, 127 bp, Homo sapiens
ggtgctgcaggtcgggctcaccatgacacagtgtgagacctcgggctacaacacaggacccgggcgctgctctgacccctcgtgtcttgtgttgcagccggagggacgcaggtccgcagcagagcct

SEQ ID NO: 48446 - DNA, 105 bp, Homo sapiens
gagctatgctacctctgtgactgccagccaggtaactgtcccttctctgaattctgctctcagaagagtgtgggcacatcctggatttgcctcactggcaagttc

SEQ ID NO: 48447 - DNA, 58 bp, Homo sapiens; identical to SEQ ID NO: 31816

SEQ ID NO: 48448 - DNA, 76 bp, Homo sapiens
tcccacaccacctgcatggctttggcctagtgactccatctctctgagcctcagtctctgtgcatgtgaagtgggg

SEQ ID NO: 48449 - DNA, 85 bp, Homo sapiens
gtacagctcccacttggacagacagaacagtgtgtggagacttacaccatggacttttgctctaggaacaaccacaggaatgtac

SEQ ID NO: 48450 - DNA, 86 bp, Homo sapiens
tacatgcacatatatgtatataagtttatacacacatatgtatataaatttatacgtatataagcttatacacatatatgtatgta

SEQ ID NO: 48451 - DNA, 58 bp, Homo sapiens; identical to SEQ ID NO: 637

SEQ ID NO: 48452 - DNA, 113 bp, Homo sapiens
tttgagacttggctgttcatgtcctttgcccactctttgaagggattattattttttttcttgatgatttgtttgagtttcttgtagattctggatatcagtcctttgttgga

SEQ ID NO: 48453 - DNA, 71 bp, Homo sapiens
gctgactcactcacactggctattatctttgtagaagatactcaaagataaatacagatgggtttcacagc

SEQ ID NO: 48454 - DNA, 83 bp, Homo sapiens
tcccccagggtggaaccctctcatggtcaggtttttgtttttttttttttgagatggagtctcactctgtcacccaggctgga

SEQ ID NO: 48455 - DNA, 72 bp, Homo sapiens
gtctaggtgagggttggaaccccaatgagttgggcaacagaaacccagctcacactggctgtcactgtgggc

SEQ ID NO: 48456 - DNA, 84 bp, Homo sapiens
caccagggtgtgaggctgcctgtgtgggtgtctggggactctcattccccagggctagacacaggatgagtttctccctctgtg

SEQ ID NO: 48457 - DNA, 95 bp, Homo sapiens; identical to SEQ ID NO: 68

SEQ ID NO: 48458 - DNA, 93 bp, Homo sapiens; identical to SEQ ID NO: 69

SEQ ID NO: 48459 - DNA, 112 bp, Homo sapiens
tgcttaggattgtcttggctaggcaggctctttttttggttccatatgaaatttaaagtagttttttcccaattctgtgaagaaagtccttggtagcttgatggggatggca

SEQ ID NO: 48460 - DNA, 99 bp, Homo sapiens
ttggcttccctagcacaatgcataacacatgatgggtcttaatatatctatatgaataataaggccagcagagtgtgggattatagtgagagccgagct

SEQ ID NO: 48461 - DNA, 96 bp, Homo sapiens
tgtgtgtgtatgtgtatatatatgtgtgtgtatgtatatatatgtatgtatgtatatgtatgtgtatatatatgtgtgtatatatatgcatgccat

SEQ ID NO: 48462 - DNA, 80 bp, Homo sapiens
ggcctgtaaggcaagggaggcatgaggtagaaggatggattctgttctggctgcgtgggtttttctgggtatagttggcc

SEQ ID NO: 48463 - DNA, 116 bp, Homo sapiens
aacttgtacaacaggtaagcacaggatactttttatttatttatgtatttatttatttatttacttttattattattactataagttttagggtacatgtgcacaatgtgcaggtt

SEQ ID NO: 48464 - DNA, 114 bp, Homo sapiens
cttgtttttctgtgaggtagatttgtcacaggttaaaccatctcattttatatttttagtagagaaggggtttcaccatgttggccaggctggtcttgaactccggacctcagg

SEQ ID NO: 48465 - DNA, 103 bp, Homo sapiens
gtttctatttcaaaaactgtgtttcttataatttaagaaatataaatttattttatatttctgtttcttatattttaacacatatcaattttgagatgcaaat

SEQ ID NO: 48466 - DNA, 101 bp, Homo sapiens
gacccaggctgggcacgatggcttacgcctgtaatccaagcacttcgggaggctgaggtggaaggatcacttgtggccaagagtttgagaccagtctgggc

SEQ ID NO: 48467 - DNA, 83 bp, Homo sapiens
ggaagtagtcataagactgtgtgtccctaagtactataaaacttttttttttggccaggcacagtggcttatgactataatcc

SEQ ID NO: 48468 - DNA, 98 bp, Homo sapiens
ctacaaaaaacgctggctgagaatgcgactggaattgcactgaatctttattttttgagacaaggtctatccctgttgcacaggttggagtgcagtgg

SEQ ID NO: 48469 - DNA, 95 bp, Homo sapiens; identical to SEQ ID NO: 580

SEQ ID NO: 48470 - DNA, 93 bp, Homo sapiens; identical to SEQ ID NO: 69

SEQ ID NO: 48471 - DNA, 95 bp, Homo sapiens; identical to SEQ ID NO: 68

SEQ ID NO: 48472 - DNA, 93 bp, Homo sapiens; identical to SEQ ID NO: 69

SEQ ID NO: 48473 - DNA, 56 bp, Homo sapiens; identical to SEQ ID NO: 36051

SEQ ID NO: 48474 - DNA, 72 bp, Homo sapiens
gcagtgacatgcactgtctcattctgactgctgtgtggacacagaggacagtcaggaggtcactgcagtcac

SEQ ID NO: 48475 - DNA, 72 bp, Homo sapiens
tcttgtgtctctgtgtccctgtctctcagcctgtctctggtggtacctgggcagggtgaggaaggcatgaga

SEQ ID NO: 48476 - DNA, 119 bp, Homo sapiens
ccatgacagcttccgtgtgtcactgcctcctggccgggccgtgtgaactgggggctgcaggtgagtcactgtgtgcctgggtgacggtctccaggagacacccctcgcactgctgtggg

SEQ ID NO: 48477 - DNA, 118 bp, Homo sapiens
gagaacacccatgaggccaccaaggggagcgtaaggagttggggcctttttttttttttttttttttgagatggagtctcactctgtcgcccaggctggagtgcagtggtgtgatctc

SEQ ID NO: 48478 - DNA, 114 bp, Homo sapiens
gccaccgcccgtctgtcctctgggagtgtctcacttctgtatggctgtttggctcactgcctggctgtgcctctgtgggaacttgggctgggggccctagatggtggagaggac

SEQ ID NO: 48479 - DNA, 116 bp, Homo sapiens
ccatttcacttcgtatattaaaccagactgcaggctgtgaaccaggttaataacaatatttattgttattaatgcctgaacatcctaacgtgtgcgtttgtatgtatgtgtgtggg

SEQ ID NO: 48480 - DNA, 82 bp, Homo sapiens
acgtagtgtgtctgtgtatacgtgtgtgcttctgtgtgtctgtgtgtatctgtgcgtgtgtgtatgctgtatgtgtgcatgt

SEQ ID NO: 48481 - DNA, 100 bp, Homo sapiens
agagatcagcccgtccgctggctgcctgggtccctctctgctgcagcaggggaggtggagttctgcctgggcaacagagctggaggccgggcagacctct

SEQ ID NO: 48482 - DNA, 75 bp, Homo sapiens
ttgccccacttattagtatacagaagcagagggtgtgtgaagaaattctctctgtctgtgtatgtgtaaatgcaa

SEQ ID NO: 48483 - DNA, 114 bp, Homo sapiens
aagacaccattgacgggttttaagcagagaagtgacatgaaggcgactttcccccaaagttattttttacattaagtctctgcttctcatcttgttttcttgtggttgcctctt

SEQ ID NO: 48484 - DNA, 113 bp, Homo sapiens
gtgggtcctggctctgtgtggatgaccttctcatggcctctgaagcctttctgtctgcctgtctgcctcagggatccatgaggattttgcttctccctgttgccaacacctgt

SEQ ID NO: 48485 - DNA, 87 bp, Homo sapiens
tagccatgtctggggtctcactgacagcccttgaccacttagaagtgaaacaagtctgctcagactctcaccctgtgaccctggctg

SEQ ID NO: 48486 - DNA, 89 bp, Homo sapiens
gtttctgtgggttgggaatctggacacagcttagctgggtcttctcctccagggtctctcactggctgtatccaggtagccacaggagc

SEQ ID NO: 48487 - DNA, 65 bp, Homo sapiens
tgagacagagtctctcactatcacccaggctggagtatggagtgcagtggtatgatctcagctca

SEQ ID NO: 48488 - DNA, 78 bp, Homo sapiens
ggtcactctgtgacactctaacttagggcttctcatcaaagtcttggccctgacctcagagttccaggatcaatggcc

SEQ ID NO: 48489 - DNA, 68 bp, Homo sapiens
tctgggggtgcatgtgtgaactctgtggggtggtgtatgtttgtgagttctgtgtgtgtgtctgtggg

SEQ ID NO: 48490 - DNA, 69 bp, Homo sapiens
atgactggtagtgatttgctcttctttttttagtttcttaatatggaaggagaaatcactgctttttat

SEQ ID NO: 48491 - DNA, 95 bp, Homo sapiens; identical to SEQ ID NO: 68

SEQ ID NO: 48492 - DNA, 93 bp, Homo sapiens; identical to SEQ ID NO: 69

SEQ ID NO: 48493 - DNA, 95 bp, Homo sapiens; identical to SEQ ID NO: 68

SEQ ID NO: 48494 - DNA, 93 bp, Homo sapiens; identical to SEQ ID NO: 69

SEQ ID NO: 48495 - DNA, 114 bp, Homo sapiens
tagggtaaggtaggtttaggtgtctgctaggtttctagtgcagaagtaacaagtgtgagagtgattttctttttttaaaaagctagttttgcattgcagtgcttaccttccttg

SEQ ID NO: 48496 - DNA, 66 bp, Homo sapiens
atgtatctgtgtatgtatatgtgtatatatatatatatatatatatatatatatatatatatatat

SEQ ID NO: 48497 - DNA, 117 bp, Homo sapiens
ctacgttctggccaataggatatgagtggaaatgatgtgggcaatttgtaaatttttctttaaaagaagttgtgtgctctccactggctcaattcctccattctggctaatatgaag

SEQ ID NO: 48498 - DNA, 90 bp, Homo sapiens
tatatatatgtatatacacacacatataatgcatagatatcatgtgtatatacagacacatttctatatttatatatatatatatgtata

SEQ ID NO: 48499 - DNA, 66 bp, Homo sapiens
gggttcctgagtggtatgttgtctcaggcctcctctggtctcagaggcaatgccccatgcctgcct

SEQ ID NO: 48500 - DNA, 84 bp, Homo sapiens
agtggaggataaaagtctgagatcaaggtgtatgcaggtttgctttcttctgttatttctcttcttagcttgtatctggccatt

SEQ ID NO: 48501 - DNA, 99 bp, Homo sapiens
tatgtataaacatatgtatagaaatgtatatagtcaaacaataaattataaatgtataatatatgtatgtatatatgcatgtatatgtatggatagatg

SEQ ID NO: 48502 - DNA, 111 bp, Homo sapiens
gattgtcttggctataacaggctctgttttggttccatatgaaatttaaagtagtttcttctaattctgtgaaaaaagtcaatggtagcttgacgggtatagcattgaatc

SEQ ID NO: 48503 - DNA, 64 bp, Homo sapiens
catagatgtatatggtgtatacatatatgtatctatataatgtatacatgcataaatatatatg

SEQ ID NO: 48504 - DNA, 85 bp, Homo sapiens
gcctaggcctacacagggtcaggatcatcaacatcactgtcttttttttttttttttttacggtgtctcactctgtcgcccaggc

SEQ ID NO: 48505 - DNA, 103 bp, Homo sapiens
actccagcctgggtgacaaagtgaaaccttgttgagagagagagatatttatttatttatttatttttttagagggagtctcgctctgttgccaggctggagt

SEQ ID NO: 48506 - DNA, 74 bp, Homo sapiens
gagatggagtctcacactgtcactaaggctggggtgcagcctgtgcagctggaataaagtgatcctcccacctc

SEQ ID NO: 48507 - DNA, 119 bp, Homo sapiens
agaaggtgcatatggatgtgcttctacagttgagttttttgtttttttttttttttttttacattttggagacacagcaaaaagtatttggcctgaagtcccaaggatgcctccctttt

SEQ ID NO: 48508 - DNA, 106 bp, Homo sapiens
gtttgtctttagttttcagcagtttatcatatatctagctaggtgtgaatatctttgtatttttcatactgagaatttgttgagcttcttggctatgtagattaat

SEQ ID NO: 48509 - DNA, 82 bp, Homo sapiens
acaaccggtgtctccctgcctccctgtctcatgatgttaccgagctattcagaaaagaaagtgcagggctgggcgcggtggt

SEQ ID NO: 48510 - DNA, 83 bp, Homo sapiens
atatgtgtatatatgtgtttatatgtgtatatatgtgtttatatgtgtatatacacacacataaacacatatataatacctat

SEQ ID NO: 48511 - DNA, 112 bp, Homo sapiens
cgtatatataagtatgtatatgtgtgtgtatgtatgtatatatgtatattcatatgtgcatctatatacatatacacacaaactacacacacacatatatatatggtgtatg

SEQ ID NO: 48512 - DNA, 77 bp, Homo sapiens
cctagcaaacattgagtgagtatttgctgcatgccccaagcactgtgttagattctgaggattaatgtctggctggg

SEQ ID NO: 48513 - DNA, 108 bp, Homo sapiens
tattactcagtgttctctagagggactgaagtaataggatatatatatatatatacatacatatatatatatatttttatatataaagggggagtttattgagtatta

SEQ ID NO: 48514 - DNA, 79 bp, Homo sapiens
tatatatacacacacacatatatacacacacattcatataccatgtgtatatatatatgtgtgtatatatacacacgtg

SEQ ID NO: 48515 - DNA, 108 bp, Homo sapiens
tctatccatcctctccctatcttttcatccatgtactcatctatgtatctatgtatctatttcattaatgcacttatgagctgaaaagtaaaggaaggattcttagga

SEQ ID NO: 48516 - DNA, 99 bp, Homo sapiens
gttggattgctaggtcaaatggtgattctgttttaagctatttgagaagtctacaaactgattttcacagtggctgaactaatttacatttcctccaac

SEQ ID NO: 48517 - DNA, 69 bp, Homo sapiens
agtcgggtcaacagagaagtgagtatgtaggtagtactgattttcttgtgcacacctcttgaccagact

SEQ ID NO: 48518 - DNA, 66 bp, Homo sapiens
aactacacagtgagctatgtgggtcagacaagtcactgagagcccatcttggctgcacatctagtt

SEQ ID NO: 48519 - DNA, 66 bp, Homo sapiens
gtgacacggtctgtctctcaaaattgcaccagagtggtttcaataacttagagacagtacagtcac

SEQ ID NO: 48520 - DNA, 110 bp, Homo sapiens
agagtggctagaactgattagtagttatggcaaattctattattggtacattatttgatgtatgtttcttaatgactaaatatatctaattatcagtttgatgttgtttt

SEQ ID NO: 48521 - DNA, 106 bp, Homo sapiens
aatatgtgtatacaaatatatgtgtgtgtttgggtatatatatgtatgtatgtatatatgggtgtatatatgtatgtatatatacatacacatacaaacacatatt

SEQ ID NO: 48522 - DNA, 115 bp, Homo sapiens
taattatttggatgctactgtatttggattttatttccccagcagagaggggaagttggatttatagtttactgctgggttaagattggaacaggctagatcttttttatggtta

SEQ ID NO: 48523 - DNA, 92 bp, Homo sapiens
acataaatgtgtgtatgtgtatatacatatatattttgtttgtatacatatatattttgtgtctataaattttgtgtgtgtgtatatagaca

SEQ ID NO: 48524 - DNA, 113 bp, Homo sapiens
gtgggagttacaaatgttgaaacaactttggaaatcagtctaaaagagtttattttatttattttttgctcgtttgtgttgatttgcttgttggttttaataaagttaaatac

SEQ ID NO: 48525 - DNA, 95 bp, Homo sapiens; identical to SEQ ID NO: 68

SEQ ID NO: 48526 - DNA, 93 bp, Homo sapiens; identical to SEQ ID NO: 69

SEQ ID NO: 48527 - DNA, 58 bp, Homo sapiens
tgagatggagtctcattctgtcactcaggctggagtgcagtggcatgatctctgctca

SEQ ID NO: 48528 - DNA, 139 bp, Homo sapiens
atacacacacatacatatatgtatatatacatacatatatatacacacatacatatatatacatatatatgtgtatatatatatgtatatatatgtgtatatatatatgtgtgtgtgtgtgtatatatatatatatttg

SEQ ID NO: 48529 - DNA, 91 bp, Homo sapiens
agaggagttaggtctctagaactaaaaaggcagacgtgctcatttctctgactgcttcttttttttttttttgagacaagagtctcactct

SEQ ID NO: 48530 - DNA, 97 bp, Homo sapiens
tgtttggcttatgagatccaacaagatcacagcttgagggagaaggtctgtaacactctctgacagtggttgacttggcttttaatagaaatgggca

SEQ ID NO: 48531 - DNA, 106 bp, Homo sapiens
taaacttgtgtaagataatgaatgcttttcatttattattattatcaattttcttgcttgtgaaataatgataatagatgccttgtagtattgttttaaatgttta

SEQ ID NO: 48532 - DNA, 75 bp, Homo sapiens
tttattgagctaatatatatatgtgtgtatatatatgtgtatgtatatatatatatatataaagagagagagaga

SEQ ID NO: 48533 - DNA, 82 bp, Homo sapiens
gctatagctatagatgtgtgtatatatatgtgtgtgtatatatatatgtgtatgtgtgtatatagattttcatagctatagc

SEQ ID NO: 48534 - DNA, 92 bp, Homo sapiens
acactcatatatatatgtgtgtgtgtgtgtatatatatgtgtgtgtatatatatatatgtgtgtatatatatgtgtgtatatgtgtatgtgt

SEQ ID NO: 48535 - DNA, 85 bp, Homo sapiens
acaaagcatatatatatatatatatgcttatgtgtgtagatatacatatatatgtgtgtatgtatagtatacatgtgcttcatgt

SEQ ID NO: 48536 - DNA, 59 bp, Homo sapiens
tgagtcggagtctcactctgtcacccaggctggagtgcagtagctgcgatctctgttca

SEQ ID NO: 48537 - DNA, 68 bp, Homo sapiens
tatatgcatgtatttgtgtatacgtacttatatgtataagtatgtgtatgtatatgtatatgtatatg

SEQ ID NO: 48538 - DNA, 102 bp, Homo sapiens
ttctagagaaacagaacatatatcctgtttgtcatctcattctctctctctaatatatgacagagagagacagagcaagcaagtgtgcactgttttaaggaa

SEQ ID NO: 48539 - DNA, 95 bp, Homo sapiens; identical to SEQ ID NO: 68

SEQ ID NO: 48540 - DNA, 93 bp, Homo sapiens; identical to SEQ ID NO: 69

SEQ ID NO: 48541 - DNA, 87 bp, Homo sapiens
agattcaagctgggcatggtgtctcctacctgtaatgccagcattttgggaggctgaggtaggaggatcacttgagcccaagagttt

SEQ ID NO: 48542 - DNA, 84 bp, Homo sapiens
atatatgtgtatatatatatgtgtgtgtgtgtgtatatatatatacacacacacacacatttatatgtgtataactacatatat

SEQ ID NO: 48543 - DNA, 76 bp, Homo sapiens
agatgtgagaggtgaagagatcactgaatttggaatctgaagatctgaattcagattttttttatctctgatgact

SEQ ID NO: 48544 - DNA, 110 bp, Homo sapiens
gcttgattcaaagttattattacctagcaaatatagatgtttatttcttaaagtgaggggctttaagaataaggatgataaaaagggtgacaacggctcagctgttgagc

SEQ ID NO: 48545 - DNA, 81 bp, Homo sapiens
gataagacagatatttttaaaactttatttttaaattatttatttaatttgttttatgaagacagagtttctgtctgtgtc

SEQ ID NO: 48546 - DNA, 75 bp, Homo sapiens
catatatataaaatgtatatatgtgtgtatatatgtgatgtgtgtatatatgatgtatatatatgtgtgtgtgtg

SEQ ID NO: 48547 - DNA, 72 bp, Homo sapiens
tttcagtctctttctctgttatatgaattttaatcttctctggttaatgaaatttcagggaagagatggaaa

SEQ ID NO: 48548 - DNA, 127 bp, Homo sapiens
agtgatagaggtcatatgtgcacacagcagctatttgaatgtgagttatcttgggttaagctatgttaagaactgtgaagcatctgagactttaccttacttataagttaacaatgttgcctgtcac

SEQ ID NO: 48549 - DNA, 107 bp, Homo sapiens
gaatgtttgaagacgtggttaatgtccctgaaaagagaatttgttctatagttgttgaatatagtgttacaaatcttcagcatactaattgtattcttcaaaacttc

SEQ ID NO: 48550 - DNA, 97 bp, Homo sapiens
ttcatcagtgaatttcctcattgtggttgtagtttgaataactctgattactaatgtaattgagcatctttggccattttgttatagttcatgtgaa

SEQ ID NO: 48551 - DNA, 93 bp, Homo sapiens
atcatttctttgaattgtcatgctaaacaggcaattgcatattttattttcttatgtttatggcctgttttcttgtattccagaaaacatgat

SEQ ID NO: 48552 - DNA, 108 bp, Homo sapiens
cctgtaaaaccacctgggcccaatgggaaagtttaaaattattaatttattctacaaatgtagaattattaaagtttcttatttcttcttgagtcagcgttggtaagg

SEQ ID NO: 48553 - DNA, 69 bp, Homo sapiens
cacggaatcactgaaccagactatagagccacgctcagtctcagtgtggctgactcagaattttctgtg

SEQ ID NO: 48554 - DNA, 83 bp, Homo sapiens
tgaggtcaaaagtattctgatgaagagatttaacaagattactgttataaggagaagtcttgtgatttttatcagtgacctta

SEQ ID NO: 48555 - DNA, 76 bp, Homo sapiens
agagtctagtggacagtcaggagtctacagtactgatgggcagaactgaattgagtgaactgattgagcagacttt

SEQ ID NO: 48556 - DNA, 102 bp, Homo sapiens
cccgcctcggcctcccaaagtgctgggattacaggcgtgagccactgcggccagcctattatttatttattaaagcactgtatgagaaagctaaatattggg

SEQ ID NO: 48557 - DNA, 111 bp, Homo sapiens
atgttattgagctgagtactgagatttcattatattgaccactgtctatttctactcagaggctgttctttatagggagttagtcaaaatctatgtgcagagtgaatacat

SEQ ID NO: 48558 - DNA, 95 bp, Homo sapiens
cacacatatatagtatatctgtagatacatacaatatacactatatttatatctgtgtatgtatatacactatatatactatatctgtatgtgtg

SEQ ID NO: 48559 - DNA, 186 bp, Homo sapiens
atatacatgtatatatatttatgtatatatatgtatatatagtatatgtatactatatataaatatatatatgtgtatatatagtatatatgtatatatactatatataaatatatacatatgtatatatacttatataaatatatacatttatgtgtgtatatataaataaatgtctgtatattt

SEQ ID NO: 48560 - DNA, 70 bp, Homo sapiens
tctaatttgccatactgtcgcttattttttttttaatgatagtatggagtgacagtatgagtaatacaga

SEQ ID NO: 48561 - DNA, 95 bp, Homo sapiens; identical to SEQ ID NO: 68

SEQ ID NO: 48562 - DNA, 93 bp, Homo sapiens; identical to SEQ ID NO: 69

SEQ ID NO: 48563 - DNA, 207 bp, Homo sapiens
tactatgttatatattatataatatgttatatatcataagttatatattatatatgttatatatcatatattatatgatgtcatatatcatatgttatacaatatgttatatatcgtatgttatatgatatgttatatattgtatgttatatagtatataatatgttatatatcatatgttatatattatatataatatattttata

SEQ ID NO: 48564 - DNA, 104 bp, Homo sapiens
ccaaatcaaataactgaatatatatgtatgtgtatatatatgtatacatatatatgtatacataaatacatatatattttgtatatatatgttatatagtttgg

SEQ ID NO: 48565 - DNA, 106 bp, Homo sapiens
cacactgccctaatggggagcagatcacaggccaggtctccttgcgcctgtctctctctgcgtgaggggacatgaccttgcctgtctttttccctgggatcagttg

SEQ ID NO: 48566 - DNA, 86 bp, Homo sapiens
attgtgtatcctgaaactttgctgaatttgtttatcagatcggggcacttttgggcagagactataaggttttccagatacagaat

SEQ ID NO: 48567 - DNA, 98 bp, Homo sapiens
gatggtatctcattgtggttttgatttgcatgtctataatgaccagtgatgttcagtatgtttttcatgttttttttttttgccacatgtatgccttc

SEQ ID NO: 48568 - DNA, 114 bp, Homo sapiens
acaagtgatgatgaacattttttcatacgtttgttggctgcataaatgtcttcttttgagaagtgtctgtgcacatcctttgcccactttttgatggagttgtttttttcttgt

SEQ ID NO: 48569 - DNA, 70 bp, Homo sapiens
tggatggtgagttctgaatctgtcaggggaaagatcagctttgtgggggcagaaggaagaagtcacccca

SEQ ID NO: 48570 - DNA, 58 bp, Homo sapiens
tgagacagggtctcactctgtcacccaggctggagtgcagtggcgtgaccccagctca

SEQ ID NO: 48571 - DNA, 75 bp, Homo sapiens
gctgccctcttacactctgtggctgagatcatcgtgtttatagccaagtctctgccagaccttgcccagggcggc

SEQ ID NO: 48572 - DNA, 58 bp, Homo sapiens
tgagtcagagtctcactctgtcgcccaagctggagtacagtggtgagatctcggctca

SEQ ID NO: 48573 - DNA, 97 bp, Homo sapiens
gagagaagaaaagtgacacctatatgccatatttttcaattcaaattagatttaaagaattttatgtatgtatgtatgtatttttctattttctttc

SEQ ID NO: 48574 - DNA, 115 bp, Homo sapiens
gctgagagaaggggtttatttagatggtagggggcccttagaattttatctttggtttacaacctctttaaaattttactgagggtgtgtatagtattgggactcagaaaccggt

SEQ ID NO: 48575 - DNA, 150 bp, Homo sapiens
tcttgtaattctgtgtgttgtacgcatatatatatatatatatatatatatatatatatatatatatatatgtgtgtgtgtgtgttgtgtgtattcattttagtttcaaggtaaaagtatgtatatatgtatgtgtatatatctgtgtgt

SEQ ID NO: 48576 - DNA, 79 bp, Homo sapiens
tgttgttgttatttttgagacagtctcactctgtggctcaggctggagtgcagtggcatgatctctactcactgcaaca

SEQ ID NO: 48577 - DNA, 95 bp, Homo sapiens; identical to SEQ ID NO: 68

SEQ ID NO: 48578 - DNA, 93 bp, Homo sapiens; identical to SEQ ID NO: 69

SEQ ID NO: 48579 - DNA, 108 bp, Homo sapiens
tttagctctcacaaatatcaaagttgtaagattctcagttgtactggacatttgtttctcagtcagaacagagtgtgctgtaatgattcgtaaggagatggtgctaaa

SEQ ID NO: 48580 - DNA, 112 bp, Homo sapiens
cacctgcctcagcctcccaattaactcatttttaataagttcttttttatttgccagtgatttgactagagagagaatgtgaaccctatatgataggtaggatataagggtg

SEQ ID NO: 48581 - DNA, 103 bp, Homo sapiens
agctgtctgatgttttgcactttttcttgtaaggtggattattttccttctgcttttaatattttatttatgaggagaatgccagtgacaaactcttttagct

SEQ ID NO: 48582 - DNA, 163 bp, Homo sapiens
tgtatatatgtatatgcatacatatacaaatgtgtatacatatgtgtatatgtatatatgtatgtatatgtacatgtatttatgcatatatacacgtgtatatatatgtatatatgtacatacacacagagagataaatgtacatgtatatatgtatagacat

SEQ ID NO: 48583 - DNA, 66 bp, Homo sapiens
gtttacatatatgtttacatatatacatatatgtgtatatgtgtgtatatatgtatacatctatgt

SEQ ID NO: 48584 - DNA, 82 bp, Homo sapiens
cctggtcccaagtgatcctcctgtgacccgacaaaattttttttttttttttttgagacggagtctcactctgtcacccagg

SEQ ID NO: 48585 - DNA, 78 bp, Homo sapiens
tttgtgagttcacataccaactgtagagaaaatatatatatacatatagaaagctgtctaacagtggatgctcacaga

SEQ ID NO: 48586 - DNA, 110 bp, Homo sapiens
agttataaatttaagccataattcagattatgaacatcaggtcatgggttctgactcactttcactggctctgtattcagtctatattttgaatgtggctaaagattact

SEQ ID NO: 48587 - DNA, 63 bp, Homo sapiens
tataattgtatgtctatacagactttttttttataagtagaggtgtatagatatatcattata

SEQ ID NO: 48588 - DNA, 142 bp, Homo sapiens
tatttatatgtatatacatatgtatatatatcacaattgtatatatgtatgtatacatgtatttatacacaatatgtatatatgtatgtatatatgtgtatacatatatgtatgtgtatgtatatgtatatacacatatata

SEQ ID NO: 48589 - DNA, 116 bp, Homo sapiens
actattagtttttcctgcatcctgactcattcattgtctgaaggtgggatttttttaattaaaattttattttgagattaaaattattttgagataattgtagattaacatgtagt

SEQ ID NO: 48590 - DNA, 109 bp, Homo sapiens
gtggcttatgacaagaaaaagagcctcaatttattaggcatgtaactgtgtgtcagtcactgtgtcaagtgctttatttttgaggactcatgcaattcttaataaccac

SEQ ID NO: 48591 - DNA, 105 bp, Homo sapiens
gctgtgtttttttcttaaatgtgacgagcccgttgggaggacaaagtcttatatggtctgaaaatatatttttaataggtcattgtctagttaaggggaattagc

SEQ ID NO: 48592 - DNA, 91 bp, Homo sapiens
gtgtgtaatgatgatgaaaatgatgtttgttcagagctttattcttattaacaaacattgtatctattttagattatcaattacattccac

SEQ ID NO: 48593 - DNA, 64 bp, Homo sapiens
atacacccacatacatataggcgcacatatgtatacatgtatgtaaatgtatatgtgtgtgtat

SEQ ID NO: 48594 - DNA, 99 bp, Homo sapiens
gtctgtctatctagcctatctatctgtatatatatatgtgtgtatatagatatagatatatatgtatatagatatgtgtgtatgtgtatgtagatatac

SEQ ID NO: 48595 - DNA, 113 bp, Homo sapiens
agactcactcaggatgcttgtttaaaatgctgattcttgggccccaccacagacacactgagttagtgagaacccaggaagatgcttttctcataggcttccaggatggttct

SEQ ID NO: 48596 - DNA, 86 bp, Homo sapiens
ggttctcactaactcagtgtgtctgtggtggggcccaagaatcagcattttaaacaagcatcctgagtgagtctgtaaagggagcc

SEQ ID NO: 48597 - DNA, 106 bp, Homo sapiens
cttttttttattacaatgaacttcagactttttgtgtgacattagtatttttatttctgaaatagtatgaccacatagttgtgatgagttgaggaagagaaagaag

SEQ ID NO: 48598 - DNA, 184 bp, Homo sapiens
atatatgtatgtatgtgtgtatgtgtatgaatatgtaatatatatatgcatatatatatgtgcatatatatatgtgtgcatatatatatgtgcatatatatatatgtgcatatatatatatatgcgcatatatatatatatatatgcgcatatatatatatatatatatatatatatatatgca

SEQ ID NO: 48599 - DNA, 130 bp, Homo sapiens
gatgagatagaaatgagagagagagagagacagagtgggggggggagagagagagagagagagagagatgggatttggaaatagcccaaatgttctgatgtttcattgtttatctgattattttctcacc

SEQ ID NO: 48600 - DNA, 107 bp, Homo sapiens
tttgagtgtctggctgaaactgactctagtcaatcactggctgtgtctctggctattgagaaggaggtagtggatttttggggtattgctttagttgctattacagg

SEQ ID NO: 48601 - DNA, 75 bp, Homo sapiens
ccgttaggttgtcatcaagatgcattggtcacattcactgagtgacactttgggtcttgggtgataagatagagg

SEQ ID NO: 48602 - DNA, 78 bp, Homo sapiens
tctttgctttgctgacctctcaggcctcttcctggcaacagttaggcttttgagaggagagagagctgagactgttgg

SEQ ID NO: 48603 - DNA, 105 bp, Homo sapiens
cctgaccattagtgaagttgagcatattttcatatgtttctttaccatttgtatatctttttttaagaattgtctgttcatgtccttagcccactttttgttggg

SEQ ID NO: 48604 - DNA, 81 bp, Homo sapiens
ggtgaatattaacaaggaagttttttgcttttaggagcattagtgttgctcattcaggtgattttctttttgagttaagcc

SEQ ID NO: 48605 - DNA, 84 bp, Homo sapiens
ggtcatcagagaggacaggggctttttccttattatgtagttcaaatatggtctaattttgtctcaatttgttcctctgtggct

SEQ ID NO: 48606 - DNA, 64 bp, Homo sapiens
gttttgagacagtctccctctgtcacccaggctggagtgcagtggtgcgatgttggctcactac

SEQ ID NO: 48607 - DNA, 120 bp, Homo sapiens
gcagatcttattgcaaagcctgacacacagttaaagctcaattagtagttgtcaaatgaatgaatgaattggtaatagctctacctattatacaggctgactgaaggagatgaaaattgc

SEQ ID NO: 48608 - DNA, 89 bp, Homo sapiens
aggagatggctaaaagtagtttatatgtttttaagtcctctattatttagaaggatgctaatgatactgaacaattttagacttttcct

SEQ ID NO: 48609 - DNA, 76 bp, Homo sapiens
atgtgtatatatgtgtgtgtatatatatgtgtgtgtacacatacgcacatatatatgcatatatatttatatgtat

SEQ ID NO: 48610 - DNA, 133 bp, Homo sapiens
atgcatacatcttgcacatttgcaatcaggtgttttatatatatatatgtgtgtgtgtgtgtgtgcatatatatatacgtgtatatatatgtatatatacacgtatatatatatatgtttcccttttgttgta

SEQ ID NO: 48611 - DNA, 108 bp, Homo sapiens
tgtggtttcctgaaacactgtttatctgttatgtaatttaactttttctttaagatacaaggttaatttctatggaatatttaaaaagtggatggaatacaaatcaca

SEQ ID NO: 48612 - DNA, 94 bp, Homo sapiens
tactaagctctctgcagcctagtagagactacatagaaactgatggaaatttttatgtttcttaaaataggtagcactcctcctagagagggta

SEQ ID NO: 48613 - DNA, 113 bp, Homo sapiens
cagtcagaagtttctagtagaagattctttaaaaagatcgacttggtaaaatacctgatgtatttaaatatattgagagaaaatgagaataatttgaggagattttgatattg

SEQ ID NO: 48614 - DNA, 107 bp, Homo sapiens
ttttgatgtaggagaatatacaagtttattggcgtggctttagattgcacattgtaactatttttttaagcaaacaccacttgttgaattttgctgtattgtcaaag

SEQ ID NO: 48615 - DNA, 121 bp, Homo sapiens
ccttctccttcctttcagaaatgttgattcctaataaacatcttgcgcttcagactctgtctcagtgtctacgtctgtaaaataggatgataatatctctgtcattgttttttgggtggga

SEQ ID NO: 48616 - DNA, 119 bp, Homo sapiens
ccaaagaataaatcttgtaaaatgtttgtaagacttctacttagaaagctatgagatgttatgaagaaagttaaagatcatctaaataagtggaggtatatgccatgtttatgggttgg

SEQ ID NO: 48617 - DNA, 92 bp, Homo sapiens
gcaagctattgtctggcacgtcttgtaaaactttggcagagtcctgggtatattctctgactctgtgtcatacaggatatgtacaggcttgt

SEQ ID NO: 48618 - DNA, 115 bp, Homo sapiens
tgtgtatatatatgtgtgttgtttcttaagtagttttctcgtcatgagtcttatttttaaaataaactttattgtgtatatttaaggtatacaatatgatgttgtgggatacaca

SEQ ID NO: 48619 - DNA, 72 bp, Homo sapiens
ccatcttgggtttttttggttttggggttttgttatttctcagacaaggtctcactctgtcacccaggctgg

SEQ ID NO: 48620 - DNA, 74 bp, Homo sapiens
tgggacttgaaaagtggtgagtgaaatggggactcagaatctctcactgtcacttctaagccttttcattctca

SEQ ID NO: 48621 - DNA, 76 bp, Homo sapiens
actcccatatatatgtgtgtatatatatgtatataaactcctatatatatgtgtgtgtgtgtgtatgtgtgtgtgt

SEQ ID NO: 48622 - DNA, 91 bp, Homo sapiens
gtaacaggtgtgaggtggtatctcattgtggttttagtttgcatttccctgatgactagtgatgttgatcattttttatatgcctgtttgc

SEQ ID NO: 48623 - DNA, 95 bp, Homo sapiens; identical to SEQ ID NO: 68

SEQ ID NO: 48624 - DNA, 93 bp, Homo sapiens; identical to SEQ ID NO: 69

SEQ ID NO: 48625 - DNA, 73 bp, Homo sapiens
gatgcctcaccctttctgccatgccaggttacagtgagaagacagccagctatgaagaagtgggacctgcatc

SEQ ID NO: 48626 - DNA, 136 bp, Homo sapiens
tatggtgtgtatgcctatgatctataaatatggtgtttgtatatataatctataaatatgatgtgtatgtatatgatctataaatatggtgtgtatgtatatgatctataaatatggtgtatatatacgatctata

SEQ ID NO: 48627 - DNA, 95 bp, Homo sapiens; identical to SEQ ID NO: 68

SEQ ID NO: 48628 - DNA, 93 bp, Homo sapiens; identical to SEQ ID NO: 69

SEQ ID NO: 48629 - DNA, 74 bp, Homo sapiens
tatatgtgtatatatatatacacacatatgtatagagagagatgtgtctgcatgtatgtatatatgtgcatatg

SEQ ID NO: 48630 - DNA, 115 bp, Homo sapiens
gctgtcttatctgtattttactgtctgctccttactggctgcttgtagttagaagagaagtgatttccttgaaatgcataaggctagaaatggagctggaacttaaagtggcagt

SEQ ID NO: 48631 - DNA, 123 bp, Homo sapiens
tatagatatctatagatatatctatatatctatctatatatatctatatatctatctatatctgtatctatatatctatatatatctatatatctatatctatatatgtatatagatagatat

SEQ ID NO: 48632 - DNA, 119 bp, Homo sapiens
atatatagatacagatatagatagatatatagatatatatagatagatatatagatatatctatagatatctatagatatatatatggatatctatagatatctatatatatctttaac

SEQ ID NO: 48633 - DNA, 118 bp, Homo sapiens
aaaagcaagtttcaagttttaagacctggaagtcaatttctgtgtttattttgaaaaatctataaatattagttatttagggaaattgggccagtttcacttgtttatttttgctttt

SEQ ID NO: 48634 - DNA, 154 bp, Homo sapiens
tatatatatatatatatatatatatacatacatatatatgtatatatatatgtatatatatgtgtatatatatatgtatatatatatgtgtatatatatatgtatatatatatgtgtatatatatatgtatatatatatgtgtatatatatata

SEQ ID NO: 48635 - DNA, 101 bp, Homo sapiens
tacacacacacacacacacacacacattcacatatatggatatatatttaaatgatatatatgtgtatgtatatatatgtgtgtatatatatatgtgtgta

SEQ ID NO: 48636 - DNA, 114 bp, Homo sapiens
tcctagtatcagctcaattttttatgttatataccactggatattaaatatttttcaaattaagtagagcatgttcaagtgaattttaatttttatttagcaagtactgatgga

SEQ ID NO: 48637 - DNA, 95 bp, Homo sapiens; identical to SEQ ID NO: 68

SEQ ID NO: 48638 - DNA, 93 bp, Homo sapiens; identical to SEQ ID NO: 69

SEQ ID NO: 48639 - DNA, 102 bp, Homo sapiens
ttgagatgtagttgaaagctaaataatgttttttctgttttgaagtaatcctgctttggaagtagaatctgagcagaaatagtttccaaatacacagatcaa

SEQ ID NO: 48640 - DNA, 104 bp, Homo sapiens
gcagagccagaaatagagaataaattgagccctgaaaacatcatctgattccaacagtacagtgatagcagagccagttctctccctagacatttcagttatgc

SEQ ID NO: 48641 - DNA, 71 bp, Homo sapiens
tttatatatacacacacatatatgtgtgtatataatatatatgtgtgtatatatgtgtgtgcatgtgtaaa

SEQ ID NO: 48642 - DNA, 82 bp, Homo sapiens
gcctatgtatatatatcagctatgtgtatatatatatcagttatgtatatatatatcagctgtgtgtgtgtatatatatggt

SEQ ID NO: 48643 - DNA, 114 bp, Homo sapiens
ccaattcagtagctctatggtggggcctgagattgttttttgttttttttttctttcttttttttttttttttttttgagtcagagtctcgctctgtcgcccaggctggagtgg

SEQ ID NO: 48644 - DNA, 108 bp, Homo sapiens
ccacttatttattgttggcaattttaaaagtggtattaaattctgtttactgatattttatttagtatttttgcattgatatccataattgatatgatattacagtgg

SEQ ID NO: 48645 - DNA, 95 bp, Homo sapiens; identical to SEQ ID NO: 580

SEQ ID NO: 48646 - DNA, 93 bp, Homo sapiens; identical to SEQ ID NO: 69

SEQ ID NO: 48647 - DNA, 90 bp, Homo sapiens
ttgtgaagaatactccaatagacatgagagtgcagatatctctttgggatactgatagtttttttttgtttgtttgtttgtttttaacaa

SEQ ID NO: 48648 - DNA, 85 bp, Homo sapiens
tttcaagagacagcaggtaacggattcttgatgattttataattgtaaacagtgcatctgagtctatttgtctctcttttgtaaa

SEQ ID NO: 48649 - DNA, 88 bp, Homo sapiens
tgtatatatcctatactatatatgtgtatatatatactatatactacatgtgtgtatatatatactatataatatatatgtgtgtata

SEQ ID NO: 48650 - DNA, 135 bp, Homo sapiens
gcatttagttcatttacatttagtgttagaacggatatgtgtgacttttatcctgtcattgtgttgttagctgattgttatgtggacttgattgtgtgattgttttatatggcccgtgggctatgtgtttaagtg

SEQ ID NO: 48651 - DNA, 81 bp, Homo sapiens
tctggcaaccactttgtgatcatgagggtacagggttgaggatgaagctagtattcagataatggcatagggagtaccaga

SEQ ID NO: 48652 - DNA, 64 bp, Homo sapiens
gaatagaggatgagaagccctttttttttttttttttttttttgagagggagtctcactctgtc

SEQ ID NO: 48653 - DNA, 103 bp, Homo sapiens
ccatctttatgtctgtatggaactattattcagctcccagttataagtgagaatatactgtatttgattttctgtttctgagtaatttttcataggataatgg

SEQ ID NO: 48654 - DNA, 58 bp, Homo sapiens
tgagactgtgtcttactctgtcacccaggctggagtgcagtggtgcaatcacagctca

SEQ ID NO: 48655 - DNA, 82 bp, Homo sapiens
gttagaacatcatcaaagtgatgaagtggtataattttctcttagggagaaagccaattatgatgatgatgatgatgatgat

SEQ ID NO: 48656 - DNA, 80 bp, Homo sapiens
ctagaagttggtgagagtaggagccctgtgtttctgactgcactagtctgaaatagagtctctatctcactgagtgaggg

SEQ ID NO: 48657 - DNA, 58 bp, Homo sapiens
gacttctgtctggatatctaggtgtttctatacatcctctgaaatctaggcaaaggtc

SEQ ID NO: 48658 - DNA, 56 bp, Homo sapiens
tgagagttagggacttgagatcctaggtcctgactttctcactgtctcttctctca

SEQ ID NO: 48659 - DNA, 106 bp, Homo sapiens
tgctactgattagttctgtggcttgtggcaagtggcttcattttcctaggtctaagtttatttataaatgtaagtgattgacactgctttacttttgtccctagta

SEQ ID NO: 48660 - DNA, 111 bp, Homo sapiens
ctcatctactttcttaccttccagctctctgctctatctctcaaactctctcaaaatcttgtcgctaggtaagctgtgaaggtcttccagctaaagaatgtgagtttgtga

SEQ ID NO: 48661 - DNA, 83 bp, Homo sapiens
cctcagtttttttatctataaaatgaggcagctgggtggaatcagtgttctaaacctttgctgcacattaagattatctgggg

SEQ ID NO: 48662 - DNA, 61 bp, Homo sapiens
atcaggctctctctcaggctgatacacactcaactgtcggtttgaaggatgagaccctgat

SEQ ID NO: 48663 - DNA, 117 bp, Homo sapiens
tttccttagccttggtggaagtggcaatttgttcaattatatgtattgtatgtgtatgtatgtatgtatgtgcatgcaatgtggttgatgtttcctttcaaaaacacagcttagaaa

SEQ ID NO: 48664 - DNA, 119 bp, Homo sapiens
aaagtgctaggattacaggcataatgacaattaaatggaaatcatttgacaggcactttgtaggccgctggaaaatacttgccaaataatttatcaacctgtagtaagaacagcacttt

SEQ ID NO: 48665 - DNA, 102 bp, Homo sapiens
tcttaactctgtcttgctttagggaaagccattgaggtatatatttttatgtaaaaagtgtatagaatcaacatttattccttgctgaagacctacagaaga

SEQ ID NO: 48666 - DNA, 96 bp, Homo sapiens
tgtgtgtatatatgtgtatatatgtatatatacatatatatatgggaaaaagtatatattcatgtgtgtgtatatatgtgtgggtgtatacacaca

SEQ ID NO: 48667 - DNA, 82 bp, Homo sapiens
agggagtagacggaaaggaagacgcggctgttctatccatcagtgagaaccaaggaacctgtgcctcagtccctccctctct

SEQ ID NO: 48668 - DNA, 58 bp, Homo sapiens; identical to SEQ ID NO: 23944

SEQ ID NO: 48669 - DNA, 124 bp, Homo sapiens
gtgtgtgtatgtatgtatatatgtatatgtgtgtatatatatgtatatgtatgtatatatgtatatagatatatagtatatatatgtgtatatatatagtacatatatgtgtgtatatatatac

SEQ ID NO: 48670 - DNA, 71 bp, Homo sapiens
aagtcactctatttctctggccttcagctttctcatttgtaaaaggaaggtcctagacagatctgtgattt

SEQ ID NO: 48671 - DNA, 144 bp, Homo sapiens
ctgggtgtttggagagaaggtggctggagcaggggctttttttttttttttttttttgagatggagtctctctcactcactctgtcgcccaggctggagtacaatggcgcgatctcggctcactgtaacctccgcctcccaggt

SEQ ID NO: 48672 - DNA, 113 bp, Homo sapiens
ccatatgaaaagtaagcaggggcaatcagatatctagacacacaatctgcatgacactatacaactggatgaactagatatgttccggaaaggccttgtgttaaattcagtgg

SEQ ID NO: 48673 - DNA, 91 bp, Homo sapiens
gccatttgtgcatttcttctctagcctcctccagctcagttatatctttttatttatttatttgagaggtggttttggacctgcatgcggt

SEQ ID NO: 48674 - DNA, 75 bp, Homo sapiens
aatatatgtgtatatatgtatatgtgtgtatatatgtaacatatatacatctatattacatacatacatgtatat

SEQ ID NO: 48675 - DNA, 58 bp, Homo sapiens; identical to SEQ ID NO: 2224

SEQ ID NO: 48676 - DNA, 56 bp, Homo sapiens; identical to SEQ ID NO: 335

SEQ ID NO: 48677 - DNA, 111 bp, Homo sapiens
acattggtctgttatttgaaagatttcaaatttaattcagatacttgtattgatttattatctaattaaatgcaagtaatttcttttttaatctttcatttctccaatagt

SEQ ID NO: 48678 - DNA, 110 bp, Homo sapiens
gagttggaatcattctttggtgatctctggtgaggactctttctctgtctctatgtttgacatttattagactggatctttattgagttgctggtgtcttgtggcagctt

SEQ ID NO: 48679 - DNA, 58 bp, Homo sapiens
tgagacagggtctcactctgtctcctaggctggagtgcagtggcacgatctctgctca

SEQ ID NO: 48680 - DNA, 108 bp, Homo sapiens
gttctggttcttttgtctttccatataaacttaggaattggttgtttatatctgtatagtaattttctaggattttgattgggattgcattgaatctgttgattgagc

SEQ ID NO: 48681 - DNA, 58 bp, Homo sapiens
tgagaccgagtctcactctgtcacccaggctggagtgaagtggtgtgatcttggctca

SEQ ID NO: 48682 - DNA, 101 bp, Homo sapiens
ctgtgccatttctgatcactttgaaagttcaagatgatagtagtgctgcctctgtttatttcttattgtcttgattgtttataaggggcatgaatggctag

SEQ ID NO: 48683 - DNA, 65 bp, Homo sapiens
gggctcccagagggcagatgctttttcttatcagtctttgaaagctcactctctctctctagccc

SEQ ID NO: 48684 - DNA, 119 bp, Homo sapiens
gctaaggagtcattttcttcctgtgttggtcatctttgcttttcttggtatgagaaattattatttattgatatgagtctggaggggaaatggaagacataagtcatagtgccctcagc

SEQ ID NO: 48685 - DNA, 58 bp, Homo sapiens; identical to SEQ ID NO: 47

SEQ ID NO: 48686 - DNA, 101 bp, Homo sapiens
ggaaattgagcattgtgaattgttctgactatatgaattattgtactcagcagttttaatctctgtcagattctctgtagcagatgttataatacttctcc

SEQ ID NO: 48687 - DNA, 76 bp, Homo sapiens
ttgtttgttttgagatagggtctctcactctgtcgtccaggctggagtgtagtaacacaatcacaactcaatgcag

SEQ ID NO: 48688 - DNA, 58 bp, Homo sapiens; identical to SEQ ID NO: 24866

SEQ ID NO: 48689 - DNA, 81 bp, Homo sapiens
gctcactcctctcttagtctcagtctttcattctttctgctgagactggcctgaaaggctggcaagtgggagggagtcagt

SEQ ID NO: 48690 - DNA, 94 bp, Homo sapiens
tccacccttccccttagctcactgtttttctctgtcaccattctggctggagcccggaaagtgtaattgtgtagtgaaaactgtgtagggtaga

SEQ ID NO: 48691 - DNA, 62 bp, Homo sapiens
tggtaagtggcagagctaggcactggaccaaggtctgtctatctctctgtatacttaaacca

SEQ ID NO: 48692 - DNA, 102 bp, Homo sapiens
gctgaccctggctgagaggcctccaggttctgggtctctctcacttacttttcagccgcttcttcctgagagacaccatctcatagagctgcctctcaatca

SEQ ID NO: 48693 - DNA, 166 bp, Homo sapiens
tatatgtatcatattatcacccatatatatgtgtgtatatatattcattatgacaccatatatatgtatatatgtacatatacgtacgtatatatgtatatatgtacatatatgtatatatgtatgtatatgtacatgtatatatgcacatatatgtgtatatata

SEQ ID NO: 48694 - DNA, 112 bp, Homo sapiens
actctatgtatatacagccaaaagagagatatacatatatatatatatttatatacagatgaaaaaaaaaatatatatatatacaattttctttccaactgtagtcattagt

SEQ ID NO: 48695 - DNA, 112 bp, Homo sapiens
gaatgcatggaattgtgtatttgcttcaaacttggttatttttatctttaaataggtgtttaaaatagcctttttttttctgtttgtggaaatagcactttctccatgttgc

SEQ ID NO: 48696 - DNA, 102 bp, Homo sapiens
cagtcaactttcctcctggcaaatggtagacagaagattgtgatctgaaatttttactgagattacatattcagcagttgtagtggcgaggcttagtttctg

SEQ ID NO: 48697 - DNA, 71 bp, Homo sapiens
catgaaggcagccgggtctctctctgagtggctggtgcaccggctcatttctgagtggcctcctgcgtatg

SEQ ID NO: 48698 - DNA, 94 bp, Homo sapiens
cccaaattacacagttattggtagaacaaggataaagattgtagtgttctgatattcctgttctttttccaatataccatgctgccagattggg

SEQ ID NO: 48699 - DNA, 96 bp, Homo sapiens
gggattggctgagtcctttagaactctgtctggtaatgaggctgcatcaaaaatggcttttcatggtcgggcactgtggctcactcctgtaatccc

SEQ ID NO: 48700 - DNA, 91 bp, Homo sapiens
tcctgagaacatgtttgttgagcagtatttatgctttctttatgattttttttttcagaagtatagttgccaggcaaaggaattttgggga

SEQ ID NO: 48701 - DNA, 101 bp, Homo sapiens
gtttgcttctaaggaatggggctcaggtcgaggaggaatgaggcaaatggcttctatctttctttataaactgatgagctttttgactttgaaaatcatac

SEQ ID NO: 48702 - DNA, 108 bp, Homo sapiens
gggggagggggaggtctatatattttgcaaagtgattttatttttctgtgtaagaaagctggggtgtctctttatacgtaatgcatatgtgatcctcccctgactttc

SEQ ID NO: 48703 - DNA, 78 bp, Homo sapiens
gtggcccccaagcctgcatcttagggtccccaggtccagcccccgagtccctcagactgagtggtttgcagtgcctac

SEQ ID NO: 48704 - DNA, 112 bp, Homo sapiens
tgccttttggatgcccaggtgcactgcccatatgtgtgtttgttccctgctcagagaagggagagagcccagggctgggtaaaccttggaaatcttcatggaggaggaggta

SEQ ID NO: 48705 - DNA, 113 bp, Homo sapiens
aacatgggttgcatttatttctgtttttaatgctttcatgctattataaattccattgttaaaatttcaatttttagttattggtgttagtatagagaaatgcaattaatgtt

SEQ ID NO: 48706 - DNA, 83 bp, Homo sapiens
gggagtaccctgaaagcaaagaacattctgtggctaggcttcctttcccctgcatacaggctgtctgtctgtctgtctacccc

SEQ ID NO: 48707 - DNA, 96 bp, Homo sapiens
gagtatttgggaagagtgtgtctattctaaatagtcgatttttatatacttttattagctatacagtagaatgacttttcctcttctctttggctt

SEQ ID NO: 48708 - DNA, 72 bp, Homo sapiens
ggcagcataaagatgagcattagaggctgggcgcagtggctcacacctgtaatctcagcactttggaatgcc

SEQ ID NO: 48709 - DNA, 99 bp, Homo sapiens
ttgatttctagtgaagctgaacatctttcaatatttttgtttactggttgtgttttctataaattatgttgatgttcttagcttattattggaacttga

SEQ ID NO: 48710 - DNA, 67 bp, Homo sapiens
tgtggtctagtcttggatgcagaccagtctctgccttccagcagtgactctgagtctctggacctca

SEQ ID NO: 48711 - DNA, 91 bp, Homo sapiens
gtgtgtgtagcatgtgtatatgtaagtatatttatccacatatgtctaggtgtgtgtatatatatgtatatagatgtgtagataggcagac

SEQ ID NO: 48712 - DNA, 63 bp, Homo sapiens
tcaacactagtgacaggcagagaaggggaggagcagcttgcagttctctgcagtttggtttga

SEQ ID NO: 48713 - DNA, 56 bp, Homo sapiens
attatgaatatatatgtgtatatatacacatatatatacatatgtatagctgtgat

SEQ ID NO: 48714 - DNA, 95 bp, Homo sapiens; identical to SEQ ID NO: 68

SEQ ID NO: 48715 - DNA, 93 bp, Homo sapiens; identical to SEQ ID NO: 69

SEQ ID NO: 48716 - DNA, 102 bp, Homo sapiens
tggaagagacatgtgcgacttttgttttttaaaaaattttatttatttatttatttatttatttataatttttttagagacagggtctcactgtgtcatcca

SEQ ID NO: 48717 - DNA, 95 bp, Homo sapiens; identical to SEQ ID NO: 68

SEQ ID NO: 48718 - DNA, 93 bp, Homo sapiens; identical to SEQ ID NO: 69

SEQ ID NO: 48719 - DNA, 90 bp, Homo sapiens
gtgcttacaatgaagccaaagtcctttagcatggtccagaaggtgctcatggtctggactcactatctctctgactttatctcatgacac

SEQ ID NO: 48720 - DNA, 103 bp, Homo sapiens
tattatgctacttttgtacagcaataaggtgggaatgtggttagttgtatgtatacatgtttatatttgtaaaatgacgctgaatagacaaaacagcttaata

SEQ ID NO: 48721 - DNA, 118 bp, Homo sapiens
cacagaggatattatacagagacaaacgtagatattatataatagattatatattatacgttatatattatataatagattatatattatctatatttgtctctctatatcctctgtg

SEQ ID NO: 48722 - DNA, 75 bp, Homo sapiens
tactcacctgtgcgtgcacacagcctatgtgtcagatcagatgctctgagctgtgtgtaacaggatccttgagta

SEQ ID NO: 48723 - DNA, 56 bp, Homo sapiens
ccctctgtggctgtgacagacacccccaacccactgtctcaagggctggcagaggg

SEQ ID NO: 48724 - DNA, 107 bp, Homo sapiens
tttgctggtctgagacgggcatcttttcccaaaaggccaggagcccgggcctccctccctgtctctctggctctcatatagaaacttgcaccggcccatgccacaaa

SEQ ID NO: 48725 - DNA, 96 bp, Homo sapiens
cttgagttatttctccctttcttctgtgtcttcccctggactgtgagcagacagaggacaggctgggcatatggcaggaagctgtgagagcttgag

SEQ ID NO: 48726 - DNA, 112 bp, Homo sapiens
gctgggcataatggtacatgcctgtagtcctaactatctgggaggctgaggtaggaggatcacttgagcccaggagtttagaggctgcagtgagctacgattgtgccactgc

SEQ ID NO: 48727 - DNA, 76 bp, Homo sapiens
gaatttacactatgtgatatcaaaacttctactgtaaagctacagtagtaagcagagtggtatggtgtataggttc

SEQ ID NO: 48728 - DNA, 78 bp, Homo sapiens
gcctgtgttaagaacctcaggcttctgccacctgcttgttctatggatgaagagactgaagagactggggttaaaggc

SEQ ID NO: 48729 - DNA, 103 bp, Homo sapiens
cccgagtagctgggactaaaggcgtgtgccaccatgcccagctaatttttgtatttttatggctggacgcagtggcttatgcctgtaatcccagcactttggg

SEQ ID NO: 48730 - DNA, 95 bp, Homo sapiens; identical to SEQ ID NO: 68

SEQ ID NO: 48731 - DNA, 93 bp, Homo sapiens; identical to SEQ ID NO: 69

SEQ ID NO: 48732 - DNA, 115 bp, Homo sapiens
cccaggaaagagataaaatgaatcctgtgactgaggagccaatatgattatttcattatttggttagaaagttaaaatgtgcaggaaatgtcagatgctttcccgagatggaggg

SEQ ID NO: 48733 - DNA, 74 bp, Homo sapiens
tatatgtatagatacatatatgtgtgtatatatatacatatatgtgtgcatatatatatatatatatatatata

SEQ ID NO: 48734 - DNA, 114 bp, Homo sapiens
cactctgcttcccttttaaatataagtttcaatttcaggtcatttctttttttttttgagatggagtctcgctttgttgtccaggctggagtgcagtggcgtgatctcgactca

SEQ ID NO: 48735 - DNA, 79 bp, Homo sapiens
gggcataataggcacaggtagaagtttctggcaggagtagctgctggagaatccacatacttgatgtgctgggcagctc

SEQ ID NO: 48736 - DNA, 108 bp, Homo sapiens
gctctccccaccccaaggtccctgtctctggtggatgctccaggctgtctctgtgcctctgtctttacctagtttaagcctcagttcctttgggcgtacaatgagaac

SEQ ID NO: 48737 - DNA, 58 bp, Homo sapiens; identical to SEQ ID NO: 605

SEQ ID NO: 48738 - DNA, 65 bp, Homo sapiens
tatgtggaaatttatcaagatatacagttgagtgcactcatgtatgtgtgataaacttccatgta

SEQ ID NO: 48739 - DNA, 116 bp, Homo sapiens
gtctcactctgtcacccaggcaggagtgcagtggtatactcatagcttattattattattattattttgacatggggtcttgctctcttgcccaggctggagtgcagtggtgcagc

SEQ ID NO: 48740 - DNA, 95 bp, Homo sapiens
ttgtgcctcttttattatctggagacctgtgatttccatggaagatcctgatctgccagagaaaacagagtctgcacatgcttttagtatcacaa

SEQ ID NO: 48741 - DNA, 58 bp, Homo sapiens
caagtgtgtgtctcagtgtctgcctgccctatggcttcaacactgagaaccatgattg

SEQ ID NO: 48742 - DNA, 98 bp, Homo sapiens
gaggccaagccagggaggaaggtgtgagaagccagtgaagaattagagccagtgcgccaattcttcactgcatctgtggctgcatctttggatgtctt

SEQ ID NO: 48743 - DNA, 78 bp, Homo sapiens
ggttctgcctcatctgaaggaagtggatgctttgggagcagttcagaggcacacacaagacactctggtggcagagac

SEQ ID NO: 48744 - DNA, 68 bp, Homo sapiens
cctgagagtctgtctgtctgacaaggaacacgggccggtgtctgatgccagaaaacagactgggactt

SEQ ID NO: 48745 - DNA, 111 bp, Homo sapiens
catggcctccctttctggtgagaaggggcagagctcagcatgcagtgagtcacagaagttagaaagcacgtgcctctgtctactgccacctctttcaggaagctctccctg

SEQ ID NO: 48746 - DNA, 90 bp, Homo sapiens
tgtgtgtgttttgagatggagtctcactctgtcaccctggctggagggcagtggcgtgatctcggctcactacaacctccacctcctggg

SEQ ID NO: 48747 - DNA, 74 bp, Homo sapiens
ggcagtctgtgcctgactctctgggatgggtgtcttttgaaaggcatgcaactccagaacaggtccttgctgct

SEQ ID NO: 48748 - DNA, 115 bp, Homo sapiens
ccatgatgaacatgaccttggatatgtttcttccctctggaatttgaactctttaactgtctctgaagggagagatggcaggctggggcagagacatgtttgctgtgctccatgg

SEQ ID NO: 48749 - DNA, 117 bp, Homo sapiens
gagtttttcaaatcagggcacaatggggtataaggaaccatgtggactcttgatcattatatttatttatggtgttctcacagtctttaggcctctgagtctttgaataaatatctc

SEQ ID NO: 48750 - DNA, 119 bp, Homo sapiens
tgtttgaaagttatgtccattgctgctttatggagtactgtttaaaaaaggctgttaggcctttttttttttttttttaagttctagggtacatgtgcacaatgtgcaggtttgttaca

SEQ ID NO: 48751 - DNA, 81 bp, Homo sapiens
ctgcactaaagagctcagagacagttccatcttctgaactaacacctgtggtcccagactgtctctcccacacataggcag

SEQ ID NO: 48752 - DNA, 111 bp, Homo sapiens
gtgctgtgataaacatgcaagtgcagttgtctttgtacccatattcttttttttattattatactttaagttttagggtacatgtgcacaatgtgcaggttagttacatac

SEQ ID NO: 48753 - DNA, 56 bp, Homo sapiens; identical to SEQ ID NO: 1102

SEQ ID NO: 48754 - DNA, 101 bp, Homo sapiens
cattgatagatacatctatcaatgtatctataagtttattgatcagtgtatcaattgtatctatcaatgtatcaatgtgttgatcaatgtatctatcattg

SEQ ID NO: 48755 - DNA, 100 bp, Homo sapiens
tatgttgattttgtaccctgaaactttactgaatttgtttatcagttctaatagattttttggtggagtctttaggtttttccaaatataagatcatata

SEQ ID NO: 48756 - DNA, 103 bp, Homo sapiens
gcatttttcaaagctgcagatcataatcagaggaatcttgagtgccatcatttacagtgatcacacaagctgatgggtaatctgtttagtattttcaccttgc

SEQ ID NO: 48757 - DNA, 119 bp, Homo sapiens
tattctagttactcggtgtcctattacagaatgttctttcacttagactagttttccaaaataaatttatttacttattttagagatagggtctcactctgtcacccacactagagtgc

SEQ ID NO: 48758 - DNA, 80 bp, Homo sapiens
gctattaagttcagagcttacattcattatgtcatcaggtgttgaaaaataatgactttgtaattctgttattccatagc

SEQ ID NO: 48759 - DNA, 71 bp, Homo sapiens
gtctgtcttcagctagagtaggagttcctttgttttttttttaagacagggtctctctctgttacccaggc

SEQ ID NO: 48760 - DNA, 56 bp, Homo sapiens
gataggaagtagagggatagaggtggggaaagcactcacactgtctctctcctgtc

SEQ ID NO: 48761 - DNA, 58 bp, Homo sapiens
aggcacaggaaagggagaggggggcacactaagtctcacccactcagtttaggtgtct

SEQ ID NO: 48762 - DNA, 82 bp, Homo sapiens
tctgactcactctccctgcctgtgaagcggcgttgaatatctcacacatctgctgggaggcagaagaattagaccgtgtgag

SEQ ID NO: 48763 - DNA, 85 bp, Homo sapiens
gctaggggagcagattcaagccgatgtttctaccaactggtcatttcagtgagcagagactcagctgtgagctgggtccttaagt

SEQ ID NO: 48764 - DNA, 110 bp, Homo sapiens
ttgtatctttagtagagacagggttttaccatgatctctttttaaaattattattattactactataatttgagacagggtatcgctctgttaccgaggctagagtacaa

SEQ ID NO: 48765 - DNA, 99 bp, Homo sapiens
tgactattttatattcctcttatattcagaaacttgctatattctccaattattgtaattatttatctgtgtatctcaagaggaatttttatatagtca

SEQ ID NO: 48766 - DNA, 93 bp, Homo sapiens
gctcaaaaacttgcctcggtctctcactctgccttatgcttcattcctttgaggaggcaagaagtgagttgctgcaggccagtacggatttgc

SEQ ID NO: 48767 - DNA, 94 bp, Homo sapiens
ggtgttagctactgaaggaaatatacaagtgtaatgtgtgctagcttcagtgtggagttgagcagttattttgttgatgtgactttaggagacc

SEQ ID NO: 48768 - DNA, 80 bp, Homo sapiens
gcagtgctgagttcacactctctctgagttaaggataacaagttagatacaagggaattcagagtgaacaagctagctgt

SEQ ID NO: 48769 - DNA, 100 bp, Homo sapiens
ctgtgactgtctaacaaaataatttactattcagtgccctttgcagagtagagattttgtagttttatgaatagaatttacttctgtgagataactgcag

SEQ ID NO: 48770 - DNA, 95 bp, Homo sapiens; identical to SEQ ID NO: 68

SEQ ID NO: 48771 - DNA, 93 bp, Homo sapiens; identical to SEQ ID NO: 69

SEQ ID NO: 48772 - DNA, 95 bp, Homo sapiens; identical to SEQ ID NO: 580

SEQ ID NO: 48773 - DNA, 93 bp, Homo sapiens; identical to SEQ ID NO: 69

SEQ ID NO: 48774 - DNA, 106 bp, Homo sapiens
ggtgctcaactaataactacgattaattctcagcaatgggatgtggtgtgatttttattttcatttttgcatttttatgcactctgagtttttatttgtaagcatc

SEQ ID NO: 48775 - DNA, 86 bp, Homo sapiens
ggcagcagtggccagacgagcaacagtatcctgacctactcttcttgtgatgtgattttgaacttttgactgtgattccagctgcc

SEQ ID NO: 48776 - DNA, 118 bp, Homo sapiens
catttctaacagattgcttttgaacaattccccagaagggaaatataaaatctatgttatttatttatggaacaatattagaatcagggagttgagttagggggcaattttaggagtg

SEQ ID NO: 48777 - DNA, 103 bp, Homo sapiens
tgagcacttttactcctaggtgtgtgtgtgtatatgtatatgaatataactccaagagaaacctgagtacccatgcaccaagacacatacacaagaaggttca

SEQ ID NO: 48778 - DNA, 115 bp, Homo sapiens
gccaggtgtggtggcacatgcctgtagtcctagttacttgggaggctgaggttggaggatcacttgggtccaggagttcaaggttacagtgagctatgtggtatcaccacactgc

SEQ ID NO: 48779 - DNA, 89 bp, Homo sapiens
attccttaaggacagagactgagtctggtttaatttttttttttttttttttttgagacagagtctcactctgacatccaggctggagt

SEQ ID NO: 48780 - DNA, 96 bp, Homo sapiens
atgtcacatgtgtatatatgtatgtgtatatcaatgtgtgtgtgcatgtgcatgttatggatatacacacaaatggatatgtgtgtgtatatacac

SEQ ID NO: 48781 - DNA, 64 bp, Homo sapiens
gtatgtgtatatatatatgtgtgtgtatatatatgtatatgcacacaaatatatacacacatat

SEQ ID NO: 48782 - DNA, 110 bp, Homo sapiens
tgtgtgtatatatttgtgtgcatatacatatatatacacacacatatatatatacacatacatatatatatgtatatgtgtacacatacatatatatatgtatatgtgta

SEQ ID NO: 48783 - DNA, 77 bp, Homo sapiens
gtctctggtgctcatgagataggtctttctttctttatttttatttttgagatggagcctcactctgtcacccaggc

SEQ ID NO: 48784 - DNA, 58 bp, Homo sapiens
tgagacagggtctcactctgtcacccaggctggagtgcaatggtgtgatctcggctca

SEQ ID NO: 48785 - DNA, 58 bp, Homo sapiens
tgagaccaggtctcactctatcactcaggctggagtgcagtggtgcaatcatggctca

SEQ ID NO: 48786 - DNA, 65 bp, Homo sapiens
tacctccaccagacagttatcacactgacagctgatagccagagagctgtctggttctgaaggtg

SEQ ID NO: 48787 - DNA, 110 bp, Homo sapiens
atatatatatatatatatatatgcatacatatgtatatatatgtgtatatatatgtgcatacatatgtatatatatgtgtatatatgtatatatatgtgtatgtgtatat

SEQ ID NO: 48788 - DNA, 73 bp, Homo sapiens
atttaacctctctgtgcctctgtctctgtctgtaaatcaggcacagaaacagagggtaaacagaggattaaat

SEQ ID NO: 48789 - DNA, 84 bp, Homo sapiens
ctgggattacaggagtgagctaccacacccggccagttattattcttattattttttgagacggggtctcactctgccacccag

SEQ ID NO: 48790 - DNA, 101 bp, Homo sapiens
ggctctgcatgctcttttttagttccatatgaaatttaaagtagttttttctaactctgtgaagaaagtcaatggtagcttgacggggatagcattgaatc

SEQ ID NO: 48791 - DNA, 142 bp, Homo sapiens
gtatgtgtatatatgtatgtatatatgtgtatatatgtatgtatatatgtgtatatatgtatgtatatatgtatgtatatatgtgtgtatatatgtatgtgtatatatatgtatgtgtatgtgtgtgtgtatatatatatat

SEQ ID NO: 48792 - DNA, 90 bp, Homo sapiens
gtatgtatatacacatgtatgtatatatacatgtatgtatatatatgtatgtatatacatgtatgtatgtatatatatgtatgtatatac

SEQ ID NO: 48793 - DNA, 91 bp, Homo sapiens
atatatatatatatacatatatacatgtatgtatatatgtatatatacacatgtatgtatatatgtatatatacacatgtatgtatgtata

SEQ ID NO: 48794 - DNA, 57 bp, Homo sapiens
tgagacagggtctgtctctgtcacccaggctggcgtacagtggcgtgatctaactca

SEQ ID NO: 48795 - DNA, 112 bp, Homo sapiens
cttcacgtcactggaggatagaatggcagggataaagctggatggggagacagaagtctctgatgtcaggcaagggaatttcgactttatcgtgtagtagaaaaaactggag

SEQ ID NO: 48796 - DNA, 87 bp, Homo sapiens
atccagggtatatttaatatttttacttaacagcctgtgacagttactattaggtgtcgacttgactggattgaaggatgcctggat

SEQ ID NO: 48797 - DNA, 128 bp, Homo sapiens
tatataatatgtacatgtattatatataatatatacatatatacatatataatatatatacatatataatatgtatgtatatatgtatatataatatacatatataatatatacaatgtatacatata

SEQ ID NO: 48798 - DNA, 88 bp, Homo sapiens
ttgtgtgtgtatgatatattatatataatatatacacaccatataatatgtaatatattatgtatacatatacaagcatatatacata

SEQ ID NO: 48799 - DNA, 100 bp, Homo sapiens
gcactctcaagaaccatggcacaaacacagagctatgtgtgtgtatatgtatcagatgcatacacacatggatgtgaaaatgatatgtgtgtgtatgtgt

SEQ ID NO: 48800 - DNA, 58 bp, Homo sapiens
tgagtcggagtctcgctctgtcaccctggctggagtgcagcggctcgatctcggctca

SEQ ID NO: 48801 - DNA, 81 bp, Homo sapiens
gagcagtgtttatgttgttgtggtcagtgttgttgccatcgttgtttatcctggaggcaacaccacaaatgtaaatgcctc

SEQ ID NO: 48802 - DNA, 116 bp, Homo sapiens
ggtgggattagtggccttataaaagagaccccagatagccccctcaccccttctatcgtgtgacaacacagtgagaagatggctatgtctgaacctggaaggcttcactggacact

SEQ ID NO: 48803 - DNA, 63 bp, Homo sapiens
tcagatgtttttcactccagactctgggagcagctcccggtgaaagagaagagaggcgtctga

SEQ ID NO: 48804 - DNA, 99 bp, Homo sapiens
gtctcattatgtagtgaatatctatgtatgtatgtatgtatctctctatctatctttaggtaatgctaatgcatttgtaaacctctctacaatggagat

SEQ ID NO: 48805 - DNA, 95 bp, Homo sapiens; identical to SEQ ID NO: 68

SEQ ID NO: 48806 - DNA, 93 bp, Homo sapiens; identical to SEQ ID NO: 69

SEQ ID NO: 48807 - DNA, 95 bp, Homo sapiens; identical to SEQ ID NO: 68

SEQ ID NO: 48808 - DNA, 93 bp, Homo sapiens; identical to SEQ ID NO: 69

SEQ ID NO: 48809 - DNA, 86 bp, Homo sapiens
cacaaaggcaggcatcacttcacagtcaacagacaaatggcccattgagggggatgtgtgagtgtgtgtgtgtgtgtgtgtgtgtg

SEQ ID NO: 48810 - DNA, 115 bp, Homo sapiens
aggataaaagtggcagggagtaagggtggtgatgccacaagatttctagtaaaaaaaaaaaaaaaaaaaaaaaaaaaatctgcttttccctctgacctcatctgccacttgtttt

SEQ ID NO: 48811 - DNA, 105 bp, Homo sapiens
gtttattgatgaaaacttgagtaaagaaaattaatgtgagtagagagagttctaagcatagagcattttcacagaccttttcaaaactttccatcatcctttgac

SEQ ID NO: 48812 - DNA, 68 bp, Homo sapiens
ctcactctgtcactcaggctggagtgcggtggtgcaatgatggctcacttcagcctctgacttctggg

SEQ ID NO: 48813 - DNA, 112 bp, Homo sapiens
gtgcttcctctaaggcccaagggaggccaatctttcctgagtgcattgttctgtggttaaaacaagactttgtatacatggaagaatggtctgagagctgttaggtaggcac

SEQ ID NO: 48814 - DNA, 122 bp, Homo sapiens
gaagcagaggaggtggaaggggaggcagcagaggcaggcacactcggtataattttatggaaatacattgtaattttggtctgcctttttttgctttttaatttctctgaaaatgtttctct

SEQ ID NO: 48815 - DNA, 76 bp, Homo sapiens
gggattgagtttgagaaagccaggtactggcgaaggcttgtaaccatgatttctcactgaagaaactcaggtgccc

SEQ ID NO: 48816 - DNA, 87 bp, Homo sapiens
gctgagcagaagaagagatatgcccagctcaggaatacatatttatttttattgtttaaagacagcatctctctctgtcatgcaggc

SEQ ID NO: 48817 - DNA, 85 bp, Homo sapiens
aggggaagaactaagcttccaacacaggcagtctggctccggagtcagtgctcttaactgctaaacaagctactctctatttcct

SEQ ID NO: 48818 - DNA, 110 bp, Homo sapiens
cagatttttgtatatggatattgtatcctacaacttcactgaatttgttattcagttcaaatagctttttggtggagtctttaggtttttccaaccataaatcttatctg

SEQ ID NO: 48819 - DNA, 117 bp, Homo sapiens
caggtggtgtttggttacatgagtaagttatttagtggtgatttgtgagatcttggtgcatccatcacctgagcattatacacggaaccctatttgtagtcttttatccctcacccc

SEQ ID NO: 48820 - DNA, 111 bp, Homo sapiens
tcttcttcaatttttttgggaaagtttgagaaggattggcatttctttttaaatatttcggagaaaccactcatgaagtaatctggtcctggacttttctatgttggaaga

SEQ ID NO: 48821 - DNA, 89 bp, Homo sapiens
atatacatctatctgtgtgtgtatatatatattatatatgtgtgtgtgtgtgcgtgtatatatatatatacacatacatatctgtatgt

SEQ ID NO: 48822 - DNA, 58 bp, Homo sapiens; identical to SEQ ID NO: 15308

SEQ ID NO: 48823 - DNA, 58 bp, Homo sapiens
cttcctgtcagaagagtgagtgctcttgcttgcatgcattttcacttttaacaggcag

SEQ ID NO: 48824 - DNA, 173 bp, Homo sapiens
ggcacctgaatatgagacttactggtctctaaaactctgagaaaaaatatatattcattattttattttattatatgttattttttgtttttttgagacagagtctcgctctgtgtcccaggctggagtgcagtggcatgatctcggctcactgcaacttctgcctcctgggc

SEQ ID NO: 48825 - DNA, 104 bp, Homo sapiens
gtgtgtgtgtatatgtatatatatatatatgtgtgtgtagcacatagacatacacacacaaacatatatatatgtatatatttatatatgtgtgtgtgtgtatg

SEQ ID NO: 48826 - DNA, 104 bp, Homo sapiens
tagacatttgtgtagctttttttgtgagagcatatgtttttatttttctaaggaaaataactaagaataggacggctgcctcataagataagtgtagttttcta

SEQ ID NO: 48827 - DNA, 91 bp, Homo sapiens
cactaggtaacaccaaactgagaacaggagagagataagagagtgctgtaacgctagcacagcccctgattctcaggaggaattgtctgtg

SEQ ID NO: 48828 - DNA, 195 bp, Homo sapiens
atatgctataaaaatataaaaatataggtagaatatataactatatattgtatataaatatatatcatatataatatatattttatataatatttacatataaaatatatgggatatatatctttatatctatgtgtctgtatatataatataatataatataacataatacaatacaatataacatatatccca

SEQ ID NO: 48829 - DNA, 64 bp, Homo sapiens
gtgcatgtgcgtgtgtgtgtgcatgtgcatgagtgtgcatgtgtgtgcatgtgtgtgtgtgcat

SEQ ID NO: 48830 - DNA, 115 bp, Homo sapiens
aggttcccttttatgtgacttgatgctttttctcttgctgtttttagaattctgtcattgtctctgacagtttgacaataatgtggcttggagaagacatttttgaattgaacct

SEQ ID NO: 48831 - DNA, 112 bp, Homo sapiens
attggcctgtagtgggaagaagtgaactatgttttatttaaaggtatctgcaactggaagtgcaaggtatgaaatgaaatgagtctgacactcagcttccaactaaccagtc

SEQ ID NO: 48832 - DNA, 65 bp, Homo sapiens
gcactgactgcattacttaatgagaattcccagatcacccactcattcagtcagtcagtcagtgt

SEQ ID NO: 48833 - DNA, 112 bp, Homo sapiens
taagatcagcctaattttaatattgaactatagatatatgatatatgatacatatatatatctatatgtatcatatatctatagttcaatactaacttagggaatgttctta

SEQ ID NO: 48834 - DNA, 90 bp, Homo sapiens
gtatatatacgtatacatatatatgtatatataaacgtatatgatatatacactatatatggatatatatacatatatatggatatatat

SEQ ID NO: 48835 - DNA, 113 bp, Homo sapiens
tacacgtatatacgtgtatatacacgtatatacgtgtatatacacgtatatacgtgtatatatgtgtatatatacgtatatatgtgtatatatgtgtatatatacgtatatat

SEQ ID NO: 48836 - DNA, 110 bp, Homo sapiens
agtaaatgatgttactgctgctagcaatggatgaattttaggagatctgagactattatattagattttattttagaaaattacatctatgagcatgtatacatttttct

SEQ ID NO: 48837 - DNA, 73 bp, Homo sapiens
ggatgctagaagaggtatggtatttcacagtttccactgtgcctgtcaccctcacttgacttctcagcttgcc

SEQ ID NO: 48838 - DNA, 117 bp, Homo sapiens
tatatatataataatatgaaatacatattatacataaaataatatatactttatatattatataaaatatgttatatattttatgtattatatattttacatatatatatatatata

SEQ ID NO: 48839 - DNA, 81 bp, Homo sapiens
ctggactacaggtggctgcctgtttttaaatatatattttttttattttcagtagagacaaagtcttgccatgttgtccag

SEQ ID NO: 48840 - DNA, 95 bp, Homo sapiens; identical to SEQ ID NO: 68

SEQ ID NO: 48841 - DNA, 93 bp, Homo sapiens; identical to SEQ ID NO: 69

SEQ ID NO: 48842 - DNA, 120 bp, Homo sapiens
gaattcgtgagatgtggctcacaagagagataagttgaatttttggtttttaattttatttaaattttaagtgctactaagaagttggaatagggctattgtgactgacaaactgaattt

SEQ ID NO: 48843 - DNA, 97 bp, Homo sapiens
gtatgtatttatgtgcatgtatatatatgtgtgtgtgtatatatgtgtatatgtgtagatatgtgtatatgtatatatgtgtgtgtatatatattca

SEQ ID NO: 48844 - DNA, 113 bp, Homo sapiens
acatccatcatctatatcacacattatatatgtgtgtgtttatccatatctgcatccgttctatatatatttatacacacatacgtaatggcgcagtttagaatattgtgtgt

SEQ ID NO: 48845 - DNA, 96 bp, Homo sapiens
taatgatcatatatataaagatctgtactctcagtagaatatataatatatatatatttgtggagagtaacggttttaaacatatataaatagtta

SEQ ID NO: 48846 - DNA, 113 bp, Homo sapiens
ggcttgacattgggcattgacattgaagaccctatatcctttattattattattattattattattattattatattttaagttttagggtacatgtgcacattgtgcaggtt

SEQ ID NO: 48847 - DNA, 70 bp, Homo sapiens
ggttctttccacatttgctaggctgtatttattttttaataccagcagcctgggacatctggaggggatc

SEQ ID NO: 48848 - DNA, 66 bp, Homo sapiens
cagctctcagcagagaagggaggtgaaggtcgggtcgggtcgtcactctcagtgtggctgagtctg

SEQ ID NO: 48849 - DNA, 89 bp, Homo sapiens
tgatggtgttgttggtagcggtgcatgtttctggtggagaatggaaatggaaagttaagaatgcattactgagagacattgccttttca

SEQ ID NO: 48850 - DNA, 95 bp, Homo sapiens
tggcttcaggtctgactcggtgcagtcatagtgatagtggccacaggggtgcttgtgttactccatctccaactccacatagctcagaacagtca

SEQ ID NO: 48851 - DNA, 108 bp, Homo sapiens
tgcattttgtatactgtcttttgctatgattattccttaaaatacattatttgtcacatgtgtgagagtacagatttatgtgaatttcttggcctaagagtacatgca

SEQ ID NO: 48852 - DNA, 122 bp, Homo sapiens
ctatccctgagcccctgacgggagttactggagttcctgtagggaggtcccgcccagtgaggagagagaggtcagggtcaggcctgaagaggcactctggttgcagtctaccacatttggtg

SEQ ID NO: 48853 - DNA, 94 bp, Homo sapiens
atgagaaagaaagaagcattccatagttttataatagttttcattcttttcgtgagtctgtgaacttcactggagcttcttagtttttttttgt

SEQ ID NO: 48854 - DNA, 82 bp, Homo sapiens
gcttggggatacgttcatttattttctaatctatttctctctttttcagattggataaatatctatggttctattttcaagt

SEQ ID NO: 48855 - DNA, 95 bp, Homo sapiens; identical to SEQ ID NO: 580

SEQ ID NO: 48856 - DNA, 93 bp, Homo sapiens; identical to SEQ ID NO: 69

SEQ ID NO: 48857 - DNA, 112 bp, Homo sapiens
gttagaaagatgagtctgaagacagtttcgccttgggatgtcttggttgctatctgtcagaacattgtctgcataatggtcctttcagctttggagagactcagaaatattt

SEQ ID NO: 48858 - DNA, 99 bp, Homo sapiens
tagttcctgtgagtctcatgttggggctctttatttttatctcactcaagacttagaacaacatagtgagcacacctggcacccagaccttggcttcta

SEQ ID NO: 48859 - DNA, 72 bp, Homo sapiens
gagattgcagtggtgtcagaagtgagggtggtcttgtggaagactgtgtcctccaactttgatacttaactc

SEQ ID NO: 48860 - DNA, 77 bp, Homo sapiens
ggtatatacagtaggcattatgctaagtgaaagaagccagtctttcccactctgtgtgattccactcctatgatacc

SEQ ID NO: 48861 - DNA, 104 bp, Homo sapiens
ggttactgtaaatggtgtcatttataaaatttttattttctaattatcttttgctaatattagaaatgaattgattttgtgtattgactctgatttcagttatc

SEQ ID NO: 48862 - DNA, 83 bp, Homo sapiens
ccttgtgtgtgtgtaaatcactgtgatttcagcttcaggaaacctttattctggggttactttgcttcttaaatgcacagagg

SEQ ID NO: 48863 - DNA, 95 bp, Homo sapiens; identical to SEQ ID NO: 68

SEQ ID NO: 48864 - DNA, 93 bp, Homo sapiens; identical to SEQ ID NO: 69

SEQ ID NO: 48865 - DNA, 82 bp, Homo sapiens
ttttttgtactatatttttctttcatcttggggcatatatgtagcaaatgtttcctaatgaagacaaagtatagataaagga

SEQ ID NO: 48866 - DNA, 81 bp, Homo sapiens
ggtatgaaggaaagaagggtggctgactgttttgtggattatagtaggggtttttagattactcagccaccattcatcacc

SEQ ID NO: 48867 - DNA, 95 bp, Homo sapiens; identical to SEQ ID NO: 68

SEQ ID NO: 48868 - DNA, 93 bp, Homo sapiens; identical to SEQ ID NO: 69

SEQ ID NO: 48869 - DNA, 134 bp, Homo sapiens
tgtgtgtatattgtgtgtgtatatcgtgtgtgtgtttgtgtgatgcatgtgtgtgtgtgtgtatatatatatatagagagagagaaagtgtgtgtgtgtgtgtatatatatatacacacacacatatagttggc

SEQ ID NO: 48870 - DNA, 104 bp, Homo sapiens
cctaatgtccaggatttgaaatgaatgaaagaatgtaaaatatctctttagtaattaaaaaagacattttctacatgtcaaaataatattttggacatattggg

SEQ ID NO: 48871 - DNA, 70 bp, Homo sapiens
gggtctgcggtagtgtgtggtaatgtcctgggtcttcacattcactcaccactcactcactgactcaccc

SEQ ID NO: 48872 - DNA, 120 bp, Homo sapiens
tatatatgtgtgcatatgtatatcctaaatctcagtgtacatatattaatataaatataaatatataaaatatataatatatatgtataaagttttatatatacatatatgtgtatgtgt

SEQ ID NO: 48873 - DNA, 92 bp, Homo sapiens
ttaagactctacaggggatggttacacaggtatgtgtttgatgtatatatgcacatatatatgtgtaaaaattcattaacctgttcacttaa

SEQ ID NO: 48874 - DNA, 74 bp, Homo sapiens
aagtggtggtcattgtaggtggacaagcaggagagggtgttccaggtttgacagtcacacactctccatcattt

SEQ ID NO: 48875 - DNA, 72 bp, Homo sapiens
gtgtgtgtgtctgtgtgtatagttatatatatatatgactatatatatgactatatatatgactatatatat

SEQ ID NO: 48876 - DNA, 95 bp, Homo sapiens; identical to SEQ ID NO: 580

SEQ ID NO: 48877 - DNA, 93 bp, Homo sapiens; identical to SEQ ID NO: 69

SEQ ID NO: 48878 - DNA, 58 bp, Homo sapiens; identical to SEQ ID NO: 605

SEQ ID NO: 48879 - DNA, 116 bp, Homo sapiens
gctggataggaggaataagttctagggctctgtagcactgtagggtgaatatagttaacaataatttattgtatattttcaaaacactggaagagagaattttgaatgctcacagc

SEQ ID NO: 48880 - DNA, 99 bp, Homo sapiens
tggaaatcagcattatgctatattcttcttcatatcctcagcacctggcacagtctgtggctcagagtagaagtggaaacagtgtatcatgaatgacca

SEQ ID NO: 48881 - DNA, 102 bp, Homo sapiens
taaggtcaaccacagcctgtagctgttttgtagttattttatatttttcacagctctattgtgaatgctgctaaaagacagtatagcaagtgtgtgttttta

SEQ ID NO: 48882 - DNA, 94 bp, Homo sapiens
gggcgacagagtgagacttcatctaaaagaaaaaaaaaaaatcttttttttttttttttttttttttttgagacagagtctcgctctgtcaccc

SEQ ID NO: 48883 - DNA, 88 bp, Homo sapiens
ttgtttttgatacaagagtctcactctgtcacccacgctggagtgcagtggtgtgatgttggctcattgcaaccttcgcctcccgggt

SEQ ID NO: 48884 - DNA, 101 bp, Homo sapiens
gccaagttgctatctaggaaggctgtgccaatttgtattatttttatcttattaacgtggtagtcgacatagtatctggttgtgttcttttagaaattggc

SEQ ID NO: 48885 - DNA, 95 bp, Homo sapiens
gagagtagttagatatttatggaaaaattataagaagcaatgtgcttttaaaatttttttttcaaaaatagatattggttaggaaaactacactc

SEQ ID NO: 48886 - DNA, 72 bp, Homo sapiens
ctagcatttacacatggtatttttctggattttttttttccagacagagtctcactctgtggcccaggctgg

SEQ ID NO: 48887 - DNA, 107 bp, Homo sapiens
taatctttggagaagattaacactttgttataagttatatataggtaaatatatatatatatatttatattagacttgcaggaatagtgaaaatgttgaaaaggttg

SEQ ID NO: 48888 - DNA, 70 bp, Homo sapiens
tatgtgtgtatatatatgtacatcatatatgtatgtgtgtctatgtgtgtatatatatatatcatacata

SEQ ID NO: 48889 - DNA, 111 bp, Homo sapiens
tgtatcctccacactttgaaagggtctggaaggtttctcattcattgaacaaaaggatgaatgaatgaatgaatgaatgaatgaatctaaattatttcagtggagtgttca

SEQ ID NO: 48890 - DNA, 133 bp, Homo sapiens
ggattcaagtgattctcctgcctcagcctcccaagtagctgggattacgggcaggagtctcgctctgtctcccaggctggagtgcagtggtgcagtctcggctcactgcaacctctgcctctcgggttcaagt

SEQ ID NO: 48891 - DNA, 84 bp, Homo sapiens
gacagatagatgatagatagacagataaatagatagataatctccctatttctctctttctgtgtgtgtctttctcatattgtc

SEQ ID NO: 48892 - DNA, 112 bp, Homo sapiens
cctgaaaatctaatgccatctgactcctacttctttgtactcaactatgtttttatctttttagaaggtattagtagggcaaactttcaaatggaataattggctggctagg

SEQ ID NO: 48893 - DNA, 86 bp, Homo sapiens
gccgagcatgtagcccagtctctcagtgtcacttcatgttatgtatgtggaggaactgtaaagggagatcaatggccatgggaagc

SEQ ID NO: 48894 - DNA, 93 bp, Homo sapiens
atatacatatcccatcagtttatatatgtttatgtatatatgtggatgtttatatatatatatgtgtgtgtgtgtgtgtgtgtgtgtgtgtgt

SEQ ID NO: 48895 - DNA, 74 bp, Homo sapiens
tgcaggttaaccgctgcagatcagccagttagggaatgccctgagtgcagacatgtgtgtttcttgttcttgca

SEQ ID NO: 48896 - DNA, 110 bp, Homo sapiens
tgcttaggaatgtcttggccatatgggctcttttttggttccatatgaaatttaaagtagttttatctaattcagtgaagaaagccaatggtaacttgatgggaatagca

SEQ ID NO: 48897 - DNA, 69 bp, Homo sapiens
tgagatttgggtggagacacagccaaactatatcagtgtggctcagtgtttcccagacattagacttca

SEQ ID NO: 48898 - DNA, 140 bp, Homo sapiens
tgtgtatatacatatgtatatacgtatatacacatatgtatatatacagatgtacgtatatgtatatacatatatatgtatatatacaggtgtacgtatatgtatatacacatatatgtatatatacaggtgtacgtata

SEQ ID NO: 48899 - DNA, 153 bp, Homo sapiens
tatgcatatatgtgtatatatgtgtatatgcatgtgtgtatatatgtgtatatgcatatgtgtatatatgtatatatgtgtatatacatatatgtgtatgtatgtatatatgtgtatatacatatatgtgtatgtatatatgtatatacgtat

SEQ ID NO: 48900 - DNA, 98 bp, Homo sapiens
gtcttttgcagcaacctggatggagctggaggccactattctttttttttttttttttttttttttttgaggcagagtttcactcttgttgcccaggc

SEQ ID NO: 48901 - DNA, 58 bp, Homo sapiens
gagccccagaggcatgagaaatatggtgtgtctgtgtgtgtctgtgtctctgtgtgtc

SEQ ID NO: 48902 - DNA, 89 bp, Homo sapiens
attaaatgtcttttcatgtgcttatctgtgcatatatatatatatatgttttaaacatttggttgtatctgggaagaaaaacatttaat

SEQ ID NO: 48903 - DNA, 133 bp, Homo sapiens
gcctaattttcctgggtttgaattgggtcatgtacttaaccttgagccaggagaatgtagtgtgctgattgcttaggtctgggttacacagcagccctagagctggcggtggagccagacgcagtaaagcaca

SEQ ID NO: 48904 - DNA, 109 bp, Homo sapiens
tggcagggtatggtggcacgtgcctgtagtctcagctgcttgggaggctgaggtggaaggatcacttgagcctgagggaatgaggctgcagtgagccatgattatgcca

SEQ ID NO: 48905 - DNA, 107 bp, Homo sapiens
gcaatgtggtatatctacatatatgctgtgcatatatatatgtatatatgctgtgcatatatatatgtatatatgctgtgcatatatgtggtgtatatatgctgtgc

SEQ ID NO: 48906 - DNA, 114 bp, Homo sapiens
tgtagtttgaagtcatgtagcatgatgcctccagctttgctttttttttttttttattattagggctcttggtcatttgggctctttttatggttctatatgaattttaaaaca

SEQ ID NO: 48907 - DNA, 69 bp, Homo sapiens
ttatttgagatggagtctcactctgtcacccaggctggagtgcggtggtgcgatctcagctcactgtaa

SEQ ID NO: 48908 - DNA, 124 bp, Homo sapiens
tatcaaaaagacattctttcttaacaagaatatgtaatgtcattcatatgccattttatgtatatcattttagtatatttaggcatcttatttttgttttgtttgtttttgggatggagtgtct

SEQ ID NO: 48909 - DNA, 115 bp, Homo sapiens
ctttccaagtggttttgaaatggagcttggggctgggtcttttatttttatttatttattttttttttgaggcggagactcaccatccttagcaccttccttacgacttgctgag

SEQ ID NO: 48910 - DNA, 99 bp, Homo sapiens
tcaaatgaatgccacagctatacacacagactgatggaggtaggttgtattgtatttgtgacttcaataccttaagtgttgttgctgttgattacgtga

SEQ ID NO: 48911 - DNA, 69 bp, Homo sapiens
tcagtttgccttgtctgagtagtttctgagcactgcccaggctgggatgcccttcagggtggctgctga

SEQ ID NO: 48912 - DNA, 58 bp, Homo sapiens; identical to SEQ ID NO: 1435

SEQ ID NO: 48913 - DNA, 115 bp, Homo sapiens
tgcagggatgggctgctcccaggggtgttgggtagaactcaggatgcaggcttctttcctgtcttgcgatctaataaaataactaacactgctttctcttttctcccaccatgca

SEQ ID NO: 48914 - DNA, 117 bp, Homo sapiens
atatatatatatatgtgtgtgtatatatatatatactatatatatatatgtgtgtatatatatatacacatatatatgtgtgtgtatatatatatacacatatatatgtgtgtgtat

SEQ ID NO: 48915 - DNA, 106 bp, Homo sapiens
atgattttgtgtatattgattttgtatcctgaaactttactaaatttgtttatcagttctaacagttcttggtggagtctttaggcttttctctatataagatcat

SEQ ID NO: 48916 - DNA, 74 bp, Homo sapiens
gattcagctctgtggctgtgcatctgcatgttttcttaccatgtaaagagctcaagtttcaagagttgattatc

SEQ ID NO: 48917 - DNA, 76 bp, Homo sapiens
agggaggttggaaagagggaggtcttgtagagaggagactgccttgttatttatttatctctgttgatgctttcct

SEQ ID NO: 48918 - DNA, 95 bp, Homo sapiens; identical to SEQ ID NO: 68

SEQ ID NO: 48919 - DNA, 93 bp, Homo sapiens; identical to SEQ ID NO: 69

SEQ ID NO: 48920 - DNA, 95 bp, Homo sapiens; identical to SEQ ID NO: 68

SEQ ID NO: 48921 - DNA, 93 bp, Homo sapiens; identical to SEQ ID NO: 69

SEQ ID NO: 48922 - DNA, 78 bp, Homo sapiens
ggtcagtggaacagtggagctgttgaaagactcacagacacacagggtagtcacacagggccatggttatgagtgatt

SEQ ID NO: 48923 - DNA, 86 bp, Homo sapiens
cgtagcaaagtgggaactgcctgagtgtgaagatgtgagcaaaagaaatgtgggcgacagagcacactgagatcagtgaggctagg

SEQ ID NO: 48924 - DNA, 71 bp, Homo sapiens
atatacatacatatctttactgtatttctatatatacataccatgtatgtgtgtatacagtgtgtgtatat

SEQ ID NO: 48925 - DNA, 93 bp, Homo sapiens
cacttacacacacgcatatatatatatatatatatatatatatatatatatatatatatatatatatatatatactgtgtgtgtgtgtgcatg

SEQ ID NO: 48926 - DNA, 95 bp, Homo sapiens; identical to SEQ ID NO: 68

SEQ ID NO: 48927 - DNA, 93 bp, Homo sapiens; identical to SEQ ID NO: 69

SEQ ID NO: 48928 - DNA, 117 bp, Homo sapiens
tgtgtgtgtatatatatgttatatatcttgtatatatatgttatatatcttgtatatatatatatgttatatatgtaatatatacacaatatatgtatgtgtgtatatatatacaca

SEQ ID NO: 48929 - DNA, 97 bp, Homo sapiens
caggcaagaggagataatgaactgaaacaaaaggtgtgagaaatcctcatctttggtattgtagctgttgaggtttctgttgctctgttccgtgttc

SEQ ID NO: 48930 - DNA, 139 bp, Homo sapiens
catatacatatatgcatacaccatacacacacacatatatatatcacacacaggcacacacacacacacacatatatatatgtgtgtatatatatgtgtgtatatatatatgcgtgtgtgtatatatatatatgcatgt

SEQ ID NO: 48931 - DNA, 114 bp, Homo sapiens
aggccatttgccataacctcattcatctgtgcagactgtcaaattctctctcccagacttctcctgtgaccttcattttattctctgctcatgcctgagtgtggcagctgaact

SEQ ID NO: 48932 - DNA, 113 bp, Homo sapiens
ttgttaaggatttatgcatcaatgttcatcaagaatatttgcctgaagttttgatttttttttgttgtgtttctgccaggttttgatatcagaatgatgctgtcttcatacaa

SEQ ID NO: 48933 - DNA, 58 bp, Homo sapiens
tgagatggagtctcactctgtcacccaggctggagtgcagtggtgtgatctcgtctca

SEQ ID NO: 48934 - DNA, 78 bp, Homo sapiens
aagaggaaaagggaaagttcataaaattgggtgaaatattccttaggaatagtatttggtactttttttttttttttt

SEQ ID NO: 48935 - DNA, 73 bp, Homo sapiens
gtggcaagggagaagtctcgtcttaactttttttttctttttttttttttgagacagagtctccctctgtcac

SEQ ID NO: 48936 - DNA, 90 bp, Homo sapiens
ggcacagtggctcacacctgtaatcccagcactttgggaggctgaggtaggtggatcacttgagggcaggagtttgagaccagcctggcc

SEQ ID NO: 48937 - DNA, 60 bp, Homo sapiens; identical to SEQ ID NO: 45696

SEQ ID NO: 48938 - DNA, 95 bp, Homo sapiens; identical to SEQ ID NO: 68

SEQ ID NO: 48939 - DNA, 93 bp, Homo sapiens; identical to SEQ ID NO: 69

SEQ ID NO: 48940 - DNA, 66 bp, Homo sapiens
tgggtgttagtggagttgaatttcttttttttctttttttgagatagagtctccctctgtcaccca

SEQ ID NO: 48941 - DNA, 73 bp, Homo sapiens
ccatattatgttttggttactacagccttgttatatatatatgtatcaaggtgactgtgaaggtactatatgg

SEQ ID NO: 48942 - DNA, 58 bp, Homo sapiens
tgagacagagtctcactctgtctcccaggctggagtgcagtggtgtgatctctgctca

SEQ ID NO: 48943 - DNA, 112 bp, Homo sapiens
cttcgatgtatggtagaggagacggcttctgtgttttcttcaatgcttaatttcctttattatttttattttttttttaagacggggtctcactctgccacccaggctggag

SEQ ID NO: 48944 - DNA, 104 bp, Homo sapiens
gccttgtaacttagaaggaatgttggaaaactcattgtgccagagaaaatagaatatatcatctgtatttgttgttttaaaagccatttcgaaggatgtggggc

SEQ ID NO: 48945 - DNA, 58 bp, Homo sapiens
cagagtctcgctctgtcacccaggctggagggcaatggcgtgatcttggctcactctg

SEQ ID NO: 48946 - DNA, 104 bp, Homo sapiens
acggccaagtctatgctttgtcgggatgagaacacagctgtgcctgtgtcagagcctaatgttgttgcttgtccttgagaatgaacagaccagtctaaggccgt

SEQ ID NO: 48947 - DNA, 111 bp, Homo sapiens
cctgggaagatgtataccaaaatggtagcagtgatttttctctgaggagagagtgtatagtgatttttttcttctttgagctgttctatttttgtaaactcttgttctagg

SEQ ID NO: 48948 - DNA, 114 bp, Homo sapiens
agtgttaaaactctgacatgtaactggagagaattatcatgtttactgtatttctctctcctttaaggaacatggtactttgctccagttgcattaggtcagttcccaagcatt

SEQ ID NO: 48949 - DNA, 110 bp, Homo sapiens
agaattcagtgagatagattttagaacccttctgaatgctgctggtttggagattctgtctgtagcaagttttgttcagttgttaatctttctttcttttctttcattct

SEQ ID NO: 48950 - DNA, 64 bp, Homo sapiens
gtgagctgagatggcatcgctgcactccagcctgggtgacacagtgagactctgtctcaacaac

SEQ ID NO: 48951 - DNA, 77 bp, Homo sapiens
gcattgatcaactttttgttgcacatgctctgtgatgtaattggcactgcatgatttgacaagaatgtgttttatgc

SEQ ID NO: 48952 - DNA, 119 bp, Homo sapiens
caagtcagagtccgtctgttccctgtaccccaagtctcacagaatgtaacctctctgtgtcagtgaatttgttctgccttagcttctagtggattgttgacatgatggctcttcccttg

SEQ ID NO: 48953 - DNA, 118 bp, Homo sapiens
ctttcattttgatgctgaatcatagtgtaattttttgaggacttttctttttttatttttgaaatttgattttaagttccggggtacatgtgcaagatgttcaggtttattatatagg

SEQ ID NO: 48954 - DNA, 116 bp, Homo sapiens
tcgtggctacagagtttccttagcagagctgtggagtgtgacaatggtgtttgtgtctaaactatcaaacgccattatcacactaaatagctactgctaggcaatccttccctcga

SEQ ID NO: 48955 - DNA, 108 bp, Homo sapiens
ttgtgcgttcctactgagtgccaggcatcatgctagtcactgacaattcacagaggtgatgctctccccagaacctagttgcttccagctcagtgaggacacacacag

SEQ ID NO: 48956 - DNA, 64 bp, Homo sapiens
tgtcagactgtgtgtgtgaccgtgccacaaagaggaggtgcacagtccaggagagtctatgaca

SEQ ID NO: 48957 - DNA, 97 bp, Homo sapiens
caggaaagaacaaggagagcttggaggtgagaagcaagacggagtcagttcagtcagatctctttcactgtcacaattttctcagttataatttctg

SEQ ID NO: 48958 - DNA, 95 bp, Homo sapiens
ggtgctgcatcgcttgtcatccagcttcagagatgaatctgaacagagagaacgtctagagaagtctggtagattcgagatcacccctgcaggac

SEQ ID NO: 48959 - DNA, 88 bp, Homo sapiens
gtctggtggattccaatgagtctctcctgattcttttttttttttttttttttttttttgagacggagtctcattctgtcacccaggc

SEQ ID NO: 48960 - DNA, 103 bp, Homo sapiens
tatatatgtatatgtgtatatatatgtgtatatatgtatatatatgtgtatatgtgtgtatatatgtgtatatatgtatatatgtgtatatatatgtatatat

SEQ ID NO: 48961 - DNA, 114 bp, Homo sapiens
ctgggattacatgcaagagtcaccacacccagcctaaaaataatatttttattttggaataattttagatttataaaatgttacaggctgagcacagtggctcatgcctgccag

SEQ ID NO: 48962 - DNA, 81 bp, Homo sapiens
gggtgacagagtgaggccctgtctcaatctttttttttttttttttttttttttttgcaacggagtctcactctgtcaccc

SEQ ID NO: 48963 - DNA, 115 bp, Homo sapiens
atagaagattgcagagtaactttgaggacaagttttagatggaagttgataaaaatctttttttgtttcatggcctctgaaagtagatggacttcagtgtatggaatagatctgt

SEQ ID NO: 48964 - DNA, 119 bp, Homo sapiens
tatgtctaaaatttgtccattggattcagctactgaagatgtgattggtggctttgagtggaatgttgaaagtgcctaatatgtgtcagttactgagttatgctgggaatttaaacatg

SEQ ID NO: 48965 - DNA, 134 bp, Homo sapiens
attgttaattttttgcagcagaggagtaagggaaaatctggcattgttgtatttcagtccaatgttgtttgctgtttggaaatggcaattacataattcagtgggaaatggaaaaaatgataatgaaatataga

SEQ ID NO: 48966 - DNA, 116 bp, Homo sapiens
ggtgcctgtgccagtgcctggagctgtctgccccgccatagcagccagcatgcctggctgtgtgtatgcctggctgtgtgtagtggctggaccccgcacttgcttgctcatgcacc

SEQ ID NO: 48967 - DNA, 118 bp, Homo sapiens
agcactgcactccagcctgtgcaacaagagtgaaaccccatctccaaaaaaaaaaagaaagaaaaacaaactgagtttggtcccctcttgcactctcacaggcagtcagtctcttgct

SEQ ID NO: 48968 - DNA, 58 bp, Homo sapiens; identical to SEQ ID NO: 1673

SEQ ID NO: 48969 - DNA, 110 bp, Homo sapiens
tatatgtatatatatgtgtgtatatgtgtatatatgtgtgtatatatgtacacatatatgtatatatacatatatacacacatatatatacacacacatatatatatgta

SEQ ID NO: 48970 - DNA, 100 bp, Homo sapiens
tatatatatgtgtgtgtatatatatgtgtgtatatatgtatatatacatatatgtgtacatatatacacacatatatacacatatacacacatatatata

SEQ ID NO: 48971 - DNA, 58 bp, Homo sapiens; identical to SEQ ID NO: 1215

SEQ ID NO: 48972 - DNA, 70 bp, Homo sapiens
acacacacacaccattacaaataatggtgtatatatatatataccattacaaataacggtgtgtgtgtgt

SEQ ID NO: 48973 - DNA, 76 bp, Homo sapiens
tgaatatatatatatatattcaagatatatatatatataaaaatatatatattcaggatatgtatatacatattca

SEQ ID NO: 48974 - DNA, 111 bp, Homo sapiens
gtagatatttaaatgactatatatatatgatttctatgaatatttctatgtatgtgtttatatatacatatatatgtgtgtgtatatatgtgtgtgttaggggtgccctac

SEQ ID NO: 48975 - DNA, 115 bp, Homo sapiens
gcctccttgatttaaaagagtatgcaaatggtcactaaccccagccagcatgaagtaactaatgtaaaccagaatgtagtggcaggttttgtgaatttaaatcctcagatcatgc

SEQ ID NO: 48976 - DNA, 95 bp, Homo sapiens; identical to SEQ ID NO: 68

SEQ ID NO: 48977 - DNA, 93 bp, Homo sapiens; identical to SEQ ID NO: 69

SEQ ID NO: 48978 - DNA, 93 bp, Homo sapiens
catatgactagaatctttatacacatatatacacacacatatatacgtatgtgtgtatatatatgtgtgtataaagaaattcttgtgaatgtg

SEQ ID NO: 48979 - DNA, 80 bp, Homo sapiens
tgagatggagtctcactctgtcacccaggctggagtgcagtggtgggatcttggctcactacaacctccacatcctgggt

SEQ ID NO: 48980 - DNA, 111 bp, Homo sapiens
acagagcaagatttcgtctcaaaaaaaaaaaaaaagacttaaaagcaaggaaccttttatatctttatgtttgtttgtttgtttgttttttgagacagagtctccctctgt

SEQ ID NO: 48981 - DNA, 90 bp, Homo sapiens
cactgtgctaggcacttaaaatagattgtctttttatttttttatttttgagatggagtctcactctgtcactgaggctggagtgcagtg

SEQ ID NO: 48982 - DNA, 88 bp, Homo sapiens
agccctgcaagtccccgtgaggcctgtctttttagcctcctcccgaccggactctggctcactcagcctctgggtctttgcacctgct

SEQ ID NO: 48983 - DNA, 99 bp, Homo sapiens
gtgggagaccagcctaggcaacacagggagaccctgtttctagaaaacttttttttttttctgagacagagtttctctctgtcacccaggctgcagcac

SEQ ID NO: 48984 - DNA, 91 bp, Homo sapiens
gggagggtgggggtggagggcagggtctcactctgtcactcaggctggagtgcagtggtgtgatcatagctcatggcagcctcaacctccc

SEQ ID NO: 48985 - DNA, 208 bp, Homo sapiens
gcatttatgcatatgtgtgtctatacatatgtctgcatgagcatgtatctatatatatatgtgtgtatgaatatgtgttgatactaatggatatatgattgtatatgtgcgtgtgcatatatatgtatacttatctatatatgtatacatatttgcatgtgaatatgtatatatacatgtgtgcctatatgtgcatatgagtctgtat

SEQ ID NO: 48986 - DNA, 103 bp, Homo sapiens
tcatttgcccaaagaaaagtctgacctgataggggagcctcagggtgtcagtgtgtctctgaaattgtgtataaaagagttgttttttttttttttcagatga

SEQ ID NO: 48987 - DNA, 118 bp, Homo sapiens
gggaaaactgagccacagagaggttaagtaaattgtccagctattaagtggtggatttgaaatcagagtctttgcccttaattaccacacaatgttgcttctcatagagtgtatttct

SEQ ID NO: 48988 - DNA, 95 bp, Homo sapiens; identical to SEQ ID NO: 68

SEQ ID NO: 48989 - DNA, 93 bp, Homo sapiens; identical to SEQ ID NO: 69

SEQ ID NO: 48990 - DNA, 95 bp, Homo sapiens; identical to SEQ ID NO: 68

SEQ ID NO: 48991 - DNA, 93 bp, Homo sapiens; identical to SEQ ID NO: 69

SEQ ID NO: 48992 - DNA, 84 bp, Homo sapiens
ccagtggtctgatttctctctctgtggctttgcctttatctgaatgtcacacagggacacaaagaggggaacaacagacactgg

SEQ ID NO: 48993 - DNA, 101 bp, Homo sapiens
tcaatcatatggctttggcaggagagaagagctctttttcagtgattatttattgattttgagacagagttttctctgttgcccaggctggagtgcagtgg

SEQ ID NO: 48994 - DNA, 100 bp, Homo sapiens
gctgggattacaggcatgaaccactgcacctggctgtatacattatatttttaaatgtattcatcagttgaggaacatttgggttatttccagttttggc

SEQ ID NO: 48995 - DNA, 81 bp, Homo sapiens
aatttgtccaatgtgtatgagtttccattacattttatataaatgttttctgaggacttatgccttataaaggaccaagtt

SEQ ID NO: 48996 - DNA, 95 bp, Homo sapiens; identical to SEQ ID NO: 68

SEQ ID NO: 48997 - DNA, 93 bp, Homo sapiens; identical to SEQ ID NO: 69

SEQ ID NO: 48998 - DNA, 108 bp, Homo sapiens
tttctgaacttttcatgtagattttatatatatatatatatatatatatatatatatatatatatatatatatatatatataaactcactgcagtgaggacaaggaga

SEQ ID NO: 48999 - DNA, 62 bp, Homo sapiens
acatggagtctctcactctgtctccaaggctggagtgcagtggtgtgatctcggctcactgt

SEQ ID NO: 49000 - DNA, 65 bp, Homo sapiens
gaaaaggattcagaggtgaccatgatgggaactctccctctgtgtcacactgtgcaattagagtc

SEQ ID NO: 49001 - DNA, 105 bp, Homo sapiens
ttgctttatttcctttggctttatggtatagcttcgaaatcttgtgaattcacacagacttttttttttaagttacatcagtttccaattttataaatgcagcaa

SEQ ID NO: 49002 - DNA, 85 bp, Homo sapiens
tatatataatatatatatatactatatatacacatcatatttgtatataatgtgtgtatatgtagtttataaatgtatatatata

SEQ ID NO: 49003 - DNA, 58 bp, Homo sapiens
tgagtaggagtctcactctgtcacccaggctggagtgcagtggtgagatctgggctca

SEQ ID NO: 49004 - DNA, 83 bp, Homo sapiens
gcatattcacttaagtcatgagaaactgttggtgcctatgtagctcatcacctatggctcactctctggctccctgagcctgc

SEQ ID NO: 49005 - DNA, 66 bp, Homo sapiens; identical to SEQ ID NO: 35156

SEQ ID NO: 49006 - DNA, 58 bp, Homo sapiens; identical to SEQ ID NO: 35157

SEQ ID NO: 49007 - DNA, 58 bp, Homo sapiens; identical to SEQ ID NO: 16930

SEQ ID NO: 49008 - DNA, 95 bp, Homo sapiens; identical to SEQ ID NO: 68

SEQ ID NO: 49009 - DNA, 93 bp, Homo sapiens; identical to SEQ ID NO: 69

SEQ ID NO: 49010 - DNA, 115 bp, Homo sapiens
aagtgctgggattacagatgtgagccaccacacccatcattttttttttttaatggtatctttgtgaaagggaagcacctggggtgatctggatcacaaactggttcttacattt

SEQ ID NO: 49011 - DNA, 105 bp, Homo sapiens
atataggtatatatgtacatatatgtgtatatatgtatacatatatgcatgtgtatatatatatgtgtacatatatacatatgtgtgtgtgtgtatatatatata

SEQ ID NO: 49012 - DNA, 126 bp, Homo sapiens
atctatatatgtatatataacaattcatacatatatacacacacacaggtatttatgtatatttatatacatatgtcagatatgtatagatatataacaattcatgtgtgtgtgtgtgtgtgtgtg

SEQ ID NO: 49013 - DNA, 60 bp, Homo sapiens
acacacacacataaatgctatatatgtgtgtatatatataaatgctctatgtgtgtgtgt

SEQ ID NO: 49014 - DNA, 106 bp, Homo sapiens
ctgtatcccagaggttttgataagttgtgtcattattgttcagtttgaagaatttttaaattttcatcctgattttgtttttgacccaatgatcattcaggagcag

SEQ ID NO: 49015 - DNA, 110 bp, Homo sapiens
tgagtaacgtttgtgacatctcagatatatgtgtatatatatgcatgtatatatgtatatgtgtgtgcttatatacatatatgtatatatatgaagcaagagtctgacca

SEQ ID NO: 49016 - DNA, 101 bp, Homo sapiens
ttacattaacaactattgtttgatttctgtttccttttggtgaagtgaaaaaaaattatttcaatttttggagcagagaggataatatgtcattttggtaa

SEQ ID NO: 49017 - DNA, 93 bp, Homo sapiens
tctcttgagaaatatgtcttcattaagctatatatataaatagctatatatatatatatatagcttaatgagaaaatatatatatttaagtga

SEQ ID NO: 49018 - DNA, 68 bp, Homo sapiens
atattttctcattaagctatatatatatatatatagctatttatatatatagcttaatgaagacatat

SEQ ID NO: 49019 - DNA, 117 bp, Homo sapiens
aatgtgtttggggtgggctaattgctgttgttcttataaaagaagatactgatacatgtgtatttgtatatatagatctgctttggaagactacatatgccacatgaagaatacatt

SEQ ID NO: 49020 - DNA, 100 bp, Homo sapiens
acagccaagtgaagttcgatgtggtagatgttactttcattttttagatgaggaactgttcagaaagtgtaagtgacttgcccaaggttccttggatagt

SEQ ID NO: 49021 - DNA, 73 bp, Homo sapiens
ccaggcttggtgactcttgcctgtagtcccagctacttgggaggctgaggtggtaggatcacttgaacccagg

SEQ ID NO: 49022 - DNA, 94 bp, Homo sapiens
tcagcctgggcaacatagtgagaccccacttcttttttttttttaattttttttttttttttgagacggagtctcactctgtcgcccaggctgg

SEQ ID NO: 49023 - DNA, 95 bp, Homo sapiens; identical to SEQ ID NO: 68

SEQ ID NO: 49024 - DNA, 93 bp, Homo sapiens; identical to SEQ ID NO: 69

SEQ ID NO: 49025 - DNA, 83 bp, Homo sapiens
tgtggctctgagtgtcacccttatttgattatttatttatttataataaataaataaatgcctaaataaatgacagagtctca

SEQ ID NO: 49026 - DNA, 203 bp, Homo sapiens
gcctggtggtgcaggtgcaggccctgtagaggaggcagtgacaacacccagcccaggccgactctctctgcctgtcccctgagtcccctggcacctctccacatctgctcagccctcccagttaacctagcactggtagatggttgatatgatttggatctgtgtccccaaatctcatgttgaattctaatccccagtgttgg

SEQ ID NO: 49027 - DNA, 58 bp, Homo sapiens; identical to SEQ ID NO: 2263

SEQ ID NO: 49028 - DNA, 108 bp, Homo sapiens
tgtagccttgtcaacccctttatttaggaatctgctttttggaatgggatatttattattattaaaaagaagagaactgtttaataaaggcaaggaatctaggctata

SEQ ID NO: 49029 - DNA, 109 bp, Homo sapiens
gagcattcttttttttttttttttttttgagatggagtctcactctgtcacccaggctggagtgcagtggggcatgatctcagctcactgtaacctctgcctcctgggt

SEQ ID NO: 49030 - DNA, 81 bp, Homo sapiens
tattctaagttctagggtacatgtgtaggatattttaattttttagatacagggtctcactctgtcacccagactagagta

SEQ ID NO: 49031 - DNA, 113 bp, Homo sapiens
acttaacataatgtttttgaggttcatccatgctgtagtgtatttcagtatttcattcttttttatgactgaataatattgcattgtatgtatataccacattttgtttttgt

SEQ ID NO: 49032 - DNA, 83 bp, Homo sapiens
agctcctttattgctttttttttttgcatttattcctgaaatggcgggaatctgtcccagaatttgagagaggagtgggagct

SEQ ID NO: 49033 - DNA, 95 bp, Homo sapiens; identical to SEQ ID NO: 68

SEQ ID NO: 49034 - DNA, 93 bp, Homo sapiens; identical to SEQ ID NO: 69

SEQ ID NO: 49035 - DNA, 118 bp, Homo sapiens
ggagtttttacatctgtgttcatgagattggcctgttactttccttctgaattggatcttgtcagattttgaagtcagggatttgctggccaggactgtggaatatgtggagagcttt

SEQ ID NO: 49036 - DNA, 111 bp, Homo sapiens
gatagggcagattcctattcaaaaaaattaaatgacaaagaaagtctgacatgacagaatataggattttttttttttttttttttttttgagacagaatctcactctgtc

SEQ ID NO: 49037 - DNA, 125 bp, Homo sapiens
tctatagatagatgtgtgtgtgcatatatatacatgtagatacatgtgtgtatatatatatatacacacatgcatatatatacacacacatataaatatatgtatatagagaaatatacatacat

SEQ ID NO: 49038 - DNA, 95 bp, Homo sapiens; identical to SEQ ID NO: 68

SEQ ID NO: 49039 - DNA, 93 bp, Homo sapiens; identical to SEQ ID NO: 69

SEQ ID NO: 49040 - DNA, 112 bp, Homo sapiens
gcagagtgattctgtttcttctttttggtgatggggtggtggttttttttttttttttttttgaaacacagtttcactctgtcacccaggagtgcagtggcacgatcttggc

SEQ ID NO: 49041 - DNA, 113 bp, Homo sapiens
tggctgagtagtattccatggtgtgtgtgtgtgtgtgtgtgtatatatatatatatatatatatatatatatatatatatatatatatatatataccacatattctttatcca

SEQ ID NO: 49042 - DNA, 58 bp, Homo sapiens; identical to SEQ ID NO: 10934

SEQ ID NO: 49043 - DNA, 70 bp, Homo sapiens
tgtttatcattgttttacatgataaatataactcttaagttatatttatcattgttttacattatgaata

SEQ ID NO: 49044 - DNA, 96 bp, Homo sapiens
gcagaaattgttagttagtatatggagcctccctctgtccgtccgtcgcccaggctggagtgcaatggcgtgatcttggcttactgcaacctctgc

SEQ ID NO: 49045 - DNA, 95 bp, Homo sapiens; identical to SEQ ID NO: 68

SEQ ID NO: 49046 - DNA, 93 bp, Homo sapiens; identical to SEQ ID NO: 69

SEQ ID NO: 49047 - DNA, 112 bp, Homo sapiens
tgactgagcaggtagtcaatctttgagaatgttctgtgcatagataagaagaatgtatattctgtggttgttggatagagtattctagacatctattaggtctatttggtca

SEQ ID NO: 49048 - DNA, 93 bp, Homo sapiens
tgtcttcgcgtggtcgcctctctgtgtgtatctgtgtcctatctcttctgcttataaggacatagtcacattagattagggcccattctgaca

SEQ ID NO: 49049 - DNA, 115 bp, Homo sapiens
gctctgggtctcctggctggacttgagctgcagtgggttggaggacaccgctcctgtgagtgatgtgtgcctgcaccagtgaccattcccagaccaggacggaggccacaggggc

SEQ ID NO: 49050 - DNA, 68 bp, Homo sapiens
tggggtggttgttcttctgaatgactgtggggtaagggacacagtgtctcagagtctcagtttcctca

SEQ ID NO: 49051 - DNA, 75 bp, Homo sapiens
gcgcttcatgagaccacaagtgttgtccctctgatccaatcacgtgagaccaaatttgtctgggtccaagagtgt

SEQ ID NO: 49052 - DNA, 88 bp, Homo sapiens
ctgctaacctaggaagtaggtaatctttgtttatttattatctgtaaaatgaggaacaaaagagtactcatttcatagaggttttaag

SEQ ID NO: 49053 - DNA, 58 bp, Homo sapiens; identical to SEQ ID NO: 1391

SEQ ID NO: 49054 - DNA, 56 bp, Homo sapiens; identical to SEQ ID NO: 1392

SEQ ID NO: 49055 - DNA, 89 bp, Homo sapiens
ggaacaatttagccaggtgaggtctggggccaagattcaaggatgccagctttgtaactcactcattcactcacttgctaacatgttcc

SEQ ID NO: 49056 - DNA, 67 bp, Homo sapiens
ccagcagcagagtgagtcctgagcacaacacagggctgtcagtgacattcagactcactggcaatgg

SEQ ID NO: 49057 - DNA, 116 bp, Homo sapiens
taccctgccccaggtaaaaatcagttgcatatctttaattttcgaaaagatacattttttttttcttttttgtttttttgagacaagggtgtcgctgtgttgcccaggctggagtg

SEQ ID NO: 49058 - DNA, 98 bp, Homo sapiens
gtatgtctgtgggttgtatctgctatatatatatgtgtgtgtatatatatgtatatacacacacacatatatatacatatatatatatacatacatat

SEQ ID NO: 49059 - DNA, 90 bp, Homo sapiens
agactcctctgagacaaatacaaatgattatgtattgggttgagcacattagggaatgatcttttttttttttttttttagatggagtct

SEQ ID NO: 49060 - DNA, 85 bp, Homo sapiens
tctgttttctagtgtctttttaggtagaattctaaagaacttaaaattttggctgccgtggaaaagaatattactgggaaatggg

SEQ ID NO: 49061 - DNA, 90 bp, Homo sapiens
gctctttaaggagaaagaagtttaaatcattagctgtcttacactctgtaagacagctcattgtctatggagctacatttattagagagt

SEQ ID NO: 49062 - DNA, 186 bp, Homo sapiens
tatatatgtatggggtatatatatatagtatgtatatataagtgtgtatatataggtgtgtgtatatgtatatgtatgtatatgtatgtatgcatatatatgtatatgtgtatatataggtgtatgtatatatgtatgtgtatctgtatatatataggtgtaggtatatatgtatgtgtgtctgta

SEQ ID NO: 49063 - DNA, 73 bp, Homo sapiens
catatatggttccagtggctagagagcttggtgtcctcctggactctttctctctcactttataccacatttg

SEQ ID NO: 49064 - DNA, 103 bp, Homo sapiens
aatcttggtcaagaggtgagagtcagggaagtcagggagatgcaaagcctgagagggttttgacaagagtgacattctcctgctaactttgaagataagggtt

SEQ ID NO: 49065 - DNA, 116 bp, Homo sapiens
atatatatatacacacacacatacatgcacatcaagttctgagatatatatatatatatcagatatatgtatctcaaaacttgatatgtgtagatagatacatagatatagatata

SEQ ID NO: 49066 - DNA, 61 bp, Homo sapiens
catatcaagttttgagatacatatatctgatatatatatatatatctcagaacttgatgtg

SEQ ID NO: 49067 - DNA, 106 bp, Homo sapiens
ttccttatgaaggctgtaaagttttctcagcattgtgaagttacaaattaaagagaacatttatttattgtttcttacctatgtgcttgtgcctatctatagggaa

SEQ ID NO: 49068 - DNA, 111 bp, Homo sapiens
tcgatgtgggattcaaatgagtacacaatctggtctctgtctatcgagtgtaaagaaataagaactctgggctgggcgcagtggctcatgcctgtaatcccagcactttgg

SEQ ID NO: 49069 - DNA, 116 bp, Homo sapiens
tgaaacaactactagctttggaattggttgatgaacaaagcaaggattaataaatttctttatttgctttgcactaaaccagaacattagctggaattacgtttttagttgtgaca

SEQ ID NO: 49070 - DNA, 95 bp, Homo sapiens; identical to SEQ ID NO: 68

SEQ ID NO: 49071 - DNA, 93 bp, Homo sapiens; identical to SEQ ID NO: 69

SEQ ID NO: 49072 - DNA, 91 bp, Homo sapiens
tgcaatcaatcttacttagtcacaatgtataatccaactattttacacatagtttgatttcatttgtgaatatgttgttcaggattttgca

SEQ ID NO: 49073 - DNA, 99 bp, Homo sapiens
gcagtgcaaagaggtgtgtgtttccctgaagaagagggtgccaccctgttgctcctggctgtaacactcagaggctctctctgcagtggaagaatcata

SEQ ID NO: 49074 - DNA, 81 bp, Homo sapiens
gggaaaacaaacatcaggcctcccagatagtatcaaggagctgaaactcaccagatctctgaacaatgagaggccagaccc

SEQ ID NO: 49075 - DNA, 86 bp, Homo sapiens
gagccatacagagaagagactgaacagaattagccttgactgatcatggttatgattcttccccatttcttttaggctgctggctt

SEQ ID NO: 49076 - DNA, 97 bp, Homo sapiens
gctggtttcagtggtcctggaatctgtgttggatgcaaggcaggctggatttgtacttgtgccactctgtgagtcactggccaatctgagaagtagc

SEQ ID NO: 49077 - DNA, 95 bp, Homo sapiens; identical to SEQ ID NO: 580

SEQ ID NO: 49078 - DNA, 93 bp, Homo sapiens; identical to SEQ ID NO: 69

SEQ ID NO: 49079 - DNA, 82 bp, Homo sapiens
gcacaactgtttcattcaacaaatgaaaaacttattttatttttgagatggagtttcgctcttgttgcccaggctggagtgc

SEQ ID NO: 49080 - DNA, 113 bp, Homo sapiens
ttgctagatcattttctgggtgctggaaagagtggcatgaagtaagtggatggctgcctttatttatttatttttttaaccaaagttgggcttcttccagacaagtgtagcag

SEQ ID NO: 49081 - DNA, 111 bp, Homo sapiens
agtgttcaagagggaagaaggctggtcactctgttaaggaggtcagtgagtatctctctgacaagatggcaaaggggagtgagccagctaaagatctagagaaggaacatt

SEQ ID NO: 49082 - DNA, 109 bp, Homo sapiens
tatatatacatatatgtatatattatatatgtatatgtacatatgtatatattatatatgtatatatgatatatattatatatgtatatatgtatatatataatatata

SEQ ID NO: 49083 - DNA, 91 bp, Homo sapiens
ctaacagctgtgaggtgataactcattgtggttgtgatttgcattttcctgatgactagtgatgttgagcacctcttcatgtatctgttgg

SEQ ID NO: 49084 - DNA, 113 bp, Homo sapiens
tatgggtacacaatgatattataatacatgtggaaataatatgaaaatgtatgtaaaatatttttaagaatgcaatttttacagctatcatgagacaaaattggtgatccata

SEQ ID NO: 49085 - DNA, 117 bp, Homo sapiens
atttttattactgtatggtattctgctgtctcaatatattgcaatatatttattcattattttgttggtggatattttggggttgttcagcctttggatgcttcagtcaatattgat

SEQ ID NO: 49086 - DNA, 58 bp, Homo sapiens; identical to SEQ ID NO: 21722

SEQ ID NO: 49087 - DNA, 112 bp, Homo sapiens
atttgtgtacattgattttgtagcctgagaccttactgaatttgtttatgagatctaggagctttttggatgagtctttagggttttctaagcatattatcatatcattgat

SEQ ID NO: 49088 - DNA, 115 bp, Homo sapiens
tatgggaaggttttcacttaaagatttgatttatttaatagatatgtaaagtaaaatgttctattttttgtgttgttcttgctaagtaacgtttttcagtgaatttgttcaagtg

SEQ ID NO: 49089 - DNA, 105 bp, Homo sapiens
acaatgtgttactgattcagcaaaatactttgctgtctagtgtttctcttcatctgaatagagaaccactagttggagtgtttgtgaattttatgataacattgt

SEQ ID NO: 49090 - DNA, 90 bp, Homo sapiens
atatatgcatatatatatatgtgtgtgtgtatatatatatgtttgtgtatatatatgtgtatatatatgcatgtatgtgtgtgtgtatat

SEQ ID NO: 49091 - DNA, 103 bp, Homo sapiens
gccaacattaagttttctacttgagctggtcaagttgattttaaagtttattttatagaacaaacaaaattggccaggaaatttaagaaggagaaaaaaggtg

SEQ ID NO: 49092 - DNA, 149 bp, Homo sapiens
atatatatatatatatacacacacacatatatatgtatggatatatatatgtgtacatatatatgtacatatatatacatgtatatatacacacatatatatgtatgtatatatgtacatacatatgtatatatatatatatacacgta

SEQ ID NO: 49093 - DNA, 107 bp, Homo sapiens
tatatgtgtgtgtgtatatatatatatatatacagtgatatatatatatctgtgtatatatatatatcactgtatatatatactgtatgtgtatatatacatatatg

SEQ ID NO: 49094 - DNA, 89 bp, Homo sapiens
tttgcctaaggccaccttgatagcagcactgctttcatatacattctaaagaagtaagctctgttgttgtttgaagctgaggaagcaga

SEQ ID NO: 49095 - DNA, 56 bp, Homo sapiens; identical to SEQ ID NO: 885

SEQ ID NO: 49096 - DNA, 72 bp, Homo sapiens
gtgtgctgacatatagtagttcatagcagtctctaatgattctttgaatttttgtagtatcagttgtaacgc

SEQ ID NO: 49097 - DNA, 57 bp, Homo sapiens
tgagaaggagtctcactctgtcacccaggcggaatgcagtggtgtgatctcagctca

SEQ ID NO: 49098 - DNA, 58 bp, Homo sapiens; identical to SEQ ID NO: 37236

SEQ ID NO: 49099 - DNA, 76 bp, Homo sapiens
gcagagtctcactctgtcaccaaggctggagtgctcactgcaacctccgcctgctgggttcaagtgactctcctgc

SEQ ID NO: 49100 - DNA, 89 bp, Homo sapiens
gaaggagaatgtgatgtggcaaagtgatatagaagcagttatttctgacaggcattttatctatatatttgctaaacaaattcaccttt

SEQ ID NO: 49101 - DNA, 68 bp, Homo sapiens
ttgttgagacggagtctcactctgtcacccaggccagagtgcagatgtgtgatctcggctcactgcaa

SEQ ID NO: 49102 - DNA, 71 bp, Homo sapiens
tatgcatctacatgtgtgtgtgtatatatatatatatatatatatatatacacacataatgtatctacata

SEQ ID NO: 49103 - DNA, 105 bp, Homo sapiens
actatatagtaatagtaaatattgcgatactatatttattacatagtaatttactatataattactgtagtgttatagtattaactgtataatttactatatagt

SEQ ID NO: 49104 - DNA, 72 bp, Homo sapiens
ggatgtctcacactatctgtgtcctttttcctctcagcaaggaggactgcagatatgtgagcaaacctatcc

SEQ ID NO: 49105 - DNA, 116 bp, Homo sapiens
ggctcctaaaatggctccttttgatatgaaaagagtcagaaatttggacaatttatgaattttttttttttttagatttaagagctcctttatctcaaattttctaagccagtgcc

SEQ ID NO: 49106 - DNA, 115 bp, Homo sapiens
gggtataactgatcccttagtatattctgactgttcagggactatatatatttatagaacatgaaggcataatagtatagggtgtccctagtgggtatagttaatctgaatactc

SEQ ID NO: 49107 - DNA, 116 bp, Homo sapiens
atgtatatatatgtacatttatatgtacataatatatgtatgtatatatattaaatgtataatatgtatacatttacatataatatattatatatatattttatatatatatatat

SEQ ID NO: 49108 - DNA, 59 bp, Homo sapiens
atgtgtatatatatgtgtgtgtatatatatatatacacacacacacatactatatacat

SEQ ID NO: 49109 - DNA, 65 bp, Homo sapiens
ctctcaagtagagtctgtctcctcaaatgaggcctactcctactgagtcagactcactcagggag

SEQ ID NO: 49110 - DNA, 119 bp, Homo sapiens
tgtattgtgcatctcatatgtatatatatatataggaagtttatacatatatttatatattaactacacagtatgaaattatatatacaagtatatatatgtgtgtgtgtatatataca

SEQ ID NO: 49111 - DNA, 98 bp, Homo sapiens
catgctatgatccaggaatagagttgatatgatttcagtgtttttgaatttgctggagattgttttatgcccaattgtgtggcctgttttagagtatg

SEQ ID NO: 49112 - DNA, 106 bp, Homo sapiens
ctgctgtaaagtcccctcttaatctagaccacactcaaaatgactgtgaacatatcagttcacagtcattttgagtgtggtctatattaagatacattgaagcagt

SEQ ID NO: 49113 - DNA, 116 bp, Homo sapiens
gtaagaatgtcccaaatattgcaggagacatatgtatactaaaaattatttacttttttaatctggattttaattgtgcattctgtatttttctttgctaaatttggcaaccttac

SEQ ID NO: 49114 - DNA, 84 bp, Homo sapiens
gctcagctaacatttactgtactcatacagctatgaaagacacactcactgtctgagtaaggtaacgcttattgttggcagggt

SEQ ID NO: 49115 - DNA, 95 bp, Homo sapiens; identical to SEQ ID NO: 68

SEQ ID NO: 49116 - DNA, 93 bp, Homo sapiens; identical to SEQ ID NO: 69

SEQ ID NO: 49117 - DNA, 77 bp, Homo sapiens
ccaggcgtgagccaccacacccagcctgaagttttttattttatggacttagatgattgtgccctgtggatgtctgg

SEQ ID NO: 49118 - DNA, 85 bp, Homo sapiens
gatctcactaaatagcatatatatatatatatatatatatatatatatatatatatatatatatatggtaatttatgatgttatc

SEQ ID NO: 49119 - DNA, 134 bp, Homo sapiens
attttagttgatttctggacatggtcaataagttcaataagtgttgagctcttcctgctgccagaggttctaggatgtttctgtgatcctttctcttcccttagttatctacttcacacttttgtctcatccgt

SEQ ID NO: 49120 - DNA, 106 bp, Homo sapiens
gctcctcccacctgcccaagcattcttgcatcattttattgttatttctggaagagtagtggtagaaacttgtttgaaaagttagagaatgggcaggcatcatggc

SEQ ID NO: 49121 - DNA, 112 bp, Homo sapiens
aagcctatcctctgtgttggtggatattaaatgtgaacttggaaaatataatttatatttttcactcgttcagtgtaattttctataggtatcatttaagatgttttggttt

SEQ ID NO: 49122 - DNA, 70 bp, Homo sapiens
gtttcacagaattttatcagacattggtagttgttagtaagacagctgaaaatgttgggttcggagaggc

SEQ ID NO: 49123 - DNA, 81 bp, Homo sapiens
gggaaggctccaggctcacagctttgttctctggctcctcgaagttaagacctcttgtgctgcaagggccaaggtgttccc

SEQ ID NO: 49124 - DNA, 68 bp, Homo sapiens
tatatgcatatgtatatatgtttatgtatataagcttatatacataaacatatatacatatgtatata

SEQ ID NO: 49125 - DNA, 89 bp, Homo sapiens
atcataaagggaatatatttatttttccttgtaaacacatggtgctgtgttatttcagaagataataaatgtttcgttctatgtgtgat

SEQ ID NO: 49126 - DNA, 123 bp, Homo sapiens
ataatttatatgtgtgtaaagatatctatatatatgtgtatgtgtatatatatgtatgtatatacactatatatagagtacattctcgctatatattgtaatatatatactatatatatatat

SEQ ID NO: 49127 - DNA, 114 bp, Homo sapiens
tggcttgagtacctctttttatgtatatgtgtgtacatatatcagacttatatatacataaaatttatatatttacaaaaatgttatatatatatacataatttggtaaggtca

SEQ ID NO: 49128 - DNA, 87 bp, Homo sapiens
tgcttcctagtttggcaatcagtagttgaaggatggtggagcctctaccaagcctgcgtcactgagtgactgtgaaacttggataca

SEQ ID NO: 49129 - DNA, 95 bp, Homo sapiens
atcaggtggaagttagtgggggaagtgtatccaagtttcacagtcactcagtgacgcaggcttggtagaggctccaccatccttcaactactgat

SEQ ID NO: 49130 - DNA, 90 bp, Homo sapiens
tttggcatcttcctttagtaaagatgaagaataggtgtgaggttttgtttttctcttttatttttttttttctgtaactacagggctaaa

SEQ ID NO: 49131 - DNA, 155 bp, Homo sapiens
gtgtaggtatgtgtaaatatatatatatatgtgtgtgtatatgtatatatacatgtatatatacgtgtatatatacatgtgtatatacatgtatatacgtgtatatgtacatgtgtatatacacacgcacaagcatgcatatatatgtatatata

SEQ ID NO: 49132 - DNA, 95 bp, Homo sapiens; identical to SEQ ID NO: 580

SEQ ID NO: 49133 - DNA, 93 bp, Homo sapiens; identical to SEQ ID NO: 69

SEQ ID NO: 49134 - DNA, 86 bp, Homo sapiens
ttgcatcacaatttggctaaacattttacaatttaattttaaatttaattcaattttaaattgtaagatgttcagattttttgtaa

SEQ ID NO: 49135 - DNA, 85 bp, Homo sapiens
tcctgcctcagcctcctgagaagctgggactacaggcgcgtgctaccatgcccagctaatttttttatttctagtagaggcgggg

SEQ ID NO: 49136 - DNA, 104 bp, Homo sapiens
tccccatatcaagatccttaggtaatcagatttcaaagtactgttttccatgtaaagtaaagtattttcaggttccaaggattaggacatgtacatctttggga

SEQ ID NO: 49137 - DNA, 119 bp, Homo sapiens
gtaatgccatcatgctttctgcaatattttattatgttatcttttagaacttttaaaaattattatttttagttctggggtacatgtgcaggatgtgcaggtttgttacataggtgtgc

SEQ ID NO: 49138 - DNA, 95 bp, Homo sapiens
taagttggctataagtgcatggatttatacctgggttctctgttgtgttccatcagtctgtgtgtctgtttctatgccagtaccatgctgatttg

SEQ ID NO: 49139 - DNA, 141 bp, Homo sapiens
tatacacgtgcgtatatatagtatatatacacgtgcgtatatagtagatacatatagtgtgtgtatatatatgtgtatatatagtatatacatatagtgtgtgtatatatacacatatatatatacacacactatatgtat

SEQ ID NO: 49140 - DNA, 82 bp, Homo sapiens
gtctctaaatatgtatgtatgtatgtgtgtgtatatatacatatatatacacacacatgtatatacatatacatttatatac

SEQ ID NO: 49141 - DNA, 165 bp, Homo sapiens
tatgtgatgtatgtgtgtctgtgtgtatacacacattttatatatatatgtgttatatatataaatgtatatgtgtatatgtgtgtatgtatataaatgtatatgtatatacatgtgtgtgtatatatatgtatatatacacacacatacatacatacatattta

SEQ ID NO: 49142 - DNA, 75 bp, Homo sapiens
ggctggaagtctgagatcaaggtgttagcagatttgggttctcctgagacctcctttcttggcttgcaaatggcc

SEQ ID NO: 49143 - DNA, 80 bp, Homo sapiens
cagagtgtgattgcatttggagatatttatttatttatttatttatttatttatttattctgagacggagtctcgctctg

SEQ ID NO: 49144 - DNA, 71 bp, Homo sapiens
ctttttttgagacagggtctcactctgtcacccagaatggagtggagtgccatgatcctggctcactgaag

SEQ ID NO: 49145 - DNA, 98 bp, Homo sapiens
gctgttttagttgtatagagcacaggagcatgtttgattgggagagaatcctctgatattcacagtgcctgatgtgttcattccccttctgaaagagt

SEQ ID NO: 49146 - DNA, 121 bp, Homo sapiens
ggttacctatttgatgtgctgctggatttcatttgctagtatcttcttgagaatttctacatctattttcatcaaggatattggcctgaacttttctttttgtattgtgtctctgccaggt

SEQ ID NO: 49147 - DNA, 117 bp, Homo sapiens
gatgtagggtgaattcttgttatatggtataaagggtatggactttgaagtcagaatatttttactttaaattttaagttagttcctttattctatgacctagatgtttacttcatc

SEQ ID NO: 49148 - DNA, 118 bp, Homo sapiens
aaaaaatatacattgttatatatatgcatacacaacggggaattgtgaataataatttaatatattatttttagttactgtgtctgtgtgtctgaatagtgatagtatgatatttttt

SEQ ID NO: 49149 - DNA, 107 bp, Homo sapiens
aagatctgatggttttataagcatttgacaatacctccttcacacactcccactctcttctgccatcttgtgaagaaggtgcctgcttctccttccacaaggatttt

SEQ ID NO: 49150 - DNA, 74 bp, Homo sapiens
atcggtgtagaatattttctcagtggcagttgatagtcacaactccagataactgttttgtgttttatgctgat

SEQ ID NO: 49151 - DNA, 58 bp, Homo sapiens
tgagaccgagtctgtctgtgtcacccaggctggagtgcagtggcgagatctcggctca

SEQ ID NO: 49152 - DNA, 106 bp, Homo sapiens
tcagccaccagtgattttcgtcacttctagacagttaacacagaggacaggtcttcgccctgagagctggggctacaggtgaactacaaagattagaatggcttga

SEQ ID NO: 49153 - DNA, 65 bp, Homo sapiens
tgagatggagtctcactctgtcaccaaggctgaagtgcagtggtcagtggtgtgatcttggctca

SEQ ID NO: 49154 - DNA, 58 bp, Homo sapiens
tacatatgtatgtgtatgtatgtgtgcctatgtgcatgtatatatgtatgtatgtgta

SEQ ID NO: 49155 - DNA, 78 bp, Homo sapiens
gtgtgtgtatatatatgtgtatatacgtgtgtgtatatatatatacacacatgcgtatatatgtatttatacacacac

SEQ ID NO: 49156 - DNA, 64 bp, Homo sapiens
tatatatgtatacgtatgtatatatgtatgtatgtgtatatgtataccatattttatatatata

SEQ ID NO: 49157 - DNA, 101 bp, Homo sapiens
cttgtggggctgtgtacgtaaactgttacttttctttttttaaattttattttattattattatactttaagttttagggtacatgtgcacaatgtgcagg

SEQ ID NO: 49158 - DNA, 77 bp, Homo sapiens
gctgtattcctgggtgggtatttcattttctttgtgattattataaataagattgtgcccttgattggactctcagc

SEQ ID NO: 49159 - DNA, 108 bp, Homo sapiens
tgtgactgagacacctggttttcctccccctcagaccacttcttagtttctctcactgactcctttcctgggcatggaccatagccatggaactgttcttttctctca

SEQ ID NO: 49160 - DNA, 95 bp, Homo sapiens; identical to SEQ ID NO: 68

SEQ ID NO: 49161 - DNA, 93 bp, Homo sapiens; identical to SEQ ID NO: 69

SEQ ID NO: 49162 - DNA, 102 bp, Homo sapiens
taagcatttcgagggcaggaattcttgtctatttgttgctctgttttatcttgaaactctagagctatatatggaacatagttggcactcaataaatgtttg

SEQ ID NO: 49163 - DNA, 117 bp, Homo sapiens
atacatcagtttttaattttggggaggtatataaataacattttttaaatgtcagattatatatttttaatactggtatacagaaatgctattgacttttttatatgaactttgtgt

SEQ ID NO: 49164 - DNA, 72 bp, Homo sapiens
ctgggcgtggtaatgtgcacctgttctcccagctacttgggaggttgaggtggaaggatcacttgaacccgg

SEQ ID NO: 49165 - DNA, 89 bp, Homo sapiens
gatctgggaattctaatgggagataaagaagtattgcagcaggagagctctctgctgtagctgtctgcttgtaccatataacccagctc

SEQ ID NO: 49166 - DNA, 80 bp, Homo sapiens
agtatatatctgtatcagtgtatatattcatatatactaatatgtatatataagtatatatacctatacttatacatact

SEQ ID NO: 49167 - DNA, 61 bp, Homo sapiens
tacttatatataagtatatttattcatatatacttatgtataatatacttatgtataagta

SEQ ID NO: 49168 - DNA, 113 bp, Homo sapiens
cagccagttgttccatttaaggccctagtatgagagatcacacagtgctcagccagcccaccagctgaccatctgtggtcagcataaatgaaggagcccagaaagattagctg

SEQ ID NO: 49169 - DNA, 108 bp, Homo sapiens
atctgaaaatttcagattttgatgttcctattttgatatttttttttatattttagtagaccataaagagatttcatgggaaaaggggcacaatttttgagtttagat

SEQ ID NO: 49170 - DNA, 91 bp, Homo sapiens
aggatgagatttatttctgttagtggattgctgtgatgcacatcacattcatttaattctactttttttttttgagagagagtctcactct

SEQ ID NO: 49171 - DNA, 117 bp, Homo sapiens
cacctggtgtttcaacacagcctgttatgctctgtctcacgtacttggatcttaagtaaaaccagactgttgtcccagtatgtagtggcccaaggctgaggttctcaaatacctgtg

SEQ ID NO: 49172 - DNA, 64 bp, Homo sapiens
tatacatatatatgtatatatatacacatatatatgtgtgtgtatatatatgtgtatatgtata

SEQ ID NO: 49173 - DNA, 116 bp, Homo sapiens
gacttccagtactatgttgaatagaagtgatgagagtaggcaatcttgtgttgttccaggtctcagagggaatgctttcaacttttccccattcagtattatgttggctgtgggtt

SEQ ID NO: 49174 - DNA, 74 bp, Homo sapiens
tagcagctcccacttgggaggacagagcagtgtgtggagactcacatcgtgaactttttctccaagagctacta

SEQ ID NO: 49175 - DNA, 113 bp, Homo sapiens
tcattattggaagttgccggggacagtgtcaaagactgtggttttactttctgatttttttttttttgagatggagtctctctctgtcgccaggctggagtgcagtgacgtga

SEQ ID NO: 49176 - DNA, 80 bp, Homo sapiens
acatatatatgtgtgtatatgtgtatatatgtgtatatatatgtgtatatatgtgtatatgtgtacatatatgtgtatgt

SEQ ID NO: 49177 - DNA, 113 bp, Homo sapiens
cacctgactcacctggtgctgtttcatggggagagatggaacactgaggagctggtgcctcttttttttttttttttttttaaacctcttgacttgcactgtcacagtaagtg

SEQ ID NO: 49178 - DNA, 65 bp, Homo sapiens
gcaatctcacagtctctgggtgtcttttatttaaaggtgtctgtctgtcccacaggctggagggc

SEQ ID NO: 49179 - DNA, 58 bp, Homo sapiens; identical to SEQ ID NO: 1725

SEQ ID NO: 49180 - DNA, 92 bp, Homo sapiens
gtgcaacaatcatcaaattatattccgtaagaactcatgacataaataaatgtactgaatttatttataaatataatgacgtattgttgtgc

SEQ ID NO: 49181 - DNA, 95 bp, Homo sapiens; identical to SEQ ID NO: 68

SEQ ID NO: 49182 - DNA, 93 bp, Homo sapiens; identical to SEQ ID NO: 69

SEQ ID NO: 49183 - DNA, 112 bp, Homo sapiens
gaggaccaaggggtttcaaaagaatcagcagatgggaggtggagtttgtcttctgcactatttctacttctgatatcgttttggataaagatctatgcttctcgaatatgtc

SEQ ID NO: 49184 - DNA, 95 bp, Homo sapiens; identical to SEQ ID NO: 68

SEQ ID NO: 49185 - DNA, 93 bp, Homo sapiens; identical to SEQ ID NO: 69

SEQ ID NO: 49186 - DNA, 114 bp, Homo sapiens
aggtcaagaatcagctgtggctaaggagttattttattgcagaatgtgacacttcagagtgtccagggcagttgaaacagtggccacttttaccaggtcctggttcttgcttcc

SEQ ID NO: 49187 - DNA, 101 bp, Homo sapiens
tgtgtgtatgtagatgtatgtatatagagacacatgtgtatatatgtgtgtatatatgtgtctatatgtaattatgtatataatatagatatatgcataca

SEQ ID NO: 49188 - DNA, 88 bp, Homo sapiens
aatgtctctgactagtttgctcaacagccatgagtcatactctgtatgtgtgtctgtgtgcaatatttatctctgggactaaggcatt

SEQ ID NO: 49189 - DNA, 116 bp, Homo sapiens
tcataggcctctttttcttaaaacatatatgtgtgtgtatgtatgcattcttgaaatatgtatatatatatatacacacacacacatatagtttttaatttttagcagaactgaga

SEQ ID NO: 49190 - DNA, 58 bp, Homo sapiens
tgagacagagtctcgctctgtcacccaggctggaggtcagtggcgtaatctcggctca

SEQ ID NO: 49191 - DNA, 74 bp, Homo sapiens
gccaagggcagaagaaccacagtgacagatagcttctcaaccatctgtgtctgtgtctcacccttgtcctgagc

SEQ ID NO: 49192 - DNA, 100 bp, Homo sapiens
gtcatatatatatatatatatatatatatatagagagagagagagagagagagaaatatacatatgtgtatatatatgtgtgtatgtatatatatatggc

SEQ ID NO: 49193 - DNA, 116 bp, Homo sapiens
gtatgattttcaatttatggtgtaaaataaattttccttttaaatgaaaagttttatttttcatttatggaaatagatttttgattttgaagaactatattaataaatataagtac

SEQ ID NO: 49194 - DNA, 109 bp, Homo sapiens
ttaaatttgaattttaataaacaatgaataatttttctatataagtataatattttggacatgcttgtactaaaaatttattcattgtttatctgaaattcaaatttaa

SEQ ID NO: 49195 - DNA, 95 bp, Homo sapiens; identical to SEQ ID NO: 68

SEQ ID NO: 49196 - DNA, 93 bp, Homo sapiens; identical to SEQ ID NO: 69

SEQ ID NO: 49197 - DNA, 76 bp, Homo sapiens
tttctcatagcttcatgacaggagatcgaggtgctcatcaaagttagaccctcaccctctcacagagactgagaaa

SEQ ID NO: 49198 - DNA, 114 bp, Homo sapiens
cattaagtacttttgcaaatcacatgcttatctgagaataatcagtggaaaaaaatgtacatttttaatacattttcaaggaaagaagaatgtgatcagcaagtcccttcaatg

SEQ ID NO: 49199 - DNA, 84 bp, Homo sapiens
tcttgagcagtgacgtaagatgggggagaagacagaatgagctggctgtctcactccctctctagctcctgtcccagcttgaga

SEQ ID NO: 49200 - DNA, 115 bp, Homo sapiens
atgccacttcaaggagcacagctgaaaaagcgagattcaaaataactagactttaaaaaaatatttttttaagacagggtcttactgtttagcccaggctacagtgcagtggtgt

SEQ ID NO: 49201 - DNA, 99 bp, Homo sapiens
ggaagtctgcatctcaggtctgccctaatatcagtatattcctatcatgaaactatattcattatatttgtagcagagtatgtgatgcacagtacttgc

SEQ ID NO: 49202 - DNA, 88 bp, Homo sapiens
attttcagagaacaagggagataaccttaaagtctggctgcctgtaggccagtcaggacagagccatatttctcttattatcgaaaat

SEQ ID NO: 49203 - DNA, 122 bp, Homo sapiens
ctcctttcttagggtattgactttagaaaacttgtaattggcagttctgtctctgtctctttgaaagacatgcacatctttttaacggccagataagtcttttgtcagcttttgatggagaa

SEQ ID NO: 49204 - DNA, 62 bp, Homo sapiens
agatgaatgcaggcaggtaggagtcaggggaagagcccctctctgtgtgtgtgtccgtgtct

SEQ ID NO: 49205 - DNA, 67 bp, Homo sapiens
ccagagttgatcagggtgggacaggatggctggaacagtcacactgtgtgacactggccagcgctgg

SEQ ID NO: 49206 - DNA, 104 bp, Homo sapiens
tactcagaggaaaagttttctggtatttgtatgtatgtatacatgtatatgtgtgtgtgtatatatgtatatataaaaatataatttaaaaattgatttgggtg

SEQ ID NO: 49207 - DNA, 86 bp, Homo sapiens
gtaaaatcagatagatatggaatgtcaagaatttactaagctgctttgcttatgatgaaaatgactccccacatctggactgagac

SEQ ID NO: 49208 - DNA, 77 bp, Homo sapiens
ttattcctgagtgggtcaattatacataacctgttatttaacaggttaaagtaaggatatgatttgtatagaagtaa

SEQ ID NO: 49209 - DNA, 109 bp, Homo sapiens
gcagatgcaggattctaacattgctttatctggctcccaaacctgtgatttttaacaatatattttacagtttcgaagacatcacaaataaagtagagtcttacactgt

SEQ ID NO: 49210 - DNA, 85 bp, Homo sapiens
tggcaataacaatgtatttttattgagcacatgagtgctcattgttcttagtgctttatatttgtatttttgaccttgttcgtca

SEQ ID NO: 49211 - DNA, 56 bp, Homo sapiens
agtgagttttctctctctgtctgccgcctgaggacacagagagaagatggccagct

SEQ ID NO: 49212 - DNA, 112 bp, Homo sapiens
ggattgtcttggctatacgggctcttttttggttccatatgaaatttaaagtagttttttctaattctgtgaagaaagtcaatggtagctttatgggaatagcatttaatct

SEQ ID NO: 49213 - DNA, 142 bp, Homo sapiens
gtgtgtgtgtgtgtgtgtgtgtgtatgtatatatgaagtgtgtatatatacgtatatatgtatgtatatatgtatgtatatatgtgtatatatgtatgtatatatgtgtatatatgtatctatatatgtatgtgtatacaca

SEQ ID NO: 49214 - DNA, 165 bp, Homo sapiens
tacatatatgtatacatatatacatgtatatatgtatatgtatacgtatatgtatacatatatacatgtatatatgtatatgtatatgtatatatgtatatgtatatacacacacacacatatatatacacacacacacatatatatgtgtgtgtgtgtatatat

SEQ ID NO: 49215 - DNA, 139 bp, Homo sapiens
acatatacatatacatatatacatgtatatatgtatacatatacgtatacatatacatatatacatgtatatatgtatacatatatgtatacatatacatatatacatgtatatatgtatacatatatgtatacatata

SEQ ID NO: 49216 - DNA, 93 bp, Homo sapiens
gtagtatatcaatgctaacttctgattttgatgattgtactgtggttagtaagacagaaatatttaggaataggaaagcattattatgtctgc

SEQ ID NO: 49217 - DNA, 183 bp, Homo sapiens
gagtgtttttgaaaagtatatgtatatatatatatatatatatatatatatatatatatatacacacacacatttaatacatatgtatatatgtattacgtatacatatacatatatacatatgtatatatgtattacgtatacatatacatatatacatatgtatatatgtattacgtatac

SEQ ID NO: 49218 - DNA, 106 bp, Homo sapiens
atacatatgtatatatgtatatgtatacgtaatacatatatacatatgtatatatgtatatgtatacgtaatacatatatacatatgtatatatgtatatgtatac

SEQ ID NO: 49219 - DNA, 101 bp, Homo sapiens
gatcctgtggcaagggcatagctttctctgtcagtctctctggtggagatctgaaacttcatcagggctgtgcacagaaggcgatgcctccaaggggactc

SEQ ID NO: 49220 - DNA, 90 bp, Homo sapiens
tatatttgatatgggtatacagagatatcatatatttgatatatgtatatctttaaattattgttcctctgtattctttatgtcattata

SEQ ID NO: 49221 - DNA, 58 bp, Homo sapiens; identical to SEQ ID NO: 1435

SEQ ID NO: 49222 - DNA, 79 bp, Homo sapiens
ttgttttgttttgtttgagtaacagtctcactctgtcacccaggctggagtgaggtgatatattcataactcactgcaa

SEQ ID NO: 49223 - DNA, 106 bp, Homo sapiens
ttagtggttttgaaacaatggatttctatgcttgtaggaaaatataaattagcatatttatatatgtcttagaagtttcaaagtttagttttatttgcctctctaa

SEQ ID NO: 49224 - DNA, 95 bp, Homo sapiens; identical to SEQ ID NO: 68

SEQ ID NO: 49225 - DNA, 93 bp, Homo sapiens; identical to SEQ ID NO: 69

SEQ ID NO: 49226 - DNA, 134 bp, Homo sapiens
gtggggctaaagtcacaccagtgtcaaagcagaaaacatttaggtattcaaggacactcacagtctcacttcttggcccacagagattctgagtctcatcagttgaccatacgttgttgttgttgttgttattg

SEQ ID NO: 49227 - DNA, 120 bp, Homo sapiens
ctgtttcttgttgtaagtatatgaaacattatatgttctgtttcttgttatatatattatatatatattatatatagagtctggaatatatacattatgttggtgcaaaagcaactgcag

SEQ ID NO: 49228 - DNA, 71 bp, Homo sapiens
atagatacaggcgcaggtgtgtgtgcatgtggacgtgcacacagacacacacacactattactagttctgt

SEQ ID NO: 49229 - DNA, 111 bp, Homo sapiens
tatatatatactatatgtgtgtgtgtgtatatatatatatatatatatatactatatgtgtgtttatatatatgtgtgtgtgtatatatatatacactatgtgtgtgtgta

SEQ ID NO: 49230 - DNA, 89 bp, Homo sapiens
gacaactggtgcctttcatagcgggtgaggtagaagttagtattttcagatgagcagagaatgcacctgtttttgttcaccacaatgtc

SEQ ID NO: 49231 - DNA, 75 bp, Homo sapiens
tttgcttatatacttataactatgtaaactatgtatgtctacatagttaaatatatgtttatgtgtatgagtagg

SEQ ID NO: 49232 - DNA, 86 bp, Homo sapiens
tgatccattctaatggaagagtagagtttgagttcttcagagccatgcctgaggaaacccaagacagactgcattgaaatggccca

SEQ ID NO: 49233 - DNA, 86 bp, Homo sapiens
gggttaagtagattatgtcaccacgagagccagccagccaggtcaagacttgtgttatttatgtggtagacataactgaattactt

SEQ ID NO: 49234 - DNA, 95 bp, Homo sapiens; identical to SEQ ID NO: 68

SEQ ID NO: 49235 - DNA, 93 bp, Homo sapiens; identical to SEQ ID NO: 69

SEQ ID NO: 49236 - DNA, 81 bp, Homo sapiens
tgagacaagagtctcactctgtcacccaggctggagtgcaatggcgcgatcttggctcactgtaacctctgcctcctgggt

SEQ ID NO: 49237 - DNA, 95 bp, Homo sapiens; identical to SEQ ID NO: 68

SEQ ID NO: 49238 - DNA, 93 bp, Homo sapiens; identical to SEQ ID NO: 69

SEQ ID NO: 49239 - DNA, 117 bp, Homo sapiens
gcctgtgtgtgcgcgcccgtgtgtccatgtgtgtgcctgtgtgcgcgcgcctgtgtgtctgtgtgtgtgcgcctgtgtgtgcgtgcgcgcgcatgtgtcgggagtgcgcggggaggt

SEQ ID NO: 49240 - DNA, 64 bp, Homo sapiens
tctgtcacgctggcaacatagagaaagattaagtatatttttgtctatagttagcatagacaga

SEQ ID NO: 49241 - DNA, 108 bp, Homo sapiens
cagaaaattttcaagaatagttcaagttatctctttatatttttagctagttctggatctctttttttctcagatcttgagtagataactgagctcattagttttttg

SEQ ID NO: 49242 - DNA, 189 bp, Homo sapiens
acaacttatctgcaccatgaattacgtatatatatatatatatatatatatatatatatatatatatatatatatgtaattatctatatatatgatttttgtacttcttaaactcagtttaaaattatatatataattatatatatatatatataattttaaactgaattcaagaagtacaaaagtaca

SEQ ID NO: 49243 - DNA, 110 bp, Homo sapiens
atgtgattctggaattagggtgattttggctgcatagaatgaagtaagaagtgtttctttaatttctattttttgaaagcaagaatgatcttgaagaataagtattatat

SEQ ID NO: 49244 - DNA, 70 bp, Homo sapiens
aatatctctgaggtatgcatgtatgtacttatgtgtatgtgtgtgtatatctatatattatatagatatt

SEQ ID NO: 49245 - DNA, 98 bp, Homo sapiens
atagggggactattgtatacgttctatttgtaatacatacaggtatacatgtgtacctgtatgtctatatttatatgtgtacacttctatatctgtat

SEQ ID NO: 49246 - DNA, 78 bp, Homo sapiens
gcaaggtgtggggtgggggggtgctatacacttttttttttttcttagagtctcactctttcacccaggctggaatgc

SEQ ID NO: 49247 - DNA, 95 bp, Homo sapiens; identical to SEQ ID NO: 68

SEQ ID NO: 49248 - DNA, 93 bp, Homo sapiens; identical to SEQ ID NO: 69

SEQ ID NO: 49249 - DNA, 112 bp, Homo sapiens
ttggatacttttcaactatctaacaatgcctggatttcatatatttatttgatattgtttcttatagtaaatattaacctaatttggcattgttgtattttttaaagactaa

SEQ ID NO: 49250 - DNA, 82 bp, Homo sapiens
gaagcattcacattttgacttgtgactctttctggtgctatattggaagagtcacttcactgcaagaattctgagttgtttc

SEQ ID NO: 49251 - DNA, 95 bp, Homo sapiens; identical to SEQ ID NO: 68

SEQ ID NO: 49252 - DNA, 93 bp, Homo sapiens; identical to SEQ ID NO: 69

SEQ ID NO: 49253 - DNA, 114 bp, Homo sapiens
ttttacttgcaagtagtggaatcctaaatcttaagaattttcttattttattttttattttattattattatactttaagttttagggtacatgtgcacaatgtgcaggttaga

SEQ ID NO: 49254 - DNA, 132 bp, Homo sapiens
atatatgtatatgtatgtatggatatatatacacatacctgtatatatgtatgcatatgtatgtatatatacatataagatatatgtatatatgatatatgtatatatgcatatatatgtgtgtatatatac

SEQ ID NO: 49255 - DNA, 116 bp, Homo sapiens
tctagaatcttgtatctatctatctacctatgtgtgtgtgtgtgtatatatatatatatatatagatgatatatataggtgatatatatagatagatagatgatatatatagatac

SEQ ID NO: 49256 - DNA, 117 bp, Homo sapiens
tctttaactgtcccgttgggaagggagagattggtaaggttttagtttttctttataagaataaacctaaatcacaatctgaaatagccttccctggaagttttataatactaaagg

SEQ ID NO: 49257 - DNA, 63 bp, Homo sapiens
tcacgatgcaaccagctcaagtcaggctgcttgctggtcaagcatctgactttgtatttgtga

SEQ ID NO: 49258 - DNA, 114 bp, Homo sapiens
atgtacttttttcagttttgcatatttatgttcattgaaatttttttattcatagatatgtctaaataaaagagcaagaaggtaaaatactaatggcagaacacagagtaacat

SEQ ID NO: 49259 - DNA, 117 bp, Homo sapiens
tgtttttttgttcaaacatctttcttatttctttcttcctatgactcttttttctttttcttaaaccaaagcaagcataaagagagggataaagaagccaggtgattgaggggcagg

SEQ ID NO: 49260 - DNA, 102 bp, Homo sapiens
gctgattttagacatatatatgtgtgtgtacatatatatgtatgtatatatgtatgtacgtatatacatatatatgtacacacacatatgtctaaaatcagc

SEQ ID NO: 49261 - DNA, 109 bp, Homo sapiens
tggagtagaaaagcaatgacagacaatgcatgaatgaatgagtggggatgtgtcccaataaaactttatattttgatgctgaaacttaaattgtgtgattttcatttca

SEQ ID NO: 49262 - DNA, 96 bp, Homo sapiens
ccccatgttggagcttctccatcaggaacagggctgctgaggtcagagaggccagagtgtggggggccctgtgcatgaggggatcttaaggacagg

SEQ ID NO: 49263 - DNA, 100 bp, Homo sapiens
gcacagagtatctacatgcatctgtctgtatgtttgtgtgtgtatacatatattatgtatacatatatgtgacatctttctgcatctggatagtattagc

SEQ ID NO: 49264 - DNA, 82 bp, Homo sapiens
ataatatatatacgtatatatatacgtatatatacgtatatatatacgtatatatacatatgtatatatgtatatattttgt

SEQ ID NO: 49265 - DNA, 103 bp, Homo sapiens
ctgagaataggcatcccgaggtgtttgtcttaacaatggaacccagagtgtctgtctcagtcctgcccttgagtggagctgaagtggtgctcacagctgggtt

SEQ ID NO: 49266 - DNA, 106 bp, Homo sapiens
gagtgatttatacttcaaattttggagaagattttactatcttatttaatgataaaggcagtaatagtattgtgttactccagcagttcaattagtggtgtcattc

SEQ ID NO: 49267 - DNA, 75 bp, Homo sapiens
aggttgccgggactcagagatacaggatggaagagggaaagacctctctctatcactcacatacccccgatatct

SEQ ID NO: 49268 - DNA, 187 bp, Homo sapiens
tatatgtgtatatatgtgtatatatgtgtgtatatatgtgtatatatgtgtatatgtatgtgtgtatatatgtgtgtatatatgtgtatatatgtgtgtatatgtgtgtatatgtgtatatatgtgtgtatatatgtgtgtatatatatgtgtgtgtatatatgtgtgtatatatgtgtgtgtatat

SEQ ID NO: 49269 - DNA, 116 bp, Homo sapiens
ctatttaagtcatattcttctattaaataatttttttcaatgatctgggttattaacatgattaatttttagttttttgtgggaatttattcttggaatgaatggaacagtgatag

SEQ ID NO: 49270 - DNA, 92 bp, Homo sapiens
gcgtccttgcctggaaaaatctaattttttttctttgactcgcagtttaagagtcatggaaataggacaggctttgtacccacgtaaaccgc

SEQ ID NO: 49271 - DNA, 94 bp, Homo sapiens
cctccccctgcaattctctatctctccagcctggaattggggacaaagatgaatttcagagtgctgagagtgagctgagtgtggccttaagagg

SEQ ID NO: 49272 - DNA, 111 bp, Homo sapiens
gtagctgctgctatgacgttaaactttgtgcacataagaaatgccctgtaattttttttttattatactttaagttttagggtacatgtgcacaatgtgcaggttagttac

SEQ ID NO: 49273 - DNA, 90 bp, Homo sapiens
ttctgttggtcattcttatttttaaatagttaatattatttttggacaagcagagaactatttatgcataagagtaactacataacagag

SEQ ID NO: 49274 - DNA, 97 bp, Homo sapiens
atgtctctatgatcctactgtactgtggccattggtttatttcttttaaaatgagatggtgaggtccttgtggccagagaagatgtgtcattggcat

SEQ ID NO: 49275 - DNA, 95 bp, Homo sapiens; identical to SEQ ID NO: 68

SEQ ID NO: 49276 - DNA, 93 bp, Homo sapiens; identical to SEQ ID NO: 69

SEQ ID NO: 49277 - DNA, 79 bp, Homo sapiens
catacacacacatatatgtgtaacatcatatatatatttataaaacgtgtgtatatgtgcacatgtgtgtctgtgtgtg

SEQ ID NO: 49278 - DNA, 91 bp, Homo sapiens
caggtagatcctaatgagcatgtaggttgtataaatcagtggttctcaactgaagcaattttgccacccatgcaatagttagcaatatctg

SEQ ID NO: 49279 - DNA, 88 bp, Homo sapiens
gtcgttattctttaaatgcacagattctcactgcctgtgtctatgaaaagacagcagtgtgaccactgtcatgtttgaagaccaacac

SEQ ID NO: 49280 - DNA, 89 bp, Homo sapiens
tcatggccgtcccacagaggtcactgtgctcactctcagggtcagaaggatacagcttcccttaggtgtggggcaggaaagaaacatga

SEQ ID NO: 49281 - DNA, 110 bp, Homo sapiens
tgtagtgaatttttaatatagcaaacttaaaatcattgagactcattgggctagtaaatttatagtatttaatagttctaataattcagagggctagaaaatttgttata

SEQ ID NO: 49282 - DNA, 111 bp, Homo sapiens
caaaaattagccggttgcggtggtgcgcctgtggtccccgcctctcgggaggctgaggtaggaggatcacttgaggtaggaggatcactttagctttggaggcagaggttg

SEQ ID NO: 49283 - DNA, 58 bp, Homo sapiens
tgagacggagtctcactctgtcacccaggctggagtgcagtggtgtggtttcggctca

SEQ ID NO: 49284 - DNA, 56 bp, Homo sapiens
gagaccgagtctcgctctgtcacccaggctggagtgcagtggtgcaatctcggctc

SEQ ID NO: 49285 - DNA, 71 bp, Homo sapiens
gctcaaagggaaacttgcgagatatatatatatatctgtataatctatgtcttgcttaatgcctactgagc

SEQ ID NO: 49286 - DNA, 107 bp, Homo sapiens
tggacatttgttttctcacagtcccagaggcagtaagtctgagatcaaggtgtcagcaggattggtttcttctgaggactttctccttggctggtggacaactgtct

SEQ ID NO: 49287 - DNA, 97 bp, Homo sapiens
gtgtcaagttagcttttagctataggttattggaagatgagtgacattcagcttctgccattaaaaatcttcaagccttagtgtgagatgtagatac

SEQ ID NO: 49288 - DNA, 117 bp, Homo sapiens
gtagctctttaatttagcagaaatgtattctgtggtatgatgtgagcctatatattaatatattttgttaaaatttagctcattccacaaaagcatgattattggattggagggcac

SEQ ID NO: 49289 - DNA, 108 bp, Homo sapiens
tatggataaactgtattccattgtgtatatgtgtatatatatttgtgtgtgtgggggggatatacaccaaattgtatatgtatgtgtatatttgtatgtatgtgtata

SEQ ID NO: 49290 - DNA, 83 bp, Homo sapiens
agatatgagaacacagagagtctgggaaggttcctccacatgagaggccaggaatattctttctttttgttttctttctttct

SEQ ID NO: 49291 - DNA, 70 bp, Homo sapiens
acacacatatatatacacacattggtgtatatatatttgtatacatatatgtgtgtgtatgtgtgtttgt

SEQ ID NO: 49292 - DNA, 95 bp, Homo sapiens
ttgtaattatagatgcatgtgcttttaagaatacagtaatttctcaaaatgaaatatatttcttagtattttataaagcactgttaaaattgcaa

SEQ ID NO: 49293 - DNA, 95 bp, Homo sapiens; identical to SEQ ID NO: 68

SEQ ID NO: 49294 - DNA, 93 bp, Homo sapiens; identical to SEQ ID NO: 69

SEQ ID NO: 49295 - DNA, 161 bp, Homo sapiens
tgtcacatatgtattatacggtatatatgtacacatatgaacacatatgtattatatatgtatgtgtatatatttatatgtgcatgtatatattatatataatacatgtgtacacatatgatatgtgtatatttatatatgcatgtgtatattacatatgt

SEQ ID NO: 49296 - DNA, 104 bp, Homo sapiens
tagctgtgggtcaattggtcatcaaaagatactcttgagagaagagattcaggtcttctatccactcaatgtatctgagagtcaatattattggtcttttgtta

SEQ ID NO: 49297 - DNA, 85 bp, Homo sapiens
cttatgctttttggttacctagtctgtttagctttgtctctctttcttgcggagctagctagagagaggtcttaaaagcagtaag

SEQ ID NO: 49298 - DNA, 71 bp, Homo sapiens
taaaggtgatcacatattaagggagtttggggagttatttgtaatgtctcttctcagtgtgagagctttta

SEQ ID NO: 49299 - DNA, 71 bp, Homo sapiens
gtctcctaagaaaagagagttggaggataacgatgagtctctgtgtctctctcccatctttccagggagac

SEQ ID NO: 49300 - DNA, 58 bp, Homo sapiens; identical to SEQ ID NO: 3380

SEQ ID NO: 49301 - DNA, 87 bp, Homo sapiens
tcaaaactgaggattgtctcgaggacccccaaatctgcaattggtgtcagaagtgagagtggtcttagggactgttccctgacttga

SEQ ID NO: 49302 - DNA, 70 bp, Homo sapiens
ctcatagttccaaaggctccaagtctgagatcaaggtgtgagcagggttggtttcttgtgaagctgcgag

SEQ ID NO: 49303 - DNA, 95 bp, Homo sapiens; identical to SEQ ID NO: 6311

SEQ ID NO: 49304 - DNA, 81 bp, Homo sapiens
ggagttctgctggggccagagagagcacagagaggccaatgggcagctgggtctgaggaggctctggccaggtaaagctct

SEQ ID NO: 49305 - DNA, 82 bp, Homo sapiens
ggttgtaaagcgggggactgagaagcgcctgtgaagttcacaatctggggtcacaggctcactcagagactgagatctaacc

SEQ ID NO: 49306 - DNA, 112 bp, Homo sapiens
ggtggtggaggggggatgatggaggggggtgatggaggggggttggtggaggggacagtagtgagtgtgaccttccttgtctctgtgcctcttggagtaacctctgcgcact

SEQ ID NO: 49307 - DNA, 96 bp, Homo sapiens
cgtgtgtgtgtatgtctggctctctggaggcaagatgatgggtgattttaatttttttctttgtgcttcccagtttttctgcagcatagatggata

SEQ ID NO: 49308 - DNA, 91 bp, Homo sapiens
atatgcatatgttacaaattatataatatatgcatatgttacaaattatataatatatgcatatattataaattatattatatatgcatat

SEQ ID NO: 49309 - DNA, 107 bp, Homo sapiens
tctggtgaaagagtaattatgaggagttctttttttttttttttttgagatggagtctcactcactctgtcgcccaggctggagtgcagtggcatgatctcagctca

SEQ ID NO: 49310 - DNA, 75 bp, Homo sapiens
gtggacgtatgtttttatgtctcttcaattcctaggagtagaattgctgagtctcatagtacatatatgttttgc

SEQ ID NO: 49311 - DNA, 76 bp, Homo sapiens
gggctcctgggtcacgtcactccaacctcggctctgtcttcacatggcctttgtccctgtgtgtctctgtgtgccc

SEQ ID NO: 49312 - DNA, 80 bp, Homo sapiens
ggtgggggcagagactcaaaccatatcagccatcttccctctgtgtatgtctgtgtctatggcctagtaagaaggacacc

SEQ ID NO: 49313 - DNA, 74 bp, Homo sapiens
atgtgacttttcagtccctgcctgtctctgtgagtgtggtcccttgccagaacatagtgcaggctctgtcacat

SEQ ID NO: 49314 - DNA, 106 bp, Homo sapiens
tgtgtccttccagtctctgcctccgtgtgtgcacagccagcctctttctgtgtctctctgtgtactctcatcttaggaggacactgagttttggatttagggccca

SEQ ID NO: 49315 - DNA, 74 bp, Homo sapiens
tacttgtttagagcacttaccatgatggagcttgtgggactggaagttgctctgggtgagtcagtgagtgagtg

SEQ ID NO: 49316 - DNA, 71 bp, Homo sapiens
gcaccttgcccatgggcacagagagatcaggcacagaagggagtctgactgagtcactgccatgcagggtc

SEQ ID NO: 49317 - DNA, 106 bp, Homo sapiens
ttatgttctaaaataggtgtggatccagattagtgaaggacatatatactaatatatatgtatatttgtgtgttgcatttgaaataatgcttagtagaagccatga

SEQ ID NO: 49318 - DNA, 74 bp, Homo sapiens
ctgctgtttggctctgtgtcagtgttgacaagtcgtacgtgttcgacgctccgtgaggcaactggttccagcag

SEQ ID NO: 49319 - DNA, 155 bp, Homo sapiens
tatgcatgtatttacttatgtatatgtatatgtatatatttccatatatacatttatatttataacacgtcacaaatgtagatacacatatacacacattcacacacgagcgtgaacataagtccacataagtgtgtgtatgtatgtgtgtatat

SEQ ID NO: 49320 - DNA, 106 bp, Homo sapiens
gagtactcaactctaccctttaaagttttttatgtaaagtcatgattggataatgaaaattatcttttttagattacatcattttaggaagagtgatagagtattt

SEQ ID NO: 49321 - DNA, 78 bp, Homo sapiens
agaaattacttagcaattaaaccttcagcaaaattgtaattcattttaaatttagcacggaggtttgatgctgtttct

SEQ ID NO: 49322 - DNA, 112 bp, Homo sapiens
tacctgggtggcttgatttgtttttcattctaaactcaattttcacttgccttttttttttttttttggagtgggttggggtgttaggtttgatcagcagccaaacagagtg

SEQ ID NO: 49323 - DNA, 96 bp, Homo sapiens
gcatgctgtacaggtttgtaccccaggaggaataggctacaccatctaggtaggtgtgtagtaggttgtttcgtctaggtttgtgtaagtgcatgc

SEQ ID NO: 49324 - DNA, 121 bp, Homo sapiens
atggaaattaatattttggattgaagtgtctggggggaaaagtggttgacatttgaatttcataaatttgttccaatctaaaaacctcagatatctttgagttaaaagtttaagactctgt

SEQ ID NO: 49325 - DNA, 82 bp, Homo sapiens
cggcaggttattgagataaactgaggagaggagcgacagctgctgcactccctctgtgagtttctctcagtaaaccctgtgg

SEQ ID NO: 49326 - DNA, 66 bp, Homo sapiens
gcaatttcaagtccacctgctgctgaaatctgctgggagcaggtttcattcaggggaggaggttgt

SEQ ID NO: 49327 - DNA, 111 bp, Homo sapiens
gtgcttgtgtatgtatcatgtgtatgtatccgtgtgtgtgcatgtgcatttgtacatgcttttgtgtatgtatgtacacgtgtatatgaatttttgtatatgtgcctgtgt

SEQ ID NO: 49328 - DNA, 59 bp, Homo sapiens
ggtcactgatcctcggtcccacatgtgaggtcactcagtctctctgagggtcagcgtct

SEQ ID NO: 49329 - DNA, 70 bp, Homo sapiens
ctgaatttgagcattttacaaaacaggtgtgcattccttgtttgggatgttttgtttttgttttattcag

SEQ ID NO: 49330 - DNA, 88 bp, Homo sapiens
cttatcagcaggtactatgctccaaccccacagtaaagtcccgggaatacagagatgacagtgaggtgagatgggtcctgccttcaag

SEQ ID NO: 49331 - DNA, 135 bp, Homo sapiens
acttacagctgggaggagcctgcacccatctctggctcttgtgaatgagaagactcaatttgtgtttttgtttttttgagaaagggtcttgctctgtcacccagactgaagtacagtagcgtgatctcagttcac

SEQ ID NO: 49332 - DNA, 134 bp, Homo sapiens
gcagcagtcttcagggcactaaaggttaagagggaagccgatgagccacaggcgtgactcagaagagagggtgcaggtttcgctgcttttcctgtgtggtcagtgggtcaatgtgggacatcaggctatagtgc

SEQ ID NO: 49333 - DNA, 137 bp, Homo sapiens
ggcctggcggtaggtgagcatggcgtggagctcgcgggagagttggagatgtgatcgcttctgtccgtgtgtcagcgtgatggcctgtccacgccgctttcttctgactgtgagctggcccatctctgtacgcttgc

SEQ ID NO: 49334 - DNA, 81 bp, Homo sapiens
gtctttgcatgttctccctgtgtgtccgtgtctctgtggcttctctactaataagggcactggtcgtattagatgtaggac

SEQ ID NO: 49335 - DNA, 72 bp, Homo sapiens
gcgcataaattctcgtaggaatcgtttctgtttccagacatgggacgttactctttatgatttttatgatgc

SEQ ID NO: 49336 - DNA, 115 bp, Homo sapiens
ggggcaggtggatggatggataggtagatataagaagaaatataaatgtatgtatacatctatattgtacatatgcatatttattcatacttatagacagacattttctagcctt

SEQ ID NO: 49337 - DNA, 83 bp, Homo sapiens
agtgcctgccaccatgcctggctaacttttatatattttgtaaagacaaggtttcattatgttgcccaggctggtctcaaact

SEQ ID NO: 49338 - DNA, 159 bp, Homo sapiens
tatgtgtgtatatatacacgtacatatatttatgtatatatgtacatatatgtgtgtatatatgtacatgtatatatatatatgtgtgtgtgcatgtgtatgtatatatatgtaaatatatatacataaaacgctactatcccatacatgcagtagtat

SEQ ID NO: 49339 - DNA, 105 bp, Homo sapiens
ggggtaaaaagcacgtgaagttatagtgaagttagagaggtctccaaatcagccttcctccctccagccatctttcccttcatccttgatttccttcctaaccct

SEQ ID NO: 49340 - DNA, 88 bp, Homo sapiens
cccggtgtcttttaatcctcagaatgcagaagtactctccttctccctggtagaggctgactctctcacattaattagacatacaggg

SEQ ID NO: 49341 - DNA, 102 bp, Homo sapiens
ggtgtggtggctcatgcctgtagttccagctactagggaggctgaggtaggaggatcattcgagcccaggagtttaagactgcagtgagctgtgatcaaacc

SEQ ID NO: 49342 - DNA, 69 bp, Homo sapiens
gaacaggggatgcactgtttatttatttatttacttatttatttatctgagacagtgtttcactctgtc

SEQ ID NO: 49343 - DNA, 98 bp, Homo sapiens
ttcagtttgtatacatggtgagccattctctgtgctcctttacttttttttttttttttttttttgagacagagtctcaccctgtcacccaggctgga

SEQ ID NO: 49344 - DNA, 113 bp, Homo sapiens
taggaagcagaggctcagaattgggtcatgggatgggaacctttactggtggagagaagatagtgacaacttgggccccgttgcggcatcacgatgactagggctctcacctg

SEQ ID NO: 49345 - DNA, 115 bp, Homo sapiens
ccagttcacaaaagaactctgccataccattacctaatggcctagagcataatctatctcagtacagagtgtggagatggtaccctttggcataattcttatacccctcatctgg

SEQ ID NO: 49346 - DNA, 65 bp, Homo sapiens
tggattggtgtcatcagacgcaagatagcatttgaacacagatgtgtgtctgtgactcgggttta

SEQ ID NO: 49347 - DNA, 80 bp, Homo sapiens
tgtgtatacacatatgtatatgtgtgtatatacatatatgtgtatatgtatatacatatatgtatatatgtgtatataca

SEQ ID NO: 49348 - DNA, 58 bp, Homo sapiens; identical to SEQ ID NO: 715

SEQ ID NO: 49349 - DNA, 116 bp, Homo sapiens
ctataccctaaataactgttctttcccagtagtgtgattggtgttttgttttttttttttttttttttttaaacacagtcttgctctgtcacccaggctggagtgcagtggtacag

SEQ ID NO: 49350 - DNA, 117 bp, Homo sapiens
gggagtcagcagcggcacaggcggagccagggctgctgggctgggaggccgagtcaccctcactgagtgatccgcagcgggcccgcgccgccctgtccccgtcactgtccctctcgc

SEQ ID NO: 49351 - DNA, 107 bp, Homo sapiens
tcttaagtgaaaagctgcaaatgtaagcattttaataaactttgatacagaactgagagtgtactgaaagtgtgtttgaaatgcactcatttttctgctttgctaga

SEQ ID NO: 49352 - DNA, 89 bp, Homo sapiens
atacacgaaagagagaaacaattgtgtagatgtataactgtccttatgtggacagacatcacactttggaaatcactttttggtgctgt

SEQ ID NO: 49353 - DNA, 89 bp, Homo sapiens
tgtgtgtctatatgtatgtgtgtaccatcaaatgtaattgaattcattatataaatgtgtgtacaaacacacacacagatagatgtgta

SEQ ID NO: 49354 - DNA, 85 bp, Homo sapiens
ctttggtgaaagtttctcatggaaagatgtgtgcacacacactcacgcacacacccagtcctcagcagcagatattttgccgagg

SEQ ID NO: 49355 - DNA, 67 bp, Homo sapiens
agctggagtggtacggaggcaggccagagcttcacagctggcctcgctcacacacacactcacggtt

SEQ ID NO: 49356 - DNA, 71 bp, Homo sapiens
gcgtgtgtgcgtgtctgcctgcgtgtgtgcctgcggtggagggggcgatgtgcctgcgtgtgtgcctgcgt

SEQ ID NO: 49357 - DNA, 96 bp, Homo sapiens
gggggcgatgtgcctgcgtgtgtacctgcgtgtgtgtgtgtgcctgcgtgtgtgcctgcggtggagggggcgatgtgcctgcgtgtgtacctgcgt

SEQ ID NO: 49358 - DNA, 106 bp, Homo sapiens
gtcacagtgtcccagcggtctccttctctggctgtacaattgcacactcactctttcacagaactgcaaattcacccacagaccaggctgactgtgtgacatggac

SEQ ID NO: 49359 - DNA, 76 bp, Homo sapiens
tcctgagtctgtctctgtcagggagaggagtgggctggagtcactatcttaggacatacggcagatttttctagga

SEQ ID NO: 49360 - DNA, 104 bp, Homo sapiens
tggctggtaatggtaaactcctagctcactctctctgtgggtcacttccccgagggaggaagaaaacaggggagagtgataagcaggcctcctttcacagcaca

SEQ ID NO: 49361 - DNA, 99 bp, Homo sapiens
tttggggggcgagggaggcagggagaggggtctcgctctgtcgctcaggctggagtgctgtggcgcgatctcggctcactgcaacctctgcctcccggg

SEQ ID NO: 49362 - DNA, 97 bp, Homo sapiens
ttcattgaaataatagagtttatgatgaagcttttttttaaaaaaaaaaaaagaaagaaaaagctgcgtataaattcattggattgtagtctctgaa

SEQ ID NO: 49363 - DNA, 58 bp, Homo sapiens; identical to SEQ ID NO: 9124

SEQ ID NO: 49364 - DNA, 127 bp, Homo sapiens
tagccaggtgcggtggtgcatgcctgtggttccagctactcaggaggctgaggtagaaggatggcttgagcccaggacataggagttgcagtgtgctataactgtgccactgcactccagcctgggc

SEQ ID NO: 49365 - DNA, 84 bp, Homo sapiens
gcagtactgtttggtacctgtgtgcagtactgtgtttgatgcctaagtgcagtactgtgtatgttgtactgtgtgcagtactgt

SEQ ID NO: 49366 - DNA, 117 bp, Homo sapiens
tgggcttctggttttaaaaaatctgatggtaattcattttttgcccttattaataaatgaatatctatatttatgaataccggtagcttgtgtggacactgtcagcctcaaagctta

SEQ ID NO: 49367 - DNA, 106 bp, Homo sapiens
aaggttcactgtttgagttgaaatacgaaatttggccctgtctgaagttgtttattattttcattgaactttgtgtcaggtttcactttaatcaaacacaagcctt

SEQ ID NO: 49368 - DNA, 72 bp, Homo sapiens
ggctaatagtttgacacaagaggctgagctttcagcctgtctcagctctctgcgtgccttcctcattaagct

SEQ ID NO: 49369 - DNA, 98 bp, Homo sapiens
ttggtttattggtggtcctcatacagaacaaagaatgcagtgagcagcaactgtttgttgaattaacatgtaggctgtttagttcacttttaatacag

SEQ ID NO: 49370 - DNA, 58 bp, Homo sapiens
tgaggctgagtctcactctgtgacccaggctggagtgcggaggcatgatctcagctca

SEQ ID NO: 49371 - DNA, 68 bp, Homo sapiens
gcgtcgtctgcaggggctgtgttgttgctggtcaagacagttcacagacagctctgcatgagtgatgc

SEQ ID NO: 49372 - DNA, 119 bp, Homo sapiens
gcactcagtttaatgccattgtggggggaggggcaaaagggatttctggtctttttttttttttttttttaatgagacagtgtctccctctgttgccctctgttggctggagtgcagtg

SEQ ID NO: 49373 - DNA, 98 bp, Homo sapiens
ttttgagaaacaagcagaacagatgagatgttgatgttgttttgaactaaaaagaatatggcttcatctttagctgtgtttgaagacaattcccaaag

SEQ ID NO: 49374 - DNA, 103 bp, Homo sapiens
tagaagacacaatggattgtgtattgaaaaacgcacccatgctttaggtagaaagtaattatttgattttcaatactaacaattatttctagtacgtttttta

SEQ ID NO: 49375 - DNA, 73 bp, Homo sapiens
ctgagctgtgtctgggtcgctgtatggggtcctcctggcagccctggtgcactttcctactgacagatctcag

SEQ ID NO: 49376 - DNA, 68 bp, Homo sapiens
gcatgcacaagtgtatgtacaagcacatgtgagtgtgtaagggcctgtgtctgtgtgtgagtgcatgt

SEQ ID NO: 49377 - DNA, 78 bp, Homo sapiens
tatttagatttatgtgagtatatgtatatataatacatatgtgcttacatatatacatatactaaatatatctatata

SEQ ID NO: 49378 - DNA, 93 bp, Homo sapiens
caattttttttttaatttgtttctgtctctattttagacatgcatagaaatgcactatctagttagtacaggtacagattaaaagaggtattg

SEQ ID NO: 49379 - DNA, 99 bp, Homo sapiens
gtcatggtgttgtgtgcctatagtcccagctactctagaggctgaggtagaaggatctcgagtccaggagtaagaggctgcagtgtgctgtgatcacac

SEQ ID NO: 49380 - DNA, 172 bp, Homo sapiens
gtgtgtgtgtgtgtctgtggatatgtgtgtgtgttgtatgtatatatgtgtctctgcgtgtatatgtatatatgtgtgtgtctgtgtgagtgtatgtgtgttagaatgcgtggggatgtgtgtgtgtgttgttggtatgtgtgtatctctgtgtgtatgtgcatgtttgtgt

SEQ ID NO: 49381 - DNA, 106 bp, Homo sapiens
ggtttagtaatttaaaattgcattcttgcaatgcattgataaaaaattgttttattttgtttcattttaaaaatgtattcctaagtgctatttgaattagtatccc

SEQ ID NO: 49382 - DNA, 77 bp, Homo sapiens
gagacagagtctcactctgtcacctaggctggagtgcgtgcagtggcgcgatctcagctcatagtaacctctgtctc

SEQ ID NO: 49383 - DNA, 153 bp, Homo sapiens
tagatagatagatagatagatagatagatagatagatagatagataggcagacagatacttttatttatttatatttattttttattttttatttttttgagatggagtctcgctctgttgcccaggcaggagtgcagtggtgcgatcttggg

SEQ ID NO: 49384 - DNA, 129 bp, Homo sapiens
agacaaccccagtctctgcctgtgtctcacttagcgttcctggctgtgagcagacaaccccagtctctgactgtgtctcacccagccttcctggctgtgaccacacaaccccagtctctgcctgtgtct

SEQ ID NO: 49385 - DNA, 76 bp, Homo sapiens
gaggccattgtgaaaaggacaggaaggagaagggtgaacttacttagactctgtgtctgtcttttttgtatttttc

SEQ ID NO: 49386 - DNA, 80 bp, Homo sapiens
ggcagctggggctggagcagcagtggtaccgtgggcctccctctctgtctctggcacctctctctctgcctcacccttcc

SEQ ID NO: 49387 - DNA, 111 bp, Homo sapiens
gcaaatggccagatgaggtattatttttctagaagtcttagcttgtaatgcaaacgcgtgcacttacacacacactctgaggaaatactgttgcatactggagttccttgc

SEQ ID NO: 49388 - DNA, 283 bp, Homo sapiens
atagatacatatatatgcatatatacatatagatacatatagatacatatatacatatatatgtgtatatgtatatgtatgtatatatgtatatacacatttatatgtatattatgtatatatgtatatgtatgtatgtatatgtatgtatgtatatatgtatgtatatgtatataatgtatatacatgtatacatttatgtatatatgtatacatatatgtatatacgtatatatgtatatatgtatacatatatgtatatacgtatatatgtatatatgta

SEQ ID NO: 49389 - DNA, 195 bp, Homo sapiens
gtatatatgtatctatatgtatctatatgtatatatgcatatatatgtatctatatatacatatatacatatgtatacatatgtatatatatagatatgtacatatctatatacctatatatgtacacatatatatgtgtatatatatgtgtatatatataggctatatatatgtgcatgtatacgtgtatgtat

SEQ ID NO: 49390 - DNA, 72 bp, Homo sapiens
atatatatgtgtacatatataggtatatagatatgtacatatctatatatatacatatgtatacatatgtat

SEQ ID NO: 49391 - DNA, 66 bp, Homo sapiens
gtgtgtgtgtctgcatgtgtgtgtatatatacacacgtatatatacatatatgtatatacatacac

SEQ ID NO: 49392 - DNA, 59 bp, Homo sapiens
ggctcaggagaggaaagtggatctggcctgtctgtcctgatttgtgtctctctgaggcc

SEQ ID NO: 49393 - DNA, 59 bp, Homo sapiens
ttgagacagagtctcactcactctgttgcccatgctggagtgcagtggcacgatctcag

SEQ ID NO: 49394 - DNA, 92 bp, Homo sapiens
acgggcactgtgagggcagcacatgtttttgtttttgtttttttaattttattttaagttctgggatacatgtgctgaacgtgcaggtttgt

SEQ ID NO: 49395 - DNA, 102 bp, Homo sapiens
acattgtatgctttttatgtgtggttcattttggtttgcactaatttcaatatatttttgataatgctgtcctggtagaacatataaaaggaaaatacctgt

SEQ ID NO: 49396 - DNA, 62 bp, Homo sapiens
gcctgcctggctctgtccctctccctgcttggagcactggaggctgaccctgcccgctgtgc

SEQ ID NO: 49397 - DNA, 95 bp, Homo sapiens
ttatggaaaaatgcacaaaatgctgatggaaggatgcttagggtatgtggcctttggcattattttatatatattttagctaatattttctataa

SEQ ID NO: 49398 - DNA, 167 bp, Homo sapiens
atatatatgtgtatatatgtatatatatacatatgtgtatatacgtatatgtatatatacatatgtgtatatatacacatgtgtatatatgtatatgtatatatacatatgtgtatatacacatatgtatatatgcatatgtatatatacacatatgtatatacgca

SEQ ID NO: 49399 - DNA, 64 bp, Homo sapiens
tgtgagcatatgtgcatgcatgggcacgtgtgtgtgtctctgtgtaagtgcacatgtgtgtgca

SEQ ID NO: 49400 - DNA, 72 bp, Homo sapiens
gtgtgtttgtgcatgtgcatatgtgtgcgtgtgtgtttgcacatgtgcatgtgtgcctgtgtgcgtgtgtgc

SEQ ID NO: 49401 - DNA, 126 bp, Homo sapiens
tgacagagtgagactctgtcttttttttttttttttttttttgagacagagtctcgctctgtcagccaggctggagtgcagtggcatgatctcagctcactgcaacctccgcctcccaggctcaag

SEQ ID NO: 49402 - DNA, 72 bp, Homo sapiens
tggctgacagagcgagactctgtctcaaaaaaaaaaaaaaaaaaaaaagacagagtctcactctgtcactca

SEQ ID NO: 49403 - DNA, 117 bp, Homo sapiens
ataggtactgtgtcttatgtttcatttaagttttaaagtagagagatgtgtgtggacagagagagggatttcctttcctacagatattaatttctagtgaattccattgactcctat

SEQ ID NO: 49404 - DNA, 226 bp, Homo sapiens
atatatatacctacatacatgctatacatatatacatatatatgtgtatatatgtatatatatgtgtgtgtatatatatacctatacatatatgtatatacatatgtgcatatatatatacagggtgtgtgtgtgtgtatatatatatatatacagggtgtgtgtatatatatatatacaggttgtgtgtgtatatatatatataaagggtgtgtgtgtgtgtgta

SEQ ID NO: 49405 - DNA, 63 bp, Homo sapiens
gttcctggtgaaattggagccagcactgataatgtctgtggctccctctgtgtcatcaggagc

SEQ ID NO: 49406 - DNA, 107 bp, Homo sapiens
cgtgtcctttcgggtttgtgtggaggcttcatgacacaggcaggtttgacaaccatgtagaaatgtgcctggacaaaaagcccatgatctaaacccaacagggcctg

SEQ ID NO: 49407 - DNA, 77 bp, Homo sapiens
cagggatcaggtgctgtttgactcacagtgcgttcacccatctcactctgacagctaacggctccacaatgtctctg

SEQ ID NO: 49408 - DNA, 78 bp, Homo sapiens
gtcactctgtcactcaggctggagtagagttgtgcaatcacagctcactgcaacctctaactcctgggttcaagtgat

SEQ ID NO: 49409 - DNA, 127 bp, Homo sapiens
gccctgggccatgagatcctgcaccctgtctgaggctctctgactttgcactgccctgggccatgagatcctgcaccctgtctgaggctctctgactttgcactggcctgggccatgagatcctgca

SEQ ID NO: 49410 - DNA, 118 bp, Homo sapiens
gtggtttctttccttacagttacttctattatgctgtgaatccgccattcttgaggtttttatttatttacctttatctacttttgcagcgtaggaagagtggtttatgagcatctgc

SEQ ID NO: 49411 - DNA, 106 bp, Homo sapiens
tgtacatgtgtgcagctggtgccgtgtgtgtagtgtgtgtgtacagtgtgtgtgcatgtgtgcagttgtgtacagtgtgtatgtgtgtagtgtgtacgtgtgtgca

SEQ ID NO: 49412 - DNA, 77 bp, Homo sapiens
tgtgcaacatgtcacagtgtctgaagctggacagatttgtgtctgtcactgctttcaactgaggctcacttggcaca

SEQ ID NO: 49413 - DNA, 60 bp, Homo sapiens
gtgtgcctgtgtgtgcaagtgcatgtgtgtgcatgtgtgtgagtgcatgcaattgcatgt

SEQ ID NO: 49414 - DNA, 66 bp, Homo sapiens
ggctctggaaatgagaaaacaactgtgtcagctcatgcggctgcaacacttctgattttcaaggct

SEQ ID NO: 49415 - DNA, 114 bp, Homo sapiens
atgattctcctcagctgcaaggatggataagggtgtcgctgatctgaggctggccaggccgtgctgggccgacgtccttgccgactgcttcttgtaccaggctgcgggttttgt

SEQ ID NO: 49416 - DNA, 82 bp, Homo sapiens
ggctccgtggtgcttcctggggtgggttggagctgctggcctctctgtttctaccgtctcaccctctcagagcttccgggct

SEQ ID NO: 49417 - DNA, 84 bp, Homo sapiens
ccctcaccctggctgcctctgaggctcaggaaagttgtggggccgcagtggtgctacctgccaagtggagttagggtgtgaggg

SEQ ID NO: 49418 - DNA, 78 bp, Homo sapiens
ttcatctctttgtgtgtctctgtcagagctcttgggtgaccaggtgcattgtcaatgagcaggaatattttgaaaaga

SEQ ID NO: 49419 - DNA, 113 bp, Homo sapiens
ggattgtcttggctatgtgggctcttttttggttccatatgaaatttaaagtagtttttttctaattctttgaagaaagtcagtggtagcttgatgggcatagcattgaatct

SEQ ID NO: 49420 - DNA, 95 bp, Homo sapiens; identical to SEQ ID NO: 68

SEQ ID NO: 49421 - DNA, 93 bp, Homo sapiens; identical to SEQ ID NO: 69

SEQ ID NO: 49422 - DNA, 71 bp, Homo sapiens
tggagtctatgcactgagctactggctgatatagagtgttgtgtctctgacagtcagacttcatgggtcca

SEQ ID NO: 49423 - DNA, 118 bp, Homo sapiens
ctgcagtcagatgcttgtgtggccttctgagttggaactctacagccaggtatgagagaagagacactggagagactgatgtagggctgtaaagctgatcaggcagggtaacagggca

SEQ ID NO: 49424 - DNA, 119 bp, Homo sapiens
actcagtgggccagccgtgtggtgtctagacctgggtgagggtcttctgtgtctctgtgtctcagccatgtggactctagacctgggtgtgggtcacctgtgtctctgtgtcctggctg

SEQ ID NO: 49425 - DNA, 83 bp, Homo sapiens
aggaaagtctgccagtagggactgtgttatcctggtctacattgtatcttaagcctctgacacagtgtctgaatgattttcct

SEQ ID NO: 49426 - DNA, 59 bp, Homo sapiens
gctctctgggtctctcacttttctcacacatgaagtggggacaaggtgaggatgaaagc

SEQ ID NO: 49427 - DNA, 128 bp, Homo sapiens
tgttttaaaagaaacttaagagcacatgtgaaaaattgtgtacttcaagtttactggttgttttttgtttgttttttgtttttttgagacagtctcgctctgtcacccagattggagtgcagtggctc

SEQ ID NO: 49428 - DNA, 111 bp, Homo sapiens
gaaggggaaatgcatatgtgtgtgtttgggttgtggatactgcattcattactagagattttgtacatatgtaactttaatacaactataaactaaatttcctaaaaagtc

SEQ ID NO: 49429 - DNA, 60 bp, Homo sapiens
gagggcagccaaggggaccgaacgtggctccttcccaatctcactctccctgtctgtccc

SEQ ID NO: 49430 - DNA, 72 bp, Homo sapiens
cagtgtgagcacactgtttacacgctaacaggatgacagcagacattgtgtgaaatcagtgtgagcacactg

SEQ ID NO: 49431 - DNA, 72 bp, Homo sapiens; identical to SEQ ID NO: 49430

SEQ ID NO: 49432 - DNA, 56 bp, Homo sapiens
tgagtcagtctcgctctgtcacccaggctggagtgcagtggcgcgatctcagctca

SEQ ID NO: 49433 - DNA, 68 bp, Homo sapiens
cgtgggtgagcggctcctcctatcccagcgaatgtggcttcagggacagagaccagagagtgcccagg

SEQ ID NO: 49434 - DNA, 115 bp, Homo sapiens
agctcctcacggaaggttagttcggcgcgttacgtcattacgttcagtgaaagaactgagtgagcagctcctcacggaaggttagttcggcgcgttacgtcattacgttcagtga

SEQ ID NO: 49435 - DNA, 70 bp, Homo sapiens
gcatgtgggtgtgtggatgtgtgtaacgtgtctatgatgtgttcatgtgtctgtgtgtatgtctgtgtgt

SEQ ID NO: 49436 - DNA, 56 bp, Homo sapiens
tgagacagtctcgctctgtctcccaggctggagcgcagtggcgtgatcttgtctca

SEQ ID NO: 49437 - DNA, 119 bp, Homo sapiens
ctggctgctgagaggtctgggtgctgagatatctggctgctgagaggtctgtgctgagaggtctgtgtgctgagagtgtgggtgctgaggtctgggtgctgaggtctgtgtgctgagag

SEQ ID NO: 49438 - DNA, 115 bp, Homo sapiens
gtctctcttcttgctgcagtacgaggcgcagttgcgggctggcttagttctcagactctgagtgtgactggcgctcccatccagctctggctctgacagcggcagggcttgaaac

SEQ ID NO: 49439 - DNA, 115 bp, Homo sapiens
ggtggagctaaagagctctggacgcgccttttaaactcttactctgtctctttctaactcctttgtttctgctggactcggggtacccaccgggtagtgtggggctggtttcccc

SEQ ID NO: 49440 - DNA, 69 bp, Homo sapiens
cttgaagacaagcggctctcagagggaggtgaaattgaacctcaaactctgtgagtcagtggtagagag

SEQ ID NO: 49441 - DNA, 82 bp, Homo sapiens
agcagaatctggtgtgatgtgcctcgctgggaggagtgggtcattccctcgagcatacaggtgacacactcacagggtctct

SEQ ID NO: 49442 - DNA, 85 bp, Homo sapiens
tctctgagccttcagtgcaggggcttggactgtcactttcttttttttttgaaacggagtctcactctgtcgaccaggctggaga

SEQ ID NO: 49443 - DNA, 144 bp, Homo sapiens
gcatcaggcaggtgcttctgatcctctccctagagataggctatctaataaagccctctaagcctttatttttattttttattttttgagacggagtctcgctctgcctcccgggctggagtacagtgatgcgatctcggctca

SEQ ID NO: 49444 - DNA, 88 bp, Homo sapiens
ctaaagttgttcatttttatagcgtgtgtgtgtgtgtatgtatatatatatatatatatatatatatataaatttactttaattttag

SEQ ID NO: 49445 - DNA, 75 bp, Homo sapiens
tgcccctcacacattcacacacactcagatgactgcagtgggtgtgtgcctgaatgagaaataagctgtgttgta

SEQ ID NO: 49446 - DNA, 62 bp, Homo sapiens
tcggagcccctcacactgcctgtctgtatgctcccctagagattggagcagtggggcactga

SEQ ID NO: 49447 - DNA, 80 bp, Homo sapiens
ctctctggctttctgtacatatgtttatgtgtgtgtgtgtgtatatatatatgtatatatatatatagagagagagagag

SEQ ID NO: 49448 - DNA, 63 bp, Homo sapiens
ggttgattgacagggtctctctctggctggagtacagtggtgtgatcatagttcagtgcagcc

SEQ ID NO: 49449 - DNA, 61 bp, Homo sapiens
gtttctgagactctctttgcctctagtccacagggatgaaggcagatagttgctgggaaat

SEQ ID NO: 49450 - DNA, 95 bp, Homo sapiens; identical to SEQ ID NO: 68

SEQ ID NO: 49451 - DNA, 93 bp, Homo sapiens; identical to SEQ ID NO: 69

SEQ ID NO: 49452 - DNA, 102 bp, Homo sapiens
gtctatcctatgcttgtcccatcactgtattttagaagcagataactttttttttagtttcacaggtctacagatgaatggagattttgcccacagatggat

SEQ ID NO: 49453 - DNA, 95 bp, Homo sapiens; identical to SEQ ID NO: 68

SEQ ID NO: 49454 - DNA, 93 bp, Homo sapiens; identical to SEQ ID NO: 69

SEQ ID NO: 49455 - DNA, 60 bp, Homo sapiens
ttgagagggactctcgctctgtcacccaggctggagtgcagtggcatgatctcggctcaa

SEQ ID NO: 49456 - DNA, 68 bp, Homo sapiens
gggtatgcatctgtcagtctgtctccctgttggagggagaacagtgctctatgtgcgtttcatagccc

SEQ ID NO: 49457 - DNA, 103 bp, Homo sapiens
ttggcctgtcttcttaaagtactgtgtgttttccaaattgtttcagacacactgggtcttcaatttccagttctcatggatgctgtattaagaaacgcaccag

SEQ ID NO: 49458 - DNA, 223 bp, Homo sapiens
tatatatatatgtgtgtatatatatatgtgtatatatatatgtgtgtatatatatatgtgtatatatatatgtatatatatatatgtgtatatatatgtatatatatatatgtgtatatatatgtatatatatacatacacacacatatatacatatatgtatatatatacatatgtgtgtatatatatgtatatacatatatacgtatatatacatatatat

SEQ ID NO: 49459 - DNA, 74 bp, Homo sapiens
gtatatacatatatatacacacatatgtatatatatacatatatgtatatatgtgtgtgtatgtatatatatac

SEQ ID NO: 49460 - DNA, 76 bp, Homo sapiens
tggtacatgtcagaatggttgggtttactgagttttatactctgatttaatcattatgcattgtatacatgtatca

SEQ ID NO: 49461 - DNA, 58 bp, Homo sapiens; identical to SEQ ID NO: 884

SEQ ID NO: 49462 - DNA, 56 bp, Homo sapiens; identical to SEQ ID NO: 885

SEQ ID NO: 49463 - DNA, 64 bp, Homo sapiens
ttgggagtccctgaccaagggggaagggagattgtccttgtccctcactctgtgggacactcag

SEQ ID NO: 49464 - DNA, 75 bp, Homo sapiens
tttctggagtgatctgactcagtgcttcctctttctagacaacagtttagaaatgctgttcatcccgcccagaga

SEQ ID NO: 49465 - DNA, 98 bp, Homo sapiens
cacagaatagtgtgtgcaatgtgctactatttgtgtgaaaaataaaatgtatttatatttatggacacacacaaatatttgtatttgcagaaaatgtg

SEQ ID NO: 49466 - DNA, 82 bp, Homo sapiens
atgaggtcatcaggagacagggtctaaggttagcccacttcctcataaaggctgggtgactccctggctctctgcgcctcat

SEQ ID NO: 49467 - DNA, 81 bp, Homo sapiens
ggaagctcagagtagagagaggtcagggcccaactgtcagtgtacagtggcccagcctctacctgtacaccgatgacttcc

SEQ ID NO: 49468 - DNA, 95 bp, Homo sapiens; identical to SEQ ID NO: 68

SEQ ID NO: 49469 - DNA, 93 bp, Homo sapiens; identical to SEQ ID NO: 69

SEQ ID NO: 49470 - DNA, 65 bp, Homo sapiens
acatatatatattctgaatatatatattcgtgactccccgaaataaattcagtttatatatatgt

SEQ ID NO: 49471 - DNA, 115 bp, Homo sapiens
actgtcaggcccccaaactacacttaattctgttttacacaaagccagttctttttcctgaagaaatcaccagcttgtcagcgtgagggagaaacaagagggaggagctgtgggt

SEQ ID NO: 49472 - DNA, 114 bp, Homo sapiens
ttgctgtggccaggtggaaatgcaggggaacttgtgggtaccaggagagctggagttttttttttttttttttgacacatcaagtctttttcatcttttatcaagaccatgtga

SEQ ID NO: 49473 - DNA, 74 bp, Homo sapiens
gtctttatcgatatctccccagattaaatggtcctagtttactaatgcccagtctgaagagagtcaggagggac

SEQ ID NO: 49474 - DNA, 58 bp, Homo sapiens
tgagacagagtctcgctctgtcacccaggctggagtgcagtggcgagatctcctctca

SEQ ID NO: 49475 - DNA, 97 bp, Homo sapiens
gctttgcttgagggaaggtccagtgtcactatctgtcacccatgggactttagacaggtaactcatgacttataaagcagggcttgtggtggacaga

SEQ ID NO: 49476 - DNA, 73 bp, Homo sapiens
gggtacagatggacagggcacaggatttttttttttttttttttttttgagacagagtctcgctctgtcaccc

SEQ ID NO: 49477 - DNA, 129 bp, Homo sapiens
gcctgttcttgctgagtgtgctggatttttttttttttttttttttgagacggagtctcactcactctgtcgctcaggctggagtgcagtggcgtgatctcaactcactgcaacctccgttttctgggt

SEQ ID NO: 49478 - DNA, 116 bp, Homo sapiens
agatgactgaatctatgcagtggagtatatatatatgtgtgtgtgtgtatacatataatatgtatatagatttaaatacgtatgtatttatgcgccagcatgggcaacatgtctct

SEQ ID NO: 49479 - DNA, 77 bp, Homo sapiens
gtgtcactctgtcactgaggctagattgcagaggcacaatcacagctcactgcagccgctacctcatgggcccacgc

SEQ ID NO: 49480 - DNA, 58 bp, Homo sapiens; identical to SEQ ID NO: 315

SEQ ID NO: 49481 - DNA, 149 bp, Homo sapiens
gcccaggaatttgagaccagcctgggcaacacagtgggaccccaactctataaaaaaatttttttttttgagacggagtctcacgctctgtcccccaggctggagtacagtggcatgatctcggctcactgcaacctccgcctcctggg

SEQ ID NO: 49482 - DNA, 78 bp, Homo sapiens
aggctgaggtaggaggatctgttgagcctggcaggccaaggctgcagtgagctggattgtaccactgcactcgagcct

SEQ ID NO: 49483 - DNA, 58 bp, Homo sapiens
tgagactgagtctcgctctgtctcccaggttggagtgcagtggtgtgatctcagctca

SEQ ID NO: 49484 - DNA, 84 bp, Homo sapiens
tggaacatttcataagacaaccgtaaaagatgggaaaggggggaaatcccagttttcatggttgtaggatgaaaactagttcca

SEQ ID NO: 49485 - DNA, 84 bp, Homo sapiens
tgagacacagtctcactctgtcacctgggctggagtgcagtggtgcgatctccactcctgggttcaagtgattctcctgcctca

SEQ ID NO: 49486 - DNA, 98 bp, Homo sapiens
taggttgatggtatgatttcatttattttttttaaaccatgtatacacacagatatataatttttaaaaactgtaaatggaatcctgttatttttctg

SEQ ID NO: 49487 - DNA, 64 bp, Homo sapiens
ctatgtcatgagtcagtgtcagaggtgtttgaaccagaacatctctgtcttgaataggggctag

SEQ ID NO: 49488 - DNA, 93 bp, Homo sapiens
tgaagtgtggtctaccagcagctcattagatatgaggagcacattctctttttttacatttataagctgaaatgggacagaaataatccttca

SEQ ID NO: 49489 - DNA, 123 bp, Homo sapiens
gttatatattgctctgtgagaaagttcatcgcactagtaaggtttgggggactgacagtctctgagtggtgagtgaccagatgggtaaagccagtcttagagtggcagcaggttgtttcggaa

SEQ ID NO: 49490 - DNA, 110 bp, Homo sapiens
tgagccgagcatggtggcgcacacctgtagtcccagctactcaggaggctgaggtaggaggatcccttgagcccaggaggtcgaggctacagtgagccattatcgtgcca

SEQ ID NO: 49491 - DNA, 88 bp, Homo sapiens
ttctgctaatgtaggtgggcctcatccaatcagatgaaagtctttttttttttttgacatggagtctcactctgtcacccaggctgga

SEQ ID NO: 49492 - DNA, 87 bp, Homo sapiens
tcagcatttcagttacagaaagctgtgtgtatcctctaatccatcagaaaatgtttgtttttacattctagctttataactgactga

SEQ ID NO: 49493 - DNA, 85 bp, Homo sapiens
cactcctctcttctgtgtctgactcttctcccaacagcggtcctcccaatgtagggtgtagaggcaggagctacgcagagcagtg

SEQ ID NO: 49494 - DNA, 85 bp, Homo sapiens
gatatttgctgtgaagggagtagctattctttgtttttttcaaagaagtttattttcgtttttttccttctcacaggtaaaaatc

SEQ ID NO: 49495 - DNA, 99 bp, Homo sapiens
gtttcccaagaaggagtatgaggttctggtcatttctctgtctgtattaggtgacctcctacatgcccgtgaccattcatgctcaagacttggaggttc

SEQ ID NO: 49496 - DNA, 118 bp, Homo sapiens
ttaaagatgtcttgttacagtactctgcaagctgtttcagaaaatttctcactcatcttctgtgtagggagtgtggtcagtttataagaaattattgtcaattacaaactttagtctt

SEQ ID NO: 49497 - DNA, 71 bp, Homo sapiens
agaccaaaggaaacggagatccgttgaaaggctaaggtttcattggctctgactgggtctctccgtggtct

SEQ ID NO: 49498 - DNA, 114 bp, Homo sapiens
ccattccaaacagatgtttgcaataccagaggaacacgcctgcctgcctgcctgcctgagagcacacgcgttaaagctaaactgagttcaaaagcattcaagttaatgagatgg

SEQ ID NO: 49499 - DNA, 90 bp, Homo sapiens
tgagactgcaggcgtgaaccaccatatctagccaatttttaaattttttgtacagatgggggtctcactatgttgcccaggctgatctca

SEQ ID NO: 49500 - DNA, 113 bp, Homo sapiens
cccctctcaccatctctctctctgtcccacatccctgtctgcctgtgtctctgtccatctctcccacagcctgaagactaagaagtgggtgaatgaggtcaggtgaggagggg

SEQ ID NO: 49501 - DNA, 227 bp, Homo sapiens
tgtaacacaattatgtgtatgtgtgtgtgtgtgtatatatatacatatatatgtgtatatatatacatatatatgtgtatatatatgtgtgtatatatatacatatatatgtgtatatatatgtgtgtatatatatacatatatatgtgtatatatatgtgtgtatatatatacatatatatgtgtatatgtgtatatatacatatgtgtatatatatatacacaca

SEQ ID NO: 49502 - DNA, 66 bp, Homo sapiens
tgtatatgtatgtatgtatatatgtgtgtgtatatatatacacatatatacatacatatatacaca

SEQ ID NO: 49503 - DNA, 58 bp, Homo sapiens
tgagatggagtctcgctctgtcactcaggctggagggcagtggcgcgatctcagctca

SEQ ID NO: 49504 - DNA, 70 bp, Homo sapiens
gtgacccctctgagtctctctctgttcatccctaagatgggtgtgtttatggccgggcacagtggctcac

SEQ ID NO: 49505 - DNA, 81 bp, Homo sapiens
gggtttctagccttgttcttgctttcctgctccatggtctctaacacagacacacacacagggccgcacacagggcaatcc

SEQ ID NO: 49506 - DNA, 70 bp, Homo sapiens
cctgggatgtttgaggctgtagtgagtgagctgtgatcgcaccactgcactccagcctggacgacagagg

SEQ ID NO: 49507 - DNA, 70 bp, Homo sapiens
ttgttttgagatcaagtctcactctgtcacacaggctggagtgcagtagtgcgatcttggctcactgcaa

SEQ ID NO: 49508 - DNA, 98 bp, Homo sapiens
tggcctggagatgaagccttgtgactgtctctgtgtgtggcccagggctgggcgtggatggcgggcagctgggggtgtgtgactctccctgggggtgg

SEQ ID NO: 49509 - DNA, 56 bp, Homo sapiens
ggctgaggtaggaggatcaattgagcccaggaggttggcaccactgcactccagcc

SEQ ID NO: 49510 - DNA, 58 bp, Homo sapiens; identical to SEQ ID NO: 6327

SEQ ID NO: 49511 - DNA, 109 bp, Homo sapiens
gcatgatgctggcgacctgaccaggaagagcaacacatattttattttatttatttatttatttgagatgctgtctcactctttcacccaggccggagtgcagtggtgc

SEQ ID NO: 49512 - DNA, 98 bp, Homo sapiens
actccatctcaaaaaataattatatacatatatattaaaatatatatatacacatacacatatatatgtatgtatgtatgtatgtatgaaaaggtagt

SEQ ID NO: 49513 - DNA, 118 bp, Homo sapiens
gaagctgggtgatggatactgtaattcttttgtgcatgttttaaaaattccataatagattttttgttcttaattatttgtagagatgggttgctgccatgttgcgtgggctggtctc

SEQ ID NO: 49514 - DNA, 86 bp, Homo sapiens
ggatgagggagagatcacagttggagggggtacattttattttattatattattattctttgagacggagtctcactctgtcttcc

SEQ ID NO: 49515 - DNA, 66 bp, Homo sapiens
acaaagtaagaccctgtctctaaaaaaaaaaaaattttttttttttgaggcagagtctcgctctgt

SEQ ID NO: 49516 - DNA, 59 bp, Homo sapiens
tgagatacagtctcgctctgtctgcccaggctggagtgcagtggtgtgatcctggctca

SEQ ID NO: 49517 - DNA, 101 bp, Homo sapiens
gggggcttctcaatgctggtcgctgctgtatatgagcccatctgccggcccttccccgtccgtcactctgtcccagccacgctgccctccatgatgctccc

SEQ ID NO: 49518 - DNA, 68 bp, Homo sapiens
acagagggagaccctgtctgtaaaaacttttttttttttttaatttttgagacagagtctcactctgt

SEQ ID NO: 49519 - DNA, 103 bp, Homo sapiens
tgtgtgtgggtatatatgtgtgtgtatgtatatatatatgtgtgtatatatatacatacacacacacacacatacatatatatatatatatatatatatatat

SEQ ID NO: 49520 - DNA, 102 bp, Homo sapiens
ggcaacaagagcgaaactccatctcagaaaaaaaaaaggaagaacattctttttttttttttttttttttttttttttgagacagtgtctcactctgtcgcc

SEQ ID NO: 49521 - DNA, 167 bp, Homo sapiens
atatatatatatatatatatatgtgtgtgtgtatatgtgtgtgtgtatatgcatgtgtatatatgtgtctatatattcatgtgtatatatgtgtgtgtatatatgtgtgtatatatgtatatacgtatacacatatatacgtatatacatatacatatatatatgta

SEQ ID NO: 49522 - DNA, 74 bp, Homo sapiens
gcgggtgttctgtgcctggtgtcctcattcgaaggagacacagtcccggggaggaggccacgggacacagaagc

SEQ ID NO: 49523 - DNA, 135 bp, Homo sapiens
gtctgtgatggacgcgtggaggggcccactgtgtctgtccatgtgtccgtgatggacctgtggagggccccactgtgtctgtctgtgatggacgcgtggaggacccactgtgtctgtccgtgatggacgcatgga

SEQ ID NO: 49524 - DNA, 102 bp, Homo sapiens
tagctgggaccacaggcacacaccgtctcacttggctattttttttttaattattatttatttatttattgggacggagttttgctcttgttgcccaggctg

SEQ ID NO: 49525 - DNA, 72 bp, Homo sapiens
tcaggaggctgaggttggaggatcacttggcccaggggttcgagacaaaagcctgagaccccatctccatga

SEQ ID NO: 49526 - DNA, 127 bp, Homo sapiens
tctagacagtcaacacagcaatctctgttaacttttttttttttttttgagatggagtctcgctgtgtcactgaggctggagtgcagtggtgcaatctcggctcactgcaacctccatctcctgggt

SEQ ID NO: 49527 - DNA, 58 bp, Homo sapiens; identical to SEQ ID NO: 37427

SEQ ID NO: 49528 - DNA, 87 bp, Homo sapiens
ctcccaacaatgcaggtgccgtggatgggctttttttctttttttttttttttgagacaaagtctcgctctgtcgcccaggctggag

SEQ ID NO: 49529 - DNA, 95 bp, Homo sapiens
tcatccacaaacactgactgaatctctgtgtctttgagcctggccctgaggaacatgctttctggaacagggaagcacacatgtatctgcggtga

SEQ ID NO: 49530 - DNA, 100 bp, Homo sapiens
cctctgtcttttactgtgtgaccttgggcaagttatttttcttttctttttttttttttgagatggagtctcgctctgttgccaggttggagtgcagtgg

SEQ ID NO: 49531 - DNA, 93 bp, Homo sapiens
gcagatagcttgagcccaggagttcaagaccagcatgggcaaacatttttttgtttgaggcggactctcactctgtcgctcaggctggagtgc

SEQ ID NO: 49532 - DNA, 129 bp, Homo sapiens
ttgagagggagtctcactctgttgcccaggctggagtgcaatggcgcgatcttgactcactgcaactccatttcccgggttcaagtgattctcctccctcagcctcccaagtagctgggattacaggtg

SEQ ID NO: 49533 - DNA, 129 bp, Homo sapiens
gggaggaagggagaggaggtgttttatttttttgcttttattttttattttgagacagagtctctctctgtcacccaggttggagtgcagtgctgtgatcttggctcactgcaacttctgcctcctggg

SEQ ID NO: 49534 - DNA, 58 bp, Homo sapiens; identical to SEQ ID NO: 1763

SEQ ID NO: 49535 - DNA, 58 bp, Homo sapiens; identical to SEQ ID NO: 2758

SEQ ID NO: 49536 - DNA, 61 bp, Homo sapiens
ctgggattacaggtgtgagccaccactttttgtttttggagagtctcactctgtctcccag

SEQ ID NO: 49537 - DNA, 58 bp, Homo sapiens; identical to SEQ ID NO: 1265

SEQ ID NO: 49538 - DNA, 86 bp, Homo sapiens
ggaggtcatgggcacagggccagatgggtgggtgtttgggtcttggccctggggaatgcctctgtctctgagactcactttcctct

SEQ ID NO: 49539 - DNA, 58 bp, Homo sapiens; identical to SEQ ID NO: 8973

SEQ ID NO: 49540 - DNA, 72 bp, Homo sapiens
ttgttttttgagacaaggtctcactctgtcacccaggctggcatacagtggtgcaatcttggctcaatgcaa

SEQ ID NO: 49541 - DNA, 89 bp, Homo sapiens
tgggcggggctccgagggtaataggagggaggggcttcagagtatgtccctgggccgcgcctctccctctctgggcctcagtttcccca

SEQ ID NO: 49542 - DNA, 83 bp, Homo sapiens
ccatgtctgggccggaagagacacttatcgtccactattttttttttttttgagatggggtctcactctgtcacccaggctgg

SEQ ID NO: 49543 - DNA, 118 bp, Homo sapiens
gctctgcatgtgtagggggtagtagtatgttttcttgagattttattttattttattatttatttatttatttttgagatggagtcttgctctgtcacgcaggctggagtgcagtagc

SEQ ID NO: 49544 - DNA, 118 bp, Homo sapiens
tctctgaggctcactttcctcatttgtaaaacggagagctctcttaaatttttttttttttttgagacagtcttactctgttgcccaagctggagtacaatggcgcaatctcagctga

SEQ ID NO: 49545 - DNA, 202 bp, Homo sapiens
catatatatatgtatatatgtatatatatgtatatatgtatatatgtgtgtatatacctatgtgtatatatgtatatatgtgtatatatacctatgtgtatatatgtatatatgtgtatatatacctatgtgtatatatgtatatatgtgtatatatacctatgtgtatatatgtatatatgtgtatatatacctatgtgta

SEQ ID NO: 49546 - DNA, 339 bp, Homo sapiens
tatatatgtgtatatatacctatgtgtatatatgtatatatgtgtatatatacctatgtgtatatatgtatatatgtgtatatatacctatgtgtatatatacatatgtgtatatatacctatgtgtatatatacatatgtgtatatatacctatgtgtatatatacatatgtgtatatatacctatgtgtatatatacatatgtgtatatatacctatgtgtatatgtatatatgtgtatatatacctatgcgtatatatgtatatatgtgtatatatacctatgcgtatatatatacatatgcgtatatatacatatgcgtatatatgtacatatgt

SEQ ID NO: 49547 - DNA, 342 bp, Homo sapiens
gtacatgtgtatatatgtatatatgtacacatgtacatatgtgtatatgtgtatatatgtgtgtatgtacatgtgtatatgtgtatatatgtgtatatacacacatgtgtatatgtatatatacatatgtgtgtgtatatatgtatatatgtgtgtatatatgtatatatgtatatatgtgtgtatatatgtatatatgtatatatgtgtgtatatatgtatatatgtatatatgtgtgtatgtatatgtgtatatatgtatgtatatgtgtatatatgtgtgtatatatgcatatatgcatatatgtatatatatgtatatacgtatatatatatatatgc

SEQ ID NO: 49548 - DNA, 84 bp, Homo sapiens
ccagcctgagccacatagcgagaccctgcctctataatttttttttttttttgagacagagtctcgcactgtcgcccagtatgg

SEQ ID NO: 49549 - DNA, 89 bp, Homo sapiens
ccagcctgggcgacatagtgacaccccatctctacaaaaaaaaaattttttttttttgagacagagtctctctctgtcgcccaggctgg

SEQ ID NO: 49550 - DNA, 116 bp, Homo sapiens
agcctcaccatgcatagccactcaatgccctattgtcgccggtatccaggcatctgtcactgtgactggggccaggggccgcagctgggggccgtgggggtcagacacaggaggtt

SEQ ID NO: 49551 - DNA, 112 bp, Homo sapiens
ccggcagccccctcaccactcaccggggccaactgagcctccctcactgagtccctgccccgtgggatgggaaggagagaggcagggaccgcgaaggtggggagggaggagg

SEQ ID NO: 49552 - DNA, 88 bp, Homo sapiens
gcgctaacctggaacagaggtacgtctgactcaagtttcacatctttttttttgagacagagtctcgctctgtcacccaggctggggt

SEQ ID NO: 49553 - DNA, 107 bp, Homo sapiens
cctataaatgtacaaaatgtgggaaagccttcagtcgttccagttacttccgaatccatgaaagaactcacactggagagaaaccctatgaatgtaagcaatgtggg

SEQ ID NO: 49554 - DNA, 84 bp, Homo sapiens
ttgtcttggggtataaaatgagtgtcttggtcatgcattatggctcatgcctgtaatcccagcatttttatttttttaagacgg

SEQ ID NO: 49555 - DNA, 89 bp, Homo sapiens
gagtgagactctgtctcaaaaaaaagaaaagaaaactgccttttatttttaattttttgtatttttatttttgagacagaatctcactc

SEQ ID NO: 49556 - DNA, 81 bp, Homo sapiens
gcccctggtgacaggaggatacgatgtgacacttgagttagacttgtctgtgttctaggtccttactgtctctctctgggc

SEQ ID NO: 49557 - DNA, 58 bp, Homo sapiens; identical to SEQ ID NO: 4572

SEQ ID NO: 49558 - DNA, 99 bp, Homo sapiens
gctgggattacaggtgtgagccaccatacctaactctcaggtttctttctttttattttttttttttgagacaagagtctcacactctgtggcccatgc

SEQ ID NO: 49559 - DNA, 105 bp, Homo sapiens
ccctatgaatgcagaacgtggaaaagccttcagtagttctaagtacttaaaaatacatggaagaactcacactggagagaagtcctatgcagtaaagaatgaggg

SEQ ID NO: 49560 - DNA, 96 bp, Homo sapiens
ctggagaattctgtctgttgcatagtttagaagtttgtggtttaaatctttactttctggaggcttttaaactatgcttctgctattgatctctag

SEQ ID NO: 49561 - DNA, 95 bp, Homo sapiens
gtgggattgctggatcatatagtagctctatttttcattttttgaggaacctcaaaaatgttctccatagtggttgtactaatttacattcccac

SEQ ID NO: 49562 - DNA, 58 bp, Homo sapiens; identical to SEQ ID NO: 3380

SEQ ID NO: 49563 - DNA, 95 bp, Homo sapiens
gggctggggccgcggcacgggcggccgggctggcggggcgagggacactcgtccatccgctcacacactcactcgctcagcacgcgcctgggccc

SEQ ID NO: 49564 - DNA, 83 bp, Homo sapiens
cctcgtcactgtgatgtgtgcctgtagtcccagctactcaggaggctgaggtagaaggatctgttgagcctaagagttcgagg

SEQ ID NO: 49565 - DNA, 80 bp, Homo sapiens
tgagactgagtctggctctgtcacccaggctggagggcagtggcgtgatctcggctcactgcaacctctgtctcctgggt

SEQ ID NO: 49566 - DNA, 117 bp, Homo sapiens
ctggtcatggtgatgtgtacctgtagtcccagctactcaggaggctgaggtagaaggatctgttgagcctaggagtttgaggctgcagtgagctatgattgcaccaccacactccag

SEQ ID NO: 49567 - DNA, 58 bp, Homo sapiens; identical to SEQ ID NO: 454

SEQ ID NO: 49568 - DNA, 62 bp, Homo sapiens
tgtagacagtcttactctgtcacgcaggctggtgtgcagtggcaggatcatggctcactgca

SEQ ID NO: 49569 - DNA, 83 bp, Homo sapiens
gccatgtgttcagcaacccagaagctccctttttttttttttttttttttttttgagacggagtctggctgtgtcgcccaggc

SEQ ID NO: 49570 - DNA, 58 bp, Homo sapiens
tgagccggagtctcgctctgtcacccaggctggagtgcagtagtgcaatctcggctca

SEQ ID NO: 49571 - DNA, 83 bp, Homo sapiens
gcctggggaacatagtgagactccatctcttattttattttattttattttttgagatggagtttcactcttgttgcccaggc

SEQ ID NO: 49572 - DNA, 84 bp, Homo sapiens
acatgaaagaactcacactggagagaaaccctacaaatgtaaacaatgtgggaaagccttcagtgtttccggttcccttcgagt

SEQ ID NO: 49573 - DNA, 75 bp, Homo sapiens
gtactgaaaatctccattctactttctctgtctgtgaatttgactattcatagagagagagatatgtggaagtat

SEQ ID NO: 49574 - DNA, 84 bp, Homo sapiens
tgtgggtgcctgcgtgtctgcgtgtctgcgtgggagaggtggaggaagccactgcccgcccccgcaagctcccaggcacccgca

SEQ ID NO: 49575 - DNA, 85 bp, Homo sapiens
tcttgggtagcagagactgaagaacattcatatatatatgtatatacaaatggacttgtgcagttcaaacctctgtttttcaaga

SEQ ID NO: 49576 - DNA, 92 bp, Homo sapiens
ttgttttttgagacagtgtctcactctgtcgcccaggctggagtacagtggtgtgatattggctcacgcagcctctgtccccctactcaagc

SEQ ID NO: 49577 - DNA, 85 bp, Homo sapiens; identical to SEQ ID NO: 49575

SEQ ID NO: 49578 - DNA, 86 bp, Homo sapiens
ggtaatttataagaaacagtatttaatttttacatttctggaggccgggaagtccagggttaaggctgggaatctgatgagaaacc

SEQ ID NO: 49579 - DNA, 58 bp, Homo sapiens; identical to SEQ ID NO: 315

SEQ ID NO: 49580 - DNA, 60 bp, Homo sapiens
gtgagatgaagtctcactctgtcacccaggctggagtgcagtggcgtgatctcagctcac

SEQ ID NO: 49581 - DNA, 99 bp, Homo sapiens
tatgtaaacatcacacattcatctgttgacacacatttaggttgtttacatatcttggctgttgtgaacaatgatgcaatgaacatgggagtgcacata

SEQ ID NO: 49582 - DNA, 90 bp, Homo sapiens
gacagagagaaagagaggtctctggtgttttttcattattattattatttattagtagtagtattatttgagacagagtctcactctgtc

SEQ ID NO: 49583 - DNA, 73 bp, Homo sapiens
agccactggtaacagtgtgacattagagttttgtttttattttgagacccagtctcgctctgtcacccaggct

SEQ ID NO: 49584 - DNA, 93 bp, Homo sapiens
gcctgggcaacatagcaggaccctgtctctaaaatttaaaaaatttaaatttttttttttttttgaggtggagtctcactctgtcacccaggc

SEQ ID NO: 49585 - DNA, 67 bp, Homo sapiens
gcctcctgtgagtggtcctcccttttttttttttttttgagacggagtctcgctctgtcacccaggc

SEQ ID NO: 49586 - DNA, 102 bp, Homo sapiens
aggcatgtgccactgtgcctggcccaggaactctttttttttttttgagacaaggtcttgctgtgtcatccaggcatgaatgcagtggtgcgatcatggctt

SEQ ID NO: 49587 - DNA, 78 bp, Homo sapiens
gcccggattttggcggactgagaacgcgggccacgtaggccttggcctgcgcgtctgggtctgtctctgactctgggt

SEQ ID NO: 49588 - DNA, 58 bp, Homo sapiens
tgagactgagtttcactctgtcacccaggctggagtgcagtggtgtgatctcagctca

SEQ ID NO: 49589 - DNA, 66 bp, Homo sapiens
ctgccaccctgtgactctgtttctccgtcggcaaaggcggcggtgatggggactctgtggtggcag

SEQ ID NO: 49590 - DNA, 82 bp, Homo sapiens
ccctgtctgtgtgtccctggctggcagtctctctgtggccaaggtgacaggggtttgtgtgtctggactggctctctcgggg

SEQ ID NO: 49591 - DNA, 95 bp, Homo sapiens
tctgggcaacagggcgatcctgtctctaccaaattttttttaattttatttatttatttatttttttgaggctcagtctcgcactgtcactcagg

SEQ ID NO: 49592 - DNA, 90 bp, Homo sapiens
tcctgtcctaattggcgagaagagcaggtacgtctttttttttttttttttttttttgagatggagtctcactctgtcgcccaggctgga

SEQ ID NO: 49593 - DNA, 88 bp, Homo sapiens
ccaacatgttctgacatagaatattgtgtccttatgctctcgtgcacacagacacagtcactgttgcagccaaatccattaatgttgg

SEQ ID NO: 49594 - DNA, 77 bp, Homo sapiens
gaaatggagtctcactcacgctgtcacccaggctagagtgcaatggggtgatctcggattactgcagcctccgtctc

SEQ ID NO: 49595 - DNA, 78 bp, Homo sapiens
ggggcaacggcgtcatcgcaccccagcccgggtagcccatgtgtgtgcctgtctgtgtctgtcgcccacgctggcccc

SEQ ID NO: 49596 - DNA, 61 bp, Homo sapiens
tttgagacagactctcactcggtcgctcaggctggagtgacaggctggagtgtcgctcagg

SEQ ID NO: 49597 - DNA, 58 bp, Homo sapiens
tgagacagagtctcgctctgtcacccaggctggagtgcagtggcgtcatctctgctca

SEQ ID NO: 49598 - DNA, 71 bp, Homo sapiens
gccacaggaggccctggccaggctgtgctgcctaggcaagtgtgagtgtgtgtctgtgtttccctgtgtgt

SEQ ID NO: 49599 - DNA, 89 bp, Homo sapiens
gcatgagattctgggagtccatgtgactgtgcgtctgtgtgtgtctttgcaacgcggtgtattgtctgggtctctatggggatctatgt

SEQ ID NO: 49600 - DNA, 89 bp, Homo sapiens
cacgtgtgtgagtgatgaggctgagcacatgagaacaccgcctaggtggcggtggctgggtgcacaccagctcgcactcaggagatgtg

SEQ ID NO: 49601 - DNA, 137 bp, Homo sapiens
ctgtctaaccctcttttggcctaaggactgctttattttattttttatttttattttttgagatggagtctctctctgtcacccaggctggagtgcagtggtgcgatctcagctcactgcaacctccacctcccggg

SEQ ID NO: 49602 - DNA, 58 bp, Homo sapiens; identical to SEQ ID NO: 6359

SEQ ID NO: 49603 - DNA, 90 bp, Homo sapiens
ctgggattacaggcgtgagcccggcctttcttctttttcttttttcttttgtttgtttttttagagacagggtctcactctgtcacccag

SEQ ID NO: 49604 - DNA, 104 bp, Homo sapiens
ctactgttctacttcctgtctctaagccagtgagctttcctttttttttttgggacacagtctcgctctgtcatccaggctggagtgcagtggtgtgatctcgg

SEQ ID NO: 49605 - DNA, 69 bp, Homo sapiens
tatatatatagcgattatgtgtatatatatatgtatagcgattatatatatatagcgattatatatata

SEQ ID NO: 49606 - DNA, 69 bp, Homo sapiens
tatatatatatgtacacgcacacacacatatgtattatatgtgtgtgtgtatatatatgtatgtgtata

SEQ ID NO: 49607 - DNA, 67 bp, Homo sapiens
ctctgaaatgtgtatatatatgtgtatgtatatatatacacatatatacacatatacatacacaggg

SEQ ID NO: 49608 - DNA, 58 bp, Homo sapiens
tgagacagagtcacgctctgtcacccaggctggagtgcagtggtgtgatcttggctca

SEQ ID NO: 49609 - DNA, 86 bp, Homo sapiens
catcatgtatactatgctatacagtacactgcatataccatgttatacagtacatcatatatgctatgttatgtagtaagatggtg

SEQ ID NO: 49610 - DNA, 60 bp, Homo sapiens
gtgagccgagatcaccccactgcgccccagcctgggcgacagactgagactctgtctcac

SEQ ID NO: 49611 - DNA, 87 bp, Homo sapiens
agtgaaactaggttctcaggtggaaaaaagaaaaagaaggtttgccttgctgctattctttttttttttttgagacggagtctcact

SEQ ID NO: 49612 - DNA, 71 bp, Homo sapiens
ggccgagggtgttggcacatgcctgtagtcccagctacttgggaggctgaggtaggaggatctcttgagcc

SEQ ID NO: 49613 - DNA, 103 bp, Homo sapiens
ctgggaatcaggatacctgggactacaggtgtgcaccatttttttttaaactttatataacaggaattatacaccatgttctgttctgtgtctgtcttcttgg

SEQ ID NO: 49614 - DNA, 75 bp, Homo sapiens
cctaggcacggtttggggcatcctggaggactgttctttgtcctccagtaaagatgtctgattttgttgtatagg

SEQ ID NO: 49615 - DNA, 84 bp, Homo sapiens
tgccttggcctctcagatctctgagtttacagatgagagccaccacactggccacaattgttacattcagtgggagctaatgca

SEQ ID NO: 49616 - DNA, 71 bp, Homo sapiens
ctctgtcacccactctgtgtcctgcaagagctggcttcaccttgagcatgtcacaggaactggggacagag

SEQ ID NO: 49617 - DNA, 63 bp, Homo sapiens
gggagatgtgcggggctctttttttttttttttttcctgagacagagtctcgttctgtctccc

SEQ ID NO: 49618 - DNA, 86 bp, Homo sapiens
cagcctgggcgacagagcaagactctgtctcaaaaaaaaaaattttttttttgtagagacggagtctctctgtgtcgcccaggctg

SEQ ID NO: 49619 - DNA, 92 bp, Homo sapiens
gcagggattacatgagccactgcacccagccattctctctctgtatctctccatatggctttgggtctctctgtctttgtgtctctctctgt

SEQ ID NO: 49620 - DNA, 97 bp, Homo sapiens
tccagcaaaagcaaatgtgctgattgacattttttatttttattttttattattattattttttgagatggagtctcactctgttgctcaggctgga

SEQ ID NO: 49621 - DNA, 58 bp, Homo sapiens; identical to SEQ ID NO: 17852

SEQ ID NO: 49622 - DNA, 70 bp, Homo sapiens
ttgttttgagtgagagtctcgctctgtcacccaggctggagtgcagtggcgtgaccttggctcactacaa

SEQ ID NO: 49623 - DNA, 78 bp, Homo sapiens
gtctctctctgtctcccaggctggagtgcagtggcacaatctcaattcttctgcctcagcctctggagtagctgagac

SEQ ID NO: 49624 - DNA, 67 bp, Homo sapiens
gttttggtcgttcttgtagtctcagggctgagaacagagcctgacactgactgactgactgactgac

SEQ ID NO: 49625 - DNA, 78 bp, Homo sapiens
ggcgtgagccactgtgcctggctctttttttttttttttttttttttaaagagagggtctcactctgttgcccatgct

SEQ ID NO: 49626 - DNA, 139 bp, Homo sapiens
ctggccctgccttctgcacaggtgaatggcttttgaatttacttttttttttttgagtcggagtctcactgtcactcaggctggagtgcagtggtgtggtctcagctcactacaccctctgcctcccaggttcaagtga

SEQ ID NO: 49627 - DNA, 63 bp, Homo sapiens
tgagacagagtctcactcagtcgcccaggctggggtggggtgcagtgacgtgatctcggctca

SEQ ID NO: 49628 - DNA, 63 bp, Homo sapiens; identical to SEQ ID NO: 49627

SEQ ID NO: 49629 - DNA, 83 bp, Homo sapiens
cctttctgagcctcagtttctctgtctgttacattgggatccccactccctctcagtgtgaattcaggagcctaaggataagg

SEQ ID NO: 49630 - DNA, 83 bp, Homo sapiens
gcttctgcttcccaaagtgtgaggattacaggtgtgagccagcatgcctggccaatttttttgaattttgatagagaggaagt

SEQ ID NO: 49631 - DNA, 106 bp, Homo sapiens
aggggcacatgtgtgagtgtggagggatgtgtactgggccatggttctgtgaagattcagacctcagtgcccctagcccttgccaattatctcctctctggccctt

SEQ ID NO: 49632 - DNA, 117 bp, Homo sapiens
gctgcctggcctccctgggctctgcctcccgtgcctactgagctgaaacacagttggtttgtgtacactggctcagttcagcaggaacaggggtcaagcccccttggagcctgcagc

SEQ ID NO: 49633 - DNA, 95 bp, Homo sapiens
gtgcctggcctgaggagcagggcttagctgcttgtgagcagggtccacaccaagtcgtgttcacagtggctaagttccgccccccaggccctcac

SEQ ID NO: 49634 - DNA, 109 bp, Homo sapiens
cctcacccctgtgccacggccggctggggttcctggggatgggatttgcttcctgtcacaaatcacattgccagggatttccaaccgaccctgagctctgccaccgagg

SEQ ID NO: 49635 - DNA, 87 bp, Homo sapiens
ggtgctcacctgtagttccagctactctggaggttgaggtagaaggatcctttgagccccggagcttgagatggcagtggtgagacc

SEQ ID NO: 49636 - DNA, 58 bp, Homo sapiens; identical to SEQ ID NO: 25382

SEQ ID NO: 49637 - DNA, 90 bp, Homo sapiens
gggtttgggggaacattcaacctgtcggtgagtttgggcagctcaggcaaaccatcgaccgttgagtggaccctgaggcctggaattgcc

SEQ ID NO: 49638 - DNA, 98 bp, Homo sapiens
ggccacagccgaggtcacaatcaacattcattgttgtcggtgggttgtgaggactgaggccagacccaccgggggatgaatgtcactgtggctgggcc

SEQ ID NO: 49639 - DNA, 118 bp, Homo sapiens
atatataatttaaataatatattttataattataaatatgcaatatgtaaatacattataattatatattttatatgtatgtatatattaaatatgaatatgtatgtattttatatat

SEQ ID NO: 49640 - DNA, 105 bp, Homo sapiens
ccagcctgggcaatacagtgagacccccaactctacaaaaaaaaaaaaagttttttgttttttgtttttttttgacacagagtctcgctctgtcacccaggctgg

SEQ ID NO: 49641 - DNA, 89 bp, Homo sapiens
atatatatatatatatatatatatatacacgtatatatatgtgtatatatatatacatatatgtgtgtatatatatatatacgtatata

SEQ ID NO: 49642 - DNA, 113 bp, Homo sapiens
ggccggcgtggtctgtgagcctggagtatgccagctgtgtgcctctgtgtctcggccagtggcaggcagagcaggcccagccctggaggcccaggagagccagaccaagggcc

SEQ ID NO: 49643 - DNA, 77 bp, Homo sapiens
gcattcagcacgctcacacgtgacttttttttttttttggagacaagagtctcactctgtggcccaggctggagtgc

SEQ ID NO: 49644 - DNA, 83 bp, Homo sapiens
gcaagctcagggtcagatcttgtgtttaaaataaatttattattattattttttgagacggagtctcactctgtcgctgaggc

SEQ ID NO: 49645 - DNA, 84 bp, Homo sapiens
ccagctacttgggaggctgaggcatgagaattccttttttttttttttttttgagacggagtctcactctgtcacccaggctgg

SEQ ID NO: 49646 - DNA, 116 bp, Homo sapiens
agaattgaaggagtggaggagtattgggggaggggggcagactcctgggactttcttttcttttcttttctttttttttttttttttttttgagacagagtctccctctgtccccc

SEQ ID NO: 49647 - DNA, 58 bp, Homo sapiens
ttgagacagtctcactgtgtcacccaggctggactggagtgcagtggtgcgatcttgg

SEQ ID NO: 49648 - DNA, 77 bp, Homo sapiens
gtgtcacttggcatgggggacaggatctttctgggtccctctgcctctctcatcctgtcactctgtcattctgctgc

SEQ ID NO: 49649 - DNA, 71 bp, Homo sapiens
gcctctgttgtctttgaagagggagaaaagtgttttggtgacaagtcctcctctccctctgactcacaggc

SEQ ID NO: 49650 - DNA, 58 bp, Homo sapiens
gggcctgtgccgatttgttttatttatttatttttgagacagtctggctctgttgccc

SEQ ID NO: 49651 - DNA, 78 bp, Homo sapiens
aggtgggaggccaagtagaaacatggagggggtcccggtgtccccagaatccagatgtctgtctgtctgtctgcacct

SEQ ID NO: 49652 - DNA, 58 bp, Homo sapiens; identical to SEQ ID NO: 2263

SEQ ID NO: 49653 - DNA, 105 bp, Homo sapiens
ggcaggtatggtggcacacccctagtcccagctactcggggagctgaggtagtaggatcacttgagcccaggagttttgagtctgcagtgagctatgatcgtgcc

SEQ ID NO: 49654 - DNA, 83 bp, Homo sapiens
gcctgtaatcccagtgagaggtgacagtgtgctggcagccctcgcagccctcgctcgctctcggcgcctcctgggcctcaggc

SEQ ID NO: 49655 - DNA, 74 bp, Homo sapiens
ttgtttgttttctgagagaatctcactctgtcacccaggctggagtgcagaggtgcgatcttggctcactacaa

SEQ ID NO: 49656 - DNA, 108 bp, Homo sapiens
gcaatggaattgctgggatgaatggtaagtctaactttattttttaaaattaattattttatatattttttgagatggagtctcactctgtcacccaggctggcctgc

SEQ ID NO: 49657 - DNA, 82 bp, Homo sapiens
ctggggagggggtacattctggctatgaggtttttttttccttttttttttttttgagacagagtctcactctgtcacccag

SEQ ID NO: 49658 - DNA, 73 bp, Homo sapiens
tctgtggcccaactccaggctctttttttttttttttttttttttgagacagagtctggctctgtcgcccagg

SEQ ID NO: 49659 - DNA, 58 bp, Homo sapiens
ggtggctctctctgcctgtgatcctagcactttaggaggccaaggccggaggactgct

SEQ ID NO: 49660 - DNA, 67 bp, Homo sapiens
tgactgcctgactattctgaataatgaccctggcacttggtcacagagagtcagacactcacagtca

SEQ ID NO: 49661 - DNA, 58 bp, Homo sapiens
tgagactgagtctcactctgtcgcccaggctggggtacagtggtgtgatctcagctca

SEQ ID NO: 49662 - DNA, 66 bp, Homo sapiens; identical to SEQ ID NO: 474

SEQ ID NO: 49663 - DNA, 58 bp, Homo sapiens; identical to SEQ ID NO: 1215

SEQ ID NO: 49664 - DNA, 114 bp, Homo sapiens
gtgtcagacactgcacctggctgccactctttccttcttttatttatttttatttttatttattgtttgagatggagttttgctcttgtcacccaggctgcagtgcaatggcgc

SEQ ID NO: 49665 - DNA, 136 bp, Homo sapiens
gcatgcctgtttgtgacagtgtctctgcccttcacacatgagggtgtgtgtgagtagcagagagcagagacagcacagtgtctgggaagtaaacagatgatcttctgggtacccagggcagcagggtgtcatgctc

SEQ ID NO: 49666 - DNA, 85 bp, Homo sapiens
ctccttctgtgtgtctgggtcctaatctcctcctcctcttcttttgtttttgagacagggtctcgctctgtcactcaggctggag

SEQ ID NO: 49667 - DNA, 58 bp, Homo sapiens
tgagactgagtctcactctgtcacccaggctggagtgcagtggtgagatctaggctca

SEQ ID NO: 49668 - DNA, 79 bp, Homo sapiens
gcctgggccagatgctcagatcttctttttttttttttttttttttttttgagatggagtctcgctctgtcacccaggc

SEQ ID NO: 49669 - DNA, 59 bp, Homo sapiens
tgagacggagtctcactctgtcaccctggctggagtgcagtggtgcgattctcagctca

SEQ ID NO: 49670 - DNA, 64 bp, Homo sapiens
ccagactgttgctcaagactttttttttttttgagacagagtcttgttctgtcacccaggctgg

SEQ ID NO: 49671 - DNA, 119 bp, Homo sapiens
gctgggcatggtgactcaggcctgtggtcccaggtactcgggaggctgaggtagaaggatcgcttgagcccaggagtttgaggctgcagtgagccatgaacatgccactgcattccagc

SEQ ID NO: 49672 - DNA, 122 bp, Homo sapiens
gaagacagaaacctcgctgcttagtgtctcttcttatgctagggtgtgatgacagtctgtttctctgaggtctggctgaagttgtgggggtggtcttctcctctcatccctgaggtctcttc

SEQ ID NO: 49673 - DNA, 95 bp, Homo sapiens
caaggaagcatgctcagtgctcatcagtaaatgcctggagtgttgggtgcattcttgtgtctcacaatttagaagcagcagtgatagaactgagt

SEQ ID NO: 49674 - DNA, 101 bp, Homo sapiens
tcttttgattgcattcattcaaatgaagaattagagatttttcaccaagtttgctgaataatagttaattttttatgtatgtatagatgtacatcaaggga

SEQ ID NO: 49675 - DNA, 70 bp, Homo sapiens
ttgttttgagaccaagtctcgctctgtcacccaggctggagtgcagtggtgtgatcttggctcactgcaa

SEQ ID NO: 49676 - DNA, 112 bp, Homo sapiens
atatctatgtgatatatatgttatctagagagcatatatatgatatttatagatatatagatatctatgtgatatatatgctatttagatagcatatctatgtgatagatat

SEQ ID NO: 49677 - DNA, 81 bp, Homo sapiens
cctatgtgaagaaaagtgcgcgactctttttttttctttctttttttttttttgagacggagtctcgctctgtcacccagg

SEQ ID NO: 49678 - DNA, 114 bp, Homo sapiens
taacagatggtactttatttttttaaattgccaaataatattatattctatggataactgtacatttatttatttgtttatttatttattttgagatggagtctcgctctgttg

SEQ ID NO: 49679 - DNA, 58 bp, Homo sapiens; identical to SEQ ID NO: 13889

SEQ ID NO: 49680 - DNA, 66 bp, Homo sapiens
agagacatcactgcagtctctgtctgtgtctccacaaggccagcttctctgtgtgtgtgtgtcttt

SEQ ID NO: 49681 - DNA, 72 bp, Homo sapiens
cacgcatgtgccctagagtctcatgagtgcgcgcgcacacacacacacacagagtcatttagggtggggctg

SEQ ID NO: 49682 - DNA, 114 bp, Homo sapiens
ggtgtatctgtgggtgtcactctgggtagatctggggtgtttttttatttgtttgtttttttgagacaggttctcactctgtcacccagacgagtgcagtggcgcgatctcagc

SEQ ID NO: 49683 - DNA, 58 bp, Homo sapiens; identical to SEQ ID NO: 9124

SEQ ID NO: 49684 - DNA, 97 bp, Homo sapiens
gttgccaagcataagctcaggagatttgcaggggcaggggggtgggaggcaaccatccttctgcctgtctgtctgcctgtctgtctgtcctggccac

SEQ ID NO: 49685 - DNA, 106 bp, Homo sapiens
ggtcatttgtacgaggacgtgtgtctgtagctgctgaggtctgtgtctgtgtcttgtctggcgtggagtggtgagctcttacagggcacaaggtccttccccatcc

SEQ ID NO: 49686 - DNA, 85 bp, Homo sapiens
ccaggatgctagagcccagagacggcactcccagaacttgctgggttcctctgtctgtctgtctctttgttaactgtctccctgg

SEQ ID NO: 49687 - DNA, 77 bp, Homo sapiens
cctggacattcacacaaatgggattgcacgccgtgtcggtgtctgtgtgtctcttgctgagggtggactcctccagg

SEQ ID NO: 49688 - DNA, 113 bp, Homo sapiens
agattgagaaatcggatggttgctgtgtctgtgtagaaagaggtagacgtgggagacttttcattttgttctatactaagaaaaattcttctgccttgggatcctgttgatct

SEQ ID NO: 49689 - DNA, 74 bp, Homo sapiens
tcttctgcccctgccccagacgtcctggcccatggcagatgccagatgtcagacaactgagacagctcagaaga

SEQ ID NO: 49690 - DNA, 67 bp, Homo sapiens
agattctgcctctctctgagcctcagttattaactcagttattaatggcttagaggaggggattgct

SEQ ID NO: 49691 - DNA, 79 bp, Homo sapiens
caggaggctagcctgggttcactaccaccatggagcctgagtttcaagagagtgagcagaaacattttagtacctcctg

SEQ ID NO: 49692 - DNA, 75 bp, Homo sapiens
tctatctatcagtccgtctgtctgtctatgatctatctaatctatggagagacagaagagggcatttattatagg

SEQ ID NO: 49693 - DNA, 111 bp, Homo sapiens
cctgtggacacaccgatcaatcctgccttttgtaagtgagcagacagaggccacatcccccaaaggggagggccggtcccagtcggagggaaaggtttgggagtaccaagg

SEQ ID NO: 49694 - DNA, 111 bp, Homo sapiens
ctaatgtaaatggcattggtttctttctttttctgctagctcatcatttgtgtatggaaacactagtgattttgtaggttgatttggaatcctgctgctttcctgaattgg

SEQ ID NO: 49695 - DNA, 117 bp, Homo sapiens
gccaggaagtggatgagccaggatttgaaccttagtctgtctgagatgagtcagtgctgtgaagcaaggagctatccaggctatgctacaagtctccccttaatcattaatctgtgt

SEQ ID NO: 49696 - DNA, 140 bp, Homo sapiens
ggtgagtccccttctgggcctgggtgggtgagtccccctctgggcctggatgggtgagtccctctctgggcctgggtaactgagtccctctctgggcctgggtgggtgagtccctctctgggcctgggtgggtgagtccc

SEQ ID NO: 49697 - DNA, 184 bp, Homo sapiens
acgtgtatatatgtgtatatatatacacacatattatatatgtatatatgtatatatacacacatgtatatatgtacacatacacacatatgtgtatgtgtatatatatctcacagtatacatatgtgtatatattatatatgtgtgtatatatgtgtatatatatatctcacagtatatatat

SEQ ID NO: 49698 - DNA, 83 bp, Homo sapiens
gatccagggtgtgtgtgggtggaagtggggcagggtctctgaagccaagaccctgactgcctctctggctgaccacatggatc

SEQ ID NO: 49699 - DNA, 92 bp, Homo sapiens
atatatactatatatattcctaattattaaattataatgttattaatatgtttatttaatttaataattaggagtcaatgaaatgtgtatat

SEQ ID NO: 49700 - DNA, 108 bp, Homo sapiens
gtcaatgaaatatatacatatttatatattttaatatatattaaatttattaacatatttatttaatttaataattaggagtcaatgaaatgtatatatttcatatac

SEQ ID NO: 49701 - DNA, 110 bp, Homo sapiens
gcatggaggcagctctcagagatggaatgcctcagagaagagagtttggagagtcaagtctcctggctgtttctggatactcaatttcctgatgggcagtagcttctagc

SEQ ID NO: 49702 - DNA, 82 bp, Homo sapiens
agtatctctagtgcagtgatgaatatgagcaaaacattgaaagtatattttgtttcttattcatttggattatgagtttgct

SEQ ID NO: 49703 - DNA, 161 bp, Homo sapiens
atatatatatatatacacacacatatatatatgtatatatatgtgtgtatatatatgtatatatacatatatatgtgtatatatatacatgtatatacatatatacatatatacacgtacatgtatatatgtgtatatacatatatatgtatatatatgtg

SEQ ID NO: 49704 - DNA, 58 bp, Homo sapiens; identical to SEQ ID NO: 1265

SEQ ID NO: 49705 - DNA, 64 bp, Homo sapiens
cacacacacacactcaatgtggctcccaccatcaaggaactactaggagagggctgtgtgggtg

SEQ ID NO: 49706 - DNA, 58 bp, Homo sapiens; identical to SEQ ID NO: 7309

SEQ ID NO: 49707 - DNA, 82 bp, Homo sapiens
aataaaataagaataaaccaagtagctgggactacaggtacgtgccactgtgcctggctaattttgtttgttttattttatt

SEQ ID NO: 49708 - DNA, 70 bp, Homo sapiens
gagttagaggctgcagtgagccgattgcaccatgcactgcagtctgggtcactgagtgagaccctgtctc

SEQ ID NO: 49709 - DNA, 67 bp, Homo sapiens
tgtctgcagagtggcaggagagtctgtgcagtcttatgcatgatgtccaaaaagcactgggtagaca

SEQ ID NO: 49710 - DNA, 90 bp, Homo sapiens
caacagtattatgtctaggagaatgtacataccttagttaaaacatactttattgctaaaaagtgacaacacagagaccacatgctgttg

SEQ ID NO: 49711 - DNA, 58 bp, Homo sapiens
tgagtcagagtctcactctgtcgcccaggctggagtgcaatggagtgatctcggctca

SEQ ID NO: 49712 - DNA, 88 bp, Homo sapiens
agacctgagccattgtgcttggcccgtttttttttttttttttttttttttttttttttagacaggctctcactctgttgctcaggct

SEQ ID NO: 49713 - DNA, 86 bp, Homo sapiens
gaggtcaggagttttagaccgagtctccctctgtcacccaggctggagtgcagtggcatgatcttggctccctgcaaccctgcctc

SEQ ID NO: 49714 - DNA, 111 bp, Homo sapiens
tgtaaggtctgaatgtcatgggggatcctgggacagaaaaaggacattagggggaaaaacgaattttttttttttgacagggtcttactctgtggcccagactggagtgca

SEQ ID NO: 49715 - DNA, 98 bp, Homo sapiens; identical to SEQ ID NO: 46231

SEQ ID NO: 49716 - DNA, 72 bp, Homo sapiens
cctggagctgtccatcactaactgaaggcagtgaccacaccggccagctcagtggggaggcggcacaccagg

SEQ ID NO: 49717 - DNA, 73 bp, Homo sapiens
gttgttttgagatgggagtctcactctgtcacccaggctggagcgcagtggtgcaatctcagctcactgcaac

SEQ ID NO: 49718 - DNA, 104 bp, Homo sapiens
gctcttgggggctgcagaatgaagtttttgtttttttttttttcaggctgaattcactttatttttcttgtataaaaaccctatgttgtagccacagctggagc

SEQ ID NO: 49719 - DNA, 116 bp, Homo sapiens
cctgtctcagagtgtactgaggtgacgatggtgatggcgtggtctgttctctgcctgacagtacattaggtgccacagacctgccccactgaccatggaggatgccctggaggagg

SEQ ID NO: 49720 - DNA, 85 bp, Homo sapiens
gttccgtggtgggggcaggtggtactggggtgatggacacacacacacacagtcagcatccaggtgtgacattccatggtggggc

SEQ ID NO: 49721 - DNA, 86 bp, Homo sapiens
ccaacagggagggcttgccttcttttccttttcttttttttttttttttttttcgagatggagtctggctctgtcacccaggctgg

SEQ ID NO: 49722 - DNA, 91 bp, Homo sapiens
cccctcagccacatacgagtcctggtgtctctgtcactcacagagggccacctccatgagagtgggagacctgccactcctgggtgggggg

SEQ ID NO: 49723 - DNA, 57 bp, Homo sapiens
tcctggtgatagcacgctgggtgggggcttctccctctcagcctctctcttctagga

SEQ ID NO: 49724 - DNA, 99 bp, Homo sapiens
gtggtagcgtgtgtctgtagtcttagctactcagaaggctgaggtaggaggatcacttgagccggggacgtagaggttgcagtgagccgattgtgccac

SEQ ID NO: 49725 - DNA, 84 bp, Homo sapiens
gagggggcacgttaggtgttctggtgtagttggcaggtggtatttgtgctggatggtatgtggaagacttgtgcattgcctctc

SEQ ID NO: 49726 - DNA, 112 bp, Homo sapiens
atcacgccaccacactccagccttggcaacagagtgagaccttatcttttttttttttttttttgagacagagtctcactctgtcacccaggctgcagtgcagcggcgcgat

SEQ ID NO: 49727 - DNA, 83 bp, Homo sapiens
aggggtctcactgtgtcactcaggctgaagtgcaccactcggctcactgtaacctccgcctcccgagttcaagtgattcctct

SEQ ID NO: 49728 - DNA, 114 bp, Homo sapiens
cacttcagaggacagttctgtttcgccaagccctaccttcgttttctttctttctcttttttttttttttttttttttgacacaaggtcttgctctgttgtccaggttggagtg

SEQ ID NO: 49729 - DNA, 93 bp, Homo sapiens
cagaggaagagtctgtctcttaagaaaaaaagaagaaaaaagaatagaaaagaaattattattattattattttgagatggagtctcactctg

SEQ ID NO: 49730 - DNA, 82 bp, Homo sapiens
tggcagcgccaagatttcaatggacacggtggggctcaaaatttgtggtctctgtgtgtatttgtctgttctcatgctgcta

SEQ ID NO: 49731 - DNA, 58 bp, Homo sapiens; identical to SEQ ID NO: 16930

SEQ ID NO: 49732 - DNA, 114 bp, Homo sapiens
cactgccctccagcctgggcgactgagtgagacttggtctcaaaaaataaagaaaattattcttatttttttggagacaggttcttgttttgtcacccaggctgaagtgcagtg

SEQ ID NO: 49733 - DNA, 72 bp, Homo sapiens
agtctgccagcctctcagagcctcagtttttgctctgtaaatgggagtgagtgttgagagagttaaatgact

SEQ ID NO: 49734 - DNA, 214 bp, Homo sapiens
cacatatgtatatacatatgtgtgtgtatatatacatatatacatatgtatgtgtatatatacatatatacatatgtatgtgtgtatatacacacatatatacgtatatatgtatatgtgtatatatatgtgtatatatgtgtgtgtatatatgtgtatatatgtgcatgtatatatatagacacgtatatatttggtaaatatatatatatat

SEQ ID NO: 49735 - DNA, 82 bp, Homo sapiens
agcctgggcaacacagcaagacctcatctctaaaaaaattttttttgttttttgagacagagtctcactctgtcaccaggct

SEQ ID NO: 49736 - DNA, 86 bp, Homo sapiens
aggctgatggcagagagggtcttgcacagagaagcagcagaattttttttttttttgagacggagtcttgctctgtcacccaggct

SEQ ID NO: 49737 - DNA, 58 bp, Homo sapiens; identical to SEQ ID NO: 315

SEQ ID NO: 49738 - DNA, 109 bp, Homo sapiens
gtccctggaagctcctggatgtggcctccactctctcctgccttcactgcctccagcaaaaggtcagggtcagggaacaagttagaagccacatgggcaggctgggtgc

SEQ ID NO: 49739 - DNA, 104 bp, Homo sapiens
ctttgtccccaggaactctgagcctctgaccctgagtcactcccactgccagtggggggtcggggcggggcggaggagtcggggcaggtcgtcgggggaggttg

SEQ ID NO: 49740 - DNA, 125 bp, Homo sapiens
aatctgttggtgtgtcggagcctcgctgggcgttaaagggttaaatgagttagtctcagtagacactgagaacattaagcagggctgtttttcgatgatattattggggttccagtgtctgccag

SEQ ID NO: 49741 - DNA, 91 bp, Homo sapiens
tatgtgcatatatatggatatgctgtgtacatgtgtgttcatagacatctagatacccacatatacatatatatatatatatatatatata

SEQ ID NO: 49742 - DNA, 92 bp, Homo sapiens
agccagggaagagaatggatttgatctttttttaaaaagttttttttttttttctcaagaggcaggttctctctcattctgtcacctaggct

SEQ ID NO: 49743 - DNA, 98 bp, Homo sapiens
gcatggtggttcacgcctgttctcacaaccacttgggaggctgaggtaggaggatcgcttgagactgggaggttgaggctgcagtgaactatgatcgc

SEQ ID NO: 49744 - DNA, 161 bp, Homo sapiens
ccatgcctggccccaagaatcttttttttaattttatttatttatttatttatttatttatttatttatttatttatttattttgaaacagagtttctctctgtctccgggctggagtgcagtggcgcgatctcggctcactgcaagttctgcctcccggg

SEQ ID NO: 49745 - DNA, 79 bp, Homo sapiens
ggggtgggggggacagtcctgttggtggccctggggtgtctgcagcaggaaacgggtctctctctgagtcagggtcccc

SEQ ID NO: 49746 - DNA, 70 bp, Homo sapiens
aaacaaggattagacaggaggaaggacttccagtggatctctagtttttgtttttgtttttttgttgttt

SEQ ID NO: 49747 - DNA, 130 bp, Homo sapiens
cctgggcgacaaaagtgaaactctgtctcaaaaaaaaaaaaaaaaaaaaaaaagacagggtctcactctgtcacccaggctggagtgcagtggtgcaatctcagctcactgcagcctccacctcccagac

SEQ ID NO: 49748 - DNA, 82 bp, Homo sapiens
cttctgtattgttacagcatctccatggggtaggcaactttgtgccttccacagtacagatggggaaactgaggctcagagg

SEQ ID NO: 49749 - DNA, 111 bp, Homo sapiens
gcctcccaaagtgctaggactacaggtgtgagtcattgtgctcagccttaatttttttttttttttttttttttgagatggagtctcactctgtcccccaggctggagtgc

SEQ ID NO: 49750 - DNA, 110 bp, Homo sapiens
gtgtatacacgtgtgtgtatatacacgtgtgtatatatacgtgtgtgtatatatatgtgtgtatatatacgtgtgtgtatatatatgtgtgtatatatacgtatatatat

SEQ ID NO: 49751 - DNA, 104 bp, Homo sapiens
gcaggggcaggcggggagaatgtaaaggaactgggagagtggggttctggtgaggaaccatgtttttttttttttttgagacagtctcactctgtcgcccaggc

SEQ ID NO: 49752 - DNA, 97 bp, Homo sapiens
acatcagctgggcttcggcgtgaggtcttgctcttatggaaaaaaaatctttctttttctttttagatggagtctcactctgtcgctgggctggagt

SEQ ID NO: 49753 - DNA, 110 bp, Homo sapiens
cgacagagcgagactccgtctcaaaaaataaataaataaataaataaaaacattatttaattattttattattattattactatttttgacacagagtttcactctgtcg

SEQ ID NO: 49754 - DNA, 77 bp, Homo sapiens
gtttgtttttttgagatggagtctcactctgtctcccaggctggagtgcagtggtgcgatttcagctcactgcaaac

SEQ ID NO: 49755 - DNA, 101 bp, Homo sapiens
gacagagtgagactctgtctcaaaaaaaaaaaaaaagaaaagaaacattttattttattttattttatttatttatttttgagacagagtctcactctgtc

SEQ ID NO: 49756 - DNA, 65 bp, Homo sapiens
acaggcgtgagacaccgtgccctgccttacttatttatttatttagagacagggtctcactctgt

SEQ ID NO: 49757 - DNA, 87 bp, Homo sapiens
ccagcctgggcaacatagggagaccccagtctctatagtatttttttttttttccaagacagagtctccctctgtcacccagtctgg

SEQ ID NO: 49758 - DNA, 86 bp, Homo sapiens
tgacagagtccctgggttgagatcaaatgaaaagtgaatttttaaattttgttatttcttttttgagacacagcctcgctctgtca

SEQ ID NO: 49759 - DNA, 75 bp, Homo sapiens
catagtgagactctgtctctgcaaaaacccttttttttttttttttttttttttttgagacatagtcttgctttg

SEQ ID NO: 49760 - DNA, 84 bp, Homo sapiens
ccagcctgggcaacagagcaagaccttatatctacaaacaacttttttttttttttaagacagagtctcactctcccaggctgg

SEQ ID NO: 49761 - DNA, 99 bp, Homo sapiens
tcagactggctggcaatgtggctcacgcctgtaatcccagcactttgggaggctgaggtaggaggatcgattgagcccaggaattcaagaccagcctgg

SEQ ID NO: 49762 - DNA, 98 bp, Homo sapiens
cacagggcagggtgaaattgccaagccactcagacgtaagaccggcctctcactgtctgtctggctcccatcccactcccccccaccccacccctgtg

SEQ ID NO: 49763 - DNA, 99 bp, Homo sapiens
tgctcatttatttaggagtcccagctgctgtctccctgcctgtttgccaaggacgtacaaggaaggtcactatcgtgctgctattttaaaacctgagca

SEQ ID NO: 49764 - DNA, 87 bp, Homo sapiens
tgggcaacaatagtgagacctcatctctactttatttattttatttatttatttattttctgagtcagagtctcgctctgtcaccca

SEQ ID NO: 49765 - DNA, 83 bp, Homo sapiens
aatatatattatatatttatacataatgtaatatattatatgttatatatgtaatatgtattatatgttatataatatatatt

SEQ ID NO: 49766 - DNA, 119 bp, Homo sapiens
gaaatactcagttcccagtggcactaacaggtaacagcagaatcatttgtttatttattcaacgaactcaaatgccctttctgtctctcattctgtgctgggctttggtgggtcctggg

SEQ ID NO: 49767 - DNA, 89 bp, Homo sapiens
tgcctcatagcagccacaaagaaaactgcaaatgccatcgggggaccacattatgtgttttgtttttatttttgtttttttttgaggca

SEQ ID NO: 49768 - DNA, 98 bp, Homo sapiens
ctatggagggtgccaggagcccttgttgacactactggggacctcgggtggtcacagcccacagtccctctgactcgggggcttcccattctcctcag

SEQ ID NO: 49769 - DNA, 58 bp, Homo sapiens; identical to SEQ ID NO: 19783

SEQ ID NO: 49770 - DNA, 77 bp, Homo sapiens
cagcctggtcgctggctctcagtctctgccttgcctgcagctgggaggactggtctgtgagctgatgcctttgaagc

SEQ ID NO: 49771 - DNA, 80 bp, Homo sapiens
gcttgagcgtgaggttgaagaaggagtcgtggaagtcccactgcaggatgtctccgtgagtctgtgcctccagctccagc

SEQ ID NO: 49772 - DNA, 115 bp, Homo sapiens
tcagcctcctgagtagctgggactacaagtgcacaccaccacgcctggctaattttcatatttttagtagagacggggtgtcaccatgttggccagaatggtctcaatcttctga

SEQ ID NO: 49773 - DNA, 71 bp, Homo sapiens
ggggctgcagggctttctgacaggcacatctgacctcattctgcccctgctcacacagcctctgtggctcc

SEQ ID NO: 49774 - DNA, 112 bp, Homo sapiens
actccagcctgggtgatagagtgagaccctgtctcaaaatatatatatataataataataatattaatatttttcccttttttgagacaagggtctctgtctcaggctgagt

SEQ ID NO: 49775 - DNA, 112 bp, Homo sapiens
actcagcctgagacagagacccttgtctcaaaaaagggaaaaatattaatattattattattatatatatatattttgagacagggtctcactctatcacccaggctggagt

SEQ ID NO: 49776 - DNA, 71 bp, Homo sapiens
ttgtttttgagacagagtctccctctgtcacccaggctggagtgcagtggcgcgatcttgactcactgcaa

SEQ ID NO: 49777 - DNA, 58 bp, Homo sapiens; identical to SEQ ID NO: 1763

SEQ ID NO: 49778 - DNA, 113 bp, Homo sapiens
agttcaagactagcatggacaacatagtaaagccccatctctaccaaaaaaaaaaaaaaatcattttttttttaaatgagctgggtgtgctgcatgtgcctgtagtcccagct

SEQ ID NO: 49779 - DNA, 58 bp, Homo sapiens; identical to SEQ ID NO: 2540

SEQ ID NO: 49780 - DNA, 74 bp, Homo sapiens
gtcagacgtgtcccccatgcagagtcaaatgctaggtctctatctctcagtgtctctgtctgtttcattctgac

SEQ ID NO: 49781 - DNA, 95 bp, Homo sapiens
ggcgtctgtccctgcgtccgtgtgtccgtccgtcggtccgctcgcgccacgatcagggcttccgggggccaacaagggggcgtcggtaccccgcc

SEQ ID NO: 49782 - DNA, 78 bp, Homo sapiens
gctggcaggtggcacgtggggaggtacgggattgacacaagggtgggtatgcctgcctgcgtgtttggcgggaacagc

SEQ ID NO: 49783 - DNA, 75 bp, Homo sapiens
gtctctactgtgtgtgcgtatatgtgtgtgtgtgtatatatatatatatttttttagtgtacttttagtagagac

SEQ ID NO: 49784 - DNA, 61 bp, Homo sapiens
ctgcccacatgagagccctctatttttttagaaccagggagggtctcactctgtgtcccag

SEQ ID NO: 49785 - DNA, 118 bp, Homo sapiens
tcccatctacaatgaataagctttgtgtgctattgttttgttaatctgtctgtcagtctgagccagacaccagagagaggaggaaagctctagccctgctagtttctggtgatgagga

SEQ ID NO: 49786 - DNA, 76 bp, Homo sapiens
tccttatcgggctaattcaggtagactaaaatcttttttttttgagacagagtctcgctctgtcgcccaggctgga

SEQ ID NO: 49787 - DNA, 86 bp, Homo sapiens
gggtgggataggggagggatagcattaggagaaataacttcttttttttttttttttttttgagacggagtctcgctctgtcatcc

SEQ ID NO: 49788 - DNA, 114 bp, Homo sapiens
tgtagctggatgggcactggggcttcctttttaaattttggttttactttatttatttatttatgtatttatttatttattgagacggagtctcactctgtcgcccaggctgga

SEQ ID NO: 49789 - DNA, 112 bp, Homo sapiens
gcccgggcgtggtggtgtgcatctgtagtcccagctacttgggaggctgaggtaggaggatcccttgagcccaggaagttgaggctgcaatgagctaggactgtgccactgc

SEQ ID NO: 49790 - DNA, 58 bp, Homo sapiens
tgagatggagtctcgctctgtcactcaggctggagtgcagtggcccgatctcagctca

SEQ ID NO: 49791 - DNA, 118 bp, Homo sapiens
tctcgcccaggctggaatgcagtggagtgatcatagttttatttatttatttatttatttatttatttatttatttatttatctgagacagtcttcttgctctgtcacttgggctgga

SEQ ID NO: 49792 - DNA, 69 bp, Homo sapiens
cagagtgaggtctctctttttattatttatttatttatttatttatttttgagacggagtctcactctg

SEQ ID NO: 49793 - DNA, 81 bp, Homo sapiens
tgctgtctagccaggctctctccacctcagggcctttgcgtaggcattgccgactgtctgagatgttcctgacaggcagca

SEQ ID NO: 49794 - DNA, 58 bp, Homo sapiens; identical to SEQ ID NO: 605

SEQ ID NO: 49795 - DNA, 92 bp, Homo sapiens
acagagggagaccctgtctcagaaaaaaaaaaaaaagaagtcaatgaggactggaatcctttttttttttttgagacagagtctcgctctgt

SEQ ID NO: 49796 - DNA, 78 bp, Homo sapiens
tgagagaggggtattgagcgtgtagcgttaactctgccagtcactgcgtcagtcgctttggaaatactaaatttctcg

SEQ ID NO: 49797 - DNA, 61 bp, Homo sapiens
tgggcaacatggtgaggcacctgtcttctttttttgagactgagtctcacactgtcgccca

SEQ ID NO: 49798 - DNA, 74 bp, Homo sapiens
cagcactgggctggagcccaactctttttttttttttttttttgagatggagtctggctctgtcactcaggctg

SEQ ID NO: 49799 - DNA, 116 bp, Homo sapiens
ctagagaggaacgggccagtcagagatggtgagagcggaggctctattttattcctttttttttttttttgagatggagtctcactctgtcgcccaggctggagagcagtgtcgag

SEQ ID NO: 49800 - DNA, 64 bp, Homo sapiens
tgagaaactcacagtcactctctaaggctgccaggtgcccagaagtgtttgtgttggtgtctta

SEQ ID NO: 49801 - DNA, 80 bp, Homo sapiens
cagaaaaaaaattatatacacacacacgtttgtatacatatgtatgtaaatatgtgtgtatatatgtatagttttaactg

SEQ ID NO: 49802 - DNA, 58 bp, Homo sapiens; identical to SEQ ID NO: 3380

SEQ ID NO: 49803 - DNA, 56 bp, Homo sapiens
gagacagagtctcgctctgtcacccaggctggagtacagtggtgagatctcggctc

SEQ ID NO: 49804 - DNA, 60 bp, Homo sapiens
ttgagatggagtctcactctgtcacccaggctgcagtgcagtggtgtgatctcagctcaa

SEQ ID NO: 49805 - DNA, 63 bp, Homo sapiens
agggtcagagacagtgctgtgtgtgcacacgccctcatggaccacaaggcactctctgaacct

SEQ ID NO: 49806 - DNA, 87 bp, Homo sapiens
ttgagacaggatctcactctgtgtcacccaggctggagtgcagtggcatcctcctcctcctgggttcaagcgattgtcctgcctcag

SEQ ID NO: 49807 - DNA, 81 bp, Homo sapiens
ggggggatgggaggggtgtgggacataggtgtatgtttcctaatggattcagagttccatattttctttttcttttcttcc

SEQ ID NO: 49808 - DNA, 102 bp, Homo sapiens
ccagcctgggcaacacagcaagatcctgtctctaccaaaaaaaagtttttgtttttgtttttgtttttttgagacagagtctcactctgtcatctaggctgg

SEQ ID NO: 49809 - DNA, 73 bp, Homo sapiens
gtgagatgccgtcttaaaaataataatgataatgatgataaattttttgtttgtttttgagacagagtcttac

SEQ ID NO: 49810 - DNA, 119 bp, Homo sapiens
agttgggcatggtggtgcatgcctgtagtcccagctactctggaggctgaggtggaaggatcatttgggcctgagaggtcgtggctgcagtgagctgattgcaccactgcaccccagct

SEQ ID NO: 49811 - DNA, 133 bp, Homo sapiens
ggcaacagagtgagaccccatctcaaaaaaaaaaatttgcctttttttttttttgagacagggtctcactctgacgctcaggctggagtgcagtggcgcaatctcggctcactgcaagctccacctcccgggt

SEQ ID NO: 49812 - DNA, 63 bp, Homo sapiens
ggggtggaatcacacgggatgaggcctggtgtgtttggcgtctctcactgagtgtgacaccct

SEQ ID NO: 49813 - DNA, 61 bp, Homo sapiens
gggtgtcacactcagtgagagacgccaaacacaccaggcctcatcccgtgtgattccaccc

SEQ ID NO: 49814 - DNA, 56 bp, Homo sapiens; identical to SEQ ID NO: 324

SEQ ID NO: 49815 - DNA, 79 bp, Homo sapiens
cctttagctcatcatgaggctgtgtctctgtctgtgccatctaatagaggatattttcatcctcatggcgagaagggat

SEQ ID NO: 49816 - DNA, 91 bp, Homo sapiens
gtcgtatgtctccttgtgagcctgtctgtctcggtcactgctatgtccccagtgcccagcccagggccaggcacacagcagagcgcaggac

SEQ ID NO: 49817 - DNA, 58 bp, Homo sapiens; identical to SEQ ID NO: 1435

SEQ ID NO: 49818 - DNA, 58 bp, Homo sapiens
tgagactgagtctcactctgtcatccagcctggagtgcagtggtgtgatctcggcgca

SEQ ID NO: 49819 - DNA, 57 bp, Homo sapiens
cggggcggaggccacagaggacacagccaggagactgctgggctggaaggagctctg

SEQ ID NO: 49820 - DNA, 83 bp, Homo sapiens
ggaagtgactgtgtctgtctgtctcttctacccaaatcagcagctccttagggacagcaacctcccggacacacctcactttc

SEQ ID NO: 49821 - DNA, 125 bp, Homo sapiens
gtggcacgatctcagctcactgcaacctctgccgtcgggttcttttttttttttttttttttttttgagaaggagtctcactgtgttgcccaggctggagtacagtgtggcacagtctcagctca

SEQ ID NO: 49822 - DNA, 118 bp, Homo sapiens
aagtgttgggattacaggcctgagccactgtgtctggctggaaaatatcttttttttttttttaagagatagcatctctagggccaggcacagtgggtcatgctgtaatctagcactt

SEQ ID NO: 49823 - DNA, 111 bp, Homo sapiens
ctgcacgcctctaatcccagctacttggaggctgaggcagaagacagtgaccccaggaggcagaggtggcagtgagccaagatggcaccattgtactccagcctgggtgat

SEQ ID NO: 49824 - DNA, 102 bp, Homo sapiens
gtcaccccaaactctgggaagcaagagtatttttttttctttttgtttgttggttctttgagacaggattttgctctgtcacccaggctggagtacagtggc

SEQ ID NO: 49825 - DNA, 86 bp, Homo sapiens
ggatgacagagccaggctccatctcaaacaaacaaacaaaaacctacttttttttttttttgagacagggtctcattctgttgccc

SEQ ID NO: 49826 - DNA, 58 bp, Homo sapiens; identical to SEQ ID NO: 605

SEQ ID NO: 49827 - DNA, 72 bp, Homo sapiens
gggcaacaaagggagacttcgtctccaataaatttttttttttttttgagacagggtctcactctgtcaccc

SEQ ID NO: 49828 - DNA, 77 bp, Homo sapiens
gggcaacaagagaaaccccgtctcaaaaaaaaattattttactttttttttagagacagggtctcactctgtcactc

SEQ ID NO: 49829 - DNA, 68 bp, Homo sapiens
ggctctgtctctgtgtgtctctgagtgtcccatcccactctgtccccagcaccgcggaggcagccgcc

SEQ ID NO: 49830 - DNA, 81 bp, Homo sapiens
cagggatggggcgtgacgagggcagcgtgacctcgagatcgatgacaggcgtgtctggctctgtgtgacacactcgccctg

SEQ ID NO: 49831 - DNA, 78 bp, Homo sapiens
ggaccctcctcaccggctcactcagtctctttgggctgcaccgaggctctttctgagatggctgaaggaaaagtgtcc

SEQ ID NO: 49832 - DNA, 65 bp, Homo sapiens
ttgagatggagtctcacactgtcacccaggctggagtatagtggcgcaatctggactcacctcaa

SEQ ID NO: 49833 - DNA, 58 bp, Homo sapiens
tgagactgagtctcgctctgtcacccaggctggagtgcagtgacgcgatctcagctca

SEQ ID NO: 49834 - DNA, 70 bp, Homo sapiens
aactgactccctggacccaccacagagagggtggtcctcctctgtggctggctctctgagtaggtcagtt

SEQ ID NO: 49835 - DNA, 98 bp, Homo sapiens
ctactaaacagaatttccatgtgacatcagtttttgttgtaggtagaaataaatagaaacatatgtccacacaagaccttgggcatgaatgtttatag

SEQ ID NO: 49836 - DNA, 117 bp, Homo sapiens
gcctcctaaagtgctgggattacagatgtgagccaccgcgcctggacttttttttttttaaagagctgtaggccagccatggtagctcacgcctgtaatcccagcactttcggaggc

SEQ ID NO: 49837 - DNA, 86 bp, Homo sapiens
ctgcacttcagcctgggcaacagagcgagagacttttttttttttttgagacagagtcttgctctgttgcccaggctggagtgcag

SEQ ID NO: 49838 - DNA, 67 bp, Homo sapiens
gccacccagcaaaagagctggaaagcaacctgtgcgtgctttatacttcattttttgttgtagtggt

SEQ ID NO: 49839 - DNA, 56 bp, Homo sapiens
gagatggagtctcactctgtctccgaggccggagtacagtggcaagatatcggctc

SEQ ID NO: 49840 - DNA, 102 bp, Homo sapiens
ttccatcttgatttcatccaacactcattcagaaacaggttgatctttaatttttaaatttaatttccgtgtatttgcatggttttgatggttcatttggag

SEQ ID NO: 49841 - DNA, 79 bp, Homo sapiens
tgagacggagtctcactctgtcacccaggctggagtgcagtggcataatctctgctcactgcaacatctgcctccaggg

SEQ ID NO: 49842 - DNA, 58 bp, Homo sapiens; identical to SEQ ID NO: 1725

SEQ ID NO: 49843 - DNA, 63 bp, Homo sapiens
gtttcacacttctgagtgtgacacgccctagtgggcatgtgcgttagtcggggtggtgggaac

SEQ ID NO: 49844 - DNA, 100 bp, Homo sapiens
tgtagtttagacacgattttattctgtttatatttacttttttgtgacttatggagcaagtactgtatctgcagaaatagaaaacaagtttctaaataca

SEQ ID NO: 49845 - DNA, 58 bp, Homo sapiens; identical to SEQ ID NO: 884

SEQ ID NO: 49846 - DNA, 56 bp, Homo sapiens; identical to SEQ ID NO: 885

SEQ ID NO: 49847 - DNA, 102 bp, Homo sapiens
gtgtatgaatatatgtacacatatggtagctacataaacactcacaaacttatatgaatgtatctatgtaaatattaatgtatacatacaatattttcccac

SEQ ID NO: 49848 - DNA, 64 bp, Homo sapiens
tatgtatatatgtatatgtacatatatgtatatatacctatatatgtatatatgcacatacgta

SEQ ID NO: 49849 - DNA, 58 bp, Homo sapiens; identical to SEQ ID NO: 1847

SEQ ID NO: 49850 - DNA, 83 bp, Homo sapiens
tcaatttgtgtttcaacataatggacacattctaacatttctgtatttttagatatagaatctcattatgttgttcaggttga

SEQ ID NO: 49851 - DNA, 73 bp, Homo sapiens
ataaagatgtatgtgccaatatttttcttgtttttttaaaaagaaaccaggagttggcaatttacatttgtgt

SEQ ID NO: 49852 - DNA, 58 bp, Homo sapiens; identical to SEQ ID NO: 1868

SEQ ID NO: 49853 - DNA, 70 bp, Homo sapiens
tatatacacacacacacatatatatatatacacaagtgtatgtatatatatatatgtgtgtgtgtatgta

SEQ ID NO: 49854 - DNA, 191 bp, Homo sapiens
tatatctatctatatctatatttatatctatatctatatatttatatatctatatctatatatgtttatatacgtatatctatatatttatatgtatctatagctgtatatttatatatctatatctatatatgcatatatctatatctatatatttatatatctatatctatgtatatttatatatatat

SEQ ID NO: 49855 - DNA, 116 bp, Homo sapiens
agattaaaaatgtcttttggggaatgtattttgtatacataagtatttacatataaatatttatataattatgtgtttgtcttcctatgtatatttatatctagatatgtcaatct

SEQ ID NO: 49856 - DNA, 116 bp, Homo sapiens
agcctcccgtgcaggtgtccagcctgctcaccccagccatagaaggagcctttatcctgagagaagctacagagccctggaaagctggggtcccacaggcagatgcagttgaggtt

SEQ ID NO: 49857 - DNA, 118 bp, Homo sapiens
gggcgtggtggcacacatctgtagtttcagctactcaggaggctgaggtagaagaatcacttgaacccaggaggcagagcttgtagtgagctgaaatggcaccactgcactccagcct

SEQ ID NO: 49858 - DNA, 119 bp, Homo sapiens
tatgaaaattagctgggcatggtggtaggcacttgtaatcttttttaatttttttattttattattattgtactttaagttttagggtacatgtgcacaatgtgcaggtttgttacata

SEQ ID NO: 49859 - DNA, 95 bp, Homo sapiens; identical to SEQ ID NO: 580

SEQ ID NO: 49860 - DNA, 93 bp, Homo sapiens; identical to SEQ ID NO: 69

SEQ ID NO: 49861 - DNA, 107 bp, Homo sapiens
tttactttttttgtgacttgtgtagcaatgactgggtctgtaggaatagaaaacaagttactaaatagaatgtctctgcaagcactggttttaatagaaaatttaaa

SEQ ID NO: 49862 - DNA, 107 bp, Homo sapiens
gttctaatttgattgcactgtggtctgagagacagtttgttgtgatttcttttttttacatttgctgaggagtgttttactaccaattatgtgatcaattttggaat

SEQ ID NO: 49863 - DNA, 76 bp, Homo sapiens
ctagaggcccagcctctgtggctctgtgtcctgccggtattgggagatccacagctaagatgctgggaccttctgg

SEQ ID NO: 49864 - DNA, 78 bp, Homo sapiens
aagttgtgcaaaataatagaatttctctagattacttactggatgaacagagaagtatctgtgcagttgctaaaactt

SEQ ID NO: 49865 - DNA, 94 bp, Homo sapiens
gaaagaaggtttatttggctcacagctcagcagactgtacaagaagggtgtaacagcatctgcttctggtgagggtctcaggaaacttacaatc

SEQ ID NO: 49866 - DNA, 83 bp, Homo sapiens
ctcttgcctgtggacagtgtgcgcctttaatctttttttttttttttttttgagacagagttttgctcttgtccaggctggag

SEQ ID NO: 49867 - DNA, 118 bp, Homo sapiens
gtaacttacaaagaaagaaggtttatttggctcacagttcagcagactgtacaagaaggatgtaacagcatctgcttccggtgagggtctcaggaaacttacaatcatggtggaagac

SEQ ID NO: 49868 - DNA, 102 bp, Homo sapiens
gcaggaactctctgtgttgagtaaaatgtgagcagataatgatggctttttcacagtctttatatttgtataatttatctcaagtataaatgctttcctagc

SEQ ID NO: 49869 - DNA, 75 bp, Homo sapiens
tctcgaccccatagattaacagctatattcgtaacataaggttgaaaagtatataactgtccatctggtccgaga

SEQ ID NO: 49870 - DNA, 74 bp, Homo sapiens
caatcataatttctagttgacataacactagatttgaggtgctgtggctgtagtaactagaaatgtcatggttg

SEQ ID NO: 49871 - DNA, 111 bp, Homo sapiens
taaattatctactctcaggtattcctctgtaggtaaaataattaatacagtctataatgtctgagttttttattttcttatttattatggcaaatggggtgttgatgttta

SEQ ID NO: 49872 - DNA, 116 bp, Homo sapiens
gccattgcactccagggcaacaagagtgaaacctcatgtcaaaaaaaagaatggccataattttttattttttgagatggagtctcgctctgtcacccaggctggagtgcagtggc

SEQ ID NO: 49873 - DNA, 98 bp, Homo sapiens
ggttaagttttgccacattgctctcacttgtaggatttctttccagtatgaattatattgaatgtaatcaagtaaggcagggagtggtggctcatgcc

SEQ ID NO: 49874 - DNA, 58 bp, Homo sapiens
tgagacggagtctcactctgtcacccaggccggagtgccgtgatgcgatctcgtctca

SEQ ID NO: 49875 - DNA, 105 bp, Homo sapiens
tgactatacagattctttttttggttccatatgaaatttaaagtagtttttttctaattctgtgaagaaagtcaatggtagcttgatgggaatagcattgagtca

SEQ ID NO: 49876 - DNA, 87 bp, Homo sapiens
ggtagcccaagataatttttttttttttgagacagagtcttgctctgtcacccagaatggagtgcagtggtgtgatcttggctcact

SEQ ID NO: 49877 - DNA, 79 bp, Homo sapiens
agaggctgtaaccgtattctgcaaaatatatatatatatatatatatgtaatttagttgtaaggctattctttgcctct

SEQ ID NO: 49878 - DNA, 84 bp, Homo sapiens
cacagcgagggagagccccacgtcggagagccagatgtagggaccagccccacagggtcagtgggtctctccctgtgtgcggtg

SEQ ID NO: 49879 - DNA, 264 bp, Homo sapiens
tatatccatatatagatatatatatccatatatatatccatatatagatatatatatccatatatatatccatatatagatatatatccatatatatatccatatatatccatatatagatatatatatccatatatatatccatatatagatatatatatccatatatagatatatatatcgatatatatatccatatatggatatatatatctatatatatatatatatatccgtgtgtgtatatatatatatccatgcagg

SEQ ID NO: 49880 - DNA, 70 bp, Homo sapiens
atatatatatctatatatggatatatatggatatatatatggatatatatctatatatggatatatatat

SEQ ID NO: 49881 - DNA, 83 bp, Homo sapiens
ctgggtcctgagcccagtgatatgtcacaattgtctatgtgggcaaacccctgtcagaagagacacatcactaggttgcctag

SEQ ID NO: 49882 - DNA, 79 bp, Homo sapiens
ggctgggtgtgtttaagagagccacaatctcacctgtgtgctgggtcctgctgtgacactctctgtgccacccaaggcc

SEQ ID NO: 49883 - DNA, 86 bp, Homo sapiens
aggacggacaacccggattctggagttgagccaaagtagttccatttttttatttagaatcatcctgagtcttctctgcctgtctt

SEQ ID NO: 49884 - DNA, 96 bp, Homo sapiens
tgtggactcttttttggttccatatgaaatttaaagtagttttttccaatgctgtgaagtcattggtagcttcatggggatggcattgggtctata

SEQ ID NO: 49885 - DNA, 69 bp, Homo sapiens
cagcactcaggtgatgtgatgcttttctctctttttttgagatggagtctcactcagtcacctaggctg

SEQ ID NO: 49886 - DNA, 125 bp, Homo sapiens
tgtatatatatatatgataatgtatatatatatgataatgtgtatatatatatgataatgtgtgtatatatatgataatttgcatatatatatgataatgtgtatatatatgtatatatacacat

SEQ ID NO: 49887 - DNA, 102 bp, Homo sapiens
gcagcctagactgtcactctttacttttttttgggggggggggcgggggacagactgtctctctgtcaaccaggctggagtgcagtggtgcgatctcggctc

SEQ ID NO: 49888 - DNA, 196 bp, Homo sapiens
atatatatatatatatatatatatatgtgtgtgtgtgtgtgtgtgtgtgtgtgtatatacatatatatgtgtgtgtatatatatacatatatatgtgtgtatatatatacatatatatgtgtgtatatatatgtgtgtgtgtgtgcatatatatatatatatatatatatatatatatatatatatatccctacac

SEQ ID NO: 49889 - DNA, 110 bp, Homo sapiens
tttcttatagattcgatatattaatcagttgtatgcactttgcaaatattttatttcatattgtaaggtgtctgtttcctttgttgatagtttctttggctgtgcagaag

SEQ ID NO: 49890 - DNA, 58 bp, Homo sapiens
tgagacagagtctcactctgtgtcccaggctggagtgcagtggtgtgatctcggctca

SEQ ID NO: 49891 - DNA, 114 bp, Homo sapiens
gttagagagaggagctgctaactagaataaccagttagacagagtctcactctgtcgcccaggctggagtgcagtggcgcgatcttggctcactgcaacctccgcctcctgggt

SEQ ID NO: 49892 - DNA, 56 bp, Homo sapiens; identical to SEQ ID NO: 324

SEQ ID NO: 49893 - DNA, 83 bp, Homo sapiens
tttcatttctgtgtaaagttaaaaactttcaaactcatggcaacagagagtggaatgatgattgtctgcagctggaggtggag

SEQ ID NO: 49894 - DNA, 81 bp, Homo sapiens
cttggggtagagttgtccaggccaggagtatgtccctggatgactcacttctgtgcccctctgtgactcagtttccccagg

SEQ ID NO: 49895 - DNA, 77 bp, Homo sapiens
cgttcctctgtgtgtgtgaggaaatgttacatatatagtatatgtagagcgacagagactcacagagagagagaacg

SEQ ID NO: 49896 - DNA, 97 bp, Homo sapiens; identical to SEQ ID NO: 1307

SEQ ID NO: 49897 - DNA, 88 bp, Homo sapiens; identical to SEQ ID NO: 1308

SEQ ID NO: 49898 - DNA, 81 bp, Homo sapiens; identical to SEQ ID NO: 1309

SEQ ID NO: 49899 - DNA, 77 bp, Homo sapiens; identical to SEQ ID NO: 1310

SEQ ID NO: 49900 - DNA, 86 bp, Homo sapiens
gtgctgccagttgttactgagatctcattttctttttgtaaaaaggtagatgagtaaatcatagtgataaaaaagcggccaggcgc

SEQ ID NO: 49901 - DNA, 58 bp, Homo sapiens; identical to SEQ ID NO: 49890

SEQ ID NO: 49902 - DNA, 69 bp, Homo sapiens
ggttccagctgagagatatcacagaggcctggtctggaatggatctctgggtgtctaggaatgggaggc

SEQ ID NO: 49903 - DNA, 118 bp, Homo sapiens
cctcccaaagtgctaggattacacgcatgagctaccgcgcccggcccgatttatttatttattttttaatgagaaaaaggagacaatgtgcagagtctgtgtctggctatgtgatagg

SEQ ID NO: 49904 - DNA, 89 bp, Homo sapiens
cccaattgtagctgggtgttcacatatgacagtcacaatctgaactgtgggctgtgtcaacgtgtgaaattcaggacctctccaatggg

SEQ ID NO: 49905 - DNA, 86 bp, Homo sapiens
gtcacactgctcattgttctgtgattccagatctcctcttagggtgagagaggactgaaaacttagagaaaaggagttctgatgac

SEQ ID NO: 49906 - DNA, 78 bp, Homo sapiens
ctgcaggttttcaaagggtacatgagtgtttttgttttgtttttgagacagagtctcgctctgtcacccaggctggag

SEQ ID NO: 49907 - DNA, 113 bp, Homo sapiens
agattgagaaatcggatggttgctgtgtctgtgtagaaagaagtagacatgggagacttttcattttgttctgcactaagaaaaattcctctgccttgggatcctgttgatct

SEQ ID NO: 49908 - DNA, 87 bp, Homo sapiens
acagtcacaatcccaactgtgaactgtgtcagtttgtgaaatttaggacctcaccagtgggctctgtttatatgggagggtgatggt

SEQ ID NO: 49909 - DNA, 79 bp, Homo sapiens; identical to SEQ ID NO: 49882

SEQ ID NO: 49910 - DNA, 113 bp, Homo sapiens
atcacccagcaggatttgcagaataattgcttagaactagaatattgatttagatttttacatgacccatccctttctgttttctgagctgcaggcagagattgctggttggt

SEQ ID NO: 49911 - DNA, 96 bp, Homo sapiens
ctgggtctgtaaactggctcaagtctggaaattgattgaggggccatgattctctgtttttatatttcaaattagtcttctgcccattcaacctag

SEQ ID NO: 49912 - DNA, 58 bp, Homo sapiens
tgagatggactctcgctctgtcactcaggctggagtgcagtggcgcgatctcagctca

SEQ ID NO: 49913 - DNA, 152 bp, Homo sapiens
tatatatgtatatacatgtatatgtatgtatatatgtatatatgtgtgtatatatgtatatatgtatgtgtgtatatatgtatatatatgtgtgtgtgtatatatatatacatatatatatatatatatatatatatatatatatatatcac

SEQ ID NO: 49914 - DNA, 64 bp, Homo sapiens
gtatatatatatatatacgtatatacatatgtatgtatatacgtatgtatacatatatatatac

SEQ ID NO: 49915 - DNA, 117 bp, Homo sapiens
gtattccaacatatatatatgtatgtgtgtgtgcatgtgtgtgtatatatacattttaagtgtttatatatttatatatatatacacacacatatatatatttcacagattctttac

SEQ ID NO: 49916 - DNA, 100 bp, Homo sapiens
atttttatatgaatcttctatttatcgaaaatgggattttggtgtctacaattaccatttttattctgttttaaatattctatagaagatctttaaggat

SEQ ID NO: 49917 - DNA, 81 bp, Homo sapiens
ctgtctttctgtccctctctccatcgatctccatgtgtcacactctcacacacatgctggagggcaggggcatggtaacgg

SEQ ID NO: 49918 - DNA, 59 bp, Homo sapiens
ttgagatggagtctcactctgtctcccaggcgcgacagagtgcagtggcacaatctcag

SEQ ID NO: 49919 - DNA, 114 bp, Homo sapiens
ggacactgcacacaactcatttataaattttccacagatgtattttggtctctatatttttgttacatttgtatgtctgtgaaagaattagggcctgtggtattttgcaaagcc

SEQ ID NO: 49920 - DNA, 79 bp, Homo sapiens
tgagttcagcaaccaggtggtgattttcttgtacacatgtcttaactgcagagaaaattgtgacatatagctgagtcca

SEQ ID NO: 49921 - DNA, 70 bp, Homo sapiens
cctgtgggactggtgccagagatatcttttttttttttttttgagatggagtctcactctgtcacccagg

SEQ ID NO: 49922 - DNA, 111 bp, Homo sapiens
catcccccaggtccggggcttgtgtcatctgtggaagctgctttgttcagggctgcgggtactgtaaggtcagtttcttcatttctgatatggggttgggtcctaggcatg

SEQ ID NO: 49923 - DNA, 101 bp, Homo sapiens
tactcatggtgactggttgtcccactttcctcaggttttctttcaccatctgtgacagcttcttgatctgtccccaagtgggtggctgtgttcaatgggtg

SEQ ID NO: 49924 - DNA, 57 bp, Homo sapiens
acagagtctcactctgtcgccctgctggagtacagtggtgcagttttggctctctgt

SEQ ID NO: 49925 - DNA, 97 bp, Homo sapiens
gattttggtattaggatgatacttgtttcatataatgaattaggaataaattccactttgattttttatatacattcagtagaattagtaccagttc

SEQ ID NO: 49926 - DNA, 108 bp, Homo sapiens
ctattcaggtattttgtggtaccatataaattttagatatatatatatataaaattttagatatatatttaaaattttctatttagtgtgtcactggtactttgatag

SEQ ID NO: 49927 - DNA, 58 bp, Homo sapiens; identical to SEQ ID NO: 1215

SEQ ID NO: 49928 - DNA, 86 bp, Homo sapiens
tttcggccaggctgaataatgttttttttctccttttcttttttttttttttgagaaagagtctcactgtgtcgcccaggctggag

SEQ ID NO: 49929 - DNA, 84 bp, Homo sapiens
gcatggtgcctatagttcataacaatgtatttgtatttctgaaaaatgctaaaacattgtcatgtgctcttaccacaaaaatgt

SEQ ID NO: 49930 - DNA, 67 bp, Homo sapiens
gttagggcctcccctcacagggtattggcaaggagaaattctgagactctgtgactgagaagctagc

SEQ ID NO: 49931 - DNA, 105 bp, Homo sapiens
gttacactacctgagttttagacccagcagtatgtcacactgtcacaatgacccatgtgagcaaagcagaggcaggagagtaacataaactaggggggagggcag

SEQ ID NO: 49932 - DNA, 111 bp, Homo sapiens
gaggttttgataggttgtatcattattgtcattaagttgaagaattttttaatttccatattgattttgtttttaacgcaatgctcattaaggagcagattatttaatttc

SEQ ID NO: 49933 - DNA, 102 bp, Homo sapiens
ttcatcttcctttattcaggccaccagtgtacatggcaaagtaatcaaaatacagtagtcagtgagcaccaaccatgcaattgtgctaggtaaggagatgga

SEQ ID NO: 49934 - DNA, 97 bp, Homo sapiens
gttcttgtcatactttgagcagttaacactgatataagtgagcttttcctggctggatgagtctctttcactgtgatatgtcctctatgatattagc

SEQ ID NO: 49935 - DNA, 68 bp, Homo sapiens
ttttttgaggcagagtctcactctgtctcccaggctggagtacagtggtgtgatctcggctcactgaa

SEQ ID NO: 49936 - DNA, 92 bp, Homo sapiens
aaaagaaaaaaagaaaaagaaaaagagaaaatctcctctgtgtgctgggtcttgttagtacactcttttttttttttttttttttttttttt

SEQ ID NO: 49937 - DNA, 104 bp, Homo sapiens
gcaatgtaaaagtattcccttttcaccaaaaccatgcgaacatgcattatttttgatgttttaattatggtcatttttgcaggaataaggtggtatcacattgt

SEQ ID NO: 49938 - DNA, 80 bp, Homo sapiens
gtgtgtgtgtgtgtgtctcacattagggttccaaatatataaagcaaatattgacagaatggaagaaacacatacaaagc

SEQ ID NO: 49939 - DNA, 112 bp, Homo sapiens
gccaggaatttgagaccagactgggtaatatagtgagaccctatttcttttcttttttttcttttttttgagatggagtctctctctgtcgcccaggctggagtgcagtggc

SEQ ID NO: 49940 - DNA, 117 bp, Homo sapiens
agataaatactagaaggaagatttctcagaaactgctttgtgatgtgtgcattcttctcacagagtttaacctcacttttcattgagcagtttggaaacactgtttctgtaaattct

SEQ ID NO: 49941 - DNA, 102 bp, Homo sapiens
gtccctccagtcactggtgtcacggccatgggtgtcccacagtcactgtcactggtgtcacggccatgggtgacccacagtctctccagtcactggtgtcac

SEQ ID NO: 49942 - DNA, 90 bp, Homo sapiens
ccagtcactggtgtcacggccctgggtgacccacagtcactgtcactggtgtcacggccatgggtgtcccacagtccctccagtcactgg

SEQ ID NO: 49943 - DNA, 102 bp, Homo sapiens; identical to SEQ ID NO: 49941

SEQ ID NO: 49944 - DNA, 98 bp, Homo sapiens
gtctccagtcactggtgtcacggccatgggtgtcccacagtcactgtcactggtgtcacggccatgggtgacccacagtctctccagtcactggtgtc

SEQ ID NO: 49945 - DNA, 87 bp, Homo sapiens
ttctgatggggtgactcggtgcatttctctctcaggcttactttttttctctttgagacagagtctcactctgtcgcccaggctgga

SEQ ID NO: 49946 - DNA, 102 bp, Homo sapiens
gtctctccagtcactggtgtcacggccatgggtgtcccacagtcactgtcactggtgtcacggccatgggtgacccacagtctctccagtcactggtgtcac

SEQ ID NO: 49947 - DNA, 96 bp, Homo sapiens
tatgtgtgtctatgtatttatgtataaattgcaggtggatatgtatgtatatatctatatatacgcagaaagatagttacttatatggcatatatg

SEQ ID NO: 49948 - DNA, 56 bp, Homo sapiens; identical to SEQ ID NO: 9180

SEQ ID NO: 49949 - DNA, 84 bp, Homo sapiens
ttagccgggcatggtggtgcacacctgtagttccagctgctctggaggctgaggtaggaggatcacttgagcccaggaggctga

SEQ ID NO: 49950 - DNA, 111 bp, Homo sapiens
agctctgcctgagagccactggagcacctttctttctttcttttctttttttctttttcttttttttttttttttttgagacggagtctcgctgtctcccaggctggagtt

SEQ ID NO: 49951 - DNA, 80 bp, Homo sapiens
gccactgggtgagagagcgagactccatctttttttttttttttttttgagacggagtctcactctgtcacccaggctgg

SEQ ID NO: 49952 - DNA, 68 bp, Homo sapiens
tcaatgtagcatgtgccctgagatggaagtgaccacagtcacacccactctcttgtttcttgctgtga

SEQ ID NO: 49953 - DNA, 58 bp, Homo sapiens
tgagacaaggtctggctctgtcacccacactggagtgcaggggcatgatcttggctca

SEQ ID NO: 49954 - DNA, 58 bp, Homo sapiens
tgaggcagagtctcgctctgtcacccaggctggagtacagtggtgtgatcttggctca

SEQ ID NO: 49955 - DNA, 58 bp, Homo sapiens
tgagacagagtctcactctgtcacccaggctggagtgcagcggtgtgatctcggctca

SEQ ID NO: 49956 - DNA, 72 bp, Homo sapiens
gtcttcaccattttcgtgtttagtgtttctctttacaattttttcaaagtacagagaagagtgagtggagac

SEQ ID NO: 49957 - DNA, 120 bp, Homo sapiens
agctgtcactggtaggatcttgcgtgtgccacctgtctgggcctgtcactccctctgtaagagggggctgtgacccccgccttctaggtttatgcggggactcagccaggtctgatttct

SEQ ID NO: 49958 - DNA, 58 bp, Homo sapiens; identical to SEQ ID NO: 315

SEQ ID NO: 49959 - DNA, 85 bp, Homo sapiens
ccagtcttggcaatgtagcaagaccccaactctataattttttttttttttttgagacggagtctcgctctgtctcccaggctgg

SEQ ID NO: 49960 - DNA, 83 bp, Homo sapiens
gcttctctctgaatctgtgtctgaggtgagagaggcatggccctggtggcctttcttaatttcaggttgggttccaagaaagc

SEQ ID NO: 49961 - DNA, 92 bp, Homo sapiens
gacagagtgagactccatctcaaaaaaaaaaaaaaatttggtattctttcttcttttttttttttttttttgagacagagtctcactctgtc

SEQ ID NO: 49962 - DNA, 58 bp, Homo sapiens; identical to SEQ ID NO: 2051

SEQ ID NO: 49963 - DNA, 58 bp, Homo sapiens
tgagacggagtctccctctgtctcccatgctggagtgcagtggcgcgatctcggctca

SEQ ID NO: 49964 - DNA, 113 bp, Homo sapiens
ccagtctgggcaacatagtgacaccctgtctttacaaagttttttttgttgtcgtttttttttgtttttgagacagactctccctctgtcgcccaggctggagtgcgatgaca

SEQ ID NO: 49965 - DNA, 99 bp, Homo sapiens
acattcagatgcaagagccacatacgacaaaggcttttatttttatttatttttgagacagagtcttgttctgtcgcccaggctggagtgcagtggtgt

SEQ ID NO: 49966 - DNA, 117 bp, Homo sapiens
gtcaccagcaccagcacagagatagttttacttcttccttaccaatcttttttttttttttttttttttttttttgagatggagtcttgctgtattgccaggctggagtgcagtggc

SEQ ID NO: 49967 - DNA, 105 bp, Homo sapiens
gctgctgccgccactcagggaaccacggtttgagaaccgctactctctttttttttttttttttgagacggagtctcgctgtctcccaggctggagtgcagtggc

SEQ ID NO: 49968 - DNA, 83 bp, Homo sapiens
agccaggtccaggagattcaaaacccacttcttttttttttttttttttttttgaggtggagtctcactctgtcacccgggct

SEQ ID NO: 49969 - DNA, 75 bp, Homo sapiens
ccaattctggctctatcactgacactctgggtggcccgtcgccctgggcctcagtttcctagtctgccacgcggg

SEQ ID NO: 49970 - DNA, 123 bp, Homo sapiens
gggattacaggcgtgagccactgcgcctggcctgttgttgttttgagacagagtctttttttttttttttgagatggagtcgctctgtctcccaggctggagtgcagtggcgtgatctcggct

SEQ ID NO: 49971 - DNA, 58 bp, Homo sapiens
tgagactgggtctcactctgtctcccaggctggagtgcagtggtgcaatcttggctca

SEQ ID NO: 49972 - DNA, 76 bp, Homo sapiens
tgtgtatatatgtgtgtatatatatttgtgtgtatgtgtttatatatttgtgtgtgtgtatatatgtgtgtatata

SEQ ID NO: 49973 - DNA, 60 bp, Homo sapiens
tgtgtgtatatatgtgtgtgtatatacacgtttgtgtgtgtatatatatttgtgtgtata

SEQ ID NO: 49974 - DNA, 102 bp, Homo sapiens
agagagagaatccatgaatctatttggaaaatagacagataaataaagtgagaaggaggcatttatatttatttatttacttttgagtcagagtctcactct

SEQ ID NO: 49975 - DNA, 88 bp, Homo sapiens
gcctcaggcaagacgctcaccctctgtgcctcggttttccttttaggatgggcagggggctaggggcaggcaaggagctgtctggggc

SEQ ID NO: 49976 - DNA, 236 bp, Homo sapiens
atatatatacacacatatatatttttatgtataatatacatatatgtatattaaaatgtatacttttatgtgtgtatatatgtatgtgtatatatgtatgtgtgtctatatattgtgtatatatatgtatgtgtatatatgtatgtgtatatacatatatgtatgtgtgtctatatattgtgtatatatatgtatgtgtatatatatgtatgtgtgtgtgtgtatatatatacata

SEQ ID NO: 49977 - DNA, 58 bp, Homo sapiens
tgagtcggagtctcgctctgtcacccaggctggagtgcagtggcatgatctcggctca

SEQ ID NO: 49978 - DNA, 58 bp, Homo sapiens
tgagacaaggtctcactctgtcgctcaggctagagtgcagtggcaggatcttggctca

SEQ ID NO: 49979 - DNA, 105 bp, Homo sapiens
tcagccttctttttccctccacagagttacacccatttaaaattttattttcatttttatttttatttttttcgagatggagtctctctctgtcgcccaggctga

SEQ ID NO: 49980 - DNA, 110 bp, Homo sapiens
acttgcagattctacaaaaagagtgattcaaaactgctttatgaaaagaaaaattcatttttttatgattatactttaagttttagggtacatgtgcacaatgtgcaggt

SEQ ID NO: 49981 - DNA, 82 bp, Homo sapiens
gaatggctgtgtgtccttgagccagcagctgaatcctctggggaccagtttttctctctctctctggaaaacgaggccaatc

SEQ ID NO: 49982 - DNA, 140 bp, Homo sapiens
catgagatatatatatatatatgtgtgtgtgtgtgtgtgtgtgtatatatatatatacacatacatatgtgtgtatatacatataatgtatatgtgtgtatatatgtatatatacgtgtgtatgtgtgtgtgtgtgtgta

SEQ ID NO: 49983 - DNA, 84 bp, Homo sapiens
aggtttctgagaaactgcttcatgatgtgtgcattcatctcacagaggtaaatgttacctttcattgagcagattggaaactct

SEQ ID NO: 49984 - DNA, 100 bp, Homo sapiens
gaagaggtccttcacctcccttgtaagttggattcctaggtattttattttctttgaagcaatagtgaatgggagttcactcatggtttggctctctgtc

SEQ ID NO: 49985 - DNA, 103 bp, Homo sapiens
ctagaaagaagctttctgaggagctgctttgtaatgagtgcactcatctctcagagttaaacttttcttttgattgagcagctttggaacagtgtctttgtag

SEQ ID NO: 49986 - DNA, 70 bp, Homo sapiens
gctttgtgagaaactgctttgtgatgggtgcattcatatcacagagttaatcctttctcctgattgaagc

SEQ ID NO: 49987 - DNA, 108 bp, Homo sapiens
aggtatgagccactgcacccagcttaaatgcatttttgagttatgattttatttttttgagatggagtctcgctctgtcacctgggctggagtgcagtggcacaatct

SEQ ID NO: 49988 - DNA, 102 bp, Homo sapiens
taaaatcttctcagttattatatatgtacatattgtatatacatatatatatacttatatgtaattttacatccaaatgtatcttatattggcttggttttg

SEQ ID NO: 49989 - DNA, 84 bp, Homo sapiens
agtgctgggattacaggcgtgagccaccacacccagcctattttatttatttttgagacagggtctcactctgttgcccagcct

SEQ ID NO: 49990 - DNA, 114 bp, Homo sapiens
ggctgattagctcggaggtctccaaaaccaaaatcttggccatggcagtgctagaaaactctgtattttcatatgtcaagtaatgttggcagaaccttgagttaccatcatgtt

SEQ ID NO: 49991 - DNA, 81 bp, Homo sapiens
ctggtgcaggaggagcagggaggtggcgtgctgtgtgtcattgtgatggtgcgtatgtgactctgtgtgtgcctgtatggg

SEQ ID NO: 49992 - DNA, 89 bp, Homo sapiens
tgtgaaatgtcacagctcagtcacagtcactaaaacagatcgaggagttaaaaagttatggcaagactgagaactgacatggaggaaca

SEQ ID NO: 49993 - DNA, 133 bp, Homo sapiens
tatgtagctgtgtgtcgtgtggagtctgtgtctgcagctgcttgagtctgcacgatgtgtgtctgtgtgtctctgtaggtcgtagtgtgtggtgtgtgtgtctatctgtaccagcctcaacggcctatctgac

SEQ ID NO: 49994 - DNA, 76 bp, Homo sapiens
gggtgtgtgtgcatgtgtgtgtatgtaaaggatactatgtatatttgtataaatacatgtgtactctttaaaaccc

SEQ ID NO: 49995 - DNA, 85 bp, Homo sapiens
tatggctgagtccatggtgtgtgtgtgtgtgtgtatatatatatatatacacatacatatatatatccatatttatatatccata

SEQ ID NO: 49996 - DNA, 84 bp, Homo sapiens
actctagcctcgtagggatggactagctctacaggcctgtgtccaagcacagcctcactgtctgtctgtctgtttgtctagagt

SEQ ID NO: 49997 - DNA, 71 bp, Homo sapiens
gttctactttgtgcacacagtcaccacacttgctgggaaaatcctatgtgtgtgtttgtgccacttggaat

SEQ ID NO: 49998 - DNA, 95 bp, Homo sapiens; identical to SEQ ID NO: 580

SEQ ID NO: 49999 - DNA, 93 bp, Homo sapiens; identical to SEQ ID NO: 69

SEQ ID NO: 50000 - DNA, 70 bp, Homo sapiens
ctccgcagtgcaccagctcaggcacctggtgacttgctgctcactgaagtgtctgaccagcaccatgggg

SEQ ID NO: 50001 - DNA, 91 bp, Homo sapiens
tgcccttttcaacactcagcctctgtcagtcagtttgttctttatgcagaaagagagatcaggaggaagaataggagagttgaaaagggca

SEQ ID NO: 50002 - DNA, 65 bp, Homo sapiens
gggcactgtgctgggcctgaggtcatggtggagggcataggcagtgacactctggctcagtgtcc

SEQ ID NO: 50003 - DNA, 104 bp, Homo sapiens
gtttttctcgtacactctgagatgtggctgcgacttaagtttttcattttgatgttaactaaaaatgactcgtgttcatttccatctcagcagccggggatcac

SEQ ID NO: 50004 - DNA, 83 bp, Homo sapiens
tccatcctaactctcagaggtcatcaggaccctggtcacacacattctcactgtctacctctcagagtcacctgtagcatggg

SEQ ID NO: 50005 - DNA, 92 bp, Homo sapiens
tttattcattcactcattcatttaatagtttttgaatatctaacttctgtcaggatttacagcaactttttctgtgaagggtgggtagtaaa

SEQ ID NO: 50006 - DNA, 81 bp, Homo sapiens
atatgtgtgagtgtgtatgtgtatgtgtgtgtgcgtgcgtgtacgcacgtgtgcatgcatctgcatgtgcatgtgtgtgtg

SEQ ID NO: 50007 - DNA, 78 bp, Homo sapiens
ccaccaagtccactgtgtctctgtgtttctgggcccagttcagccctaggactcacctaagagtcgcagtccttatgg

SEQ ID NO: 50008 - DNA, 94 bp, Homo sapiens
tagtggtcatttcggtttttgtttttttttttttgagacagagtctcgctctgtcgcccaggctggagtgcagtggcatgatcttggctcattg

SEQ ID NO: 50009 - DNA, 119 bp, Homo sapiens
tttcttagtcattagagtatctcacagatgttctctgaatttcttgaatttgaatgtttgtttttgttatgtggagtatcgtggagatgtccgttaggtccatttggtgaaatgtgaag

SEQ ID NO: 50010 - DNA, 79 bp, Homo sapiens
tgttctcaccctcacactctgtgtcttacaattttttccctatggcactgttggaggtgcagacatgaggtcgattata

SEQ ID NO: 50011 - DNA, 135 bp, Homo sapiens
gtgtatatatatgtatatatgtatatgtatgtatatacatatatatgtgtatatgtatatgtatgtatatacatatatatgtgtatatgtatatgtatgtatatacatatatatgtgtatatgtatatgtatgta

SEQ ID NO: 50012 - DNA, 352 bp, Homo sapiens
atatgtgtatatgtatatgtatgtatatacatatatatgtgtatatgtatatgtatgtatatacatatatagtgtatatgtatatgtatgtatatacatatatagtgtatatgtatgtatatacatatatagtgtatatgtatgtatatacatatatagtgtatatgtatgtatatacatatatagtgtatatgtatatgtatgtatatacatatatagtgtatatgtatatgtatgtatatacatatgtatgtgtatatgtatatgtatgtacatatgtatgtgtatatgtatatgtatgtatatacatatatgtacacattcacacatatatacatacatatatttacac

SEQ ID NO: 50013 - DNA, 180 bp, Homo sapiens
gtgggtatacatgtatatatgtatatatacacacacacacctatatacatatgtgtatatatacatatatgcatatgtgtatatacacacatacatgtatattggtgtgagtgtaaatatatgtatgtatatatgtgtgaatgtgtacatatatgtatatacatacatatacatatacac

SEQ ID NO: 50014 - DNA, 118 bp, Homo sapiens
gctgggattacaggtgtgaaccactgtgcctggccgagatggagatgtctctttttttttttttgagatggagtctcgctctgtcacccaggctggagtgcactggcacgatcttggc

SEQ ID NO: 50015 - DNA, 119 bp, Homo sapiens
gagtaggtgtttgctttgaggagtttagactcttgcaggggagagcctgtgtgacgcacctgtctgtctctccctcatagcagtgaatcatgtgctgccttgatttaagtgcctgtctc

SEQ ID NO: 50016 - DNA, 78 bp, Homo sapiens
cgcaggcagggaacgcagtgcacgtgtgtaagtgtgtgtgtgagagagagagacagtgtgcgtgtgtgtgtgcttgtg

SEQ ID NO: 50017 - DNA, 75 bp, Homo sapiens
ggagcacatcccccacagcttttgctttgttattctatatataatcaagcatttcagctaagatggatgcgttcc

SEQ ID NO: 50018 - DNA, 88 bp, Homo sapiens
gcctctgaatagggggttatagatttatagataaatttaatgttatttttatataacaatctatactgtccaatgctatattcaaggt

SEQ ID NO: 50019 - DNA, 88 bp, Homo sapiens
gaggcagattcagcaagggagactctcactctgattcataagcacttggcgtttaatgtagaactctcttggtccaaactctgctctc

SEQ ID NO: 50020 - DNA, 117 bp, Homo sapiens
gcatcttccgtgtgtacctccctgggggctagtgttcagaaaaccctctgagaagagactcagatggtttgaacgtgcgccaagaacaccctggctgtgtgggccatgtctgactgc

SEQ ID NO: 50021 - DNA, 112 bp, Homo sapiens
agggctcatgcaatttgttaaaggcctaaatacaataaaaggctgagtgagaaaatattctttctctctgtctgactgtcttagagctgggatgtctgttgtatcctgccct

SEQ ID NO: 50022 - DNA, 95 bp, Homo sapiens; identical to SEQ ID NO: 68

SEQ ID NO: 50023 - DNA, 93 bp, Homo sapiens; identical to SEQ ID NO: 69

SEQ ID NO: 50024 - DNA, 101 bp, Homo sapiens
gggttaactttatctaattgtctttgttaaactacaaattttctttctttattttttccttttggaaagaagaactttgtttttcataaagggttgcaccc

SEQ ID NO: 50025 - DNA, 92 bp, Homo sapiens
tgtgtgtgtgtgtgtgtatacacatatatgcatatatatacacatacatgcgtgtgtgtatatatatgtgtgtatatacacacacacacgca

SEQ ID NO: 50026 - DNA, 70 bp, Homo sapiens
aagtctgcgttctctgttgtgtgtgaccactgaagtagtggttagctaattactggacagagattaactt

SEQ ID NO: 50027 - DNA, 63 bp, Homo sapiens
gtgctgtgtgtgtttctctgagtccgcgtgtgcgtgttcccagaaaactgagcaccgctgctc

SEQ ID NO: 50028 - DNA, 91 bp, Homo sapiens
cctgtccctgtcccagagggtgtccctgcctgctctgtgtccctgagagccaatgctgcagcatcctcccagagccagtcccaggtgacac

SEQ ID NO: 50029 - DNA, 60 bp, Homo sapiens
gggcagagactgagaccacctggttgtaaagcctgtgtgggtgtttgccagtctctgacc

SEQ ID NO: 50030 - DNA, 95 bp, Homo sapiens; identical to SEQ ID NO: 580

SEQ ID NO: 50031 - DNA, 93 bp, Homo sapiens; identical to SEQ ID NO: 69

SEQ ID NO: 50032 - DNA, 75 bp, Homo sapiens
atgtatatgtgtgtatatatatatatgtgtatgcgtgtgtgtattttatatatacatatatattataaatacata

SEQ ID NO: 50033 - DNA, 84 bp, Homo sapiens
agccaggggctgctctgactctgactctctgaggcgcctcaggaggtggggggatatttgacacaacagactccttatcaggct

SEQ ID NO: 50034 - DNA, 113 bp, Homo sapiens
ttcctggcctcggtctctagcgggcattgggtgctcaactgggacttttagggggtgctctgtccctctcagtggcccttctggcaagctggttacttctgagctgcatggag

SEQ ID NO: 50035 - DNA, 58 bp, Homo sapiens
tgagatggagtctcactctgtcacccaggttggagcgcagtggtgtgacctcagctca

SEQ ID NO: 50036 - DNA, 70 bp, Homo sapiens
gcagcagaaagaagtgtgtgtgcttatatgtgtgggagggttgatcgcaagtgtgcacatgtgtctgtgc

SEQ ID NO: 50037 - DNA, 74 bp, Homo sapiens
gtgtgtgtgcaggcgcgcatgtgtgtgtgcacgtgtgtgtctgtgtgtgtatctgtgtgtgtctgtatgtgcat

SEQ ID NO: 50038 - DNA, 98 bp, Homo sapiens
ccacccctaatcttgcttgctgtgtcacagtcactcagggccagtctattcccagtaggtggctggatgggtggctggatgaatggataaatgggtgg

SEQ ID NO: 50039 - DNA, 131 bp, Homo sapiens
tatatatatatatgtgtgtgtatatatatacgtatatatatatgtgtgtatatatatatacgtgtatatatatatatatatatacacgtatatatatatatatatatatatatatatatatatatatatat

SEQ ID NO: 50040 - DNA, 95 bp, Homo sapiens; identical to SEQ ID NO: 68

SEQ ID NO: 50041 - DNA, 93 bp, Homo sapiens; identical to SEQ ID NO: 69

SEQ ID NO: 50042 - DNA, 108 bp, Homo sapiens
ggctgccagaagtctcagcactgggcctctgcctgtggactttgtctgcctcagtcccagacactgacatacatgacaggcccctgggctgagggacccgttttccca

SEQ ID NO: 50043 - DNA, 76 bp, Homo sapiens
acagaatgctgggttggatggagggaaaacagcaagaggttggccaactctgagtgcatcctgaaagcgtccctgt

SEQ ID NO: 50044 - DNA, 63 bp, Homo sapiens
gtgtgtgtctggctgtgtctgtgtgtctcgagtgtgcacacacggtggtggcctgaggtgcat

SEQ ID NO: 50045 - DNA, 105 bp, Homo sapiens
tgatggtggtggccatgatagtgatgatggtggtgatattgatgataatgatgatgatggtggtggtgatgacgacgatgatgatggtgatggtgatgatggtgg

SEQ ID NO: 50046 - DNA, 58 bp, Homo sapiens
tgagacagtgtctcactctgtcgctcaggctggagtgcagtggtgtgatcttggctca

SEQ ID NO: 50047 - DNA, 81 bp, Homo sapiens
acttcacctctctgtctctgaggctcagcgccctcccctgaagcggggcaggggatggagccttggtgactgaggtgctgt

SEQ ID NO: 50048 - DNA, 89 bp, Homo sapiens
gccctgtgtgtcctgttgtaaacttgaggagagtagacctatatatatatatttagactagacctaaatagcagcgactcagtcagggt

SEQ ID NO: 50049 - DNA, 79 bp, Homo sapiens
ggttttggatggcacggggttgctcagatcacctggttctggctgagcagggaccactgtgcctgtgtcactgtgagct

SEQ ID NO: 50050 - DNA, 62 bp, Homo sapiens
gagacagggtctcactctcactctgttgcccaggctggaatgcagtggcgtgatcttggctc

SEQ ID NO: 50051 - DNA, 84 bp, Homo sapiens
gcctttctttggaatacacaactctgtctgtacagcctgtcttgcccacagtatcacagtcttgctatctcctcgctgaagggc

SEQ ID NO: 50052 - DNA, 95 bp, Homo sapiens; identical to SEQ ID NO: 68

SEQ ID NO: 50053 - DNA, 93 bp, Homo sapiens; identical to SEQ ID NO: 69

SEQ ID NO: 50054 - DNA, 95 bp, Homo sapiens
gatcagagaggggttgaaaaatctcttcatatgtgaagtttaacaaatgcctagaaaacttgtcacacattcaggatggacagactcctatgctc

SEQ ID NO: 50055 - DNA, 89 bp, Homo sapiens
gcagcctttcttggtgctgtctctgtgtttctcacaacccacagatcatggttttgggaaacagttattgagacatcatagattgccgt

SEQ ID NO: 50056 - DNA, 78 bp, Homo sapiens
aggtggcactgtctgtctctgtgctttccatgtaggaatgagaaaatctttcccagaggccacagcagattttcacct

SEQ ID NO: 50057 - DNA, 65 bp, Homo sapiens
ggataggattgttgtgtgttcctggcccaccataggctggtggctgtgccagtcagtctctctct

SEQ ID NO: 50058 - DNA, 76 bp, Homo sapiens
aatgtatatataatagacatacaatatagattgctgtatatatacaatattatattgtatatattatatgtacatt

SEQ ID NO: 50059 - DNA, 62 bp, Homo sapiens
agggcttctctctgagcctcagtctctctctataaagtgcggctgaagccagctcgagccct

SEQ ID NO: 50060 - DNA, 81 bp, Homo sapiens
cctggaccagacaggctgctgcaaaccctcagtcttcggatggacttgaagctgtcagtctgtggctctgtcaatcacggg

SEQ ID NO: 50061 - DNA, 99 bp, Homo sapiens
gccatggtggttcatgcctgtggtctcagcaagtcatgtggctgaggtagaaagatctcttgagcccaagaggtagaggctacattgagccatgatcac

SEQ ID NO: 50062 - DNA, 111 bp, Homo sapiens
gctgaggaggacaccactaccagcggtctctgaggctcctgggctgcctccctggctgcctgtgtcccactgaacagatcagggatgcagggacattcagtccagtgatgc

SEQ ID NO: 50063 - DNA, 72 bp, Homo sapiens
gagctggaagagtcaaggaagtgtcctcccctgaagcctctagagggagcgaagccctgtagacattggctc

SEQ ID NO: 50064 - DNA, 94 bp, Homo sapiens
aggaaatacatgtagatgtctagatatcgctgtatgtatatgtatatttacatacataatacatatatgtgtatatcaatatatgtatatttct

SEQ ID NO: 50065 - DNA, 73 bp, Homo sapiens
cctctgtctcacacacagtctggatggaaagtactgctgtccacgtcgggcctgctgttgtggggaaacgagg

SEQ ID NO: 50066 - DNA, 106 bp, Homo sapiens
gtgctaggctcatggagcagggaactcactcactctgtccacctgaggggaagaccagtgggcacttctctgagtgtgagccttgaaaagccttgggtgtgtgcat

SEQ ID NO: 50067 - DNA, 77 bp, Homo sapiens
caggaacaaatgaatgaatgaatgaatgaatgggtagccttctgcttcctcatcacttttttgtttgtttgtttttg

SEQ ID NO: 50068 - DNA, 84 bp, Homo sapiens
tctcactccgagttcacaggggagcttgtttgaaagagcctggtacctcctcccctctctcttgttcccactctcgccatgaga

SEQ ID NO: 50069 - DNA, 83 bp, Homo sapiens
gcagctggcaattccagcttgattaccaggtctccagttttgattagtaaattactgtggtaatcaaggttaattctcgctgc

SEQ ID NO: 50070 - DNA, 101 bp, Homo sapiens
cagcctgggtaacacggtgaaacccatctctagaaaaatttttatatatcttttgtttgttgtttgttttgagatggagtctccctctgtcacccaggctg

SEQ ID NO: 50071 - DNA, 91 bp, Homo sapiens
atcattgtggtagctataggttttgtgataattctgtagtttttttttttttgctgagttttgctatggcaggcatgttgcctcatgtgat

SEQ ID NO: 50072 - DNA, 152 bp, Homo sapiens
atatatagtatatattcatatatattgtacatatacatatatgtatatatccatatatatatctatgaatttgtatatgtatatatataagaatatatatataagaacatatatatatatatacaaacacacacacacacacaatggaatac

SEQ ID NO: 50073 - DNA, 130 bp, Homo sapiens
gtatatatatgatggaatatatatatacatgtatatatatgatggaatatatacacgtatatatatagtgtatgtatatacacatatatatttttattgtatatatattcattgtatgttgtatattgta

SEQ ID NO: 50074 - DNA, 166 bp, Homo sapiens
atatatatgtgtatatacatacactatatatatacgtgtatatattccatcatatatatacatgtatatatatattccatcatatatatacatgtatatatatattccatcatatatatatacatgtatatatatattccatcatatatatatacatgtatatata

SEQ ID NO: 50075 - DNA, 95 bp, Homo sapiens
gctggggcacatccttatctcctccacaggtaaagatataggagccggaggaagggagtcactcagtgcctgaggctgagaagggtgtgtcccgc

SEQ ID NO: 50076 - DNA, 62 bp, Homo sapiens
ggcactctcgctctctgcttcattaaactgccagttccttgaggtacagggggcattttgcc

SEQ ID NO: 50077 - DNA, 61 bp, Homo sapiens
gaggcttatcatccgagaggctctgtgctctcactcaccctctcaggagctggggagcttt

SEQ ID NO: 50078 - DNA, 106 bp, Homo sapiens
gagatggtaaggacgagctgggcttttagtgcatcagacaccctctctcactgttcagaaatgagaggatgcatctaagagggtctcaggagtggctttgccttcc

SEQ ID NO: 50079 - DNA, 105 bp, Homo sapiens
acagatgatttttgcaccaatgtacataataagattagactttttttgttttttaattttttagggtccaatctctttcaggtttgggtgtattgttgtatttgt

SEQ ID NO: 50080 - DNA, 95 bp, Homo sapiens; identical to SEQ ID NO: 68

SEQ ID NO: 50081 - DNA, 93 bp, Homo sapiens; identical to SEQ ID NO: 69

SEQ ID NO: 50082 - DNA, 76 bp, Homo sapiens
ctctggctgttaagattgtgatttttctttttttttttttttctgatggagcctcacactgtctcccaggctggag

SEQ ID NO: 50083 - DNA, 101 bp, Homo sapiens
tgcataagaaaataggatcaatggtcacctctgattggtgggatcttgagtgattcttctgattttgatgtttgatgtccaaattttctgacttccctgca

SEQ ID NO: 50084 - DNA, 116 bp, Homo sapiens
cagttccttcatggcaggaaactagtatgaatagtatgaaatgagaatagtgcataacatagaattatttttatttttatttttatttatttatttattttcttgagagagtcttg

SEQ ID NO: 50085 - DNA, 86 bp, Homo sapiens
agatgtttatccagtattattctgctggtcagctgcaagtgtacaggaagcttgatcaaagaacagactgagaagaaaagacattt

SEQ ID NO: 50086 - DNA, 115 bp, Homo sapiens
tgcggcatgcatgctccaaagagcaaacaccaaagtagcaagtactttttttctttttagaaggctgtgagggaaagcaggtgggtgagtggtaatgggagtggggaaggccaca

SEQ ID NO: 50087 - DNA, 93 bp, Homo sapiens
ggtagtgttcctgggagacagaagacagagtgttcatctttgccatatgcagagtgtctcttgcagttttctctttacctcactggcactgct

SEQ ID NO: 50088 - DNA, 83 bp, Homo sapiens
tattagacctttgggtatatggtttgtatacgtgtatgtatatatgtgtaaatataccatatatatattcaattttgttaata

SEQ ID NO: 50089 - DNA, 68 bp, Homo sapiens
tatgtatacattatgtttgtgtacacatatatgtatatattatatgtgtatattatatattatacata

SEQ ID NO: 50090 - DNA, 99 bp, Homo sapiens
ttactattataccattatggtgacctgtgagcagtgattttttttttttttttttttgagatggagtctctctctgtcgcccaggctggagtacagtgg

SEQ ID NO: 50091 - DNA, 75 bp, Homo sapiens
gctgcagcttctccatcagcatgtgctgcttcaccttgcacttttatgttatggagttggcttctttccttaagc

SEQ ID NO: 50092 - DNA, 58 bp, Homo sapiens
tgagacagggtctcactttgtcactcaggctggagtgcagtggcttgatcttgtttca

SEQ ID NO: 50093 - DNA, 114 bp, Homo sapiens
ggcagaataggaaggtggaatgcagcaagagcaagtagataggactaagtttatatatgtatatgaaatgtttagtgtttctgcaggtgtgccagtgaccactcctacactgct

SEQ ID NO: 50094 - DNA, 62 bp, Homo sapiens
tttacagggactctctcacattctgtcccacatggtcagaggaataagagggtttcaatgaa

SEQ ID NO: 50095 - DNA, 90 bp, Homo sapiens
ctctgccttattgggacgtgtgtccctcagactgtcccatcacccttaatgggccattttagtctgggggtcccctttttaaaggtagag

SEQ ID NO: 50096 - DNA, 119 bp, Homo sapiens
tatattatagttatatactatagtatgttattgcatagtatgtaagatataataatttaattatactatattgttacatatataatatatatattatggtataacatattatgattata

SEQ ID NO: 50097 - DNA, 119 bp, Homo sapiens
agcctgggcgacagagtgagacttcatctcaaaaaaaaaaaaaaaagtcacattttctttctttttttttttttttttttttggtgtttgagtcaaggtctggctctgttgcccaggct

SEQ ID NO: 50098 - DNA, 90 bp, Homo sapiens
taaggagcttctggactggggcagacggaggtttacagagctggcttgaagcaggttaccttttgcctgaagggaaggagttgctccttg

SEQ ID NO: 50099 - DNA, 116 bp, Homo sapiens
gtgtctttttttctgttgaaaaagtacagaaattgacagagatatcagtttatatttttcaaatgttctatatccacatctgttgttttctctgcttctctagggtgtcgtggtgc

SEQ ID NO: 50100 - DNA, 136 bp, Homo sapiens
acaatacaaaaattagccaggtgtggtggcgggcacctgtagtcctagctgctcaggaggctgaggtggaaggatcagttgaggccaggagttggaggctgccgtgagctatgattgtgccgttgcactccagcct

SEQ ID NO: 50101 - DNA, 96 bp, Homo sapiens
ttggtttgagggtttgagtccagtctttctttttttttgagactgagtctcgctctgtcacccagacgggagtgcagtggtgcaatctcagctcaa

SEQ ID NO: 50102 - DNA, 79 bp, Homo sapiens
acagcaagactctgtctcaaatatgtgtatatatatataaaaaatatatatatatatatagagagagagagagaactgt

SEQ ID NO: 50103 - DNA, 87 bp, Homo sapiens
gccctctcggtggcagaggtgacacgctggtttgatgtggttagttctgaggagcagcgcagttacttgcaaccaaagataaagggc

SEQ ID NO: 50104 - DNA, 89 bp, Homo sapiens
ccgtctggaaaactttggaaagaaaggctctataatattttattttattgtgtttatttttcagccggagtctcactcgcccaggctgg

SEQ ID NO: 50105 - DNA, 105 bp, Homo sapiens
aagacagtggagcctggctgggcctgggtccacagtgacatggcttgtgtgatgacacactcacagtcactagtccagacctacttgtcagctcccgacggtttt

SEQ ID NO: 50106 - DNA, 66 bp, Homo sapiens
tcggagtgactgtcacagtctctctaatgccccccatgggaggagacgctggcgcagccactttgg

SEQ ID NO: 50107 - DNA, 71 bp, Homo sapiens
gtgattcctcatctagacgttgcataaggtacaaaaaagtatatatatatgtgtgtacatgatggagttac

SEQ ID NO: 50108 - DNA, 119 bp, Homo sapiens
atatgtaatatatgtgtataatagatatatatgtatatatttgtatatgtatatatgtgcatatatgtatatatgtatatgtgtatcattacatgtctgttatacatacaaatacatat

SEQ ID NO: 50109 - DNA, 111 bp, Homo sapiens
actaatggcctttccaggaatggtcagaaagggcgttctttttaaaaatttttaaaaaaatttttttagagtcagggtcttactctgtcacccaggctggagtgcagtggt

SEQ ID NO: 50110 - DNA, 82 bp, Homo sapiens
cctgttatgtggtagttgctagaaaagcctagaaagaacaagactttttttttagacagtctcgctctgtcacccagcctgg

SEQ ID NO: 50111 - DNA, 205 bp, Homo sapiens
ttagtcttatgagagttccttatatgtaactagacatatatatatatatatatatatatatatatatatatatatgtctaaatatatattctaaatatatatgtctaaatatatgtatgtctaaatatatatatgtctaaatatatatgtctaaatatatgtatgtctaaatatatatatatatatttagaattctgtatttgac

SEQ ID NO: 50112 - DNA, 102 bp, Homo sapiens
acattgattttgtattctgcaactttactaaactttttttttttttatcagatctaagagtcgtttggtgaagtctagttttttctaaatataagatcatgt

SEQ ID NO: 50113 - DNA, 96 bp, Homo sapiens
gatagagaaataggtgatgagctgtgttcgggaagaaagagtccttgtttttaattattttagttttttctttttgagacggagtctcactctgtc

SEQ ID NO: 50114 - DNA, 80 bp, Homo sapiens
ctggggtggacctggaggggaacagggtcaagaaaggctttacttttttttttttgagacagtctcgttctgtcacccag

SEQ ID NO: 50115 - DNA, 112 bp, Homo sapiens
ccagtctgggcaacagagtgtgatcttgtctcaaaaataaataaaataaatacatttttaaaaagtatatattttttaagagacaggggtctcagtacgttgcccaggctgg

SEQ ID NO: 50116 - DNA, 109 bp, Homo sapiens
gctgcagcatgaaaatttccattggagcagacggattgagatttttttttttttttttttttttttgagacagaatctcactctgtcgcccaggctggagtgcagtggc

SEQ ID NO: 50117 - DNA, 151 bp, Homo sapiens
tgggtgacagagcgagactccgtctcaaaataaataaatacataaataataaataaataaaatttttatatttattcattttgaggctgggtcttgctgtgttgcccaacctggagttcagtggtatgatcacagctcactgcagcctcaa

SEQ ID NO: 50118 - DNA, 98 bp, Homo sapiens
ggtctcactgtgttgcctgggctggcctcgaactctttttttttttttttttgagacagagtctggctctgttgcccaggctggagtgcagtggcacc

SEQ ID NO: 50119 - DNA, 86 bp, Homo sapiens
ccagcctgagcaacatagaaggatcccatctctattttttttttttttttttttgagacagagtctcgctctgtcgcccaggctgg

SEQ ID NO: 50120 - DNA, 58 bp, Homo sapiens; identical to SEQ ID NO: 2051

SEQ ID NO: 50121 - DNA, 89 bp, Homo sapiens
ccagcctggcaaacatggtgaaaccccatctctctttttttttttttttttttttctgagatggagtctcactctgtctcccaggctgg

SEQ ID NO: 50122 - DNA, 111 bp, Homo sapiens
gtcagggctcctttaagcattggctgtaaggtctgaattttcttttctttttttttttttttttattgagacaagagtctcgctctgtcgcccaggctggagggcagtggc

SEQ ID NO: 50123 - DNA, 74 bp, Homo sapiens
catgtgcctgtgtctgtgcctcagtgccagtgacttcaagcttgagtctgctctgagccaggcgccactacatg

SEQ ID NO: 50124 - DNA, 92 bp, Homo sapiens
gctgctgtccttgggccctgggctcactcagcgtctctcagggacagtggcgcctctgggggaccttggtacagcccagatgtggacgcggc

SEQ ID NO: 50125 - DNA, 74 bp, Homo sapiens
tgagagtataagtgaaggactggcatgtctttttttttttttttttaagagacaggatctcactttgtctctca

SEQ ID NO: 50126 - DNA, 80 bp, Homo sapiens
ggggggcccagaaggggagcctgggggtgacccagtctgctgtctgtctgtccctcccacagcccccatctggactcccc

SEQ ID NO: 50127 - DNA, 100 bp, Homo sapiens
ctgtgtcagtgtgaataaacacatctgtgtgtgtatttgtgtgcagataggtatgttggtgtctgtatatgtgcacatgtgactgtgtttcctgacccag

SEQ ID NO: 50128 - DNA, 112 bp, Homo sapiens
ttggggaatgatggatgacccttcagaagaacaagtgatagcctgggacaaagtgttgacatattgttgacctccagcttcctctcctgtgatctgagttaaacagccttga

SEQ ID NO: 50129 - DNA, 60 bp, Homo sapiens
gtgagacagagtctcactctgtcacccaggctggagtgcagtgggatgactttgactcac

SEQ ID NO: 50130 - DNA, 99 bp, Homo sapiens
actacaatagaatctgtatggtaacattgcatttatatatatatatatatatatatatatatatatatatgaataaactacaacagaatctgtatggta

SEQ ID NO: 50131 - DNA, 62 bp, Homo sapiens
gtgtgtgtagagtgtgtgctcccggcccctgaaagcctgtggccacttgcattcatgcacat

SEQ ID NO: 50132 - DNA, 134 bp, Homo sapiens
ccaggagttgctgggcagcatagtgagaccttgcctctatgaattttttttttttctgagacagagtctcactctgtcatccaggctggagtgcagtggcacaatctcagctcactgcaacctccacctcccag

SEQ ID NO: 50133 - DNA, 70 bp, Homo sapiens
ggatgacagagtgagactctgtctcagaaaaaaaaaaaattcatagaggcaaggtctcactatgctgccc

SEQ ID NO: 50134 - DNA, 72 bp, Homo sapiens
ttgttttttgagatgtagtctcactctgtcacccaggctggagtgcagtggagagatcttggctcactgcaa

SEQ ID NO: 50135 - DNA, 69 bp, Homo sapiens
tgtttttgagaaggagtctcactctgtcacccaggctggagtgcagtggtgagacttcggctcactgca

SEQ ID NO: 50136 - DNA, 122 bp, Homo sapiens
atatatatataccatgcatatatatatatatatatttatatatataccatgcatatatatatatatatatatatatataccatgcatatatatatatataccatgcatatgtatatggctgg

SEQ ID NO: 50137 - DNA, 76 bp, Homo sapiens
ggaggctgaggaagaaggatcacttgagcccaggaggttgagcctgcattgagccatgattgtgcccctgcactcc

SEQ ID NO: 50138 - DNA, 97 bp, Homo sapiens
tcttttttgggtggagggtggttacatggttgtatacatttgtcaaaatgcatgggtgcattttattttgtaaaaattatgcctcaataagttggaa

SEQ ID NO: 50139 - DNA, 89 bp, Homo sapiens
tgggcatgggcttggggtagggttggtgcatgagggggtttgactttttttttttttttgcaatggagtctcactcagtctgtcgccca

SEQ ID NO: 50140 - DNA, 82 bp, Homo sapiens
tttgccgctcactctcagtctgtgggactcagtggcccaggaaaggggtggaaggggacacgactggacctgggcaagcaga

SEQ ID NO: 50141 - DNA, 118 bp, Homo sapiens
gtatgtgtatatatatgtgtgtgtgtacatgtgtgtgtatgtatatgtatatatttgtatatgtgtgtgtgtgtgtgtgtatatatatatatatatatatatatatatatatatatat

SEQ ID NO: 50142 - DNA, 82 bp, Homo sapiens
caagacagtgctcaagaaggaagccagtcttttatgcctaatctcataagaaggacagcctcacttctgctgtatgtaattg

SEQ ID NO: 50143 - DNA, 117 bp, Homo sapiens
gagcagctgagactacaggtgagtgccaccacgcttggctaatttttaaattttttgtagagacagggtttcatcatgttacccaggctggtatcgaactcctgggctcaagccatc

SEQ ID NO: 50144 - DNA, 58 bp, Homo sapiens; identical to SEQ ID NO: 1215

SEQ ID NO: 50145 - DNA, 74 bp, Homo sapiens
acctcagccttccgagtagctgggattacaggtgtacgcccagctaatttttgtatttttcatgaagatggggt

SEQ ID NO: 50146 - DNA, 60 bp, Homo sapiens
tgagacagggtctcactctgtcacacccaggttggagtgcagtgacacgatcttgtctca

SEQ ID NO: 50147 - DNA, 58 bp, Homo sapiens
tgagacagggtctctctctgtcactcaggctggagtgcagtggtgggatcttggctca

SEQ ID NO: 50148 - DNA, 103 bp, Homo sapiens
catctgctgtgtgccagacacctctttaagtacaggggatttagttgtgaacaagacagaagacagagtccttgctctttagagggagttcacagtctagatg

SEQ ID NO: 50149 - DNA, 119 bp, Homo sapiens
tggcaagtacttacatgtcaaaagtgtgttttagttcttgagatgtaatagaagctagtcattttttgaatatttactagattttgaggaaatatattgatttggcttggatattttca

SEQ ID NO: 50150 - DNA, 115 bp, Homo sapiens
gggtgtgattgttgctgggactgggcacgtggctgcctctgtctctgcctctgtgtctgatagagacaggaagagatgggggaggcctggtgtgggggccctgcgggacagggcc

SEQ ID NO: 50151 - DNA, 70 bp, Homo sapiens
cccaaaatgctgggattacaggcgtgagccaccgcgcctggccgtttgtttttgtttttgtttttttggg

SEQ ID NO: 50152 - DNA, 70 bp, Homo sapiens
gagtcctcagtttctggtcctgggaaagtaagtcagatctgactctgtttctctgggagggaaacggctc

SEQ ID NO: 50153 - DNA, 122 bp, Homo sapiens
gctaggacttccagtactattttgaataaaagtgatgaaagtggccattcttgtcttgctccagattttagaggatgacatttcaacttttctttattcagtatgattttggcgatgggttt

SEQ ID NO: 50154 - DNA, 119 bp, Homo sapiens
gagagataggggtctagtttcattttttttggcatacggatatccagtttttcaggcaccattgactgaagagactgtccattcaccagtaaatgttcttggtgcctttgttgaaaatc

SEQ ID NO: 50155 - DNA, 69 bp, Homo sapiens
ggtcctggcatagaaagtgcacgatctggtcatgtcatgcaggtgaggatacttgtgtgccaggtaacc

SEQ ID NO: 50156 - DNA, 117 bp, Homo sapiens
gatcacgccactgccctccagcctgggggacaaagccagaccctgcctctctttttttttttttttggagacagtctcattctgtcaccgaggttggagggcagtggcgtgatctgg

SEQ ID NO: 50157 - DNA, 100 bp, Homo sapiens
ggaggaaaagacatatttcattgaattgtgtttttgttcaatttattacttttacaatttagacccaggaatacagttctccagtgtacttttacactcc

SEQ ID NO: 50158 - DNA, 119 bp, Homo sapiens
gtagatatatatgtgcatgtatatatacacatatatgtgagtatgtgcatatatatacatgcatatatatatatataaatgtctatctatatgtacacacacacatatacacaaaatgc

SEQ ID NO: 50159 - DNA, 76 bp, Homo sapiens
ctttaggatatgctgggttagtggtcctaattccaaaagaggccactgttgactgggacacagcaggatccttttg

SEQ ID NO: 50160 - DNA, 92 bp, Homo sapiens
gcctctgatagagttcctgcgtgtaacttaaccactaattctgaccgcggctctgtgtgtcactgtaagttacctgtgtgtgtctggggctc

SEQ ID NO: 50161 - DNA, 116 bp, Homo sapiens
gactgcacctctctgagcctctgtaaaatggagatgggaacactcagaccctctcacagggttgctggagaggaaatgagttaacacccgtaacatgcttggatgagctcgcagcc

SEQ ID NO: 50162 - DNA, 58 bp, Homo sapiens
tgagactgagtctcattctgtcacccaggctggagtgcagtggtgtgatctcggctca

SEQ ID NO: 50163 - DNA, 58 bp, Homo sapiens; identical to SEQ ID NO: 1409

SEQ ID NO: 50164 - DNA, 81 bp, Homo sapiens
cagtaatggtgccctcggagcctgaggttgtttttttttttctttctttagagacagggtctcactctgtggccctggctg

SEQ ID NO: 50165 - DNA, 79 bp, Homo sapiens
gtggcttctctctctgtcactccacactccagggctggctgagcctgtgagggtggtggtcagggggacccggagccac

SEQ ID NO: 50166 - DNA, 71 bp, Homo sapiens
gaggggactgctgagcctcagagacatctggcagcaccaggaggtgggtccctctctctgtggctcctctc

SEQ ID NO: 50167 - DNA, 59 bp, Homo sapiens
ccggcacagtgagagacagagacagattcacagagcagagctggcttctcactggcagg

SEQ ID NO: 50168 - DNA, 83 bp, Homo sapiens
ggccatgtgagaagtcagtgcagagtcaggagacgcgggccccagctctgtcgctgactttgccttctaagtgcgggtgggcc

SEQ ID NO: 50169 - DNA, 70 bp, Homo sapiens
atatacatatatgtgtgtgtatatatatacgtgtatatatatgtatatatgtgtatgtatatatatatat

SEQ ID NO: 50170 - DNA, 79 bp, Homo sapiens
ggacctcagtgtctgcatttggtcctgggtctccgttgtcctccgtgtccctctctgtttgtgacagtctctctggttc

SEQ ID NO: 50171 - DNA, 116 bp, Homo sapiens
tctctgtgactgtatctgctcttgtgtatttctgtgtcactccctatctctgtgtatcttcagtctctcagtgtcgccgtgccccttcatctgcttgtgcctagagtggcagcaga

SEQ ID NO: 50172 - DNA, 58 bp, Homo sapiens
tgagatggagtctcactctgtcacccaggctggagtgcagcggtgtgatctcagctca

SEQ ID NO: 50173 - DNA, 114 bp, Homo sapiens
actaaaaaggcagtgaacagactttctggagtaaggggaagtgttacatggatgtatagagttgtaataatccaagaaattgaacttcagaaacttgtgcattaataggtgagt

SEQ ID NO: 50174 - DNA, 168 bp, Homo sapiens
cctgagtagctgagacaacaggcatgcaccaccacacacaaataattttttttttctagagacgggtttttgttgttgttgttgttttttgagatggagtctcactctgtcacccaggctggagtgtagtggcgcgatctcggctcactgcaacctccacctcctggg

SEQ ID NO: 50175 - DNA, 79 bp, Homo sapiens
tgacaatctgagggtgattttgatcttacagctggcttttttttttttttggagacagtctcgcagtctccctctgtca

SEQ ID NO: 50176 - DNA, 121 bp, Homo sapiens
agggtctgtccccctccagcccataaggttccccaaggcaggatgggagctgactctctctgtgcctggagcgtggggcctgcacagaggcggtctcagtgaatgtctgctaagtgaggga

SEQ ID NO: 50177 - DNA, 81 bp, Homo sapiens
ccacctggcaaggtggccaggacttgtgtgactttttttttttttttttgagacggagtctcactctgtcacccaggctgg

SEQ ID NO: 50178 - DNA, 58 bp, Homo sapiens; identical to SEQ ID NO: 605

SEQ ID NO: 50179 - DNA, 116 bp, Homo sapiens
caccctggctgggcacaggttgattcctgctcatggatacattttattttattttcatttttatttatttatttactttttttgagatggagtctcactctctgtcacccaggctg

SEQ ID NO: 50180 - DNA, 73 bp, Homo sapiens
gggggcaggagaaagagaaacaagaggcagtgatgcagagagggacctgccttggttgccggctcttgccctc

SEQ ID NO: 50181 - DNA, 64 bp, Homo sapiens
gtctgtccctgtgactgtcacttctgcctccagagagtagaggatgagctcactggcctcagat

SEQ ID NO: 50182 - DNA, 82 bp, Homo sapiens
gctgggattacaggagtgagccaccacacccagccaaaaatttttttttttttgagtcggagtctcactctgtcccctaggc

SEQ ID NO: 50183 - DNA, 107 bp, Homo sapiens
cccctcaacaattctgggatctttctgttaatacatgtggatttcatttgttgcattttacagatatatagtattacataagaatttcccatattgttcgtgatggg

SEQ ID NO: 50184 - DNA, 91 bp, Homo sapiens
gtttgtttttagagagggagtctcactctgtcacccaggttggagtgcagtggcacgacttctgctcactgcaagctccgcctcccgggtg

SEQ ID NO: 50185 - DNA, 56 bp, Homo sapiens
tgagacagtctcgctctgtcacccacgctggagtgcagtggcgggatctcggctca

SEQ ID NO: 50186 - DNA, 112 bp, Homo sapiens
tcagtactcagatacctgttggtgagctgatgtgttatttttattttatttttttttagtgaatcatgcatgccagttttcgctcactggaatagaaattctgggtttcaga

SEQ ID NO: 50187 - DNA, 86 bp, Homo sapiens
aagagatgattaagttaaaatgaggtagttagggtgggtcctaatcctatatgactgttgtccttattttatcttttttttttttt

SEQ ID NO: 50188 - DNA, 99 bp, Homo sapiens
tccagttttggcagaaggcacaggaaatgggattttttttttttttttttttttttttttttttttgagacagagtctcgctgtgtcacccaggctgga

SEQ ID NO: 50189 - DNA, 98 bp, Homo sapiens
caataaataacagtgcagcctggcattcggggccactatcagtctctgtgtcttggtggtagtggctcacccgggcccaggtgtcttttatctctttg

SEQ ID NO: 50190 - DNA, 81 bp, Homo sapiens
ctagctgggactacaggtgtgagccaccttgcctgggaaattttttgttttttttgagtctcactttgtcactcaggctgg

SEQ ID NO: 50191 - DNA, 115 bp, Homo sapiens
ttttagctaggtatagaatcataggttttgaagatgttttgttttcagcatttgaaatcactgaaaataaagattagtagtattagagttagtgatactgagccaggagctaaaa

SEQ ID NO: 50192 - DNA, 77 bp, Homo sapiens
ggaagaagactgagagaggagatggtgaatgatatatccactattttttttttttttaataaagagagtcttgttct

SEQ ID NO: 50193 - DNA, 61 bp, Homo sapiens
cagcacatgcagtgatgccacagatactttttattttttgtggtagccactgaaatgtctg

SEQ ID NO: 50194 - DNA, 65 bp, Homo sapiens
gtgctggtgtgtgcctctggtttcagcttacttggtaggctgaggtaggaggatcacttgagcac

SEQ ID NO: 50195 - DNA, 107 bp, Homo sapiens
gtgctaggaatacaggagtgagccactgcacccaacctatatttgtatatacattaaattgtatatgctaagccgggcacggtggcttactcctgtaattccagcac

SEQ ID NO: 50196 - DNA, 100 bp, Homo sapiens
gtgctgatgatattgctgtacttggaatggactggtcctttcatttcctggatttgtctctttgttcttttgagttcaggcataacttatgttaatacac

SEQ ID NO: 50197 - DNA, 103 bp, Homo sapiens
gcctggttgtttttatttatttattaatctttatttttaattttttgggtacatagtaggtatgtatatttatgggttacatgagattttgatacaggcaggc

SEQ ID NO: 50198 - DNA, 74 bp, Homo sapiens
tcggtctgggtcataggctaagttctttttttttttttttttgcgacggagtctcgctctctcacccaggctgg

SEQ ID NO: 50199 - DNA, 118 bp, Homo sapiens
ctgggcaacagagtaagaccctgtgtcaaacaaacaaacaaaaaaggaagaaagaacaatcgtttctttttttttttttttttttttttttgagacagagtctcgctctgtcgcccag

SEQ ID NO: 50200 - DNA, 82 bp, Homo sapiens
gcatgttcaataaattcaagagccaatttcagagatcgtaggttttggctttctttgttgactatttgtatttgtgaacggc

SEQ ID NO: 50201 - DNA, 109 bp, Homo sapiens
cattaatctgagagctggaaggacccttagaccagccccccagtaacagatgagactctgctctgggattatagcctaaggtaatgccctgagcttttctagagatttg

SEQ ID NO: 50202 - DNA, 58 bp, Homo sapiens; identical to SEQ ID NO: 605

SEQ ID NO: 50203 - DNA, 71 bp, Homo sapiens
gttgttttgagatggagtctcactctgtcacccaggtggagtgcagtggtgcgatctcagctcacggcagc

SEQ ID NO: 50204 - DNA, 104 bp, Homo sapiens
gggtgtgtgtgtgtgtgttggggggatgcgtctgtgtgtgtgtctgtgtgtgtgcgcgcgcagtgcgtgtctgtgtgccgacttctgtctctctctcacgtctc

SEQ ID NO: 50205 - DNA, 104 bp, Homo sapiens
gggtgtgtgtgtgtgtgttgggggggtgcgtctgtgtgtgtgtctgtgtgtgtgcgcgcgcagtgcgtgtctgtgtgccgacttctgtctctctctcacgtctc

SEQ ID NO: 50206 - DNA, 104 bp, Homo sapiens; identical to SEQ ID NO: 50205

SEQ ID NO: 50207 - DNA, 106 bp, Homo sapiens
gggtgtgtgtgtgtgtgtgttggggggatgcgtctgtgtgtgtgtctgtgtgtgtgcgcgcgcagtgcgtgtctgtgtgccgacttctgtctctctctcacgtctc

SEQ ID NO: 50208 - DNA, 104 bp, Homo sapiens; identical to SEQ ID NO: 50205

SEQ ID NO: 50209 - DNA, 104 bp, Homo sapiens; identical to SEQ ID NO: 50205

SEQ ID NO: 50210 - DNA, 96 bp, Homo sapiens
gattacagacataagccactgcacctggccaatactcacatattttattttattaaaaaaatttttggctgggcatgatggcttatgcctgtaatc

SEQ ID NO: 50211 - DNA, 58 bp, Homo sapiens
tgagacggagtctcgctctgtcgctcaggctggagtgcattggcgcgatctctgctca

SEQ ID NO: 50212 - DNA, 111 bp, Homo sapiens
gcatggcatggtggtgtgtgcctgtagtccaaactacctggaaggctgaggtaggaggatctcttgagcccaggagtttgagactgcagtgagctatgctggtgccactgc

SEQ ID NO: 50213 - DNA, 58 bp, Homo sapiens; identical to SEQ ID NO: 315

SEQ ID NO: 50214 - DNA, 99 bp, Homo sapiens
tgtggagcagtagtagttctgaggattaaatgagataatgacacaatgagataaccatgtgtgacagtctctctatctttgtgctaatacggctgtgtg

SEQ ID NO: 50215 - DNA, 107 bp, Homo sapiens
tatcgaaacgtatccctggaaaaaatgtactcaactcaaatatgatatattttatatttaatgtgcttctgggtcacttttttccttttgggtcattttgatgtttt

SEQ ID NO: 50216 - DNA, 110 bp, Homo sapiens
gctgggattacaggcatcagccaacatgcccagactacccagcttatttttaaattttttgtaatgatggagtttcgctatgttgcgcaggctggtctcaagatcctggc

SEQ ID NO: 50217 - DNA, 59 bp, Homo sapiens
caaagacccttgtgtctgagtcactccctgagccaaggaatgactcagatacaagtttg

SEQ ID NO: 50218 - DNA, 66 bp, Homo sapiens
tgagacggagtctcgctctgtcgctctgtcacccaggctggagtgcagtagcgcgatctcggctca

SEQ ID NO: 50219 - DNA, 71 bp, Homo sapiens
gtgggaaggctttcacttgtgtttctgattttaatagacatcagagaattcacactggtgaaaaaccctat

SEQ ID NO: 50220 - DNA, 77 bp, Homo sapiens
aggacacgtgctgggggactggggtgggttctggccatctgcctctctgtgcgtctatctctgtctccgtgtgtctt

SEQ ID NO: 50221 - DNA, 85 bp, Homo sapiens
cacatactatcatattatatttggatgttgccattatcactctaaccataaactggtaatctatttatatttttaatagtatgtg

SEQ ID NO: 50222 - DNA, 102 bp, Homo sapiens
accccacttgtcatggtgtataattcactttatatattgttaaattctactttgtaatattttgttaaggatttttgcacgtcttcatgagggatatggggt

SEQ ID NO: 50223 - DNA, 75 bp, Homo sapiens
gtgagcctccgtgtctggctaaggtatgttttttaacaatttatataaatactctttcacatggaggaggtttgc

SEQ ID NO: 50224 - DNA, 85 bp, Homo sapiens
gccaatttcagagaagaaataagtggtcaacaacaagttcttaggttttgactttatttgttgactatttgtatttgtgaatggc

SEQ ID NO: 50225 - DNA, 95 bp, Homo sapiens; identical to SEQ ID NO: 68

SEQ ID NO: 50226 - DNA, 93 bp, Homo sapiens; identical to SEQ ID NO: 69

SEQ ID NO: 50227 - DNA, 58 bp, Homo sapiens
tgagacggagtctcactgtgtcacccaggctggagtgcagtggcatgattttggctca

SEQ ID NO: 50228 - DNA, 83 bp, Homo sapiens
ggtctcactctgtcactcaggctggagtgcagtggcatgatcacagttcactgcagcctccaactcctgggctcaggtgatcc

SEQ ID NO: 50229 - DNA, 109 bp, Homo sapiens
cccaggagtttgagaccagcctgggcaacatggtgaaaccccatctctacaaattttttttttttttgggttggagtctcactctgtcacccaggctggagtgcagggg

SEQ ID NO: 50230 - DNA, 118 bp, Homo sapiens
gagagactgcatctcaactccaccatgcccttgtcagaggaaatatggcaagttactgaacctctctgtgcctctgtttctgcctctgagaagagggggtgataacaatgcccatttc

SEQ ID NO: 50231 - DNA, 58 bp, Homo sapiens; identical to SEQ ID NO: 2540

SEQ ID NO: 50232 - DNA, 74 bp, Homo sapiens
ttgtttgttttgagacagagtctcactctgtcatccaggctggagtgcaatggcccgatctcagctcactgcaa

SEQ ID NO: 50233 - DNA, 58 bp, Homo sapiens; identical to SEQ ID NO: 8307

SEQ ID NO: 50234 - DNA, 58 bp, Homo sapiens
tgagaccgagtctcactgtgtcacccaggctggagtccagtggtgtgatcttggctca

SEQ ID NO: 50235 - DNA, 67 bp, Homo sapiens
gcatatgtgcatgtgcttgtgtgtgcctgtgtgagtgcaggtgtgtgcatgtgttatgtgcatgtgt

SEQ ID NO: 50236 - DNA, 108 bp, Homo sapiens
cctgagcagtgaatagcagaagggatgtggctgggcgggggaaagttcggttggtctgtctgtctgtccgtctgtccatccatctgtctgtccgtccatcctcccagg

SEQ ID NO: 50237 - DNA, 114 bp, Homo sapiens
tggctgcttttggggagggagcaggatggctgagggccagggaagggagagaggcttactttttttttttttttgagacggagtctcgctgtctcccaggctggagtgcagtgg

SEQ ID NO: 50238 - DNA, 70 bp, Homo sapiens
gccacttggatggagctggagacattattcttttttttgtttgtttgagaggaaggtcttgctctgtggc

SEQ ID NO: 50239 - DNA, 74 bp, Homo sapiens
ggagcgggtgtgtgggtgcctggaggcccagggcagttcttcctctggtgaccagtgtctgtgtgtctgtctcc

SEQ ID NO: 50240 - DNA, 68 bp, Homo sapiens
ttttgtttttgtttttgttttgggacagagtctcactctgtcacccaggctacaggacagtggcaaaa

SEQ ID NO: 50241 - DNA, 102 bp, Homo sapiens
ttgacacggagtcttgctctgtccccaggctggagtgcagtggcgcgatcttggctcactgcagtctgtgtctcccgggctcaagcaattctcctgcctcag

SEQ ID NO: 50242 - DNA, 85 bp, Homo sapiens
gatgcctaatgcctgatgatctgtcactgtctctcatcacccccagatgggagcatccagttgcaggaaaacaagctcagggctc

SEQ ID NO: 50243 - DNA, 104 bp, Homo sapiens
agttcctgcggacggtgcgtatctctgggttaggggcctgtggggctatctcttggggctctctgagggtctctctgtctctgaatgtccctgtccggcttgct

SEQ ID NO: 50244 - DNA, 103 bp, Homo sapiens
gctcccccctcatagtagacaagtctggggacacagaagagagtgaagtcaagggttcagctccccggaatctggtccctaatcctactcatagggtcccagc

SEQ ID NO: 50245 - DNA, 87 bp, Homo sapiens
tgtcccctcttaacctcactctttgtgtgtctgcgtccttgttctctgtggctgtgagaccacaaaccttgggtgatactccagaca

SEQ ID NO: 50246 - DNA, 110 bp, Homo sapiens
ggagtttagaggttaggggtcatgtgtatattattgttattattttttgagaagggtctcgctctgtcagtgaagctggagtatagtggctcactgcagcctctgccccc

SEQ ID NO: 50247 - DNA, 107 bp, Homo sapiens
cattgtgtgacctcggacaaatgcttttccctctctgcgtctcggtctccctctctgtaaaacgggtgggtctgggggagtcttgcgggagtgaggttgcggcagtg

SEQ ID NO: 50248 - DNA, 102 bp, Homo sapiens
ggcatggtggcatacacctgtagtcccagctactcaggaggctgaggtaggaggatggcttgagcctaggaggcagaggttgcagtgagttgacatcatgct

SEQ ID NO: 50249 - DNA, 117 bp, Homo sapiens
gttgggattacagaagtgagccaccacacttagctgctttttttttttttttaacacaacaatacaccatgaaagacatataggccgggtgtggtggctcatgcctgtaatcccagc

SEQ ID NO: 50250 - DNA, 58 bp, Homo sapiens
tgatatggagtcacactctgtcacccaggctggagtgcagtggcgtgatctcagctca

SEQ ID NO: 50251 - DNA, 75 bp, Homo sapiens
ctccaaactctgagtgagaaatgggaggtgcatttttttttttgagacagtctccctctgtcacccaggctggag

SEQ ID NO: 50252 - DNA, 270 bp, Homo sapiens
atatatgtatacatgtatatgtgtgtatatatgtatatgcgtatatatgtacatgtgtatatatgtatatatgtataggtgtgtatatatatgtatatgtgtatatatatgtatatgcgtatatatgtacatgtgtatatatatgtatatatgtatatgtgtgtatatatatgtatatgtgtatatatgtatatgcgtatatatgtacacgtgtatatatgtatatatgtatatgtgtgtatatatgtatatgtgtgtatatatgtatgt

SEQ ID NO: 50253 - DNA, 282 bp, Homo sapiens
atgtgtgtatatatgtatatgtatatatgtatatgcgtatatatgtgcatgtgtatatgtgtgtatatatgtatgtgtatatatgtatatgcgtatatgtgtacatgtgtgtatatatgtacatgtgtatataagtatatatgtacatgtgtatatatgtatatgtgtatatatgtatatgcgtatatatgtacatgtgtatatatgtatatatgtatgtgtgtatatatgtatatgtgtatatatgtatatgcgtatatatgtacatgtgtatatatgtat

SEQ ID NO: 50254 - DNA, 370 bp, Homo sapiens
atatatatgtatatgcatatatatgtacatgtgtatatatgtatatgtgtgtatatatgtatatgtgtatatatgtatatgcgtatatatgtacatgtgtatatatgtatacatgtatgtgtgtgtgtatatgtatgtgtatatatgtatatgcgtatatatgtacatgtgtatatatatgtgtatatgtatatgtgtatatatgtatgtgtatatatgtatatgcgtatatatgtacatgtgtatatatgtatacatgtatatgtgtgtatatatgtatatgcgtatatatgtacatgtgtatatatgtacatgtgtatatatgtacatgtgtatatatgtatatgtgtatatgtatatgcgtatatat

SEQ ID NO: 50255 - DNA, 58 bp, Homo sapiens; identical to SEQ ID NO: 1847

SEQ ID NO: 50256 - DNA, 65 bp, Homo sapiens
ttgagacagagtctggctctgtcacccagaccgaagtgtggtggcatgacctcggctcacctcaa

SEQ ID NO: 50257 - DNA, 58 bp, Homo sapiens
gtgtatatgtatatgtgtatatgtgtgtgtatatatgtatatacatatatatatatcc

SEQ ID NO: 50258 - DNA, 74 bp, Homo sapiens
gtcctgaccctgctgtctctctgtccctcggacccaagtgggagttgtttaggcgagagagagggtcgaaggac

SEQ ID NO: 50259 - DNA, 74 bp, Homo sapiens; identical to SEQ ID NO: 50258

SEQ ID NO: 50260 - DNA, 92 bp, Homo sapiens
ccagcctgggcaacacaggaagacctgcctctaagaaattttttttttttttttttttctgagacagagtctcactctgtcacccaggctgg

SEQ ID NO: 50261 - DNA, 74 bp, Homo sapiens
gtgacagagtgagactctgtctcagaaaaaaaaaaaaaaaaaaaatttcttagaggcaggtcttcctgtgttgc

SEQ ID NO: 50262 - DNA, 56 bp, Homo sapiens
gagacaaggtctcactctgtcacccacgctggagtgcagtggcatgatcttggctc

SEQ ID NO: 50263 - DNA, 123 bp, Homo sapiens
gcctgccatgattctgggattttggtcctccctggcatcgaccctgctgaatccagacagtagagactggggagttgcttgttggtgtcaggggatctctgaaaaccatgggctcaggtcgtg

SEQ ID NO: 50264 - DNA, 114 bp, Homo sapiens
tctggttgctctgtggccccctaggaatgttcataaaggcagaacatcactgtctcagtctgtttgtgctgctgtgacaacatatctatgactgggtaatttacaaaaaacaga

SEQ ID NO: 50265 - DNA, 62 bp, Homo sapiens
tgagacggagtctcactcactcttttgcacaggctggagtgcagtggtgcaatctctgctca

SEQ ID NO: 50266 - DNA, 58 bp, Homo sapiens; identical to SEQ ID NO: 315

SEQ ID NO: 50267 - DNA, 58 bp, Homo sapiens
tgagacaaggtctcgctctgtcactcagagtggagtacagtggcgcgatcatggctca

SEQ ID NO: 50268 - DNA, 91 bp, Homo sapiens
gaaggaagacaggtaggtcggttcttgggttggtctggattccagtcttgacagctgcttgggcctctctctgcctcagtgtcttcctctc

SEQ ID NO: 50269 - DNA, 58 bp, Homo sapiens; identical to SEQ ID NO: 1391

SEQ ID NO: 50270 - DNA, 56 bp, Homo sapiens; identical to SEQ ID NO: 1392

SEQ ID NO: 50271 - DNA, 118 bp, Homo sapiens
gtctctctgatctctgctgatatgtgaggtgtggcccccctcagcctagttttcatttgtatttttctatttagtagggttgagcatttttcatatttataaaagccatcagaatgtc

SEQ ID NO: 50272 - DNA, 115 bp, Homo sapiens
ttgcacgagggcagaagtttccgtgagactgtgcctcactcagtcactctgggtgaccctggagttgactgggtgtgcctaggtccatggaggtctccttgcctactgtgtgtgg

SEQ ID NO: 50273 - DNA, 102 bp, Homo sapiens
ttacatgatcattatcactggggcgtgacttctgtcccccacccgctgagtgtctgtgagtgtctgagcgttggggcaggaagtgcctgtgaaagcatgtgg

SEQ ID NO: 50274 - DNA, 56 bp, Homo sapiens
tgagacagtctcactctgtcacccaggttggagtgcagcggtgtgaccttggctca

SEQ ID NO: 50275 - DNA, 60 bp, Homo sapiens
ttgagacagggtctcactctgtcacccaggctggagtgcagaggcacgatcttggctcag

SEQ ID NO: 50276 - DNA, 60 bp, Homo sapiens
tgggattacaggtgtgagccacctcttcttttttgagatggagtctcactctgtcaccca

SEQ ID NO: 50277 - DNA, 102 bp, Homo sapiens
gcactgcagacaggagtgagggcagaggccaaggcgaggagggggccggctcccactctctctcccactgtgtgtgctgtgccttcacgctccgagcattgc

SEQ ID NO: 50278 - DNA, 83 bp, Homo sapiens
ggtgaccaaaagacaagagtgtgagccctctgtcacgcccggataaaggccgtttgagggctccttggtctagcggtagcgcc

SEQ ID NO: 50279 - DNA, 112 bp, Homo sapiens
gccaggagttcgagactagcctgggcaacatagcaagaccttgtctctattttttttttttttttgttagagacagagtctcgctctgttgcccaggttggagtgcagtggc

SEQ ID NO: 50280 - DNA, 86 bp, Homo sapiens
agaaattggaggcagcaatgtagattattcttttgagaaatcttttttttttttttgagaaggagtctcactctgtcacccaggct

SEQ ID NO: 50281 - DNA, 73 bp, Homo sapiens
agccatggtgtccggcagggaggaacttttttttttttttttttttacggagtctcgctctgtcacccaggct

SEQ ID NO: 50282 - DNA, 58 bp, Homo sapiens
tgagacagagtctcactctgtcacccaggctggagtgcaatggagtgatctcggctca

SEQ ID NO: 50283 - DNA, 112 bp, Homo sapiens
gcaggcatggtggcatgtgcacctgtagtctcagctattcaggaggctgaggtgggaggatgacttgagcttggtaggtggactgtgcagtgagctatgattgcaccactgc

SEQ ID NO: 50284 - DNA, 111 bp, Homo sapiens
gagatgggtttttgccatgttacccagcctgttctcaaattcctgggctcaagtgatccaccagccttggttgcccaaagcgctgggattacaggcatgagccactgtgtc

SEQ ID NO: 50285 - DNA, 162 bp, Homo sapiens
acatatatgtatatacgtatagtgtatatatgtatatatacgtataagtatatatgtatatatacgtataagtatatatgtatatgtgtatatatacatgtatatatgtatatgtgtgtatatgtgtatatatgtatatgtatgtgtgtatacatatgtatt

SEQ ID NO: 50286 - DNA, 58 bp, Homo sapiens
tgagacacagtctcactctgtcactcaggctggagtgcagtggtgtgatcttggctca

SEQ ID NO: 50287 - DNA, 78 bp, Homo sapiens
ctggactgcagtgatcctcacacatctgccccctcttgtgtagctggggtgaaaggtgtctgccactctgccagtcag

SEQ ID NO: 50288 - DNA, 71 bp, Homo sapiens
ggttgcatagtattccattgtgtgtgtgtatatatatatatacctacacacacaatggatatatatgtacc

SEQ ID NO: 50289 - DNA, 119 bp, Homo sapiens
ttgttctttttgcttaggattgtcttggctatgcaggctctttttttggttccatatgaaatttaaagtagtattttccaattctgtaaagaaagtcagtggtagcttgatggggatag

SEQ ID NO: 50290 - DNA, 79 bp, Homo sapiens
ggtctctctctgtctcccagcccaagctgtctatcccgttctgggagaagagggtgagcagattctggcttactaggga

SEQ ID NO: 50291 - DNA, 122 bp, Homo sapiens
tgtcgtttctgctgcatcacaggcacaggcctccaaacaggtgtggttgtgactgagtctgtttctgacaccccaccccttctcactgtgtgaggaaaccttcctgggaggggcttggaatc

SEQ ID NO: 50292 - DNA, 85 bp, Homo sapiens
atgaatgtttgtgtgtacttatgagatcaattttatttttttgtcgttaaaataattggtctcgtattatgcatgttttcttcat

SEQ ID NO: 50293 - DNA, 64 bp, Homo sapiens
gagacctgtgacttcagaagagactcagcacattcctgtctgtggctgttatgaggcaaggctc

SEQ ID NO: 50294 - DNA, 101 bp, Homo sapiens
ctcagatcagatttgtggaagtagagctggtagaattggtcagaatatttatatgttttacaggaaaagcaaactgtatttcctggtgaattagatgtgag

SEQ ID NO: 50295 - DNA, 114 bp, Homo sapiens
gatcaattactgacttaatctggtgaactggacaggcgtgactttttttttttttttttttttttgagagacagtctcactttctcacccagactagagtgcagtggcgcgatc

SEQ ID NO: 50296 - DNA, 77 bp, Homo sapiens
cctgggaaggagggacagtgattctggatgcctgggttccaagaagggagtgaggacagctggtggccattccctgg

SEQ ID NO: 50297 - DNA, 72 bp, Homo sapiens
gtgtcctgtaatcaagaggtctggtgagggatgcagcctctgactctgacagtcttcacaattgcagcacac

SEQ ID NO: 50298 - DNA, 108 bp, Homo sapiens
gacttcgggcaaatgactttacctttctgtgcctcagtttctctgtctgtataaggggcctattaagagaactcaccaggccaggtgcggtggctcacgcctgtaatc

SEQ ID NO: 50299 - DNA, 100 bp, Homo sapiens
caagtcctggactttttctttgttgggagacttttaattactgattcaatatatttgaatcattattggtcttacacattattggtctgttcaggttttg

SEQ ID NO: 50300 - DNA, 95 bp, Homo sapiens; identical to SEQ ID NO: 68

SEQ ID NO: 50301 - DNA, 93 bp, Homo sapiens; identical to SEQ ID NO: 69

SEQ ID NO: 50302 - DNA, 78 bp, Homo sapiens
ggcaactggacaagctgtggggactagtcacaaaataatttttttttttgagatggagtctctctcagtcaccaggct

SEQ ID NO: 50303 - DNA, 106 bp, Homo sapiens
gccactgcacctggctatttttggtttttaaaagcagtatgataccatttttttttttttttgagatggagtttcgcttttgtggctcaggctggagtgcaatggc

SEQ ID NO: 50304 - DNA, 98 bp, Homo sapiens
aaatatatatatatgtgtatatatatatatgtatttgtgtgtgtgtgtgtatatatatatttgtgtatatatatatttgtgtatatatatgtgtatat

SEQ ID NO: 50305 - DNA, 86 bp, Homo sapiens
gtctcttccagcctttgtgtctggttcgagtgactgactctgtctctgtttctctccactagaactatgcaaaggagggttaggac

SEQ ID NO: 50306 - DNA, 115 bp, Homo sapiens
gctggaggagggtgagtgatggggagagtgggagatgtggcagagaggtgacagagcagacattggagacctgtgggccacggtgaggactttggcttttgtcacaggatgtggc

SEQ ID NO: 50307 - DNA, 80 bp, Homo sapiens
tccagctaaagcgctggagctttttttatttttatttttatttttttgagatggagtctcgctctatcgcacaggctgga

SEQ ID NO: 50308 - DNA, 76 bp, Homo sapiens
ggttacaggcatgagtcaccacacctggactgttgtgaattcttatcacgaatggtgtgtctctctgtgtgtctct

SEQ ID NO: 50309 - DNA, 100 bp, Homo sapiens
gtggtggtgctcacctgtagtcccagctactagtgaggctgaggtagaaggatcgcttgagcccataatgggcagaggttgcagtgagaggaaatcccac

SEQ ID NO: 50310 - DNA, 58 bp, Homo sapiens
tgagatggaatctcgctctgtcactcaggctggagtgcagtggtatgatctcagctca

SEQ ID NO: 50311 - DNA, 86 bp, Homo sapiens
ctgggcaacttggtaagacctccatcgctacaaaaaaaatgtttttttctttttcttttgagacggagtcttgctctgtcacccag

SEQ ID NO: 50312 - DNA, 74 bp, Homo sapiens
gctgggcagagtggctcacacctgtaatcccagcactttgggaggctgaggtaggaggatcagttgagcccagc

SEQ ID NO: 50313 - DNA, 81 bp, Homo sapiens
tgggcaacagagtgagatcccaccttaagaaattttattttattttattttttttgagacagagtctcgctctgtcaccca

SEQ ID NO: 50314 - DNA, 153 bp, Homo sapiens
gtgggctccttctcttctacttgctgcttattttatttaatttaatttaacttatttaatttaatttaattaatttatgtatgtatgtattgagacagagtctcgctctgtcacccaggctggagtgcagtggcgcgattgtggctcactgca

SEQ ID NO: 50315 - DNA, 225 bp, Homo sapiens
tgtatatatatatacatatatatagtgtgtatatatatatacatatatatgtgtatatatacgtatatgtgtgtatatatacgtatatatgtgtatatatacgtatatatgtgtatatatacgtatatatgtgtatatatacgtatatatgtgtgtatatatatgtgtgtgtatatatatattttgtgtgtgtgtgtgtgtgtgtgtgtgtgcgcgcacgtagag

SEQ ID NO: 50316 - DNA, 87 bp, Homo sapiens
tcaaaagagagagagagagagttctgaattctaggatctttactatggaaattgggatattgggaatttttttttttttttttttga

SEQ ID NO: 50317 - DNA, 58 bp, Homo sapiens
gagctgactgttgacagtggccaggtctcctccagggtccacgtcttgcagctggctc

SEQ ID NO: 50318 - DNA, 93 bp, Homo sapiens
gcccttatcattgcctggtgttgatttagattattttattaatattttatgagatagagtcttgctttgttgcctgggctggagtgcaggggt

SEQ ID NO: 50319 - DNA, 58 bp, Homo sapiens
tgagacaggatctcactctgtcactcaggctggagtgcagtggtgtgatcatggctca

SEQ ID NO: 50320 - DNA, 87 bp, Homo sapiens
ggattttttttttttttttttttttttttttgagatggagtctcactctgtcacccaggctggagtgcactggcgccatctccatcc

SEQ ID NO: 50321 - DNA, 94 bp, Homo sapiens
ggtcacctgtgaatctgggtgttgtctaggaatgtgtgtgtgtgtatatatgtgtgtacattagtgtgatgaacatctacttcagcatgtgttc

SEQ ID NO: 50322 - DNA, 80 bp, Homo sapiens
tgagacaaggtctcactctgtcacccaggctggagtgcggtggcgggatcacggctcactgtaacctctacctcctgggt

SEQ ID NO: 50323 - DNA, 110 bp, Homo sapiens
gggcctctcggtctctactccaaggccagctgccgcgggctcagtctgtccgtctgtccagaattctgcctgcggactctctgtccccggcgcaggcccgaggccggccc

SEQ ID NO: 50324 - DNA, 87 bp, Homo sapiens
caacagaggaagattctgtctcaaaataatttatttatttatttatttatttatttattttttctgagacagagtctcactctgttg

SEQ ID NO: 50325 - DNA, 102 bp, Homo sapiens
gcattgagatgtccttgaacattggctaagactggcagaagtcagcgtgctcagaaacagcaagtgtgggagatggggatgcgtgaaactcttgtgcctggc

SEQ ID NO: 50326 - DNA, 112 bp, Homo sapiens
ggcgttccaaagtgctgggattataggagtgagtcaccgcgtctggcctgaaagatttttttttttttacaggcagggtctcactctgtcacccagactagagtgcagtgcc

SEQ ID NO: 50327 - DNA, 56 bp, Homo sapiens
gagacagagtctcgctctgtcaccccggctggggtgcagtggtgcgatcttgactc

SEQ ID NO: 50328 - DNA, 58 bp, Homo sapiens; identical to SEQ ID NO: 2224

SEQ ID NO: 50329 - DNA, 56 bp, Homo sapiens; identical to SEQ ID NO: 335

SEQ ID NO: 50330 - DNA, 98 bp, Homo sapiens
gctttatttttatgtatttacttttttttgagatggagtctcactctgtcacccaggctcgagtgcagtggcgtgatctcaaaatactaaaaattagc

SEQ ID NO: 50331 - DNA, 67 bp, Homo sapiens
ggagtctcactctgtcacccaggttcgagttcagtggtcttgaactcctgatgtcaggtgattctcc

SEQ ID NO: 50332 - DNA, 113 bp, Homo sapiens
cagtaatttggatgggagattggattatgagcttggagcaatgtgattggaatacttctgatttttatattacttctagcttttataatgccactgtacaccattgggagatg

SEQ ID NO: 50333 - DNA, 136 bp, Homo sapiens
gtgagtacctgatgaggtgcatgtgtgttcatgccactgttcctgaatgcttgccagtctctgggtctgtctgtgcatgtcgcctgagtgcacatgtgctttgggatatgccacttgggggaggtctatgacgtgc

SEQ ID NO: 50334 - DNA, 58 bp, Homo sapiens
tgagaaggagtctcactctgtcacccaggatggagtgcagtggtaagattttggctca

SEQ ID NO: 50335 - DNA, 114 bp, Homo sapiens
gataagagtgaaacctagttcgtagaaggatggatgaatgcatgaatgaatgaatgaatgagccaatgaatcaatgacaaatagtccatcaacataccactgtttcaaaggatc

SEQ ID NO: 50336 - DNA, 160 bp, Homo sapiens
tgaatatatattcatatatatgaatatataagtatatatgaatatatgaatatataagtatatatgaatatatgaatatatattcacatatgtgaatatatgaatatatattcacatatgtgaatatatgaatatatatattcacatatgtgaatatatg

SEQ ID NO: 50337 - DNA, 77 bp, Homo sapiens
ccctagatggctagtgattttgaacatcttttcataaaagggtctttttaagatgggagaaatacagcttattgggg

SEQ ID NO: 50338 - DNA, 100 bp, Homo sapiens
agttctcttggagctgggcgtggtggtttgtgcctataatcctagctataggaggctgaggtggaaggatcactagaggccagaaatttgagaccaggct

SEQ ID NO: 50339 - DNA, 80 bp, Homo sapiens
agagtgatagatgatagatggctgataggtagacagacatctgtagatatgtagatcgctcactgtttttctgtctctct

SEQ ID NO: 50340 - DNA, 110 bp, Homo sapiens
ggcgtgagccactacacccagctctgcttagttttttgtttgtttttgagacagactcactctgtcgcccaggctggagtacagtgccgtaattacagctcactgcagcc

SEQ ID NO: 50341 - DNA, 58 bp, Homo sapiens; identical to SEQ ID NO: 3385

SEQ ID NO: 50342 - DNA, 56 bp, Homo sapiens; identical to SEQ ID NO: 3386

SEQ ID NO: 50343 - DNA, 114 bp, Homo sapiens
gcctctgagtacatgacctaaggatgcttaccagtcagcgtatagatgtgtctctgtgtcaatctatgtgtccatggcagtgtctccatccttgtgtgtctgcatcaggcctgc

SEQ ID NO: 50344 - DNA, 81 bp, Homo sapiens
tgagaaagcaaaagggcaaataatgtcttggtaatagtatgaaaatagatttgaccttatgggccccctgcaaaggtctca

SEQ ID NO: 50345 - DNA, 107 bp, Homo sapiens
cattgttagaattattgaggactagaaagagcttttgtttatgttacatatatatcaatatttctgtattcaaaaataaaactagctgggcacagtggttcacagtg

SEQ ID NO: 50346 - DNA, 92 bp, Homo sapiens
caggccagcctgggcaacacagtaagacccccatctctcccaaaactttttttttttaaaggaagtctcactctgttgcccagactggagtg

SEQ ID NO: 50347 - DNA, 126 bp, Homo sapiens
gcagggcaatggaggaagagccacctcgctgctgcctgcaggaagctcacagtggaaagagagcacaggttgggagtcagctggctctgcctcagtttcctaatgtgtttcttctccaggcctagc

SEQ ID NO: 50348 - DNA, 58 bp, Homo sapiens; identical to SEQ ID NO: 2595

SEQ ID NO: 50349 - DNA, 61 bp, Homo sapiens
ggggatgagagggtggtgagcaggggcggagactcacatgcactcacactcattcacactc

SEQ ID NO: 50350 - DNA, 64 bp, Homo sapiens
cttaggaggtgggcaataaatattttcagcctgactgaatctgtctgtgtgcctggttctctgg

SEQ ID NO: 50351 - DNA, 119 bp, Homo sapiens
gcattccagcctggcgacagagcaagactccatcttaaaataaacaaatgaacaatatatatatatatgtattttgttttttgagacagagtctcgctctgtcatccaggctggactgc

SEQ ID NO: 50352 - DNA, 79 bp, Homo sapiens
caagtatataaaactcctgagtctctgtgagtgtctgagcgagtgctctggcaacattcgacacggctctgtgtatctg

SEQ ID NO: 50353 - DNA, 95 bp, Homo sapiens; identical to SEQ ID NO: 580

SEQ ID NO: 50354 - DNA, 93 bp, Homo sapiens; identical to SEQ ID NO: 69

SEQ ID NO: 50355 - DNA, 82 bp, Homo sapiens
agttttagggtacatgtgcacaacgtgcagatttgttacatatgtatacatgtgtgaagttggtgtgctgcacccattaact

SEQ ID NO: 50356 - DNA, 94 bp, Homo sapiens
cctccaggatgcacagcagctgggccagggggaggagcagggacaggtgtcagccaccctgtgtgtctgcaagtcaggctgggggtgtgggagg

SEQ ID NO: 50357 - DNA, 99 bp, Homo sapiens
tggatctctgtccctgggtcagaggcaaggctggtgacactggagagagaggactggtcccccccgtagtcgccccccattttctatcccacagagcca

SEQ ID NO: 50358 - DNA, 88 bp, Homo sapiens
tgggagttccgcctccaggtcatctgtgtccctgtctgtcacctgccccaggcctctccacagggcccaggagctggggcagctccta

SEQ ID NO: 50359 - DNA, 120 bp, Homo sapiens
ctctggtgtgatccctgagcccgcgctagagtcctcctcacaatgcctaatggtcagatctatgtgtggagacctaacggtgggggggtggggaggtctcgtgtgctcacacagagtgcc

SEQ ID NO: 50360 - DNA, 75 bp, Homo sapiens
tgatcagctagcaaaagggtaagaatttatttccagtgaggctcctggcttctctttctctgtgcaatctggtca

SEQ ID NO: 50361 - DNA, 66 bp, Homo sapiens
agtgctgggactacaggagtgagccactactcctggcctggggtgtcttactctgtgtctctaact

SEQ ID NO: 50362 - DNA, 58 bp, Homo sapiens; identical to SEQ ID NO: 87

SEQ ID NO: 50363 - DNA, 56 bp, Homo sapiens; identical to SEQ ID NO: 88

SEQ ID NO: 50364 - DNA, 75 bp, Homo sapiens
tgctatgaacatatataatatatatatatatatacacatatgtatatgtatatgtgtgtatatatgtgtgttgca

SEQ ID NO: 50365 - DNA, 109 bp, Homo sapiens
tacttaaaccttgagcacagtgactggtagagaacaagctcccataaggcctattaggtgcttttttttttttttgagacagtctcactctgttgcccaggctggagtg

SEQ ID NO: 50366 - DNA, 89 bp, Homo sapiens
tggcggggtggggcctggcatggcgtctggaactctctgtgactgtctggcgttgacatcctgggtctgtgcctctgcgcctccctcca

SEQ ID NO: 50367 - DNA, 135 bp, Homo sapiens
ctacttgagtgtctctgggctgggcgtgtccgcattttgggatgggggcgtctgccagctctccgactgtgcctctgcctgagtggggtgaggagcctttgcctgtttcttgcggtctgtctcgggttgtgtggc

SEQ ID NO: 50368 - DNA, 60 bp, Homo sapiens
gggcagacagggagtgtgttccctgccacttgggagctcagtgtgtctctgtgtctgcct

SEQ ID NO: 50369 - DNA, 57 bp, Homo sapiens
gagtctctgtgtcagtcacccctaactaggtatctgggtgattagcctcagacattc

SEQ ID NO: 50370 - DNA, 70 bp, Homo sapiens
gggtgatggagtttggggtgttgttccttttttttttttttttttgagacagagtcttgctctgtcaccc

SEQ ID NO: 50371 - DNA, 77 bp, Homo sapiens
gactctcatgtctctctgtcaccaggttatgcctgcattgctgtgtgtgtgtgtgcgtgtcagtgtgtgtgtgagtt

SEQ ID NO: 50372 - DNA, 117 bp, Homo sapiens
gggccctgatgtatcagcagcggggtgtgcctgggtctctatgtgacactcactctgggtatctgtcaagccatgaccacctgctggtgtctgttctcaaggccgctgaggtcacac

SEQ ID NO: 50373 - DNA, 80 bp, Homo sapiens
ccttgatgcctcactgtacatttgagaaaacggggctaataccagtccctctctcactgggtggccatgaggagtcaagg

SEQ ID NO: 50374 - DNA, 85 bp, Homo sapiens
ggcccgcgaccaatcattatatgctcctgcctctctgacaccacacccaagctgtgtatagatgaatgggcatggtcgtccagcc

SEQ ID NO: 50375 - DNA, 88 bp, Homo sapiens
gctcatggccaggggagaagggggtctctctcacacttttttttttttttcctgagacagagtctcgctctatcacccaggctggagt

SEQ ID NO: 50376 - DNA, 102 bp, Homo sapiens
gtgctgggattacaggcgtgagccactgcacctggcctatttttaaaatttaatttaattttttttttttttgagatggagtctcactctgtcgcccaccgc

SEQ ID NO: 50377 - DNA, 65 bp, Homo sapiens
gtctgtctcactctctctctcactcaggtccccctaccctgggctagaggaagagagaggcaccc

SEQ ID NO: 50378 - DNA, 111 bp, Homo sapiens
ggtcttccctctgttcccatctgtgacctaattccctctttttcttctttttttttttttttgagatggagtcttgctctgtcactcaggctgtagtgcagtggcacgatc

SEQ ID NO: 50379 - DNA, 116 bp, Homo sapiens
gtgacttgggcatccagatatttaaaagcccctccaggtgattctctttttttttttttagacagagtctcactctgtcgcccaggctggagtgcaatggtatgatctcagctcac

SEQ ID NO: 50380 - DNA, 96 bp, Homo sapiens
gtgtttgtgtgtgtgactctgtgtgagcatgtgcatgtctgggtgtgtatctctggctggactgatgtgacttggtgtgagaacatgtgtaagtac

SEQ ID NO: 50381 - DNA, 58 bp, Homo sapiens; identical to SEQ ID NO: 4512

SEQ ID NO: 50382 - DNA, 56 bp, Homo sapiens
gcctctctgtgcctctctcagaactgtgcggaccctgagcagcatccacagagggc

SEQ ID NO: 50383 - DNA, 86 bp, Homo sapiens
aggctctgggtgtgtccctgtgtgtgtcatggtgacttggtgtagacggcacggtgtatgtgtgtagaggctacaaccctgagtct

SEQ ID NO: 50384 - DNA, 114 bp, Homo sapiens
ccaggtgttaggcattgtgcaaggtgctttgaacttttttttgttgttcattttaaaaaacggaggaaaaaaaaaaactctgagcatagagtgtccccagagcatgagacctgg

SEQ ID NO: 50385 - DNA, 76 bp, Homo sapiens
actctaagagtggggcccagcagtccctttttttttgttttttttgagacagggtctctgtcacccacgctggagt

SEQ ID NO: 50386 - DNA, 82 bp, Homo sapiens
gagtgcgcgtctgcctgtccctcggtctgtcagcatccctggctgctcgccccaggcctctgggcaggcctcagcctgtacc

SEQ ID NO: 50387 - DNA, 100 bp, Homo sapiens
ttatatagagggtggggtcggtatgatggtgtctgtgagagctgagtgtgcactggggataggaggcgctttgtgagtgctaggaaggctgtgtgtgtga

SEQ ID NO: 50388 - DNA, 72 bp, Homo sapiens
ctgggactacaggcacttgccctttttttttttttttttttttttgagacggcgtctcgctctgtctcccag

SEQ ID NO: 50389 - DNA, 86 bp, Homo sapiens
ttgggtgacagagcgagattgtcttaagaaaacaaaaaacaatgattttgttttgttttaagacagggtctctctctgtcacctag

SEQ ID NO: 50390 - DNA, 75 bp, Homo sapiens
agtctcggtctgtcatccaggctggagtgcagtggtgtgatcacatgtctcactgtagcctcgacctcctgggct

SEQ ID NO: 50391 - DNA, 183 bp, Homo sapiens
tgtggcaaccctgcgtcaaaccagtctgttggcaccatttttctgacagcagttgctcactttgtgtctctgtgtcacattctggtaattttcacagtgtttcacactttttcattattattatatttgttatgatgatctgtgatcaatgatctctggtgttactattgtgagtgggggcac

SEQ ID NO: 50392 - DNA, 97 bp, Homo sapiens
tggtagactaaactgggtgtggtggtgtgtacctctaaccccagatccttgggaggctgtggtggaaggatcacttgagcccaggagtttgagacca

SEQ ID NO: 50393 - DNA, 72 bp, Homo sapiens
ggtctgaggggataggcctgaacattttttttttttttttttgagatagagtctcactctgtctcccaggct

SEQ ID NO: 50394 - DNA, 88 bp, Homo sapiens
ctgggttagaggccaggctggtgacactagagacagagggctggtccctccccagtcatcccccagtgagcccctttccatcccccag

SEQ ID NO: 50395 - DNA, 100 bp, Homo sapiens
tctgtccccaccttgattactctgacagcccctctctgtgtcccaccaggggtaaaaatgtcctgagcagtggccactgggacagaggagaacctggtgg

SEQ ID NO: 50396 - DNA, 76 bp, Homo sapiens
ggaaatgccacggagtttgagtgtggtctgttgtgctgtcctcatagctgactccctcgctctctgtggctgcacc

SEQ ID NO: 50397 - DNA, 66 bp, Homo sapiens
ggagagaaaataggccaggagggctggtcactttacttagtgccctgcctttctctctctctctct

SEQ ID NO: 50398 - DNA, 73 bp, Homo sapiens
gtactttagggggctgaggtaggaggatctcttgagcccaagagttcgagaccagcctgggcaacagtgagac

SEQ ID NO: 50399 - DNA, 116 bp, Homo sapiens
gctcacctctaatgtctacagcagtctatagactcatttttctttttcttttttttttttttttttttttttttgagacagagtctggctctgttgcccaggctggagtgcagtgg

SEQ ID NO: 50400 - DNA, 98 bp, Homo sapiens
gacataggctgcaggatgctgagggcacagggctgtgctcacccagtctccagggtgtatgtgtgactgtgtgtgtctctttgtgtatgtgtgtgtct

SEQ ID NO: 50401 - DNA, 99 bp, Homo sapiens
gccatggtggcatgcacctgtggtcccagctccttatgaggctgaggtggtaggatcacttgagcctgggaggttgaggttgcagtgatccatgattgc

SEQ ID NO: 50402 - DNA, 84 bp, Homo sapiens
cattctagatctctttgtatgtctgtcttcctccccaggagagtgtgagctctgtgaggacaggggcttgtgtgatcttggttg

SEQ ID NO: 50403 - DNA, 78 bp, Homo sapiens
tccaccagatgtcactgcacctcaccagaagtgttaatatagaaacttttttttttggataagtggcattggattggg

SEQ ID NO: 50404 - DNA, 68 bp, Homo sapiens
gggagcagcagggtgggaagatcaatgtcaggggggcaaggacaagtcattttcattttctcactccc

SEQ ID NO: 50405 - DNA, 95 bp, Homo sapiens; identical to SEQ ID NO: 580

SEQ ID NO: 50406 - DNA, 93 bp, Homo sapiens; identical to SEQ ID NO: 69

SEQ ID NO: 50407 - DNA, 83 bp, Homo sapiens
ctctgaagtcactgcctgtctgagtctgtggacagagctcctggaacacaacacagaggacagtgagtgatggacacttggag

SEQ ID NO: 50408 - DNA, 64 bp, Homo sapiens
atatacagatacatttctataaatatacacatatatgtatatgtgtatatatgtatatgtatat

SEQ ID NO: 50409 - DNA, 99 bp, Homo sapiens
tacagttctagaagctagaggtctgagatcaaggtgtcagcagggatggtgcctcctgaggcctctctcctgggcttgtagatggtgtcttctccctgt

SEQ ID NO: 50410 - DNA, 79 bp, Homo sapiens
ttgttatatgcctgacaggaagccagaagtctctaggaagtgactggagaatgtgagctccacagcaggttgaggatgg

SEQ ID NO: 50411 - DNA, 87 bp, Homo sapiens
gcagcagcattgggtcatggaaagacacaggaccagcagtcacagcccctggtgcctctgtgtgtccctccgtctccaactgcctgc

SEQ ID NO: 50412 - DNA, 109 bp, Homo sapiens
accagtgacaaatttcaagcttgttatatgcctgacaggaagccagaagtctataggaagtgactggagaatgtgagctccttagcaggttgaggctggagtcacaggt

SEQ ID NO: 50413 - DNA, 72 bp, Homo sapiens
ctctgcctgtgtcactcactgcgttatgtcccatgctgggatttgggcatttagtgcaggacacacacagag

SEQ ID NO: 50414 - DNA, 85 bp, Homo sapiens
ttgggcttgggagcagcagggtgggaagatcaatgtcaggggggcagggacaagtcattttcattttctcactcccagggaccag

SEQ ID NO: 50415 - DNA, 83 bp, Homo sapiens
ctctgaagtcactgcctgtctgagtctgtggacacagctcctggaacacagcacagaggacagtgagtgatggacacttggag

SEQ ID NO: 50416 - DNA, 99 bp, Homo sapiens; identical to SEQ ID NO: 50409

SEQ ID NO: 50417 - DNA, 89 bp, Homo sapiens
cagcagcattgggtcatggaaagacacaggaccagcagtcatagcccctggtgcctctctgagtccctccatctccaactgcctgcctg

SEQ ID NO: 50418 - DNA, 97 bp, Homo sapiens
ccttttcatagttgcatctttctctcagtgtctcagttgtggcagccatgaatggcctccatggcagggacttgactgacagagggccctggtcagg

SEQ ID NO: 50419 - DNA, 79 bp, Homo sapiens
ttgttatatgcctgaccggaagccagaagtctctaggaagtgactggagaatgtgagctctatagcaggttgaggatgg

SEQ ID NO: 50420 - DNA, 109 bp, Homo sapiens
gtatatatgtatatatgtatatgtgtgtatatatatgtgtgtgtctgtgtgtatatatatatacatatatatatatatatacacacacatatatatatatataatgtgc

SEQ ID NO: 50421 - DNA, 73 bp, Homo sapiens
ctgtgcctgtgtccctctctgcattatgtcccatgctgcggtttgggcatttagtgcaggacacacacagagg

SEQ ID NO: 50422 - DNA, 94 bp, Homo sapiens
acacatatatgtgtatatttatagacatatgtatctacatattaaatttatatgaatatatgctcacatctaatgaatataagtatgtatgtgt

SEQ ID NO: 50423 - DNA, 78 bp, Homo sapiens
cttggaggttagaagcaagacggtgttcattaggttaggttagatctctttcactgtctcagtcataattttgccaag

SEQ ID NO: 50424 - DNA, 75 bp, Homo sapiens
gtgtccgtgtgaagagaccaccaaacaggctttgtgtgagcaacatggttgtttatttcacctgggtgcaggtgg

SEQ ID NO: 50425 - DNA, 79 bp, Homo sapiens
catgcgcgtccatgtgaagagaccaccaaacaggctttgtgtgagcaacatggttgtttatttcacctgggtgcaggtg

SEQ ID NO: 50426 - DNA, 116 bp, Homo sapiens
cccaagtcccttctgaatccttggttaagggaatctgtggccaggtcacctggagtgtgactcaagagtgtgatcaccttccctagcccaggacgtggagggacagacatggtggg

SEQ ID NO: 50427 - DNA, 129 bp, Homo sapiens
agggaaggtgggggtacatgactttgtgctcagagcagctggccaccttgggccagagtctctgtgtgtctgggcctcatttctccacggccctggatcccataccttgaggagggagggagttcagca

SEQ ID NO: 50428 - DNA, 108 bp, Homo sapiens
cccagaacctgtgctgtggggatgaggttcttggtgtttggtggatggtgtcaggcagactctgtccctcagagcttgttcagggggtccaggtgcagatggccacat

SEQ ID NO: 50429 - DNA, 108 bp, Homo sapiens; identical to SEQ ID NO: 50428

SEQ ID NO: 50430 - DNA, 129 bp, Homo sapiens
agggaaggtgggggtacatgactttgtgctcagagcagctgcccaccttgggccagagtctctgtgtgtctgggcctcatttctccacggccctggatcccataccttgaggagggagggagttcagca

SEQ ID NO: 50431 - DNA, 58 bp, Homo sapiens; identical to SEQ ID NO: 315

SEQ ID NO: 50432 - DNA, 83 bp, Homo sapiens
tccccgtgacagctgacttctctcactctgtcctaacatcacaagaggacaagcggagagacaaggatgagaaggatacagga

SEQ ID NO: 50433 - DNA, 84 bp, Homo sapiens
gtctcaccctgcctgtcactcactgggtccccgctctatccttcaggaggtaggggttttcaggggaagttcagagagggagat

SEQ ID NO: 50434 - DNA, 59 bp, Homo sapiens
ggtgtccctcacacacaccctcaggcaccagcactgggagtgggatggccttgggcacc

SEQ ID NO: 50435 - DNA, 81 bp, Homo sapiens
gagacagtctcgctctgtcacccaagctgaggatattgacttttgttttttgttttttttttttgagacggagtgttgctc

SEQ ID NO: 50436 - DNA, 101 bp, Homo sapiens
gatgactactgcagagggtgatggctacgtgggacttacttttttttttcttttttttgagacggagtctcactgtcacccaggctgaactgcagtggcgc

SEQ ID NO: 50437 - DNA, 72 bp, Homo sapiens
tgtatgtgtgtgtgtgtgtgtatatatatatatgtatataaatatatatatagatataaatatatatatata

SEQ ID NO: 50438 - DNA, 70 bp, Homo sapiens
ccttctgtaaggctcatttcctgagccttagcaaatggtcactgaggctctctctgagccaaatgggagg

SEQ ID NO: 50439 - DNA, 58 bp, Homo sapiens
tgagacagagtctcgctctgtcacccaggatggagtgcaatggcgcgatctctgctca

SEQ ID NO: 50440 - DNA, 65 bp, Homo sapiens
ggtgcagacggcaggtgatctcagccaccccaccctcagccactgtcacgttctctgtctgtact

SEQ ID NO: 50441 - DNA, 103 bp, Homo sapiens
taggatggggacaggaccactattctatttattattattattattattattattattattattattattatttagactgagtctcattctgtcacccaggctg

SEQ ID NO: 50442 - DNA, 98 bp, Homo sapiens
cccctggccctgccctcctgggggctcacagtccagtagaggagacatacctgtcaccagacagtgaccacccagagtgggatgggggagtacagggg

SEQ ID NO: 50443 - DNA, 84 bp, Homo sapiens
agcctgggaacaggctacaaggggcttagtgtctatagagaattttttttttttgagacagagtctcactctgtcacccaggct

SEQ ID NO: 50444 - DNA, 58 bp, Homo sapiens; identical to SEQ ID NO: 41048

SEQ ID NO: 50445 - DNA, 119 bp, Homo sapiens
ccactgcactccagcctgggcgacagagtgagactccatctcatcaaaaaaatatataaataaatcaagttgggcaccgtggctcacatctgtaattccagcactttgggaggccaagg

SEQ ID NO: 50446 - DNA, 58 bp, Homo sapiens
cacctgacaggggaagatgctgggaacaagacccaaactctctctcactgtgggagtg

SEQ ID NO: 50447 - DNA, 81 bp, Homo sapiens
gtccccagcttgcatgtgggtggggttttttttttttttctttgagacaagagtctcgctctgtcgcccaggctggagtgc

SEQ ID NO: 50448 - DNA, 65 bp, Homo sapiens
ttgcggcgggaagtcagtcctcggtttgtggcccaaggccactctgcctctgactcaccttgcag

SEQ ID NO: 50449 - DNA, 61 bp, Homo sapiens
gtgtcagtctctgtctccgtttttcacaagtgcctgaactggggcacagatgccatggcat

SEQ ID NO: 50450 - DNA, 120 bp, Homo sapiens
ccagcctgcccagttaaacaactctttgtccctggccccttcctgctgggccccgaggcacctgggttctttccaggcccggagatggggctgcgacagaggtggtgcagctgggacaag

SEQ ID NO: 50451 - DNA, 120 bp, Homo sapiens
gtcagtttgtgtgttgctggggctgatgtatgggtttacagggcactacaggaccacacttcactctacctgtcctggagtgcatgtttcttgtcaggggtctcttactgtgctgtccac

SEQ ID NO: 50452 - DNA, 95 bp, Homo sapiens; identical to SEQ ID NO: 68

SEQ ID NO: 50453 - DNA, 93 bp, Homo sapiens; identical to SEQ ID NO: 69

SEQ ID NO: 50454 - DNA, 99 bp, Homo sapiens
actgatttcaaaagactccaggatttttacttgactgaagagagagaggcaaagaaaaagaattctccacttagtggacctggccctttttgtgtgggt

SEQ ID NO: 50455 - DNA, 79 bp, Homo sapiens
tagctgttggatagtgggtgggctgaggtggtgcagcgacccagtctgtctgtccctgtcctgaggctactaccattgt

SEQ ID NO: 50456 - DNA, 86 bp, Homo sapiens
ttgcaatttttctataggtttcaaatgatatgaaaataaaacgttaaatattttttttttttgagaccgggaggcagaggatgcag

SEQ ID NO: 50457 - DNA, 81 bp, Homo sapiens
gccgactgcccagtggctgctgcacctcaagaccccgagggctctcaggtgcacagtgacagtcactcacgcagacctggc

SEQ ID NO: 50458 - DNA, 58 bp, Homo sapiens
tgagacggagtctcgctctgtcaccctggctggagtgcagtggtacgatctctgctca

SEQ ID NO: 50459 - DNA, 58 bp, Homo sapiens
tgagactgagtctccctctgtctcccaggctggagtgcagtggcacgatctcagctca

SEQ ID NO: 50460 - DNA, 96 bp, Homo sapiens
cctgatctgggggctgtgggggtcctgggagagggctcatgggtaggggacagtttttgatgttctcttagtgaaggacagagaagaaggatgggg

SEQ ID NO: 50461 - DNA, 66 bp, Homo sapiens
agcggattcagaggacaggacagaacacttgggtaagtgaatctctgtctgtctgtctcattggtt

SEQ ID NO: 50462 - DNA, 107 bp, Homo sapiens
agttgccagggcttaaaattcttcattcacactttctggactcagtacaggttgtgtcattttcttcttgtattaagtcttgtgtaggactttgtattgtggcttct

SEQ ID NO: 50463 - DNA, 65 bp, Homo sapiens
gaagcggattcagaggacaggacagaacacttgggtaagtgaatctctgtctgtctgtctgtctc

SEQ ID NO: 50464 - DNA, 120 bp, Homo sapiens
gcactgtgattacaggtatgaactgctgcacctggccacttttattttcttttagtttttgatccaatggcttctaaagaaatgagttatcaaaaattagcagtagttgcttttcagtgt

SEQ ID NO: 50465 - DNA, 77 bp, Homo sapiens
tcacagtgctttgggaggctgaggtggaaggatcacttgagcccaggagttcgagcccagcctcagcaacacagtga

SEQ ID NO: 50466 - DNA, 69 bp, Homo sapiens
cactgtgtggccttttgtgcctggagtctctcactgagtggcccatcctcagagttcatccactccgtg

SEQ ID NO: 50467 - DNA, 81 bp, Homo sapiens
cagccctgtgagggggtacgcattcattcactctgttactgctgtggactgaatgtttgtctctctgtcattcagatgttg

SEQ ID NO: 50468 - DNA, 63 bp, Homo sapiens
cagctctgaattagagtctctctctctcccctctaaacagagaggctcaaagaccctcagctg

SEQ ID NO: 50469 - DNA, 70 bp, Homo sapiens
acacagcaagacccagtctcttaaaaaaaactttttttttctttttttttgagacagagtctcgctctgt

SEQ ID NO: 50470 - DNA, 101 bp, Homo sapiens
ggccggtgcacacatggcctcttcctgcctccctgtaacccactgcaagggccatcagctcccaggaagccctcaagtaagagtcatgtgaggggctggcc

SEQ ID NO: 50471 - DNA, 84 bp, Homo sapiens
cagaccttttatgggtgtcgggctgggggacggtcaggtctttcccttcccacgaggccatctctcaggctgtctcagtggggg

SEQ ID NO: 50472 - DNA, 116 bp, Homo sapiens
agagctgttagtcggcctcatggagaccctggccaggacagccacctctggggaccaggaagtctctcagtttctgtctctgagggtttggctctctgagtctctctgtcacctct

SEQ ID NO: 50473 - DNA, 58 bp, Homo sapiens; identical to SEQ ID NO: 1435

SEQ ID NO: 50474 - DNA, 87 bp, Homo sapiens
ggctcctataacctgctgtgtgagatctggggccagcgagtgtgtctctctcagcctcagtttccccagctgtgcaatgaggatacc

SEQ ID NO: 50475 - DNA, 119 bp, Homo sapiens
tatatatacacacacacatatatatacacacacatatacgtatatatgtgtatatatatgtatatgtgtgtgtatatatatacacacacacgtatgtatatatatacacacatatatat

SEQ ID NO: 50476 - DNA, 58 bp, Homo sapiens
gagacggagtctcactctgtcacccaggttggagtgcagtggtgcgatctcggctctc

SEQ ID NO: 50477 - DNA, 89 bp, Homo sapiens
agccaccgtcccctgactctgtgtgtgtgtgtttgaggcaaagtctctcgctgtcactcaggctggagtgcagtggcatggtcacagct

SEQ ID NO: 50478 - DNA, 113 bp, Homo sapiens
ccagcctaggcaacatggtgagccacaccccacccccatctctaccaaatatacaataaaatttttttgttttgtttttttcagatggagtctcgctctgtcacccaggctgg

SEQ ID NO: 50479 - DNA, 58 bp, Homo sapiens
tgatactgagtctcgctctgtcacccaggctggggtgcaatggcatgatctcagctca

SEQ ID NO: 50480 - DNA, 88 bp, Homo sapiens
agctcccgagcggtcggtctgtgggcgcggggcaggctctcagctccgggtgtcccagcgctcctcagtctctctctctctgggtcct

SEQ ID NO: 50481 - DNA, 76 bp, Homo sapiens
ggaggctgaggcagcagggttgattgagcctgggagttcgaggctgcagtgagtcttgattgcaccactgcactcc

SEQ ID NO: 50482 - DNA, 63 bp, Homo sapiens
gagacaagagtctcactctgttgcccaagctggcaatagtgtctcactctctcactctgtctt

SEQ ID NO: 50483 - DNA, 117 bp, Homo sapiens
gtctggaaccctaggccggcgtggtcaggtcgggggcgggagggccgggcctggctctgtctctgtctgtgtccaggtcacacataaactgcccgccgtgagatgagggagccgtcc

SEQ ID NO: 50484 - DNA, 99 bp, Homo sapiens
gaggagctggaccacaggtgtgcaccactttgcctggctaattttgtttgttttatttttttagagatggtgtctcactttgatgttcagtctggtctc

SEQ ID NO: 50485 - DNA, 118 bp, Homo sapiens
cccagctgcaccccagggcacatggctcaggggactatggactggattcttttttttttttttgagacagagtctggctctgtcgcccaggctggagtgctgtggcgcgatctcggct

SEQ ID NO: 50486 - DNA, 91 bp, Homo sapiens
gaggcacagggcaggcagggcctggagcctgtttctgaggagggacatttctgggggttccgtgcctctgtccctctgtgctcaactctgc

SEQ ID NO: 50487 - DNA, 103 bp, Homo sapiens
aaaaaaaaaaaaagccaggtatggtgacacgtacctgtagtctcagctattcaagaggctgaggtaggaggatcacttgagccttggaaatttttttattttt

SEQ ID NO: 50488 - DNA, 56 bp, Homo sapiens
gagtcggagtctcgctctgtctcccaggctggagtgcagtggtgcgatctcggctc

SEQ ID NO: 50489 - DNA, 84 bp, Homo sapiens
gggtctctctctgtcacagaggctggagtaaagtggcacaagcacggctcactgcagcctccacctcccaggctcaagagaccc

SEQ ID NO: 50490 - DNA, 134 bp, Homo sapiens
agcttttccttgtcttgcttctgccctgggagggtctcggggagagaccatatcatgtgtcctctcatctgtgtgactgttctagaacgggagctgttggccttgttactctagagttggggtcgaggatggga

SEQ ID NO: 50491 - DNA, 82 bp, Homo sapiens
gagatgcagtctcgctctgtcacccaggctggagtgcagtggcatgcaacctccgcctcctgagttcaagtgattctcctgc

SEQ ID NO: 50492 - DNA, 75 bp, Homo sapiens
ttgggtgggttgtgtgtgagagaaagctggggtttattcttttttttagagacagtgtctcactctgtcacccaa

SEQ ID NO: 50493 - DNA, 76 bp, Homo sapiens
ggaggctgaggtggaaggatcacttgagtccaggaggtcgaggctttagtgagctgtgatcacaccactgccctcc

SEQ ID NO: 50494 - DNA, 105 bp, Homo sapiens
ggctgcagtgctggctggtcctcagttgtgtgggtgcagagttctctcgctgtctaaggccctgtaccccaggttccagctggtgggtggcctctgagcctctgt

SEQ ID NO: 50495 - DNA, 109 bp, Homo sapiens
agtgggcatggtggtacacacctgtagtcccagctgctgaggaggctgaggtacgaggatcatttgagcccaggagtttcaggctgcagtgaactatgatggggccatt

SEQ ID NO: 50496 - DNA, 89 bp, Homo sapiens
caggtgcctgctatcacaccaagctaatctttatatttttagtagagacggggttttaccatgttggccaggctggtcttgaactcctg

SEQ ID NO: 50497 - DNA, 83 bp, Homo sapiens
gggaggggagtggaatgttgtgagggaaccccgtggggatgggccaggagagggtgcacctgaggacagctcactggctacct

SEQ ID NO: 50498 - DNA, 96 bp, Homo sapiens
tggggaccaaggcaggattttgaggggcggggactaagaacgctttgaaggcgggttttttttttttttttttccagagtctctctgtgtcaccca

SEQ ID NO: 50499 - DNA, 68 bp, Homo sapiens
gggcaacatagtgacaccctgtctctattttttttttttttttgagacagaatctcactctgtcaccc

SEQ ID NO: 50500 - DNA, 93 bp, Homo sapiens
gagtagctgggactacaggcatgggccaccacgctctgctaacttttatatttttagtagagaaggggttttgccatgttggccaggctagtc

SEQ ID NO: 50501 - DNA, 92 bp, Homo sapiens
ctggcactgcaccgctatgtcagcttcattcctctcacactctgatggtgacaggtttcctgtgtgacaggagagtgtgtgcagcatgtagg

SEQ ID NO: 50502 - DNA, 73 bp, Homo sapiens
tttgtttttgagacggagtctcactctgtcacccagcctggagtgcaggggagtgatcttggcttactacaag

SEQ ID NO: 50503 - DNA, 91 bp, Homo sapiens
ccagcctgagcaacaaagtgagacccctgtctctacaaattttttttttttttttttttgggacggagtctcgctctgtctccgaggctgg

SEQ ID NO: 50504 - DNA, 83 bp, Homo sapiens
ttcagtgtgacccgacagggctgtaggagtccagcctgggtgttcccagctcagtctggctctctgacccggttcctactgaa

SEQ ID NO: 50505 - DNA, 115 bp, Homo sapiens
ggcactgcctctctctggccttcagtttcctcatctgtaaaacaaggtcttaatttttttttttttttttttgatacagagcctcactctgtcccctaggctgaagtgcagtggc

SEQ ID NO: 50506 - DNA, 58 bp, Homo sapiens
tgagacagagtctcactctgtcacccaggctggagtgcagacgtgtgattccgtctca

SEQ ID NO: 50507 - DNA, 74 bp, Homo sapiens
catctcccagtctctgtccctccctcctggctggtggcagacagagggggcgtggaggaacagggcagggggtg

SEQ ID NO: 50508 - DNA, 57 bp, Homo sapiens
tgagttgagtctcactctgtcacccaggctggagtgcagtggcgcgatctcagctca

SEQ ID NO: 50509 - DNA, 86 bp, Homo sapiens
ctgggcgacagagcgagacaccatctcaaataaaaaaaaaattttattttaatttttttgagacagagtctcactctgtcacccag

SEQ ID NO: 50510 - DNA, 74 bp, Homo sapiens
gacagagtgagactctgtctcaaaaaaattaaaataaaattttttttttatttgagatggtgtctcgctctgtc

SEQ ID NO: 50511 - DNA, 120 bp, Homo sapiens
cttcgtgctgtgtgatctttggcgatcactgcctctctgggcctgtgtcttaggctctgcaagatcaaccgagcaaagcacacggcctgcagagaggcagcgctctgccccttactcggc

SEQ ID NO: 50512 - DNA, 65 bp, Homo sapiens
ccttgagttcagtgagtctgtgcccacctaagacaggaaggacagtgtctctgagtctcggctgg

SEQ ID NO: 50513 - DNA, 81 bp, Homo sapiens
ttgtttgtttgagatggagtctcgctctgtcacccagattggagtgtagtagcacgagctctgtctcctgggttcaagcga

SEQ ID NO: 50514 - DNA, 68 bp, Homo sapiens
cagcttgaggagaaagctaggctagaacaggcaccctcgtgttttctttctttttttttcccaagatg

SEQ ID NO: 50515 - DNA, 96 bp, Homo sapiens
ggcgtgagccactgcgcgcagcctttttatttttttaaagacagggtctcgctctgttgcccagacaggctggaatgcagtggcgcaatcatgact

SEQ ID NO: 50516 - DNA, 103 bp, Homo sapiens
tgccatttacttgctatatgaccttaggcaagtcttttatttatttttatttatttatttagagacagtctccctctgtcacccaggctggagtgcagtggta

SEQ ID NO: 50517 - DNA, 85 bp, Homo sapiens
gaggcagagtctcgctctgtcacccaggctggatgatctcggctcactgcaagctccgcctcctgggttcaagcgattctcctgc

SEQ ID NO: 50518 - DNA, 82 bp, Homo sapiens
gctgagtctcgctctgtcacccaggctggagtgtggagtgcagtggtgtgatctcggctcactgcaaactctgcctcccggg

SEQ ID NO: 50519 - DNA, 113 bp, Homo sapiens
ggtctgggcgagcccttttgttttcccgccgtctccactctgtctcactatctcgacctcaggtagcggtagtgaagatgaagcagacgggccaggtgtatgccatgaagatc

SEQ ID NO: 50520 - DNA, 119 bp, Homo sapiens
agtgagagtctgtctaaaaaaaaaaaaaaaaaaaaaaagataagttttgactattctcacatctataattttattttattattttattttttccattttttttgagatggagtctcatt

SEQ ID NO: 50521 - DNA, 111 bp, Homo sapiens
ccggggcctgagggcattgcccagcccagcaggggagccggtgtggcctcagccagcagtgaggacacagcgtgctcagcagctgagcagagcagtgtgtggctgccctgg

SEQ ID NO: 50522 - DNA, 71 bp, Homo sapiens
gttgggagagtcaccagacaggcctttgctgcagtctgggtcactgcatctctgtcactgctcttccacac

SEQ ID NO: 50523 - DNA, 73 bp, Homo sapiens
ggagtgaggtagggatcttactatgttttttcataattaagtatactaagcagagtattctgtaccttgtttt

SEQ ID NO: 50524 - DNA, 102 bp, Homo sapiens
cctgtgtatgctctttttgtaaatgaaagggaaatatgtatatatgggtttttttattttcattttttttcctttttttgcataaaatctagctcctgcagg

SEQ ID NO: 50525 - DNA, 111 bp, Homo sapiens
tgaaaggaggggtcagtggggctccactctgctggtcagcaaaggatcccaggacccactgagtgtccgtctgtctgtccatcttgccttctctacaaatcccttccatca

SEQ ID NO: 50526 - DNA, 62 bp, Homo sapiens
atatgcatctcgttccacacacgcactctctgaggcagtgagttaggtagagaatggcatat

SEQ ID NO: 50527 - DNA, 80 bp, Homo sapiens
gcgtgtgtggaacgagatgcatatggcagggctggctgttcttgtgtgttctatgtgtgtctctgtgagtccgtgtatgt

SEQ ID NO: 50528 - DNA, 56 bp, Homo sapiens; identical to SEQ ID NO: 1392

SEQ ID NO: 50529 - DNA, 97 bp, Homo sapiens
gtgcgctaggagagtggaatagatgttgagaggcgccacacctcctccacgtggttgcacgccctctctctctgtccatctctgtttttacgtgcat

SEQ ID NO: 50530 - DNA, 123 bp, Homo sapiens
gaccagcctgggcaacatcgcaaggccccatctctactaatatagatagacaaaattatatatatatatatatatattattttattttattttgagacagggtctccctctgtcactcaggct

SEQ ID NO: 50531 - DNA, 58 bp, Homo sapiens
tgagacggagtctcactgtgtcacccaggctggtacacagtggtgcgatctcggctca

SEQ ID NO: 50532 - DNA, 110 bp, Homo sapiens
ttaatttggaaaatgttgctgctgctgttaataccccctttatttttattttattttttattttttaattttttggtatttttagtagagacaaggtttcaccacgttga

SEQ ID NO: 50533 - DNA, 73 bp, Homo sapiens
ggagaacagattggtatttgcaaagggacagatacagtgtgtttgtgtatgtgcatgtatatgtgtgtgtgcc

SEQ ID NO: 50534 - DNA, 95 bp, Homo sapiens; identical to SEQ ID NO: 68

SEQ ID NO: 50535 - DNA, 93 bp, Homo sapiens; identical to SEQ ID NO: 69

SEQ ID NO: 50536 - DNA, 85 bp, Homo sapiens
agcctaggcaacacagtgagatcccatctctacaaaaaaaaaaaattttttttttgagacagggtctcactctgtcacccaggct

SEQ ID NO: 50537 - DNA, 115 bp, Homo sapiens
ccagagggccttgcaggtggggttctggatacatttgaatctctggtagcacagtcattgtgtctctgggtgtatccacagtaacatctcacatccaagcaatagctctgaatgg

SEQ ID NO: 50538 - DNA, 86 bp, Homo sapiens
gggtcagtcagccctgcgttcaaaccctgtccctgcaccttcctaaggtgtcagaagagtctgtgcacacagccatgtccaatccc

SEQ ID NO: 50539 - DNA, 102 bp, Homo sapiens
aggtgtgagacactgcacacagcctcattctagcatttatttatttttttagagatgaagttttgctcttgttgcccaggttggagtgcaatggccctatct

SEQ ID NO: 50540 - DNA, 117 bp, Homo sapiens
tctagccttttgtctctcagcttctcctattgcactctgcacctaggaggataaactttttattatttttttgtttgtttgtttgcgactgggtcttgctctgtcacccaggctgga

SEQ ID NO: 50541 - DNA, 58 bp, Homo sapiens
tgagacaggatctcactctctcgctcaggctggagtgcagtggtgcgatctcggctca

SEQ ID NO: 50542 - DNA, 91 bp, Homo sapiens
ttgaacccaggccacttggctctctaggacctatcaaatggcggcttcccatattgcctgcacactcctgtaagagtcacctgcctgtcaa

SEQ ID NO: 50543 - DNA, 125 bp, Homo sapiens
ccatgactgtcgggagggtgcttcagacctgatgggagtcagccaggcgggcagctgtgaggctctcagactcactgggtgtcggggttccctgccgctgcagttcaggaggtctcccaggaccc

SEQ ID NO: 50544 - DNA, 98 bp, Homo sapiens
ggccctgcaggtgctgtttgaaggcccctgcgctgaaatataatagcgaacactctgttctgtctcagttactagagggctcccctacctgtggggcc

SEQ ID NO: 50545 - DNA, 70 bp, Homo sapiens
ggtgcctgagtgtacatgtgtctgtggtatgtgctgtgcctgcgtgcctggatccgagtgtgcatgtgtc

SEQ ID NO: 50546 - DNA, 73 bp, Homo sapiens
gggccaggcatggtggcttccatctgtaatgccagcactttggaaggctgaggtaggaggatcacttgagccc

SEQ ID NO: 50547 - DNA, 79 bp, Homo sapiens
cacattctgtgctcctcacactgattcgggtctctctcagtctgggaggccccagctgacatcggagtcatagagcatg

SEQ ID NO: 50548 - DNA, 69 bp, Homo sapiens
actcagtatggttgtgtgtgcctgtactcccagctactagggaggctgaggtaggaggatcacttgagt

SEQ ID NO: 50549 - DNA, 77 bp, Homo sapiens
gagttagctctctctctctctctggaaataaccaataaaaccttaggattatgcggcgggagaagagatgtgttctc

SEQ ID NO: 50550 - DNA, 79 bp, Homo sapiens
actttctgggatgatggggtgttcggtattttttttttttttttgagatggagtctcactctgtcacccaggctggagt

SEQ ID NO: 50551 - DNA, 96 bp, Homo sapiens
ccctgctgaactacaacccctgaccctgcctgcctgcctgcctgctggctgggcagtcgcaccttgtagggtgtgggtgagttgtagttgtcaggg

SEQ ID NO: 50552 - DNA, 57 bp, Homo sapiens
aagaccaagtctcgctctgtcacccaggctggagtgcagtggtgtgatcttgatctt

SEQ ID NO: 50553 - DNA, 118 bp, Homo sapiens
ctagctgggctgctcctgaattcctgactcctaggcactgcaagagataacaaatgatgatgataatgatgatgatgatgatttttgagatagagtctcagcctgtcacccaggctgg

SEQ ID NO: 50554 - DNA, 76 bp, Homo sapiens
ggatggtgaggaagggatggggggttctggagaagggcattgaagggtgctcacctcctctctctgtgtcaccccc

SEQ ID NO: 50555 - DNA, 77 bp, Homo sapiens
atatatatacatatatgtgtatatacatgtgtgtatatatagtgtatatatgtgtatatatatgtgtgtatatatat

SEQ ID NO: 50556 - DNA, 114 bp, Homo sapiens
gtagggactgttaagatctccattatgtttcatgttttttttgtttgttttttgagacggagtctcgctgtgtcacccaggctggaatgcagtggtgcgatctcggctcactgc

SEQ ID NO: 50557 - DNA, 84 bp, Homo sapiens
gctgccatgtcctgagtgtccagacagcggcctccatcctttctcgtatgttcactggggcctgctgggggactggggcacagc

SEQ ID NO: 50558 - DNA, 61 bp, Homo sapiens
gctgcaggaggcagacgtggggacacccctgttggaatgtgtccctgaatgcctctgtggc

SEQ ID NO: 50559 - DNA, 113 bp, Homo sapiens
gagattgtgccactgcactccagcctgggtgacagagccagactcttttttttttttttttttgagacggagtctcgctttgtcaccaggctagagtgctgtggcacaatctc

SEQ ID NO: 50560 - DNA, 113 bp, Homo sapiens
tcagtatttaatctcctaaatttgataactatgctatacatatatatatatacatatctatatgtgtgtatatatataaaagtatctttgttgatggcattagaggacactga

SEQ ID NO: 50561 - DNA, 74 bp, Homo sapiens
gtgtttaggtttgggtcccatccccaagatatctttttttttttttttttggagagggagtctcactctgtcac

SEQ ID NO: 50562 - DNA, 105 bp, Homo sapiens
tgtgctattacactctagcctgggcaacagagcgagattctgtctcaatttttttttttgagatggagtctcgctctgtcacccaggctggagtgcagtggcgca

SEQ ID NO: 50563 - DNA, 100 bp, Homo sapiens
tctgggcaacatggtgagaccctatctctatattttatttattttatttttatttttagtttgattttttttgagaccgagtctcactctgtcgcccagg

SEQ ID NO: 50564 - DNA, 87 bp, Homo sapiens
ccagcctgggcaacatagcaagaccctctctctacaaaactttttttttttttttgagacggagtctcgctctgtctgccaggctgg

SEQ ID NO: 50565 - DNA, 116 bp, Homo sapiens
cccgagtagctgggattacagacatgcaccaccacgcctagctaactttgtattttttaaatagagacagggtttcttcatgttggtcaggcttgtcttgaactctcaatctcagg

SEQ ID NO: 50566 - DNA, 83 bp, Homo sapiens
tgagatggagtctcactctgtcacccaggctggagtgcagcggtgagatctcagctcactgcaacctctgactcctgggtaga

SEQ ID NO: 50567 - DNA, 58 bp, Homo sapiens
tgagacagagtctcgctctgtcacccagaccggggtgcagtggcgcgatctcagctca

SEQ ID NO: 50568 - DNA, 58 bp, Homo sapiens; identical to SEQ ID NO: 285

SEQ ID NO: 50569 - DNA, 65 bp, Homo sapiens
gtttttgagacagtctcactctgtcccccaggctggagtgcagtggtgtgatagctcactgaaac

SEQ ID NO: 50570 - DNA, 85 bp, Homo sapiens
tgtgctcttcgctgctgccctccagttggaaagctgtccaggccagggacaggctttgcagagagaaggtacagaggacgggaca

SEQ ID NO: 50571 - DNA, 56 bp, Homo sapiens
tgacagggtctcactctgtcacccaggctggagtgcagtgatgagatctctgctca

SEQ ID NO: 50572 - DNA, 65 bp, Homo sapiens
tccgtgtttgtcctctgcctccaggtctcatgtcctggatgaggatgtgacctccgagacatgga

SEQ ID NO: 50573 - DNA, 57 bp, Homo sapiens
ttgagacgcagtctcactctgtcacccaggctggagtgcagagtggcatgatctcag

SEQ ID NO: 50574 - DNA, 58 bp, Homo sapiens; identical to SEQ ID NO: 315

SEQ ID NO: 50575 - DNA, 79 bp, Homo sapiens
gcaggacagagtgtgtacacaccattttttatgttggtaacttttttttttttttgagatggagtgtcgctcttgttgc

SEQ ID NO: 50576 - DNA, 128 bp, Homo sapiens
agcgagactccgtctcagaaaaaaaaaacaacaacacttttttctttttttgagacagtctggctctgtcacccaggctggagtgcggtggtaccatcatggctcactgcagcctcagtctctcagcc

SEQ ID NO: 50577 - DNA, 65 bp, Homo sapiens
ggagggcttcaggcacagctggatccaggtgctttggcggcatctccctgagtctgtctctctcc

SEQ ID NO: 50578 - DNA, 69 bp, Homo sapiens
ccagagagagagaccaccaaggcagagtgtggatcgctcccctgtttggctctgtctctctccctctgg

SEQ ID NO: 50579 - DNA, 74 bp, Homo sapiens
ccccgccagccactctctctgtgtccccctcacattggggctgatgaggcctgcacagatgggctggggtgggg

SEQ ID NO: 50580 - DNA, 114 bp, Homo sapiens
gagctccgacctcgggccttttctggactccctgtgggacttcaggccactccctcctctgtctctgagcctcagtctccccagtccatatcacaaagggccagtgttggcttc

SEQ ID NO: 50581 - DNA, 56 bp, Homo sapiens
ctgccaggcgcagttgacgtgcctgtcactgcacgtcagtcactgtgtgtcagcgg

SEQ ID NO: 50582 - DNA, 56 bp, Homo sapiens
ggtgatatggctctcccatggggctgtgaaccctgtgaggacagggcctggttact

SEQ ID NO: 50583 - DNA, 106 bp, Homo sapiens
tatacatatatacacacacgtgtacatatatacacatgtgtatatatgtgtatgtgtatatatgtgtgtatatatctatacatttacacatacacagacacacaca

SEQ ID NO: 50584 - DNA, 91 bp, Homo sapiens
ttgtttattgagatagagtctcactctgtcacccaggctggagtgcagtggtgtgatctcggctcactgcaatgcacttcatctcctgggt

SEQ ID NO: 50585 - DNA, 80 bp, Homo sapiens
gctaactgtcacagccaccctgtgaggcaggcgctgtggacatctgcccgcccagcctcacacggtggacgagagttggc

SEQ ID NO: 50586 - DNA, 121 bp, Homo sapiens
tagtctggagtcagagtcagattttttttttttttttttttttgagacagagtctcactctgtcacccaggctggagtgcagtgacatgatcttggctcactgcaacatccgcctcccggg

SEQ ID NO: 50587 - DNA, 70 bp, Homo sapiens
ttgttttgagatggagtctcactctgtcacccaggctggagggcattggtaggatctcagctcattacag

SEQ ID NO: 50588 - DNA, 72 bp, Homo sapiens
tggcatggtggttcacgcttgtaatctcagcactttgggaggctgaggtaggaggatggatggcttgagcca

SEQ ID NO: 50589 - DNA, 90 bp, Homo sapiens
gagagagagagactctgtctcaaaaacaaaaaataaaacaaaacaaagaaaaaaaaattttttttttttgagacggagtctcgctctgtc

SEQ ID NO: 50590 - DNA, 91 bp, Homo sapiens
tttgctgccgtgtgtgtgttgagagtcttgacttgggggttacaaagaagttttgatgagcagataaatgcacaaatatggcatttgcaaa

SEQ ID NO: 50591 - DNA, 79 bp, Homo sapiens
ggaggattcctggggtgggggtgggggctctgactcacccactctcgctgctccttaaaccaacacctcaggctcctcc

SEQ ID NO: 50592 - DNA, 68 bp, Homo sapiens
ttgttttgagactgagtctcactctgtcgcccaggctggtgcaatggcacggtctcagctcactgcaa

SEQ ID NO: 50593 - DNA, 68 bp, Homo sapiens
ctgtagtcttagctacttgggaggctgaggtggaaggatcacttgagcctgagagcttaaggctgcgg

SEQ ID NO: 50594 - DNA, 106 bp, Homo sapiens
tctcttcttcacatcatttcccctatatgtgggtctgtctctgtgtccagatttcccctttttataaggacacccatcataaggtggatcatagggtggatcggga

SEQ ID NO: 50595 - DNA, 119 bp, Homo sapiens
ctccgcctggctaattttggcggggtggggggggttgttttatttattattatttatttatttatttatttatttatttatttttgagacacagtctcactctgtcgcccaggctggag

SEQ ID NO: 50596 - DNA, 72 bp, Homo sapiens
cctgagattgattgattgattgattgattttttttcttttttttgagatggagtctcactctgtcactcagg

SEQ ID NO: 50597 - DNA, 96 bp, Homo sapiens
atctggcaatagtgggtgctcaacgaatgggttggggcttactttagatatttaattattcaacacctattaactgagtcagacactgttctaggt

SEQ ID NO: 50598 - DNA, 92 bp, Homo sapiens
gtgtgtatctgtgtgtgcaggcatgttcaatgcattgtgcacacatgtctgtgagcacatgtgcctaagtgcaagcatatgcatgtatacac

SEQ ID NO: 50599 - DNA, 98 bp, Homo sapiens
aggacactgcatgtctcattactgtagcactgaggttactaaacttacataaaacacatctcagtctctgtgtcttagaaaggcatctgttaagtcct

SEQ ID NO: 50600 - DNA, 58 bp, Homo sapiens; identical to SEQ ID NO: 293

SEQ ID NO: 50601 - DNA, 116 bp, Homo sapiens
caccttgatttcctttccttggtgagctgctgatgagctggtcaggaggactctgggtgtgtctgtgcctggacaccgggtcatcacagaggtgagaggttggatgtctgggggtg

SEQ ID NO: 50602 - DNA, 67 bp, Homo sapiens
gcagggggcacggtgcccatcattctgcctgttagagacagtgacagagagaggcacagttcagtgc

SEQ ID NO: 50603 - DNA, 87 bp, Homo sapiens
ggtcactagggaagtgagtgtggacagagcagagaaggccaagggaccctttcctctggcgggtcatgaacatctctggcagtgacc

SEQ ID NO: 50604 - DNA, 69 bp, Homo sapiens
cggagtctcactctgtcacccaggctggagtgctctatcacccaggctggagtgcagtggtgcgatctg

SEQ ID NO: 50605 - DNA, 82 bp, Homo sapiens
tcccaaaggtagaaaggttttgtttgaattccattctgtgtctttgatggctgctcagatagattttttttttttttggtga

SEQ ID NO: 50606 - DNA, 90 bp, Homo sapiens
agagctcactgggttgtagtgtgtgtcagtgcctcagtccgttttatggctgggtaatattccatggtgcggatagaccacgtttgcttt

SEQ ID NO: 50607 - DNA, 77 bp, Homo sapiens
ctgctggctcattggttttcaagctgttttcagccatgctgacaggctcttaggaaggctggtaataaatcccgcag

SEQ ID NO: 50608 - DNA, 71 bp, Homo sapiens
tgagccagagactcacacactgacacactctgttgtccaggctggagtgcagttggtgcgatctcagctta

SEQ ID NO: 50609 - DNA, 67 bp, Homo sapiens
agctgagatcgcaccaactgcactccagcctggacaacagagtgtgtcagtgtgtgagtctctggct

SEQ ID NO: 50610 - DNA, 88 bp, Homo sapiens
actcttcctggataggctccacacaggactctctctctcttttttctttttttgagacagtgtctcactgtgtcttgcaggccggagt

SEQ ID NO: 50611 - DNA, 121 bp, Homo sapiens
ctcactcgcacccccgctttgtgccctcagcccccccacccccccttccagcgtctgtgtctatctgtctgtctgggtcacctctgaagctagtggctggtgtgtgcgtgtgaggagcggg

SEQ ID NO: 50612 - DNA, 71 bp, Homo sapiens
gggccaggaatggatgccagggctggtgggagcctgtccccactctcagtccctgtgttaggaactggtcc

SEQ ID NO: 50613 - DNA, 58 bp, Homo sapiens
tgagaccgagtctcgctctgtctcccaggctggagtgcggtggtgtgatctcagctca

SEQ ID NO: 50614 - DNA, 76 bp, Homo sapiens
cagcctcccaaagtgctgggattacaggcgtgagccaccacgcctggatctctgtccctctctctctgggtctctg

SEQ ID NO: 50615 - DNA, 73 bp, Homo sapiens
gtttgtttgagacggagtctcgctctgtcgctcaggctggagtgcagtggtgtgatctcggctcactgcaagc

SEQ ID NO: 50616 - DNA, 77 bp, Homo sapiens
actgtagatgtaatggagtgaggtttttttttttttttctttgagacagagtctcgctctgtcgcccaggctggagt

SEQ ID NO: 50617 - DNA, 88 bp, Homo sapiens
tccaccttgtagcatatgtcagaactccttttcttttcttttttttcttttttttgagacggagtctcgctctgtcacccaggctgga

SEQ ID NO: 50618 - DNA, 93 bp, Homo sapiens
tgtctctagctctgtgtgtgtgtttctttctttctttctttttttttttttttttgagatggagtctcactctgttgcccaggctggagtgca

SEQ ID NO: 50619 - DNA, 117 bp, Homo sapiens
tcccaaagtgctagaattacaggtgtgagtcaccacaccgggcccatttgtatttaaaaatttttttgaaataggcagggcgaggtggctcacgtctgtaatcccagcactttggga

SEQ ID NO: 50620 - DNA, 58 bp, Homo sapiens; identical to SEQ ID NO: 1847

SEQ ID NO: 50621 - DNA, 85 bp, Homo sapiens
acacagcatgtgtgtatatgtgaatgtgtatacatatatatgtatatatatacactttgtgtatctatacattgtatgcattttt

SEQ ID NO: 50622 - DNA, 106 bp, Homo sapiens
gttgctggacttgtgtgagttgtggtccctgtttttctggttccctgtttctatcacacaggagagagagaccttccaggaccctaacgtctgagcccccagttgc

SEQ ID NO: 50623 - DNA, 103 bp, Homo sapiens
ttccaggctcaggtgatcctcacacctcaggctccagggtagttgaatttctttcttttttttttttaaatagacggagtctcgctgtgtcgccaggctggag

SEQ ID NO: 50624 - DNA, 80 bp, Homo sapiens
gtatatatgtgtatatatatctacataggaggtatgtatacatagacacacatatattaggtatgtatacatttgtatat

SEQ ID NO: 50625 - DNA, 74 bp, Homo sapiens
ctgggagtacaggtgtgagccaccgcgcccggcttctttatttttttgagagagggtctcactctgtcacccag

SEQ ID NO: 50626 - DNA, 109 bp, Homo sapiens
gcacccaggcataactgcctgtgacagatttctgttttttcttttcttttctttttttttttttaaagatggagtctcgctctgtcaccaggctggagttcagtggtgc

SEQ ID NO: 50627 - DNA, 93 bp, Homo sapiens
gggcgctctctggaggttgcttgggcttcagtcggaatcttgcacgtgactctcacattcacactgttccagggaatgtctcagaggcgacct

SEQ ID NO: 50628 - DNA, 71 bp, Homo sapiens
agcttccagagaagacagagagcaggcccccaggctgaccagggtctcctctcctgtcagagcgggaagct

SEQ ID NO: 50629 - DNA, 75 bp, Homo sapiens
agggaagaagcgggcaccctacagaggatgctgggccgctgggcctggctctgtgtttggctcttttaactcctt

SEQ ID NO: 50630 - DNA, 57 bp, Homo sapiens
gacatgattctgaggacagagggcacagatgctggattgagttcaaagagtcatgtc

SEQ ID NO: 50631 - DNA, 128 bp, Homo sapiens
tcagccagggacaaatacagtccaacacctgtttttaatttttttttttgagacggagtctcactgtgtcacccaggctggagtgcagtggtgcaatctcagctcgctgccagctccgcctcctgggt

SEQ ID NO: 50632 - DNA, 76 bp, Homo sapiens
cagcgtggactctgcctgcctctgtgggtgtggactcagtgtcgacagccccctctacaggagcatgaacacgctg

SEQ ID NO: 50633 - DNA, 68 bp, Homo sapiens
atacatatatatatatatacatacatacatacatacatatgtgtgtatatacatatgtatgtatgtat

SEQ ID NO: 50634 - DNA, 74 bp, Homo sapiens
gggacagggtctcactctgtcacccaggctggagtgcaatggtgcactccaacctgggctcaagtgatcctccc

SEQ ID NO: 50635 - DNA, 102 bp, Homo sapiens
catgtatctatatatacacatatatatgtatatatatgtgtatatatacacatatatatgtatatatatacacgtgtatatatatgtgtgtgtgtatatata

SEQ ID NO: 50636 - DNA, 69 bp, Homo sapiens
ttgtttgagtccgagtctcgctctgtcacatgggctggagcgcagtggcgtgatctcgactctctgcag

SEQ ID NO: 50637 - DNA, 76 bp, Homo sapiens
cttgagcctccaggacagggagttgggggtctggaatttcttagaagactctttctctgtcagataattcctcaag

SEQ ID NO: 50638 - DNA, 81 bp, Homo sapiens
gaggacagtggccctcttctcacagctccactaggcagtgccccagtagggactctgactctgtgtgagggctctgacccc

SEQ ID NO: 50639 - DNA, 91 bp, Homo sapiens
atctcttccttgctcccagggtggggaggagggttaaggactatgtcataaagggcctgggtccctgcctggcacagcaggtggtagaggt

SEQ ID NO: 50640 - DNA, 135 bp, Homo sapiens
gagacgtgctggtggagggggctggggggtggcagcgggagggatgtattcctcaggcccctccctcagtctctgcctctgtttctcatctgtgctagggtttctcacagtcaatctctctggctctcactctct

SEQ ID NO: 50641 - DNA, 58 bp, Homo sapiens
tgagatggactctcactctgtcacccaggctggagtgcagtggcgggatcttggctca

SEQ ID NO: 50642 - DNA, 117 bp, Homo sapiens
ggcagcggcggctcctctccccatggccctgtctcccaacccttgtaccagtgctgggctcagaccctggtacaggcctgggggacagggacctggggaccccggcaccggcaggcc

SEQ ID NO: 50643 - DNA, 82 bp, Homo sapiens
cttcctcttactggctgtgtgactgtgggcaagtgacttaacctctctgtgtctcagttacccctctgtaaaacggaggaag

SEQ ID NO: 50644 - DNA, 58 bp, Homo sapiens; identical to SEQ ID NO: 1847

SEQ ID NO: 50645 - DNA, 64 bp, Homo sapiens
tgagggcgacagagtctctctctgtcatccagcctggagggcagtgagtggcacaatctccccg

SEQ ID NO: 50646 - DNA, 114 bp, Homo sapiens
gtgagtctgtgagctggcttgtgtctggttttggcgactgtcgctctgtctggatcctcagtacctggcccgcagtaggagctctgaccacttttgctgccagcctgtctttgc

SEQ ID NO: 50647 - DNA, 87 bp, Homo sapiens
ggggagaggatagttactgcagtgccccggcagacaggacgaagccctgcccttgggatgcctctctcagtctctgtccctctctct

SEQ ID NO: 50648 - DNA, 66 bp, Homo sapiens
catatatatgtgtgtgcatgtatatatttataggtctataaatatgtatgtatctatgtatgtatg

SEQ ID NO: 50649 - DNA, 109 bp, Homo sapiens
cctccaggctctgtgccttcctcgttgtgccacttgggcaggtcactggctctctcccagcctcagtttccctcccttataaaatggatggataatagtttttggagtg

SEQ ID NO: 50650 - DNA, 87 bp, Homo sapiens
atagtgagacactgtctcaatttttcaatgttttttttttgttgtttgtgttttttgttttttttttttgagacggagtctcactgt

SEQ ID NO: 50651 - DNA, 84 bp, Homo sapiens
ctccgcctcccgggtccaagtgaatttcttttttttttttttttttttttgagatggagtctcactctgtctcccaggctggag

SEQ ID NO: 50652 - DNA, 64 bp, Homo sapiens
gtgaggtcagcgccagactggatcctgcggccgcctggctgtctgtccctctcgctggcctcgc

SEQ ID NO: 50653 - DNA, 97 bp, Homo sapiens; identical to SEQ ID NO: 1307

SEQ ID NO: 50654 - DNA, 88 bp, Homo sapiens; identical to SEQ ID NO: 1308

SEQ ID NO: 50655 - DNA, 81 bp, Homo sapiens; identical to SEQ ID NO: 1309

SEQ ID NO: 50656 - DNA, 77 bp, Homo sapiens; identical to SEQ ID NO: 1310

SEQ ID NO: 50657 - DNA, 77 bp, Homo sapiens
ggctgaggtaggaggatcgcttgagcccaggagttcaagaccagcctgggtaacatgagaccctctgacacacacac

SEQ ID NO: 50658 - DNA, 81 bp, Homo sapiens
gtgcgtgtgtatctgtgtgtgtaatgtgatctagtttgccttttaaaaagagagaatagagacaccacagatacagagtac

SEQ ID NO: 50659 - DNA, 118 bp, Homo sapiens
accaaataaaaactctaatgattgtatgtgtgtatatgtatatgtgtgtgtctatatatgtatatatgtgtatgtgtgtatatatatacacacaatcattgtatgtgtgtatatgtgt

SEQ ID NO: 50660 - DNA, 71 bp, Homo sapiens
ttgtttttgagacggagtctcgctctgtctcccaggctggagtatagtagcacgagctctgctcactgcaa

SEQ ID NO: 50661 - DNA, 71 bp, Homo sapiens
gccttgggtgtgtctgtgtctctgtgtgactgacttctcctcatgctgtgtacattttggtgtatccgggc

SEQ ID NO: 50662 - DNA, 115 bp, Homo sapiens
atatatatatatatatactcatatatatatacttgtatatatatacgagtatatatatatgaatatatatatgagtatatgtatatgagtatatatatatatatatatgctgtat

SEQ ID NO: 50663 - DNA, 58 bp, Homo sapiens; identical to SEQ ID NO: 1391

SEQ ID NO: 50664 - DNA, 56 bp, Homo sapiens; identical to SEQ ID NO: 1392

SEQ ID NO: 50665 - DNA, 73 bp, Homo sapiens
ctgggtgatggacttaagatttttttttttttttttttttttttttgagacagagtctcgctctgtcacccag

SEQ ID NO: 50666 - DNA, 127 bp, Homo sapiens
gggattgagggcccagtttcaattatttatttatttttatttacttttgagacagggtctcactctgtcacccaggctagagtgcagtggtgcgatcacagctcactgcaacctagacttcctgggt

SEQ ID NO: 50667 - DNA, 92 bp, Homo sapiens
aggaaaaaagaaaatatttgggagtgctgtttttgtagttcacttaaaaagagcttcagatttagtaaaacttggtgttaacagtttttctt

SEQ ID NO: 50668 - DNA, 105 bp, Homo sapiens
ctgtaaccgagatgccaacaaaccccagtgtccctcagtgggtgacttgatttttgtcccccaaatagaagaataacagctgacatttgtggagcacttactcag

SEQ ID NO: 50669 - DNA, 75 bp, Homo sapiens
atatatatgtgtgtatatatatgtgtgtatacatgtgtgtatatacgcatacatgcacgtgtgtgtatacgcata

SEQ ID NO: 50670 - DNA, 116 bp, Homo sapiens
gtgtgtatatgtatatatacgtgtgtgtatatgtgtatatatacatgtgtgtatatgtatatgtatatatacgtgtgtatatgtatatatacgtgtgtatatgtatgtatacgtgt

SEQ ID NO: 50671 - DNA, 64 bp, Homo sapiens
atatgtatatatacatgtatgtgtgtatatatgtatatatacatgtatgtgtgtatatatatat

SEQ ID NO: 50672 - DNA, 102 bp, Homo sapiens
agcgcccacccaaaaccgcctcttccgaacccatctgtgacctggcttctctcgggaaccctggctcattatagatgtgtctggcccactttccttccagct

SEQ ID NO: 50673 - DNA, 58 bp, Homo sapiens; identical to SEQ ID NO: 1099

SEQ ID NO: 50674 - DNA, 95 bp, Homo sapiens
gccttgctctctggaaagtactctggcttttttttgtttttaacaaagggaatttgttgacttatagaaccgagctgtataactagcttcaggca

SEQ ID NO: 50675 - DNA, 74 bp, Homo sapiens
gacacattctccagctgtgtcctgtggagcgcttctcacagacagtctgacagtgaccggtttgtgtatgtgtt

SEQ ID NO: 50676 - DNA, 74 bp, Homo sapiens
ggtctgacactgtggctcacacctataatcccagcactttgggaggccgaggtgggtggatcacttgaggtcag

SEQ ID NO: 50677 - DNA, 110 bp, Homo sapiens
tctgtttgtaaactcgggtcttgtatcggaactgaggtcaagggtagggtagtgagagagacacagagacttggaatcaggggcctggggagaaggcttggggtagggga

SEQ ID NO: 50678 - DNA, 69 bp, Homo sapiens
tgtttttgagatggggtctcactctgtcacccagactggagtgcagtggtgtgatctcagctcaatgca

SEQ ID NO: 50679 - DNA, 115 bp, Homo sapiens
gtcaacaggtgtcaccagaaagacaagacaccgcctaaaaaatacaatccaatgcttttttaattttctttttatttttcttttttgagtcggagtcttgctctgtcacccaggc

SEQ ID NO: 50680 - DNA, 76 bp, Homo sapiens
tctctcggtctctgtctcacctgtgccttctccctactgagcacacgcatgggatgggcctggggggaccctgaga

SEQ ID NO: 50681 - DNA, 69 bp, Homo sapiens
agctgtgatgttaaccacgaggggatactgtcttcctgtttgtctgtgtctctctgtgtgtctccagct

SEQ ID NO: 50682 - DNA, 96 bp, Homo sapiens
gggtgagggatagtgcccgcaggtgaccgcgacgaggcaggaatgtctctgtgtctctctgtctctcctgggtctctaacactctttccttctcct

SEQ ID NO: 50683 - DNA, 67 bp, Homo sapiens
gactgcgaattcagggttggggaaccagaaacatctgtgtctgtctctctctgtcattcttgctgtc

SEQ ID NO: 50684 - DNA, 101 bp, Homo sapiens
ctgtactttttttttttttttgagacagagtctccctctgtctcccaggctggagagtgcagtggtgcgatctcagctcactgcagcctctctctcctggg

SEQ ID NO: 50685 - DNA, 123 bp, Homo sapiens
gttgaaggtgtggagagggaagaaacctaattttttttttttttgagatggagtctctctctgtcacccaggctggagtgcagtggcacgatctcggctcactgcaacctcagcctcccgggt

SEQ ID NO: 50686 - DNA, 60 bp, Homo sapiens
gccccggaggtcggggcacttccttccctctccgctgggtctggctctgtctctgtgtgc

SEQ ID NO: 50687 - DNA, 124 bp, Homo sapiens
gcactccactggaccgcgcaggtttgcaatgtgcttcctagacccagactgcctgagttcagaaccaagctctgccgggaatgctgtgtgaccttgagcaggttctttggctgtacagtgtggg

SEQ ID NO: 50688 - DNA, 149 bp, Homo sapiens
gctggtctgggggactgtcttctgcccaaggttcagtcaggggcccctgagacatgggagagagaagtgagtcagagcagacagtgaggatggggcgcggtggctcacatctgtaatcccagctcttcaggaggctgaggtaggcggat

SEQ ID NO: 50689 - DNA, 88 bp, Homo sapiens
ctatccatagcctcatgtccttagcacacacacactgtctggctttagagctgcggacactgatgagtttgccatgtgtcatggtagc

SEQ ID NO: 50690 - DNA, 69 bp, Homo sapiens
ggagcaggagactcagccctgcgtggaagaggaacctcagaccctcacacagtcagagctcatccctcc

SEQ ID NO: 50691 - DNA, 109 bp, Homo sapiens
gtatgtatagttcccatgaaaggaattaccttgagatgctagaggctgtctctccctccctctgcctctcagggtgtactttcgctttgtaataaacttctttgcctac

SEQ ID NO: 50692 - DNA, 108 bp, Homo sapiens
gtgtggtagtgtgtgcctgtggtcccagctacttgggaggctgaggtaggaggatggtttgggcccaggaggttgaggctgcagtgagccatgatcacaccactgcac

SEQ ID NO: 50693 - DNA, 58 bp, Homo sapiens; identical to SEQ ID NO: 16930

SEQ ID NO: 50694 - DNA, 81 bp, Homo sapiens
gtgtacctgtgtgtttctgtgtatgagctgagcactgcctccttgggcagtgtgacagttaatttgatgtgtcagcttcac

SEQ ID NO: 50695 - DNA, 58 bp, Homo sapiens
tgagactgagtctcgctctgtcgctcatgctggagtgcagtggtgcaatcttagctca

SEQ ID NO: 50696 - DNA, 136 bp, Homo sapiens
ggtggcagagtgaaactttcttttttttttttttttttttttttttttttttttttatgagacagagtctcactctgtcgcccaggctggagtgcagtggcgtgatcttggctcactgcatgctccgcctcccggg

SEQ ID NO: 50697 - DNA, 117 bp, Homo sapiens
caggagtggacggggtagtggacggtggatcttccaggggtgacccggccctgacagtgtctgtgtgtgaagttcctcctgtgaggtcaccgttcagaacccacccccaacttcctg

SEQ ID NO: 50698 - DNA, 113 bp, Homo sapiens
aaaacaaaatcagtgcactaaggggtcagggatggtaaatttttcaatatatatggcagataaaagccaagatctatattccagcaagaactcttacaaattgaatttgtttt

SEQ ID NO: 50699 - DNA, 95 bp, Homo sapiens; identical to SEQ ID NO: 68

SEQ ID NO: 50700 - DNA, 93 bp, Homo sapiens; identical to SEQ ID NO: 69

SEQ ID NO: 50701 - DNA, 96 bp, Homo sapiens
ggactcctgggtcctggcacccacccgtagaaccgaccttgcggggccttcgccgcacacaagctcgtgtctgtgggtccgtgtcgggggctcacc

SEQ ID NO: 50702 - DNA, 91 bp, Homo sapiens
gcgccccccgggctgaggtaggaggttgtatagttgaggaggacacccaaggagatcactatacggcctcctagctttccccaggctgcgc

SEQ ID NO: 50703 - DNA, 165 bp, Homo sapiens
caccccagggtctaccgggccaccgcacaccatgttgccagtctctaggtccctgagaccctttaacctgtgaggacatccagggtcacaggtgaggttcttgggagcctggcgtctggcccaaccacacacctggggaattgctggcctgacttctgacccctg

SEQ ID NO: 50704 - DNA, 85 bp, Homo sapiens
tttgtttgtttgttttgaggcagggtctcactctgtcacccaggctgggcaacatcgtgagatcccatctctgcaaataaataaa

SEQ ID NO: 50705 - DNA, 81 bp, Homo sapiens
tctgctcagttctctctctgtgactctttctagcaaatgatccagccggagggtgttctggagattctgcaaattggcaga

SEQ ID NO: 50706 - DNA, 111 bp, Homo sapiens
atatatgtgtatatatgtatatatatgtgtatatatgtatatatgtgtatatatgtgtgtatatatgcatatatgtgtatatatatgtatatatatgtatataaaatatgt

SEQ ID NO: 50707 - DNA, 167 bp, Homo sapiens
gtaacaagagcaagattccgtctcaaaaaaaaaaaaaaaaagaagttgaaaatgcatttatttattattttctttctttctttatttttgagatggagtctcactctgtcacccaggctggagtgcagtcctgcaaactcagctcactgcaacctctgcctcctggg

SEQ ID NO: 50708 - DNA, 90 bp, Homo sapiens
tcctagaggtggtgtgacagatgatgtcttttttcttttttttttttttttttttttgagatagagtctcactctgtcatccagattgga

SEQ ID NO: 50709 - DNA, 58 bp, Homo sapiens
tgagatgaagtctcgctctgtcactcaggctggagtacagtagcatgatcttggctca

SEQ ID NO: 50710 - DNA, 105 bp, Homo sapiens
gtgtaacatagacaaattttgcataatacagagtactagagtctattttttttattatactttaagttctagggtacatgtgcacaatgtgcaggttagttacat

SEQ ID NO: 50711 - DNA, 58 bp, Homo sapiens; identical to SEQ ID NO: 23944

SEQ ID NO: 50712 - DNA, 119 bp, Homo sapiens
gcacttttcttgcttcttttgtttctgtggaagtcagttgttaggacattttatttttcttttgatggtaatgcatcttttccttctattaacagttgtttgcataatgttatatgtgc

SEQ ID NO: 50713 - DNA, 89 bp, Homo sapiens
ctcagtggggaacaccatattctactctccctccagccttgctaccccgtagggaagcagcaggagccgaatggccagtcctattgcag

SEQ ID NO: 50714 - DNA, 59 bp, Homo sapiens
tgagacaagagtctcactctgacttccaggctggagtgcagtggtgtgatcttggctca

SEQ ID NO: 50715 - DNA, 63 bp, Homo sapiens
ttgagacagagtctcgctcgctctgtcgcccaggctagagtgcagtggtgtgatctcggctca

SEQ ID NO: 50716 - DNA, 117 bp, Homo sapiens
cacccgctttttgctcttcttgggatagtgagttctggtgagatcttgtttttttgtttgttttgcttttttgagacggagtctctctctgtcgccaggctggaatgcagtggcgtg

SEQ ID NO: 50717 - DNA, 57 bp, Homo sapiens
ttgagacagtctctgtgtcgcccaggctggggctggggagcagtggcgcgatctcgg

SEQ ID NO: 50718 - DNA, 58 bp, Homo sapiens; identical to SEQ ID NO: 25336

SEQ ID NO: 50719 - DNA, 116 bp, Homo sapiens
tctgtcacccaagctggagtacaaatggcaagatcagagctcactgctcaaactctcaaactcctgggcttgagcaatcctcttgcctcggcctcttgagtagctggaactacaga

SEQ ID NO: 50720 - DNA, 83 bp, Homo sapiens
gagagagagagaaagaaagatctccagtcaaataaacaaaaaaattatttatttatttgaaactgagtctcgctctgtctctc

SEQ ID NO: 50721 - DNA, 103 bp, Homo sapiens
acagagaaagaccccatcttaaaaaaaaaaatctagatgccacttttagtgtttgtcttttcctcatttttttttttttttttgagatggagtctcactctgt

SEQ ID NO: 50722 - DNA, 94 bp, Homo sapiens
ctgttctagtccattggcttatatgtctgccttcatggcagtacagttctattttgatgaaggtagcttagtaataagttttgtaatcatgcag

SEQ ID NO: 50723 - DNA, 91 bp, Homo sapiens
ccagcacaggcaacaatacaagacaccatctctacaaaatttatgtatttatttatttttgagatggagtctcgctctgtcaccaggctgg

SEQ ID NO: 50724 - DNA, 88 bp, Homo sapiens
gtcatgagcctgtagccccagctactccagaggctgaggttggaggatgacttgagtttaggaggcagaggttgcagtgagtcaagat

SEQ ID NO: 50725 - DNA, 84 bp, Homo sapiens
gctgtgcaaggtcagaattgtgactgaagaccttactgcacagggtgcatttgtaaggtttctctccaatgtgaattctatggt

SEQ ID NO: 50726 - DNA, 76 bp, Homo sapiens
ggctcaaggcggggtctatgcttctgtcagtctgactcagcgatcctgttttagggttttggaggcgagatctgct

SEQ ID NO: 50727 - DNA, 58 bp, Homo sapiens
tgagatggagtctcgctctgtcgctcaggctggagtgcagtggggagatctcagctca

SEQ ID NO: 50728 - DNA, 79 bp, Homo sapiens
cgaccccagccatgaaaagggaagagggtgatccacaacgaatgagtcaagtcactgtcctctggctgaagaggggttg

SEQ ID NO: 50729 - DNA, 75 bp, Homo sapiens
aggtattgtagtagccagtctttcctgagtctgaagcgtcctgcctgacaggctcactcgcactcacccatgcct

SEQ ID NO: 50730 - DNA, 79 bp, Homo sapiens; identical to SEQ ID NO: 50728

SEQ ID NO: 50731 - DNA, 108 bp, Homo sapiens
ggtgtcgctctgtggcttagttctggagtacaatggcacaattcagagtttacagcagcctcaaactcctgagctcaactaatcgctactgtagcctcccaaagagcc

SEQ ID NO: 50732 - DNA, 104 bp, Homo sapiens
attctagaggagaagtagtttttgcaggttatgaaactttatttatttatttatttatttatttattttgagatggagtctcactctgtctcccatgctggagt

SEQ ID NO: 50733 - DNA, 86 bp, Homo sapiens
cctaaggaggttcagcatagccttgccagtaaagattatttatttactttaagagttaagagtggcggtttgtggacagcactagg

SEQ ID NO: 50734 - DNA, 103 bp, Homo sapiens
gcattgggattataggtgtaagccattactcccggccagtatctatttttaagtttaaattagcattgggccgggcgccgtggtgcacgcctgtaatcctagc

SEQ ID NO: 50735 - DNA, 70 bp, Homo sapiens
ttgttttgagtcagagtctcactctgttgcccaggcttgagtgcagtggcatgatcttggctcactgcaa

SEQ ID NO: 50736 - DNA, 95 bp, Homo sapiens
tctctgagtttcctcagtgtttattgatcattatttttactatcttagtgaggggaatgtagcagggcaacaggtggggagaaggtcagcaggga

SEQ ID NO: 50737 - DNA, 106 bp, Homo sapiens
tctgtctcaggttttctactgctctcttagtccctctctctgtctcctgatccctttggcccacacgatcacacgagggtttggagtaagacacctgcatctcgga

SEQ ID NO: 50738 - DNA, 58 bp, Homo sapiens; identical to SEQ ID NO: 1409

SEQ ID NO: 50739 - DNA, 106 bp, Homo sapiens
tctgtctcaggttttctactgctctctcagtccctctctctgtctcctgatccctttggcccacacgatcacaagagggtttggagtaagacgcctgcatctcgga

SEQ ID NO: 50740 - DNA, 80 bp, Homo sapiens
ggaaatcagaccgtccaactagcctggcagccactcccagagcccctggaactctggccccaggctctctgactgactcc

SEQ ID NO: 50741 - DNA, 57 bp, Homo sapiens
gggggagggagagggagattttttttttttttcaaacagagtctcactctgtcctcc

SEQ ID NO: 50742 - DNA, 104 bp, Homo sapiens
ctgtctcaggttttctactgctctctgattccctctctctgtctcctgatccctttggcccacacaatcacaggagggtttggagtaagacgcctgcatcccag

SEQ ID NO: 50743 - DNA, 105 bp, Homo sapiens
ttctctgtctcaggttttctactgctctctctctcagtctcccgatccctttggccaacacaatcacaggagggctttgaagtaagatgcctgcatcccggagga

SEQ ID NO: 50744 - DNA, 88 bp, Homo sapiens
ggctttgagtgttggacggagcagcggcccctctgagtgtgctgggctctccaagtctgtgtgtgtctctgtgtaactgcgcaaggct

SEQ ID NO: 50745 - DNA, 85 bp, Homo sapiens
acagaagtgagccaccacgcccggccgggatgattttttttttttttttaagaagtaccttggctacttcctgggccttttctgt

SEQ ID NO: 50746 - DNA, 58 bp, Homo sapiens; identical to SEQ ID NO: 1673

SEQ ID NO: 50747 - DNA, 117 bp, Homo sapiens
ctgggtgtagtggcatgagcctgtagtcccagctactcaggaggctgaggtaggaggatcatttgagcctaggaggttgaaggtacagtaagctatgatcatgccaccatattccag

SEQ ID NO: 50748 - DNA, 97 bp, Homo sapiens
cgtccccgtattccccctggtgcagtggggcgcagaggaccatctttccacagggtgagatctgtgcgtgtgactgtggcacatgaaggggatgtat

SEQ ID NO: 50749 - DNA, 72 bp, Homo sapiens
ctgggcgtggtgacgtgcatctgtaatcccagctactcaggaggctgaggtagaagaatcacttgaacccgg

SEQ ID NO: 50750 - DNA, 79 bp, Homo sapiens
gcactggtctggagtggatcttttttttaatttttttttttaatttttttgagacagagtctcgctctgtcgcccaggc

SEQ ID NO: 50751 - DNA, 87 bp, Homo sapiens
gagaccacaggcacacaccaccatgcccagctaatttttgtatattttaccaagacagagtttggacatgttgctcaggcaggtctc

SEQ ID NO: 50752 - DNA, 80 bp, Homo sapiens
cgaacaagtgagtcactgtgtttctgactccaaactccttttttttgttgtttttgttgagacagagtctcgctctgtcg

SEQ ID NO: 50753 - DNA, 115 bp, Homo sapiens
ggtgtgagccctgtgcctgccgggacctccagcctgcagaatgcgtccagaaataaattctgtgtctgtgtgtgtgtcagtgtccggagggcttgatgacggcgacacagcagcc

SEQ ID NO: 50754 - DNA, 87 bp, Homo sapiens
agctggggctggggcaaggctgggcaccgggccatggtgacacatcggtgtgtctcagtctctcctttgcccatggatgccagggcc

SEQ ID NO: 50755 - DNA, 110 bp, Homo sapiens
tacaaatagacctatctatgtatatgtccatctatgcaaacatatatgtgtgtctacatatttatctatatttgtatctatgtctatctctatagatctatgtctctgta

SEQ ID NO: 50756 - DNA, 96 bp, Homo sapiens
cagcccccagacctggcactccgctccatccacctttctttcttttttttttttttttttattttgagacggagtctcactctgtcccccaggctg

SEQ ID NO: 50757 - DNA, 104 bp, Homo sapiens
ggcagcttttttttttctttcagcactttgaaaatgttgccccacttcctcttggtctgtacagtttttgttgaaaagtctgttgtgagataatttggagcgcc

SEQ ID NO: 50758 - DNA, 108 bp, Homo sapiens
cttgccctttagtaccggcagagggcggggcggggctgggctggggcgggatctgtgcgtctctcagcctccctcccaccgcctctgtttttgggttttggaggcgag

SEQ ID NO: 50759 - DNA, 62 bp, Homo sapiens
tttgacatggagtctcgctctgtctcccaggctggagagcagtggcaggatctcggtgcaaa

SEQ ID NO: 50760 - DNA, 96 bp, Homo sapiens
gtgtcctttcgtatctttgtattttctctttttttagatagagtatctctctctctgtccccaagggtggggtgcaatggtgtgatcatggctcac

SEQ ID NO: 50761 - DNA, 82 bp, Homo sapiens
tgggttggagttactcttaggcttctttcatttcttttttttttttttttgagatggagtctcggtctgtcactcaggctgg

SEQ ID NO: 50762 - DNA, 96 bp, Homo sapiens
aacttgcctgacttggtggctcatgcctgtgaccttagctactcaggaagctgaggtaggaggatggtttgagcccaggaggtcgaggctgcagtt

SEQ ID NO: 50763 - DNA, 76 bp, Homo sapiens
tcagccgtatgagggtccttcatgatgcacggataaacacactgtgagacagacagacagatttctcagcggctga

SEQ ID NO: 50764 - DNA, 117 bp, Homo sapiens
aacaccacctatctttagtcttttccctaagcctgattttcatatcacagccagaaagtagatcgtttgagtacgtgacaaggttgtcagctttgtgaggcttttaagagtggagtt

SEQ ID NO: 50765 - DNA, 133 bp, Homo sapiens
gtatgtatatgtgtatatgtatatatgtatatacgtgtgttatggtgtgtatatatgtatatacgtgtgtgtatatatatatgtatatatgggtatgtgtgtgcatgtgcgtatggtgtatatgtgtatatat

SEQ ID NO: 50766 - DNA, 117 bp, Homo sapiens
catcagagctctggtgagcttctctagttggcgatagttggtgcctgttgtcacacatcaaagacagcagagtaatgagtcctgactccacagggagaagacaccagaagctctgtg

SEQ ID NO: 50767 - DNA, 58 bp, Homo sapiens
tgagacggagtctcgctctgtcgctcaggctggagggcagtggcgcgatcttagctca

SEQ ID NO: 50768 - DNA, 74 bp, Homo sapiens
gtttttctttgagatggagtctcgctctgtctcccaggctggagtgcagtgggaccatctcggctcaatgaaac

SEQ ID NO: 50769 - DNA, 59 bp, Homo sapiens
gcaggtttcacccacacagtcacactcagccgagagctgtgaggaagctgtggagccgc

SEQ ID NO: 50770 - DNA, 89 bp, Homo sapiens
gcctcagcctcccaaagtgctggaattacaggtgtcagccaccactccctactcatacttgtatatttctctttaaattctgttgaggt

SEQ ID NO: 50771 - DNA, 109 bp, Homo sapiens
cttggattcaaatggtccttttttgcaagcaaagtctctctctctcacccaggctggagtgcagtgatgtgatctcggctcgccgcaacccccgcctcctgggttcaag

SEQ ID NO: 50772 - DNA, 82 bp, Homo sapiens
caacagtttattagtcacacagactcacagggaaggtgtccccatatgccaagagggtcacatgaagctacagagactgttg

SEQ ID NO: 50773 - DNA, 123 bp, Homo sapiens
gcctgggagatctggaatttatatatatatacacacacgtatatatatgtgtatatatgtgtatatatatgtgtgtgtatatgtgtgtgtgtatatatattttaagagatgaggtagccaggt

SEQ ID NO: 50774 - DNA, 104 bp, Homo sapiens
ttagtcctggaagggactggatgtgggagaatgtctcataaaaagctgtgaaggttttttttgttttgttttgagacggagtcttactctgtcacccaggctgg

SEQ ID NO: 50775 - DNA, 89 bp, Homo sapiens
tgcatatatatacacacacagatatatatatatatgcatgtataaatgtgtgtgtatatatatatgtgtgtgtgtgccgatataagaca

SEQ ID NO: 50776 - DNA, 81 bp, Homo sapiens
tgggagtcagagtttgcagtgacctgagatcacaccactgcattccagcctgggcgacagagtgactgagactctctctca

SEQ ID NO: 50777 - DNA, 81 bp, Homo sapiens
ctctcaggctgtgactctgtctccccctccctctgcaacttgatctctttgggagtccgtctctgtcttcctctctgggag

SEQ ID NO: 50778 - DNA, 67 bp, Homo sapiens
ggtggtggtggtggggtccagctcattcatgatttttttttttgagatggagtctcactctgtcacc

SEQ ID NO: 50779 - DNA, 69 bp, Homo sapiens
gtgcatgccagcagtcagagctagggagagtgagatggagtctcactctgtctcctaggctggagcgca

SEQ ID NO: 50780 - DNA, 116 bp, Homo sapiens
atgaattggtctttgtggtccctgggaggtatagattttctttttttttttttttttttttttaagagactgggttttgctctgtcacccaggttggagtacagcagcaccgtcat

SEQ ID NO: 50781 - DNA, 79 bp, Homo sapiens
ggcaacatgacttccagttgagagccactgtcctaaaggaagaaagtgggaacagtcactctctctgggaaatgaggct

SEQ ID NO: 50782 - DNA, 92 bp, Homo sapiens
gccagggactggtgagtaggtgatatttcatttcatttttatttttatttttattttttttttgagacggagtctggctctgtccctcaggc

SEQ ID NO: 50783 - DNA, 62 bp, Homo sapiens
tgtctgaggcagactctcactctgtcgcccaggctggagtgtagtggtgtgatctcagctca

SEQ ID NO: 50784 - DNA, 84 bp, Homo sapiens
tgtttttatctatatatatacacacagatatatacatacacgtgtgcatatatatgtgtgtgtgtgtatatatatatatataca

SEQ ID NO: 50785 - DNA, 63 bp, Homo sapiens
aagtttgggaggaacaaaccatgctttccaggtattgggaggctctgtttctctctctgactt

SEQ ID NO: 50786 - DNA, 84 bp, Homo sapiens
cactgtctctcacgctctgtgtctcggatcccggggtctccttctcacctgggtctgtcttggagtagttccagaccgatagtg

SEQ ID NO: 50787 - DNA, 163 bp, Homo sapiens
tatgtgtgtgtatatatatgtttgtgtgtatatatgtgtgtatatatatgtttctgtgtatatatatgtgtgtatatatatgtttgtgtgtatatatatataatcgtatctggtgtatatatatgtacacatatcaaaaaatatatgtgtgtgtacatatatg

SEQ ID NO: 50788 - DNA, 58 bp, Homo sapiens
ggagacatcaggaggggagcgggtggggcctctgtcttccactctcagtctaatctcc

SEQ ID NO: 50789 - DNA, 159 bp, Homo sapiens
cacagtgtatatatatttgtgtgtgtgcgtgtatacatatatatatgtatatatgtgtgtgtatatatgtatatatgcgtatatatgtgtgtatatgtatatatatgtgtatatgtatagatgtatatatgtgtgtgtgtatgtgtgtatatatatatg

SEQ ID NO: 50790 - DNA, 114 bp, Homo sapiens
gggctcacaaaggccggggctgatggaggaagaagtggggcagcaagtgagacagacagacggacactctcttggaagctctcctttttcatttccaagaacccctttgagctc

SEQ ID NO: 50791 - DNA, 66 bp, Homo sapiens
ttagcgacgtgtgtgatgtgccggcgaggtctcctcttcactgattctcacacactgggtccttaa

SEQ ID NO: 50792 - DNA, 80 bp, Homo sapiens
gacagagcgagactctgtctcaaaaaaaaaaaaaaaattaaaaaaaatatatatttttttagatggagtctggctctgtc

SEQ ID NO: 50793 - DNA, 96 bp, Homo sapiens
ctgcacacgtcaactgaccactctgtgcctcagtttcccctgtcaaagggcagttctgagaatacagtgggtacagtggggtctttggtgtgatag

SEQ ID NO: 50794 - DNA, 95 bp, Homo sapiens; identical to SEQ ID NO: 68

SEQ ID NO: 50795 - DNA, 93 bp, Homo sapiens; identical to SEQ ID NO: 69

SEQ ID NO: 50796 - DNA, 60 bp, Homo sapiens
tgtggtcctgcacctgctccttgcagccagttagggctcagagaggacacagagagcaca

SEQ ID NO: 50797 - DNA, 122 bp, Homo sapiens
caggatttgcatcccacaaatgccatagttatgatccccgtttggttgaagagagtgtgcatacaagagaccccaggaattcaaggctgcattgctccagggttgcctggattttgcttgta

SEQ ID NO: 50798 - DNA, 94 bp, Homo sapiens
attcacacacacatacaaacatatatatatatatgctaaatggagatgtcactcaaggttcataaatcagtatttgtttttatgaagtgtgaat

SEQ ID NO: 50799 - DNA, 74 bp, Homo sapiens
gtatgtatacatatatatgttaatttgtgtatatatttacctattatgtacataagcactatatgtatacacac

SEQ ID NO: 50800 - DNA, 71 bp, Homo sapiens
ctgtggggcatatgtaagactagtgaatgtgttgatgtttgcatagtattcaactagtaattgctccatag

SEQ ID NO: 50801 - DNA, 100 bp, Homo sapiens
ggacccagcctccaagcggccacaccctgtgtgtctctttgtcctgccggcactgaggactcatccatctgcacagctggggcccctgggaggagacgcc

SEQ ID NO: 50802 - DNA, 106 bp, Homo sapiens
gccttgacaattcttagtcacgttttgtaaaagtgagatttatatttttctaaatgaaagatataatttaccttcttcacgccgatctgagaaattgtctatagac

SEQ ID NO: 50803 - DNA, 108 bp, Homo sapiens
gtgaaaatatggtgctaaattaaatatgtggcaaataaatgtgtttttttaacttttaggttcagaggtacatgtgcaggtttgttatataagtaaattgtgtgttac

SEQ ID NO: 50804 - DNA, 77 bp, Homo sapiens
gctacattcatgttgctgcaaaggacatgatttcattattttttatggccatgtaatgttccatgtgtatatgtagc

SEQ ID NO: 50805 - DNA, 92 bp, Homo sapiens
tggtgtccctgatttctctctgtgcctctcagtgatcctttcatatgtggggttatttggaatgtgagcctcagaatccagtctggagacca

SEQ ID NO: 50806 - DNA, 92 bp, Homo sapiens
tggtgtccctgatttctctctgtgcctctcactgatcctctcataagtgggcttatttggaatatgagcctcagaatccagtctggagacta

SEQ ID NO: 50807 - DNA, 105 bp, Homo sapiens
tttgctttttggtgtccctgatttctctctgtgtctctcagtgatcctctcatatgtggggttatttggaatgtgagcctcagaatccagtctggggaccgcaag

SEQ ID NO: 50808 - DNA, 75 bp, Homo sapiens
ggtctctgagcaaagtcagcatggaaggacacctctctctgggacatgtctgtctgtctgagtgtctcctttacc

SEQ ID NO: 50809 - DNA, 91 bp, Homo sapiens
ggtgtccctgatttttctctgtgtctctcagcgatcctatcatatgtgggattatttggaatatgagcctcagaatccagtctggggaccc

SEQ ID NO: 50810 - DNA, 96 bp, Homo sapiens
ttgaagtccctgatttatctctgtgtctctcagtgatcctattatatgtaggattatttggaatatgagcctcagaatctagtctggggacaccaa

SEQ ID NO: 50811 - DNA, 144 bp, Homo sapiens
atacatacatgtatatatacatgtatgtatatatgcatatatgtatatacatacatgcatatatacatgtatgtatacatatacgtatatgtgtatatatgtatatacatatatatatacatgtaaggtactatgtagttttca

SEQ ID NO: 50812 - DNA, 82 bp, Homo sapiens
gcctcagcctcctgaatagctgggattacaggcgcgtgccactgtacccggctaattttcttatttttagtagagatggggt

SEQ ID NO: 50813 - DNA, 71 bp, Homo sapiens
gtggttctgcctgtctcagtggctcacgcctgtaatcgcagcgctttgggaggccgaggcgggaggatcac

SEQ ID NO: 50814 - DNA, 87 bp, Homo sapiens
ggatatgcatccaccagtacaggagagaagacagagtgtccaccctggaaggtgacaccaagtcatagtccttctggaggggggtcc

SEQ ID NO: 50815 - DNA, 87 bp, Homo sapiens
ggtttggttttgttttgagacggagtctcacactgtcacccaggctggagtgcagtggcacgatctccactgactgcaacctctgcc

SEQ ID NO: 50816 - DNA, 102 bp, Homo sapiens
gtggacacatggacacacgcatgtgtgacaagcaaacactcatttttttttttttttgagacggagtcttgctctgtcacccaggctggagtgcagtggcac

SEQ ID NO: 50817 - DNA, 58 bp, Homo sapiens
tgagacggagtctcgctctgtcaccctggctggagtgcagtggcgcgatctcagctca

SEQ ID NO: 50818 - DNA, 82 bp, Homo sapiens
gggcggtgtgagtgctgttcgtcctgaaagcctctgagagactggcctgaccccatggactccctcacactctcacccgttc

SEQ ID NO: 50819 - DNA, 83 bp, Homo sapiens
gacagagaaactgacttctcaaagtggtggtgtgagaacttatttatttatttgttaattttgagacagagtctccctctgtc

SEQ ID NO: 50820 - DNA, 81 bp, Homo sapiens
ggggatgtgctttattgggctgtagtctcacattctgcttgtgcctggctggtgtgagtgtcagcctcctacagatgcccc

SEQ ID NO: 50821 - DNA, 84 bp, Homo sapiens
ttgagacagggtctcactgtgtcacccaggctggagtgcagtggtgtgatcatgactcactatagccttgacctcccggctcaa

SEQ ID NO: 50822 - DNA, 70 bp, Homo sapiens
ccagtctgggcaacagagcgagacctggtcttttttttgaaacagagtctcactctgtgtcccaggctgg

SEQ ID NO: 50823 - DNA, 82 bp, Homo sapiens
ttggggttgttttgagacaggatctctcactgtcacccaggctggagtgcagtggcgtgatctcagctcacagcagcctcga

SEQ ID NO: 50824 - DNA, 58 bp, Homo sapiens; identical to SEQ ID NO: 1847

SEQ ID NO: 50825 - DNA, 95 bp, Homo sapiens
ccagcctgggcaacagggtgagactctctctctcaaaaaaaattaatttcttatttttttatagagacagggttgccctatgttgcccaggctgg

SEQ ID NO: 50826 - DNA, 118 bp, Homo sapiens
tcttcgggtacatttctgttggggtaagagttgactcatcattggaggactctggagtccctctctctgtcccccaacgaggcaggtgcagaattgcccccaatcactgttctagaga

SEQ ID NO: 50827 - DNA, 61 bp, Homo sapiens
gtgatgaggcggtgaacatgatgatgatgattatcatgatgatgatgatggtcctggtcat

SEQ ID NO: 50828 - DNA, 70 bp, Homo sapiens
ggcggtggacatgatgatgatgatgatggtggtggtgatgatgatgattatcatgatgatgatgatggtc

SEQ ID NO: 50829 - DNA, 85 bp, Homo sapiens
gtagcagccgggttggagaagattaactcaatttttaaaaattttttagagtcagggtctcgctctgtcacccaggctggagtgc

SEQ ID NO: 50830 - DNA, 155 bp, Homo sapiens
ttgagaccagcctgggcaacacagcaagaccctatcttaaattttttattttttatttaatttaattttatttttttgagacagactctcgctctgtcgcccaggctggggtgcagtggcgccatctcggctccctgcaacctctgcctcccggg

SEQ ID NO: 50831 - DNA, 116 bp, Homo sapiens
ggcaatggaagaactcggaatgtccgagcacactggactctctctctgtttctcaggaaacgtgtgtggaatgaggagacggatggatggccgaacatggcaggtttgtaatggct

SEQ ID NO: 50832 - DNA, 56 bp, Homo sapiens
gagacagggtctccctctgttggccaggctggaatgcagtggaatgatcttagctc

SEQ ID NO: 50833 - DNA, 65 bp, Homo sapiens
ggcacctgctttcacctcatgtgccatcttgtcttaagagtcaagaacagtgggagctctcagcc

SEQ ID NO: 50834 - DNA, 82 bp, Homo sapiens
gcaaccgtgtgtcagcatgagggtgtgtgtgcatatctttgggagtatgtgtatgtgtctgtgtgtgtctgtatgagagtgt

SEQ ID NO: 50835 - DNA, 74 bp, Homo sapiens
acttgaatctctcagcctcactcccttcaaagccaagtactgaagagactgtaaaggcgtgagtaggggcgggt

SEQ ID NO: 50836 - DNA, 113 bp, Homo sapiens
gtgtgtatgtgtatgtatatatgtgtatatatgtatatgtgtgtatatatgtgtgtgcgtatatatgtatatatatatatatatgtgtgtgtgtatatatatgtgtactttgc

SEQ ID NO: 50837 - DNA, 111 bp, Homo sapiens
ccagcctggggacagagtgagactccttctcaaaaaaaaaaaaaaaaaaaaaaaaactccttcctttttttttttttttgagacagagtctcgctctgtcgcccagagtgg

SEQ ID NO: 50838 - DNA, 97 bp, Homo sapiens
aggatagctgtaatttccattgtaatttcatatttgatcattttatttagaagtggttatttaatttgcatatatgtggagaatttatggatttctt

SEQ ID NO: 50839 - DNA, 97 bp, Homo sapiens; identical to SEQ ID NO: 50838

SEQ ID NO: 50840 - DNA, 93 bp, Homo sapiens
ctttgatttggagaaagaaacatgagcatgggctgcggtgtaagtgtgcctctgttctctagctatgtaaattttttttttttctagttaggg

SEQ ID NO: 50841 - DNA, 59 bp, Homo sapiens
ggggtgggtggtctcaggtgctcccctctctggtgctcacactgtcactgactcactct

SEQ ID NO: 50842 - DNA, 111 bp, Homo sapiens
gggattgcattgtggttttgatttgcatttccctggtcattagcgatgttgagcatttttttcatattcattttttcaaggactatcagatactggccatttgtgtatctt

SEQ ID NO: 50843 - DNA, 95 bp, Homo sapiens; identical to SEQ ID NO: 68

SEQ ID NO: 50844 - DNA, 93 bp, Homo sapiens; identical to SEQ ID NO: 69

SEQ ID NO: 50845 - DNA, 90 bp, Homo sapiens
ctccatttcagaaaaaaaaaaaaaaagaacaagaagaaaatttgtatgatttgtgttttgttttttttttttttttttttttttttggag

SEQ ID NO: 50846 - DNA, 91 bp, Homo sapiens
tatgtatatatgtgtgtatatatgtatatatatacatatatatgtgtgtgtatatatacgtgtatatatatgtatgtatatatatatgtat

SEQ ID NO: 50847 - DNA, 78 bp, Homo sapiens
aggtgacctgcgggattcttttttcttttctttctttctttttttttttttttgagacggagtctcactcagtcacct

SEQ ID NO: 50848 - DNA, 57 bp, Homo sapiens
tgagacgagtctcactctgtcattcaggctggagtgcagtggtgcgatctcggctca

SEQ ID NO: 50849 - DNA, 58 bp, Homo sapiens; identical to SEQ ID NO: 2263

SEQ ID NO: 50850 - DNA, 58 bp, Homo sapiens
tgagacagagtctcactctgtggcccaggctggagtacagtggtgtgatctcggctca

SEQ ID NO: 50851 - DNA, 82 bp, Homo sapiens
cctgggcgacagagccagactccgtctcaaaaacaaaaaaaaatttttattttaaatacggagtctcgctctgtcacccagg

SEQ ID NO: 50852 - DNA, 68 bp, Homo sapiens
acgtgtgtatacgtacatgcgtatatacatatgtatatgtatatgtgtatgtatatgtatacatatgt

SEQ ID NO: 50853 - DNA, 63 bp, Homo sapiens
gtgcctcccgcttctggagctgagagagtctcctgggagtctctgtggctctgtgcctggcac

SEQ ID NO: 50854 - DNA, 58 bp, Homo sapiens; identical to SEQ ID NO: 1847

SEQ ID NO: 50855 - DNA, 67 bp, Homo sapiens
gtgtgtccgggtgtgtctctgtgtgtgtctaggggactagacacatatgccacgactcctggcttgc

SEQ ID NO: 50856 - DNA, 66 bp, Homo sapiens
gtgtctgtggatatgtgtatatacaatatatataatgcatgtatgtatatatgtatacacgcacac

SEQ ID NO: 50857 - DNA, 94 bp, Homo sapiens
attatatatcatacatataagatatttgtatatatttaatgtcatttaatataatgtgcatatttatattcaatatgtgtatgacttatatggt

SEQ ID NO: 50858 - DNA, 114 bp, Homo sapiens
catgaaactgcgacagaatttgtgtgacagtgtgtgagactgtgtcactgtatgtgaaactgtatgtgaacagagtttttgttgttggactaagattgtatgtgacagtgtttg

SEQ ID NO: 50859 - DNA, 69 bp, Homo sapiens
ttgtttgagactgagtctcgctctgtctcccaggctggagtgcagtggcgtgatctcagctcactgcaa

SEQ ID NO: 50860 - DNA, 62 bp, Homo sapiens
gacatctgtgtgtgtgtgtgcacgtgcatatgtgtgcatgtgtgtctgtgtgtgtgtgtgtc

SEQ ID NO: 50861 - DNA, 111 bp, Homo sapiens
ggaaacgcgcgacggctgagccttcggtgtgagtacgcgtggggctttgtgacgctgtctgtgcctctgtgatcgcgatgtcattcggagcgcggccttctgtgccagtcc

SEQ ID NO: 50862 - DNA, 86 bp, Homo sapiens
taacatgatcctacatgaatgtttcaatattgtaatcctgtaagttacttttacattgacagttctgaaattcatgttgagtgtta

SEQ ID NO: 50863 - DNA, 109 bp, Homo sapiens
taagtaggttgatccagacatcagttagggaaagttcattttatttttatctgaaaacatgttttctactggaacttgtttcactgtcagggtgaatggatactaagta

SEQ ID NO: 50864 - DNA, 77 bp, Homo sapiens
tggcttatcactccctctgtgacattgttgatgagcaactctcactttacctgacactgagaagtgagaatcagcca

SEQ ID NO: 50865 - DNA, 262 bp, Homo sapiens
gtggatgaaaggtgcctgagttttgtgggactcacacatacacacacacacacatgcacatttagtggatgaaaggtgcctgggtcttgtgggactcacacacacacacatgcacatgtagtggatgaaaggtgtctgggtcttgtgggacacacacacacacacacacacacacatgcacaggtagtggatgaaagatgcctgagttttgtgggactcacacacacacacagacatgtgcacatttagtggataaaaggtg

SEQ ID NO: 50866 - DNA, 70 bp, Homo sapiens
gtgcatgtgtgtgtgtgtgtgtgtgtgtgtgtcccacaagacccagacacctttcatccactacatgtgc

SEQ ID NO: 50867 - DNA, 63 bp, Homo sapiens
gcagatgagttgaggagttgcttttttttttttttgagagacagagtctcgctctcactctgt

SEQ ID NO: 50868 - DNA, 105 bp, Homo sapiens
ttagtcattgatggtactgttctgattctttcttttcttttttctttttctttttttttttttttttttttttgagatggagtctcactctgtcatcaaggctgg

SEQ ID NO: 50869 - DNA, 97 bp, Homo sapiens
ttgcttactgtcttttccttttttttttttttttttttttgagacagagtctcactctgtcatccaggctgcagtgcagtggtgcgatctctgctca

SEQ ID NO: 50870 - DNA, 94 bp, Homo sapiens
tttaatctggaaaacctcctcagcctttctttggtttctaagtcacactctgacacactttggggtttggggggccattttcctatgaattaga

SEQ ID NO: 50871 - DNA, 116 bp, Homo sapiens
attacaggcatgagccatggtgcccggcctatttatgtgttaatttttaaaaattatttttaattgtggcaaaagatatataacacaggctgggtacagtggctcatgcctataat

SEQ ID NO: 50872 - DNA, 84 bp, Homo sapiens
cagctttggctgaagggtggttttgtattgcaactctgtcttcgacattcaataaatactgaattcactgtcagtcagtcaatg

SEQ ID NO: 50873 - DNA, 58 bp, Homo sapiens; identical to SEQ ID NO: 637

SEQ ID NO: 50874 - DNA, 69 bp, Homo sapiens
ggaggtggtgacagtagagtgtgtggccctccctgctgggtttcacacctcacccaggtcacgcttacc

SEQ ID NO: 50875 - DNA, 70 bp, Homo sapiens
tttttttgagacggagtctcactctgtcacccaggctggagtgcagtggcgtgatctcggctcacggaaa

SEQ ID NO: 50876 - DNA, 58 bp, Homo sapiens; identical to SEQ ID NO: 3380

SEQ ID NO: 50877 - DNA, 64 bp, Homo sapiens
gtagtcccagctactcaagaggctgaggtaggaggatggcttgagcccaggaggttgaggctgc

SEQ ID NO: 50878 - DNA, 80 bp, Homo sapiens
gataggggtggagccatggagaaagcacagtttttttttttttgtttgtttgtttttttgagacggagtctctctctgtc

SEQ ID NO: 50879 - DNA, 107 bp, Homo sapiens
gcatatatgttttggggggaatactgcatatttctatgtatatttgtgtgtggggggatacatgcatatttataagtatatttgtggggggggataagcatatatgt

SEQ ID NO: 50880 - DNA, 65 bp, Homo sapiens
ccctctgtgtgtgtctgtgtcctaatctcctcttcttataaggacacacacccgttgaaagaggg

SEQ ID NO: 50881 - DNA, 58 bp, Homo sapiens
tgagacagggtctcactctgtcacccaggctggagtgcagtagtgcgatcacagctca

SEQ ID NO: 50882 - DNA, 126 bp, Homo sapiens
cagatagtgtgtgtgtatatatatatatatatatatatatatatatatatatatatatatatatatgtatgtgtatatatatatgtatgtgtgtatatatgtatatatgtgtgtatatatatgtat

SEQ ID NO: 50883 - DNA, 62 bp, Homo sapiens
ctgggattacaggcgtgatctctctctattttttaggagacaggtctcactctgtcacccag

SEQ ID NO: 50884 - DNA, 66 bp, Homo sapiens
ccctctgtgtgtgtctgtgtcctcatctcctcttcttataaggacaccagacagcttgcattaggg

SEQ ID NO: 50885 - DNA, 85 bp, Homo sapiens
tccaggtggaagagacagaagagagggtgcggaagagacttaaaagtcttaggccttcaagcgtgtttgcctcagccacccgtga

SEQ ID NO: 50886 - DNA, 164 bp, Homo sapiens
tatatatacttatatatgttatatatacttatatatgctatatatacttatatatgctatgtatacttatatatgttatatatatacttatatgtatgttatatatacttatatatgttatatatgcttatatgtatgttatatatgcttatatgttatatata

SEQ ID NO: 50887 - DNA, 72 bp, Homo sapiens
ccagcctgggcaagacggtttttttgttttttttttttttgagacacagtctcactctgttgcccaggctgg

SEQ ID NO: 50888 - DNA, 95 bp, Homo sapiens; identical to SEQ ID NO: 580

SEQ ID NO: 50889 - DNA, 93 bp, Homo sapiens; identical to SEQ ID NO: 69

SEQ ID NO: 50890 - DNA, 116 bp, Homo sapiens
gtccaggcacaacttctctcccaatattcagtcagagattgaactgctgtgacacagacactctgtggtcatacagacatttcaaactgatcatgcttaaagttggagtcatgagc

SEQ ID NO: 50891 - DNA, 68 bp, Homo sapiens
cttcgtgttcaaggctcattttcccatggagtttctcactctgtgggtctgtccctggtctcaaaaag

SEQ ID NO: 50892 - DNA, 110 bp, Homo sapiens
tggtattttgttaagagtgcattgaatctgtagatcacttgaggtagtatgttcattttttttcataagctatctcttacaggaaagtatgttcatttttatagtaacca

SEQ ID NO: 50893 - DNA, 107 bp, Homo sapiens
ctttccaaatatatatatattcatatatatgattcatattcatatatatattcatatagatatatgattcatattcatatatatatgaatatccaggtataagaaag

SEQ ID NO: 50894 - DNA, 59 bp, Homo sapiens
ggtggtgaagtctgacctcttttttttttttttttgagagggagtctcgctctgtcgcc

SEQ ID NO: 50895 - DNA, 117 bp, Homo sapiens
gccccacgcacctgggtgacagtgttacagtttctattttatttattcattttttattgcaattacaaatgacttagggatgaatttgtatataaatcttgttgacccagggaaggc

SEQ ID NO: 50896 - DNA, 75 bp, Homo sapiens
ggtcatggcagcccccaaatgtgtagccaagtggagaaaattacagtggtctggacattggcttgcaattgccat

SEQ ID NO: 50897 - DNA, 74 bp, Homo sapiens
agccaaatcaacaatgtgggaagttcgttttgttttttttttttgagacggagtctcgctctgtcacccaggct

SEQ ID NO: 50898 - DNA, 117 bp, Homo sapiens
ctggaaggcctgttcaatgctgaaagtggggtgttgtcatcttcagctatcactgtgtcagactctatctgtctctttagctctaataatatttacttttatatctgggtgctccag

SEQ ID NO: 50899 - DNA, 102 bp, Homo sapiens
tcaagagggtgtgatagtccctgattcccataaaagaatgcaactggcttgtttttatttttaatttttgagacagggtcttgttctgtcactcctgctgga

SEQ ID NO: 50900 - DNA, 119 bp, Homo sapiens
tgagtcagtggtttatgttttgcattttttttgttttgagacaaagtctcgctctgtctcccaggctagagtaccgtggcacaatctcagctcattgcaacctctgcttcctgggctca

SEQ ID NO: 50901 - DNA, 87 bp, Homo sapiens
gaattggtgtagtcagtatagagttgccaaacctgttttccaaaaataatggtaaatctatatttttcttttgaactgcattttttt

SEQ ID NO: 50902 - DNA, 73 bp, Homo sapiens
tttgagtcagtgtctcgctctgtcacccaggctggagcacagtggtgtgatcagagctcactgcagccttgaa

SEQ ID NO: 50903 - DNA, 118 bp, Homo sapiens
gtgtccaggagatatgttttactgagttgcattacaaaactttatatttattaatagttttgttataataatgaaatatacagaagctacagttacataatttttgtttttgagacat

SEQ ID NO: 50904 - DNA, 84 bp, Homo sapiens
tctgtctcagcattagctaagccttttttttgtttgttttttgttttttttttttagagatggggtcttgctatgttgcccaga

SEQ ID NO: 50905 - DNA, 103 bp, Homo sapiens
gccaggttattttttctaatcaatgaataataattgtatatatttatggggtacaatatgatgtcttgatatatgtatacattatggaatgattaaattgggc

SEQ ID NO: 50906 - DNA, 99 bp, Homo sapiens
ctgaggtttcttttttctttcttttttttgggggtggggggacggagtctcgctctgtcacccacgctggaaaactggagtgcaatggagcaatctcgg

SEQ ID NO: 50907 - DNA, 104 bp, Homo sapiens
tgtgcgtatatgtattatgtgtgcatgtgtttaagtatatgtatgtctacatgtatatatatttattacaagtatgacactttactcataaatatgttggcaca

SEQ ID NO: 50908 - DNA, 98 bp, Homo sapiens
gcatacgtgtatatatacatacttgtttatatatttgggggcatatgtgtgtatacatgtatttttgtatgtatatatgtatgtgtatattgtgtata

SEQ ID NO: 50909 - DNA, 98 bp, Homo sapiens
gcaaggccagagcccgggagagctgagccatggcccttcttttttttttttttttttttgagacaggatctctctctctctcacatgggctggagtgt

SEQ ID NO: 50910 - DNA, 74 bp, Homo sapiens
ttgtattttttgagactgagtctcactctgtcccccaggctggagtgcagtgacaagatctcagctcactgcaa

SEQ ID NO: 50911 - DNA, 114 bp, Homo sapiens
tgaagggaatcattcagggaaaggttttacactttgctcctccactactcaaaaatcacagaagacacactggagagcaaagtgatggatacagtcatcgtgggaaaggcttca

SEQ ID NO: 50912 - DNA, 118 bp, Homo sapiens
tagctgggactacaggtgcacaccagcatgcccagttaatttttgtatttttatttatttatttatttattattattattattttttgacatggagtctcactctgtcgcccaggctg

SEQ ID NO: 50913 - DNA, 76 bp, Homo sapiens
tgatgattttgagatggagtctcactcactctgttgtccagcctggagtgcagtggcatgatctcggatcagtgca

SEQ ID NO: 50914 - DNA, 130 bp, Homo sapiens
tcagcctcttgagtagctgggatcacaggcgcgcatcacaatgcccagctaatttttgtattttttaagcagaagcggggtttcaggatgttgtccaggctggtctcaaactcctgacctcaagtcatgc

SEQ ID NO: 50915 - DNA, 128 bp, Homo sapiens
aggtgggagcttgaggccaggagttcaggaccagcctgggcaacacagcaagaccctatttatttatttatttatttatttatttatttattttttgagacagagtcttgctctgtcacccaggctgg

SEQ ID NO: 50916 - DNA, 58 bp, Homo sapiens; identical to SEQ ID NO: 2248

SEQ ID NO: 50917 - DNA, 76 bp, Homo sapiens
ccagcctgggcaatagagcaagaccccatcttttttttttttttgagatggagtctggctctgtcgcccaggctgg

SEQ ID NO: 50918 - DNA, 89 bp, Homo sapiens
ccgggtagcgcaggtggaggtggaggagccgatgcctggagctccgggttcccttcccagctctgcctctcactgactgtgcgtcctgg

SEQ ID NO: 50919 - DNA, 113 bp, Homo sapiens
aggtgagcagccccaagtgggaagtataggccccaggtgtgagaagggactgtccccatggctgccctctgcctggtggttttccaggctccttgactagtggctctttgctt

SEQ ID NO: 50920 - DNA, 78 bp, Homo sapiens
gctggggttacaggtgtgagccactgcacccttttttttttttttttttgagacgtagtctcactctgtcacccaggc

SEQ ID NO: 50921 - DNA, 120 bp, Homo sapiens
tatactaacaaggacgtgagggttcttttttttttttttttttttttttgagacggagtctcactctgtcacccaggctggaggagtatgaaggaactggacaacctactgtgtgcgtgg

SEQ ID NO: 50922 - DNA, 81 bp, Homo sapiens
ggtttgagtctgaacaaagacgatgatggcaggttattagacttgtgtgttttttgttgtttttttgttctgagacggatt

SEQ ID NO: 50923 - DNA, 79 bp, Homo sapiens
gctgggtctcgccctcaacctgtgcatgtatatgtgtgtctttgtgtgtgtatgtgtgatctctgcctgcaggaccagc

SEQ ID NO: 50924 - DNA, 72 bp, Homo sapiens
gggatggcaggcgtgagccactacccctggctcccacccacttttttgagacagggtctcactctgtcaccc

SEQ ID NO: 50925 - DNA, 58 bp, Homo sapiens; identical to SEQ ID NO: 605

SEQ ID NO: 50926 - DNA, 90 bp, Homo sapiens
gtgttcctaggtccctgggtattcgggtccctgggtcctcagatctctgagtccctgagtccctgggtccctgggtccctggattcccac

SEQ ID NO: 50927 - DNA, 79 bp, Homo sapiens
gcctgctgcgggtgagccccgggggtggatctgacgtatgtttagtttttgagacagtctctcgctctgtcgctcgggc

SEQ ID NO: 50928 - DNA, 94 bp, Homo sapiens
gggtccctggatctctgggtttctggatctctgggtccttgaatccctaagtccctgggttcctcagtccctgagtccctgagtccctgagtcc

SEQ ID NO: 50929 - DNA, 71 bp, Homo sapiens
ctctgggtccctgagtgtctgagtccctggatgctaatgtatataggtccctagttctcagggcccctgag

SEQ ID NO: 50930 - DNA, 118 bp, Homo sapiens
tgtgcagcagtgttaattgaacacacaagtacaggatggagtgagaaagtgtgactgtgtgtgtgtggctgtgtatgattgtgtgtggctgagtgcatggcttttgtgagcaggcagt

SEQ ID NO: 50931 - DNA, 88 bp, Homo sapiens
cgttgtagggctccaccaccgtgtctgacactttgggcgagggcaccacgctgaaggtgttcatgatgcggtctgggaactcctcgcg

SEQ ID NO: 50932 - DNA, 74 bp, Homo sapiens
tgtgtgtgtgtatatatatgtgtgtgtgtatatatatatgtgtgtatatatatatgtgtgtgtatatatatata

SEQ ID NO: 50933 - DNA, 78 bp, Homo sapiens; identical to SEQ ID NO: 22393

SEQ ID NO: 50934 - DNA, 70 bp, Homo sapiens
gttgttgagagggagtctcgctctgtcacccacgctggagagcagtggcgcgatcttggctctcagcaac

SEQ ID NO: 50935 - DNA, 160 bp, Homo sapiens
tgggcgacacagtgagtccatctcaaaagtaaaaataaaactatgtgtagattatttagaattttcttttttttttttttttgagacagagtctcactctgtcacccaggctggagtgcagtggtgtgatctcggctcactgtaagctccacctcctggg

SEQ ID NO: 50936 - DNA, 58 bp, Homo sapiens; identical to SEQ ID NO: 1435

SEQ ID NO: 50937 - DNA, 87 bp, Homo sapiens
tgattctccaccgtccctctcactcactctggtcgtctggtcgctgggcctttagtgagtgtgccatgggggccctggggccgatta

SEQ ID NO: 50938 - DNA, 171 bp, Homo sapiens
gggcaacatagcaagaccttggctctacaaaaaaatttattttattttattttattttattttattttattttattttattttattttatttgagacagactctcactctgttgcccaggctggagtgcagtggcgtgatttcggctcactgaaacttccacctcccaggc

SEQ ID NO: 50939 - DNA, 118 bp, Homo sapiens
gctctctaatctgattaaactgaaagaggctaatgactctttacagtagtaagagagcactggtggtccatggcatgatctggcaatagagagatgcagatatcaccactgtatactc

SEQ ID NO: 50940 - DNA, 139 bp, Homo sapiens
gtgctggcatgtaaatgtgcgtgcatatgtgggcaggtgcatgcatatgtgtatggtcatctgtgtgcatgtgcatgtggtccatgtacatgcatgcatgtgcacgtgtgtgtatgtgtgaacatgcatcacatgtgca

SEQ ID NO: 50941 - DNA, 100 bp, Homo sapiens
ctgctttagtgatgctgcctggcaggctctatgagaaagaggatcagattctccggtcatgtgggcattgctgtcacgttagtaaggatcattcgagcag

SEQ ID NO: 50942 - DNA, 75 bp, Homo sapiens
ttgtttgtttgtttgagacacagtctcgctgtcacccaggctggagcacagcggtgtgatctcggcttatagcaa

SEQ ID NO: 50943 - DNA, 69 bp, Homo sapiens
ttttagtacactgacagggtgtactttttttttttttgagacagagtctctctgtcacataggctggag

SEQ ID NO: 50944 - DNA, 108 bp, Homo sapiens
gccctaaatccaataacaagtgtccttgtaagagacacacagacagacataggagaaaaccatgtaaagatggagtcacaatccaaggatgcatgtgaaataggaggc

SEQ ID NO: 50945 - DNA, 73 bp, Homo sapiens
tttgagacagtctcagtctgtcacccaggctggagtgcagcctggcccaatcacagctcactgcagtctcaaa

SEQ ID NO: 50946 - DNA, 106 bp, Homo sapiens
gttaggatcaactccagaatgtcacaggcttgccacagtaggagttattttttccttatgtatcagtagagggtgagcaaacaggtctgaagagtgtctatcctgc

SEQ ID NO: 50947 - DNA, 58 bp, Homo sapiens
tgagatggagtctcactctgacacccaggctggagtgcagtggcaagatctcggctca

SEQ ID NO: 50948 - DNA, 79 bp, Homo sapiens
tggctctgctccatgtgtgttctgcatgaccacagatgagacagtggtcatcaggatagtacacaagtgagagaaaaca

SEQ ID NO: 50949 - DNA, 75 bp, Homo sapiens
gtttgttttttgaaatggagtctcactctgtcacccaggctggaggacagtggtgcaatctcagctcactgcaac

SEQ ID NO: 50950 - DNA, 116 bp, Homo sapiens
ctgaaggaagagagaaagggggaaggtgctacatagttttgtttgtttgttttgagacagattctcactctgtcacccaggctgggctgcagtggcacaatctcggctcactgcag

SEQ ID NO: 50951 - DNA, 98 bp, Homo sapiens
gtgactctgatgactctaggaacctcatataagtggaataatataggatttattcttttttaaaaaatttattttgagatggagtctcactctgtcac

SEQ ID NO: 50952 - DNA, 126 bp, Homo sapiens
ttcggtagcagtcatcgagtgatatcttttttctttttttcttttttgagacggagtctcgctctgtctgccaggctggagtgcagtgggcacgatcttggctcaccgcaagctccgcctcccagg

SEQ ID NO: 50953 - DNA, 66 bp, Homo sapiens
gcctgggtgacagagtgagactctgtctcaaaaaaaaaaggcaatctctccctgtctctctcaggc

SEQ ID NO: 50954 - DNA, 69 bp, Homo sapiens
gggaaacatggtgagaaccccatctctacaaataatttttttttagatggagtctcactctgtcatctc

SEQ ID NO: 50955 - DNA, 56 bp, Homo sapiens
gagatcgagtctcgctctgtcacccaggctggagtgcagtgcagtggcacgatctt

SEQ ID NO: 50956 - DNA, 58 bp, Homo sapiens; identical to SEQ ID NO: 23013

SEQ ID NO: 50957 - DNA, 59 bp, Homo sapiens; identical to SEQ ID NO: 23012

SEQ ID NO: 50958 - DNA, 88 bp, Homo sapiens; identical to SEQ ID NO: 3816

SEQ ID NO: 50959 - DNA, 97 bp, Homo sapiens
cctgagtagctgggattataggtgtgtaccacttttttgtattttattttattttattttttcgagacagggtctcactctgtctcccaggctcggg

SEQ ID NO: 50960 - DNA, 74 bp, Homo sapiens
ttgccattgagggataggtgctgagggagcctgtcctctcagaacctcagtctccctgtctgtaaatttgggga

SEQ ID NO: 50961 - DNA, 124 bp, Homo sapiens
agaggcgtccagcgtgagccccgcccacctggggaccccagctccagtggcctctctgtgtctctgtttccccgcatgttcaccggggcggaagaaggctcccagtcaggggagttgggggtcc

SEQ ID NO: 50962 - DNA, 58 bp, Homo sapiens
tgagatgaggtctcactctgtcacctaggctggagtgcagtggtgcgaccttggctca

SEQ ID NO: 50963 - DNA, 77 bp, Homo sapiens
ctgggattacaagcgtgagccaccttttgtttgtttgtttgtttgtttttgacatggagtctcactctgtcgcccag

SEQ ID NO: 50964 - DNA, 96 bp, Homo sapiens
agaacacggggtaactgcgatcattgcacttggtgttcacagtgggccaggcacacagtagacactcagttcaaccaatccgctgccttctgttct

SEQ ID NO: 50965 - DNA, 96 bp, Homo sapiens
ccaggctcctggctctggtgagctcttatttatttatgtatgtatttatttatttatttatgtagagatggagtctcactctgtcacccaggctgg

SEQ ID NO: 50966 - DNA, 118 bp, Homo sapiens
aggcatggtggtgcatgcctgtagttccagctactcaggaggctgaggtggaaggatggcttgagcctgggaggtggaggttgcagcaagctaagattgtgccactgtactccagcct

SEQ ID NO: 50967 - DNA, 173 bp, Homo sapiens
gtatatatgtatatatgcgtatatacgtatatatgtatatatgtatatatgcgtatatacgtatatatgtatatatgtatatatgcgtatatacgtatatatgtatatatgtatatatgcgtatatacgtatatatgtatatatgtatatatatgtatatatgtatatatata

SEQ ID NO: 50968 - DNA, 93 bp, Homo sapiens
ccaggctggagtgcaatggcgtgatcttggccctaatttttaattaattaatttatttttgaggcggagtttcactcttgttgcccaggctgg

SEQ ID NO: 50969 - DNA, 81 bp, Homo sapiens
gagtctcactctgtctcccaggctgaagtgcagtggtgcaatctcagctcactgcaacctcactgggttcaagtgagtctc

SEQ ID NO: 50970 - DNA, 58 bp, Homo sapiens; identical to SEQ ID NO: 2626

SEQ ID NO: 50971 - DNA, 72 bp, Homo sapiens
ggaccctgtgctctgggcacccccttgcatggatctgggtctgggtgagtcactgcctgagtcagggaaccc

SEQ ID NO: 50972 - DNA, 142 bp, Homo sapiens
gcctaggcaacatagcaagactctgtctctacaaaaagattatttatttacttatttgagacagagtctcgctgtgtcactcaggctagaatgcagtggtgcaatcttggctcactgcaacctctgcctcccaggttcaagc

SEQ ID NO: 50973 - DNA, 73 bp, Homo sapiens
ccgggagtggtgacatgcacctgtattcccagctacttgggaggctgaggtaacaggatcacttgagcccagg

SEQ ID NO: 50974 - DNA, 92 bp, Homo sapiens
cagcctgaccaacctagtgagaccccatctctataaaagacattttttttttttttttttttagacagagtctcactcagtcatccaggctg

SEQ ID NO: 50975 - DNA, 93 bp, Homo sapiens
ttcagtctggatgtgttgagtctgagatcatggtgctatttcttttttttttttttttttgagacggagtctcactctgccgcccaggctgga

SEQ ID NO: 50976 - DNA, 109 bp, Homo sapiens
acagagaggggacgacctgctccaggacacgtgtagagaagaaatgaagctcattgctggtgttttttttttctttttaatatttttttgagacagagtctcgctctgt

SEQ ID NO: 50977 - DNA, 58 bp, Homo sapiens; identical to SEQ ID NO: 1763

SEQ ID NO: 50978 - DNA, 84 bp, Homo sapiens
cccatctccaggcagccagcatggctgggattatgtattcagcttcgagctctgacaccctgtcaccctgggccacatgttggg

SEQ ID NO: 50979 - DNA, 103 bp, Homo sapiens
ctgggattacaggtgtgagccactgcgcccagcctatttattgatttttaaaatcaatttattttcttttttttggggagcagggtctcactctgtcacccag

SEQ ID NO: 50980 - DNA, 109 bp, Homo sapiens
gtcaggtgacacaatgccagtcccaccactgtgtggcttcaggcaagttgctcaccctctctgtgcctgtttcccactctgtgaaatgagatctgtaacagttcctgac

SEQ ID NO: 50981 - DNA, 66 bp, Homo sapiens
ggcaggactgaacagagtgtgttgacagcaggaatgagtcctgttggaatgatctagcagccagcc

SEQ ID NO: 50982 - DNA, 80 bp, Homo sapiens
tgagcgtgcaagtgtgtgtgtgtatctgtgtgtgtaagtgggtttatatgcaagatggcgggagtgtgtttgtgtgtcta

SEQ ID NO: 50983 - DNA, 94 bp, Homo sapiens
attattgcattaactgtagtcccagctattcgagaggctgaggtagaaggatcccttgaggccctgggaggttgaggctgcagtgagctgtgat

SEQ ID NO: 50984 - DNA, 154 bp, Homo sapiens
gcccaggagtttgagaccagcctgggcaacatagcgagacccatgtctataaaaagcaatttttttttttttgagatagggtctcactctgtcgcacaggctggagtgcagtggtgcgatctcggctcactgcaacctccacctccctcgttca

SEQ ID NO: 50985 - DNA, 129 bp, Homo sapiens
cgggagagagtgggtaggagagagaccccttgttcagctgtctgtctctctcttttttttttttttttttttgagacagagtctcactctgttacccaggctggagtgcagtggtgtgatctcagctca

SEQ ID NO: 50986 - DNA, 58 bp, Homo sapiens
tgagacagagtctcgctgtgtcactcaggctggagtgcagtggcaagatctcggctta

SEQ ID NO: 50987 - DNA, 118 bp, Homo sapiens
ggtggagcccagagagcgtccagggtaggaggaagatggtaagtcgtggaaggcaacaaccccactgtccctctgtgacacagatacccccactcctgcaatgcctggccccacctgg

SEQ ID NO: 50988 - DNA, 100 bp, Homo sapiens
gggtgacaagagtgagattctgtgttagaagaaaagaaaagaaaaaatatattgtaatttaaattaatttatttagagacatggtctttctctgtccccc

SEQ ID NO: 50989 - DNA, 74 bp, Homo sapiens
ggcatgagccactgtgcccggcctcagtttttttctttaaaaagagtgaattgtgtacaagggggttaaatgct

SEQ ID NO: 50990 - DNA, 58 bp, Homo sapiens; identical to SEQ ID NO: 637

SEQ ID NO: 50991 - DNA, 108 bp, Homo sapiens
gcatggtggtgtctccctgtagtcctagctactctctaggaggctgaggtggaaggatgacaagcctgggagatctaggctgcagggagctgtgatcacaccaccagc

SEQ ID NO: 50992 - DNA, 94 bp, Homo sapiens
ctactgtactccaaccttggagacagagggagactgtcttatttatttttttgagatggagtctcactctgtcgcccaggctggagtgcagtgg

SEQ ID NO: 50993 - DNA, 58 bp, Homo sapiens; identical to SEQ ID NO: 87

SEQ ID NO: 50994 - DNA, 56 bp, Homo sapiens; identical to SEQ ID NO: 88

SEQ ID NO: 50995 - DNA, 93 bp, Homo sapiens
gcatgagtgaatgaatgaatgagggagagaaagaggaaggtcttccatgtctgaaacttttttttttttttttgacacacagtctcactctgt

SEQ ID NO: 50996 - DNA, 63 bp, Homo sapiens
acaggtgtgagccaccatgcctgcattttttctttttcttttgaggcaggggtctcactctgt

SEQ ID NO: 50997 - DNA, 67 bp, Homo sapiens
ccaggctgggctttggacttgacttttttttttttgagattgagtcttactctgtcacccaggctgg

SEQ ID NO: 50998 - DNA, 79 bp, Homo sapiens
ggttgcagtgagccgagatggcgctgagaggtgacagcgtgctggcagtcctcacagccctcgctcactctctgcgact

SEQ ID NO: 50999 - DNA, 85 bp, Homo sapiens
ggcttcccaaagtgctgggattacaggcatgagccacgacccccggccaatttttgtgtttttctagtagagatggggtatcgcc

SEQ ID NO: 51000 - DNA, 112 bp, Homo sapiens
cagctttttgaagatgggtgatttttaaacaagggtgctagcattttttttgtttttcaaaagcctttaaacttggtaagttcttggcagaagataccccagttgaaacatg

SEQ ID NO: 51001 - DNA, 71 bp, Homo sapiens
acagagtgagactctgtgtctgtctcagttgaaaaaaaaaaaaaaggccaggcgcagtggctcacgcctgt

SEQ ID NO: 51002 - DNA, 108 bp, Homo sapiens
cctgggttgacgacaagatgttaggttccattcattcatccatccatccatccatccattcatttatttatttattttttgagatggagtctcgctctgtcacccagg

SEQ ID NO: 51003 - DNA, 115 bp, Homo sapiens
tgggattacaggcatgagccactatacctggctgggtgattttttttgagacagggtctccctctgtcactcaggctggggtatagtggcgccgtgatagttcactgtagcctca

SEQ ID NO: 51004 - DNA, 96 bp, Homo sapiens
ggtgtacaacggggagctgggcctgcagagggctgagttccaccctacctggggtccggactctgtttctctcattccaacgtctgtctgtctacc

SEQ ID NO: 51005 - DNA, 111 bp, Homo sapiens
agcactgtgaggaggggcctgtggctggacgtgggatttttttattttttattttatttttattttttttgagacagtctcattctgtcacccagcctggagtgcagtgtt

SEQ ID NO: 51006 - DNA, 86 bp, Homo sapiens
tttgggaggctgaggcgggtggatcacttgaggtcaggagttcaagaccagcctggccaacatagtgactctctgtctctactaaa

SEQ ID NO: 51007 - DNA, 95 bp, Homo sapiens; identical to SEQ ID NO: 68

SEQ ID NO: 51008 - DNA, 93 bp, Homo sapiens; identical to SEQ ID NO: 69

SEQ ID NO: 51009 - DNA, 88 bp, Homo sapiens
tggagtgaatttgtggggattcagggaattggacgttagggaactgcccgaaatctgactgtgtctctctctctgtcctacagctcca

SEQ ID NO: 51010 - DNA, 88 bp, Homo sapiens; identical to SEQ ID NO: 51009

SEQ ID NO: 51011 - DNA, 88 bp, Homo sapiens; identical to SEQ ID NO: 51009

SEQ ID NO: 51012 - DNA, 88 bp, Homo sapiens; identical to SEQ ID NO: 51009

SEQ ID NO: 51013 - DNA, 85 bp, Homo sapiens
cagaatgggactctatgtgtaagatcaggcttttttttttttttttttttttttttttttttttttgagatggagtctcactctg

SEQ ID NO: 51014 - DNA, 73 bp, Homo sapiens
ttgagatagagtctcgctctgtcacccaggctggagtacagcctcctaggctcaggcgatcctcccacctcag

SEQ ID NO: 51015 - DNA, 96 bp, Homo sapiens
tatgttacatataatgtatgttatatatgatatattatatataattatattatacataattgttatatataatgcatacattgtatttgttacgta

SEQ ID NO: 51016 - DNA, 74 bp, Homo sapiens
ggggaagagacagcagggagtgtcctcactctcagcacctctgctgagactacagactcacctaacatccaccc

SEQ ID NO: 51017 - DNA, 86 bp, Homo sapiens
tgagattctaatccagagtagttgggggacaggaagcccagcctataacccctgatttttttttttttttttgagacagagtctca

SEQ ID NO: 51018 - DNA, 56 bp, Homo sapiens
gggactttggagaacgggacaggtctatgcctgggtccctgttttccttcaagccc

SEQ ID NO: 51019 - DNA, 79 bp, Homo sapiens
gggtgcagaaaggctctctatcctctttccatttgcccaaaagcaaatagagacacaggacagagagctgactgtactt

SEQ ID NO: 51020 - DNA, 97 bp, Homo sapiens
gttgaggttgagtgatgaaagcaggcagccctgggtcttggtgacagatcactgggtggacgtgggaaaatgtttggagtgtttcttagttcttttc

SEQ ID NO: 51021 - DNA, 81 bp, Homo sapiens; identical to SEQ ID NO: 35667

SEQ ID NO: 51022 - DNA, 104 bp, Homo sapiens
atgaatagatgttaggataggtgtatcctagcacagtgctcaggggtcctgcaataaccttttatttatttattttgagatggagtctcgctctgtggctcagg

SEQ ID NO: 51023 - DNA, 77 bp, Homo sapiens
ttgtttgtttgtttgagactgagtctcgctctctcacccaggctagagtgtgatggcacgatctcagcttacctcaa

SEQ ID NO: 51024 - DNA, 58 bp, Homo sapiens; identical to SEQ ID NO: 14455

SEQ ID NO: 51025 - DNA, 58 bp, Homo sapiens; identical to SEQ ID NO: 884

SEQ ID NO: 51026 - DNA, 56 bp, Homo sapiens; identical to SEQ ID NO: 885

SEQ ID NO: 51027 - DNA, 72 bp, Homo sapiens
ttaggaaaatggaaatcaagagcacaatgagacaccacttcattgtttttttgtttatttttgtttttttga

SEQ ID NO: 51028 - DNA, 77 bp, Homo sapiens
gaccacaggggcgtgccaccatgtctggctaattttttatttttttgtttttttttgagatggtgtctcgctctgtc

SEQ ID NO: 51029 - DNA, 75 bp, Homo sapiens
gtccaacagtcagaaaaatgagctgaaaactagaggtcaccaggcctttatacatctgtctctctgtctgatggc

SEQ ID NO: 51030 - DNA, 59 bp, Homo sapiens
ggtctgtctgtgtgactgtcatgcaggcctgtctgtgtgattgtcagggagaattgacc

SEQ ID NO: 51031 - DNA, 99 bp, Homo sapiens
ggtagtagtgttgcgggacgatcaacgatgggagagactgaacagagtgagttcaggaaaggtctttaaaaggtgatcacctggctcaggaggactggc

SEQ ID NO: 51032 - DNA, 99 bp, Homo sapiens
gacagagcaagactacatctcaagaaaaaaaaaaaaaaagtgctgaagaacattaaccaaaagattttttttttttttgagacagagtctcgctctgtc

SEQ ID NO: 51033 - DNA, 91 bp, Homo sapiens
gtaaagtgtaaaaattattctggagagaaataaggaacagactttagtttgttttttgtttgttttttctgtttgtttgttttactgttgc

SEQ ID NO: 51034 - DNA, 128 bp, Homo sapiens
ccagcctgtgcaacatagtgagacccccatctctatttttttttttttttgagacagaggctcgctctgtcgctcaggctggagtgcagtggagcgatattggctcactgctagctctgcctcccagt

SEQ ID NO: 51035 - DNA, 95 bp, Homo sapiens
ttgctttgagatggagtctccctctgtcactcaggctggagtccaggggtgcaacctctgctcactgcaacctctgccacctcacctggctgtca

SEQ ID NO: 51036 - DNA, 82 bp, Homo sapiens
gttgttgttcttgttttgagacagtttcactctgtcacgcaggctggagtgcactggcatgatctcagctcactgcaatctc

SEQ ID NO: 51037 - DNA, 116 bp, Homo sapiens
ccattctgtaggtgattgtttgagccactgtttcatgtttgattaattaatgattgtcattattattattattattttttttttgagacagagtcttgctctgtcacctaggctgg

SEQ ID NO: 51038 - DNA, 68 bp, Homo sapiens
gctttgggaggctgaggttggaggatcacttgaggtcaagagttcaagaccagccagcacaacagagc

SEQ ID NO: 51039 - DNA, 83 bp, Homo sapiens
ggttttgtttttttttttgagacagagtctcactctgtcacccaggctggagtgcaatggcactgtctcaactcactgcaacc

SEQ ID NO: 51040 - DNA, 92 bp, Homo sapiens
gcatggtaactcttttccaggattctacagcctagggtaaagagtcatgccgactctctgtctctgctatatcctgaagttcaacaacatgc

SEQ ID NO: 51041 - DNA, 87 bp, Homo sapiens
gcaatggtgtggagtgattctggctgtttcttttctttttccttttttttttttttttgagatggagtctcgctctgtcacccaggc

SEQ ID NO: 51042 - DNA, 112 bp, Homo sapiens
cggctatatatatatacacatatatatacacgtatatatatgtgtatatatacatatatacgtgtatatatacacgtatatacgtgtatatatacgtatatatacacgtata

SEQ ID NO: 51043 - DNA, 61 bp, Homo sapiens
gggcttgtgtgtccgtcggtctgtgggtcagtcaaatacccagagagcgggcaggctgctc

SEQ ID NO: 51044 - DNA, 120 bp, Homo sapiens
ccagcctcagttttctgcatattattagttggataataagtaatacaggttttttttttttttgagatggagtcttgcactgtcgccctggctggtgtgcagtgacatgatcttggcttg

SEQ ID NO: 51045 - DNA, 113 bp, Homo sapiens
ggagttcgagaccagtcttggcaacatagggagactcctgtctctgtctgtctacctgtctgtctatctatctatctatatttatttttgaaacagagtctctctctgttgcc

SEQ ID NO: 51046 - DNA, 132 bp, Homo sapiens
agagcggactgacctctgcgagataagatcagccccagcttggtatagtttgggtctttttttttttttttttctgagacgtagtctcgctctgttgcacaggctggagtgcaatggcgcggtgccggctca

SEQ ID NO: 51047 - DNA, 58 bp, Homo sapiens; identical to SEQ ID NO: 1868

SEQ ID NO: 51048 - DNA, 59 bp, Homo sapiens
ttgagacagtctcactctgtcgcccaggctggagtgcaggtgcagtggcgcgatctcag

SEQ ID NO: 51049 - DNA, 58 bp, Homo sapiens
tgagtcggagtctcactctgtcactcaggctggagtgcaatggcgtgatctcagctca

SEQ ID NO: 51050 - DNA, 83 bp, Homo sapiens
tgtctctctgtgtctgtctgtctctacctctgggattctatctccatctcaccataggaccctgacggggaccctgggaaaca

SEQ ID NO: 51051 - DNA, 101 bp, Homo sapiens
ccagcctgggcgacagagcgagacctccatttcaaaaacaatttttttttttttttttttttttttttggagacagagtctcgctctgtcgcccaggctgg

SEQ ID NO: 51052 - DNA, 91 bp, Homo sapiens
gtggtttgagaaagaaagacactctgtgtgtgtgagggggtccatccatccatccattcatccattcagcagatatttcttgagcacctac

SEQ ID NO: 51053 - DNA, 75 bp, Homo sapiens
ggttggatgtcttagaattatactttccagacatccttgtggttaaggctctggatgaattctgttgtgccaatt

SEQ ID NO: 51054 - DNA, 101 bp, Homo sapiens
gtatgtatgtatatgtacataatatatacatatatgtatatgtatgtgtatgtacataatatatacgtatatgtatgtgtatgtacataatatatacgtat

SEQ ID NO: 51055 - DNA, 111 bp, Homo sapiens
tcctggtcttcctcctttgcatagattcctttgtgagttgtattgttaaggtaaaatccttagaaaatatttttatttgcaaaaaatgttcatgggaggtaattgtcctga

SEQ ID NO: 51056 - DNA, 82 bp, Homo sapiens
gtgtgtatgtatatatgtatgtgtgtgtatattttataatacatgtataatatatgtataatttgtgtgtatgtgtatatat

SEQ ID NO: 51057 - DNA, 86 bp, Homo sapiens
gccaggatgactctctgcctctgtggtagctcattgctgagggatgggggcaggaagtgtggggggtgacacagaggaggagtgat

SEQ ID NO: 51058 - DNA, 72 bp, Homo sapiens
gctggtaggtgtgagaggtggagttcccaccttgggggtgactctgtgcctgtgctccactcttgaccacgc

SEQ ID NO: 51059 - DNA, 99 bp, Homo sapiens
gcctgcttcacctgtcttcattatttattagtttatcttgctttaaaatctacccagaggaaaagcaaggacaagagtgaaatcagttgccatcagtgc

SEQ ID NO: 51060 - DNA, 117 bp, Homo sapiens
ttcatgtgctctggggaagctagatgccatgttgtaagggagctcaagccagattactgagtgatgagacaccttgtgaagagagagggtatcattgagaagaactaaacatgtgag

SEQ ID NO: 51061 - DNA, 94 bp, Homo sapiens
gagattttaattcatactgaatagaaaagctgaagaaaaaaatggacttttataagccacaagcaatttttttttttttttgaaatagagtctc

SEQ ID NO: 51062 - DNA, 103 bp, Homo sapiens
gggttggtaatctggcttgagtctgcaagatgtgtgtgtatgtatctataactatgtatctataaatctatattttcaacttgggccactagtttaaaaatct

SEQ ID NO: 51063 - DNA, 66 bp, Homo sapiens
atcagaacttccagggatgggtcttgggaatctccattttcaaaaggctccctctgtgcctctgat

SEQ ID NO: 51064 - DNA, 86 bp, Homo sapiens
taaaatgctaagtgttgagagaacatacagagggcgcaaagatcattggctttgagtgtgttcttccaggactgataaggatctta

SEQ ID NO: 51065 - DNA, 73 bp, Homo sapiens
tggggaggccgcatgacacagaggttgaatgtgggctctggtgtctgactttctgtgtctgactcctacctca

SEQ ID NO: 51066 - DNA, 66 bp, Homo sapiens
gagtatatatgtgagtgtgtctgttagtgggtgtttgtactcacagacacactcatatacatactc

SEQ ID NO: 51067 - DNA, 76 bp, Homo sapiens
gatcactgggtgtgaacactgtctgcacaccaggcttctggagtgccagctgtggtttcgtggcacaactagtatc

SEQ ID NO: 51068 - DNA, 128 bp, Homo sapiens
tgttctttttgcttaggattgtcttggctatgtaggctcttttttggttccatatgaaatttaaagtagtttttttctaattctgtgaagaaggtcaatggtagcttgatgggaatagcattgaatct

SEQ ID NO: 51069 - DNA, 73 bp, Homo sapiens
gcctttggttttcctttttcatattttattttgcacctacaataataagcatgcagagaggagacagagaggc

SEQ ID NO: 51070 - DNA, 77 bp, Homo sapiens
tgtttgcctgaaaataatctaaatttcttcttcacatggaaggtaactttcacgggatatagattttcaggatgaca

SEQ ID NO: 51071 - DNA, 77 bp, Homo sapiens
gggacttcataggtttgagcactgaaagtcctgcactaggtatggaaaactcctcaggctcagtcactctgtgtccc

SEQ ID NO: 51072 - DNA, 64 bp, Homo sapiens
gttagagtgactgcatgtgcttgtgtggtaggaaaggcaggttgaagggttcgggagctctaac

SEQ ID NO: 51073 - DNA, 102 bp, Homo sapiens
agttaagttttttcaataatattagacaataaaatgttcaactttgctcttttgcatgtgaatatgtatttttctatgtaccacttgttgaaaagactgtct

SEQ ID NO: 51074 - DNA, 108 bp, Homo sapiens
cttcaataaacgggtagataaaaacagtgttgttttattatacatttatttgcagtttcaaatatgttaggtttacttactgtaaattcaaccaagagtttattgagg

SEQ ID NO: 51075 - DNA, 95 bp, Homo sapiens; identical to SEQ ID NO: 68

SEQ ID NO: 51076 - DNA, 93 bp, Homo sapiens; identical to SEQ ID NO: 69

SEQ ID NO: 51077 - DNA, 89 bp, Homo sapiens
cacgtgtatatgtatatgtgtgtgtctatatatatatagaatattatacatattgtgtgacacatatttattcatatactttatatgtg

SEQ ID NO: 51078 - DNA, 115 bp, Homo sapiens
acagcatctaccagggcaccgctgggaactatttgtaaaagtactatgccagtttaaaagactagtgattatgtatatttggtgtaaaaaagtccaggcttcctggaagagctgt

SEQ ID NO: 51079 - DNA, 105 bp, Homo sapiens
ggataatggcctccagctgcatccaagttgctgcaaaggacgtgattttgttcatttttataaaaatgccctttacactaactttttttttcctgtccaggatcc

SEQ ID NO: 51080 - DNA, 104 bp, Homo sapiens
tagctcacttgaatagtgctatgtgccaggcactctttttatatatatatatatatatatactttaagttctagggtacatgtgctcaacttgcaagtttgtta

SEQ ID NO: 51081 - DNA, 102 bp, Homo sapiens
cagtactagcttgtgactttctgtgaaaacagctagatagattatggagtcaatttgaatctatagatctatttaggcagaattgacatcttaacagtattg

SEQ ID NO: 51082 - DNA, 86 bp, Homo sapiens
tactcaaacctagcccactctagcagccaggaagatctttcaaaagcaggaatgaagatttccaggtcagtgtggtgtggtgagtg

SEQ ID NO: 51083 - DNA, 72 bp, Homo sapiens
gactcaaatacctggagactctcagactctcaggcatcaagataagggtctgggaagcccaccatttggctc

SEQ ID NO: 51084 - DNA, 106 bp, Homo sapiens
tgtctttctagggagtaacttctatttcaaaggtgatattttttctttttttgaaaacttatccaaaccttcggagatccagcagaagtggatccctagagtttca

SEQ ID NO: 51085 - DNA, 95 bp, Homo sapiens
gtatgtcttatagcttccagatgttttctcatatctacacgtttaggtgtctgtctccctctgttagatatgagcttcttgaaactaggactcac

SEQ ID NO: 51086 - DNA, 58 bp, Homo sapiens; identical to SEQ ID NO: 1391

SEQ ID NO: 51087 - DNA, 56 bp, Homo sapiens; identical to SEQ ID NO: 1392

SEQ ID NO: 51088 - DNA, 78 bp, Homo sapiens
ccctgggagaaagagtgagtttgaaagaaggaactgggcatgatctgctcagccagtctctgcctctctctccttggg

SEQ ID NO: 51089 - DNA, 77 bp, Homo sapiens
tgtatccaatatataatatacatattatataaaatatagtatttcacatataatatgtatattatatattgtatata

SEQ ID NO: 51090 - DNA, 132 bp, Homo sapiens
ccacatcaattatttataaattactgtttatagaaatggctgcatcataaatagcttctagattctataaatgtatttatgcatatgtggcaaatacaaagataatatatttgaagcattaagccattttta

SEQ ID NO: 51091 - DNA, 95 bp, Homo sapiens; identical to SEQ ID NO: 68

SEQ ID NO: 51092 - DNA, 93 bp, Homo sapiens; identical to SEQ ID NO: 69

SEQ ID NO: 51093 - DNA, 106 bp, Homo sapiens
agtttggttctgggattgttttggctttatcagggggcaacattttatttatatgtttccactggttctgctcagccttgcaaataatctagttccctaccaatct

SEQ ID NO: 51094 - DNA, 115 bp, Homo sapiens
tgtctcccccagaaacggttgcaggtgatttttgtttgtttgtgttctgtcatgacaacacagaacacagtggggagagggactcacctgaaattgctggttagaaagggaagca

SEQ ID NO: 51095 - DNA, 95 bp, Homo sapiens; identical to SEQ ID NO: 580

SEQ ID NO: 51096 - DNA, 93 bp, Homo sapiens; identical to SEQ ID NO: 69

SEQ ID NO: 51097 - DNA, 205 bp, Homo sapiens
cactgtctctctatgtatgtgtgtgtgtacgtgtgtgcatatatatatacatgtgtgtatatatatgcgtgtgtgtgtgtatatatatgcgtgtgtgtatgtatatatatacatgtatgtatatgtatgcatgtgcgtatgtgtatatatatatatatatatatacacacacacacgcacacacacacattagcacctgatatgc

SEQ ID NO: 51098 - DNA, 89 bp, Homo sapiens
ggctgctttgctatggagatgacaaatctcagagctgccctcagaaagaatagatgggagcctgtggtagaagtttctctggcagaccc

SEQ ID NO: 51099 - DNA, 122 bp, Homo sapiens
gtgcccgagctgtcttatctgtgttttactgtctgctctttctggctgcttgtagttagaagagaagtgatttccttgaaatgcatgaggctagaaggggagctggagcttaaagtggcggt

SEQ ID NO: 51100 - DNA, 115 bp, Homo sapiens
caaaagtctagtaggtacatttgtattttagggagcctgaagctgtgtgagtctgtgtgtatcctcttttgcatacagaagacattttctccttaatccacacctaaactttttg

SEQ ID NO: 51101 - DNA, 100 bp, Homo sapiens
gtttgaagaactgttaagacttttaccctactgaagagctgttgttggaataaataatcagaggttgaaggttgttttttaaagagcaggaaaagaaaac

SEQ ID NO: 51102 - DNA, 72 bp, Homo sapiens
tttgtggtttgttccaggaactttcattaccctaactagggggcaatgttctgaggctggagggatggcaaa

SEQ ID NO: 51103 - DNA, 85 bp, Homo sapiens
gcgtagccacaagaccgggtccgtttctggttgccgttcccgcaggtgacgctgcagacagaccagagactccagtcaccctcgc

SEQ ID NO: 51104 - DNA, 105 bp, Homo sapiens
acgcaagagaacactgtgacatggtctaggacataaggaggcacatgtgactaatctttctctgatctgtgtgtgtgtgtgcttctgcattagtcgattctcaca

SEQ ID NO: 51105 - DNA, 123 bp, Homo sapiens
agtggcctataaacaacagaaatgtatttctcacatttctggaggctggaagtctgagatcaaggtgctagcatggccagattttgctgagagtcctcttctggtttatagactgctgacctc

SEQ ID NO: 51106 - DNA, 103 bp, Homo sapiens
atttttttatgttaattttgtatcctatgactttactgaatttgtttattaattctatcagctttttggtggagcctttaggattttctgaatataagataat

SEQ ID NO: 51107 - DNA, 90 bp, Homo sapiens
gtggccagtgtatgtggccgtgatgggttgaatatggaaatgtcgtgggtgagacatccttactcactcactcacaggtaatgaagccac

SEQ ID NO: 51108 - DNA, 117 bp, Homo sapiens
ttggtttctatgattataaatattgagaatcccccattgattttatgatgtaacaacttttattacattattttattaaatgggtgagttacagatgtggaatctactaggtatatc

SEQ ID NO: 51109 - DNA, 56 bp, Homo sapiens
tgagacagtctcactctgtcacccaggctggagtgcagtggtgtgatctctgctca

SEQ ID NO: 51110 - DNA, 100 bp, Homo sapiens
cgctcacctgacctccaaactgtctgtgtgtcaatatatttatttttctccatagatatgtaattcctcaaagagagaatggcattcaagtgatttggcg

SEQ ID NO: 51111 - DNA, 108 bp, Homo sapiens
caactttgcttctaaaatgtgtacaagttagtacacaaatgtataccttgcatttttatcttcttttttgtttaactagagtacatcttacagagggtcacaaagttg

SEQ ID NO: 51112 - DNA, 73 bp, Homo sapiens
tctatataaaaatgtgtgtgtgtgtctgtgtatgtgtgtatatatatatatacactcaatttgtcatactaga

SEQ ID NO: 51113 - DNA, 72 bp, Homo sapiens
ctgggcatggtggtgcatgcctgtattcccagctacttgggaggctgtggtaggaggatgaattgagcccag

SEQ ID NO: 51114 - DNA, 90 bp, Homo sapiens
tttgaaataacagggattgtgttcttatttattaattatataataatgcattattgtatatttggtacaaggacttaattcattttcaaa

SEQ ID NO: 51115 - DNA, 110 bp, Homo sapiens
tgcttaggattgtcttggctatgcgggctgttttttgattccatatgaaatttaaagtagttttttccaattctgtgaagaaagtcagtggtagcttgatggggatggta

SEQ ID NO: 51116 - DNA, 91 bp, Homo sapiens
tagaatggatattttaataaaattacccataagtattgaatttcttgttgaccaatataacatgctaaagttttattgtatgtccattttg

SEQ ID NO: 51117 - DNA, 108 bp, Homo sapiens
gtgtgtatatataaaagatcacatgtgtgtatatatatcttttatttatatgtgtgtatatatataaaagattatatgtgtatatatatctctcttatgtatatatac

SEQ ID NO: 51118 - DNA, 88 bp, Homo sapiens
ggatattctctgacttcactttcactcacattcaaagggaggatgttataaaagagtgaaaatcattggaagtcattcttagaattct

SEQ ID NO: 51119 - DNA, 92 bp, Homo sapiens
gtttggagaaattcaaggagctttttggttgtttaattctcatgtgtacatagaagcaacacacaactgtttgagcagctttggatgtaacc

SEQ ID NO: 51120 - DNA, 65 bp, Homo sapiens
agcctctgtgtgtctttttttgggggggggcgttgggggcaccgtctcactctgtcaccgaggct

SEQ ID NO: 51121 - DNA, 111 bp, Homo sapiens
tttgaccaaagagagctgcagcaataagggatcatgtaacccgagggacccacagtgcctgtgacaggaccctggagatcttgaatttgttgccatcaagaactggccaga

SEQ ID NO: 51122 - DNA, 115 bp, Homo sapiens
tcaaaggtagaatctgggtggtaaacatatgaacaattcactgtgtaattgttttaattttctatgtgtttgaaaattaccataataagatgctgaaaaattaaggccttagtga

SEQ ID NO: 51123 - DNA, 77 bp, Homo sapiens
ggctcttttgatttatgagagtcaggactcatggtttcatgtgtccagtgaatactcagatcacttaacacagggcc

SEQ ID NO: 51124 - DNA, 76 bp, Homo sapiens
gaatggttgcctctcctgactgtgcagatcatctttggagagaagagagtagacaggcaggagaaacacccgcatc

SEQ ID NO: 51125 - DNA, 92 bp, Homo sapiens
gtgttttgcggtgtttatatttgaggaagacaaggatgtgaaaactctcactctctctgtgttcattctcacaaatagatggataccgtcac

SEQ ID NO: 51126 - DNA, 116 bp, Homo sapiens
accgagttagtctgtggtcaagttgtgatttcagctcaagtgcatgtcagggcaaatacaatattttttttagactatgtgtgcacttattgtcccttcttgaccatctctagggt

SEQ ID NO: 51127 - DNA, 122 bp, Homo sapiens
tatatatacatatatgtgtatatgtatatgcatatagtcttctatatatacacagatacgtatatatgtatatacatatataggagactatatatatgcacacatatatgtatacatatatg

SEQ ID NO: 51128 - DNA, 112 bp, Homo sapiens
gtatacatatatgtgtgcatatatatagtctcctatatatgtatatacatatatacgtatctgtgtatatatagaagactatatgcatatacatatacacatatatgtatat

SEQ ID NO: 51129 - DNA, 103 bp, Homo sapiens
ggcatgaggtagtgttaaagagagagaaagtaatcaaagtaaggaagattgttctcttccagccgctttaagactctatctccaatacactgactaaaatgcc

SEQ ID NO: 51130 - DNA, 103 bp, Homo sapiens
cactggttttgtgaaaaatgtccttgatcacatgatccctcaatgtgcaactgcaggtgcatgcgtgagcaagttttcagtggacgtgactatgcaccttcca

SEQ ID NO: 51131 - DNA, 118 bp, Homo sapiens
tgggtggatggatgaatggtgaatggtcagtgctgatttttaattttatattgttcataccattgggttaagagggaacaatattttgagattcagcttcactttgctatgttaaaca

SEQ ID NO: 51132 - DNA, 95 bp, Homo sapiens; identical to SEQ ID NO: 68

SEQ ID NO: 51133 - DNA, 93 bp, Homo sapiens; identical to SEQ ID NO: 69

SEQ ID NO: 51134 - DNA, 87 bp, Homo sapiens
agaggacatgctctagaggtggactcgctggccacatcctgactgccactcactaggcacccagcctctctgtgcctcagtttcctc

SEQ ID NO: 51135 - DNA, 101 bp, Homo sapiens
atatacttgcccagtctctgtagtaaagtttataagccttagtcacagaagagagtctgaggccctcactcttattttaggcataattttaacaagtgtgt

SEQ ID NO: 51136 - DNA, 78 bp, Homo sapiens
atgctaacagcagcggcactagcagcagtttattattatttcaagattgctgtcttgtctagtgagccaggtgtgcat

SEQ ID NO: 51137 - DNA, 73 bp, Homo sapiens
gagacgggctctcactctgtcacgcaggctgaaatacagtggtgtggtcatggttcactgcagcctccaactc

SEQ ID NO: 51138 - DNA, 78 bp, Homo sapiens
cagtggatgcagcagacacggtcagtgggtcagtggtccccctaccccctttgatctctccgtgtgctccatctgact

SEQ ID NO: 51139 - DNA, 69 bp, Homo sapiens
ctgtgggatggcagacgaggcagcaggggcccttgtgggtccatctctgtctcactgtcagcctggcag

SEQ ID NO: 51140 - DNA, 93 bp, Homo sapiens
tgtactcactcatgagcttgtggatatagaattatgtgaaaaattcaagattctatttttattcatgttaagctcatcttacctgtttgtaca

SEQ ID NO: 51141 - DNA, 86 bp, Homo sapiens
gcactgtgcccttccattttggaacttatgatgatgatgttgttgatcaccgtgatagtaacaggaagaggaagagaagcagcagc

SEQ ID NO: 51142 - DNA, 113 bp, Homo sapiens
gatctatagattcaaaatctcagcaagctattctgtggatatcaacaagctaattctatagatttttttttgttgttgtttgtttgttttttgagatggagtctcactctgtc

SEQ ID NO: 51143 - DNA, 95 bp, Homo sapiens; identical to SEQ ID NO: 68

SEQ ID NO: 51144 - DNA, 93 bp, Homo sapiens; identical to SEQ ID NO: 69

SEQ ID NO: 51145 - DNA, 70 bp, Homo sapiens
gtgtgtgcatatatatatatagtaggtatgtgctatctatatatatttacatatatatgtatgcatctat

SEQ ID NO: 51146 - DNA, 64 bp, Homo sapiens
atgtatgtatgtgtatagatatacatgtatatgtatatatgtatatatgtacacacatatgtgt

SEQ ID NO: 51147 - DNA, 116 bp, Homo sapiens
ctataagcactttcactttgagaggtaaataaatatgagactttacgactgcatttgtgctcagtatatttttttataacacactgtctgctttgaccagagttgaaattttatag

SEQ ID NO: 51148 - DNA, 106 bp, Homo sapiens
tagttcaaaaagagaagatactattttatttgcatttatttatataataaagagatagggcatctcttcatatttataatgactgtatatcttcttttgtgaatta

SEQ ID NO: 51149 - DNA, 106 bp, Homo sapiens
gccttcctgagccatctcataatattcattttttaatattttaccttctgtgctccatattccccatctctcaagtgaaatgaatttgatgaagagggctaaaggc

SEQ ID NO: 51150 - DNA, 83 bp, Homo sapiens
tgagtcaaggtctcactctgtcacccaggctggagtgcagtgttgcgatctcagctcactgcaacctctgcttcctgggttca

SEQ ID NO: 51151 - DNA, 100 bp, Homo sapiens
acttacattgggaccagcacatttgagtcagtggctcctgctgacacaatctgagtcagtggctccctctgacacaatctgagtggtccaatatgagagt

SEQ ID NO: 51152 - DNA, 90 bp, Homo sapiens
catcctcagggtgctgaacagagggctgagcctggagccacacaccctgtcaggctgtctctcagctcactctgtggccttgggcagatg

SEQ ID NO: 51153 - DNA, 59 bp, Homo sapiens
cctcagagaagtttgacatctccccagcacagatatttggacggagcaggctcctgagg

SEQ ID NO: 51154 - DNA, 58 bp, Homo sapiens; identical to SEQ ID NO: 1847

SEQ ID NO: 51155 - DNA, 117 bp, Homo sapiens
atataactgaaagatggtgtagtgctaactatgtttccaaatttgattttatatctaggatgactctaagttttagctttttggtgacaacaggacagcagcttctgttagggatat

SEQ ID NO: 51156 - DNA, 96 bp, Homo sapiens
gatttctttggggaaaaatggcaataaaaacaaataaatatatgtgctcatgtattctttttttttcttttccttctttcctttagagacagagtc

SEQ ID NO: 51157 - DNA, 74 bp, Homo sapiens
ctggcagccctttgacagatggtgcggcagaagggagagctgcctctgtgagtgtctgtccagagcagagctgc

SEQ ID NO: 51158 - DNA, 99 bp, Homo sapiens
acattaaaaagttagaattatatagtttatataatttacatatttataaacacaccgtatgcagttttataagctatgtaagttaactgatattaatgt

SEQ ID NO: 51159 - DNA, 119 bp, Homo sapiens
atgtttgagtaaccagaacagatgcctagacttttagtgttttcataagaatcataacaatttttttataatatgtgaatcatgtggaaaacgtggtgctcattgaagttattcagcat

SEQ ID NO: 51160 - DNA, 58 bp, Homo sapiens; identical to SEQ ID NO: 637

SEQ ID NO: 51161 - DNA, 66 bp, Homo sapiens
tgcagcctgggctggtagtgctgaatggtgacgtgtgtctgtgtcagctttatcgttctatgtgca

SEQ ID NO: 51162 - DNA, 95 bp, Homo sapiens; identical to SEQ ID NO: 68

SEQ ID NO: 51163 - DNA, 93 bp, Homo sapiens; identical to SEQ ID NO: 69

SEQ ID NO: 51164 - DNA, 57 bp, Homo sapiens
gaactgaggcatatatatgtatatataatacatatgtgtatatgcatgtgtctgttc

SEQ ID NO: 51165 - DNA, 92 bp, Homo sapiens
caggcagccactcccagagcccctggaactctggcccaaggctctctgactgactccttcccagatcttcttggcttagtgactgaagactg

SEQ ID NO: 51166 - DNA, 115 bp, Homo sapiens
aggaaaataaatcacgatacctaacccaaatgtgaaagaacagactgagcagaactaacaaaactcatttgctcttctagtttttaaaaatgtgagttttggacatctgattcct

SEQ ID NO: 51167 - DNA, 70 bp, Homo sapiens
gcctgcgagtttctcagaagacactcagcatcagctttttcctgattgctattcttctgggcacttaggt

SEQ ID NO: 51168 - DNA, 95 bp, Homo sapiens; identical to SEQ ID NO: 68

SEQ ID NO: 51169 - DNA, 93 bp, Homo sapiens; identical to SEQ ID NO: 69

SEQ ID NO: 51170 - DNA, 88 bp, Homo sapiens
tgtgcctgtagtcccagctactcagaaggctgaggtggaaggatcacttgaatcacttgagcccaggagtttgagattgcagtgagca

SEQ ID NO: 51171 - DNA, 108 bp, Homo sapiens
tgtgtgtgtgtatacatatatatgtatatatataagcgtatatatgtgtatatatatgtgtacatatatgtgtgtgtgtatatatatatatctatatagtttgtttgt

SEQ ID NO: 51172 - DNA, 77 bp, Homo sapiens
atatatgttagcatgcatgtgtgtgtgaaagcacatgaactctttatgtgtgtgtatgtcagcatgtggatgtgtgt

SEQ ID NO: 51173 - DNA, 343 bp, Homo sapiens
tatatatatatgtgtatatatatatatgtgtatatatatatgtgtatatatatatgtgtatatatatgtgtatatatgtgtatatatatgtgtatataatatgtgtatatatatgtgtatatatatgtgtatatatatgtgtatatatatgtgtatatatatgtgtatacatatatgtgtatatatatgtgtatacatatatgtgtatatatatgtgtatacatatatgtgtatatatatgtgtatatatatatgtgtatatatatgtgtatatatatatgtgtatatatatgtgtgtgtgtatatatatatatatatatatatatatatatatatatatagc

SEQ ID NO: 51174 - DNA, 105 bp, Homo sapiens
tgctgtttttagaactatatgaatatatgtctggcacataataataatttaataaatgttatatttattattaccaaaaatgtacatgtactttaaaaatctgca

SEQ ID NO: 51175 - DNA, 152 bp, Homo sapiens
gtatatgtatatatacacatatacacatgtgtatgtatatatacacatatacatgtatgtatatatgtgtatatatacatatatgtatatatatacatatgtttgtgtatatatatacacatatatgtgtgtgtgtatatatatatatatat

SEQ ID NO: 51176 - DNA, 92 bp, Homo sapiens
tgttacccattttgtaccagactttgtggattttttggtaagatattcctaagaaaaatagtatctccttggaagtttggtttctggtgata

SEQ ID NO: 51177 - DNA, 117 bp, Homo sapiens
ctgtgtcttttaattggagcatttagtccatttacatttaaagttaatattgctatgtgtgaatttgatcttgtcattatgatgttagctggctattttgctcgttagttgatgcag

SEQ ID NO: 51178 - DNA, 123 bp, Homo sapiens
ctcacacacatatacatatgtgtatacaaattatataataatataggtgtgtgtgtgtgtgtgtgtgtgtgtgtgtatgtattacatgagccaattgagtttatgtaattatgaatgcaggca

SEQ ID NO: 51179 - DNA, 94 bp, Homo sapiens
ctgagataatatgcaaaacagcaattatgtagtttttttaaactctagggttaaagaagtatgtaaacaactatgttttgttaaagatttacag

SEQ ID NO: 51180 - DNA, 73 bp, Homo sapiens
tacccaaaagtcattcaggagcaggttgtttaatttttatttacttgtatggttttgagtgattttcttggta

SEQ ID NO: 51181 - DNA, 84 bp, Homo sapiens
ttttttttgggggggggggttgtgtttttgttttttgttttttgtttttttgagacggagtctcactctgtctcccaggctgga

SEQ ID NO: 51182 - DNA, 61 bp, Homo sapiens
tcttggcgcggagggggttgttttttgttttttgagacagagtctcactctgtcgcccagg

SEQ ID NO: 51183 - DNA, 170 bp, Homo sapiens
atatatgtatatatacgtgtatgtatatatatatacacacacacacgtatatatacgtgtgtatatatatatacacgtatatatacgtatatatatacacacacgtatgtatatatgtgtgtatatatgtatatgtgtgtgtatatgtatatatacgtatatatatacgt

SEQ ID NO: 51184 - DNA, 145 bp, Homo sapiens
tctatttatatatgatgtgtgtgtgtacatgtatatgtatatatgtatatacgtatatatgagtagatatatgtatatatgtatatatgtgtgtgtatatgtatatatacgtatatatatacacgtatatatatacgtatatata

SEQ ID NO: 51185 - DNA, 94 bp, Homo sapiens
gtgaactcttgagagatctggtcatttaaaagtgtgtggcacctctctgccttcctcccactctcactgtgtgaccagacagctccccctttgc

SEQ ID NO: 51186 - DNA, 110 bp, Homo sapiens
ggaggcagagccatcacaacctcaggactggcagatgtttgagctacagggtgggtactttttattttttatttttttgaggcggagtctcgctctgtcacccaggctgg

SEQ ID NO: 51187 - DNA, 82 bp, Homo sapiens
ctcaggactgatctgagaaagacagtggatgctttcattagaaaaaaggcagcatggtcactatcttttttttttttttgag

SEQ ID NO: 51188 - DNA, 119 bp, Homo sapiens
gtactagtgcatctgtgtgtcctagtgcttctatgcgttcctagtgcctctgtatgtctgtcctagtgcatctgtgcgtcctagagcatctggtgtcctagtgcatctgtacgtcttag

SEQ ID NO: 51189 - DNA, 104 bp, Homo sapiens
attttgtgagtgctgtgtgttactgtttttttttttttaaaggtaattgctaaaaagtagaaacaatgaaaaaaaaaaaagaatcctacactactcattttgat

SEQ ID NO: 51190 - DNA, 67 bp, Homo sapiens
tccttagggggagaagggagaattctttttttttgagagggagtctcgctctgtctcccaggctgga

SEQ ID NO: 51191 - DNA, 82 bp, Homo sapiens
cctgaacactccagaaatggcacctttgtaggatacatctctctgcctctcccacagaaatgccaatggagaaatgagcagg

SEQ ID NO: 51192 - DNA, 56 bp, Homo sapiens; identical to SEQ ID NO: 324

SEQ ID NO: 51193 - DNA, 63 bp, Homo sapiens
ttgagacagtgtctcactctgtcacccaggctggagtgcagtggtgtgatcatgcagcctcaa

SEQ ID NO: 51194 - DNA, 91 bp, Homo sapiens
ggaattggagaagggtactttgttttaatcactgaggctttccacccgagcaattaaatatttgattataacctaccctgtgttcctgccc

SEQ ID NO: 51195 - DNA, 101 bp, Homo sapiens
tgccaaatgaatgtaaataaaggtatttaggaaataatgtgaaaaagctttaaagcattatttactttttcttttcttttttaattttagattcgggggta

SEQ ID NO: 51196 - DNA, 83 bp, Homo sapiens
gacaagtacctattttgtggtttagcattgtttttattttgaattacagtggggtggggacgatgagacaccatgatcttgtc

SEQ ID NO: 51197 - DNA, 112 bp, Homo sapiens
ccacacacttgagtttgtccacctggagccctacatcttaaataattcttttcttcttttttttttttttgagatggagtctccctgtgtctcccaggctggagtgcagtgg

SEQ ID NO: 51198 - DNA, 58 bp, Homo sapiens
tgagacagagtctcactctgtcgcccagactggagtgaagtggtgcgatctcggctca

SEQ ID NO: 51199 - DNA, 91 bp, Homo sapiens
cttgatgtacagaatcaatgcagtttcagtaaagatgccagcaagctcttttttattatattgacaaattggttctaaaatttacatggag

SEQ ID NO: 51200 - DNA, 83 bp, Homo sapiens
tggcttctagatgcagcactccagtctctgcctttgccatcccgtggagctctccctctgtgtctgcctgtgtgtgtatgcca

SEQ ID NO: 51201 - DNA, 108 bp, Homo sapiens
tgggtgacagaaggagattccgtctcaaaaaaaagaaaaaaattaagttgtacttaccactctctttcttttttttttttttgagacggagtcttgctctgtcaccca

SEQ ID NO: 51202 - DNA, 75 bp, Homo sapiens
tttcagctagtgggatggggtaacaatttttttttttttttgagacagaatcttgttctgtcacacaggctggag

SEQ ID NO: 51203 - DNA, 58 bp, Homo sapiens
tgagaaggagtctcactctgtcacccaggctggagtgcagtggtgtaatctcggctca

SEQ ID NO: 51204 - DNA, 102 bp, Homo sapiens
agctatggaaggaatactattatagtcccactctattatagtcccactctatatctgtgacatatagaggctcaggattgtcaagtatacttttcaaaagtt

SEQ ID NO: 51205 - DNA, 81 bp, Homo sapiens
gggtggagtcattcagggtgtttgcagcttgtctcacatacagtcagtgcttcagtgaacatccttgtgcatgttccatcc

SEQ ID NO: 51206 - DNA, 95 bp, Homo sapiens; identical to SEQ ID NO: 68

SEQ ID NO: 51207 - DNA, 93 bp, Homo sapiens; identical to SEQ ID NO: 69

SEQ ID NO: 51208 - DNA, 62 bp, Homo sapiens
gggtctctctctgtcacccatgattgtagtggtgcaatcatggctcactacagcgttgacct

SEQ ID NO: 51209 - DNA, 74 bp, Homo sapiens
tttgttttttgagacagagtctcactctgtcacccaggctggagtgtggtggtgagatctcggctcactgcaaa

SEQ ID NO: 51210 - DNA, 89 bp, Homo sapiens
ctgggttggtactggggtttgtctgcatagagtcctgtgatgtgaactgtctatcactctcttagatgtggataccagcacttgttcag

SEQ ID NO: 51211 - DNA, 182 bp, Homo sapiens
ctcatgtgtgtgtatatatatgtatatatatgtgtatatatgtatatatatgtatatatgtgtatatatgtgtatatatgtatatatgtgtatatatgtgtatatatgtatatatatatcgtgtatatatatcatgtatatatgtatatatatcgtgtatatatgtatacgataaatatatg

SEQ ID NO: 51212 - DNA, 87 bp, Homo sapiens
gtatatatatatgaaaaagtatatatacatatatatacatatacatatatatctatatatgtactttttcatatatttatcgtatac

SEQ ID NO: 51213 - DNA, 95 bp, Homo sapiens; identical to SEQ ID NO: 68

SEQ ID NO: 51214 - DNA, 93 bp, Homo sapiens; identical to SEQ ID NO: 69

SEQ ID NO: 51215 - DNA, 69 bp, Homo sapiens
gttcacagtcactcacacattctttgccatgggccctcaccaggaactcatgagaaaagagactggaac

SEQ ID NO: 51216 - DNA, 88 bp, Homo sapiens
gatggttcttagggcagctgcctctgctttggcccacccagacttactgagtctgtcattgagcatcatcttgctgcctggggtcatt

SEQ ID NO: 51217 - DNA, 101 bp, Homo sapiens
tgcttaagcccagcctgttcctgtgactagagagagctctcaggctggtaaccctgaagccttccctgagtgcaggttacctgcaggcaggctgaggggca

SEQ ID NO: 51218 - DNA, 111 bp, Homo sapiens
accagcagtgtaaaagtgttcccttttcactacatccatgccaacatttattattttttattttttaattatggccattcgtgcgggagtaaggtggtatcacattgtggt

SEQ ID NO: 51219 - DNA, 76 bp, Homo sapiens
gtcggagggcatatataagagtggtcaattttttttttttttaattagagacatggtctggctctgttgcccaggc

SEQ ID NO: 51220 - DNA, 65 bp, Homo sapiens
gctgactcggctgtcatcttccgactctcttccgtgatcagaagactgtctcagcctctgtctgt

SEQ ID NO: 51221 - DNA, 76 bp, Homo sapiens
cgctgctcactcttcctcactcacagtcagccctgcctcatggcaagctcctcttgggtccttggtggatgcattg

SEQ ID NO: 51222 - DNA, 108 bp, Homo sapiens
tggttttgttttgttttttggcgaggaagggcaggcttatgtcccaatatataatttttgtttacatgtgtgttcattttccacagaagaaaaaaattttttaaacca

SEQ ID NO: 51223 - DNA, 99 bp, Homo sapiens
gcgtgtacaattctatggtttaattatttatttaatgcttttggtgttgttggcaccacttggatgaaaagaagctgggctcagatgaattagtacacc

SEQ ID NO: 51224 - DNA, 74 bp, Homo sapiens
gcctgatgatctgtcactgtctctcatcacccccagatgggactggtctagttgcaggaaaaccagctcagggc

SEQ ID NO: 51225 - DNA, 78 bp, Homo sapiens
tagatatgtgggaatatatacaatatttgtatatgttgatacatccaatatatactgtgtatatatgaacagtgacta

SEQ ID NO: 51226 - DNA, 83 bp, Homo sapiens
tgttcacgtgatcacccctaagtccctcactctgtgtatatgtggggtgtggctggtatggatggtgtgggtgtggggagtga

SEQ ID NO: 51227 - DNA, 119 bp, Homo sapiens
cgttctctctctgtgtctgtggccacatttccctcttctttttattatttacttctatttatttatttatttattttgagacggagttttgctcttgttgcccaggctggagtgcaatg

SEQ ID NO: 51228 - DNA, 73 bp, Homo sapiens
tttagcctttgtgagccagatgattttattttattttactgaaatggagtctcactctgtcacccaggctgga

SEQ ID NO: 51229 - DNA, 100 bp, Homo sapiens
tctcaaagaaaggagtcagtgattatccctggagtgtgggattactgggcccttaacattttttttttcttttggagacagtctttctcagtcacccagg

SEQ ID NO: 51230 - DNA, 58 bp, Homo sapiens
tgagaccgagtctcgctctgtcacccaggctggagtacaaagtcgcactctcggctca

SEQ ID NO: 51231 - DNA, 110 bp, Homo sapiens
tggtacagaagcagttacagacaatacgtgagtgaatggctgggttccaatagaacttgttgtttgtttatttgttttttgttagagatggagttttgctctgttgtcca

SEQ ID NO: 51232 - DNA, 97 bp, Homo sapiens
agccctttccctgttctgggtcacagcattttgactcagatgagaaacttgtctgggtccagttgacgtgtacttgaggagtcctggagttaaggct

SEQ ID NO: 51233 - DNA, 119 bp, Homo sapiens
gatttttttggtaaaggtatttgtgttaacgtgtaattgatttattatttttgagtgaatatttaaaatttttaaatctcagtagatattacgcgtataaacaaaagttctttggagtc

SEQ ID NO: 51234 - DNA, 125 bp, Homo sapiens
tttgaatcagtggagaggaaaaactgggtaattaagttggctctggaaggacttaggttgtaaagttattttcacagtctcatagctgaagtcaaagtaggaactacccattaatttttcagtgc

SEQ ID NO: 51235 - DNA, 122 bp, Homo sapiens
gtaaaagttatatatatacacatatatatgcatatatatgtatatatatgtatatatacatatgtgtatatatataacttttatgtgtatatatataacttttatatgtatgtgtatgtata

SEQ ID NO: 51236 - DNA, 151 bp, Homo sapiens
atatatatgtatatatgcacatatacgtgtatatatatacatatatgtatatatgtgtatatatacatatatgtatatatgtgtgtgtatatacatatatgtatgtgtgtgtgtgtgtgtgtatatatatatatatatatatatatatata

SEQ ID NO: 51237 - DNA, 88 bp, Homo sapiens
aagattctgtctatatatgtgtgtgtatatatatatatgtacacatatacatatatgtgtatgttacattttatagtttatatatttt

SEQ ID NO: 51238 - DNA, 87 bp, Homo sapiens
ctctttattgtgggttttgagtagtttgattatgatatgccttggcatagttttcttcatttttttttatgcttgagattcactgag

SEQ ID NO: 51239 - DNA, 78 bp, Homo sapiens
tgtatgtatatatatataggtgtgtgtatatatatatataggtgtgtgtgtgtatatatatataggtctatatatata

SEQ ID NO: 51240 - DNA, 56 bp, Homo sapiens
gagtcaaggtctcactctgtcacccaggctggagtgcagaggtgtgaccatagctc

SEQ ID NO: 51241 - DNA, 108 bp, Homo sapiens
tcagtttgtggttggggaagaagaaaagattggggaagagaggagaagggagatttttctttattttaacatttgcagcttattttctgctactaaattaaagctaga

SEQ ID NO: 51242 - DNA, 136 bp, Homo sapiens
gcccttgtgatggcatccagctggtaagagtgagtgaagccccagtacccgagacagaaacagtctctctctgtaatttacccttccactggggatccaagcaacccaggccaaggcagagaatgatgtttctctc

SEQ ID NO: 51243 - DNA, 117 bp, Homo sapiens
ctcttcttagaatgtatccccatcactatgcgatgcgtgactctgtgtgtctgtgtgtgtctatctccttcaatctaacacaccgagttattcatagtttttccatggaaggagtag

SEQ ID NO: 51244 - DNA, 122 bp, Homo sapiens
tcattctttcccatgtatatataaagccctggaggctgtgaggaaggtttcagatttttattatatttttcaaagacttctgttatagctgtgtcttaatgtatggtggggatggtgaaaga

SEQ ID NO: 51245 - DNA, 90 bp, Homo sapiens
agcaaggtttgcagttttcagtgcaagtcttgggttaaatttattcctaagtatttgattctttttgatgctattgtaaatagaattgct

SEQ ID NO: 51246 - DNA, 87 bp, Homo sapiens
atatgtgtatatattttgtatatatatgcacatatgtgttttgtgcatgtgtgtgtgtgtgtgtttgtctgtgtgtgagaaatatgt

SEQ ID NO: 51247 - DNA, 110 bp, Homo sapiens
gaaacaaagctgtagtcaaggcccacgctgtccaatcacttgttccagaaaagtatatctatttttaaagaccattcagtgatgggtctgatctctttcttatttgtcgc

SEQ ID NO: 51248 - DNA, 97 bp, Homo sapiens
tatagtattgctttgtacatatattctgaatatatttatttcaagggaattacctttttaatttgattagaaggatgtgatttatggcaatgaaata

SEQ ID NO: 51249 - DNA, 89 bp, Homo sapiens
gaagacatcatgtaccctgagaagaatctgagcacagcggctcggggatgtcggaggtgctgctgctccgaaggacctgctgctgctgt

SEQ ID NO: 51250 - DNA, 82 bp, Homo sapiens
gagaaggctagtttccgagaattgacagtcagctaacttgactagcagagacttgaaggttctgagtgggtcccgccttctc

SEQ ID NO: 51251 - DNA, 88 bp, Homo sapiens
tttgagatggggtctcactctgtcgctcaggctggagtgcagtggtgcgatcacggttcactgcagcctcgacctccccaggctcagg

SEQ ID NO: 51252 - DNA, 56 bp, Homo sapiens
tgagacagagtctcgctctgtcgctcaggctggagtgcagtggtgatctctgctca

SEQ ID NO: 51253 - DNA, 112 bp, Homo sapiens
aataatttctaaacataactgttttatatgtgtaaatatatgtatgtatacattttcatataaatatttatatttatacatacattaaatggtttataacgttgaaaatatt

SEQ ID NO: 51254 - DNA, 84 bp, Homo sapiens
gtggtggcggtggtgactttcatggatcgatctagttgtgaattttaatttctttcattgtgtgagtgtcactgtcactctgac

SEQ ID NO: 51255 - DNA, 90 bp, Homo sapiens
ccatgtagctctccagagtgtcacagactctttcttattgggatttttaacctgggggattcagaggtcagtaactatctggaattatgg

SEQ ID NO: 51256 - DNA, 61 bp, Homo sapiens
ttcctgtgagatataaggttctttactgggcaacattggcctgagtgaaatctcctaggaa

SEQ ID NO: 51257 - DNA, 87 bp, Homo sapiens
tggctagtacttccagtactatgttgaataggagcagtaagagtggccattcttgtcttgttccagtttttagggggaatgctttca

SEQ ID NO: 51258 - DNA, 69 bp, Homo sapiens
gggtaggaagacctgggggcaggaagacctggggttccccagtcacctctctctgtctctatcctaccc

SEQ ID NO: 51259 - DNA, 80 bp, Homo sapiens
gctgaatgtgtgtgtgtgtgtgtgtgtgtgtgtgtgtgcgcgcatatgcacacagacacacatatgcacgctgtgcattc

SEQ ID NO: 51260 - DNA, 112 bp, Homo sapiens
gtacatatataggtatccatatatagatatgtatctatatagatatgtatctctctctatatatatagatacatatctatacgtatatagatatagatacttgtgattgtat

SEQ ID NO: 51261 - DNA, 58 bp, Homo sapiens; identical to SEQ ID NO: 1673

SEQ ID NO: 51262 - DNA, 119 bp, Homo sapiens
gttattagtgccagagcaaattggtttctgatcattgatgtctgcagtatatttttattcatagaaaatggaatttgttttaagttgatgatctagcaagtatgctcaattgctgtgac

SEQ ID NO: 51263 - DNA, 136 bp, Homo sapiens
ggattaacggctgacgcaggaccataaaacaaaacatcagactctgctgtgttgttccatgtctgtctgtctgtttctatccatatatacacgtgtgtttaagagaggagacgaggaggctcagactgggctggtg

SEQ ID NO: 51264 - DNA, 104 bp, Homo sapiens
ttgtgatcatcacctggccagtttgatcaaccattgcagaaacactggtttggagagaatgatttattcttgttctttaatggttaataactctggtgtcatag

SEQ ID NO: 51265 - DNA, 103 bp, Homo sapiens
ctgggaaattctgcagagataattgtcccattactttttaattaattaaaactaattaattaactattttttttttgagacggtgtctcgctctgtcacccag

SEQ ID NO: 51266 - DNA, 103 bp, Homo sapiens
ttgggaaaatctctgaaagtaaatgtgaccctgcaattcatagttgattttttattatacagaattcttggggccaacatttttttctctaggtcatacctaa

SEQ ID NO: 51267 - DNA, 95 bp, Homo sapiens; identical to SEQ ID NO: 68

SEQ ID NO: 51268 - DNA, 93 bp, Homo sapiens; identical to SEQ ID NO: 69

SEQ ID NO: 51269 - DNA, 87 bp, Homo sapiens
tctctctgcttcagacttttctgttttgttttttagcctaaatgctattgaaaagagcagagaagatagagtgcaggcccctagaga

SEQ ID NO: 51270 - DNA, 116 bp, Homo sapiens
ttgtaatgtattatgtagtttttataaaattgtaatttatgtgatttttatctatttgtcattttaaattttttaattatgtggttgcaattttacatgattataacttattacaa

SEQ ID NO: 51271 - DNA, 117 bp, Homo sapiens
catggtttccattgagaagtggtgtttctgtactttctctttgaatctggaagacttgtggatactttgaccaatagattatggctgaagtaaaggtttatgacctctgaagctaag

SEQ ID NO: 51272 - DNA, 63 bp, Homo sapiens
cttgagaaatcaggctgctgtctgcggcagccagagatgcagacagcactcactgggctcagg

SEQ ID NO: 51273 - DNA, 116 bp, Homo sapiens
tatatgtgtgagtgtgtgcattttttttgtgtgtgtatgtatgcatgtacgtatgtatgtatgtatgtatatgtagcaagcattgggatgtcatagcaattagagacaaaaatatg

SEQ ID NO: 51274 - DNA, 103 bp, Homo sapiens
tctctcatggcagagcacactcacacccatgctcacattcactcacactgagtccatgtagacatgccaattaacctaatgtgcatgactttggaatgagaga

SEQ ID NO: 51275 - DNA, 115 bp, Homo sapiens
gagtctttatgtttttctagctgtaagattatgtcatcatcaaagagggataatttaatttattcttttttaatctgaatgactttcttttgccagatttctgtggctaagactt

SEQ ID NO: 51276 - DNA, 96 bp, Homo sapiens
tacatatacatatgtatgtatatatgtatatgtataggtatataaacacatacatatatacatatatacacaaatgtacatatatacatatgcgtg

SEQ ID NO: 51277 - DNA, 103 bp, Homo sapiens
ggggtgggtgtgggggacaggtttggagagtgtagagagagaggtttggatttactctactttcctctttctaacacttttctgatatccaacacagttcctc

SEQ ID NO: 51278 - DNA, 118 bp, Homo sapiens
atggacccagtttacattaccaaattgtatcaagatattttgggattgaactaatttcttttttcttcaaattttcattttaagttcaggggtgcatgtgcaggatgtggaggtttgt

SEQ ID NO: 51279 - DNA, 98 bp, Homo sapiens
ctctgcatggcagggaacctgactgcctcactcactggcatttgggtgtaaagttgggaaagtggtgtaaacaggtctttttcctctatagtctagag

SEQ ID NO: 51280 - DNA, 70 bp, Homo sapiens
aatattattttttctgtatacatacacatacatataaatttgtgtgtatctgtgtgtatctgatgatatt

SEQ ID NO: 51281 - DNA, 95 bp, Homo sapiens
gaggactctgaaaagtgactcatagaagaggactggaacttaaagtgctgaaactgctggtgattttttttttttgtctgttacttttatccctc

SEQ ID NO: 51282 - DNA, 74 bp, Homo sapiens
ggaagaatttaaagtgcaagtagtggcttcagagtttcttggcctctgagtctcccagtcactctgcaccctcc

SEQ ID NO: 51283 - DNA, 80 bp, Homo sapiens
atagttctgtgtctgtctctgtccatcttttgtgtattttaaacagcacaaaagaaatctcattgtccagacacaattgt

SEQ ID NO: 51284 - DNA, 105 bp, Homo sapiens
tgtattttagaccaactgcatgtggtggaggaacaaagaaagattttttttttaattttttaaattttgccagtacatagtaggagtatatatttatgggataca

SEQ ID NO: 51285 - DNA, 73 bp, Homo sapiens
actccactgggccctctagcatttctgagtcactctgagccacatgccatgggaccccaggagtgaacggcct

SEQ ID NO: 51286 - DNA, 89 bp, Homo sapiens
aagggacactgcattacttctgaggctaggttataacaggcaatatggcttcaccttgcctcactctctgtctctgaatgctcaccctt

SEQ ID NO: 51287 - DNA, 63 bp, Homo sapiens
gtacctggagaattaagacacctgagcagccattgtcagtcagtgactgacaggagttggtgc

SEQ ID NO: 51288 - DNA, 78 bp, Homo sapiens
aacctactacaaatcttggttgaatggtttacagtaagattaataatgtgcataaaattacaaggtttatggtaggtt

SEQ ID NO: 51289 - DNA, 68 bp, Homo sapiens
atgtgtgtatgggtgtgtgtggatgtgtgtctatctgtgtgtatatctgtgcatgagcatgtgcatgt

SEQ ID NO: 51290 - DNA, 70 bp, Homo sapiens
acatgtagatatagatatcaacacatatacaaaggaagtattatatgtgtctgtctgtctgtctacctgt

SEQ ID NO: 51291 - DNA, 68 bp, Homo sapiens
tgcaacacactctgagcatggaggcagagaggtctggcagctttctcactctgtggctcagaggtgca

SEQ ID NO: 51292 - DNA, 96 bp, Homo sapiens
ggccttcagtaagcgtgacttgacagcccccagggcggcccaggtctgagagctgacagtcatcagaaccccagcaccacagggagctaagatcac

SEQ ID NO: 51293 - DNA, 106 bp, Homo sapiens
ttcagctcctttgggaaaacactaaaaagtacaattgctggatcatatggttaaagcatgtttaattttgtaaaaaacttccaagctgtcttccaaggtggctgga

SEQ ID NO: 51294 - DNA, 119 bp, Homo sapiens
tcccttggcactgcctgcctgctctacctgcaggtggagcccctttctgagccagagacagcatcaggaagtcactggggcccgcagcaggaaaacatcagcatatatgggagtgggga

SEQ ID NO: 51295 - DNA, 98 bp, Homo sapiens
catcggcccaccccaagtcctgtctccctctcagcctctgcagggacattttccagcaccggggcaaaggggcagcctggaaggggggtgagcaagtg

SEQ ID NO: 51296 - DNA, 74 bp, Homo sapiens
cctgggtgtggtggtgcatgcctatagtcccagatattcaggaggctgaggtaggaggatcacttgagcccagg

SEQ ID NO: 51297 - DNA, 114 bp, Homo sapiens
gtttgattttaatgtgtcttggtgtaggtctctttgagttcattctacttggagttcattgagcttcttggatgtttatattcatatcttcatcaaatttggggagttttcagc

SEQ ID NO: 51298 - DNA, 140 bp, Homo sapiens
atatgtatacatatatgtatatatacacatgtgtgtatatgtgtatatgtatacatatatgtatatatacacatgtgtgtatatgtgtatatgtatatgtatatgtagatatatatatgtatatatacacatatgtatat

SEQ ID NO: 51299 - DNA, 104 bp, Homo sapiens
agacagggcaatgatgttctgagagtaattgaggctggcaaacatctccacttaagacagctgtctgcctctcacactcacattaggtacaccaagctatgtct

SEQ ID NO: 51300 - DNA, 59 bp, Homo sapiens
ctagctgtgtgacattggagagtcactgattctctctggccttcagcttccacacctgg

SEQ ID NO: 51301 - DNA, 58 bp, Homo sapiens; identical to SEQ ID NO: 18119

SEQ ID NO: 51302 - DNA, 93 bp, Homo sapiens
ctggtgctgggtccacagtgatgagctctacgaacagggatttttttttttttttttttttgagacggagtctcactctgtcgcccaggctgg

SEQ ID NO: 51303 - DNA, 95 bp, Homo sapiens; identical to SEQ ID NO: 68

SEQ ID NO: 51304 - DNA, 93 bp, Homo sapiens; identical to SEQ ID NO: 69

SEQ ID NO: 51305 - DNA, 124 bp, Homo sapiens
ctctccagatgttccctctcgggacgttcactcttccacctggccacactgtgagtcgctcagtcccatagggaggctgcgtgcaggtccttgcttcgggagccctggctgagctcccacggtg

SEQ ID NO: 51306 - DNA, 89 bp, Homo sapiens
tctattaggtggcttccaagttcctgccagcctcaaagcctgtctacttacatgaggtggcaacagcatatcctgaagtccttgagaga

SEQ ID NO: 51307 - DNA, 102 bp, Homo sapiens
gcatcctgatgttagagctgaattttgcctctggttctacatgcttatcttcatagtactgtcactgtcactttttgtggtatttctactctaatatcttgt

SEQ ID NO: 51308 - DNA, 61 bp, Homo sapiens
tgagcagagtctcactcactctgtcgcccaggctggagtgtaatggtgcaatctcggctca

SEQ ID NO: 51309 - DNA, 95 bp, Homo sapiens; identical to SEQ ID NO: 68

SEQ ID NO: 51310 - DNA, 93 bp, Homo sapiens; identical to SEQ ID NO: 69

SEQ ID NO: 51311 - DNA, 95 bp, Homo sapiens; identical to SEQ ID NO: 68

SEQ ID NO: 51312 - DNA, 93 bp, Homo sapiens; identical to SEQ ID NO: 69

SEQ ID NO: 51313 - DNA, 76 bp, Homo sapiens
gagaagaaacttaagtcttgtccagaaagagtactttatttaatttttagctggaggatgtgatggtttctttctc

SEQ ID NO: 51314 - DNA, 90 bp, Homo sapiens
tatatatatatatatacacacatatacacacgtatacatatatacatatatatgtatacgtgtgagtatatatatatatatatatatgta

SEQ ID NO: 51315 - DNA, 84 bp, Homo sapiens
atatatatatatatatatatactcacacgtatacatatatatgtatatatgtatacgtgtgtatatgtgtgtatatatatatat

SEQ ID NO: 51316 - DNA, 86 bp, Homo sapiens
agttttagggtacatgtgcacaacgtgcaggtttgttacatatatatatatacatgtgcaatgttggtgtgctgcacccattaact

SEQ ID NO: 51317 - DNA, 95 bp, Homo sapiens
gtgcgccagtccctgccgtctcacaccctgtttctctgctccaaggaacagtacagtgttccaacaagctgagcacacaggcctgtgcatgatgg

SEQ ID NO: 51318 - DNA, 104 bp, Homo sapiens
attgtattcctgtttttaaaatgatgagactgaagactgaatgctgaattgttggagcgtgcaggatgtccagtgatgacatcatgggcaagaggatgtgcagt

SEQ ID NO: 51319 - DNA, 74 bp, Homo sapiens
gagagtctatactgaataaacagagagaccctggggacagcctgtctcccactgtgtgtatctctctcactctc

SEQ ID NO: 51320 - DNA, 109 bp, Homo sapiens
ggctcaccaggggctctggccagacataggggcctggcaggctgtgtggcctgtaaggacacagtctgtctctgtgcctcagtttctctgctgcccagatggaggggcc

SEQ ID NO: 51321 - DNA, 103 bp, Homo sapiens
tttcttggtagtgtacttagatgcacaaaagtctttaattttgaataagtccaatttatctatttttctttgttgccttggtttaggtgtcatatccaagaaa

SEQ ID NO: 51322 - DNA, 88 bp, Homo sapiens
ggtgatctggctagctccttctgctttcttttttttttttttttttttttggttggtggggagggggacacagtcttgctctgtcact

SEQ ID NO: 51323 - DNA, 77 bp, Homo sapiens
gggttatcacagtggcagccagcctcattcccattgtgctcctgggaaacagcctggaacagcctcagagttgaccc

SEQ ID NO: 51324 - DNA, 97 bp, Homo sapiens
tgctggaatctttactagtgctgatttaattttttaaaattcagggttactatgctacctgtgatggtgaaaaatgagattgtcactaaagatggca

SEQ ID NO: 51325 - DNA, 72 bp, Homo sapiens
caagctcaaatatatatatatatatatatatatatatacacgtgtgtttgtgtgtatatatatctgagcttg

SEQ ID NO: 51326 - DNA, 116 bp, Homo sapiens
agatatatatacacacaaacacacgtgtatatatatatatatatatatatatatatttgagcttgtaatgtgatacatatgtgtgtatgtaatgtgatgtgtgtgtatatatatgt

SEQ ID NO: 51327 - DNA, 111 bp, Homo sapiens
ttctttgcctccttgtgtttaatcctaagtattttattattttcaatattattgtggatgcaattgttttcttaatttcacttttggattgttcactggtagtgcatagaa

SEQ ID NO: 51328 - DNA, 102 bp, Homo sapiens
gtgtttgctgtaggtatgacactatatatatatgtatatgtgtatatatgtatgtatatattctaatgtcatcattttatcaattcctataaaagtaaccat

SEQ ID NO: 51329 - DNA, 92 bp, Homo sapiens
ttttgttccccaatgtgtccctgtctgtctgacactaaggcctgaccacttcctgttatcccagactgggctagtcaggggagacttcaaga

SEQ ID NO: 51330 - DNA, 77 bp, Homo sapiens
tgtgtgggtgtgtgtatatatgtgtgagtgtatatatattgtgtgtatacttgtgtgtgtatatatatgtgtgtgta

SEQ ID NO: 51331 - DNA, 140 bp, Homo sapiens
tgtacatatatattagtgtgtgtaaatatgtgtgtgtatatttgaatatataacttgtgtgtatgtaaagtgtatatatatatttgtgtgtatatatgtgtgggtgtgtatatatgagtgtatatatagtgtgtgtatat

SEQ ID NO: 51332 - DNA, 108 bp, Homo sapiens
gtgtgtatgtatagtgtgtgtatttgtgtgtatatttgtgtatatatatttgtgtgcatatatgtgggtgtgtgtatatatacagtgtttatatttgtacatatatat

SEQ ID NO: 51333 - DNA, 67 bp, Homo sapiens
tgcaggtggtgactgggtggggggtacacaaagcttcagtgctattctctgtctgtcactgtgtaca

SEQ ID NO: 51334 - DNA, 103 bp, Homo sapiens
tcagctggagatacagagggatgtgtttagaggtgaagtgagtttggaatggtttttttatttttttgaagtttacatcaaagtgattttgtatttttactga

SEQ ID NO: 51335 - DNA, 82 bp, Homo sapiens
gttgttgttttttctgagatggagtctcactctgtcacccaggctggagtgcagtggtgtgatctctgctcactgcaacctc

SEQ ID NO: 51336 - DNA, 58 bp, Homo sapiens; identical to SEQ ID NO: 2276

SEQ ID NO: 51337 - DNA, 121 bp, Homo sapiens
gcatgtgtgtgtgcattcatgtatgtgtctgtgtgtggtcatgtgactgtggtgtgtgcctgtgtctgtgcctgtccctgtgagcatgtgtgtgcatgcatgtgtacgtgtgtgtgcatgt

SEQ ID NO: 51338 - DNA, 76 bp, Homo sapiens
gctgttctggtgggcttttggtttcttgtcagggttggggctctgccaagtagccacagtgaacacagaaagcagc

SEQ ID NO: 51339 - DNA, 66 bp, Homo sapiens
cacactggagagagtgtgcaccgatgtggagccacagaagtctgtgctgtttactctgcctgtgtg

SEQ ID NO: 51340 - DNA, 70 bp, Homo sapiens
ggagacaagcattcattcacaaagggaagttgtcaaaagagaactgtctctgttaatgtctgcttgtcct

SEQ ID NO: 51341 - DNA, 75 bp, Homo sapiens
gttttctctttttgatgatgtgtctgtttttctattgagaaatctggggccaagttatggggcaagaaggagaac

SEQ ID NO: 51342 - DNA, 80 bp, Homo sapiens
tcaagtgaaatgaagattcagtagtcagagtggacacactgggaaggtgccacatgctttgtatgtcctcagatccttgg

SEQ ID NO: 51343 - DNA, 87 bp, Homo sapiens
agtttgctatattcaggcattggcactggctatgactgaaacccagggtttctgggtgggtcccagtatgcaaattcaaggcaatct

SEQ ID NO: 51344 - DNA, 98 bp, Homo sapiens
gctcgtctgaggcttagtgtttagtagattcctcaggaaatgttcacgggaatgatctttgctgagttgttacatactgataatagtctatacatggc

SEQ ID NO: 51345 - DNA, 88 bp, Homo sapiens
gcctgtcagtgcctgcctccctgtgagcccccccaccaactgccacagttcctgatgacctcccaggagagaagaggaataactgggt

SEQ ID NO: 51346 - DNA, 108 bp, Homo sapiens
ttcaaagcactattcccatttcttgtgattttgcctcaaactaagactgtgagctaaagagcatccaccctcattacacaggtgaggaaagagacttgaggctttgag

SEQ ID NO: 51347 - DNA, 105 bp, Homo sapiens
gccagggatagtggcatgcacctgtagtcccagctactcaggaggctgaggtaggaggatcatttgagcctgggaggttgaggctgcagtgagtcaagatcacgc

SEQ ID NO: 51348 - DNA, 58 bp, Homo sapiens
tgagcctgagtctcactctgtcacccaggctggagtgcagtggggtggtctcggctca

SEQ ID NO: 51349 - DNA, 77 bp, Homo sapiens
cacagaggagagagtggactgtgggtgccaggctgggggtgcctgcagagcctccaaatcagtgaacctcttctctg

SEQ ID NO: 51350 - DNA, 80 bp, Homo sapiens
ccctacagagacaagagtttcctgccagggagggcccagatgagagtcagctgtggggacggagagccttggctgtgggg

SEQ ID NO: 51351 - DNA, 120 bp, Homo sapiens
ccagctttgctctttttgcttaggattttcttggctataagggctcttttttggttccatatgaaatttaaagtagttttttctaattctgtgaagaaagtcagtggtagtttgatgggg

SEQ ID NO: 51352 - DNA, 73 bp, Homo sapiens
gggtctctctgtcactcaggctggagtacagtggtacaaccttggcttactgcagccttgacctcctgggctc

SEQ ID NO: 51353 - DNA, 96 bp, Homo sapiens
ggtcatcttctcatggtcttccctctgtctctgtgtctaaatgtccccattttataaggataccagtcatgttgggttagtatccacccagtgacc

SEQ ID NO: 51354 - DNA, 95 bp, Homo sapiens; identical to SEQ ID NO: 68

SEQ ID NO: 51355 - DNA, 93 bp, Homo sapiens; identical to SEQ ID NO: 69

SEQ ID NO: 51356 - DNA, 58 bp, Homo sapiens
tgagatggagtctcactctgtcacccagcctggagtgcagtggtgcgatctcggctca

SEQ ID NO: 51357 - DNA, 107 bp, Homo sapiens
gatatgggcaaagaagttttcttaaaagaaaagtaagtaagaattcagtgaagcaacgtctttatttttttaatttttttttttgagacggtgtctcagtctgtatc

SEQ ID NO: 51358 - DNA, 72 bp, Homo sapiens
tgggagatgtcatagctgtggtgaagggcggcctctgaggggccctctctctctcactctgttcctctctca

SEQ ID NO: 51359 - DNA, 106 bp, Homo sapiens
acagagtgagattccgtctcaaaaaaaaaaaaaaaaaaaaaaaaccaactttttgtagagttacacttttttttttttttttttttgagacggagtctcacactgt

SEQ ID NO: 51360 - DNA, 121 bp, Homo sapiens
caccagtgaagccatcagctcctgggctttgttaggaggtttttttgttttttgttttttgttttttttgagacagagtctcgctgtgtggcccaggctggagtgcagtggtgctgtctgg

SEQ ID NO: 51361 - DNA, 58 bp, Homo sapiens
tgagccagagtctcactctgtcacccacgctggagtgcagtgatgcgatctcagctca

SEQ ID NO: 51362 - DNA, 146 bp, Homo sapiens
tttagcttttccaaaatgtcagagatcctgggcaagtagacttttttttttttttttttttttttgagaaggagttgctcactctgtcacacaggctggagtgcagtggcgcaatctcagctcactgcaacctccacctcccaggc

SEQ ID NO: 51363 - DNA, 114 bp, Homo sapiens
tgtgtttcccttttgttaggattttgattttttgctgagctaaagcaaccttttttttttttttttttttttttttcagacagagtctcactctcttgaccaggctggagtgca

SEQ ID NO: 51364 - DNA, 79 bp, Homo sapiens
aggagagacaacaggcacccctggccggcatcacacaggacattccaggcctctctgtgtctctcttcgtgtctctctt

SEQ ID NO: 51365 - DNA, 58 bp, Homo sapiens; identical to SEQ ID NO: 2626

SEQ ID NO: 51366 - DNA, 111 bp, Homo sapiens
ggctaaagcttgctctgattatctctttttgttttcagttttgtttgcctatattgtttttgttttacattttgggaagggagagattttccattaagtaagatttttgct

SEQ ID NO: 51367 - DNA, 88 bp, Homo sapiens
ggtggctcatgcctgtaatcacagcaattttggaaaccaaggtgggggactcacttgaggtcagaagtgtgagaccagtgtagccacc

SEQ ID NO: 51368 - DNA, 82 bp, Homo sapiens
cccaaactcagtctcattgtctgtttctagagaaacccagtctacaacagagggttcaagagactggacaaagggaattggg

SEQ ID NO: 51369 - DNA, 88 bp, Homo sapiens; identical to SEQ ID NO: 51367

SEQ ID NO: 51370 - DNA, 171 bp, Homo sapiens
acacactatatttatacatatatagtcccaactatatgagttggaggagtcccaactacatgagtatatatatatgtgtgtgtgtgtgtgtgtgtgtgtatatatatgtgtatatatatagtgtgcatatatatagtgtatatatatctgtatacatagtgtatctatact

SEQ ID NO: 51371 - DNA, 107 bp, Homo sapiens
ggcctgggtgacacagcagagtagggataggtgacaagggataggtgtggggggctctttttatttttattttttaagacagagtctcgctctgtcacccaggctat

SEQ ID NO: 51372 - DNA, 116 bp, Homo sapiens
ggggctttcttcaggctcggtctgctaatccccaagtgtggagacttctctgtctcaggacatagactaggagcccccactcgctttgttgttcagctgactttcctccctgtccc

SEQ ID NO: 51373 - DNA, 58 bp, Homo sapiens; identical to SEQ ID NO: 315

SEQ ID NO: 51374 - DNA, 80 bp, Homo sapiens
tttcagggggtagaaggcagagtgggatggagctgcttttttttttcagtcagggtctcgctctgtcacccagactggag

SEQ ID NO: 51375 - DNA, 92 bp, Homo sapiens
aagtgtgagccactgcacctggcctttttaattttttattttaggtgataaaaatgttttaaaatggactgtgctgatggcaatacatactt

SEQ ID NO: 51376 - DNA, 80 bp, Homo sapiens
ggtaactgatggcaagggtgggaatgaaattcactttttttttttttttttgagatggagtctcgctctgtcaccaggct

SEQ ID NO: 51377 - DNA, 95 bp, Homo sapiens; identical to SEQ ID NO: 68

SEQ ID NO: 51378 - DNA, 93 bp, Homo sapiens; identical to SEQ ID NO: 69

SEQ ID NO: 51379 - DNA, 64 bp, Homo sapiens
catctcctaccctcagtctccctgtctgtggttccagagggaagaagaggggaaaaaaaggatg

SEQ ID NO: 51380 - DNA, 83 bp, Homo sapiens
gtgtgtgtgtgtctatatatgcatatatccatatatatgttatgcatatatatatgtttattcatatacagacacacatacat

SEQ ID NO: 51381 - DNA, 84 bp, Homo sapiens
agaagggggagatagtgggatatggttttttatttttatttactttttttttttgagacggagtctcgctctgtcacccaggct

SEQ ID NO: 51382 - DNA, 74 bp, Homo sapiens
agacactgagctaagtgctttcgagacacactgggtgaccttaggcgtatcaccctctctgagcctcagtttct

SEQ ID NO: 51383 - DNA, 273 bp, Homo sapiens
tgtgtttgaaggatatatatcaaatatatattcaaatatatatatgtgtatatatatattcaaatatatatgtgtatatatatattcaaatatatatatgtgtatatatgtatttaaatatatatatgtgtatatatatattcaaatatatatatgtgtatatatattcaaatatatatatgtgtatatatattcaaatatatatgtgtatatatatattcaaatatatatatgtgtatatatatattcaaatatatatatttaccagatata

SEQ ID NO: 51384 - DNA, 94 bp, Homo sapiens
gcaggaggtgtctagggtgtgacacataaagaggcactcactctcaggctcatgcaaatgcctccttaaatgtcaccctttaagtacctgttgc

SEQ ID NO: 51385 - DNA, 116 bp, Homo sapiens
gcctctgtggtcatacagcattctccctgtgtgtctctgtccaaatttctctttttttttttttcttttttttttttttgagacagggtctcactgtgttgcccaggctgtagtgc

SEQ ID NO: 51386 - DNA, 75 bp, Homo sapiens
ctcccgagtagctgagactacaggcgcctgccatcatgcccggctaattttttgtatttttagtagaaacggggg

SEQ ID NO: 51387 - DNA, 78 bp, Homo sapiens
tgtatatatgtatatacatatgtatacatgtgtatatatgtatatacacatgtatacatgtgtatatatgtatatata

SEQ ID NO: 51388 - DNA, 109 bp, Homo sapiens
ctccctttgcccggtggttgtggggaagggcagcctgactcacggtctgagtcccaggaacggatctgacctggaggaggtcccttctctggaggtgctgggcaaggag

SEQ ID NO: 51389 - DNA, 77 bp, Homo sapiens
ggatgctgggtctgcttggtagtctgcctgtctgtctgtgtcttggatgctgggtctgcttggtagtctgtctgtct

SEQ ID NO: 51390 - DNA, 95 bp, Homo sapiens
ggtcgtctgtttgtctgtgtcttggatgctgggtcggcttggtggtctgtctgtctgtctgtctgtgtcttggatactggatctgtttggtggtc

SEQ ID NO: 51391 - DNA, 163 bp, Homo sapiens
gtggtctgtctgtctgtgtcttggatgctgggtctgtttggtggtctgtctgtctgtgtcttggatgctgggtctacttggtggactgtctgtgccttggatactgggtctgcttggtggtctgtctgtctgtgtcttggatgctgggtctacttggtggtct

SEQ ID NO: 51392 - DNA, 63 bp, Homo sapiens
gccctgtagagactgagcagacaagggcagacctctccttgctaaatggctctgtagctgggc

SEQ ID NO: 51393 - DNA, 101 bp, Homo sapiens
gttccaggtgccgggtgagggtcaccaagggctgtggatgcacttagacgaaacctcaccctctgtgtgtctcccttcccagcaggctctgaggacatcat

SEQ ID NO: 51394 - DNA, 113 bp, Homo sapiens
gtgccctgtcgagcagatccacactggaggaaaagtgcgagaccaagtgcatgtggaggtgttaattagtcttcatcttgtccatcaattgttgaacagctcagaatgaaagc

SEQ ID NO: 51395 - DNA, 101 bp, Homo sapiens
tgaggcaggagaatggcctgaacccaggaggcagagttcacagtgagctgagatcgtgccactgcactccagcctgggtgacagagcgagactccatctca

SEQ ID NO: 51396 - DNA, 98 bp, Homo sapiens
cacttctaatggtgggtatatggttggtggttgtattcatctgtgtaattttctttttttttgagatggagtctcaccctgtcacccaggctggagtg

SEQ ID NO: 51397 - DNA, 75 bp, Homo sapiens
ggctggctccctctcactcttccagtctcattctggttcccacagggaggtggcagcctgggagaatgacaagcc

SEQ ID NO: 51398 - DNA, 75 bp, Homo sapiens
gcctggacaatacagtaagacccgtctctacaaatttcttttttttgagatggagtctcactctgtcacccaggc

SEQ ID NO: 51399 - DNA, 78 bp, Homo sapiens
cataaatgtgtatacatatatatgtatatatgtatgtgtgtatatatgtgtatatgtatgtgtatatatgtgtatatg

SEQ ID NO: 51400 - DNA, 105 bp, Homo sapiens
agcacagaagggccgtgaattgtgtggtctgtgtcattctgtctgcccctgtaagaaggtttgaatgggcagagcaagaggcagaagccatgtgctttgggggtc

SEQ ID NO: 51401 - DNA, 74 bp, Homo sapiens
gactcagagagcctcactggctgagtgaggcctggaatccagttctgattccaaagcccaggttctctcacgtc

SEQ ID NO: 51402 - DNA, 78 bp, Homo sapiens
acagtcacacattgtctccctgagtccttgcccaaatgcccagtggccacagtggctctgtcagactgactgtgtgtg

SEQ ID NO: 51403 - DNA, 85 bp, Homo sapiens
tgcggagtgagatgagaagggaagagccagagaggctctgcggcctcgggagctctcctgcctccctctgtgtctctattccccg

SEQ ID NO: 51404 - DNA, 131 bp, Homo sapiens
gcccagcctcaggcctggtgcaggtgggacagagctgtcaatcatcagtcccatccgtcagtctgtccgtcccccatccagccgtccaggatagaactgtggtttggcgcacaggttctggagggctgggt

SEQ ID NO: 51405 - DNA, 122 bp, Homo sapiens
gggtttacaggcgtgagctactgcacccagtccctgtttttctgagacagtgtctcactctgatgcccgggctggagtgcagtggggcaatctcgactcactgcagccttcacctcccgggt

SEQ ID NO: 51406 - DNA, 117 bp, Homo sapiens
ggcacagttaccaagacacatggagaaagggctgcagtgggaggcatgaggcctctctggctccaggcttgatcctcctgctgcctagtcatgtaatctcagatgggcccctgagct

SEQ ID NO: 51407 - DNA, 65 bp, Homo sapiens
tttgactctgtctgtgtccctgacaggcctcagcctgggacagggtgggcaacgaagaggccaga

SEQ ID NO: 51408 - DNA, 64 bp, Homo sapiens
acctatacctagactatctatatttatatctgtttagatgtgcatattgtgtttaggtatgcgt

SEQ ID NO: 51409 - DNA, 57 bp, Homo sapiens
tgagacggagtctcactctgtcacccagctggagtgcagtggtgcgatctcgactca

SEQ ID NO: 51410 - DNA, 102 bp, Homo sapiens
cattaaatttttatacacttggttctttactgtggcttgtggaccattctttttttcttttttgagacagtctcactctgtcacccaggttggagtatagtg

SEQ ID NO: 51411 - DNA, 73 bp, Homo sapiens
gcacagtggctcatgtctgcagtcctagcattttgggaggctgaggttggaggatcacttgagcccacggtgt

SEQ ID NO: 51412 - DNA, 76 bp, Homo sapiens
ctagacactgaagtcccaggtgggggttcagccacttgctgggctgcataagacactccgcctctcagagtctcag

SEQ ID NO: 51413 - DNA, 94 bp, Homo sapiens
acgcagcaagtccctgctggatatattgtctttgtgctgccagctcttggctgagagtagtaagtgagaagatgctcaggagaacccactgtgt

SEQ ID NO: 51414 - DNA, 71 bp, Homo sapiens
agcgcggcatgcaggagaggctttttttttttttttttttaagactgagtctctctctgtcgcccatgctg

SEQ ID NO: 51415 - DNA, 78 bp, Homo sapiens
gggaggggacaggtggagactactggaggcggcagggctcagacctctgaaggcctcacagaccacactgaggatccc

SEQ ID NO: 51416 - DNA, 76 bp, Homo sapiens
atgaagaattagcttgtttagattgcagcacctaggaagcgtgaggtgccctgaaatctggttctagttctgccat

SEQ ID NO: 51417 - DNA, 101 bp, Homo sapiens
tgggggctgaggactcaagagtctctcagatcctggtttcaaaccgcagtgctcactgctactcactgcctgtgtggctactctgtgcctcagtttcccca

SEQ ID NO: 51418 - DNA, 73 bp, Homo sapiens
ttgacttccagggaaatgtagtcactggtgacagtgggcacactgaccatggaatagcggatctgggactcag

SEQ ID NO: 51419 - DNA, 78 bp, Homo sapiens
gtgcagaggcagggccaagagtggaggtttgtgtgtgaaaggcccctggtgtccatccgtgcctgtgtgtgtctgtgt

SEQ ID NO: 51420 - DNA, 58 bp, Homo sapiens
ttgtgtgtgtgtgtgtgtgtatatatatatatatatatatatatatatatatatataa

SEQ ID NO: 51421 - DNA, 85 bp, Homo sapiens
ccccaggccttggctctctctgtccctctgggttacctgcaggcccccagggatggaggctggactatggcccctcagtctgggg

SEQ ID NO: 51422 - DNA, 82 bp, Homo sapiens
tgagatggagtctcactctgtcacccaggctagagtgcaatgtcgtgatcttgtgtctggaattggtgggttcttggtctca

SEQ ID NO: 51423 - DNA, 93 bp, Homo sapiens
ccagcccaagtgtcagagcgagttcctgtatttaaattaattaatttatttatttatttttgagacaaggtctcactctgtcacccaggctgg

SEQ ID NO: 51424 - DNA, 131 bp, Homo sapiens
gcttagaggggtgggtggggtgagtgggtcctgtcattttttttttttttttttgagatggagtctcactctgtcacccaggctggagtgcagtggcgtgatctccgctctgcaagctctgcctcccgggt

SEQ ID NO: 51425 - DNA, 112 bp, Homo sapiens
cataggaatgctaaagggatggcaggaactgagctgatcccaggcttcactgcaattttgtatgcctgttcgtcagtctcttttagggcattctatattttgcattctgatg

SEQ ID NO: 51426 - DNA, 102 bp, Homo sapiens
ggtgttgtggcaggcacctatagtctcagctactagggaggctgaggtaggaggatcacttgagcccaagaggttgaggctgcggtgagccataagcatgcc

SEQ ID NO: 51427 - DNA, 88 bp, Homo sapiens
actgcttcctggggacacacagcgagtgagtgttggagtcaattgaccctgccaccctctgtgtctgtctgagtccctgctaatcagt

SEQ ID NO: 51428 - DNA, 68 bp, Homo sapiens
gcagtcctggggactccacttttttttttttttttgagacagagtctctgtcacccatgctggacggc

SEQ ID NO: 51429 - DNA, 88 bp, Homo sapiens
ggatttctctgtcttcctgtgacctgactttctgtgtgtctgtttccctgataagtgccggagtaccagggggagccggatgagattt

SEQ ID NO: 51430 - DNA, 91 bp, Homo sapiens
tgcaagtgcttgtatgtatatatgagagcatttgcatgtatgagtatagatttgtacatgtgtgtttgtttatatgttatttgtatgtgta

SEQ ID NO: 51431 - DNA, 86 bp, Homo sapiens
ccactgtgcccaacctgcagctgaatcttttttttttttttttggagaaggagtctcgctctgtcaccctggctggagtgcagtgg

SEQ ID NO: 51432 - DNA, 79 bp, Homo sapiens
tgagacagagtctcactctgtcacccaggctggagtgcagtggtgtgatctcagctcactgcaacatctgcctcctggg

SEQ ID NO: 51433 - DNA, 58 bp, Homo sapiens; identical to SEQ ID NO: 605

SEQ ID NO: 51434 - DNA, 90 bp, Homo sapiens
cactttagcctgggtgacagagtgagactctctctcaaaaaaaaaaaaaaaaaagagacagggtctcttactgtcacccaatgtggagtg

SEQ ID NO: 51435 - DNA, 68 bp, Homo sapiens
gggtgacagtaagagaccctgtctcttttttttttttttttttgagagagagtctcactctgtcaccc

SEQ ID NO: 51436 - DNA, 134 bp, Homo sapiens
gggatgagctgcatgtttgatcagctttgtcatctgttgacaggaagcagtggggcctgacagagcaaacacagcagtctcctctcatgcgctgagggcgggggagcacttgaacagctggccaggggcccgac

SEQ ID NO: 51437 - DNA, 115 bp, Homo sapiens
gcctgcttcggactcctaaagtgttgggattataggtgtaagtcgtggtccatctgtatttttttattttttgagacatggtcttgctctgtcacccagactggagtgcaatggt

SEQ ID NO: 51438 - DNA, 63 bp, Homo sapiens
gggtctcactctgttactcacgcctgatctgttagatcaggccagagtacattggtctgatct

SEQ ID NO: 51439 - DNA, 69 bp, Homo sapiens
atcacgcccaacctctctgctgattttttgattctgtatataagaaaactaggtcaggttgggcgcggt

SEQ ID NO: 51440 - DNA, 79 bp, Homo sapiens
gggtgacagcgaagtaaggttttttttgttttttgtgttttttttttttttggtagaagacagtctttgtctgtcactc

SEQ ID NO: 51441 - DNA, 86 bp, Homo sapiens
ggtatttgcactgtctgctggtttgactttcagagagggtccaagcccgtcaggcactctctctctcgcccggccaaggtgaagcc

SEQ ID NO: 51442 - DNA, 64 bp, Homo sapiens
tgtgtgtctctgtgtgtctctacgtgttattccactagggatttgcacagataggttttgcaca

SEQ ID NO: 51443 - DNA, 63 bp, Homo sapiens
gactggtgtctgtaatcccagctcttagagaggctgaggtggaaggatcacttgaagccagtc

SEQ ID NO: 51444 - DNA, 58 bp, Homo sapiens; identical to SEQ ID NO: 2758

SEQ ID NO: 51445 - DNA, 121 bp, Homo sapiens
tggtaggactgtgactctcaggctatgtcccctctgatctccctcagtcacacactcaggcatcctgctagagaaactgaggcgagggtagcccagaggcacccagccttaagccaggtct

SEQ ID NO: 51446 - DNA, 74 bp, Homo sapiens
gcctttttttttttttttttgagatggagtctcactctgtcacccaggctggagtgcaatggcttgatcttggc

SEQ ID NO: 51447 - DNA, 116 bp, Homo sapiens
atcatagtatttattacactacttaattcagtaaatatataaaagtagccttcaatttatttttatattattttacatgtttttacctgcagttgtgtatgtgaatttaccttggt

SEQ ID NO: 51448 - DNA, 96 bp, Homo sapiens
ccaaggtgctaggattacaggcatgagccactgcacctggcctcagagattatgttctctcagtgtttcagtgtctggtaattctgtgcagtttgg

SEQ ID NO: 51449 - DNA, 68 bp, Homo sapiens
caggatactagaggggcagggaaagagctgtcctggactcacgctctcacaccttctcacagtgcctg

SEQ ID NO: 51450 - DNA, 117 bp, Homo sapiens
gttaaggccaggagttcaagaccagcctgggcaacacagcaagatcccatcttttttttttttaagaaaaggataaaccgtttgagcatcaggcagtgtctaagactcatctttgac

SEQ ID NO: 51451 - DNA, 73 bp, Homo sapiens
gccaggtgcagctctcacagcctaggctgaggccattggcaatggcaatgcagtctctgtctgtctgcctggc

SEQ ID NO: 51452 - DNA, 67 bp, Homo sapiens
gtgggccctcagtgaggagagattgtttcttcttgagacattctctctctggttttggtgggcccac

SEQ ID NO: 51453 - DNA, 119 bp, Homo sapiens
ccattgcttcctctctcctgcctacacagattatgatcgtactccacttttttttttttttttttttttttttttttgaggcagtcttgctctgtcacccaggctggagtgcagtggca

SEQ ID NO: 51454 - DNA, 58 bp, Homo sapiens; identical to SEQ ID NO: 38489

SEQ ID NO: 51455 - DNA, 111 bp, Homo sapiens
gggagcattccctggggaccgaagacgattttaacagaggaaataatctcctacatttgtaaaacaatttttttttttttttttaaaatagcatgtccctacagaactctt

SEQ ID NO: 51456 - DNA, 64 bp, Homo sapiens
gggctgggagtggggtttcagttttctgttttgtttttagagatggggtctctctctgtcaccc

SEQ ID NO: 51457 - DNA, 88 bp, Homo sapiens
aacctcagtatgacctctcactaactctgtgaccttaggccaatgacagaacctatattgtaaagtgggtgtgaggattaactgggtt

SEQ ID NO: 51458 - DNA, 58 bp, Homo sapiens; identical to SEQ ID NO: 2531

SEQ ID NO: 51459 - DNA, 64 bp, Homo sapiens
tgtgtgtgtgcatgaatgtgtgtgcacatttgaagaaagagagtgaacacacaggcacaaaata

SEQ ID NO: 51460 - DNA, 66 bp, Homo sapiens
agttctctgagcatctctaagacaattgttttaatatatttgtctagtaggtctgccatgaggact

SEQ ID NO: 51461 - DNA, 113 bp, Homo sapiens
gtcattcagaaaaatggccagaagtagatgatgacagcatcaaagatcttggagaagtaaagaagtgaatttgaaaatttgtctgtatttaatggcctgaactgagagttgat

SEQ ID NO: 51462 - DNA, 74 bp, Homo sapiens
tgggtgtgtgagggaggaggggctaaactctcacggggaaagtgagccatttctctccctctctggctcactta

SEQ ID NO: 51463 - DNA, 116 bp, Homo sapiens
ggcatgatccccattcctcagccttggcaccgtggctttcttcttttttttttttctttttgagacagagtcttgccccgttgcccatactggagtgcagtggtgcgatcttggct

SEQ ID NO: 51464 - DNA, 68 bp, Homo sapiens
gccccatggagcagggatagtgtagtgaccagccccatagggtcggtgggtctctccctgtgtgcggc

SEQ ID NO: 51465 - DNA, 81 bp, Homo sapiens
ggagggtttgcttgtttagttttgtttactttagtagaatgatggaggtgatgtaacttaaatttttaagagcctccctct

SEQ ID NO: 51466 - DNA, 120 bp, Homo sapiens
ctgggtgacagagcaagactctgtctcaaaaaaaaaaaaaaaaaaaaaaaagaactgtttttcttctttttttgtttttttgtgtgtttttttgagacagggtatcactctgtctcccag

SEQ ID NO: 51467 - DNA, 56 bp, Homo sapiens; identical to SEQ ID NO: 6939

SEQ ID NO: 51468 - DNA, 59 bp, Homo sapiens
gtaggagtctctctctgtcacgcaggctggagcgcagtggcgtgatcttagctcactgc

SEQ ID NO: 51469 - DNA, 83 bp, Homo sapiens
agtctggccaacatggtgaaaccccgtctctttttttttttttttttttttttgagacagagtattgctctgtcgcccaggct

SEQ ID NO: 51470 - DNA, 66 bp, Homo sapiens
tgagacaaagtatccctctgtcactctgtcgcccaggctggagtgcagtggcgtgaactcggctca

SEQ ID NO: 51471 - DNA, 102 bp, Homo sapiens
ggtgtggctgagtgcgcctgtagtcctagctactggggaggctgaggtggaaggatcacttgagcccaggaggcggaggttgcagtgagccaagatgacacc

SEQ ID NO: 51472 - DNA, 85 bp, Homo sapiens
ttttgaaaaagtaatatattcacatggcttaaaatttgaaactttttcaaattttgcccaagctgtgaggattacaaacacaaaa

SEQ ID NO: 51473 - DNA, 70 bp, Homo sapiens
gctctcaagtcacactgtctctctcccacacacatgcggcgctgtgctggaggacggtggcgcgctgagc

SEQ ID NO: 51474 - DNA, 84 bp, Homo sapiens
tggaggaaggcggtggggtttctgcttcaccacgactcaacagaagagagtgtgtagaggggagaccccgacagccaggagcca

SEQ ID NO: 51475 - DNA, 114 bp, Homo sapiens
gggcagggtcttcgaatggttctgtcactatggtatttctgtgcccagctcagtctgtctgtcccattctgggccacacacagaagaatcaaagggagcctagaagctcagccc

SEQ ID NO: 51476 - DNA, 76 bp, Homo sapiens
ggtaactagccacttgtgtgcctgagaacctgaatttttaatttaaatttcagaagccacatgtagctaggctacc

SEQ ID NO: 51477 - DNA, 58 bp, Homo sapiens; identical to SEQ ID NO: 315

SEQ ID NO: 51478 - DNA, 92 bp, Homo sapiens
ctgggactacaggcctgagccagttttcatttctcttttttaaatttttttttctttgagatggagtctcactctgttgcccaggctagagt

SEQ ID NO: 51479 - DNA, 65 bp, Homo sapiens
attcctctcagcctcactctctatctcaggtcggggggcaggggagggtggggaaggaaaggagt

SEQ ID NO: 51480 - DNA, 58 bp, Homo sapiens; identical to SEQ ID NO: 1391

SEQ ID NO: 51481 - DNA, 56 bp, Homo sapiens; identical to SEQ ID NO: 1392

SEQ ID NO: 51482 - DNA, 67 bp, Homo sapiens
ctgagacccactctcagtcagttctctaaaatgttctggtttctttgaatgagaagtggtatttcag

SEQ ID NO: 51483 - DNA, 73 bp, Homo sapiens
gagacagagtctcgctctgtcacccaagctggagtgcagttgcgcgatcttggctcactgcgagctctgcctc

SEQ ID NO: 51484 - DNA, 95 bp, Homo sapiens
ggccaggtgtggtggttcaggcctgtaatcccagcactttgggaggctgaggttggaggatcatttgagcccaggattttgagaccactcctgcc

SEQ ID NO: 51485 - DNA, 114 bp, Homo sapiens
gagatggaatctcactgtgttgtctaagctgtgatgacggttttttgtttttttttttaaacggtgtttctccctgtcacccaggctggagtgcagtggcgcaacctccacctc

SEQ ID NO: 51486 - DNA, 86 bp, Homo sapiens
tgacaggagtgaaaccctgcctcaaaacaaaacaaaacaaaaaggacactttttttttttttctgagacagagtctcactctgtca

SEQ ID NO: 51487 - DNA, 113 bp, Homo sapiens
cggccagaataaagacattttaaaactaaaaaaaaaaaaaaaaagagtttgctttgcattaatctttttttttcttttttttcgtttttattttttagtttttattttttttg

SEQ ID NO: 51488 - DNA, 83 bp, Homo sapiens
tacaaaactgaattttatgcacacttagtttttctgggtttttttggggggggtaggggtgtgtgtgtgtgtgtgtgtgtgtg

SEQ ID NO: 51489 - DNA, 140 bp, Homo sapiens
gcgtgtgcaggtttttatctgttggtgtgtcagcgtgtgtgcgtgtgtggccgagcctccgtgtgtgtctgtgtgtgtctgtgtaggggtcagggtgtgaattacagcctatccctgtccccgtcactgcctgcctgcgc

SEQ ID NO: 51490 - DNA, 68 bp, Homo sapiens
gggtgtggtggtgcatgcctgtagtcctagctactcaggaggctgaggtaaaaggatcatttgagccc

SEQ ID NO: 51491 - DNA, 163 bp, Homo sapiens
ccattgcactccagcctgggtgacaagagtgaaactccatctcaaaaaaaaaaaaaaaaaaaaaaaaaaaaaaaaaaaaagacagggtctcactctgtcacccaggctggagtacagtggtgtgatcatggctcgctgcagccttgaacacctgggctcaagc

SEQ ID NO: 51492 - DNA, 171 bp, Homo sapiens
gtatatgtatatatgtgtgtatatatgtatatatgtgtatatatgtatatatctatatatgtatatacgtatatatgtgtatatatgtatatatgtatatgtatatatgtttatatgcatatatgtgtatatgtatatatgtttatatgcatatatgtgtatatgtatata

SEQ ID NO: 51493 - DNA, 108 bp, Homo sapiens
gtgtggtggcatgtgtctgtagatccagctacttgggaggctgaggtaggaggatcgcttgagcccatgagtccgggagttagagactgcagtgagctatgatcacac

SEQ ID NO: 51494 - DNA, 157 bp, Homo sapiens
atacacacgtgtgtatatatgtatatgtatatacacacgtgtgtatatatgtatatgtatatatacacgtgtgtatatatgtatatgtatatatacacatatatgtacatatgtgtatatatgtatatgtatatatacacatatatgtacatatatg

SEQ ID NO: 51495 - DNA, 56 bp, Homo sapiens
gagacagggtctcacactgtcacccaggttggagtgcagtggtgggatcatagctc

SEQ ID NO: 51496 - DNA, 115 bp, Homo sapiens
ggcaagatgggtgatggttgtaatcccagcactttggaaggctgaggtaggaggatcacttgagcccaggagattaagaccagcctgggcaacaaagtgagacccccatctctac

SEQ ID NO: 51497 - DNA, 87 bp, Homo sapiens
gggcgggcagagaactggactggggctggggtgggcacaggggaggcgttcccatcccagctctgtttgactctctctgtgtgacct

SEQ ID NO: 51498 - DNA, 118 bp, Homo sapiens
taaaagggacaggaattgctcactcggggagctccgtttttgagaagtgagtcagctgacgctcccggccgaataaagctccttccttctttaacccggtgtctgaggagttttgtct

SEQ ID NO: 51499 - DNA, 98 bp, Homo sapiens
atatatgtatatgtagatatatgtatatatgtacatatatatgtgtgtatatatacatatatatatatatatatatatatatatatatatatttagac

SEQ ID NO: 51500 - DNA, 82 bp, Homo sapiens
ctgcagcctgggcaacagagtgagacagacactgactcttaaaaaaaagaagacagtcaaatctgcctgtgcccaagttaag

SEQ ID NO: 51501 - DNA, 67 bp, Homo sapiens
tgggcacaggcagatttgactgtcttcttttttttaagagtcagtgtctgtctcactctgttgccca

SEQ ID NO: 51502 - DNA, 100 bp, Homo sapiens
gcgcagaagacctaaagccgtgcctcgcagcctgtttagcactaagcgcacttggtttatctggtctgcgatcatgtccggaacacagggtcttctgtgt

SEQ ID NO: 51503 - DNA, 68 bp, Homo sapiens
tcgcccaggctggagtgcagtggcgcgatcttggctcaccacagtctctgtctcccaggctaaagcga

SEQ ID NO: 51504 - DNA, 115 bp, Homo sapiens
gcccaactcctttccagagcaaaggatcatgtaccaggatctccactgtctctctcagagcctttatcatcttttcataatcttcattttgcttctgagactgggtcaacagagc

SEQ ID NO: 51505 - DNA, 103 bp, Homo sapiens
tcagccccactttttccctgaccatatgtcaatgctaatgttgtctgaagagtctgaagacaatgtgatgtggtgattacaagtttagattaagtgattatga

SEQ ID NO: 51506 - DNA, 66 bp, Homo sapiens
ggtgtggtggttcactcctgtggtcccagctacttgggaggctgaggtaggaggatcacttgagcc

SEQ ID NO: 51507 - DNA, 114 bp, Homo sapiens
gggattctggaaggaggccaccatgtagaatggccctgcttgaatccagttaagagtaatgtgcagaatggttaagcagggttacagcctcgactggcctcctgttatgatcct

SEQ ID NO: 51508 - DNA, 58 bp, Homo sapiens
tgagtcagagactcgctctgtcacccaggctggagcgcagtggcgcggtctcggctca

SEQ ID NO: 51509 - DNA, 81 bp, Homo sapiens
acctcagcctctcaaggagctaggactacaggcacgtgtcaccatgcctggctaattttttactttttgtagagatggggt

SEQ ID NO: 51510 - DNA, 140 bp, Homo sapiens
atgcacacacacacacataaatatgaattcatactaatttctgtgtgtgcgtatgtgtgtgtgtgtgtgtgtgtgtgtgtatgtattttgagacagagtcacactctgtcgccaggctggaatgcaatggcacaatcata

SEQ ID NO: 51511 - DNA, 89 bp, Homo sapiens
ataactttttgtctacacatactgttttagcatgtgttaaaatttgttttttctaattttaaaatacgtgcttgttagtatgaagttat

SEQ ID NO: 51512 - DNA, 58 bp, Homo sapiens; identical to SEQ ID NO: 87

SEQ ID NO: 51513 - DNA, 56 bp, Homo sapiens; identical to SEQ ID NO: 88

SEQ ID NO: 51514 - DNA, 103 bp, Homo sapiens
tttagttatggtctatagatgacaaagtatttgtttctgaattctatttcttattttttagagaccgagtctcgctctgtcgcccaagctgaagtccattggc

SEQ ID NO: 51515 - DNA, 167 bp, Homo sapiens
atagtgtgagactgtctcaaaaaaaaaaaaaaaaaagcctctaaataaactttttatttttatttttttttttatttttattttttttgagactgagtctcactctgtcacccaggctggagtgcagtggtgtgatctcgtctcactgcaagctctgcctcctgggt

SEQ ID NO: 51516 - DNA, 97 bp, Homo sapiens
ttcatgtatatgtatattcatgtatatgtatatacatatatatgtgtgtgtatatatatatatatatatatatatatatatatatatatggaattac

SEQ ID NO: 51517 - DNA, 56 bp, Homo sapiens
ttgggatggagtctctcactctgtcgccaggctggagtgcagtggcatgatctcag

SEQ ID NO: 51518 - DNA, 90 bp, Homo sapiens
atagatagatagatagatactattctggtatatatatacatatatataaaaactatatcagcccatttagtgtctacctcttaggtttgt

SEQ ID NO: 51519 - DNA, 94 bp, Homo sapiens
tcttagaatagtatatacatatatatcttagaatagtgtatatatatatatatatatatatatcttagaattgtgtgtatatatgtatcttaga

SEQ ID NO: 51520 - DNA, 58 bp, Homo sapiens
tgagatggagtctcactctgtcacccaggctggagtacagtggtgtgatctcagctca

SEQ ID NO: 51521 - DNA, 58 bp, Homo sapiens; identical to SEQ ID NO: 2248

SEQ ID NO: 51522 - DNA, 99 bp, Homo sapiens
ccggctaatttggttttttggggttttattctgttttgttttggagggttttttttttttttttggagagatggggtttcaccatgttgcccaggctgg

SEQ ID NO: 51523 - DNA, 118 bp, Homo sapiens
cctggaatcttcctcttcctcattcctcactgtctatagagtttttgtttttgatttttgtttttgagacggagtctcactctgtcacccaggctggagtgcagtggcgtgatcttgg

SEQ ID NO: 51524 - DNA, 101 bp, Homo sapiens
tgaggcaggagaatcgcttgaacctaggaggcagagattacagtgagctgagatggcgccactgcactccagcctgggcgacacagtgagactccatctca

SEQ ID NO: 51525 - DNA, 83 bp, Homo sapiens
gtgtgtgtatatgtatatatgcatatatatatgtgtatgtgtatatatgcatgtgtgtatatatacatatataaatatatata

SEQ ID NO: 51526 - DNA, 57 bp, Homo sapiens
gcccaggaagttgaggctgtagtgagctgtgtttacaacactgtgtgcagtctgggc

SEQ ID NO: 51527 - DNA, 74 bp, Homo sapiens
atgtgtatgtgtatatgtgtgtatgcatgtgtatgtgtgtatatatgtgtgtatgtatatgtgtgtgtgtgtgt

SEQ ID NO: 51528 - DNA, 86 bp, Homo sapiens
cctaggtctggcgtgagaaccaagaaattgcatttcttttttttttttttccctgagatggagtctcgctctgtcacccaggctgg

SEQ ID NO: 51529 - DNA, 119 bp, Homo sapiens
ctgtagtgttcagaggatgaggctgtggctcacagaggtaagtcacctgcgcaaagtcacccagctttgactaggcctgctgacttggaaccctgagctctgtccctaaactttggcag

SEQ ID NO: 51530 - DNA, 82 bp, Homo sapiens
gtaatgagactgagctcactggcaggaaagggagcagccttaattggtactggccctgccttggccccgtgacactcattac

SEQ ID NO: 51531 - DNA, 85 bp, Homo sapiens
gagccggagttgccacttttttttttttttttttgagacagagtcttgctctgtcacccagactagagtgtagcgatctcagctc

SEQ ID NO: 51532 - DNA, 61 bp, Homo sapiens
gctgtgtctgtctgtctgtctatcagaggcctcccacgatggatggtgcaggggagagggc

SEQ ID NO: 51533 - DNA, 70 bp, Homo sapiens
ggcccagtgccacgttcctggccctgagtctctctctctatcacaagtcactgaatgttgttaaggggcc

SEQ ID NO: 51534 - DNA, 111 bp, Homo sapiens
ggcatgacattgatttgtaaatggacctgttggtagggagctggtgggacacacctgggtttcagtctcatctttgctgcttactggctgcaggaccttgagcaagatgct

SEQ ID NO: 51535 - DNA, 100 bp, Homo sapiens
gcctgctttgcaatctctgaagtgctctgcctgtgtctgtcattgttggaccaacccagagagagctgggaatggccagccaagggacagaactgcctgc

SEQ ID NO: 51536 - DNA, 58 bp, Homo sapiens
gactaaagataggggatgggctacatgtcccaatactgcctgggtccctgtattggtc

SEQ ID NO: 51537 - DNA, 65 bp, Homo sapiens
gctgagagatctgctgttagtctgataggctaccctttgagggtaactcagtctttctctctggc

SEQ ID NO: 51538 - DNA, 83 bp, Homo sapiens
ggtctcactctgtcactgaggctggagcacaatggcatgatcttggctcattacagcctcagcctcctgggctcaggtgatcc

SEQ ID NO: 51539 - DNA, 68 bp, Homo sapiens
aagagggagggagaaagccaagccaccaatcccagcagtgggatttctttgttttttttttttttttt

SEQ ID NO: 51540 - DNA, 61 bp, Homo sapiens
tgagagagtctctcactctgtcacccaggctggagtgcagtggtgtgatgatcacagctca

SEQ ID NO: 51541 - DNA, 75 bp, Homo sapiens
gatttataggcatgtgccaccatacctagctaattttatatttttagtacagatggtcaggctgccttgttggtc

SEQ ID NO: 51542 - DNA, 99 bp, Homo sapiens
tcgtggctccgtccgagtgtttatcacagagactcagtcattcattcaacaaatagatactgtgtgctgactttgtgccaagcactgttcaaaacacga

SEQ ID NO: 51543 - DNA, 56 bp, Homo sapiens
gagacatggtctcactctgtcacccaggctggagtgcagtagtgaaatcatagctc

SEQ ID NO: 51544 - DNA, 95 bp, Homo sapiens
tttttctggaagaattggaaagtaggaatattatgtatactctagcatctctctggtatgcatttattttattttattttattttttgagacgaa

SEQ ID NO: 51545 - DNA, 70 bp, Homo sapiens
tttttttgagactgattgtcactctgtcacccaggctggagtgcagcggtgtgatcttggctcactgaaa

SEQ ID NO: 51546 - DNA, 103 bp, Homo sapiens
atagatagatagatagataggatattacatatatatatatttagagacgagggtctcactatgttgagtatatatgtatatatatatgtgtgtgtgggtatat

SEQ ID NO: 51547 - DNA, 91 bp, Homo sapiens
actttgttttggttgttacagtagaaagtgaggtaaatctttttttttttttttttgagatggagtctcgctctgttgcccaggctggagt

SEQ ID NO: 51548 - DNA, 101 bp, Homo sapiens
ttgtctttattaaactaacaaagaaatttatatgtgcatatatatatatatatatatatatatatatattttttttttttttttttttttttttgagacag

SEQ ID NO: 51549 - DNA, 60 bp, Homo sapiens
ggttgcagtcagttgtcagtcaggctacagtcatttgaatgcctgatgagctggaagacc

SEQ ID NO: 51550 - DNA, 90 bp, Homo sapiens
ctgcctcccagtctggctgcctggagttgtgatttttttttttctttttctgagacaaagtattgctctgtcacccaggctggagtgcag

SEQ ID NO: 51551 - DNA, 76 bp, Homo sapiens
gacagtcagggaggcttttggtggaggtggcttttttttttcttttttttttggtcaaacacagtctcattctgtc

SEQ ID NO: 51552 - DNA, 105 bp, Homo sapiens
gcaaaagaatataatccttttcctgtgacaaagagaaaggggactgtcccatttatttttttatttttgagatggagtcttgctctgtcacacagattggagtgc

SEQ ID NO: 51553 - DNA, 58 bp, Homo sapiens
tgagatggagtctgactctgtcacccagcctggagtgcagtggtgcaatctcagctca

SEQ ID NO: 51554 - DNA, 86 bp, Homo sapiens
ttttgccatctgctaagcatcctaatgtttgcatctttgaatagatgttaaacatttctgattatattgttctgaccgtggtgaaa

SEQ ID NO: 51555 - DNA, 58 bp, Homo sapiens
tgagacaggatctcactctgtcacccacattggagtacagcagcatgatctcatctca

SEQ ID NO: 51556 - DNA, 88 bp, Homo sapiens
ggttgataaatatttgagttgtttccaccttttgacttttttttttttttttttggagggggggggacaagatctcactctgtcaccc

SEQ ID NO: 51557 - DNA, 58 bp, Homo sapiens; identical to SEQ ID NO: 1087

SEQ ID NO: 51558 - DNA, 58 bp, Homo sapiens; identical to SEQ ID NO: 1265

SEQ ID NO: 51559 - DNA, 117 bp, Homo sapiens
ctgacaagctggagcttgcaggctccatccaaagggacgagctgctattcagtgtcagctgactgctgccgttcaggaatcaggcccgccgtggacagctctagttttctctttcag

SEQ ID NO: 51560 - DNA, 58 bp, Homo sapiens
tgagacagactctcactctgttgtccaggctggagtgcagtggtgtgatcttggctca

SEQ ID NO: 51561 - DNA, 108 bp, Homo sapiens
agacagaaggcaaatacaggagagacaggtgccggctgtgcacttgtcaccctctcttggtgtctgtctgtctatatgtcggcctggccctctctctcactccctccc

SEQ ID NO: 51562 - DNA, 103 bp, Homo sapiens
ggctggccggttttgccggtgtggagggaggcctgcagcatggcagctgtctgtagggggctgtctgtgtgtctgtctcggtgtatggggctgctggccagtc

SEQ ID NO: 51563 - DNA, 130 bp, Homo sapiens
ttgtgtgtacgtgtaagtgggtcatctctttctgaggcatggtcagggttggcttccactctctgtcactctcatggacatttcatctgcttgcctctccatccagccatctgtagcatgctcagctaac

SEQ ID NO: 51564 - DNA, 124 bp, Homo sapiens
agggagtggggtgggtgaaggctgggtgcagacctaggagagggccacctccctggacctctgtttctgtgtctgtgaagtgggccttgaagagtggccccaaaagatacagctgggcagatcc

SEQ ID NO: 51565 - DNA, 79 bp, Homo sapiens
ttctccaccttgtcctctcacagatctcataggaaatgttcaacaattctgtgaagagtctcaggacccaattggagaa

SEQ ID NO: 51566 - DNA, 120 bp, Homo sapiens
ggacttatttctaagtgtgacagggagctattagagggttttaagcaggagagtgatgtgatctcattttgtaatagagatcctctggctgccgtggcactgacttctgggcgtgatgcc

SEQ ID NO: 51567 - DNA, 79 bp, Homo sapiens
ttcccagaactggggctgtgttggaagacaatgaaggcctgccagcctgtctgccagagaagttcagagggctgtggga

SEQ ID NO: 51568 - DNA, 85 bp, Homo sapiens
aggagccaggcttgtttcagatcatgacagcaagctctcttgcctttggcatccccttgctctccctctcactccctgtgctgct

SEQ ID NO: 51569 - DNA, 132 bp, Homo sapiens
gggtaaggtgtggcctctgtcaccagctgggtgaccttgagaaaatcgcttcacctctctgagtctcagtttcttcacctgcatcatagggttattgtgaggtttaaataagagtgatgaagcttggctggg

SEQ ID NO: 51570 - DNA, 90 bp, Homo sapiens
tcagtcatcatgaccatgagatgaagcggcaagtcatgaccctgtcgtgtgtctctgtcaggtgctgaagatgcagaaaggaatatgact

SEQ ID NO: 51571 - DNA, 91 bp, Homo sapiens
ctcagctttctaagaaatggcagcttggtcagacatgagtgtcagcattcgagcacccacctcctggccactgttttctctgtctgctcag

SEQ ID NO: 51572 - DNA, 118 bp, Homo sapiens
ggtagatttttacacaccggggggcatttgtttgggatgatctgattttttctttttttttttttttaagagatgagatcttgttctgttgcccatgctggagtgcagtggtgcaatc

SEQ ID NO: 51573 - DNA, 58 bp, Homo sapiens
acatagtgagactccatctcaaacaattttttttttttgagactgagtctcactctgt

SEQ ID NO: 51574 - DNA, 58 bp, Homo sapiens
tgagacagagtctcactctgtcgcccaggctggagtgcagtggcgagatctcggctca

SEQ ID NO: 51575 - DNA, 172 bp, Homo sapiens
atatatatgtgtgtgcgtgtgtgtgtatatatatgtatatatgtgtgtatatatatgtgtgtgtatatatatgtgtgtgtatatatgcctatacatattagtgcctatatatgtatatatataggtgtatatatgtatatatataggtgtatatatgtatatatataggtat

SEQ ID NO: 51576 - DNA, 92 bp, Homo sapiens
ggtggtggttgttgttgttttgagacagagtctcactctgtcacccaggctggagtgtagtggtgtgatctctgctcactgcaacctccacc

SEQ ID NO: 51577 - DNA, 112 bp, Homo sapiens
cagagcctgccctgcccctctgtcccctgctccaggctgtgcctctcactgtcacccctgccttctcccttcagccagccagcaggggacggccgctctgcagaaggagctg

SEQ ID NO: 51578 - DNA, 58 bp, Homo sapiens
tgagacagggtctcactctgttgctcagactggagtgcagtggcatgatcttggctca

SEQ ID NO: 51579 - DNA, 135 bp, Homo sapiens
attcttttcaggaaaacattcctagaggtggagttgctgggttgaaggacagcaatgctttctttttttgttttgttttttgagatggagttttgctcttgtcacccaggctggagtgcaatggtgccatctcag

SEQ ID NO: 51580 - DNA, 58 bp, Homo sapiens; identical to SEQ ID NO: 16419

SEQ ID NO: 51581 - DNA, 58 bp, Homo sapiens; identical to SEQ ID NO: 2248

SEQ ID NO: 51582 - DNA, 70 bp, Homo sapiens
ccaaatatttttgatctctgactggctgtgtccatggatacagaacccacagagggtcaattgtacctgg

SEQ ID NO: 51583 - DNA, 79 bp, Homo sapiens
ggggaatccgtgggatcctccttctttaacacaatttttttttttttttttttggagacagggtctcactctgtcaccc

SEQ ID NO: 51584 - DNA, 130 bp, Homo sapiens
gcatgtgcgtgtgttttgttcaggctctgtccacaggaccctgtgtgagtgtgtcagtgagtgtgtgtctctgcgggcaggtctctgtgcacgggatctgtgtacgggagtatagtctgcaggtgggcat

SEQ ID NO: 51585 - DNA, 60 bp, Homo sapiens
cctggctctctcactctctgcttgctccttggaaggggttgctatgttgagaagctcagg

SEQ ID NO: 51586 - DNA, 58 bp, Homo sapiens
ggagggagagagggaggaaagaacagaactaaaatattgggtctctctctgtcactcc

SEQ ID NO: 51587 - DNA, 57 bp, Homo sapiens
tgagactgagtctcaatctgtcacccaggtggagtgcagtggtgcaatctcggctca

SEQ ID NO: 51588 - DNA, 78 bp, Homo sapiens
acacctagaagcttctcaaagaagagtgagatcagacttggaaacaattgtcatggagcctttactctgaagaggtgt

SEQ ID NO: 51589 - DNA, 87 bp, Homo sapiens
catgaaggctctctaaggaacaagactagatacatcatatgatcacctgtgtgtgtgtgtgtgttacttaggacaggagccaacatg

SEQ ID NO: 51590 - DNA, 115 bp, Homo sapiens
tgcattctaactgggcaacaaagtgagaccctgtctcaaacaaacaaaaatacttatttatttatttattttttttgagatggagttttgctcttgttgcccaggctggagtgca

SEQ ID NO: 51591 - DNA, 92 bp, Homo sapiens
tgaggtttgtaagatgttaacatgtggagaacttgggtgaagagtattcaggaatttcttatattatttttgtaacttctttataaatctta

SEQ ID NO: 51592 - DNA, 87 bp, Homo sapiens
ctaagtagtgggcacaccagctccggagcagtcagggtgggcattctcatgtgaggctcccactgtgtgttagttggcacggcttag

SEQ ID NO: 51593 - DNA, 108 bp, Homo sapiens
tctgcatgggaggcatgtcaaagaatctgtggggggaaaaaaaaaggcacggcaccagtccatctatttttattttttttttttttagacaaggtctcgctgtgttga

SEQ ID NO: 51594 - DNA, 103 bp, Homo sapiens
tgattttttatgttgatttttcaccctaaaactttattgaatttgtttattacttctaacaggttttttgtggaatttttagggttttctacatataagatca

SEQ ID NO: 51595 - DNA, 95 bp, Homo sapiens; identical to SEQ ID NO: 580

SEQ ID NO: 51596 - DNA, 93 bp, Homo sapiens; identical to SEQ ID NO: 69

SEQ ID NO: 51597 - DNA, 111 bp, Homo sapiens
tctaagtgcaaaaagaagtcattgactgtttctaagcagagtcagtaacacaatcagaatttctttctttttttggaaaaaatagtctcctctggctactgtgcatagaga

SEQ ID NO: 51598 - DNA, 69 bp, Homo sapiens
atccaggtgggctcagctgggatctctgctcagtgtctcacagacagaaattacagtgccggccagggt

SEQ ID NO: 51599 - DNA, 105 bp, Homo sapiens
ccagccatgcttcctggagagcctatggaactgtgagccaattaaacttattttgtttataaattacccagtctcaggtagttctttatagcaatgcgaaaatgg

SEQ ID NO: 51600 - DNA, 109 bp, Homo sapiens
tagtgtgtgtacatgtgtatgtgtgtatattgtatttgtgtgtatacatatagtctatatatgtatatatgtgtaatatattagtctatagaaatatatacatatacta

SEQ ID NO: 51601 - DNA, 56 bp, Homo sapiens
gagacggagtctcactctgtcacccaggctggaggacagtggtgcaatctctgctc

SEQ ID NO: 51602 - DNA, 125 bp, Homo sapiens
cttgggtatatgagtgagaacggaatcttcttattttattttctttgagatggagtctcactctgtcacccaggctggagtgcaatggcgcaagctctgctcactgcaacctccacctaccgggt

SEQ ID NO: 51603 - DNA, 110 bp, Homo sapiens
tatgtggggttttcaaagtttggaatgtgtcagatataatgatgcttggtcactgaagatagtgaccaagtctttctagtgacaggaagaggctgctattgaaccacatg

SEQ ID NO: 51604 - DNA, 72 bp, Homo sapiens
cagggtggtggctgaagctggttggagctttttctagaaatgtcctgactcaatctctcagtcacactcctg

SEQ ID NO: 51605 - DNA, 108 bp, Homo sapiens
agattatattgttgataggttcttggaaactgcaacatcaagttaaaaatttttttttagatggaatttcgctcttgttgcccaggctggcgtgcagtggcatgatct

SEQ ID NO: 51606 - DNA, 95 bp, Homo sapiens; identical to SEQ ID NO: 68

SEQ ID NO: 51607 - DNA, 93 bp, Homo sapiens; identical to SEQ ID NO: 69

SEQ ID NO: 51608 - DNA, 107 bp, Homo sapiens
cttttgttcatatctgtacacttatacccagtgtctcacacagtgcctcttacctagcaagccctacaaatattgtgattgtgtatatgtgaaggaatgaatgaatg

SEQ ID NO: 51609 - DNA, 95 bp, Homo sapiens; identical to SEQ ID NO: 580

SEQ ID NO: 51610 - DNA, 93 bp, Homo sapiens; identical to SEQ ID NO: 69

SEQ ID NO: 51611 - DNA, 64 bp, Homo sapiens
caggtgtagttgtccatgcctgtagtcccagctactctggaggctgaggtagaaggatcacttg

SEQ ID NO: 51612 - DNA, 114 bp, Homo sapiens
caatttataggctgtcagcagttgtttatgccttcatattaattctgggatgtatatttattttattctgaggatataatatgatgcataattgattttgagagtttggaattg

SEQ ID NO: 51613 - DNA, 83 bp, Homo sapiens
acgtgttcctttctgatctacttaactagttgatgccatctttagatgtatgtattgtagtagtagttacggaagggacttgt

SEQ ID NO: 51614 - DNA, 71 bp, Homo sapiens
tccaagtagctgagattacaggcaggtgccaccatacctggctaatttatgtatttttatcagagactggg

SEQ ID NO: 51615 - DNA, 81 bp, Homo sapiens
gctgccacctcttcccctaggggctcaggcccagggagatcagagttctgtccctgagtccctggctgaagttgttaaagt

SEQ ID NO: 51616 - DNA, 95 bp, Homo sapiens; identical to SEQ ID NO: 68

SEQ ID NO: 51617 - DNA, 93 bp, Homo sapiens; identical to SEQ ID NO: 69

SEQ ID NO: 51618 - DNA, 112 bp, Homo sapiens
ttaatttgcttcactgtggtaatgatttacctatgtatatgtatattaaaacatcatgttgtacaccatacataaagaaaaaaattaccaggtttgctgaacaacagattga

SEQ ID NO: 51619 - DNA, 88 bp, Homo sapiens
tctctcagagataagactgaagtatactctaggagggttcggcagtcaacaagctgcttctcctttttttttgttttttttttgagga

SEQ ID NO: 51620 - DNA, 69 bp, Homo sapiens
gcatgcagtctctctgactttcagaatcttctggtccagaagtccttctgtcaggtggccttggcatgt

SEQ ID NO: 51621 - DNA, 58 bp, Homo sapiens
tgagatggagtctcactctgtcacccaggctggggtgcagtggtgtaatctcggctca

SEQ ID NO: 51622 - DNA, 67 bp, Homo sapiens
aagaggctgtagctagtttagatagtgaaaaaaatcttaccttctaactggatactttcagcctttt

SEQ ID NO: 51623 - DNA, 120 bp, Homo sapiens
cccacctcagcagagctgcgtctttgtgctttcagcttctttacagtgctgccttgtagcattcaggtcaagcagcattgtacagggctatgaaagaaccaagaatgggctgcccttggg

SEQ ID NO: 51624 - DNA, 92 bp, Homo sapiens
tgggtattcttttatagcattgcaaatcagactgaggcaaccactcaaccctagactctgagctcagtgcttggcaaatggtagatactcca

SEQ ID NO: 51625 - DNA, 84 bp, Homo sapiens
ggggtcaggtcaagtctgactgtgtctgagccacatggcatggccataatttcgacctcagaaaagactgctgcttgtgtctcc

SEQ ID NO: 51626 - DNA, 79 bp, Homo sapiens
agaagcattttcttttcaaagtgtgtgcacagagtgaggaggccagcctgggcaacatagtgagttgagacctgtctct

SEQ ID NO: 51627 - DNA, 82 bp, Homo sapiens
cagaggaggtagcagtagatgctggctagtaatgaggacggtggagctgcacttggtgcctgtctctctgtggctctctctg

SEQ ID NO: 51628 - DNA, 80 bp, Homo sapiens
aaggatgcacagctagtaaatgccagtgctagaattcaaacccgggaagtctgaatctggaggctatgttgttaatcttt

SEQ ID NO: 51629 - DNA, 58 bp, Homo sapiens
ggctgtccatctgtctgtctgtctgtctgtctaggaggctgcaggcaagtccttagcc

SEQ ID NO: 51630 - DNA, 101 bp, Homo sapiens
ccttctctatttttgtatatgtttcatgtatcttatattagtattatagaagattaatattattaataatatgcactattgggagcatatacttgaaaagg

SEQ ID NO: 51631 - DNA, 77 bp, Homo sapiens
ttcttcaggagtatgtggccttcttatagtaacatgatcagccggctggtttctgagacagcctcactccctgtgaa

SEQ ID NO: 51632 - DNA, 91 bp, Homo sapiens
ggttttggacaattctactctcttagttttagttactttatatagtaatataaggagagagaaagagagagagagactgcaaatgtctacc

SEQ ID NO: 51633 - DNA, 86 bp, Homo sapiens
taggaaacttggagagcagacagaaatgggatctggttggccttataggccaccagaaatattatgtttttattctaagtgaactg

SEQ ID NO: 51634 - DNA, 95 bp, Homo sapiens
ggaagatgggctggaatcactcacaggtatggcagaaggtgctggctgtcagttctccttcatagggtctctctgtgtgagctagttgggcttcc

SEQ ID NO: 51635 - DNA, 106 bp, Homo sapiens
gctggcctgtttttagtttcttggttctatccagttcattcccacctcagagctcagagagcacatgctctcagcctggaatgttctccatctctctttacttagc

SEQ ID NO: 51636 - DNA, 94 bp, Homo sapiens
tgtaccagatcctctaaaaaacagcttccagacattattttattataattgcatagtgaccctgagaggcaggtatggcagggactgtagtgca

SEQ ID NO: 51637 - DNA, 110 bp, Homo sapiens
gtcattgtactctattttttgcaaatctttagagtctcatatctactttttttttttttttttttttttgagacagtgtcactctgttgcccaggctggagtgcagtggc

SEQ ID NO: 51638 - DNA, 83 bp, Homo sapiens
ggggttccagatccaccttccacatcagagccccaattcccactttaactgacttgctggcactgtgtctctctgtgtgcccc

SEQ ID NO: 51639 - DNA, 77 bp, Homo sapiens
ggttttagcctggatgtaggggatcatgatttaatttcattttaaagatttaaagcatgataaatccaggcaaaacc

SEQ ID NO: 51640 - DNA, 149 bp, Homo sapiens
gaaatagagaaaatgaagacacagaaaacagaagtcacagctgcattctgaactgaatgctttgaatttttctttttcttttcttttttcttttctgagacagtctcactctgtcacccaagctggggtgcagtggcgcgatctcagaa

SEQ ID NO: 51641 - DNA, 81 bp, Homo sapiens
gaggctgaggcagggggattgcttgagcccaggagttgagaccagcctgggcaacaaagtgagaccctgtctccctgtctc

SEQ ID NO: 51642 - DNA, 100 bp, Homo sapiens
tcgtagatgagcaagtgagttctgtagaaacacagagtagagagttcgtgatcacctgaactcccttttctccaagtttttaatcttttagcttagggga

SEQ ID NO: 51643 - DNA, 82 bp, Homo sapiens
ttgggaccctgtgaattgacaagaagttctaggcacccccatgttttaaatcttcagtccagcctcagtcagtgagtcccag

SEQ ID NO: 51644 - DNA, 104 bp, Homo sapiens
gtgctgatccccactccgccatttgctagctgtgaccatgggcaagtgacttcatctctctgaccctcagtctcagcctccaaaatgggaataacatcaggcac

SEQ ID NO: 51645 - DNA, 68 bp, Homo sapiens
gccctgttcctcatccctcggtccctgttagcctggtggctgacagctgccagggccaccccaccggc

SEQ ID NO: 51646 - DNA, 75 bp, Homo sapiens
ggtcgatggagaaggtctgtctggagtagttgttttttttttttttttttgagacagagtctcgctctgtcgccc

SEQ ID NO: 51647 - DNA, 70 bp, Homo sapiens
aatgtgtgtgtatgtatagatgtatgtatacatacatacacatttacatgtttatatatacacatatatt

SEQ ID NO: 51648 - DNA, 89 bp, Homo sapiens
catactcttagagctttctgaaaattgtatgcagcaacatgtaggtagttttgcaaagaaggtaaatctgaggaccaattttaggtatg

SEQ ID NO: 51649 - DNA, 91 bp, Homo sapiens
caaaaggtaaaagcataagaaagagagacaagtgcgatgcagttaaaagttgtaatgtatttctttttttttttttttttttttttttttg

SEQ ID NO: 51650 - DNA, 89 bp, Homo sapiens
gagtgcaattgctaagtcacatggaagttgcatgtttagttttgtaagaaactaccaaattgttttccagagtggctgtgccattttac

SEQ ID NO: 51651 - DNA, 87 bp, Homo sapiens
cctacattcctgagatcccacccaagtttctgtggtagatgaaagatgaaattccctgccagacagaagggagtgaacattatgagg

SEQ ID NO: 51652 - DNA, 71 bp, Homo sapiens
tgagacggagtctcactttgtcactctgttgcccgggctgtagtggagtgtggtggtgcgatctcggctca

SEQ ID NO: 51653 - DNA, 110 bp, Homo sapiens
gcttcctgcctccaagtgggagtgcagacttctgcactggtagatatcagtcactgtctctgctactaataaggcagttttgtatctcccactgggtgtctgcttttagc

SEQ ID NO: 51654 - DNA, 83 bp, Homo sapiens
gtataagctttgagtacagagtcagatgagaagcccagtaatggagtctctttcttcctctctcctgaatgtgaagtttttat

SEQ ID NO: 51655 - DNA, 108 bp, Homo sapiens
ggaatgactaaaaagaagttgtctaaacagaaaggaaatgatgaacaaaggaatttttcttttttctttttttttttttttgttgagacagagtctcgttctgtcacc

SEQ ID NO: 51656 - DNA, 89 bp, Homo sapiens
gcagggctgggactagagtgagacaagtgagagacgtaaaaggcccaaactattcatctcagcattgctctcgagagctcctgctttgt

SEQ ID NO: 51657 - DNA, 114 bp, Homo sapiens
gggtaggtggaggactttttctttttttttttttttgagacagagtctcgctctgtcacccaggctggagtgcagtggcgcgatcttggctcactgcaacctcccgctcctggg

SEQ ID NO: 51658 - DNA, 58 bp, Homo sapiens; identical to SEQ ID NO: 1725

SEQ ID NO: 51659 - DNA, 79 bp, Homo sapiens
atgtgactagtctgaattgagatgtgctgttagaataaaatgcacagcatatttttaatatttagtaacttaatcatgt

SEQ ID NO: 51660 - DNA, 107 bp, Homo sapiens
gtttagctaagtattactctgcaactattttgcattccttagtcttattataatttttatgaatgagagatagaaaataggagcagtctgtattttcagtgtgaggc

SEQ ID NO: 51661 - DNA, 106 bp, Homo sapiens
gcataaaggaaggggagaatctcagatccaaatttcctcaatattgatagagtctttttatttagatttggaggaagggttgtctctggggcattcactcactggc

SEQ ID NO: 51662 - DNA, 97 bp, Homo sapiens
tggaagtcagtcattaaatgtttactattatcagcatgaggataaagacattttatagactctttgttgatctgtgaatatgaagtattttaatcca

SEQ ID NO: 51663 - DNA, 100 bp, Homo sapiens
agatataaaatggtatcttgttgtcttgctttgtattccctctattattaatgaggtagaatattgtatttcattttctgtgggatatctgttcatgtct

SEQ ID NO: 51664 - DNA, 58 bp, Homo sapiens; identical to SEQ ID NO: 315

SEQ ID NO: 51665 - DNA, 106 bp, Homo sapiens
atagatagatgataggtagatagataaatagatatgggtttgtgtttaggcatgagttactatctatctatctatctatctatctatctatctatctatctatcta

SEQ ID NO: 51666 - DNA, 69 bp, Homo sapiens
tgagagcatcaggattccctttggaggtcagttgtctcactgtctctgtactgagcaatgatgttccca

SEQ ID NO: 51667 - DNA, 107 bp, Homo sapiens
ctatgtaaatagttgttttactgtatttctttatttgtattattattatttttattttgctttaagttctgagatacatgtgcagaacgtgcaggtttgttacatag

SEQ ID NO: 51668 - DNA, 107 bp, Homo sapiens
gctgggcatggtgctgcacacacgtaatcccagctacttgggaggctgaggtggtaggatcacttcagcccgagaggttgaggttgcagtgagccatgattgtacca

SEQ ID NO: 51669 - DNA, 95 bp, Homo sapiens; identical to SEQ ID NO: 68

SEQ ID NO: 51670 - DNA, 93 bp, Homo sapiens; identical to SEQ ID NO: 69

SEQ ID NO: 51671 - DNA, 58 bp, Homo sapiens; identical to SEQ ID NO: 37097

SEQ ID NO: 51672 - DNA, 113 bp, Homo sapiens
ggcttggcttggggcaggtagcctggggccttaacagtggagtcagagcacagagggcaggcttgagatcaacgttgtgaaaagaaccaaaaggacttgctcttggtggagtt

SEQ ID NO: 51673 - DNA, 86 bp, Homo sapiens
aaaggggagaggcagcgtcgaaagacttctatggtggaagtaatctagtttttccaccatgtggaagtgatctgattttccccttt

SEQ ID NO: 51674 - DNA, 116 bp, Homo sapiens
tgttctcatagtcacccctggtcgtgtgggcctgcttctctgtttctcaccctctgacaggatgaacttgcaggactcacgcccaagccaggcccgtgtgtggcattcatgggaca

SEQ ID NO: 51675 - DNA, 91 bp, Homo sapiens
cctggaaatattctcacagacacagctggggcagtccaattattctttttttttttttttttttgagacggtgtctcgctctgttgccagg

SEQ ID NO: 51676 - DNA, 70 bp, Homo sapiens
gctggacatggtggtgcatgccttgtagtcctagctacttgggaggctgaggtaggaggatcacttgagc

SEQ ID NO: 51677 - DNA, 79 bp, Homo sapiens
ctcagtagcctttttaggccttggatgggactgatgtaacagctgcattagtctgggtccctgagtgcctctctctgag

SEQ ID NO: 51678 - DNA, 77 bp, Homo sapiens
ggctgaggttggaggatggtttgagcccagaacgtcaaggcggcagtgggccaagattgtaccactatacttcagtc

SEQ ID NO: 51679 - DNA, 110 bp, Homo sapiens
gaaaatggaagattgctttcaaagtaagatctttgtgcatttggaatgaaaataaaatcaatagggagtgcaaggaagttcctctggtttgaatgaatctgcccggcttc

SEQ ID NO: 51680 - DNA, 149 bp, Homo sapiens
tgagcaccttcaggcaaagctggatctaggtactcgaatgatggcatcgggcctcctctctctccctatctgtctgtctctgtatctcagctgggcttctctctatgggtagtcaaagaaaccggccaatgacagctccatacacaggt

SEQ ID NO: 51681 - DNA, 113 bp, Homo sapiens
ccaggtggtactaacagccactgagaggctcaagctatttcaggtgacagaaaacagacaggagtatctgcaagtgagggcctgtattagaaatgggtgggggggatgctggg

SEQ ID NO: 51682 - DNA, 57 bp, Homo sapiens
ggaggctgaggttgatggatctcttgaggccaggagttccagaccaccctggccgac

SEQ ID NO: 51683 - DNA, 94 bp, Homo sapiens
tgcccttaaattcatctttagagaaaggcacagaccacagactgtttctgtgattctgagtttacttcttctgggcatgtccttaaccttggca

SEQ ID NO: 51684 - DNA, 86 bp, Homo sapiens
gtgtgtgtgtacatgtgtgctcatgtgtgcgtgtgcatgtgtgtacacgtgtgtacctctgtgtgcatgtgcatgtgtgcgtgtgt

SEQ ID NO: 51685 - DNA, 107 bp, Homo sapiens
gctgctgaggctacatgcggaatgaggatttggaataggatgttgtggcagtgggttgtctgtgattatctgtctctcagaatgattgttcccctgaaacctgcagc

SEQ ID NO: 51686 - DNA, 86 bp, Homo sapiens
gcctcagctttcagtggcacagacgaccccaggagtaattttttttttttttaagactgagtctcactctgtcatcaggctggagt

SEQ ID NO: 51687 - DNA, 58 bp, Homo sapiens; identical to SEQ ID NO: 1101

SEQ ID NO: 51688 - DNA, 56 bp, Homo sapiens; identical to SEQ ID NO: 1102

SEQ ID NO: 51689 - DNA, 99 bp, Homo sapiens
caggcatgagccaccgcgcccggctagaattgcgtttttttttttttgttttttttttttgactaagtctcgctctgtcgcccaaggtggagtgcagtg

SEQ ID NO: 51690 - DNA, 98 bp, Homo sapiens; identical to SEQ ID NO: 1311

SEQ ID NO: 51691 - DNA, 89 bp, Homo sapiens
gacactgcggtctgcccccttactgaccactgatttgacagatggcccctacctctgccagaagacagtgagggctgtccgctggtgtc

SEQ ID NO: 51692 - DNA, 115 bp, Homo sapiens
actgcattccagctgggagacagaaagactccatctcaaaaaaaaaacaaaacaaatatatatataactttttttttgacagggactccctctgtcgcacagactggagtgcagt

SEQ ID NO: 51693 - DNA, 88 bp, Homo sapiens
tttcactctgtgatgaagaccaggacgctttctttttattttatttagttatttgagatggggttttgctctgtcgcccaggctggag

SEQ ID NO: 51694 - DNA, 118 bp, Homo sapiens
ctatattccatatgctgaagaagctagaggaagaattgaacatgttaagtagagaaatagaagatacttttttttttttgagaccaagtcttgctctgttgcccaggctggagtgcag

SEQ ID NO: 51695 - DNA, 104 bp, Homo sapiens
gtgattgcctgctccactggggtttgaggggtgatagcggcttctggagtgtgcgtgctcggagcatgcttcattctgcttacaccaggccgtgtggcatttgc

SEQ ID NO: 51696 - DNA, 58 bp, Homo sapiens; identical to SEQ ID NO: 454

SEQ ID NO: 51697 - DNA, 57 bp, Homo sapiens; identical to SEQ ID NO: 1034

SEQ ID NO: 51698 - DNA, 56 bp, Homo sapiens; identical to SEQ ID NO: 3704

SEQ ID NO: 51699 - DNA, 87 bp, Homo sapiens
tagctgggactacaggcgtgcaccaccatgtccagcaaattctttaattttttgtaaagacagggtctcactgtgttgcccaggctg

SEQ ID NO: 51700 - DNA, 84 bp, Homo sapiens
tcctccaggtgcggggtctgtggctgtgggtaggcacggggcagcccacgtgaggcaccacactcgggctgtgtgtgtgtggga

SEQ ID NO: 51701 - DNA, 106 bp, Homo sapiens
ctgtgtgcacctgtggtcccagctactcaggaggctgaggtaggaggatcacttgagcccaggaggttgaaggggctcacttcaatcccctctgggcctctctgag

SEQ ID NO: 51702 - DNA, 108 bp, Homo sapiens
gtcttcagaactgtgacagaatacgaagctgttgttttttctttatttttattttttatttatttatttttgagatggagtctcgctctgtcgcccaggctggagtgc

SEQ ID NO: 51703 - DNA, 134 bp, Homo sapiens
agcccgggtgacagagtgagactccatctcaaaaaaaaaaaaaaaaaaaagatagagtctcattctgtcactgaggctggagtgcagtggcaagatcatagctcactgcagctttgaactcctagactcaagtg

SEQ ID NO: 51704 - DNA, 64 bp, Homo sapiens
gtgacagaatgagactctatcttttttttttttttttttttgagatggagtctcactctgtcac

SEQ ID NO: 51705 - DNA, 139 bp, Homo sapiens
ggcggaacagaaccaacaggatatatatgtgtgtgtgtatatatatatatacctgttgggtctgggtctgtttctctgtatatatatatatatatatatatatatatatatatatatatatatatatatttataaaata

SEQ ID NO: 51706 - DNA, 97 bp, Homo sapiens
caagccagaatgtgataaaatgttaagaatttgatgatcttggtgagggctatatggtagtactatgtattgttctagcaatttttccacaagcttg

SEQ ID NO: 51707 - DNA, 103 bp, Homo sapiens
ggtgagccctcttgctactcttggaactcttatttaaaaattttttttgtatatgaataagttctttaatggtgatttctgagatgttggtgaacctaccacc

SEQ ID NO: 51708 - DNA, 76 bp, Homo sapiens
gggaacctggctggcgggttaaggagcaagtgtccctcctcactgcactctccctctcctgctggctgcggttgtt

SEQ ID NO: 51709 - DNA, 58 bp, Homo sapiens; identical to SEQ ID NO: 3701

SEQ ID NO: 51710 - DNA, 159 bp, Homo sapiens
ttgtgaatatcagaggctggcaaaacatggctggtgggcaaaatctggcccgatgtctgatttgtttttttttttggtctttgagctaagaacagtttttacatatgtatgtatgtatgtatgtatgtatgtatgtatgtatgtatgtatttttgaaac

SEQ ID NO: 51711 - DNA, 79 bp, Homo sapiens
acaaggcgggaaaagcctcgtgatcagaggaggctggagcccagtccctctctgactcagccctttctcccacccttgt

SEQ ID NO: 51712 - DNA, 74 bp, Homo sapiens
ctgatgtctttggtgatgatgatgatgatgatgatgatgatgatcatgatggtcattatgaagagaaagaagat

SEQ ID NO: 51713 - DNA, 64 bp, Homo sapiens
gctccccttagctaccgttaggatagaaacaggaaagttccttttttttttttggttggggggc

SEQ ID NO: 51714 - DNA, 139 bp, Homo sapiens
gtatccagctcttggtctagaaaatgtttattctgtatatcaaattgataagaatcaccaaaagtcatttttttttttttttgagatggagttttgccctgtcactgaggctggagtgcagtggcgcaatctcggctca

SEQ ID NO: 51715 - DNA, 72 bp, Homo sapiens
ggttgcacacaaagtcaaggtggagtcagatctgagcacagctctcttgactctctgacaggtgttttgacc

SEQ ID NO: 51716 - DNA, 89 bp, Homo sapiens
ggggactctcctttcactgtctatgcccagctagactgtagacctgctgagggcaggtctgtgtctctctgagttaatggtgcatcccc

SEQ ID NO: 51717 - DNA, 98 bp, Homo sapiens
cttcgtgtctaacactgctttctttctctctgtgagcctctcaaatggtggccatgggtaggggtggagtctggcaggaagagttcagcagcggggga

SEQ ID NO: 51718 - DNA, 80 bp, Homo sapiens
gtcttatctgtgttttactgtctgctctttctggctgcttgttgttagaagagaagtgatttccttgaaatgcatgaggc

SEQ ID NO: 51719 - DNA, 69 bp, Homo sapiens
gtttgttcagccttgtttgtctcactatgtctcacatggtgactggcacagaagaaatgctcaataagc

SEQ ID NO: 51720 - DNA, 99 bp, Homo sapiens
ttcagttagattgctgtaacatggaggggatagggggtcttgtctttttattttcttctattaaattcctttgcttcatgttcttagatttttattgaa

SEQ ID NO: 51721 - DNA, 84 bp, Homo sapiens
atagaggttaagaccactgactctagagctctgggaccttaggcaggttactgtcccgctctctgcctcagtttctccatctgt

SEQ ID NO: 51722 - DNA, 120 bp, Homo sapiens
actcctagtgaccagggagctagaacagcaaggaatttgaacttggacaccagctggggtcaggctctctgggtctgagtcctgatttcccactttccagctagaggagcttgaatgagt

SEQ ID NO: 51723 - DNA, 92 bp, Homo sapiens
gggggcatcagtagtgggggccaggcctcaccctcctcagaaggtaggtgggctctccacagcctgtctccctcactgacacatgcacactc

SEQ ID NO: 51724 - DNA, 88 bp, Homo sapiens
gtcagacagacccagcggtgccaggggctgcagccttgcgggggtgctcaagtggggctggctccctgtaagcctcagctgggctggc

SEQ ID NO: 51725 - DNA, 87 bp, Homo sapiens
cagaatagtataaagaataaaatgaaaattatacttagcaacaatcactgctaacgttgtttttttgtttttgtttttgtttttctg

SEQ ID NO: 51726 - DNA, 109 bp, Homo sapiens
gtagtagtaatgtcaggtttttttgtgtgctttgtctgtttgtttgagacagagtctcactctgtcacccaggctgaagtacagtggtgggatctcggttcactgcaac

SEQ ID NO: 51727 - DNA, 63 bp, Homo sapiens
gagacagagtctggctgtgtcactcaggctggagtgcacacaatctcagctcactgcaatctc

SEQ ID NO: 51728 - DNA, 117 bp, Homo sapiens
agtccagaagttcactatggcatatgtgtatatgtatgtgtgtgtgtacatatatatcatatatatgtatatataataacctgttatatataccacatatacatatgatttatgatt

SEQ ID NO: 51729 - DNA, 76 bp, Homo sapiens
tgcagctccagtactgtgttgaaagcagtagtaatagtagccatccctgtctttttctcactctaaagggagtgca

SEQ ID NO: 51730 - DNA, 119 bp, Homo sapiens
agttattgatttggttctcagtttggacattggtatataacaatgctacttattatatttttgtacattgattttatatactgaaactttgctgaagtggtttatcagatcaaggagct

SEQ ID NO: 51731 - DNA, 102 bp, Homo sapiens
ctggcgtgtgcagagccggcgtgagaggctctgggtggtcacactcactctgtttgcctgcctttcctaacagtccctccaaaccaggttctccactcacag

SEQ ID NO: 51732 - DNA, 81 bp, Homo sapiens
taagtcaagcccagaatacaactggctccctgattcccagacatgggttcattgtaccattgtatgaaaagagctgacttg

SEQ ID NO: 51733 - DNA, 64 bp, Homo sapiens
gagaaaagctctcactctgtcactccattgcctatgctggagtgaagtggcatgctcacagctc

SEQ ID NO: 51734 - DNA, 80 bp, Homo sapiens
ctagggctgacacctgcttacccttgagatggctgacccacatgactggttggaggagagtctctctgtctcagttctag

SEQ ID NO: 51735 - DNA, 59 bp, Homo sapiens
atgtgctacatggtagtgtagttatgatactcataattttgtattgccattgtagatat

SEQ ID NO: 51736 - DNA, 118 bp, Homo sapiens
ccagctttgttctttttgcttaggattgtcttggctacatgggctcttttttggttccatatgaaatttaaagtagttttttccaattctgtgaagaaagtcaatggtagcttgatgg

SEQ ID NO: 51737 - DNA, 114 bp, Homo sapiens
tatataattatatacatatataaaacagacatgtatatagcatatattatgtgtatataatatacatattttatatatttatacatattatttctattaatatataattacata

SEQ ID NO: 51738 - DNA, 67 bp, Homo sapiens
gatagctgggcttttgaattctgtgagacgcttggtgtgccaggcactctctctgagccttgatttc

SEQ ID NO: 51739 - DNA, 57 bp, Homo sapiens
gttgagacagagtctcgctctgtgacccaggctatagtgcaatggcatgatctcgac

SEQ ID NO: 51740 - DNA, 101 bp, Homo sapiens
tttctgtgtgtttatgtgtgtttaaatttgtatatgtatatctgtgtatgtgtttatatacatttatatatgaaacagctacttactctttcactcaggaa

SEQ ID NO: 51741 - DNA, 75 bp, Homo sapiens
agttttgtaaactatatataactatatatacagttttgtaaactatatatataactatatatagttttgtaaact

SEQ ID NO: 51742 - DNA, 158 bp, Homo sapiens
aaactgtatatatagttatatatagtttacaaaattgtatatatagttatatatatggtttacaaaactatatatagttatatatatggtttacaaaactgtatatatagttatatatatggtttacaaaactgtatatatagttatatatatggttt

SEQ ID NO: 51743 - DNA, 148 bp, Homo sapiens
tatgtatgtatatatatctgtatatatatgcatatgtatgtatatatatctgtatatatatgcatatatacatgtatatatatatctgtatatatatgcatatatacatgcatatatatgtgtatatacatacagatatatatataca

SEQ ID NO: 51744 - DNA, 127 bp, Homo sapiens
atatatgtatatatgtgtgtgtatatatatatctgtatgtatatacacatatatatgcatgtatatatgcatatatatacagatatatatatacatgtatatatgcatatatatacagatatatata

SEQ ID NO: 51745 - DNA, 116 bp, Homo sapiens
tctgtaaaatggggataaggatgtttagctcccagagtgataatgcagttgagaagaaatgcattttatttatttatttatctgggacaaggtctcactctatcacccaggctgga

SEQ ID NO: 51746 - DNA, 58 bp, Homo sapiens; identical to SEQ ID NO: 47

SEQ ID NO: 51747 - DNA, 68 bp, Homo sapiens
ggtgagccgagcgcaccactgcactctagcctgggcgacagagtgtgtgtgtgtgtctgtctctgtct

SEQ ID NO: 51748 - DNA, 83 bp, Homo sapiens
atatatatgtgtatatatatgagatatagatggggttatgccatctctactaaaaaatatatatttacatatatatatatata

SEQ ID NO: 51749 - DNA, 83 bp, Homo sapiens
gtgggggttgggaagaatggctttgaggtgaggaactgctctggggctgcctcttcagctcagactttctctgtgtctcctgc

SEQ ID NO: 51750 - DNA, 95 bp, Homo sapiens
actgaatcctaagaaggaagctgacagcctccgactctgccagttctctgaggggcgggatgatgtgtcttttatctcttctttgtggttccagt

SEQ ID NO: 51751 - DNA, 58 bp, Homo sapiens; identical to SEQ ID NO: 47

SEQ ID NO: 51752 - DNA, 58 bp, Homo sapiens
tgagtcagggtctcactctgtcacccaggctggagtgcaatgatgtgatctaggctca

SEQ ID NO: 51753 - DNA, 116 bp, Homo sapiens
cttattccttacaaagtttatactgcatttggggctgtatctttttttgttttttgttttgtagaaaataaatatctccgggggcagtacaggtgtctgggcttgtatttgatggg

SEQ ID NO: 51754 - DNA, 76 bp, Homo sapiens
ggagagaggagcattgagacctgagttctcatttggactctgtcactgtgagactctgggcaagtgaccctcctct

SEQ ID NO: 51755 - DNA, 92 bp, Homo sapiens
agtgagaaatgtggttcctcctcagtcctctttcagtctttcgattatgtcaaagggaaagttgggtttggggatcgcatgtctttatcact

SEQ ID NO: 51756 - DNA, 112 bp, Homo sapiens
cacatctgtgtctgggtccaaatttctcctttttatttatttttatttatttatttatttatttatttatttattgagatggagtttcactcttgttgcccaggctggagtg

SEQ ID NO: 51757 - DNA, 58 bp, Homo sapiens
tgagacaaggtctcactctgtcacccaggctggagtgcagtggtgtgacctcagctca

SEQ ID NO: 51758 - DNA, 89 bp, Homo sapiens
ctgccttcctatctctgtttctctctttatcaacacgtgagcagctgccgtcagcacacagtggatcctgagtttacagcaggaggcag

SEQ ID NO: 51759 - DNA, 84 bp, Homo sapiens
tccctgggcaaagcacaatgcagggctgagtgactccccagagacatggctgagctctctctctccctggctgcatcccaggga

SEQ ID NO: 51760 - DNA, 115 bp, Homo sapiens
tctagggatacagcacctgagtcccagagggcctggcttggagacaccctcagtgactccgggcagggtcacaacccctctgagcttgcctctggtgcctccacattcccccaga

SEQ ID NO: 51761 - DNA, 65 bp, Homo sapiens
gtgcgtgcgaacatgtgtctgcagtcacatatgtgactgagtgtgcatgacgatctgatatgcat

SEQ ID NO: 51762 - DNA, 69 bp, Homo sapiens
tctgtctctctgtctcagtcttgggacttttggacacccctaggctgtggccaatctggggagaaggga

SEQ ID NO: 51763 - DNA, 77 bp, Homo sapiens
ctagtggttttcgaggtgcgacacaacacggctgtgtcagtctgtgtctgtggccatcacactcctagagggtccac

SEQ ID NO: 51764 - DNA, 125 bp, Homo sapiens
ggcataggttggcatcttgctctgcccctcaccagctgtaagatctcggaccctctctgagcctcagtttcctcatctgcagcgaagggatcacggtgctccctccatcacacggctgctgtgag

SEQ ID NO: 51765 - DNA, 96 bp, Homo sapiens
cccagctactcgggaggctgaggcaggagggttgattgagcccaaaagtttgaggctgtagtgaactttgattgccccactgccctccagcctggg

SEQ ID NO: 51766 - DNA, 169 bp, Homo sapiens
tatatacatatatgtatatttggtatatatatatatgaatgaacatatctatgtgtatatatgtgtgtgtatatatgtgtatatatgtgtatatatgtgtatacatatgtgtatatacgtgtgtatatatatgtgtatatatgtatgtgtatattataaatctacagac

SEQ ID NO: 51767 - DNA, 92 bp, Homo sapiens
tgtggccttcctcccgccgtgtgtctcctctgtgtctctgtgttacatttccctcttcttataaagacccaagtcattggatggagggccca

SEQ ID NO: 51768 - DNA, 78 bp, Homo sapiens
gctcaaggaatcagcgattagcatagtggagggttctgctaggcagtctctctgtgtggctggagctgaggcccctgc

SEQ ID NO: 51769 - DNA, 104 bp, Homo sapiens
gttagaagcaagatggttaagttggatctctttcactgtctcagtcataattttgcaaaggtggttccaggcagagagaccatctgtcccagtttgctggggac

SEQ ID NO: 51770 - DNA, 118 bp, Homo sapiens
atcataaattggggaccatatgtatacatttaactatatataggggatcatatgtatatatgtaactatatatgtataggtatgtatatatattcttactgcatacaattcacttgat

SEQ ID NO: 51771 - DNA, 108 bp, Homo sapiens
gtgtgtgtgggggtgtgtgtgtatgtgtgtccagtcgatgggaatgtttagaagtatggtggcatattgaattaatgggtccaaatgtttacccctccctgtattcac

SEQ ID NO: 51772 - DNA, 114 bp, Homo sapiens
gactggacaaacagtgagatcctgtcttaaaaagaaaaagaaaagaaagaaagaaagaaaatctgcttttctagctatttgaaaatacatagtcaattgttgttagttgtagtc

SEQ ID NO: 51773 - DNA, 64 bp, Homo sapiens
gtgggattatgtcctggttctcacagcacttcaacgctagtgagaggagacagtcatcagacac

SEQ ID NO: 51774 - DNA, 94 bp, Homo sapiens
tgagcaggacctcaccagcttgacatcttaacacattctgtctcactgtcacttgtcatcagcacccagaatttgaagctgaaggctctgccca

SEQ ID NO: 51775 - DNA, 66 bp, Homo sapiens
tacatatatacatgtatacatatgcgtgtgtgtatatatacgtatatgtatgtatgcatgtgtgtg

SEQ ID NO: 51776 - DNA, 78 bp, Homo sapiens
cctgctgtcagggaaaattctgtttagggtccaacaaagggtaaattacttattaagaaaattttttcttttagtagg

SEQ ID NO: 51777 - DNA, 106 bp, Homo sapiens
ggtctgggattacaggtgtgagccatcatgtctggcctgagtatttttttataagttttaaaaccaaattagctgggtgtggtggctcatgcctgtaatcccagct

SEQ ID NO: 51778 - DNA, 73 bp, Homo sapiens
ctgagaagactgacggctgcattcccgcacagacctctgcggcctccctgcagcttctcactcacactctcag

SEQ ID NO: 51779 - DNA, 101 bp, Homo sapiens
tgccagggtgtgatgtatgtgacattgatggtatgcaaagactattttcatgagtatatagttttttacatttttagtcactgtatatctatttcattgca

SEQ ID NO: 51780 - DNA, 122 bp, Homo sapiens
accatatacatatactgagtatatgtatatggtatatatatactgagtatatgtatatggtgtgtatatatatatatatacacacacacacacacacacacacacacacacactgagtatat

SEQ ID NO: 51781 - DNA, 99 bp, Homo sapiens
cagatcagccccagcaatcacggctttgttgtctccctccagtttagaaaggcccggagaaggagtgtgattaaagcccagctctggggttcgcttctg

SEQ ID NO: 51782 - DNA, 115 bp, Homo sapiens
gctggttcttgccacataggagtatgggctctgtattgagagatttctggtttttctttcttttttttttctttttagacggagtctcactctgtcgtccaggctggagtacagt

SEQ ID NO: 51783 - DNA, 98 bp, Homo sapiens
ctccagcctggacaacagagcaaagccctgcctcttttttttttttcttttttctgagacagagtctcgctctgtcacccaggctggagtgcagtggt

SEQ ID NO: 51784 - DNA, 56 bp, Homo sapiens
gagacagggtctctctctgtcgcccaagctggagtgcagtgggacgatctcggctc

SEQ ID NO: 51785 - DNA, 56 bp, Homo sapiens; identical to SEQ ID NO: 324

SEQ ID NO: 51786 - DNA, 98 bp, Homo sapiens
gcctcggcctcccaaagtgctgaggttacaggtgtgagctgctgtgcctggcctgatgactacatttctcagcctgctttggatctaagtgttgatgt

SEQ ID NO: 51787 - DNA, 84 bp, Homo sapiens
gaaacccagtttgctgctgtgttcccagctgcgcctggaacagcccctctcttcaggtgatgacagacagtgtagtttggtttt

SEQ ID NO: 51788 - DNA, 66 bp, Homo sapiens
tgaggcggagtctcgctctgtcgctctgtcgcccaggctggagtgcaatggtgatatctcggctca

SEQ ID NO: 51789 - DNA, 90 bp, Homo sapiens
tgagactccgtctctaaaaaaaaaaaactaatttctttctctttttttcttatttattattacttttttttttctagagacatggtctta

SEQ ID NO: 51790 - DNA, 83 bp, Homo sapiens
ccagcttgggcaatgtggcaaaactcttgtctccacagaaaatttttttttttgagagagtctcgctgtgttgctcaagctgg

SEQ ID NO: 51791 - DNA, 95 bp, Homo sapiens; identical to SEQ ID NO: 68

SEQ ID NO: 51792 - DNA, 93 bp, Homo sapiens; identical to SEQ ID NO: 69

SEQ ID NO: 51793 - DNA, 90 bp, Homo sapiens
gtaatcacgggtgactccacggcagaagtcaggtacactgggtctgtcactcactccgtgagacagcgggcaggtccccaaacttctctg

SEQ ID NO: 51794 - DNA, 109 bp, Homo sapiens
gtcaaggctgaagtaaagggtgagtttccactgcttttcacagtgggtgttctgggggcaaggagctcccgcgaagaagaggaggaaaaacaagcctggtcagaggggc

SEQ ID NO: 51795 - DNA, 97 bp, Homo sapiens
ggctgaaagtcttaacctcatagtcatttgtgacatttctgttgggggaatgggctctgatcagtgtcactgaggattcttgggttgtgtttctgct

SEQ ID NO: 51796 - DNA, 69 bp, Homo sapiens
ccacacctgctcccaggcaaagggagtttgctgtgggtgcccctctctgtctgtgtgtccagtgtgtgg

SEQ ID NO: 51797 - DNA, 83 bp, Homo sapiens
gccattctcagcctctgcctctctccccagcccctctaccaggtgttcaaggaaagcagagcccagaacctgtcgtgtagggc

SEQ ID NO: 51798 - DNA, 87 bp, Homo sapiens
gtgtgtgcatatgagtgtgtctgtgtgagtgtgtatgtatcagtgtgcatatatgcgtgggcattgtaggcacacatgtgcatatat

SEQ ID NO: 51799 - DNA, 94 bp, Homo sapiens
gctcccacttataagtgagaatgtggtatttgactctctgtttctgaattattttaggtaggatcatggcctccagttccatccatattggtgc

SEQ ID NO: 51800 - DNA, 82 bp, Homo sapiens
gggatgtctgttttctttttatatacttttcatatactttttacgtatatgtatttcgtgtgtgtgtgtgtgacagggtctc

SEQ ID NO: 51801 - DNA, 69 bp, Homo sapiens; identical to SEQ ID NO: 51796

SEQ ID NO: 51802 - DNA, 86 bp, Homo sapiens
cacgaactgcgtattaaatacacctgactcactgtgtctgtgagtgcgtgggcatgtgtgggtgtgggagagtgcatgtaggagtg

SEQ ID NO: 51803 - DNA, 85 bp, Homo sapiens
ggggtacccagtccaagctttgaggtccactccagtgccaggatgccctgggctacatccctgactctctctgcctgggtgtccc

SEQ ID NO: 51804 - DNA, 74 bp, Homo sapiens
ctctctgtctctcagttcctctgttctctaggttggccccattctcagctggcaggaatgaaagacatgatgag

SEQ ID NO: 51805 - DNA, 58 bp, Homo sapiens; identical to SEQ ID NO: 884

SEQ ID NO: 51806 - DNA, 56 bp, Homo sapiens; identical to SEQ ID NO: 885

SEQ ID NO: 51807 - DNA, 58 bp, Homo sapiens
tgaggctgggtctcactctgtcactccagccggagtgcagtggttcgatcatagctca

SEQ ID NO: 51808 - DNA, 112 bp, Homo sapiens
gaggggagggagagaaggaaggaaggaaggaaggaagggagggagggactggattatctctgcctctctgcctgactgcttgagctgaaatgagtctctgaccttcagactt

SEQ ID NO: 51809 - DNA, 62 bp, Homo sapiens
ctcttctgtcggactgagctgtcatgggatcctggccaaggcaccctgtctgactctcaggg

SEQ ID NO: 51810 - DNA, 115 bp, Homo sapiens
taaaagtcttaagacttgccctgatgggaccagcttgggtaatgtgacagccactgactcaatcactgtggcccagagaatatgatacagggacaggcttttaaaaaaattttta

SEQ ID NO: 51811 - DNA, 108 bp, Homo sapiens
gtttaacagattttaaaaaatgtgggaggtaatgtatttggacggctgagctgtattttcctcagtctctctgtctctccatgcaaccgtcattcattcatgttgtac

SEQ ID NO: 51812 - DNA, 94 bp, Homo sapiens
ctagccatgccccactgcccatctgggtttcaggagaagacagtgctcacacactgtgcttttcactcactgggtatgatgccccctgagctgg

SEQ ID NO: 51813 - DNA, 68 bp, Homo sapiens
gtgtctgcgtgtgtcagtgtgtgtgcaagagtgtgtcagtataagagcatatgtatgtatgcaggggc

SEQ ID NO: 51814 - DNA, 92 bp, Homo sapiens
ggcagctgggattacaggtgcccgccacagtgccctgctaattttcttatttttagtagagagagggtttcaccatgttgtccaggctggtc

SEQ ID NO: 51815 - DNA, 79 bp, Homo sapiens
gggaaactgccctgggctgagagccgctggtctgtagcatggattctgttatctgtgtgtgtgtgcctccctccctccc

SEQ ID NO: 51816 - DNA, 67 bp, Homo sapiens
gtgtgggctatgtgtgagacacccaaataaagatatatgtatttgtatttcttccacttgaccacgc

SEQ ID NO: 51817 - DNA, 100 bp, Homo sapiens
tgattctacattatggtgagttgcataattatttcattatatgttacaatgtaataataatagaaacaaagtatacaacaaatgtaatgtgtttgaatca

SEQ ID NO: 51818 - DNA, 85 bp, Homo sapiens
acactacaaattttccttggctgacaccttcactgtctgtcttcactgcacacacggtgagggagagagcttttgtctgtattgt

SEQ ID NO: 51819 - DNA, 58 bp, Homo sapiens
tgagaccaagtctcactctatcactcaggctggagtgcagtggcgtgatctcggctca

SEQ ID NO: 51820 - DNA, 80 bp, Homo sapiens
gcacatcgcagggtgttggagtggttatgggcctggagtggaggtcagtctctggctctgccactcgctgtgtgtgatgc

SEQ ID NO: 51821 - DNA, 83 bp, Homo sapiens
gcagctttccagatctttccctgtgtgtttgttcatgtcattgccacacatcgatgtgaacctgcagcagtgacatagcatgc

SEQ ID NO: 51822 - DNA, 66 bp, Homo sapiens
gctggcagagcgaggttcttttttttttttttttttttttttggagacagagtctcactctgtcgc

SEQ ID NO: 51823 - DNA, 62 bp, Homo sapiens
aggatggagacacagctactagatttttttttgagacagggtcttgctgtgttgcccaggct

SEQ ID NO: 51824 - DNA, 99 bp, Homo sapiens
cacagtttctgtgggtcaggaatttgggagcagcatgggtgtttctggatcaggatctgttgagattgctgttgagctgtcatctggggctgcagtcag

SEQ ID NO: 51825 - DNA, 100 bp, Homo sapiens
attcacattgtgctaaggcacgtgtgacttttttgaattaaaattaattttaaaatcttaaccacagaggttgcactacccttggcagggttataggaat

SEQ ID NO: 51826 - DNA, 103 bp, Homo sapiens
tcaacttgttatttaagaatgctgtttatttttgaaaatcagtatttttatttacttaaagggtgagccttaaaattgaatgcatttgtgggtatttagggga

SEQ ID NO: 51827 - DNA, 72 bp, Homo sapiens
ggtttgctctctgtgaaagatggaagccgttggaggtttttgtttttttttttgacggagtctctcctgacc

SEQ ID NO: 51828 - DNA, 83 bp, Homo sapiens
gagaggtggcagccgctttgactgggctagagatttctggtttaccacaatccttacccagcctgcctcactcactcactctc

SEQ ID NO: 51829 - DNA, 117 bp, Homo sapiens
gggtggggagggtgcaggggcagatttacagatctattttgtctttaaaaaaaaaaaaaaaaaaaaaaaagagagacagggggtctcactgtattgtccagattggattctaactcc

SEQ ID NO: 51830 - DNA, 95 bp, Homo sapiens
ttctgccagcgactgtgatccttatttatttatttatttatttatttatttatttatttttgagatggagtctcactctgtcgcccaggctggag

SEQ ID NO: 51831 - DNA, 58 bp, Homo sapiens
gtgacggagtctcactctgtcacccaggctggagtgcagtggtgcgatctctgctcac

SEQ ID NO: 51832 - DNA, 118 bp, Homo sapiens
agacagtcttgctatgtgccccagcctggttttgaactcttggcctcagctgacaattttttttttttgagacagagttcactcttgttgcgtaggctgaagtacagtggcacggtct

SEQ ID NO: 51833 - DNA, 66 bp, Homo sapiens
tgagactgagtctcacagtctcactctgtccaccaggctgcagtgcaatggtgtgatctcggctca

SEQ ID NO: 51834 - DNA, 119 bp, Homo sapiens
gatggaatctcattgtggttttgatttgcatttctctaatgattagtgatgttgatgttgagcatttttttcctctgcttgttggccatgtgtatgtcttcttttgagaagtgtctgtt

SEQ ID NO: 51835 - DNA, 63 bp, Homo sapiens
gccagacacttgctttctcaggttccctcagagctagagcatgagcatgtgacctgtcctggc

SEQ ID NO: 51836 - DNA, 68 bp, Homo sapiens
ggctctgtgagactctgaatctcttacagtgttcccaccaagagtcccaagactgtgtctcattggct

SEQ ID NO: 51837 - DNA, 114 bp, Homo sapiens
tctacagtatatgatgtttcactggaaattatttttggggggtttgccagattttctattattttattttaaaaattatttcgcgtggtttaaacattaaaaatgtaaagtaga

SEQ ID NO: 51838 - DNA, 65 bp, Homo sapiens
gatcatctattgccagtgtggctcagatgcagcccccgccactgactgtgtgactctggcaggtc

SEQ ID NO: 51839 - DNA, 82 bp, Homo sapiens
aatagccgggtgtggtggtgcacacctgtggtcccagctacttggaggctgaggtggaaggatcacttgaacccaggaggtt

SEQ ID NO: 51840 - DNA, 74 bp, Homo sapiens
gctcactctctgtgtgaccttgggcacgttagagggacattctgggcctcaggttttacatccctagaatgggc

SEQ ID NO: 51841 - DNA, 63 bp, Homo sapiens
tgctggctttttggggcagagtggggctgctttcacttgctcactcgctcactcagtcatgta

SEQ ID NO: 51842 - DNA, 117 bp, Homo sapiens
ggtcttttgcatgctcacctctctctatgggcacacttttgagtctcacagtctgagttgctgttaagtggtcaccctggagcttgccttatactggagtgagaaaaaagctgagca

SEQ ID NO: 51843 - DNA, 73 bp, Homo sapiens
tctgatcaagtgacagagtctgtctgtcataatagatgacagaaaaataatccagcattctgcatggcccaga

SEQ ID NO: 51844 - DNA, 58 bp, Homo sapiens
tgagtcagggtctcactctgtctcccaggctggagtgcagtggcgctatcttggctca

SEQ ID NO: 51845 - DNA, 97 bp, Homo sapiens
tagctgggattacaggctgcctgacaccgtgcctggctaatttttgtattttgcattttttttttgaggtggagtctcactctgttgtccaggctgg

SEQ ID NO: 51846 - DNA, 143 bp, Homo sapiens
tgccaccatactccagcctgggcaacagaacaagaccttgtctctcttttatttttttctcttttgagacagggtctcactctgtcacccaaactggagtgcagtggggcgatcttggctcactgcaacctctgcctcctggg

SEQ ID NO: 51847 - DNA, 96 bp, Homo sapiens
cctaggagcccggcttctgagttcagggcttaaccccaggttagagccctcctagctcacagcctctgtgcctgggactcgccctgggaattccct

SEQ ID NO: 51848 - DNA, 73 bp, Homo sapiens
gactgtggtaagggtcagtgagccagcaggtgtaaactgcgtggctctctgcctctctggcacaccatcagtc

SEQ ID NO: 51849 - DNA, 58 bp, Homo sapiens; identical to SEQ ID NO: 1847

SEQ ID NO: 51850 - DNA, 59 bp, Homo sapiens
caagtgtgtgtgtgtgtgtgtgtgtagctgcaagcacacaggaaaatgtatacatcttg

SEQ ID NO: 51851 - DNA, 85 bp, Homo sapiens
gagacagagtctcgctctgtcacccaggctggagtgcagtggctcactgcaacctctgcctcctgggttcaagcgattctgcctc

SEQ ID NO: 51852 - DNA, 121 bp, Homo sapiens
gcgcgggcgggcgagcgggaggcggggcctcggccgcgcgagggcggccctctgtccctccgtctcagtggcccgagggtgggagaaagcgcgtgggaggattgcttcttagtctctcccg

SEQ ID NO: 51853 - DNA, 263 bp, Homo sapiens
tatatatggcatatatatagtgtgtgtgtgtatatatacagtatatatatatatacacagtatatatatatacagtatatatatatatatacagtatatatatacagtatatatatatacacagtatatatatatacacagtatatatatatatacacagtatatatatatatacagtatatatatatatacacagtatatatatatatacacactgtatatatagtgtgtgtatatacatatactgtgtgtatatatagtgc

SEQ ID NO: 51854 - DNA, 251 bp, Homo sapiens
tatatatacacacagtatatgtatatacacacactatatatacagtgtgtatatatatatatactgtgtatatatatatatactgtatatatatatatactgtgtatatatatatatactgtgtatatatatatactgtgtatatatatatactgtatatatatactgtatatatatatatatactgtatatatatatactgtgtatatatatatatactgtatatatacacacacacactatatatatgc

SEQ ID NO: 51855 - DNA, 95 bp, Homo sapiens
ttctcttctttcaaaaggccatgtttaaaaatgtatatgtttcatatatatgtacgtatgtgtatatatacatatacatttatatgtggtgagaa

SEQ ID NO: 51856 - DNA, 111 bp, Homo sapiens
ggatggacacttctgatttgcatcttttatattgtcatgctttcgttaaagttttttttttaatccagacagttcaagaaagaaaaaaatgtaacaagtcagtctccttcc

SEQ ID NO: 51857 - DNA, 79 bp, Homo sapiens
gcagcctcactggcaagatgacagtctttttttttttttttttttttgagatggagtctcactctgtcacccaggctgc

SEQ ID NO: 51858 - DNA, 74 bp, Homo sapiens
gggcaacacagcgagaccctgtctctactaaaaaaaattttttttttttgagactgagtctcgctcagtcaccc

SEQ ID NO: 51859 - DNA, 63 bp, Homo sapiens
cagatttcagagaaggctgtgagccctcaaaggctaagtaacagtgtcctctggtaggttctg

SEQ ID NO: 51860 - DNA, 115 bp, Homo sapiens
gcgagcatcaggtgagctgatgcctggtacctgtccacactcagtggctgactctgtttatcttagttttccccactgggagggaaggaggcaggtagtgcagcgggtgcacagc

SEQ ID NO: 51861 - DNA, 80 bp, Homo sapiens
ggggcagcaagagagattcctccaaaacttcagggcatttttttttttcttttttgagatggagtctcactctgtcaccc

SEQ ID NO: 51862 - DNA, 58 bp, Homo sapiens; identical to SEQ ID NO: 2221

SEQ ID NO: 51863 - DNA, 83 bp, Homo sapiens
cccttgccccgtgagctcagctgtgcggggtccctcgtgcctttatgcgggctctgtcagtctgtccatgggtgtcccagggg

SEQ ID NO: 51864 - DNA, 101 bp, Homo sapiens
ggggaaggccatgcagggctgtccttgggaccagagcagggactgtctttctctctgagggaggtaggagtagggtttggagtgaggcaatggtgtgacct

SEQ ID NO: 51865 - DNA, 66 bp, Homo sapiens
gtaccagctgcatgactctggaacacgcagctctcagggcctctgtgtcagtcactgccagggtgc

SEQ ID NO: 51866 - DNA, 109 bp, Homo sapiens
cagttttcagccattataaataaagccactagaaacatttgcaaacaggtttttatgtgaacataaatttttgtttatcttgggtaaatttctaggagtggaattgctg

SEQ ID NO: 51867 - DNA, 62 bp, Homo sapiens
tgagtctgggtctcactcactctgtcacccaggctggagtgcagtggtgatatctcagctca

SEQ ID NO: 51868 - DNA, 61 bp, Homo sapiens
gggggcaggtggtgaggcccttttttttttttttttgaggcagagtctcgctctgtcgccc

SEQ ID NO: 51869 - DNA, 75 bp, Homo sapiens
acaaatcacagacatcacagacaaggataaaaccaaatggtgttaaaatctgcgtgtgtgtgtgtgtgtgtgtgt

SEQ ID NO: 51870 - DNA, 112 bp, Homo sapiens
tggggacttctggcagtaacatttccttactctcaagagagagctatggggagacactccctctctttcgcactggatgatttagcaaatgatcttaccgtcataatcacta

SEQ ID NO: 51871 - DNA, 108 bp, Homo sapiens
ggtgcgggggagcacatagggtgtatgtgtgtgtgtgtgcgcgtgcagattctctctttcactgtatgtatttgtatgcatgtatgtatcttaggacttaagctttct

SEQ ID NO: 51872 - DNA, 106 bp, Homo sapiens
gcactccagcctgggtgatagagtgagccctgtctctctctcagaaaaaaaaagaagtgagccggacgtggtggctcacgcctgtaatcccagcactttgggaggc

SEQ ID NO: 51873 - DNA, 69 bp, Homo sapiens
gccagacatggtggtgcatgcctgtggtcccagctactctggaggctgaggtaggaggatcacttgagc

SEQ ID NO: 51874 - DNA, 58 bp, Homo sapiens
tgagactgagtctcgctctgtcacccaggctggagtgcaatggcgcgatctcggctca

SEQ ID NO: 51875 - DNA, 100 bp, Homo sapiens
gcgttcaatgaacatctggggctgctgttactgttactcccttgggttctcacaaacactctcagggtccggacacggtgcttctcagggacataaacgc

SEQ ID NO: 51876 - DNA, 66 bp, Homo sapiens
agccactgtgcctggctgtctctgaggcttacaaaggctaagagacttgcccatggtcacacagct

SEQ ID NO: 51877 - DNA, 85 bp, Homo sapiens
tcgctgagcctcagtttccccttttgcaaagtgagatggaggttccctgcctctctcagccgctgtgaggatgaatgctctgtga

SEQ ID NO: 51878 - DNA, 84 bp, Homo sapiens
gtttgtttgttttttgagacggagtctcactgtgtcactgaggctggagtgctgtggtgtgatctcagctcatgcaacctctac

SEQ ID NO: 51879 - DNA, 115 bp, Homo sapiens
ttcccaaagtgctgggattacaggcgtgagccaccgcacctggtcaagatttttttttaaaaaagcaactatctacgggtgccatggcttatctacaatcccagcatattaggaa

SEQ ID NO: 51880 - DNA, 66 bp, Homo sapiens
cccaaattatgaatctgggttcaagcagtatggctggacacagaactgtgtgaggacaagtttggg

SEQ ID NO: 51881 - DNA, 78 bp, Homo sapiens
tcctctggcacagtctctctggcttttctgctgtggctgctccaacaaagcaagcaggagagacccatgtggcaagga

SEQ ID NO: 51882 - DNA, 115 bp, Homo sapiens
gtctttttccccactgcctggtcagcagagttgggtggtaagcttcttttttttttttttttttttttttttgacatggagtctcactctgtccctcaggctggtgtgcaatggc

SEQ ID NO: 51883 - DNA, 65 bp, Homo sapiens
ttgagatggagtctcactctgtcacccaggctggagtgcagtggcacagtgctggctcactacaa

SEQ ID NO: 51884 - DNA, 57 bp, Homo sapiens
gaggtctcattcaacagagagaggtgccgtcttctctctgtgtcttcgtgtggtctc

SEQ ID NO: 51885 - DNA, 110 bp, Homo sapiens
gttcaagagcaaggagtcggcagggctgcttttttcttttttaattgttatttatttatttatttatttatttgagatggagtctctctctgtcacccaggctggaggac

SEQ ID NO: 51886 - DNA, 68 bp, Homo sapiens
gctatgaggtttgtggatgatttgttatgccacagtaactaatatacctgtccacagaccatttcagc

SEQ ID NO: 51887 - DNA, 84 bp, Homo sapiens
tgtctgtgtcttgtctttcaaccatgggcagctcgtgagcagatcgctgggctgcaggcaaaagagagagaagtcactgtgata

SEQ ID NO: 51888 - DNA, 81 bp, Homo sapiens
tccaagtaggaggttgacatgatgtgatttctatatatatagttttttgagacggattctcactctgtcacccaggctgga

SEQ ID NO: 51889 - DNA, 81 bp, Homo sapiens
cccagtagccgccctctggatagaggcaggaggcctggggaggtctgagtcactgtgtggctagagagcaggggtgctggg

SEQ ID NO: 51890 - DNA, 87 bp, Homo sapiens
ccaaagtgctgattacaggtgtgagtcacgacatcattttattttttatttttttgagacaggggctcactctgtcacccaggctgg

SEQ ID NO: 51891 - DNA, 124 bp, Homo sapiens
taaatgtatgcatatttaaatatacatatatatttattttattttatgtgtatttatataatatatgatatgcatatttataatatgtaaatatttacatattataaatatgtaaagaaatata

SEQ ID NO: 51892 - DNA, 111 bp, Homo sapiens
attccaagactacgtggtatggaagtggtgaaagtgggcattcttgtcttgttcctgatcttcgaggaaaaagtttgtcttgcatcattgagtatgatttaactatggggt

SEQ ID NO: 51893 - DNA, 58 bp, Homo sapiens; identical to SEQ ID NO: 9719

SEQ ID NO: 51894 - DNA, 58 bp, Homo sapiens
tgagatggagtctcgctctgtcgctcaggctggagtgcaatggcgggatctcagctca

SEQ ID NO: 51895 - DNA, 128 bp, Homo sapiens
tacaatggatccatgatgagagtctatttattgaatttttttttttttttcagatggagtctcactctgtcacccagggtagagtgtagtggtgtgatcttggctcactgcaacttccgcctcctggg

SEQ ID NO: 51896 - DNA, 81 bp, Homo sapiens
ccagcctggtcaacatagcaagacctcatctctttttttttttttttttgagtcagagtctcactctgtcacccaggctgg

SEQ ID NO: 51897 - DNA, 116 bp, Homo sapiens
gagggaaggaaatgtcggtgtctgctctcttcagaggtagtttcccttggtcactcactgagtgacagatcacaaacaaccatgcagtgaacaagtagatcttgagctcctgcctc

SEQ ID NO: 51898 - DNA, 58 bp, Homo sapiens; identical to SEQ ID NO: 605

SEQ ID NO: 51899 - DNA, 112 bp, Homo sapiens
gatctgttcccaaaaggatcatcactgcaattgaaaagaatcatatgtgtcaacacgtcatatctttttttgttttgtattttgttttttgtgttttttttgaggcagagtc

SEQ ID NO: 51900 - DNA, 58 bp, Homo sapiens
tgagacagagtctcgctctgtcacccaggctgcggtgcagtggcgcgatctcggctca

SEQ ID NO: 51901 - DNA, 56 bp, Homo sapiens; identical to SEQ ID NO: 335

SEQ ID NO: 51902 - DNA, 79 bp, Homo sapiens
gaaccatggctgtaggagcctcatgaggacttggtttttagcctgagtgcagtgagagacctgagagagttttgagttc

SEQ ID NO: 51903 - DNA, 111 bp, Homo sapiens
tgtgctgctcccatattgtcctgatctctgcactgagcccaaattaatattgtatttttaaagtcaatatttaaaaaaagagagagagagttcatcctgggaagagacaca

SEQ ID NO: 51904 - DNA, 87 bp, Homo sapiens
catatatgtatatgtgtgtgtgtatatgtgtgaatatatacatgtgtatatacacacacacacacacacacacacgtatattttatg

SEQ ID NO: 51905 - DNA, 85 bp, Homo sapiens
tgtgaataccaggaagcaggtatcattgaggccatcctagagtctgtctgccacacctctctgtgtctcagttttcttatttaca

SEQ ID NO: 51906 - DNA, 114 bp, Homo sapiens
atagtaaatatttttggctctgagggttggctaatctccattgcagctactcaaccctgtctgtgtagaaagagagcagttggaggcagtcaatcaaaccatggtagtggctgt

SEQ ID NO: 51907 - DNA, 108 bp, Homo sapiens
gagtctctgcttctgtgatattgtgatctataataatacatatgtacgtgtgtgtgtatatatatatatatgtatttagtctttgtccagttttatgacacagagctc

SEQ ID NO: 51908 - DNA, 104 bp, Homo sapiens
tggcatggtggtatgcacctgtagtccaagctacttgggaggctgaggtaggaggatcacttgagcccaggaagttgaggctgcagtaagccatgatggagcca

SEQ ID NO: 51909 - DNA, 82 bp, Homo sapiens
cacacacacacatatgtatatgtatatatgggtgtgtatacatatgtatatatgtatatatatatatatgagtgaagaagtg

SEQ ID NO: 51910 - DNA, 70 bp, Homo sapiens
tgactcaacagcaacccatctgattctccctcaagaatgtcgtcttaagagtcagatggcactgagctca

SEQ ID NO: 51911 - DNA, 82 bp, Homo sapiens
tctgtggccctataagtactgttgtcttcgttgttctgcagatactgcaactgcaactcaaatacattgcagaggtcaaaga

SEQ ID NO: 51912 - DNA, 107 bp, Homo sapiens
tctttgaaatgtctgtcagaaaatgtgcttagcattggtatgttcagaccatggtgcagaatatatttatttgtaatgagaaattaattttccaagaagcttagaga

SEQ ID NO: 51913 - DNA, 107 bp, Homo sapiens
agcctgccttgccctaagggctggggaattagactaaacttttttttttttgagacagaattttgctcttgttgcccaggctggagtgcagtggcatgatctcggct

SEQ ID NO: 51914 - DNA, 111 bp, Homo sapiens
caggctaagaccagggagaaatgaaaaaaaaatgcatatatgtgtatatgtatatctgtatacacacagagacacatagtagcatgtatcatttcagcatgttctagtttg

SEQ ID NO: 51915 - DNA, 96 bp, Homo sapiens
catatattaatatatatacatatatatatacacacacatatatatgtgtgtgtatatatatatatatacgtgtgtgtgtgtgtgtgtgtgtgtgta

SEQ ID NO: 51916 - DNA, 77 bp, Homo sapiens
gggtctcagaacacagtgagcacgggagctctattttcattgagaacagctgctcatttgctgtggcgaagaggcct

SEQ ID NO: 51917 - DNA, 149 bp, Homo sapiens
atacacccgcacacatatatctgtatatctatatttacttgtgtatatttatatacaaatatagatatgtgtataaataataaatatagatatacagatatatgtgtgcaggtgtatgtgtatatatatatgtgcatgcacatctgtat

SEQ ID NO: 51918 - DNA, 82 bp, Homo sapiens
gtctcatttattcctcccaataatgccaaggtgggtagtatttttattttgtatttcagttgggaagagtgaggtttgagat

SEQ ID NO: 51919 - DNA, 60 bp, Homo sapiens
tggtgtgtgcatgcatgcatgtatgtgtgtgtgtgcgtgcatgcgtgtgtgtgtgtgtga

SEQ ID NO: 51920 - DNA, 86 bp, Homo sapiens
gtctgtgagtgatatgcgagaggacaggagcgggttttggaaagacagaaaatctggaattcactcactcacacacacacacagac

SEQ ID NO: 51921 - DNA, 117 bp, Homo sapiens
tacatttcccagcctctgtcagatagatacagctttgtggcaatgcactagacactgagctgtcagtggaggtaatatttgtgatttccaggttatatctttaaaaagaggggcctg

SEQ ID NO: 51922 - DNA, 81 bp, Homo sapiens
actgtacagatgatccccagagtattatctttttttttttttttttgaggtagagtcttactctgtcatcctggctgcagt

SEQ ID NO: 51923 - DNA, 116 bp, Homo sapiens
tagttttaagcaggactttgtggttttagtgaagaagtcatggtgcaattgaaatcactgtaagaaataagtgacttttaaaacaaacacagacacacacactcctcttaagagta

SEQ ID NO: 51924 - DNA, 99 bp, Homo sapiens
ccctcaagctgaaactttttctgtctctcttccagtctgtctgttaggcgaggccttgggagcaggatcctgacaatgtactggtcagctcttttaggg

SEQ ID NO: 51925 - DNA, 77 bp, Homo sapiens
accccatcactcattctcacagtcaccaagctgtgctgagatcagactttgtgtcagggtggagaatggtagggagt

SEQ ID NO: 51926 - DNA, 58 bp, Homo sapiens; identical to SEQ ID NO: 1409

SEQ ID NO: 51927 - DNA, 81 bp, Homo sapiens
tttgcgacagagtctcgctctgtcacccagactggagtgcagtggtgcgatcttgactcactgcaagctctgccgcctggg

SEQ ID NO: 51928 - DNA, 95 bp, Homo sapiens; identical to SEQ ID NO: 68

SEQ ID NO: 51929 - DNA, 93 bp, Homo sapiens; identical to SEQ ID NO: 69

SEQ ID NO: 51930 - DNA, 128 bp, Homo sapiens
caaatgacagattcctgtgtgaaaaccaaggaagttttccagttctcaagacctcagtcctgattttgttattgactttctgtgattcttgactcaggttatctggcttttttggatctcagcatgaa

SEQ ID NO: 51931 - DNA, 82 bp, Homo sapiens
tgtgtatatatatatatatacacacatatatacacatatatacatatatatgtgtatatatgtatatatgtatgtgtatata

SEQ ID NO: 51932 - DNA, 117 bp, Homo sapiens
tgttcagtagctagagtaggttccaagattctgcatttctttttttttaattaaaagattttattgatataaaataaatgtaaatattttcagggtacctgtgatattctgctaaca

SEQ ID NO: 51933 - DNA, 107 bp, Homo sapiens
cttatacctagtgtgtgaaggctactgttctattttattttattaattaattaattaattaattaatttatttgagacagagtctcactgtgtcgcccaggctggag

SEQ ID NO: 51934 - DNA, 122 bp, Homo sapiens
gtaccactgcactctatccagtctgggcagcagaacaagaccaactcaatggaaaaataataataacttgtttttttttttgagacagagtctcactctgtctcccaggctggagtacagtg

SEQ ID NO: 51935 - DNA, 56 bp, Homo sapiens
gagactgagtctcgctctgtcgctcaggccggagtacagtggtgcgatctcggctc

SEQ ID NO: 51936 - DNA, 108 bp, Homo sapiens
gtgccaatccacctggagttgcgggggttttttttttctttctttctttttttttttttttttgagacggagttttgctcttgttgcccagcctgagtgcagtggcac

SEQ ID NO: 51937 - DNA, 74 bp, Homo sapiens
gctgcacccaatatgtagacttattctcagaatattcttttttttttttttgagacggagtctcactgtgtcgc

SEQ ID NO: 51938 - DNA, 61 bp, Homo sapiens
ttttgaaacagagtctccctctgtctcccaggctggagtgcagtggagttcagtgccagga

SEQ ID NO: 51939 - DNA, 107 bp, Homo sapiens
ctggcaagctgatttgaaaatttacatggaagagtaaaaagccaagaatagccaagacactcttttttgttttttgttttttgtgttttttttttttggacaaatag

SEQ ID NO: 51940 - DNA, 58 bp, Homo sapiens
tgagtcagggtctctctctgtcacccaggttggagtgcagtggtgtgatcttggctca

SEQ ID NO: 51941 - DNA, 106 bp, Homo sapiens
gacatactagcatgtgaccttgggtaacttgtctacctctctgtgtctcagtttcatcatctggaaaacggagagataataattcttagcccactggcacactgtc

SEQ ID NO: 51942 - DNA, 140 bp, Homo sapiens
agtgaacagtgagactttgtctcaaaaaaaattttttttaaaattcttaattaggaggttattatttatttatttatttatctgagactgagtctcactctcttactcacggtggagtacagtggtgtgatctcagctca

SEQ ID NO: 51943 - DNA, 104 bp, Homo sapiens
atatcaatatatatcatatatccatgtatcatatatatctatatatcatatatcaatatatatcatatgtatcatatatatctatatatcatgtatatcaatat

SEQ ID NO: 51944 - DNA, 79 bp, Homo sapiens
gcccaaagttatatagctagtgagccatagaatcaggattcgaacctgagaagtctggctccagggctgtgctttcagt

SEQ ID NO: 51945 - DNA, 222 bp, Homo sapiens
tatatatatgtatatatacatgtatctgtatatgtgtatatatatacatgtatacgtacatatatacgtgtatatatacgtatacatatatacacatggatatatatacacacacatggatatatatacatatatgtatatatacatatatacgtatatacatgtatacatatatacgtatatatatgaatatgtgtgtgtgtgtgtgtgtgtgtgtgtgta

SEQ ID NO: 51946 - DNA, 57 bp, Homo sapiens
aggcttctgagtgcagaggttctgggagcagcaatgtgagtctctgactctcagcct

SEQ ID NO: 51947 - DNA, 73 bp, Homo sapiens
ctcagtcagaatgcgtgtgttgactttctgtcagtgcctctgactattagagaaataggcgcttgggattgag

SEQ ID NO: 51948 - DNA, 105 bp, Homo sapiens
tggtttcttgatctacaaatgctgtgtgagataacaaattcttcttattttaaactgctaaattttttgtttaatttgttacacagcaatagataactcatacca

SEQ ID NO: 51949 - DNA, 112 bp, Homo sapiens
taatccgtttcagcgccatagtgtgtgcttgtcgtctggctcctcactctctcagtgtatgctcaaaggtccggccaaaactcttgattatcctggcggcggggcaggattg

SEQ ID NO: 51950 - DNA, 90 bp, Homo sapiens
agagctgggaatccgaggttggcatgaagtgagactccagagactaattctttcgtctcagtctgtgactcacatgtggaaattcagtct

SEQ ID NO: 51951 - DNA, 93 bp, Homo sapiens
caagtccctcattccagtctttgactctgtgaatttgtagttgtaaaacacactaaaaagttatcacaggcattttaatgttctggaggcttg

SEQ ID NO: 51952 - DNA, 116 bp, Homo sapiens
ctgttgggccagaaattatttctatggcacatgtaaaattcagtaatttatagaagattctttcattttataactgtcattattatcaagttgggagtgaattttctaccttccag

SEQ ID NO: 51953 - DNA, 68 bp, Homo sapiens
tggcacagtggcttatacctgtagtctaactatttgggaggctgaggtgggaggatgtcttgaggcca

SEQ ID NO: 51954 - DNA, 119 bp, Homo sapiens
atatataaattttgtatacattatgtatacatgtaaagtgtatgtgtgtatatatgtatatatacttatacatgtatacatacatatacatatatgcaatgtgtgtatatgttgtatgt

SEQ ID NO: 51955 - DNA, 104 bp, Homo sapiens
atgccacattttcattattcatttatccattgttggacacttagatttattctatattttgtctgttatgaatagtgctgcaataaacatggaggtgtaggtat

SEQ ID NO: 51956 - DNA, 95 bp, Homo sapiens; identical to SEQ ID NO: 68

SEQ ID NO: 51957 - DNA, 93 bp, Homo sapiens; identical to SEQ ID NO: 69

SEQ ID NO: 51958 - DNA, 109 bp, Homo sapiens
tgggcatagtggtatgtgcctctcatcctggctacttgggaggcagaggtagaaggatcatttgagcctaggaggttgaggtttcagtgaggagtgattatgccactgc

SEQ ID NO: 51959 - DNA, 120 bp, Homo sapiens
cagcctcagtccacatcccggttctgtcctttgatggccgtgtgaggatagtgacagcctgtctcactgggtcgtagaggagtaaatgagttacaggccgtggaacagtgcctggcactg

SEQ ID NO: 51960 - DNA, 118 bp, Homo sapiens
agcctgggcgacaagaacaaaactccatctcaaagcaacaacaaaaaaaggcagttatttatttatttgatttggttgattgaattttttgagacagagtctcactgtcacacaggct

SEQ ID NO: 51961 - DNA, 91 bp, Homo sapiens
atatataatttactggaaaaggtgtgtgtgtgtgtgtgtgtgtgtatatctagatatatatacacacacacatattatagtgtatatatat

SEQ ID NO: 51962 - DNA, 103 bp, Homo sapiens
tgacagagtcaaggggatcttttcaatactaatgaatgaagattgtattattattattattattattattattattattttgagacagagtctcgctctgtca

SEQ ID NO: 51963 - DNA, 58 bp, Homo sapiens; identical to SEQ ID NO: 2224

SEQ ID NO: 51964 - DNA, 56 bp, Homo sapiens; identical to SEQ ID NO: 335

SEQ ID NO: 51965 - DNA, 75 bp, Homo sapiens
gacccgtctcagcttagcggttcatgagctgtgtgtcctcggtcacatcactcactgcctctgagcctcggtgtc

SEQ ID NO: 51966 - DNA, 109 bp, Homo sapiens
tggatgtctgtctctcactctcttttatatatgtctctgaataaatatttatatatcctcatacatatatatgagacagatgggggtggggggagagagaagagctatc

SEQ ID NO: 51967 - DNA, 95 bp, Homo sapiens
tttgaactggatcctgtactgcagaggggaaaatgtgacaggggaccttcttggtagagttgacaatttttttttttgagacatggtcacacaaa

SEQ ID NO: 51968 - DNA, 95 bp, Homo sapiens; identical to SEQ ID NO: 68

SEQ ID NO: 51969 - DNA, 93 bp, Homo sapiens; identical to SEQ ID NO: 69

SEQ ID NO: 51970 - DNA, 99 bp, Homo sapiens
gtgtatataagatatagatatctctcctatatatgcatatgggagatatacatatgtatatatatatctcctattagttctatgtctctggagatctct

SEQ ID NO: 51971 - DNA, 117 bp, Homo sapiens
tgcctatattacctatgcctgtacatgtttaagtgtgttcacatacacatatatatacatatatacatgatatgcacataaacacctgcatgtattatagatggacatgttttatgg

SEQ ID NO: 51972 - DNA, 95 bp, Homo sapiens; identical to SEQ ID NO: 68

SEQ ID NO: 51973 - DNA, 93 bp, Homo sapiens; identical to SEQ ID NO: 69

SEQ ID NO: 51974 - DNA, 95 bp, Homo sapiens
ggagagttgcctgcacagcgaacacacacactctgacagcggatcagaacgggctgctcagggtttctgtgcttctgtgaatttggggactttcc

SEQ ID NO: 51975 - DNA, 109 bp, Homo sapiens
ttggtattgccattcttttacatttcagcacttttagcaagttaattttatttcttaaaatggtattatagatgttgtgtaatgaaacaaagtaaaagaggtatgccag

SEQ ID NO: 51976 - DNA, 58 bp, Homo sapiens; identical to SEQ ID NO: 1868

SEQ ID NO: 51977 - DNA, 97 bp, Homo sapiens
gcatatatatgtgtgtgtgtatacatatgtttgtgtatatagtatatatgtatacatatatatacatgcatatagtattacacaggaaatgaactgc

SEQ ID NO: 51978 - DNA, 69 bp, Homo sapiens
tgtgtaatactatatgcatgtatatatatgtatacatatatactatatacacaaacatatgtatacaca

SEQ ID NO: 51979 - DNA, 84 bp, Homo sapiens
gtataacttaagtaaaaaccacatacatatatatatgtatatacatatatgtacatatgtgtatgtatgtgtatatatatatac

SEQ ID NO: 51980 - DNA, 97 bp, Homo sapiens
atagagaattacgagtgaaagggcaggaaacttagatatgtttatagtaagtaaagatatatgagtttgacaaggttactgcgtatgagatctctgt

SEQ ID NO: 51981 - DNA, 110 bp, Homo sapiens
tgcttaggattgtcttggctatatgggctctttattggttccatatgaaatttaaagtagttttttctaattctgtgaagaaagtcaatagtagcttgatggggatagca

SEQ ID NO: 51982 - DNA, 90 bp, Homo sapiens
cagtcaatctctgctacagagaatacagtgaatggatgttgtttttatatactcagaatttattttactgttttctggttagagcaactg

SEQ ID NO: 51983 - DNA, 115 bp, Homo sapiens
actggttttattggaggttgaattttgaaggttttataagttataaatagtgattatatatttatagcttatatatcgacaggatttactgttatttttcctttataactacggt

SEQ ID NO: 51984 - DNA, 131 bp, Homo sapiens
atgtgcgtgtgtgggtgtgtgcgcatgtgtgtgcacatgtgtgcgtgtgtgtgtatgtgtgcatgtgcatgtgtgcttgtgtgtgcatgtgcgtgtgtgtgttcatgtgcgcgcgtgtgcgtgcgcatgtg

SEQ ID NO: 51985 - DNA, 107 bp, Homo sapiens
gccactgcaatacatatattgagcaataatgggtacatgtcacagaatgtttttatttaactaattaccctgagtctgattccatgctcaactaatgtcctgctggt

SEQ ID NO: 51986 - DNA, 73 bp, Homo sapiens
gatgtcgttctccttacagcagtaaagcagacacgctgtgtctctgtgttattgctccccaatgaggaaagtc

SEQ ID NO: 51987 - DNA, 56 bp, Homo sapiens
gagacggagtctcactctgtcacccaggctggagtgcaatggtgagatctctgctc

SEQ ID NO: 51988 - DNA, 88 bp, Homo sapiens
gtggatgtaggctgaattttgctgtttgctgatttccaccgagtcagaacagctctgagttccaatggaaagtcttacaaatctttgc

SEQ ID NO: 51989 - DNA, 135 bp, Homo sapiens
tattttatgtatagtatagtatatataatatagtatatataatatagtatagtatatataatatagtatatataatatagtatattatatagtatactatgctatactatatattttgtagtatactatatgata

SEQ ID NO: 51990 - DNA, 234 bp, Homo sapiens
atgtatacatatatgtatatatgtatatattatatattatgtatacatatatgtatatatgtatatattatatattatgtatacatatatgtatatattatatattatgtatacatatatgtatatattatatattatgtatacatatatgtatatattatatattatgtatacatatatgtatatattatatattatgtatacatatatgtatatatgtatgtatacatgtat

SEQ ID NO: 51991 - DNA, 92 bp, Homo sapiens
tatatacatataaatttatcatttaatatatacgtgtatatacgtatatatgtatatacacgtatatatgtgtatacgtatatatgtatata

SEQ ID NO: 51992 - DNA, 114 bp, Homo sapiens
tgtatacatatacatatatatatatgtatatatatgtgtatatatatatgtatatatgtatatgtgtgtgtgtgtgtgtgtatatatatatatatatatatatatatatatatg

SEQ ID NO: 51993 - DNA, 105 bp, Homo sapiens
tgaatcacttagagatcctgttaaaatgcagtttctgattcagtaggtctggggcctcagattctctctgtctaactcatttctaagaagctcctgatgatgtca

SEQ ID NO: 51994 - DNA, 129 bp, Homo sapiens
atgtataaatatatgcatatcttctctggatatatgtacacatatgtatatatgtatatatgtacacatgtatatatgtatatatgtgtatatatgtatatgtgtgtgtatatatatatattagacata

SEQ ID NO: 51995 - DNA, 94 bp, Homo sapiens
aataagagaagcaaggcttagcaagattatcaaatgcccacagtcacactgtgtgtagaccatgttttaattactagtttatttttctcttatt

SEQ ID NO: 51996 - DNA, 120 bp, Homo sapiens
tgtcactttctaatgagcccgggaaacttgagttattttgagaccttgagaaaagagaaatttttttttttttttttttgagttggggtctcactctttctcccaggctggagtgcagtg

SEQ ID NO: 51997 - DNA, 95 bp, Homo sapiens; identical to SEQ ID NO: 68

SEQ ID NO: 51998 - DNA, 93 bp, Homo sapiens; identical to SEQ ID NO: 69

SEQ ID NO: 51999 - DNA, 58 bp, Homo sapiens
tgagttggagtctcactctgtcacccaggctggagtgcagtggtgcaatcttggctca

SEQ ID NO: 52000 - DNA, 117 bp, Homo sapiens
aggttccaatttctccatatcctcacaagatgtgttattttctgtgtgtgtgtgtgtgtgcgtgcgcacgctttttttttttaaagtagccatcctaatgagtgtgaagtggtatct

SEQ ID NO: 52001 - DNA, 59 bp, Homo sapiens
ggagtctctgtttctctcagctcttgagtcaaatgacccaacggcagaaaacagagccc

SEQ ID NO: 52002 - DNA, 74 bp, Homo sapiens
cagggctgggcagtgtgtttttaaggagctgttgtggacattaaatgagagagattagagagtgttcagtcctg

SEQ ID NO: 52003 - DNA, 70 bp, Homo sapiens
tgtagctatagatagatatatagatatatctatatatggatgttatatccatatatctatatatgttata

SEQ ID NO: 52004 - DNA, 104 bp, Homo sapiens
tctatatatctctctgtgtagatgtatctatatatatctatatatctatatatagatgtatctatatatatctatatgtctatatatagatgtatctatatata

SEQ ID NO: 52005 - DNA, 107 bp, Homo sapiens
ggtgaagtccaattttgtttttgccacttgtacttttttcttttttttgagacagggtctcactctgtcacccaggctggagtgcagtggtgcaatcatggcttact

SEQ ID NO: 52006 - DNA, 58 bp, Homo sapiens; identical to SEQ ID NO: 2224

SEQ ID NO: 52007 - DNA, 56 bp, Homo sapiens; identical to SEQ ID NO: 335

SEQ ID NO: 52008 - DNA, 116 bp, Homo sapiens
gggtttgggttttgtttttttttttctgttgtccttttattttgttttttgagacagggtctcactctgtcacccaggctggagtgaagtggcgcagtctcagctcactgcaacct

SEQ ID NO: 52009 - DNA, 87 bp, Homo sapiens
gctatgtaagtaattgtagtttaaatagtttaaaacaatatgctacattgttttaagatttttattattttttattgctgtactggc

SEQ ID NO: 52010 - DNA, 58 bp, Homo sapiens; identical to SEQ ID NO: 7614

SEQ ID NO: 52011 - DNA, 106 bp, Homo sapiens
gtggtggctcacgcctgtaatctcagcactttggaggccaaggcaggtggatcacttgaggtcagaagtttgagaccacactgggcaacatggtgaaactccatct

SEQ ID NO: 52012 - DNA, 108 bp, Homo sapiens
tgattgcctaaagaaactgctttgtaagcctccctacaagataagagaaacttttttttttttctccgagatggagtcttgctctgatgcccaggctggagtgcagca

SEQ ID NO: 52013 - DNA, 78 bp, Homo sapiens
agggctgactcttagtggtccagcttggtcatgtgcccattggtgaaccaatcactgtgactctgactgttttgccct

SEQ ID NO: 52014 - DNA, 94 bp, Homo sapiens
agcttcagagggctgagaagaaaacggatctgtttctattttatttatttatttattttgagatggattctcactctgtcacccaggctggagc

SEQ ID NO: 52015 - DNA, 103 bp, Homo sapiens
ggcgcctttgggccgtgacagtttctcacactttccttttttttttttttttaatgatcttgacagttttgatgagtactggtcggctttattgtaagatgct

SEQ ID NO: 52016 - DNA, 89 bp, Homo sapiens
tgctcagggcaaaatgaatttgacagagattatgttatattattattatttttgaggcatagtctcactctgtcacccaggctggagca

SEQ ID NO: 52017 - DNA, 59 bp, Homo sapiens
gaaatcgactgtgacactggataggtcttttcacctcaccaagtctcagtctgactttc

SEQ ID NO: 52018 - DNA, 82 bp, Homo sapiens
cagagcttccgtttctgcatctgcaagtggggataacaagaaaagcagcacttccagagttggatgggaaatgaaagctctg

SEQ ID NO: 52019 - DNA, 58 bp, Homo sapiens
tgagactgagtctcactctgtcatccaggctggaaaacggtggcatgatctcagctca

SEQ ID NO: 52020 - DNA, 72 bp, Homo sapiens
gggctgacccaagctgggagaggaggcctgttccaccctctttgcctgttgggcccttttcacgtgctgggg

SEQ ID NO: 52021 - DNA, 68 bp, Homo sapiens
ggaacgctgtctctgtctctctgccgggatgtaatatccagaagggcagggatttttgtctgttttcc

SEQ ID NO: 52022 - DNA, 174 bp, Homo sapiens
tttatatatatatatatctgaacacaatacatatatatatatctgaacactatatatatatatatatctgaacactatatatatatatctctgaacacgatatatatatatctgaacactatatatatatatgaacactatatatatatatatctgaacacgatatatatatat

SEQ ID NO: 52023 - DNA, 113 bp, Homo sapiens
ggttagggcactcacacagtgcagaggagtctgaaaaggaatgctgcctgctggcgccctggctctctgtctctctccctgtctttctgtctctgtgtgtgtttttcctcact

SEQ ID NO: 52024 - DNA, 75 bp, Homo sapiens
ctgattcaggtatggctcgatccaggtgctctgacaaagagtcagtctctgtctctgcctctatctgtctatcgg

SEQ ID NO: 52025 - DNA, 107 bp, Homo sapiens
ggctcagctgacggccacaagttctggagaagccatttgatctgctgcgattgtctccaggtgacagatgacagagtggagacggagagtggcaccaagtatgtgcc

SEQ ID NO: 52026 - DNA, 69 bp, Homo sapiens
ttgtttgagacagggtctcgctctgtcactcaggctggagtgcaatagcgtgatcacagctcactgcaa

SEQ ID NO: 52027 - DNA, 114 bp, Homo sapiens
gaggttgggagtgccgacaccagtggctgctgacacctgcgtcactcactgccacacttcagcggtgtgccttggggttcacaagggggaggcctgggaggggagaggaagcgg

SEQ ID NO: 52028 - DNA, 64 bp, Homo sapiens
catgtggatatgtgtatctatgcacaggtatgcctgtatcagtgtgtgtgtgtgtgtctatgtg

SEQ ID NO: 52029 - DNA, 115 bp, Homo sapiens
catgagttcaagccccagttctactgagtatagctgagtagctgagcggccatgggtacgtcactcaccctctctgagcctcagtttcctcctctgtaaagcaggctgccgtgaa

SEQ ID NO: 52030 - DNA, 98 bp, Homo sapiens
gcagtgggtcgtaggggatggggatccagagtgctagctttattttattcatttatttattgagatggagtctcactctgtcacccagactggagtgc

SEQ ID NO: 52031 - DNA, 156 bp, Homo sapiens
gcggcgctgtgtctcgggctctgagtggatgtccgtgcgtctgtggagtgtgcgtggctgcgtggctctgtctgggtcttcggcgtctctcggggtgtctgggggtctgagtcgcggtcttgcccaagagtgcgtgtcaccgagtcttcctgcctc

SEQ ID NO: 52032 - DNA, 64 bp, Homo sapiens
ggcatgtggacgcgtcacagagatcggcaggcagatctctgcctctgtctgtgcatggtcttcc

SEQ ID NO: 52033 - DNA, 79 bp, Homo sapiens
gggtctcagtctgtcacccagtctggagtgcagttgcataatcacggttcgctcgacttcctgggcttaggtgatcccc

SEQ ID NO: 52034 - DNA, 119 bp, Homo sapiens
cctttagtcgttcacagagtgcaggagagtttctgatgcccagtccagctatggcatgcctgcctctctgcgtgagctcggaacccctgctttttgccaagatgaaatatatcaccagg

SEQ ID NO: 52035 - DNA, 92 bp, Homo sapiens
ctcaaagatgcctacacctcaattctcagaagctgtgtgccttccgtgagagaagagactttgcagatgtgacgaagggtgtaggccttgag

SEQ ID NO: 52036 - DNA, 58 bp, Homo sapiens
tgagacagagtctcgcactgtctcccaggctggagtgcagtggcgtgatctcggctca

SEQ ID NO: 52037 - DNA, 58 bp, Homo sapiens; identical to SEQ ID NO: 454

SEQ ID NO: 52038 - DNA, 110 bp, Homo sapiens
ggcacctgtggtgaccagaccctcagggactggaaccggggcggtatggcaagcttgctgtcactctcactgtcttttctgagggccacgttctctcctgctgccgactg

SEQ ID NO: 52039 - DNA, 60 bp, Homo sapiens
gaagagagtgaagtgggtttgcaccctggagagaggaggtaaagccaaatactcctcatc

SEQ ID NO: 52040 - DNA, 147 bp, Homo sapiens
gtattccatagtgtgtgtgtgcatatatatatatatatatatatatatatatatatatacacattgtctgtatatatatatatacacacattgtctgtatatatatatacacattgtctgtatatatatatactatgtgtgtgtgta

SEQ ID NO: 52041 - DNA, 123 bp, Homo sapiens
gtgtgtgtgtgcataggcattgtgggcacatgtatgtatgtgtgtgcatgtgtgtgtgcatttgcatgtgggcacatgtgtgtacatgtgtgcaagtgtgtggatatgcatgtgtgcacatgt

SEQ ID NO: 52042 - DNA, 79 bp, Homo sapiens
ggtggacttattccgagccagagaagacccagcaaattcctctgactctgtctcagaatggtgtggaatgaactccacc

SEQ ID NO: 52043 - DNA, 79 bp, Homo sapiens
acatacatgtgtatatctctatgtatatgatatattgatatatatgcatatatattgataatgaaatacatatatatgt

SEQ ID NO: 52044 - DNA, 95 bp, Homo sapiens
catgattgcctgttaagcaccggctgctcattttcatcttctgggtgaaatgctcaaagggactggatgaatactgagtgagtaaggaataaatg

SEQ ID NO: 52045 - DNA, 85 bp, Homo sapiens
gtgcacttggacctggttcttggctatggctcaggctgggcacacactgagttcagagtctgcagagaattcagggccaggagcc

SEQ ID NO: 52046 - DNA, 111 bp, Homo sapiens
ttgtttgtggttttgttgttgttgttttgagatggagtctcactctgtcacccaggctgaagggcggtggcacagtctcagctcactgcaacctccacctcccaggttcaa

SEQ ID NO: 52047 - DNA, 95 bp, Homo sapiens
tccccagggcagggcccactatgaggcatggaggggaaggaaccttgagcatgtcccttcactccgtctctcagcccgggagcctgcctttcaga

SEQ ID NO: 52048 - DNA, 58 bp, Homo sapiens
tgagacagggtctcactctgtcactcaggctggagtgcagtggtgtgatcacagctca

SEQ ID NO: 52049 - DNA, 76 bp, Homo sapiens
cccacagtcagtgactgactggtgaggtgaccaaggccagcagcacccactctgatcaggccagttctggggtggg

SEQ ID NO: 52050 - DNA, 58 bp, Homo sapiens; identical to SEQ ID NO: 21243

SEQ ID NO: 52051 - DNA, 75 bp, Homo sapiens
ggtgcctgacactcagtctgtgtttgctgaagagtcatattcttggtcgagagcaggcactccgatggtcagccc

SEQ ID NO: 52052 - DNA, 88 bp, Homo sapiens
acagcatttgatttcccacaaatctgtgagtagactgggtggtgcttctgcttaatgtggtttcagttggggaagtccgaaatgatgt

SEQ ID NO: 52053 - DNA, 83 bp, Homo sapiens
aattcatgtatgagctgaggttgccaaagaagcagggaagctttcttccccctcctttgcctcacactctgttacactgagtt

SEQ ID NO: 52054 - DNA, 111 bp, Homo sapiens
acccagcatagcacctggcacatgatggatgctcagcaaatgtctgtgggtcttctttttactaaacaggcagttgatttcaccagaagtagtgaccacctaagttttggt

SEQ ID NO: 52055 - DNA, 152 bp, Homo sapiens
atattttatatacatacatacatatatatatatatatatatatatatatatatacatacatatatatatatatacatatatatacatatatgtgtatatatatatctgtatatatatataactgtatatatataactgtatatatatatata

SEQ ID NO: 52056 - DNA, 113 bp, Homo sapiens
gtgtagaagtgatgtgaagagtatgaggtactacatgtaatgtttgcaggctgggacccagaacacagtgtggactcaataaatatgagctgttcttattgctgcgaggatgc

SEQ ID NO: 52057 - DNA, 97 bp, Homo sapiens
gctgcttctgaactcttggtccacagaaactgtgtgagataataaatgtatatcattttaattacctaagtttgggagcaatttgttatgcagtagc

SEQ ID NO: 52058 - DNA, 108 bp, Homo sapiens
ggattccggctgagtgcggcccccgcagcctccggctcagccagtgactcactccagacactgcgtgagtcagcggctctgcggctctggccagctctgacgccctcc

SEQ ID NO: 52059 - DNA, 115 bp, Homo sapiens
tcagatctacctatatattctaaaaaccttaactagttgataatgacaacagactgagcacagcctaaatagccttcattgggaactggttaaatatattgtgtagcatctctga

SEQ ID NO: 52060 - DNA, 69 bp, Homo sapiens
ggcccactttgtgtctgtccctctgtccctcattttcatggctggtcaggctgttgacatctggtggcc

SEQ ID NO: 52061 - DNA, 104 bp, Homo sapiens
atcaatctctccctctctctgggcctctctcacacacacccactctctctatctgtgtgtgggaacttcagggttatccggagggaagggttggagtgtgtggt

SEQ ID NO: 52062 - DNA, 115 bp, Homo sapiens
gtgggaggtgaggagaaaggacccttccagagggccccccctcaatcctgttgtgcctaattcagagggttgggtggaggctctcctgaagggctctgaagagcgctgcacccgc

SEQ ID NO: 52063 - DNA, 78 bp, Homo sapiens
tggagattttatttatatacatgatatatactgtactaagtatatatagatatgtggtatatatagagagagtcttta

SEQ ID NO: 52064 - DNA, 83 bp, Homo sapiens
ccctatgaggcaggtaatcctatcagtaccctctttaacagtcagactcagacacagagagtagtaaagtcacttgcccaggg

SEQ ID NO: 52065 - DNA, 117 bp, Homo sapiens
gaaggacagagtcatggtggcttctggaaggactggacccaggacccagggactcaggacactgtctgaccctctgtcttctccgctcgtttttgcttctccctatggaatgccctc

SEQ ID NO: 52066 - DNA, 89 bp, Homo sapiens
taagtcctgatgtgacattgtttttgtgtgcgaataaggcacgggcagcctcagtctcgtgcagagccagatactttattcatcacttg

SEQ ID NO: 52067 - DNA, 109 bp, Homo sapiens
gactctgagccttgcaaaaccgagagctgtactttttcttttttttaaattaatttataaaattttttttctgtagagatgaggtctcgctctgttgtccaggctggtc

SEQ ID NO: 52068 - DNA, 96 bp, Homo sapiens
tggttcactgttactcttgattttagtttgtgagactttttcattttctttaaaggaactgtctgcacagctgcatgattatggccatgtgaacca

SEQ ID NO: 52069 - DNA, 116 bp, Homo sapiens
tccaacgcaagggcagccccagcctgctgttttcccagtgagctttgctgcctttttatttcattataatagcctcctgaagaaaacacatacaaatataatgctcttggttagga

SEQ ID NO: 52070 - DNA, 89 bp, Homo sapiens
cggggaagcaaacagatctgccaatgtcgttcccggtggcatctgagctaaggggtggacagtgggtcagtctgtctgtctttgtcctg

SEQ ID NO: 52071 - DNA, 89 bp, Homo sapiens
ggccatggacagagagattcagcatcaccatgtcattgcagaatgaagggagagttggctttgttaaccaccttggctgcccgtgatgc

SEQ ID NO: 52072 - DNA, 59 bp, Homo sapiens
gagttgaggaatgaatgactgaatgggctgacatgtcagagtcactctgtccttccctc

SEQ ID NO: 52073 - DNA, 85 bp, Homo sapiens
acacacactctcacacactttcctgcatgctgagaaatgaatccctgaagaagggaagtgtgtgtgtgtgtgtgtgtgtgtgtgg

SEQ ID NO: 52074 - DNA, 115 bp, Homo sapiens
ctgtggtgggaatgctttagtgtctcataaatagggactgacagggacactctgtaactattagtgctttttgtggttgttgttttagaagcagtggatttgttttatatttcag

SEQ ID NO: 52075 - DNA, 69 bp, Homo sapiens
ggcgggccaggctctgtgcaccgtgctgagggacgtgagtgaactgagtgtgctgagatggcacaagcc

SEQ ID NO: 52076 - DNA, 80 bp, Homo sapiens
tgagcgcgtgggcaagaaggtgtcgtactggtgcccgtgtgtgcaacggggcagccctgactcagtgcctcagtgcctca

SEQ ID NO: 52077 - DNA, 74 bp, Homo sapiens
tgggcccaggttggtgagaccatcttcatcttttttttttttttttccaggacagtgtctcactctgtcgccca

SEQ ID NO: 52078 - DNA, 117 bp, Homo sapiens
ggagaatgagtcattgcgtgtgtatgcctgtgtgtttgtgcatatatatatgtgtgtgtatgtgcatgtacaagtatgtgtttgtgtgtgcaggtgtgcacgtgtgggtacttcccc

SEQ ID NO: 52079 - DNA, 107 bp, Homo sapiens
tgttacaggtttcttttactgtgtttctctctatatatatgcacatctatataaatatagatacatagatatatggggagaagatatagatagagataatgtatgca

SEQ ID NO: 52080 - DNA, 65 bp, Homo sapiens
gctcactctgcctctctgagccttggtttcctcacctgacctgcacagtggaagaggagaagagc

SEQ ID NO: 52081 - DNA, 94 bp, Homo sapiens
gtgagctcaggtgggctgtgtgccttattgaggctgtgaacccaggtgggctgtgagctcagtgaggacagacaccacacctggttttgctcat

SEQ ID NO: 52082 - DNA, 89 bp, Homo sapiens
tttttattggacaacggctggtgtagacttctcttttcttttttttttttttaaggagacaggggtctcactctgttacctaagctaga

SEQ ID NO: 52083 - DNA, 95 bp, Homo sapiens
ttttgagtctaccaaattgtggcagtaatgttcagtggcttaaaaagtaagtttttggatatgttttgaaaattaaccacgctggaggtttaaaa

SEQ ID NO: 52084 - DNA, 61 bp, Homo sapiens
tcccttagtctctctttctgtcaccaacgctaggggaggcagagcctggaagagggaggga

SEQ ID NO: 52085 - DNA, 178 bp, Homo sapiens
gtatatacacatatatatacatatatatgtgtatatatatgtgtatgtatatatatacatatatgtgtgtatatatgtgtatgtatatatatacatatatgtgtgtatatatgtatgtatatatgtgtatatatgtacatacacatatatacacatatatgtgtatatatacatatat

SEQ ID NO: 52086 - DNA, 85 bp, Homo sapiens
aggaaagatacagggtggggattctgaggcatgccccaaccttgcctgtcactctccgtctcattaccctgttttattttctcct

SEQ ID NO: 52087 - DNA, 68 bp, Homo sapiens
gcacagaagagagtgttgacagtggatgccagttgcttttaacctgctcagcatgttcatcttctggt

SEQ ID NO: 52088 - DNA, 80 bp, Homo sapiens
ctgtatatgtatatgtctatatgtctatatgtatatgtatagaagcatgtacatgtacagaggcatgagtatgcatatat

SEQ ID NO: 52089 - DNA, 69 bp, Homo sapiens
acacactgcctcctggcttgtctgcccctcctctaggctgtaggcgagctcactgggggccagtgatgt

SEQ ID NO: 52090 - DNA, 75 bp, Homo sapiens
gtgagtatatatgtatatatctatatgtgtatatatgtattatacatatatgtagatgtgggcataagtatttgt

SEQ ID NO: 52091 - DNA, 78 bp, Homo sapiens
gccctgagacaggattgccatcaagcgttcatggtgcagggttctttgggggcatttattctgtctcttgtcaatggc

SEQ ID NO: 52092 - DNA, 89 bp, Homo sapiens
gcggagtgagcccttccctggctccctgtcaggcacctcacaaatcagaggacggtgatggggagggtggctgggagggcgctacctgc

SEQ ID NO: 52093 - DNA, 58 bp, Homo sapiens
gagaatggtcttggtctatgaagactccacggtctctcagtgactcaatggccagatc

SEQ ID NO: 52094 - DNA, 80 bp, Homo sapiens
ccactgtcactgactgtcacagccatgagagcccacggcttatctccgggtagtgcggtggccatgtgctgggcagtggg

SEQ ID NO: 52095 - DNA, 169 bp, Homo sapiens
atattatatatatcttatatatatgtgtgtgtatatatatattatatatgtgtatatatattatatatgtgtatattatatgtgtatatatatattatatatgtatatatattatatatgtgtgtatatatatatcatatatgtgtgtgtgtgtatatatatatatata

SEQ ID NO: 52096 - DNA, 108 bp, Homo sapiens
tcaaaattttaggatgctgctgaattgatgtctagaggtaacttatatctttatagatgtatatatatacttaaaggaaggtttaaaatcagcgaactgagctttcga

SEQ ID NO: 52097 - DNA, 184 bp, Homo sapiens
tatatatatacagtgtgtgtgtatacatagttgtatgtatacatattttatatatatggtgtgtgtatacatagaattgtgtatatatttttacatagtgtgtatatataaattttatatatagtatatgcatatatatagtgtatattttatatatatagtgtgtgtgtatatatatatttta

SEQ ID NO: 52098 - DNA, 76 bp, Homo sapiens
aatatatacgtgtatatgaatatatatgtgtgtgtatatgaatatatgtgtatatatgtatgtgtgtgtgtatatt

SEQ ID NO: 52099 - DNA, 109 bp, Homo sapiens
ggagaagtataaaagaggttatggaaaggaaagctttgcgggccactgtctgacttggcatttcagtgcctgctttgagctttgcatgatcatctatgtatcctttttc

SEQ ID NO: 52100 - DNA, 119 bp, Homo sapiens
tgtaagtcagtgagttctttagtcctggtcagatgtctcctggcacctacaactctgaagacagtgtgcagaggcgcacaggacaaatgtgcttctgaagaaacagttcagggtatgca

SEQ ID NO: 52101 - DNA, 128 bp, Homo sapiens
ggtgactcagcgtcattgactgatgtcctatctcatccagactgggattgcattgatgtttggctccaggttgtctctcacaagctatggagattttctccacaagatgcttatggagcaattggtgt

SEQ ID NO: 52102 - DNA, 92 bp, Homo sapiens
aagcaaaagacatagaaataatatgtaatatatatataacatatatattatatgtttatatatatatattattatttctatgtcttttgctt

SEQ ID NO: 52103 - DNA, 92 bp, Homo sapiens
aagcaaaagacatagaaataataatatatatatataaacatataatatatatgttatatatatattacatattatttctatgtcttttgctt

SEQ ID NO: 52104 - DNA, 69 bp, Homo sapiens
tgtacatatattatgtatgtgtgtaacatacataatagtatgtatgtatatatatacataatatataca

SEQ ID NO: 52105 - DNA, 58 bp, Homo sapiens
tgagatgaattctcactctgtcacccaggctggagtgcagtggtgtgatctcagctca

SEQ ID NO: 52106 - DNA, 114 bp, Homo sapiens
gggtcatccatggggctatcagcaacgagtgagctccaggtgacaggagtgacagaggaaacagcacatcctctgtccaggtcaggggggccctggggctgagcttggggaccc

SEQ ID NO: 52107 - DNA, 91 bp, Homo sapiens
gtccagtgtaaatgggtgaattctataagacataaattatctctcaataaatgtgttttgaaaagattcattattggccaggtgcagtgac

SEQ ID NO: 52108 - DNA, 76 bp, Homo sapiens
gcatgtgtatgtatatatctgtgtatatataaatatatgtgtgtatatataccaacatctatatacatatgtgtgt

SEQ ID NO: 52109 - DNA, 116 bp, Homo sapiens
gcgtgtatgtgtgtatatatatatacacacacctatatatggtatatatggtatatatgtatactaattatatattttatatatgtatgtatgtatgtatgtatgtatatatacca

SEQ ID NO: 52110 - DNA, 57 bp, Homo sapiens
aggtcagggagatgtgggtgtggatctcggggccatcactcactcgctctgtgagct

SEQ ID NO: 52111 - DNA, 78 bp, Homo sapiens
ctgcttttcatttggatttcaggtgtctcatgtttcaagaaggaattggtagatgccttgagagaagattgagtgcag

SEQ ID NO: 52112 - DNA, 58 bp, Homo sapiens; identical to SEQ ID NO: 1725

SEQ ID NO: 52113 - DNA, 87 bp, Homo sapiens
tacaggtgtgagccactatgcccggccccatcttcattatttttaaatgcatagttctgtggcattaaataccttcacaccgttgtg

SEQ ID NO: 52114 - DNA, 80 bp, Homo sapiens
tgtgaggtgtgcctgaccagactgaagggtctcaggacagggccagggcttcttctatgctgtcgcaggtggacttcaca

SEQ ID NO: 52115 - DNA, 78 bp, Homo sapiens
cctagtagttaaagatgtaaattctggaacctgggttcttaccctggctttaccgtttaccagctggacaactgtagg

SEQ ID NO: 52116 - DNA, 76 bp, Homo sapiens
gctgagtgtcagacccacaggctatactgcaggcgtggcttttgcactgtctgagtctgtgttttctagactgagc

SEQ ID NO: 52117 - DNA, 95 bp, Homo sapiens; identical to SEQ ID NO: 6311

SEQ ID NO: 52118 - DNA, 107 bp, Homo sapiens
ggagagatggctggaggctcaaacacacacgccacacactgagtctgtgaaacagaaggagagggggatgggagtggatgggtataatatggagagttccagaggtt

SEQ ID NO: 52119 - DNA, 76 bp, Homo sapiens
tatgtatgcatgtgtgcatgtgtgtgcatgtgtgcatgtatgtatgcatgtgtgtgcatgtgtatgtgcatgcatg

SEQ ID NO: 52120 - DNA, 68 bp, Homo sapiens
aagaagggctccctctcacagtgtctccctctggtgtccataaggcgagaggtggagagggctttctt

SEQ ID NO: 52121 - DNA, 58 bp, Homo sapiens
gaggttttgcagaggtgattaagttaaggatcttgatatgagatcatcctgtatcctc

SEQ ID NO: 52122 - DNA, 103 bp, Homo sapiens
tttgcgagtcattccaggcaccttcagaggaagcaggcttctgtctctctggctggctcagtgaggagcagctcaaagagaagttacttaataagctctttcc

SEQ ID NO: 52123 - DNA, 117 bp, Homo sapiens
accttatacaatttgtttctagcctgcagactttttaaattttattgtagcactggtaattaaatttactttttaaaaaaatttcaatagtttttagaggagcaggtggtgtttggt

SEQ ID NO: 52124 - DNA, 60 bp, Homo sapiens
ttcagtcttcagtgggtccctctggggcctggtttgcagagagaacccagtgaggaggag

SEQ ID NO: 52125 - DNA, 66 bp, Homo sapiens
gggagtgtaacaaggtgcactgtgtctcacactgacactattagtccacccatgtcagcggctccc

SEQ ID NO: 52126 - DNA, 106 bp, Homo sapiens
acatgtcatatatatagagagagtatatatgtgtatatatatacacacacacacacactatatagagtatatatatacactccatatacagtatatatactagtgt

SEQ ID NO: 52127 - DNA, 86 bp, Homo sapiens
ctggggtggctcctaatgtagtgggactgatgtcctcttaaggagaggaaatttggacagtgacacacacagaggcacaaccttgg

SEQ ID NO: 52128 - DNA, 73 bp, Homo sapiens
gtgcctctgtgtgtgtcactgtccaaatttcctctccttaagaggacatcagtcccactacattaggagccac

SEQ ID NO: 52129 - DNA, 96 bp, Homo sapiens
gtgcgtctgtgaatatgtgtgtgctgtgtgtggacacatgtatgtgtgtgctatgtgtggatatgcatatatacatgtgtgctgtatggggataca

SEQ ID NO: 52130 - DNA, 72 bp, Homo sapiens
gctctgtctaactcactctggatgggaactgctgggagaaaggagaggctgcagggtggtgctgggtagggt

SEQ ID NO: 52131 - DNA, 66 bp, Homo sapiens
atgcagggaggcagtcacagtgtctgagagaggagcttcgacttggaaaatggtgagccctggcat

SEQ ID NO: 52132 - DNA, 114 bp, Homo sapiens
ggggcctcctatgttagcttcccggggctgctgcaacacattcttgatttcagaagtctgagatcaaggtgtgtgcagggccatgctccctccgaaggctctaggggagggccc

SEQ ID NO: 52133 - DNA, 63 bp, Homo sapiens
gggatcctgaacagcagatgttttatgtctgtgtgaagctgtctgtctgtctctctctctccc

SEQ ID NO: 52134 - DNA, 89 bp, Homo sapiens
ccagtgtcaaggaacggtgagaggacacagaggggattgtgcttcttcacttccctgattttgctgcctctccttgtcttccaggctgg

SEQ ID NO: 52135 - DNA, 88 bp, Homo sapiens
tgtgcacatgtgtgcatgtgtgtatagtgtgcacgtgtgtgtgcatgtggatgtgtgtatagtatgcacgtgtgtgcatgtgtgtata

SEQ ID NO: 52136 - DNA, 92 bp, Homo sapiens
ccccatcgtccctgttttcactgtctctgagttagttgtaaagaaaggaatttctctgcagagcatcgctttgaaggaaaacttacttgggg

SEQ ID NO: 52137 - DNA, 79 bp, Homo sapiens
tgagcctgctgtgtgtgtctgtgacagagttccttgtgccattaccaggactcttcccagcaaaaactgccctcggcca

SEQ ID NO: 52138 - DNA, 62 bp, Homo sapiens
aggagaaggagagggcacagtcacactcattcattcagtaaatctgtctctctctctctctt

SEQ ID NO: 52139 - DNA, 114 bp, Homo sapiens
tgagtttgtgagtttgctctctatttcttatcatagagctttgatttttttttttttttttttttgacagagtcttcctccattgccaggctggagtgcagtggcatgatctcg

SEQ ID NO: 52140 - DNA, 100 bp, Homo sapiens
gtgggagggttttttttttttaggagatagggcctcactctgtcactcaggctggagtgcagtggtgccttgaactcctgggctcatgtgatcctcctgc

SEQ ID NO: 52141 - DNA, 107 bp, Homo sapiens
ggctcccaagggaattgtttcggggttggggtcagaggtctgagtggacagtgcgtggacaaggcaggacactaggagccagggagctgaacccttctctgggcgct

SEQ ID NO: 52142 - DNA, 132 bp, Homo sapiens
gagtcctcccggcgcgcagccttgctgagagccacgctgtggagtagggtttcagcaccgtgtgtgtcactgtctcttccagagctgcgttggtgcctaaaggaaggagcgcctagctactctggttgctgc

SEQ ID NO: 52143 - DNA, 112 bp, Homo sapiens
gacctgtgtttctcagaaatgctaagaacattcactgtttggatgaagaacacaatatttttttttctttcacatgcactggatgacttcaccgtgtttactgtctttggtt

SEQ ID NO: 52144 - DNA, 87 bp, Homo sapiens
gagctgggcgcatgggatgtgcctctgtgaaaatgcaggcaagaggagactgtgcccttgcacacacgcacactcacaccgtcagcc

SEQ ID NO: 52145 - DNA, 103 bp, Homo sapiens
acgagccacagccaatcactgcagatccagctatggggacatgagctcaccactgtctgagtctgtctatgttgggactgtccacgttgccaagtgtgcttgt

SEQ ID NO: 52146 - DNA, 118 bp, Homo sapiens
tgatgccaggaaatactgttggggacagggaagtaagactgaaaagagaagagtgtcaccaatcaggttacacttcagcagctggtgacccctgggagacagtgtagacacagcctca

SEQ ID NO: 52147 - DNA, 126 bp, Homo sapiens
cgtgtgtgtgcacgcccgagccagtgtgcatgtgtgtgccgtgtgtgtgcatgatagccagtgtgcgtgtgtgtgtgccatgtgtgtgcacgcccgagccagtgtgtgtcccatgtgtgtgcacac

SEQ ID NO: 52148 - DNA, 78 bp, Homo sapiens
ctggtctggctgggtccctgcatgtcctgagcgtactggactccaggtacgtggttggcctgaggccctcagctccag

SEQ ID NO: 52149 - DNA, 112 bp, Homo sapiens
tgcatgcagactgcctgcttgggaaacatacttctttatatgcccatatggacctgctaagctatggaatgtaaagaagtatgtatctcaggccgggacctctctcgccgca

SEQ ID NO: 52150 - DNA, 58 bp, Homo sapiens; identical to SEQ ID NO: 1763

SEQ ID NO: 52151 - DNA, 76 bp, Homo sapiens
agcaggtgccgcctggctgcagccttgcagggtgttggcgctccctgtgtcctctgtctgtctctgcggctctgct

SEQ ID NO: 52152 - DNA, 115 bp, Homo sapiens
ggggctgagggcaggtgcccggctcaccgagggtggcccactccctccatgatcctcagagagagcagagggtccacagaggtgccagcatgggcctggccagcctggggacccc

SEQ ID NO: 52153 - DNA, 79 bp, Homo sapiens
gttagaatcctctggagaggcagcccgcttggtcagagctgccgcttttgtctcactgtctgtccgtggtggttccaat

SEQ ID NO: 52154 - DNA, 128 bp, Homo sapiens
tccctgagctcaatgtcttccagctgctggttggaggtgccagctggttcctgctgggtccgtctgacagtggcacagggaggttcaggtgggcacagacgccgccgcctcagctctgagtgttattg

SEQ ID NO: 52155 - DNA, 74 bp, Homo sapiens
tgtgggtgcatgtatgtgcacaagtgtgcctgtgtgtacacatgtgtgtctgtgtgtatatgcatgtgctggca

SEQ ID NO: 52156 - DNA, 73 bp, Homo sapiens
ccgtcaaactgtccgtctgtctctctggccctgcagcagcagggatgagctcatgtcagcacacagggtgcgg

SEQ ID NO: 52157 - DNA, 90 bp, Homo sapiens
ccttggccctgggtgctccccggggtggaggtgcagccccagcctctgcatctgtgcctctctctcgcagggcccccggggattacgagg

SEQ ID NO: 52158 - DNA, 58 bp, Homo sapiens; identical to SEQ ID NO: 1435

SEQ ID NO: 52159 - DNA, 93 bp, Homo sapiens
tgtgtatatatatgtgtgtgtgtgtatatatatatatgtgtgtgtgtgtatatatatgtacatatatatatacacacacacacacatacatat

SEQ ID NO: 52160 - DNA, 114 bp, Homo sapiens
ttctgtggcttattgatggcactcaagcaccgcacagcaatgacgtctgtcctggcagggcacacgcactctgcgtctgaatgagtattgagctaattccaaagcccagcagag

SEQ ID NO: 52161 - DNA, 85 bp, Homo sapiens
gagggcccctctgcgtgttcacagcggaccttgatttaatgtctatacaattaaggcacgcggtgaatgccaagagaggcgcctc

SEQ ID NO: 52162 - DNA, 58 bp, Homo sapiens; identical to SEQ ID NO: 11136

SEQ ID NO: 52163 - DNA, 81 bp, Homo sapiens
gggagatcagggcaggtggccgggccagggctgccacttggtctttactcagtggcagggcaggctccctgactgccaccc

SEQ ID NO: 52164 - DNA, 77 bp, Homo sapiens
cgtgtgtgtgtatacatatatacgttgtgtgtatatatatatgtacgtgtgtgtgtgtgtgtatatatatatgtata

SEQ ID NO: 52165 - DNA, 58 bp, Homo sapiens
gcacgtgtgtgcgtgtgtctgcgtgcatgtgtgtgcgtgtctgcatgcatgtgtgtgc

SEQ ID NO: 52166 - DNA, 109 bp, Homo sapiens
tgtgcacgtgtgcatgtatgcgcatcgggtcttgcacgtgcacctgtgactgtgcatatgcatgcatatgtatgtttgtgcacgtttgtacatgtgcgtgcatgtgtgt

SEQ ID NO: 52167 - DNA, 115 bp, Homo sapiens
gcactcagtaaaacgcagtgattcaacctggacggtgtgtggcctcctcactcccactgtctctgggcggccggtctgagggccggggacttctggtcgatgctggggctgagtc

SEQ ID NO: 52168 - DNA, 74 bp, Homo sapiens
acgctcctgagatcccgcgtttctcatcagtgattgggcacccactgtgtgtgtgcgtgagtcacaggctgtgt

SEQ ID NO: 52169 - DNA, 117 bp, Homo sapiens
ccgtacgctccagctcctgggtctgggtttggggggctgagcctgtgtgtgatgtgcgcctgtgtgcgtgtctgagtgggtcagtcccggcttactgagtgctgtgtgcgtgagtgg

SEQ ID NO: 52170 - DNA, 95 bp, Homo sapiens
gcatgagccaccgcacctggcctttttgttttttgagacagagtctcgctctctcacccaggctggagtgcagtggtgtgatcttggctcactgc

SEQ ID NO: 52171 - DNA, 58 bp, Homo sapiens; identical to SEQ ID NO: 24627

SEQ ID NO: 52172 - DNA, 89 bp, Homo sapiens
gacatttctcccatggccaagtgatctctgatagatcctgtaggaccactgaagtcagacaggacaagttgagtcagggcctgtgtgtc

SEQ ID NO: 52173 - DNA, 68 bp, Homo sapiens
ttgttttgtttttttgtttttgagacggagtctgtttctgtctcccaggctggagtgcagtggtgcaa

SEQ ID NO: 52174 - DNA, 85 bp, Homo sapiens
gcatgagttcatgtgtgagtgcatgtttatacgcgtgtcagggtctctgtgtatgtgtatgacgtgtgagtacatgtgttaatgt

SEQ ID NO: 52175 - DNA, 105 bp, Homo sapiens
tctggcctcctcagaatcacttaacctaggctacccctctgtgattcagagaaaattgaaaccacagtttagagcctcaaaaaagttcatcgagtggggaaatga

SEQ ID NO: 52176 - DNA, 72 bp, Homo sapiens
gtggaggctgtggaaaggactccagagtctgcaagtcaccaagcagcctctgtggctctgtcacagcaccac

SEQ ID NO: 52177 - DNA, 58 bp, Homo sapiens
tgagactgagtctgactctgtcacccaggctggagtgcagtggtgagatctcggctca

SEQ ID NO: 52178 - DNA, 72 bp, Homo sapiens
ctttctgttgacatgggatccccttgaaagttttttttttggagacagggtctcactctgtcacccaggctg

SEQ ID NO: 52179 - DNA, 113 bp, Homo sapiens
gagcccccgtccccagtagctgggtgctcacacatgcacaatctactctctgactgtggctcattgggctggtcctatcatctgtggttctaaaggtccaaaaagggctatgg

SEQ ID NO: 52180 - DNA, 67 bp, Homo sapiens
gggtctcaccgtctctgcctccctgctgtgtgctggcagactgcttggaagacatgggcgatgacct

SEQ ID NO: 52181 - DNA, 72 bp, Homo sapiens
gccatatagctggtgggtgtcaggagcccttggcctggagcaaggctctgtgagactctgtgagaaggtggc

SEQ ID NO: 52182 - DNA, 81 bp, Homo sapiens
ggagtctcactctgtgacccaggctggagtgcagtagtgcgatctctgcaacctctgcctcccgggttcaagcgattctcc

SEQ ID NO: 52183 - DNA, 66 bp, Homo sapiens; identical to SEQ ID NO: 474

SEQ ID NO: 52184 - DNA, 97 bp, Homo sapiens
tccagacattgccatagcatttgtaaactgtcatgccaccagtgggaatatctgttagcatgctaatgcattgtaaaaatgtaatgagcagtgggga

SEQ ID NO: 52185 - DNA, 67 bp, Homo sapiens
gcctgtgatggttaatactgagcgtcaacttgattggattgaaggatgcatagtattgatcctgggt

SEQ ID NO: 52186 - DNA, 95 bp, Homo sapiens; identical to SEQ ID NO: 68

SEQ ID NO: 52187 - DNA, 93 bp, Homo sapiens; identical to SEQ ID NO: 69

SEQ ID NO: 52188 - DNA, 73 bp, Homo sapiens
ggtcactgtgagacagggcagatttgtggtcaggactcccgcgttctgactctctgagactctttccatgatc

SEQ ID NO: 52189 - DNA, 73 bp, Homo sapiens
ctttgggtcatgttgggtcaagaaagtgagctgaagaggcctatgacatttctgaccctctttcatctcagag

SEQ ID NO: 52190 - DNA, 103 bp, Homo sapiens
gctatttgggctctttgtcggttccatatgattcttggaatagtttttttataattctgtgaagaatgatgttggtagtttgataggaacagcattgaattgt

SEQ ID NO: 52191 - DNA, 57 bp, Homo sapiens
tgacattctgcatctgcatgtcttttaaaccactagcaggaagatgctggggtgtca

SEQ ID NO: 52192 - DNA, 105 bp, Homo sapiens
tgtaaaaaagtaagagatatgtttttcctgagccagaaaggtgggaccctgacactccctcacagttacaccttgggttgggaaggagcctttatttgcatgaca

SEQ ID NO: 52193 - DNA, 86 bp, Homo sapiens
tagactactgggaaaatgagaatgaatggagatgtatctgacgttttgggagcaggctagattcagatcttctctccctgtagcta

SEQ ID NO: 52194 - DNA, 107 bp, Homo sapiens
gcccccttgtgcccaatatactgtaacaggataatacagggaaacagtcaagaaagaaactttttgaaaactccattcattaaagctacagtatagcaatgtgtggt

SEQ ID NO: 52195 - DNA, 87 bp, Homo sapiens
ggtggttgttttgagacttttctcctttttaaaaaaatttttttatttattttttatttttttgagacggagtgttactctgtcacc

SEQ ID NO: 52196 - DNA, 88 bp, Homo sapiens
tatatgtacccgcacatacacaaacatgtatatttatttatctatccacctgtttgtgtgcatatgtgtatgtgtgtgagtatatata

SEQ ID NO: 52197 - DNA, 95 bp, Homo sapiens
tacatgaattattttactatattattatgtcattttatatatgtgtgtatgtataagagtagataatttcatgtatatagtgtgtgtcttatgta

SEQ ID NO: 52198 - DNA, 60 bp, Homo sapiens
tatatatgtgtgtatacatgtatatgtatatatgtatatacatgtacacacgcatatatg

SEQ ID NO: 52199 - DNA, 120 bp, Homo sapiens
gataatgatatacttgtgtggatatctatgtatatgtaggtgtatttatgtgtatatatacatatacatacacatcaatatacacatatatgttcatttataatatatttaagagttgtt

SEQ ID NO: 52200 - DNA, 95 bp, Homo sapiens
aatgaacatatatgtgtatattgatgtgtatgtatatgtatatatacacataaatacacctacatatacatagatatccacacaagtatatcatt

SEQ ID NO: 52201 - DNA, 115 bp, Homo sapiens
gctttatgtaagccatgcagggatattgatttccatgttaagaagtttgtagaaaggccattgccaggcagaggttggtggcagagagattatgtttcgggtcttacgctggggt

SEQ ID NO: 52202 - DNA, 183 bp, Homo sapiens
gtgtgtgtgtgtgtgtatatatatatatatatatatatacactctcatatatatgtatgtgtgtgtatatatatatatacactctcatatatatgtatgtgtgtgtgtgtgtatatatatatatatatatatatatatatatatatatacactctcatatatatgtatgtatgtatatgtatg

SEQ ID NO: 52203 - DNA, 95 bp, Homo sapiens; identical to SEQ ID NO: 68

SEQ ID NO: 52204 - DNA, 93 bp, Homo sapiens; identical to SEQ ID NO: 69

SEQ ID NO: 52205 - DNA, 91 bp, Homo sapiens
cgaatttatccaccaccagaagctgcctctttttttcattaataaatcaggaaagatgagagagatctgcagattggttaggaagactttg

SEQ ID NO: 52206 - DNA, 124 bp, Homo sapiens
tgtgcatatgatatttgattttatacatatgtgtatgggtacatatatttatatacgtatatatgtacatttatatatgtgtgtatatataaatatacacatatacatatatattaaatcaaat

SEQ ID NO: 52207 - DNA, 93 bp, Homo sapiens
gtgggtaaggtaacatctcaatgtggttttgatttgcatttcactgatgtttagttatgttgatcatttttcatattcctgttgcctatttgt

SEQ ID NO: 52208 - DNA, 70 bp, Homo sapiens
ttgtcttgagacagagtctcactctgtcactcaggctggagtgcagtggtgtgatctcagctcaccgcaa

SEQ ID NO: 52209 - DNA, 108 bp, Homo sapiens
tattctccatgggaccccaattgcgtctaaacagaagtgagagtctaaagacccataaggggcttctctcactttacgatgtcttatttttccttcctctggttgatg

SEQ ID NO: 52210 - DNA, 114 bp, Homo sapiens
tggtttcatttttttctgtattacctgcagtgctctgaatagatctgcttttaatatatttattgttagaatctaggtacctcaggatacaatattagctaaaaagaaaaatca

SEQ ID NO: 52211 - DNA, 139 bp, Homo sapiens
gtctttgttggtgaatagcagtgctagtccttagtatacattgattttgtatcctaagactttactgaatttgtttatcagatctacaagttttttggatgagtctttagggttttctaaatatacggtcatatcattg

SEQ ID NO: 52212 - DNA, 120 bp, Homo sapiens
gttgtgaactctagtaagtgcctagtaaataccaaaacatccttatgaagtaagtagtattgtttgcatccctagttgaggaatttgaggtagaggcataagttggcacattagtaaaca

SEQ ID NO: 52213 - DNA, 108 bp, Homo sapiens
cttttgcattggaaagaggtaatgaattggagggaggagtaacagaatataaatgtataaacatttttttttctgcttctaaaacttgggtctatccactatcgaaag

SEQ ID NO: 52214 - DNA, 112 bp, Homo sapiens
gaaacaacaaataaacgggccttaaaagcttctgtacagcaggaagaaattcaacagagtgaagagacaacctgctgaatggaagaaaatatttgcaaattattcatccttc

SEQ ID NO: 52215 - DNA, 89 bp, Homo sapiens
tacagacttatgaggatcagatgatcagtggagttttagcttaaatctatttcacagtgagctcagtgcatctctgaacctattctgtg

SEQ ID NO: 52216 - DNA, 113 bp, Homo sapiens
gtatatatacatatgtgtgtccataggtatcttttgttttatatatataatttattatatacctatataaaattcaagagagtcctattgttaacactcattatttcacatac

SEQ ID NO: 52217 - DNA, 111 bp, Homo sapiens
tcgtgtactctgtgctctgaataggttgttacaaagcacccatcaggttatttgtgtctttcactgtcagaccctgagtagctttgggatattctcctatcacatatatga

SEQ ID NO: 52218 - DNA, 86 bp, Homo sapiens
catatatttaccattcgatatcagtggttattagcaggggggcaattttgcctttctgacctccaagtgaggtttggtaatgtgtg

SEQ ID NO: 52219 - DNA, 99 bp, Homo sapiens
tgtatcaagaagctttcattataacaaatatagaagcatttatgacataatatttatgtcatgtatttttttttattatactttaagttttagggtaca

SEQ ID NO: 52220 - DNA, 118 bp, Homo sapiens
ggctgagtagtattccatcatatgtgtatatatatatatgtgtatatatgtatatatgtatacatatgtgtgtgtgtgtatatatatatgtgtatatagttctttgatttatttcatc

SEQ ID NO: 52221 - DNA, 114 bp, Homo sapiens
gcagagcaaatcagaataactttagctcttagaaaatttattattaaaagagaaaatatatatcttttttttttttttttttttttttttttttgagacagagtctcgctctgt

SEQ ID NO: 52222 - DNA, 89 bp, Homo sapiens
cccagctgtccatctctctgtctgtctgcctgtctacaactagcccccaggggcctgggatgggcctgggcagtttggggaaggaaggg

SEQ ID NO: 52223 - DNA, 57 bp, Homo sapiens
tgtgtcactccctgtctgtgtctccagtgttcctgttggcaaatcaggggtgggacg

SEQ ID NO: 52224 - DNA, 84 bp, Homo sapiens
gggcgggggggaggaggagggaggagggaaaagagcggttagggggggcgccgggcgtgtgtcactcgctctctccctctgtgt

SEQ ID NO: 52225 - DNA, 106 bp, Homo sapiens
cagctagtgggcgggctggggtccccaggctagtgtctacagagtctgctccaacggtcagtctctgggtgtctcctgttcctaccatctgtcccccatttgggtg

SEQ ID NO: 52226 - DNA, 111 bp, Homo sapiens
gtaggccacgtcacaggcaggaaaggcaaagtgagcacatcctttcaggaagtttactgaattaatttgtaaggtcagcttgctttctatctgtgttcaccttggctgtac

SEQ ID NO: 52227 - DNA, 73 bp, Homo sapiens
gcatgtgtattactgtatatgtatataacactaatttgtgtgtgtgtatatatatatataactatacatatgt

SEQ ID NO: 52228 - DNA, 106 bp, Homo sapiens
gatgagcaagtctagaaatctcatttacaacatgaggactgtagttagtaaaactgtatggtattggggttctttgttaaataagtaggttttagctgctcttgtc

SEQ ID NO: 52229 - DNA, 72 bp, Homo sapiens
catatatgctaatatatatgtacacatatatatgtgtacatatagatatgtgtacatatatatatatatatg

SEQ ID NO: 52230 - DNA, 75 bp, Homo sapiens
tgtccatcagttaatcaatggatgaagaaatgttttatatatatttatctccattcatcagttaatgaatggata

SEQ ID NO: 52231 - DNA, 96 bp, Homo sapiens
cagcctgggtgacagagcgagaacctatcttaaaaacaaataaaataggataatttttttttttttgagacagagtctccctctgtcaccaggctg

SEQ ID NO: 52232 - DNA, 95 bp, Homo sapiens; identical to SEQ ID NO: 580

SEQ ID NO: 52233 - DNA, 93 bp, Homo sapiens; identical to SEQ ID NO: 69

SEQ ID NO: 52234 - DNA, 82 bp, Homo sapiens
gacagcctgtattctgtttcttttcttttcttttttttttttttttttttttggtgggggcaggggacagagtttctctgtc

SEQ ID NO: 52235 - DNA, 86 bp, Homo sapiens
tggatttccatgtgcagaagaatatatattatgtatatatatatgtacacacatatatacatatatatgcacacaatggaatacta

SEQ ID NO: 52236 - DNA, 90 bp, Homo sapiens
gatcagttccaggtggccagagggtcgagactcatctcacagccgtgcaatagatgcgtgtctctcagtcggtcagctctggctgggatc

SEQ ID NO: 52237 - DNA, 72 bp, Homo sapiens
ggataaaaagaagagtctgagctaactggagaaaacggcaagatgtgtttgttcagattcttgttggcatcc

SEQ ID NO: 52238 - DNA, 69 bp, Homo sapiens
gaagagagtcacagcctcactctgaattaggctctggcctgagggaacgttttggctagttggatcttc

SEQ ID NO: 52239 - DNA, 85 bp, Homo sapiens
aagtaactaaatatctaggttcactaaggggatttaaaaatgtattttttaaatatcctttgtgcaaccctattgtaccatgctt

SEQ ID NO: 52240 - DNA, 68 bp, Homo sapiens
gagtgatagatcaggaccctgtcttttatttatttatttatttgatacagagtctcgctctgtcactc

SEQ ID NO: 52241 - DNA, 104 bp, Homo sapiens
actggatcactgtgtattgtgtattgtgagggtttgcagataatttatctttttaaattataggtctttggactatcataagccacatgggggtggggtggtct

SEQ ID NO: 52242 - DNA, 92 bp, Homo sapiens
gcaggataaactttcagttgattaaaagacatcaaggcaaacagactaagggtatgttttttgtttttttttcagatgaagtttcactctgt

SEQ ID NO: 52243 - DNA, 57 bp, Homo sapiens
gagtgagaagtccggactctgctaaattctcagtggatgttcttatttctctggctc

SEQ ID NO: 52244 - DNA, 123 bp, Homo sapiens
catatatgtatatatatacacacacacgtatatatgtatatatgtacatatatacgtacatatgtatatatacatatatatgagactaacatatatacgtatatatatgtgtatatatatatg

SEQ ID NO: 52245 - DNA, 154 bp, Homo sapiens
atatatatatacacatatatatacgtatatatgttagtctcatatatatgtatatatacatatgtacgtatatatgtacatatatacatatatacgtgtgtgtgtatatatatacatatatgtgtgtgtgtgtgtgtgtgtgtatatatatatg

SEQ ID NO: 52246 - DNA, 96 bp, Homo sapiens
gccatcccacagcttatacttagaagaaaaatggactctttaaagtaaagcttgttaattgagtttttctttttctgagggttgtgcttacatggt

SEQ ID NO: 52247 - DNA, 73 bp, Homo sapiens
gttgttgttgagatggtctctcgctctgtcacccaggctggagtatagtggcatgatcttggctcactgcagc

SEQ ID NO: 52248 - DNA, 89 bp, Homo sapiens
ctcacatgttgtgacagtgtggtaagctggttttgtgtgtggcatgccaaaacagggtttggctgacatggggtgcacagcaatgtggg

SEQ ID NO: 52249 - DNA, 86 bp, Homo sapiens
gaataagcgttctctgtatctcactgtcattgctggaatgagcactttaaatgctcatggttgattactgagggagagacgttttc

SEQ ID NO: 52250 - DNA, 77 bp, Homo sapiens
gtttgggaaaggtcactctctctcgctctctttttttttttttttttttgagacagggtctgctctgtcgcccaggc

SEQ ID NO: 52251 - DNA, 101 bp, Homo sapiens
tgcccattggcctaactaaacagttggtgtttgggtaactcctttttttttttttttgagatggagtcactctgtcgctcaggctggagtgcagtggtgcg

SEQ ID NO: 52252 - DNA, 76 bp, Homo sapiens
tatatatatgtatatgtgtatatatatgtatatgtgtatatatatatgtatatgtgtgtatatgtacatatatgca

SEQ ID NO: 52253 - DNA, 72 bp, Homo sapiens
ttgtttttgagaccgagtctcactctctgtaaccaggctggagtacagttgtgcgatctcggctcactgcaa

SEQ ID NO: 52254 - DNA, 80 bp, Homo sapiens
ctgaggcccacagaagtgacagaagtccaagagaggcagagcctggtggattcagtgtcatgtttggagggagaaatcgg

SEQ ID NO: 52255 - DNA, 82 bp, Homo sapiens
gaatatatatatacatatatattctgcttgaatatatatatacatatatattctgcttgaatatatatatacatatatattc

SEQ ID NO: 52256 - DNA, 82 bp, Homo sapiens; identical to SEQ ID NO: 52255

SEQ ID NO: 52257 - DNA, 96 bp, Homo sapiens
gtgggtacaaattccatctaatagtgtcagctaaagttcagttaactgttaccactaacaatgagttagctgttgcttccaggatgtctgtttcac

SEQ ID NO: 52258 - DNA, 74 bp, Homo sapiens
ccctgaggcagggactgtgtctgtctcattcactgctgtgtgccagggcatggcacagggcctggcacccaggg

SEQ ID NO: 52259 - DNA, 103 bp, Homo sapiens
tcatgcaaatcaatattttgttcatttttattgctaagtagcatactactatatgattatatatttatgcattctattgatggacatttgggttgtttcatgg

SEQ ID NO: 52260 - DNA, 60 bp, Homo sapiens
tgagacagagtctcactctttgtcacccaggctggagtgcaatggtgcgatcttggctca

SEQ ID NO: 52261 - DNA, 109 bp, Homo sapiens
tctttttaattttaatttttgtgggtacatagtaggtatatatatatttatggggtacatgagatgttttgatacaggcatgtaattcataataattacatcatgtaga

SEQ ID NO: 52262 - DNA, 76 bp, Homo sapiens
atgtatgtatttgtgcatttgtatatatatatgtgtgtgattatatgtatgtatacacacatactgtacagtatat

SEQ ID NO: 52263 - DNA, 89 bp, Homo sapiens
ctatttacacagtatgtatatttcattatatggatttgtatttctgtaacaatgcatcctaggggaagtttacaaatgaaggtagatgg

SEQ ID NO: 52264 - DNA, 115 bp, Homo sapiens
ggttgttcagaagtaaaatgctttagtttcagttatatagattttaataagatactactttctatataatttatcaggcactttaggcattttaatttgcaaatttaggacaatt

SEQ ID NO: 52265 - DNA, 87 bp, Homo sapiens
ctttctgattcggccctcaggagtcatttagctttgttatgttgattcaatgcagtagactgatgacagtgaggaagagtttgatag

SEQ ID NO: 52266 - DNA, 109 bp, Homo sapiens
gcaatgagattacagacatgagccaccgcgtgcccggccttttttctttgacacagagtctctggcacacaggctggagtgcagtggcacagctcactgcaacctctgc

SEQ ID NO: 52267 - DNA, 112 bp, Homo sapiens
tacaaaggcctttgtctaggtgctcccaggaagacctgtcttcttttcttttcttttttttttcttttcagataggatctctccctgtcacccaggctggagtgccgtggtg

SEQ ID NO: 52268 - DNA, 71 bp, Homo sapiens
gagaagcagagagttgagagagtcatcagaacttgggagatccctgagaagctgtccacctctactttttg

SEQ ID NO: 52269 - DNA, 112 bp, Homo sapiens
tttgtgtttattattgagcgctctcattttgctcactggtctgtgtttctctgtgtatgccagtaacatatggattggttaactagggattttcgtttaattcgaactcagg

SEQ ID NO: 52270 - DNA, 95 bp, Homo sapiens; identical to SEQ ID NO: 68

SEQ ID NO: 52271 - DNA, 93 bp, Homo sapiens; identical to SEQ ID NO: 69

SEQ ID NO: 52272 - DNA, 101 bp, Homo sapiens; identical to SEQ ID NO: 48144

SEQ ID NO: 52273 - DNA, 128 bp, Homo sapiens; identical to SEQ ID NO: 48143

SEQ ID NO: 52274 - DNA, 93 bp, Homo sapiens
ctctgtctcaaaaaacaaaacaaaacaaaaagatagagtagtaggttagcaaaattttacattctatctttttttgttgtttttgagatggag

SEQ ID NO: 52275 - DNA, 82 bp, Homo sapiens
ccctcgtaacagtcttttgaatcctatgtgagggaaaaacattcagaccctcatagtagtgttctggaatcttatttgaggg

SEQ ID NO: 52276 - DNA, 106 bp, Homo sapiens
tagtgccttggagtgccatttgaaatctgtatgtcaaccattattattaattattatcttatttcatacaagatttttgaagtttggccctcactttcaaagccta

SEQ ID NO: 52277 - DNA, 82 bp, Homo sapiens; identical to SEQ ID NO: 48135

SEQ ID NO: 52278 - DNA, 94 bp, Homo sapiens
acaagggttttctgagaaaatctttctttttttttcggatgaagatagtgggctttactcgaaaagaatggagggatctattagcaaaaattgt

SEQ ID NO: 52279 - DNA, 75 bp, Homo sapiens
gttcttttaattgtgatgttagggtgttttttcttttgttgagacagtctcactctgtcatccaggctggagtgc

SEQ ID NO: 52280 - DNA, 77 bp, Homo sapiens
gaatactatttcattgtgtgtgtgtgtgtatatatatataatgatatatatatacaatgaaatacgattgtgtattt

SEQ ID NO: 52281 - DNA, 126 bp, Homo sapiens
atatgtattataatatgtatgttataatacatatacatatgtattataatatgtatattataatacatatacatgtatatatgtataatacatatacatgtatatatgtattatacatatacatgt

SEQ ID NO: 52282 - DNA, 100 bp, Homo sapiens
atatatgtatataaacacacacataaatatatgtatatacatatgtctatgcatataatatatacatatgtctatgcatataaaatacatatacatatgt

SEQ ID NO: 52283 - DNA, 82 bp, Homo sapiens
acatccatactccaggcttctgatgcttactaaagaactatggtgatttcagtaggcttgtgaatctcggaggaaatggtgt

SEQ ID NO: 52284 - DNA, 118 bp, Homo sapiens
cctgggaacagtacactgccagcaccagggagccagatcggagcctccctggtagcctgtgagctggacccaggcagtggcacctcgaccctcctgctgggaccctcctgctgtgcag

SEQ ID NO: 52285 - DNA, 108 bp, Homo sapiens
tgatttgtgttgatactgatcactatgtcccaataagtataatttaatctttttaatttattatttatgacttgagtgactgctatcaatctagaacaacacacaaat

SEQ ID NO: 52286 - DNA, 79 bp, Homo sapiens; identical to SEQ ID NO: 42851

SEQ ID NO: 52287 - DNA, 102 bp, Homo sapiens
ttgagatggagtctcgctgtatcccccaggctggagttcagtggtatgatctcagttcactgcaacctccaccttctggttcatgcatttctcctccctcag

SEQ ID NO: 52288 - DNA, 106 bp, Homo sapiens; identical to SEQ ID NO: 48122

SEQ ID NO: 52289 - DNA, 76 bp, Homo sapiens
gccacaactttgttctctggctcctcgaggtttggagtccactgcactgaggggaccaaagtgcggcagctgtggc

SEQ ID NO: 52290 - DNA, 120 bp, Homo sapiens
gttcttttcctattcattaaaagccattcacaaataaacaggaagagagagacacacactctgagtttgacacttgctcttttttattaggtatttggaatccaggtgaatgtgaagaac

SEQ ID NO: 52291 - DNA, 66 bp, Homo sapiens
ctcgggagaaacaagttctggattcagctgaactgagtttaagttcaggctctgtgactcactggg

SEQ ID NO: 52292 - DNA, 101 bp, Homo sapiens
ctcagatgtttctcttttaatgttttgaatagcatgaagttttcagtataaaatttttatatttgtcagggattcaaagcactgaattttgagactctaag

SEQ ID NO: 52293 - DNA, 115 bp, Homo sapiens
gagccaggctggtgccaaagctgaggcagtgtcagggcatgttcagggcggggctggggccagaaccgagccagggcacggccaaggcagggtaaggcagggcaatggcatggcc

SEQ ID NO: 52294 - DNA, 117 bp, Homo sapiens; identical to SEQ ID NO: 48115

SEQ ID NO: 52295 - DNA, 140 bp, Homo sapiens
ctgttctgttatggtggagagttgttgtttgtttttttgttttttttttttttgagagagagactctcgctctgtcgcccaggctggagtgcagtggtgtgatctcggctcactgcaagctctgcctcccacgttcatgc

SEQ ID NO: 52296 - DNA, 102 bp, Homo sapiens
atgtgtgccataaagatgaataaataatccttactgagtgctttgaatctctgaaaagagagcgagcatacaattgttagacatctttacacctgccctcat

SEQ ID NO: 52297 - DNA, 109 bp, Homo sapiens
agtacttatttgggttaagatagctttaacccagtcattattttttaaatttttatttattgatttattttatagaggcagggtcttgctatgttacccagtctggtct

SEQ ID NO: 52298 - DNA, 79 bp, Homo sapiens
ccagttgtgccttcctgcctgcctgcctgcctgcccaagtcgatgcagggcaaatggcgggccgcagccaggagcctgg

SEQ ID NO: 52299 - DNA, 77 bp, Homo sapiens
gtgtgctcctgatgtctctctctgtgtgtccaaacatcatcttataaggacaccagtaggaacggattaggtcctac

SEQ ID NO: 52300 - DNA, 125 bp, Homo sapiens
tatatatatatgtgtgtgtatatatatgtgtgtatatatatacatatatacatatgtatgtatatatacatatatacatatatacatatgtatgtatatatacatatatacatatatacatacgt

SEQ ID NO: 52301 - DNA, 98 bp, Homo sapiens
atcatttttatctaaattatctggagaattgaataaatatttttttaaggctgtctgtagaagaaaattatgtcaatttttcatttagctagagaggt

SEQ ID NO: 52302 - DNA, 67 bp, Homo sapiens
acagagactggagaacatcaggatctcaggccacagcctcaagtctctctcattctctctctgtctc

SEQ ID NO: 52303 - DNA, 97 bp, Homo sapiens
ggtttcagtattatctcacatatgagaagaagctaatgggtatggagcttgtgctaatattttattatttcaactctagaagatcatgtactcaacc

SEQ ID NO: 52304 - DNA, 109 bp, Homo sapiens
tttggttcaacagtactgaattcaaaatgttaatgatagagacagattgagctggaaagagtattttattttcttaacaaatttgactttcacgtgcagttcaactaga

SEQ ID NO: 52305 - DNA, 128 bp, Homo sapiens; identical to SEQ ID NO: 12949

SEQ ID NO: 52306 - DNA, 95 bp, Homo sapiens; identical to SEQ ID NO: 12950

SEQ ID NO: 52307 - DNA, 93 bp, Homo sapiens; identical to SEQ ID NO: 12951

SEQ ID NO: 52308 - DNA, 95 bp, Homo sapiens; identical to SEQ ID NO: 68

SEQ ID NO: 52309 - DNA, 93 bp, Homo sapiens; identical to SEQ ID NO: 69

SEQ ID NO: 52310 - DNA, 116 bp, Homo sapiens
tccagctttgttgtttttgcttaggattgtcttggctatgtgggctcttttttggttccatatgaaatgtaaagtagctttttctaattctgtgaagaaatgcaatgatagcttga

SEQ ID NO: 52311 - DNA, 112 bp, Homo sapiens
acagagtgagaccctgtctcaaacacacacacacacacacacacacacacacacacacacacacatatataatagatgtgtgagtgtgtggtttagcacagggcttgcatgt

SEQ ID NO: 52312 - DNA, 105 bp, Homo sapiens
tattgattggtccaagatggacacttgaccactctgagtcagtcaaattctctctcaaagaaccgatactcagagtcatctagtttctaaaaatggctggagatg

SEQ ID NO: 52313 - DNA, 110 bp, Homo sapiens
ggaacgacagacaccaggggtcaacttgagggtggaacgagagaagagggtgaggactgacaaactccctgttgagtactatgctgattacctgggtggcaaaatattct

SEQ ID NO: 52314 - DNA, 93 bp, Homo sapiens
gcatttatctaaagctcttgtgacatgatggtattcagggttgtcatatctttatacctgagtcactgtatgccacaggttgtggaacccagc

SEQ ID NO: 52315 - DNA, 94 bp, Homo sapiens
tagctgggttagtatggggaatgaatttagtattcacatggatagataacacatgtgcttttctaggtgtttcactatcatttagctttagcta

SEQ ID NO: 52316 - DNA, 96 bp, Homo sapiens
tacacttcaatatcattcaaatgtttgtgtatatgtatatgtgtgtgtctgtgtgtatatatgtatataaaccctgtgtgtgtgtgtgtgtgtgtg

SEQ ID NO: 52317 - DNA, 88 bp, Homo sapiens
gcattttccagtctctctccaactctgactctcatgcctttctctaataagagcccttgtgattagagtggatgtacttggataatcc

SEQ ID NO: 52318 - DNA, 98 bp, Homo sapiens
gaagtcagagggacacagagaagaatctgagcaaacaggccttgctaagatggggtttgttaccattagatcataccttgttagtccaattacacttc

SEQ ID NO: 52319 - DNA, 75 bp, Homo sapiens
gggtctcacactgtcactcaggctgagttgccatgacacaatcatggctcactgccgctgtgacctcctgggctc

SEQ ID NO: 52320 - DNA, 75 bp, Homo sapiens
gacagagtgaaaacatcaattttagagttttatagactagtgttggaatactgattttgctgttgactacctgtc

SEQ ID NO: 52321 - DNA, 87 bp, Homo sapiens
tcagttgaaggccttgagagtagagactgaggtttcccaaagtagaagaattctgtctccagattgtcacaaggaaattctgcctga

SEQ ID NO: 52322 - DNA, 82 bp, Homo sapiens
atatatatatatatatatacacacacatatatatatatatgtgcatatatgtgtatatatgtgtgtgtgtatatatatatat

SEQ ID NO: 52323 - DNA, 117 bp, Homo sapiens
aactttagaataattttattcagctatacttttgatgagaactatgcaaaatgtatctatttaatttgagcaggattgtcatcttgacagtattgagtatttctgtctagagttctg

SEQ ID NO: 52324 - DNA, 99 bp, Homo sapiens
gataatggcttaaataatcttttggctgctggcaacattagcctgtctttaggttagacatcaaccccacagctagtcaggattatttttgtcctattc

SEQ ID NO: 52325 - DNA, 80 bp, Homo sapiens
atacaagacacaataaagcatatcaatgatatgatatattactatataaagtacaattgtgtgtgtgtgtgtctgtgtgt

SEQ ID NO: 52326 - DNA, 58 bp, Homo sapiens
tgagacggagtctcactctgtcaccctggctggagtgcagtggtgtgatctcagctca

SEQ ID NO: 52327 - DNA, 59 bp, Homo sapiens
gtctgactggtgtccttgtaagaagagattctgacacacaaaagagacatcagaggggc

SEQ ID NO: 52328 - DNA, 110 bp, Homo sapiens
tgcttaggattgtcttggctatatgggctctttattggctccatatgaaatttaaagtagttttttctaattctgtgaagaaagccaatggtagcttgatgggaatagca

SEQ ID NO: 52329 - DNA, 122 bp, Homo sapiens
catctgttgacataatcatgtgtttttcatcattgatttgcatatgttgaaccagccttgtatgccaaggatgaagccaacttgattgtggtggatgagctttttgatgtgctgctggattc

SEQ ID NO: 52330 - DNA, 108 bp, Homo sapiens
atgtcttcatttatttgcaaaacaagggcaggaaaaactagaattaaatcgttaattctctctcggtctctcagggcaatatgttgggcagttacttgagtgagatat

SEQ ID NO: 52331 - DNA, 102 bp, Homo sapiens
tcttttatgtggaattatttatgagtgatagtggtattttgttttcttccttacaatgtctttatttttagatatcactattatacttgtttcatagaagga

SEQ ID NO: 52332 - DNA, 146 bp, Homo sapiens
atatgtatatgctaggtgtgtgtgtgtgtatatatatgttatatatatgttatatatgttatatattatatatatgttatatatatgttatatatatgttttatatatatatgttaggtgcatatatgtatatatatgtgtatata

SEQ ID NO: 52333 - DNA, 117 bp, Homo sapiens
ggcccatgcaagatgttgcccattggcataaacccgtagatccgatcttgtggtgaagtggaccgcacaagctcgcttctatgggtctgtgtcagtgtggtaatctgacaaaatgct

SEQ ID NO: 52334 - DNA, 113 bp, Homo sapiens
ttggaagctgtgtgcatccgggttgaggtagtaggttgtatggtttagagttacaccctgggagttaactgtacaaccttctagctttccttggagcacacttgagccgtcga

SEQ ID NO: 52335 - DNA, 103 bp, Homo sapiens
ggctcaagtgtgctccaaggaaagctagaaggttgtacagttaactcccagggtgtaactctaaaccatacaacctactacctcaacccggatgcacacagct

SEQ ID NO: 52336 - DNA, 79 bp, Homo sapiens
actagaaggcatggttttcacattatctcaacacatctgctcagtggatgagtagtggatgatatggaggttgtctggt

SEQ ID NO: 52337 - DNA, 98 bp, Homo sapiens
ctgtaaagtgaaagtatacgcccatataccttggaaaaatttgtttagtttttaatttttatgggtacatagtaggtatatatatttatggattacag

SEQ ID NO: 52338 - DNA, 102 bp, Homo sapiens
gcatcaaaccagacttttcctagtccctgagaccctaacttgtgaggtattttagtaacatcacaagtcaggctcttgggacctaggcggaggggaaccagc

SEQ ID NO: 52339 - DNA, 97 bp, Homo sapiens
tgtggtatgagtagaaagactgtcacgttatgtggatcataaattaatatattttttagggtgaaccccacatagaagagaaagtcgcagggccaca

SEQ ID NO: 52340 - DNA, 128 bp, Homo sapiens
ttcttgtgtttagttgtgaggtaaaggtcaagttctctgtatggatgtatgtatatatgtatactactttgtatattgatgtccatttcctcatgtaccacttgttgaaaatattacctttattttat

SEQ ID NO: 52341 - DNA, 117 bp, Homo sapiens
ggacttccaggactatgttgaataggagtggtgagagtgggcattcttgtgttgttccagttcttcgagagaatgcttacagcttttcccatttgttatgatgttggctgtgggttt

SEQ ID NO: 52342 - DNA, 103 bp, Homo sapiens
tgtatatgtgtatatatatacacccatatatacatatacactgtatatgtatatatatacatatacatatgtatgtgtatatatgtatatatatacatataca

SEQ ID NO: 52343 - DNA, 85 bp, Homo sapiens
atatactgtatatgtatatatatacatatatacacatacatatgtatatgtatatatatacatatacagtgtatatgtatatatg

SEQ ID NO: 52344 - DNA, 159 bp, Homo sapiens
atgtatacatatacagtatatatgtgtatatatacatatacagtgtatatatgtatatatatacatatatacagtgtatatgtatatatatacatatatacagtgtatatgtatatatacatatatatactgtatatgtatatatacacatatatacac

SEQ ID NO: 52345 - DNA, 95 bp, Homo sapiens; identical to SEQ ID NO: 68

SEQ ID NO: 52346 - DNA, 93 bp, Homo sapiens; identical to SEQ ID NO: 69

SEQ ID NO: 52347 - DNA, 58 bp, Homo sapiens; identical to SEQ ID NO: 1847

SEQ ID NO: 52348 - DNA, 97 bp, Homo sapiens
gttaatcacttttgttgttgaaaaaggagaaaatcttatggcctcattcagcatagtttttatttttattcctgttttggataatatcagtgttaat

SEQ ID NO: 52349 - DNA, 65 bp, Homo sapiens
atattgatatgtacatatagatgtatataagatatgtaatacatgtatatgtatataataaatgt

SEQ ID NO: 52350 - DNA, 103 bp, Homo sapiens
actgtctgtatacattttacttttactttttttctttttgtgttagctaggacttctagcacaatgttaaagagaagctgttccaagtggaaatgcatctggt

SEQ ID NO: 52351 - DNA, 92 bp, Homo sapiens
ttctgcttctaagtgggtctcccctgtggaattgtacatgagtttttgatttcagaagttacagggcagagaagagattgcatttagcagag

SEQ ID NO: 52352 - DNA, 78 bp, Homo sapiens
tatatatatatacacacatatatatgtgtatatatatatatatatacacacacgtatatatgtgtgtatatatatata

SEQ ID NO: 52353 - DNA, 113 bp, Homo sapiens
gatgacaggaagattctggagttctgattcatttcataattttgctcaaaatgtttatttgtttatttgtattattgtgggtaagggcagttatcagacacattttcttaatc

SEQ ID NO: 52354 - DNA, 75 bp, Homo sapiens
ggagccagtctgacactcggtgactcagtgtaggcttcccagctttctctgtcttcaacctcagtttctgcatcc

SEQ ID NO: 52355 - DNA, 62 bp, Homo sapiens
caggtgtagtggctcatgcctacaatcccagcactttgggattgtagtctgagaccagcctg

SEQ ID NO: 52356 - DNA, 85 bp, Homo sapiens
ggcatttagcccatttacatttaaggttaatattgttatgtgtgaatttgatcttgtcactatgatgttagctggttattttgcc

SEQ ID NO: 52357 - DNA, 58 bp, Homo sapiens
tgagttggagtctcactctgtcacccaggctggagtgcagtggtgagatctcagctca

SEQ ID NO: 52358 - DNA, 117 bp, Homo sapiens
attctcacattctttttgaatagaagcacattcaaagaagattgattattttgaagattttcaatttattatcattttgaaggtgatttggtttatagagttctataatgtaagaat

SEQ ID NO: 52359 - DNA, 119 bp, Homo sapiens
gttgcagaacttggtttgctagtatgctgttgaggatttttgcgcctatgttcatcagtgatattgatgtatagttttcttttcttgatgagtctttggttttggtatcagggtaatgc

SEQ ID NO: 52360 - DNA, 88 bp, Homo sapiens
ggtagaatcaggctgtgaatccatctggttctgggctttttttttttttttttttttggttgctaggttatttattactgattcaact

SEQ ID NO: 52361 - DNA, 115 bp, Homo sapiens
gccttttgagtagctgggactacagatgtgcatcaccatgtccagctaatttttctatttttttgtagagatggggttttgctatgtttcccagactggtctcaaactcctaggc

SEQ ID NO: 52362 - DNA, 95 bp, Homo sapiens; identical to SEQ ID NO: 68

SEQ ID NO: 52363 - DNA, 93 bp, Homo sapiens; identical to SEQ ID NO: 69

SEQ ID NO: 52364 - DNA, 85 bp, Homo sapiens
tgtctttcattggctaacatcttccctttcttctcatatcccaaataagaggagacagtgcagaacctgggtcatgtgaaaggga

SEQ ID NO: 52365 - DNA, 78 bp, Homo sapiens
ctgctttctatcaccttagagccaaccttttaaaatttttttgatacaaggtcttatgttgctcaggatggagtgcag

SEQ ID NO: 52366 - DNA, 97 bp, Homo sapiens
agcacataccaaagtatatgtgtgtatgtatatgtgtgtatatatatatacacacattattatacacacatatatattcaaattatttagatgtgtt

SEQ ID NO: 52367 - DNA, 104 bp, Homo sapiens
gtagcattttaggtggcacatggttcaggggtttgggtgaaactttttctttttttggaaaaacagaaaaataaatgtcagactaggttatctgactgttgcca

SEQ ID NO: 52368 - DNA, 90 bp, Homo sapiens
tctcagcactttgggaggctgaggtaggaggatcacttgaggccaggagttcaagaccagccagggccaacatagttgagaccctatctc

SEQ ID NO: 52369 - DNA, 65 bp, Homo sapiens
gtgatttccttgggctcacataggtgccatctttttttcaggctgcctctgtgcctgtagttcac

SEQ ID NO: 52370 - DNA, 77 bp, Homo sapiens
gtattcctgcagtcattctggagcaaaagttcgtgatgcaagcctccacatgctgctctgtctgtctgagtgggtgc

SEQ ID NO: 52371 - DNA, 58 bp, Homo sapiens
tgagacagagtctcacactgtcacccaggctggagtgtagtggtgcgatcttggctca

SEQ ID NO: 52372 - DNA, 73 bp, Homo sapiens
gggcagctctgcctacatggctctgcaaggtacagcccctgaggctgctttcatgagctggctttgagtgcct

SEQ ID NO: 52373 - DNA, 96 bp, Homo sapiens
tcctcctgagaaaagctagctcagaaaattatacatgcaaatcttgataccaaagaccatgtctctctctctcggactctttcttctcaaggagga

SEQ ID NO: 52374 - DNA, 81 bp, Homo sapiens
gcatgtgggaggttctctgtgtgtcagtctgaaaatggtcccatcatttctgcttgccatttacgagaactctcacatagc

SEQ ID NO: 52375 - DNA, 75 bp, Homo sapiens
gattagctgcagtcagtagagagtgagatctatcggagtaaatacatctgactgtatactgctagtgaggtagtc

SEQ ID NO: 52376 - DNA, 82 bp, Homo sapiens
acacagacatacacacatatgtgtatgcatatatgtatatgtatgcatatatgtgtatatgtatgtatatgtatatctgtgt

SEQ ID NO: 52377 - DNA, 83 bp, Homo sapiens
tcgttttggcattttcatgttcagcacgtgcacgcatgtgtgcgtgtgtgtgtgtgactgtgtgcttgtttctatgtatatga

SEQ ID NO: 52378 - DNA, 113 bp, Homo sapiens
gtaactgtccagccactggagataaagtagttaacaagactagttcttttttttttttttttttttttttagatggagttttgctcttgttgcccaggctggagtgcagtgac

SEQ ID NO: 52379 - DNA, 107 bp, Homo sapiens
gcattccctctaagaactggaacaagagaagatgcccactttcaccctcttttttttttttttctttttgagatggagtttctctcttcttgcccaggctggagtgc

SEQ ID NO: 52380 - DNA, 76 bp, Homo sapiens
tctgggccacagtgattccaacatgcagagaaggatgatctttctctcaatgtgactcactcagagatgtcccaga

SEQ ID NO: 52381 - DNA, 115 bp, Homo sapiens
ctttttgttttgaggaagatatagctaggaccaaaattctagtaggttctatactttgttactaaatgggtactgggttattatctttttaaattttatattacaaaatatttgg

SEQ ID NO: 52382 - DNA, 69 bp, Homo sapiens
gggaacccagagacagaagagccaccgcagaaatgccaccctctgtcgctctgactggactttggtccc

SEQ ID NO: 52383 - DNA, 224 bp, Homo sapiens
tatatatgtatataatatatatgtataatatatatgtatatatgttatatataatatatgtgtgtatatatgtatatgtgtgtatatatgtatgtatattatatatgtatgtatattgtatatgtatgtatatatacattgtatatgtgtatatatatgtattgtacctataatataatacatatatatgtataatacatatatatgtatacatatatattatg

SEQ ID NO: 52384 - DNA, 144 bp, Homo sapiens
attatgtataatatatattatatataaatacatatatgtataatatatatttacatatatgtatatattacatatatatgtatacataatatatatgtatacatatatatgtattatacatatatatgtattatattataggta

SEQ ID NO: 52385 - DNA, 113 bp, Homo sapiens
tgtctattcagataatttgcctatttttaaagtcggaatatatgtttttatttcttgtcgatttgtttgagctctttatatattctggttaatatgtgcttgtcaaatggata

SEQ ID NO: 52386 - DNA, 58 bp, Homo sapiens
tgagacggtgtctcgctctgtcgctcaggctggagtgcagtggcgtgatcttagctca

SEQ ID NO: 52387 - DNA, 105 bp, Homo sapiens
cttagaagaggccctgatagaactataaactgggacatttcaacagtagtcaataaattgttggaggctcagtgtagactagcttgagaataaaaaacttctggg

SEQ ID NO: 52388 - DNA, 87 bp, Homo sapiens
tcattctcaataaggaatgaagggaagtgttgatatgtcctttatttttttttttaacattaatcctgtcacctaaatgagtgatga

SEQ ID NO: 52389 - DNA, 93 bp, Homo sapiens
tatatacatatattcctagaatatatatgtgtatatatatattcctagaatatatatgtgtatatatatattcctagaatatatatgtgtata

SEQ ID NO: 52390 - DNA, 64 bp, Homo sapiens
tggagactatcttgctctgtctctgtgtgtatacatatatagagaggatgctctgataccttca

SEQ ID NO: 52391 - DNA, 59 bp, Homo sapiens
tacatatatgtgtgtgtgtgtgtatatatgtatatatatacacagatatatatatgtat

SEQ ID NO: 52392 - DNA, 91 bp, Homo sapiens
gccttcaggaaattctatttcattctttaagtattgaaaaactaaatgatttatgaactcactttttgaagagtgtatttttcctttgggc

SEQ ID NO: 52393 - DNA, 116 bp, Homo sapiens
tattaattattggttcaaattctataggatatagaggccaatttagattttatttttctatttgtgtgagttttggcagtctgcgtccattggtaacaaaccttttttatttgata

SEQ ID NO: 52394 - DNA, 71 bp, Homo sapiens
aagaaaagacaggagacggggcttaaaagaacacatttctcacgctctgtctctcttaatagtcttttctt

SEQ ID NO: 52395 - DNA, 68 bp, Homo sapiens
gagtgagttctcaggagagctgatggttttaaagtgtggcactttctttctctcttgctctctctctc

SEQ ID NO: 52396 - DNA, 114 bp, Homo sapiens
tgtgtgtgtaaatatataaaatatgattttatacattcaacatatatatttaatgtatattttgtgcatatatattgaatgtgtatatatatatagtgtgtgtgtatatatata

SEQ ID NO: 52397 - DNA, 68 bp, Homo sapiens
cttgtccctgaatctgccatctcttcacggacctggtttctttgttagagatggtattagataccaag

SEQ ID NO: 52398 - DNA, 97 bp, Homo sapiens
gcacagtgcatatacagatgcactgtatatgtggatctggatctggatgtcacatataaggatctggatatcacatatgtatcgatatggacatggc

SEQ ID NO: 52399 - DNA, 79 bp, Homo sapiens
atatatatatatatatatacacatataggtctatatatatgtctctctatatgtctatatgtctatatatatgtctatg

SEQ ID NO: 52400 - DNA, 294 bp, Homo sapiens
tatatatgtctatatatgtctatatatatgtctatatatatgtctatatatatgtctatatatatgtctatatatatatgtctatatatatgtctatatatatatgtctatatatatgtctatatatatatgtctatatatatgtctatatatatatgtctatatatatgtctatatatatatgtctatatatatgtctatatatatgtctatatatatgtctatatatatatgtctatatatatgtctatatatatatgtctatatatatgtctatatatatatatatattta

SEQ ID NO: 52401 - DNA, 58 bp, Homo sapiens; identical to SEQ ID NO: 3818

SEQ ID NO: 52402 - DNA, 73 bp, Homo sapiens
gggtatctggcagaagagatttctttctttctttctttctttttttttgagacagagtctcgctctgtcaccc

SEQ ID NO: 52403 - DNA, 85 bp, Homo sapiens
ggcaattttgtccccctcttcatagagggcagtgtttggaaacattatttttattgttatgactggagtgaggaagggatttgct

SEQ ID NO: 52404 - DNA, 133 bp, Homo sapiens
tcttagtattgacttctgtttttattgtgctgtggtctgagcgggtgattggtgttatttattttttttaatttgctgagaattgtttcatggccaattgtgtggtcgattttagagtatgtactatgtgaac

SEQ ID NO: 52405 - DNA, 96 bp, Homo sapiens
gatatctttgggatttttttttttttttacataatcttttcttttgccatttgaaaggcatttggcgaccaaaaggaagcaaaacatcccattgtc

SEQ ID NO: 52406 - DNA, 56 bp, Homo sapiens; identical to SEQ ID NO: 11717

SEQ ID NO: 52407 - DNA, 67 bp, Homo sapiens
tgtatgtatatatatatgtgtgtgtgtatatacatacacacatactgaaatatactatatattatac

SEQ ID NO: 52408 - DNA, 133 bp, Homo sapiens
atatgagatatatatttgtatatgtgtgtgtacaatttatatatatatataaatttgtatattatgtaatatataattatatagtatatattatataattatattatatattatactatattatatattatat

SEQ ID NO: 52409 - DNA, 88 bp, Homo sapiens
gggagctagaaacaaaatggagttgtttgggtcagatctctttcactgtctcagtcacaattttgcaattactgttttgaaagcttcc

SEQ ID NO: 52410 - DNA, 70 bp, Homo sapiens
tcaagagaggagagagacattcctgaaagcacgtatagagtgactattcaagcttcactcttccttttga

SEQ ID NO: 52411 - DNA, 58 bp, Homo sapiens; identical to SEQ ID NO: 1847

SEQ ID NO: 52412 - DNA, 116 bp, Homo sapiens
tagctggcgtgcctggctgtgcacagtggctggtccctgcgcacactcactcacacaccacttgctgctccacgcctggcttgcccttggcaggcatgggatctgggccaagagtg

SEQ ID NO: 52413 - DNA, 164 bp, Homo sapiens
atattaatatttaaatagtaaaatactatatatgtgtatatgtgtgtgtgagtatatatatatataccactgccatatatatattttatatataattatatattaatgatattaatatatatatatatatatatggcagtgagtgtgtgtatttgtgtgtgtgt

SEQ ID NO: 52414 - DNA, 93 bp, Homo sapiens
acatatatatgtaaatgtgtacacatgcatataggtatgcatatatatatgtgtgtgtgtgtgtatatatatatatatgcatatgtaagccta

SEQ ID NO: 52415 - DNA, 80 bp, Homo sapiens
tagtgggattactggatcatatgggacttctctttttgattttttgaggagcctgcatactgctttccataatagtacta

SEQ ID NO: 52416 - DNA, 90 bp, Homo sapiens
tagagataaaattttttatctaatatgtatacctagatatttttatctaacatatatatctagatatatatatagatattttatctacta

SEQ ID NO: 52417 - DNA, 85 bp, Homo sapiens
atgctattatatagaattatatgtgtgtatatatatgtgtgtatatatagatagatacatgcatatataatttatattttattat

SEQ ID NO: 52418 - DNA, 152 bp, Homo sapiens
atgtggcatatatctatatatatatatgtgtatatatctatgtatgtgtgtgtgtatatatatatatagtgtgtgtatatatatatgtataaacataccattgaatacagtataaatttgtaaagaaatgtggcatatatatatatacacac

SEQ ID NO: 52419 - DNA, 88 bp, Homo sapiens
cctttctctgacaccttctggaatagcttaataatcaaatttttgaatttttaaaatttggtgtttcaaaaggtttgtctgggtttgg

SEQ ID NO: 52420 - DNA, 103 bp, Homo sapiens
cactcctcatcttacttgaaacagataattgattcttccttcttgatagcatttttttttttttttttgagatggagtctcactctgtcaccaggctggagtg

SEQ ID NO: 52421 - DNA, 95 bp, Homo sapiens; identical to SEQ ID NO: 68

SEQ ID NO: 52422 - DNA, 93 bp, Homo sapiens; identical to SEQ ID NO: 69

SEQ ID NO: 52423 - DNA, 68 bp, Homo sapiens
aggtgcatatatgtatatgtatatgtgtatatgtatatataggtgcatatatgtacatatatgcacct

SEQ ID NO: 52424 - DNA, 104 bp, Homo sapiens
tgtataactatataggtgcatatatgtacatatacatatgtatatatgtatgtatatatgtatatgtatatgtacatatgcatatatatatatgcacctatata

SEQ ID NO: 52425 - DNA, 109 bp, Homo sapiens
tagttgattgacagatgatgagaagcctttaaagcagtatcattagcattagagattagtgtactgatttttttttaatgaggcaagatatgtctgtctttgtgattaa

SEQ ID NO: 52426 - DNA, 113 bp, Homo sapiens
atatataaggaaatgtacatacatataaagtatatatgtaaataaatttatatataaaaagttatgtaaataaagttgtatatatttatatatgtatttatttctgggtatat

SEQ ID NO: 52427 - DNA, 110 bp, Homo sapiens
tttgagaagtgtctgttcttgtcctttgccgactttttaatggagttttattttttcttttaagtttatttaaagtccttgtggattctggatattagacctttgtcaga

SEQ ID NO: 52428 - DNA, 130 bp, Homo sapiens
tatatatatgtatacatatacacatatatatgtgtgtctctgtgtttatatatacatatatatgtgtatatatatatatatgtgtatatatatatatatatatatatatatatagagagagagagagaga

SEQ ID NO: 52429 - DNA, 110 bp, Homo sapiens
tctatttcaaggatacatatatgtatatatgtatatgtatgtatatatatgcgtatatatatgtatgtgtgtgtatatatatatatgtagcaaatggcttggaagaaaga

SEQ ID NO: 52430 - DNA, 108 bp, Homo sapiens
ctaacatcaaatgatttaacaggagccatcaacattgtttttacactaattgtacatgtctgtgtttgtgtgttgctgataatcctgtaaaatttaaatgtatgttgg

SEQ ID NO: 52431 - DNA, 176 bp, Homo sapiens
tatatacacatatatatatgcacccttccaggtatatatatatacacacaccctcttgggtgtgtatgtatatatatatacaccctcccgcatatatatatatatatatatacacaccctcccgcttgtatgtatatatttatatacacctggatatatgtgtgtgtgtgtgtgtg

SEQ ID NO: 52432 - DNA, 101 bp, Homo sapiens
tatatatgcacacactcctgagtgtgtatgtatatatatatacacccactcccgggtatataaaaatatatacacacacccctcctaggtatgtatatata

SEQ ID NO: 52433 - DNA, 82 bp, Homo sapiens
acaccagagtgtgtgtgtgtgtgtgtgtgtatatatatatatatatatatatatatatatatgtatatgtatacctgggagt

SEQ ID NO: 52434 - DNA, 84 bp, Homo sapiens
tatatatatatatatacacacacacacacacaaacacacacatataacccctcctgggtgtgtgtctgcatatatatatgtata

SEQ ID NO: 52435 - DNA, 106 bp, Homo sapiens
ggagtggttacagcaggccttgggcaagacttagtgctgtgttggcttcagatcagactcagcacagttatagtgatggtggccacaggggtgcttgtgtcactcc

SEQ ID NO: 52436 - DNA, 91 bp, Homo sapiens
ttgtatcataagatctgtctatatatatagattcatatatacatatatagatatatgtatctttatatatctgtttaatcttacaatataa

SEQ ID NO: 52437 - DNA, 58 bp, Homo sapiens
tgttgacttttcaagagggcactgatgtattcggtccctctctctgacagagaagaca

SEQ ID NO: 52438 - DNA, 80 bp, Homo sapiens
gtgtgcatgtctgtctattgtgagtatatatatgtataggtgtatatatatatatactcacaatagacagacatgcacac

SEQ ID NO: 52439 - DNA, 116 bp, Homo sapiens
tacatatatatatatatatatatatatatatatatgtgtgtgtgtgtgtgtgtgtgtgtgcgcgtgtgtgtatgtatacctataaatatatgtgtgtgtatatatgtgtatgtgtg

SEQ ID NO: 52440 - DNA, 90 bp, Homo sapiens
gaacttatggtcagaaaagcaaatttgagtcttgccatgtattaattatataactgtgtttcactcactttgatattttggctaccgttc

SEQ ID NO: 52441 - DNA, 110 bp, Homo sapiens
gctccaaccgtgactctggttctagttatgctttttggcttcatttttttaatatataaatgaatgagtccataatgacataaaaattgacctttcagcacagtagcagc

SEQ ID NO: 52442 - DNA, 78 bp, Homo sapiens
tttagtttaggaaataaatcacacagtgacaattggttgttttttttgtttgtttgttgattggttttctgtactaga

SEQ ID NO: 52443 - DNA, 118 bp, Homo sapiens
atatacataatttgtataaatgtaactaatttatataaacatgtcatttaaataagcatatagctatatttaatttatatttatatgggtgcgtatattcatatataagtaattatat

SEQ ID NO: 52444 - DNA, 107 bp, Homo sapiens
aaatagaatgctttaaaaaatggtagggccagacttgatataaatattttactttagatacagcatatattcctgttatgtttctggttttacttaaaggtttgttt

SEQ ID NO: 52445 - DNA, 85 bp, Homo sapiens
tttgtttgtataggtctgtgtatatatatttgtgtgtgtgtatatacttatacacatacagatattacatatatatgcatacaga

SEQ ID NO: 52446 - DNA, 83 bp, Homo sapiens
actcctcactgccagtttgagttctggtgtcctactcattctctctgactgaatgaaccatgactttatgtgtgtgcgtgggt

SEQ ID NO: 52447 - DNA, 101 bp, Homo sapiens
tgcaatatcctgtgtctgtcctattagtgacatatacatgtgatatatccatatatgtatatatatctattagtgttactggaaggaccaatatatatgca

SEQ ID NO: 52448 - DNA, 79 bp, Homo sapiens
tgagatggagtctcactctgtcacccaggctggagtgcagtggtgcaatctcggctcactgcaacttctgcctcctggg

SEQ ID NO: 52449 - DNA, 101 bp, Homo sapiens
tatatagatgtatgtgtatatgtatatgtacatatttatgtatacgtatacatatacatgtatatacatgtgtatatatgtatatatacaggctacacata

SEQ ID NO: 52450 - DNA, 80 bp, Homo sapiens
acatgtatatacatgtatatgtatacgtatacataaatatgtacatatacatatacacatacatctatatatgtatatat

SEQ ID NO: 52451 - DNA, 144 bp, Homo sapiens
atatatatatgtatatatatatacatatatatgtgtatatatatatacatatatatgtatatatatacacacatatatatatgtgtgtgtatatatatatatatacacacacatatatatatgtgtgtatatatatatatatat

SEQ ID NO: 52452 - DNA, 145 bp, Homo sapiens
atatatatatatatatacacacatatatatatgtgtgtgtatatatatatatatacacacacatatatatatgtgtgtatatatatacatatatatgtatatatatatacacatatatatgtatatatatatacatatatatatg

SEQ ID NO: 52453 - DNA, 102 bp, Homo sapiens
tagaatatgtatgtatatatacatatacacatatgtatatgtgtgtatataatatatatgtgtgtgtacatacatctatgtgtgtgtgtgtgtgtgtgtgtg

SEQ ID NO: 52454 - DNA, 91 bp, Homo sapiens
tgatataccagatgacatctgacaggggcagagtgcatggacatttactgtctttaatgtggaaactctctctctctctgtgttaatatta

SEQ ID NO: 52455 - DNA, 103 bp, Homo sapiens
tggctgtgtagaaattcatgatttattttatattttaaaaaattaacccagttttgcttggatgtcctaataatttttgtgtcatctgaatttctacttgtca

SEQ ID NO: 52456 - DNA, 93 bp, Homo sapiens
ttttgtatactacaactttactgattttatttatctgaagagtttttcgtagcatctttagatttttctaaaaagattgtattgtctgcaaga

SEQ ID NO: 52457 - DNA, 68 bp, Homo sapiens
gggcagcaggcagcagatagatctcttttttctttttcgagacagagtctcactctgtcgcccaggct

SEQ ID NO: 52458 - DNA, 102 bp, Homo sapiens
gggtgaaacatttaaaaatgcatctatagtatgcatttttaaaatataaaaatgcacatatagttcattatataaatattttgcacaaatgaagctttatcc

SEQ ID NO: 52459 - DNA, 76 bp, Homo sapiens
aaatatttatataatgaactatatgtgcatttttatattttaaaaatgcatactatagatgcatttttaaatgttt

SEQ ID NO: 52460 - DNA, 65 bp, Homo sapiens
aggtacatcatatctatatatacttatatagatatatgtatatatatgtatatgtgtatgtatct

SEQ ID NO: 52461 - DNA, 118 bp, Homo sapiens
tagttcttctttaaaagtttggtagaattcagcagtaaaaccactgggtcctgggctctttttttttttttttttttttgagatggactctcactctgtcatccaaactggagtactg

SEQ ID NO: 52462 - DNA, 96 bp, Homo sapiens
ggagaagggttgttggatcacatgatagttttattttcattttttttgagaaatttctctactgttttttgtgtggctgtaacaatttacattccc

SEQ ID NO: 52463 - DNA, 107 bp, Homo sapiens
gtacatgactgtgtatgtatatatatgtgtgtgtgtatatatatatatatatatatatatatatatatatatatatacacacacacacatatacctaatatgtatag

SEQ ID NO: 52464 - DNA, 115 bp, Homo sapiens
ttctgactgggttaagatgacatttcacagtggtttggattttcatttacctgatgattagtgatattgaagatttttccatatacctgttggtcatttgcatatcttttttgag

SEQ ID NO: 52465 - DNA, 79 bp, Homo sapiens
ctgggattacaggtgtgagccacagcgcccggcctttttatattttttttcttaaacggagtctcactctgtcgcccag

SEQ ID NO: 52466 - DNA, 97 bp, Homo sapiens
agcaagggctctgaggactgtcagcacgctgtcacctctcatttctctctctctttctcttttttttgtgacagggtctggctctgttgcccaggct

SEQ ID NO: 52467 - DNA, 114 bp, Homo sapiens
ctgtggaaagggggatgaagccagggagccaagtggtctcactcagtgggtcccactcccacagagcccagcaagctaagaaccactggctggacattctcgttgccagcacag

SEQ ID NO: 52468 - DNA, 115 bp, Homo sapiens
gagagaaaaaacaagtttgtgaaaagatcttacaatgttctgacttttgactgttctatttttatagttaataaacactgtttgagatttaaagagaaactatttcattgctctc

SEQ ID NO: 52469 - DNA, 89 bp, Homo sapiens
tcttctgttactatgtgtgtattggggttgggtgaagggtgtggtgtcctcactgactgtctcaaacaaatcacgtggaaatggaaaga

SEQ ID NO: 52470 - DNA, 65 bp, Homo sapiens
ggaagagtttctacttttataggaagtatatatatatatatacttcctataaaatatatacttcc

SEQ ID NO: 52471 - DNA, 58 bp, Homo sapiens
tggaacgaagtctcactctgtcacccaggctggagtgcagtggtgcgatcttggctca

SEQ ID NO: 52472 - DNA, 58 bp, Homo sapiens
tgagacggagtctctctgtgtctcccaggttggagtgcagtggcgcgatctcggctca

SEQ ID NO: 52473 - DNA, 76 bp, Homo sapiens
gtgtgtgtgtgtgtgtgtgtgtattatatacaaattatatatatatgtgtatatcatatacagattttatatatat

SEQ ID NO: 52474 - DNA, 78 bp, Homo sapiens
gttgtgtgcatatttattcatatttttgttaaatgttaaatcatttatcacagtaaatctgggtgcatagtacataat

SEQ ID NO: 52475 - DNA, 106 bp, Homo sapiens
gtgtgaacaagttcaagtcacttaactcttggggtctcagtttctctgtgtgtaaaagtaggatggtaaaagtgtctacctcaaaatgtttgtgtgtagttcacat

SEQ ID NO: 52476 - DNA, 112 bp, Homo sapiens
ccagttgatagcaaatatatatatatatatatgtgtatttgtgtatatatatatgtatgtctggatatatgtgtgtgtgtatatatatgtatatatatgtgtgtgtgtgtat

SEQ ID NO: 52477 - DNA, 107 bp, Homo sapiens
gtgaatcccagttgctctgtaatttagctaatacttagtatcatcagtctttttgattttaaattttctgataagtacttggtgacattgcatttctaggggttaac

SEQ ID NO: 52478 - DNA, 79 bp, Homo sapiens
tgtctcactctgtcactcaggctggagtgcagtggtgcaatcatggctcaccgcagccttgacctccgtggcgtgagca

SEQ ID NO: 52479 - DNA, 117 bp, Homo sapiens
acttcctggagttcatgccaaggaagaaaatgttgaactgtggattcagatattttttaaatatctatgtgggtttgtaaaatgtaatgtgtgtctgtatttggtgtactagttggt

SEQ ID NO: 52480 - DNA, 79 bp, Homo sapiens
cctgagggccatttaagagtcagagatttttttttttttttttttttttttgagattgagtctcgctctgtcgcccagg

SEQ ID NO: 52481 - DNA, 73 bp, Homo sapiens
atatgtttgtatatatatacatatgtgtattatttatgtgtacatagactatatatatatatatacatataca

SEQ ID NO: 52482 - DNA, 115 bp, Homo sapiens
ttaacttcatctgcctgctttttagcttttcattttttctttatatctttttgtactatagtcagtacaaaaagacataaagacatagtcagtcttgaaaagttgtagttgttaa

SEQ ID NO: 52483 - DNA, 58 bp, Homo sapiens
tgagacagagtctcgctctgtcgctcaggctggagtggagtggcgcgatctcggctca

SEQ ID NO: 52484 - DNA, 154 bp, Homo sapiens
tatacacatacatatatgcatatatgtgtatatgtgtatatatgtgtatatgtgtgtatatatgtgtatatctatatgtgtatatatgtgtatatctttatgtgtatatatgtgtattgatatatgtgtgtatagctatatgtgtatatttcat

SEQ ID NO: 52485 - DNA, 111 bp, Homo sapiens
gttgacagaacattcattacaccatgtacacctaaatatatgtatgtatgtatgtgtgtatacagacatacaaaatatgttgcaagtggcaggaaaagttgatactgaagc

SEQ ID NO: 52486 - DNA, 69 bp, Homo sapiens
aggtaaatagatataggtatagaagtatatatttatatgtatatatataagctatatctaaatatacct

SEQ ID NO: 52487 - DNA, 114 bp, Homo sapiens
tcctcaaaacagcccttttgaattctctgtctgaaagttcacatatcactgtcactctgtgaatggtgactggtgccttatttactttgatttttgaggtcatgttttcctgga

SEQ ID NO: 52488 - DNA, 109 bp, Homo sapiens
tgcttttaatggcctataaatcgtggctaatacattatattaaaaccagagaaagttatgtctgactctgacagtgtgtttaatacccaatttagctgttaaatttgta

SEQ ID NO: 52489 - DNA, 76 bp, Homo sapiens
tatgtatacatatatatgtgtatatatacatatgtatacatatatatgtgtatatatacatatgtatacatacgtg

SEQ ID NO: 52490 - DNA, 98 bp, Homo sapiens
tgtgtgtatatatgtgtgtgtgtgtgtgtgtgtgtgtgtgtatacatatatatacgtatatatacatatacacacatatatgcatatgtatacatata

SEQ ID NO: 52491 - DNA, 90 bp, Homo sapiens
tgttttttatattgtgtatgtatatatacacactatagatacatatttgtatattgtgtgtatatatatgtgtgtgtatacaaaacaata

SEQ ID NO: 52492 - DNA, 136 bp, Homo sapiens
cttacaattatggtggatggggaaacaaacatgtccttcttcacatggtggcaggagagagaagaatgagtacccagtgaagcaggaagccccttataaagccatcaggtctcatgagaactaactcactatcatg

SEQ ID NO: 52493 - DNA, 111 bp, Homo sapiens
gtaaggcgtcaatggcttgtactcaacagatcacacccaaccttgtctttttttaaaattttttcagagatagggtctcactctgtcacgcaggctatgatcatggcttac

SEQ ID NO: 52494 - DNA, 109 bp, Homo sapiens
tgtatgaccttatgatagattatatatgtgcatttatatataagtatatatttatatatatacttatatataaatgcatgtatataattgcatatggtagaattatata

SEQ ID NO: 52495 - DNA, 115 bp, Homo sapiens
tgactgccagagagaaattaaaatagaaaaaatagctttggtgattggagatagtgattttaattttgtacttcagtttctcttgcatctatactaatagatctttggtttagca

SEQ ID NO: 52496 - DNA, 58 bp, Homo sapiens
tgagacagggtctcactctgtcactcaggttggagtgcagtgacatgatcttggctta

SEQ ID NO: 52497 - DNA, 102 bp, Homo sapiens
gcagagtgtcaatatctagtgtgcagtcatatatttgtatgcttttcgtatatttttctatatatttacatatatattttttgagacagagtctcactctgt

SEQ ID NO: 52498 - DNA, 115 bp, Homo sapiens
ggattaaaacatacaggtgacaaagcagttataaatgtcctatccaaagtaaagaagttcttttatctttagctgatgatgttcgctgacctggcagcctttttgatgtgagtcc

SEQ ID NO: 52499 - DNA, 82 bp, Homo sapiens
ggagattttatatatatatggctatttatattttagttatatatatggctttttatatatttcatatatatatggctttttc

SEQ ID NO: 52500 - DNA, 123 bp, Homo sapiens
ggtatctcattgtggttttgatttgcatttccctaatgatcagtgatgtggagcttttatttttttttcatattattgttaagacggaaatgtaaaacccaaaacttttagaaccctcaaaga

SEQ ID NO: 52501 - DNA, 157 bp, Homo sapiens
tggatatttatatataagatatatatatatatcttaacccactgtgtgggtgatatatatatacatatatatatatacacacacatatatgatatatatatatacatatatgatatatatatatcttaacccactgtgtgtgtgtgtgtgtgtgtgt

SEQ ID NO: 52502 - DNA, 109 bp, Homo sapiens
agttcattctgctgcttatttgccatttttttcctctggtcactgtctgtctttgtaaaagtgatttgaaaagtgaagaaagttgtgatgagttagaagtattaggact

SEQ ID NO: 52503 - DNA, 102 bp, Homo sapiens
atatataatatatatatattttaatgtgcatatatatttttatgtgcatatatatattttatgtgtgtatatatatatatatattatatatatatatatatt

SEQ ID NO: 52504 - DNA, 98 bp, Homo sapiens
cttggggaagatctaggcagaaatgttgaggagatctagttgaaaaaatacttgttgatttttttaaattttttttttattatgctttaggttctagg

SEQ ID NO: 52505 - DNA, 91 bp, Homo sapiens
tggtaacactccctcctgtttgctgaactatgagagtggaagaactgtaacactccctctcactcgtcaaactaggggagtgaagaagcca

SEQ ID NO: 52506 - DNA, 108 bp, Homo sapiens
tacatcttcttttgagaattgtctattcatgtccctagccaaaacttttttttattatactttaagttctagggtacatgtgcacaatgtgcaggttacataggtgta

SEQ ID NO: 52507 - DNA, 58 bp, Homo sapiens
tgagactgagactcgctctgtcacccaggctggagtgcagtgacatgatctcggctca

SEQ ID NO: 52508 - DNA, 86 bp, Homo sapiens
tgatgtatgaaactttctctgtctggtttgcaaccataaagaagtggtggaaatgtgtgttggaaagagagataacctaggtgtca

SEQ ID NO: 52509 - DNA, 76 bp, Homo sapiens
gtgatagtgagggagttctcacaaggtctgatggtttaaaaatggcagtttcccctgagttctctatctctgtctc

SEQ ID NO: 52510 - DNA, 109 bp, Homo sapiens
cgaatatactatagaaacgacctttaacatataagtatgtatgtgtgtgcatatggatgtgtatgtttcttatataaattgttagaggtgtgctttattgttgatttcg

SEQ ID NO: 52511 - DNA, 74 bp, Homo sapiens
gtgtttgtgtgcatgtgtgtgtgtgcatgtgtgtgtttgcatctgtgtgtgcatgtgcatatgtgcatgtgtgt

SEQ ID NO: 52512 - DNA, 112 bp, Homo sapiens
ggattgtcttggctatgcaggctcttttttggttccatatgaaatttaaagtagttttttctaattctgtgaagaaagtcaatggtagcttgatgggaatagcattgaatct

SEQ ID NO: 52513 - DNA, 98 bp, Homo sapiens
ataggtacctaatacaggtgtgttattaattaaaatgaatatttatttttgagatacaaatattcatgataatttgttatatagcaatgggtatctat

SEQ ID NO: 52514 - DNA, 83 bp, Homo sapiens
tgagacttcttggtgataggcagaattataaagaatatattttttttgatggagtgttgctctgtcgtccaggctggagttca

SEQ ID NO: 52515 - DNA, 102 bp, Homo sapiens
caggagattttagaaacatggtaacattctgcttcttaaattggatggtgaatgtgctagtatgtattttattgtttcaaactggatatagaagttatctgt

SEQ ID NO: 52516 - DNA, 76 bp, Homo sapiens
agagacagagagagagagagaagttgagatatttgcaaccctagattccttactttacatccaaatctctggatct

SEQ ID NO: 52517 - DNA, 86 bp, Homo sapiens
aaccaaaatgcttctaatttcaaattatatttgtttattacaggctatacataaatataatttgactattgtgtatttataaggtt

SEQ ID NO: 52518 - DNA, 115 bp, Homo sapiens
gagagcatagtgaaaggggtttcccttataaaaccttcagatctcatgagacttactcactgagtcttattcatgagacagtatggaggaactgcccccataattcaatgatctc

SEQ ID NO: 52519 - DNA, 96 bp, Homo sapiens
atagagattcctcaggatgagagttgagtgtctgcagatactacattttagatatctccaagaaagagctcaggttttatgattttttttttctgt

SEQ ID NO: 52520 - DNA, 95 bp, Homo sapiens; identical to SEQ ID NO: 68

SEQ ID NO: 52521 - DNA, 93 bp, Homo sapiens; identical to SEQ ID NO: 69

SEQ ID NO: 52522 - DNA, 110 bp, Homo sapiens
gccgttgctgcctcttctcatggtttttcctctgtgcacacacacttctgatgtctctgtgtgtgtccaaatctcttcttgggagaacaccagtcagtttggtttagggc

SEQ ID NO: 52523 - DNA, 99 bp, Homo sapiens
gatttactttacattcagactactcattagcttggaaataactttatttttattgtttaatccaagaacatgacctgtatgtctgcttatttagttttc

SEQ ID NO: 52524 - DNA, 81 bp, Homo sapiens
agagagctttctctttcactctctctgcacacgtgcactgaggaaaagcagtgtgaggacacagtgaaaaagtgactgtct

SEQ ID NO: 52525 - DNA, 83 bp, Homo sapiens
attatctatatctatacatctatatctatatttgtatctatatcatctacctatattgatatagatatgtatgtatagataat

SEQ ID NO: 52526 - DNA, 169 bp, Homo sapiens
gtgtgtgtgtgtgtgtgtgtgtgtatatatatatacgtgtgtgtatatatatatatacgtgtgtatatatatatacgtgtgtatatatacatatatacgtgtatatatatgtgtgtgtgtatatatatacgtatgtgtatatatatacatatatatgtatatattccac

SEQ ID NO: 52527 - DNA, 117 bp, Homo sapiens
tgcaagaggtgggttactgtggtcttgggcagctctgctcctgtggctttgtgggtacagtctcgctcctggctgctttcatgggctggtgttgagtgtctgtggcttttccaggca

SEQ ID NO: 52528 - DNA, 96 bp, Homo sapiens
gagaggtcagaagtcactctttcaaaatacaaagactctttcaaaaaacagatgagtgagtgcattggatcttgagaaaatggaatatggcccttc

SEQ ID NO: 52529 - DNA, 118 bp, Homo sapiens
tagtgcagctcccgcttcctggtgcagtggtgatgtgatggcaagctctctctgtgtgtgatagagttgagtgggaagtggcattcttcacttcaggatgaaaaggagtaggctgcta

SEQ ID NO: 52530 - DNA, 108 bp, Homo sapiens
atttgtttaaatctgtggtccattttgagttaatttttctatgagtgtgagatttaggtttaggttttttttttttttttttttttttgtgggctatagatgtcagat

SEQ ID NO: 52531 - DNA, 100 bp, Homo sapiens
cagagaagtttttaattttgatgaaactagtttattaaaatttgataacatttttgtttttatagattatgtttttggggttaattctaagaactctttg

SEQ ID NO: 52532 - DNA, 90 bp, Homo sapiens
gtcaaaactttagtgaatctcagtgtgtttatatatattttatatatgtatattttttttctaggcatattggcgttcctgtgctatgat

SEQ ID NO: 52533 - DNA, 100 bp, Homo sapiens
gtatctgggataggaggtgtgagccaccgcacctggctatacttagtttttaatttaactggtattgtctgttggtctcatagcctaagtattgcaatac

SEQ ID NO: 52534 - DNA, 118 bp, Homo sapiens
agtgtccagtttggaaacagtattaaattgctatttgtggatgcaaaaatatatttttttaagccatagatctataagtagactttttaaataaccctgtccctcaaattttagcatt

SEQ ID NO: 52535 - DNA, 117 bp, Homo sapiens
agtcaattttacctgaattgtgtatacaagagcatctgtcatgaggcatgtatagtaatgaagtaattaaatcatgagctagatgttaggttgaagcaaatcatcagaccgagtact

SEQ ID NO: 52536 - DNA, 88 bp, Homo sapiens
ttcatgagtaaaatgactgtcttaaataacctgcctgcaattttcagcatctgccattagatttgagacacatatttgagtccatgaa

SEQ ID NO: 52537 - DNA, 99 bp, Homo sapiens
agaatgtggtggttgggtcaatgaaatggagcacttttaaaaaaaaatttttttttttttttttttgagacattgtcatctggctctgtcacccacgct

SEQ ID NO: 52538 - DNA, 91 bp, Homo sapiens
ggctccctctttgtttcagtgggtcttcattttctaccgaattaattccaactcctttgccagatgctgaaggccctctgtggtctgggcc

SEQ ID NO: 52539 - DNA, 95 bp, Homo sapiens; identical to SEQ ID NO: 68

SEQ ID NO: 52540 - DNA, 93 bp, Homo sapiens; identical to SEQ ID NO: 69

SEQ ID NO: 52541 - DNA, 98 bp, Homo sapiens
gcagtaggagaactatgcatggcttgatgtcaattgagcgtgactcaatctctgtctaaaaagttgatattttgttcatcatggagtttttttgcagt

SEQ ID NO: 52542 - DNA, 112 bp, Homo sapiens
tgagctattgtgcctggccaatgttgtttttataaatatcattactcagttattttgtttataattgaattgataggctcatagaataaagatggataagcactgtttctta

SEQ ID NO: 52543 - DNA, 56 bp, Homo sapiens; identical to SEQ ID NO: 9180

SEQ ID NO: 52544 - DNA, 127 bp, Homo sapiens
ctgggtcaaatgttagttgttttaggttctttgagaattttccaaactgcttttcacagtggctgaactaatttacattcacaccagaagtgtataagcattatactttctcagtaaccttcttaac

SEQ ID NO: 52545 - DNA, 86 bp, Homo sapiens
tatatatacatgtatatatgtatgcgcatatatatacatgtatatatgtatgcacatatatatatatatacatgtatatatatatg

SEQ ID NO: 52546 - DNA, 81 bp, Homo sapiens
ccatcttaagtctctgtatttctctgttaagagtataaggcttagcaaagattatccaaggttctggagattagggcatgg

SEQ ID NO: 52547 - DNA, 102 bp, Homo sapiens
catgactgtatttggttgaagatgtttgtcatttttgcattgtgccctatggctaaaatgttctgattttgatcatgaaacaaaattcaccacagttatggt

SEQ ID NO: 52548 - DNA, 96 bp, Homo sapiens
gggtgaggctgaggtgaatgttttttatttttattttttgagacagagtcgcactctgtcacccgggctggagtgcagtggtgtgatctcagctca

SEQ ID NO: 52549 - DNA, 92 bp, Homo sapiens
catggcagttcaacaatgtgattgaaatcttgcttctgtgaattcacagggtgctttgtacttccctaacacacttaccatattctgccttg

SEQ ID NO: 52550 - DNA, 100 bp, Homo sapiens
cacagattacattactaatgagaatgagcaacttgattgtatagatgttttctcttatctaaatcttgcctattttctaattatctaactgtaagttgtg

SEQ ID NO: 52551 - DNA, 105 bp, Homo sapiens
gcataacagcttgtaacattgtgtacagaaggtgcaactttttttttttattatacttcaagttttagggtacatgtgcacattgtgcaggttagttacatatgt

SEQ ID NO: 52552 - DNA, 108 bp, Homo sapiens
cagctgcaagccacctccgtcatttagaaaagcttcgtgatgtagtgtgtcgtttcgatgtgacactgtctcacagagttaaaatgatgtgcaaggaactgttcaatg

SEQ ID NO: 52553 - DNA, 115 bp, Homo sapiens
atagatatacattttatatatatgtgcaatgtattttatatataaataaattatataaatatataatttatatatgcattatatatgcaatatataattattatataatgtatat

SEQ ID NO: 52554 - DNA, 102 bp, Homo sapiens
acatttgtgtgtgtgtgtgtgtgtgtgtgtgtgtgtgtatatatatatatatatatgcttgtgtgtgtatgtatgtatatacacacatatatacatatgtat

SEQ ID NO: 52555 - DNA, 104 bp, Homo sapiens
ccgttaatatgcagagttcgataaagtggaagtgattgctttgagggttacataacactccctgcctcttagccactgtagctttttgttgaaatattgagtgg

SEQ ID NO: 52556 - DNA, 58 bp, Homo sapiens
tgagatggagtctcactctgtcacccatgctggggtgcagttgtgtgatctcagctca

SEQ ID NO: 52557 - DNA, 58 bp, Homo sapiens
tgagacagagtctcgctctgtctcccaggctggagtgcagtggtgcgatctctgctca

SEQ ID NO: 52558 - DNA, 58 bp, Homo sapiens
tgagatggtgtctcactctgtcacccaggctggagtacagtggtgtgatctcagctca

SEQ ID NO: 52559 - DNA, 65 bp, Homo sapiens
aatctctctctctctctggggcaaagctcaaacagattacttgcagcccagagaaggttcagatt

SEQ ID NO: 52560 - DNA, 127 bp, Homo sapiens
gggggaaggagcaggacatatttgctgaacaataatttttttgttttttgagacagagtctcgctctgtcacccagactggagtgcagtggcgtgatctcggctccctgcaagctccgcctcctggg

SEQ ID NO: 52561 - DNA, 112 bp, Homo sapiens
atttgtttttctgaatgatattcatggctgtgttatatgaaaacattagtttttaaatataaaataaattttcattagcatgtctgaatagcatcctctgagtataataagt

SEQ ID NO: 52562 - DNA, 94 bp, Homo sapiens
cagtttcatagcatgcttaatgtttgttgtttatgatttttatgtctcttgtattgaaataactgacgttactgctttgcaatgaacacctctg

SEQ ID NO: 52563 - DNA, 94 bp, Homo sapiens
tgtagagacttttccaaaggctgtaaatgccgagccacattgtcccccctacaaaatcacactgtctcacagcctgtatggagctgaatttaca

SEQ ID NO: 52564 - DNA, 119 bp, Homo sapiens
ggcctgagtgctcctggaaaatctctggtgtaggaccaagcatccaaaggctttagaacttggagtccaatgttcaaaggcaggaagcatccagctgtgagatggccagaagactcacc

SEQ ID NO: 52565 - DNA, 75 bp, Homo sapiens
tatttgtatgtctatatctatgtatatagatatatgtgtaatatgtgggtatatgtgtatacatgcatacatgta

SEQ ID NO: 52566 - DNA, 87 bp, Homo sapiens
tatatatgtgtgtgtataaacacagtatatatatatacacacacagtgtgtatatacactgtatatatatatatacacacatacata

SEQ ID NO: 52567 - DNA, 77 bp, Homo sapiens
gagtgaaatgtgaaattgatgttgagttttggaaatggcattgatatgatctgaccaacattttcaaagattcactc

SEQ ID NO: 52568 - DNA, 95 bp, Homo sapiens; identical to SEQ ID NO: 68

SEQ ID NO: 52569 - DNA, 93 bp, Homo sapiens; identical to SEQ ID NO: 69

SEQ ID NO: 52570 - DNA, 101 bp, Homo sapiens
gttctaatttgtatagttggtgtatgtttttatatgtatgtatatatagtatttaagttgcatacatagattgacaatcaaagcctaatataaagaagaat

SEQ ID NO: 52571 - DNA, 129 bp, Homo sapiens
tctttatcaaagatatacatgtgtatatatctagctttatcagatatatgtgtgtatatatttatctttatcaaagatatatgtgtatatatatctttatcaaagatatatgtgtgtatatatatcttt

SEQ ID NO: 52572 - DNA, 93 bp, Homo sapiens
tacatatgtctttatcaaagatgtatatgcgtatatatatctttatcaaatatatatgcgtatatatatctttatcaaagatttacgtgtgta

SEQ ID NO: 52573 - DNA, 92 bp, Homo sapiens
tgtgtctgtgtgtatgtgtgtatatatatacgcacacatacacacacacatttctttatacatatatatatacacacacatacacatacaca

SEQ ID NO: 52574 - DNA, 74 bp, Homo sapiens
tgtgtatgtgtatgtgtgtgtatatatatatgtataaagaaatgtgtgtgtgtatgtgtgcgtatatatataca

SEQ ID NO: 52575 - DNA, 97 bp, Homo sapiens
ttgcctccagtaaaagtttgcagctcaaaatgatgagatatatgtatatacatatatgtatctcattatttagatggctgtttaggatgctgtgtaa

SEQ ID NO: 52576 - DNA, 100 bp, Homo sapiens
tcactaataaaggtcctgggtataagcagtagttatatggcattttaattttttttttaagacaggtctcactctggtggcccaggctggagtgcagtgg

SEQ ID NO: 52577 - DNA, 135 bp, Homo sapiens
ccatgagtggtggtgaggcaacgacttaaatttttttttttttttttttttttttttgagagggagtctcactctgtcacccaggctggagtgcagtggcatgatctcggctcactgcaacctccgcctcccggg

SEQ ID NO: 52578 - DNA, 112 bp, Homo sapiens
aaggttaaattgattaaagtttctgtacttaggtttgcctgataaaatatttaaaaactatgtattttggtttaataagcctggctactgtagctgtacttcagagaatttt

SEQ ID NO: 52579 - DNA, 56 bp, Homo sapiens
tgtgtgcctgtgtgtttctctcatatatgaaagagagagagagaggaaggcaggca

SEQ ID NO: 52580 - DNA, 73 bp, Homo sapiens
cccgaggaggcttctgacctgttaccagggcaactgtgcattgatgaaagggaaatgattagacgtttcaggg

SEQ ID NO: 52581 - DNA, 143 bp, Homo sapiens
gtaaatatatgtatatatgtgtgtatttgtgtataaatatacacatatatatacacatatatagtatatagatgtatatatatacgtatatatacatgtatacatatatacatatatatacatatatacacacacatatatat

SEQ ID NO: 52582 - DNA, 107 bp, Homo sapiens
taagaaagctgtgatatgactgaacaagtgacttgtgtttttcatcataattataaagattatgagtagaatggtcaaattagaagacattttaaaatgcttacttg

SEQ ID NO: 52583 - DNA, 88 bp, Homo sapiens
tcctgatagcaagaaagttatcaagagagctgatggttttaaagtgcggcacttcctcagtctctctgtctctcctgccacgtcgtga

SEQ ID NO: 52584 - DNA, 91 bp, Homo sapiens
tgctggggcactttaggcctcaggagcagacctcatggaacagaaactctctttctctctctgaaattctcctgtccttcttccacaggca

SEQ ID NO: 52585 - DNA, 82 bp, Homo sapiens
ttggaatttaattaatcattattagtttgttcaggatatttatttatttctgattcattcttgatggttgatatatttccag

SEQ ID NO: 52586 - DNA, 112 bp, Homo sapiens
ggtttttttacttggatcttttgtttgcctttattgtttaagaagttatatatatgtatctttaaattatcattaagaggtgacttaatcaaacaatttagggaatgagacc

SEQ ID NO: 52587 - DNA, 119 bp, Homo sapiens
tcattgctcactaactagacagccttgagagcttaataattaaccagagtctatttatagtatttttaaaacatggtcattcctaggagttctgggctgtttatcatactgctctgagt

SEQ ID NO: 52588 - DNA, 118 bp, Homo sapiens
tttgtatatatactcagtagtgggattgctgaatgatgtggtagttatgttttaaatatttttggaaaccatactgtttttcatagtggttgtactaatttacagatatttaatacag

SEQ ID NO: 52589 - DNA, 58 bp, Homo sapiens; identical to SEQ ID NO: 1868

SEQ ID NO: 52590 - DNA, 92 bp, Homo sapiens
ttttccttttatgtttgtgctttaaaatttttttttcaagttgaaatgcctaaactttagaaagttttgaagtttggcacatgttgggtgga

SEQ ID NO: 52591 - DNA, 181 bp, Homo sapiens
gtattttatatatatgtatatatatgtatatatatatacacacataatatatgtgtatatatgtgtatatatatacgtatatatacacatatatatgtatgtatatgtatatatatgcacatatatatgtatatatatatacgtgtatatatatacatatacatacatatatatatatata

SEQ ID NO: 52592 - DNA, 91 bp, Homo sapiens
tctgtttagattcctttttatttctttatcttgcctgattactctggctgggacttcaggtactatgttgaataggagtggtgagagtgga

SEQ ID NO: 52593 - DNA, 129 bp, Homo sapiens
tatatagtgtgtgtgtatatatacactaattgttagtgtgtgtgtatgtatataatgtgtgtgtatatatgtatatatatacactaattgttaatgtgtgtgtatgtatatagtgtgtgtgtatatata

SEQ ID NO: 52594 - DNA, 149 bp, Homo sapiens
gttttttcacttagggatagtaatttgagatgattttgtatggctcaataactcttttttttttttttttgagacagtgtctctctctgttgcccaggctggagtgcagtggcgtgatatctgctcactgcaagctctgcctcctgggt

SEQ ID NO: 52595 - DNA, 90 bp, Homo sapiens
ctggtcctgtggtctaatctcattatcattctcggaggtgggggtttgtggggaagagagagagagagagagacagcgacagagacagag

SEQ ID NO: 52596 - DNA, 86 bp, Homo sapiens
gttgctcttatttctgtcttattaggcatttctcaggcacaattttcatcgcctcatacctgtgtagacagtgagcactgagtaac

SEQ ID NO: 52597 - DNA, 110 bp, Homo sapiens
ggctgggctcaggagggtggttcttctggtctcatttgaatttgtttatgtgtagggaatgactgagtgtcggctggggctatgaggatgatttgacttgctctaatgcc

SEQ ID NO: 52598 - DNA, 72 bp, Homo sapiens
gtatatatgtgtatatatgatggagtatatatgtatacatatatgtatatttacatatatacacatatatac

SEQ ID NO: 52599 - DNA, 83 bp, Homo sapiens
ctgtgtgtatgtaaatatatattgtgcatgtgtatgcctttgtgtgtatatatctgtaaatctatatatatgtgtatatgtag

SEQ ID NO: 52600 - DNA, 99 bp, Homo sapiens
agcaagcatcctttcgctgagctgaaatagttataggccacatcacagataaaagacactgatgagtcactgctttcagcttctgataatttctttgtt

SEQ ID NO: 52601 - DNA, 79 bp, Homo sapiens
ggattttaactcagaacatgtctggattgcaatgaacactaaggccaggaagctgattcctgactctctgagtgagtcc

SEQ ID NO: 52602 - DNA, 74 bp, Homo sapiens
agatgcatctgcttttgataagtacttaggtggaaaagtacttttatctatttatttattttgagacagagtct

SEQ ID NO: 52603 - DNA, 58 bp, Homo sapiens; identical to SEQ ID NO: 87

SEQ ID NO: 52604 - DNA, 56 bp, Homo sapiens; identical to SEQ ID NO: 88

SEQ ID NO: 52605 - DNA, 68 bp, Homo sapiens
cgtatacatacatgtatttacacacatatatacatacacatatgtatatatgtatatgtgtgtgtatg

SEQ ID NO: 52606 - DNA, 109 bp, Homo sapiens
ctttttcagaaattaaaaatgaaagtgggcaatctgcagctgagtacttggcgagtatctgtatttgttcttgactcagagctgcttctttacaaactttctggcaaag

SEQ ID NO: 52607 - DNA, 111 bp, Homo sapiens
atgctatgatggacatcttgatataagaagaaatttttattattattattatggattaataatagtcctaaaatttaagattattgttcttcaggatggattccttggcat

SEQ ID NO: 52608 - DNA, 86 bp, Homo sapiens
tttttttttgagatgagtctcgctctgtcagccgaggtgggcggatcaccctggccaacatggcaaaaccccatctctactaaaaa

SEQ ID NO: 52609 - DNA, 106 bp, Homo sapiens
cttctgccatttcagatgagaaagcccagaattattcttacagcataagatgccacatagtggttatgatatgaatataagaaatgacttagaggagatgcggggg

SEQ ID NO: 52610 - DNA, 59 bp, Homo sapiens
tggcagctgattagatggtgcccacccagattgagggtgagtctgtctctctcagtcca

SEQ ID NO: 52611 - DNA, 61 bp, Homo sapiens
ctgagacagggtctcactctgtcacccaggttgcagtgcagtggtgcgatcttgatctcag

SEQ ID NO: 52612 - DNA, 66 bp, Homo sapiens
gcatgctaccacctggctaactttttttatatttgtagagacaaggtgtcactgtggtggccaggc

SEQ ID NO: 52613 - DNA, 78 bp, Homo sapiens
atgaggaagagagaaaagtgtgtgcagagggcaggaagaaagcccaagctctgtgcattacacttttctcagtctcat

SEQ ID NO: 52614 - DNA, 67 bp, Homo sapiens
tgtttgagacagggtctcactctgtcactcaggctagagtgcagtggcaggatcttggtttattgca

SEQ ID NO: 52615 - DNA, 119 bp, Homo sapiens
atggaataagacacttatctgctgtgtggtctggagcaagcgactcagcctctctgattcttaattctttaaaaactgagtatctccaaactctggagcccattttattttgttttatt

SEQ ID NO: 52616 - DNA, 72 bp, Homo sapiens
gcactctgaccctctgattctaaattttcagtatgtttcacactgcctaggatcatgagaccgctcggaggc

SEQ ID NO: 52617 - DNA, 57 bp, Homo sapiens
tgagattgagtctcgctctgtcacccaggctagagtgcagtggcgcgacttagctca

SEQ ID NO: 52618 - DNA, 102 bp, Homo sapiens
cacatgctcagcagcacttgctcttttcactatttttaaaattttttttaatttttaaatattttttgagatgaggaactgcctccgcttccagagtatttg

SEQ ID NO: 52619 - DNA, 129 bp, Homo sapiens
tatatacatatatatatacatatacatatgtatatatatatgtacacttatatatacatatacatatgtatatatatatgtacatatatatacacatacatatgtgtatatatatgtacacatatatat

SEQ ID NO: 52620 - DNA, 60 bp, Homo sapiens
atatatatgtgtacatatatatacacatatgtatgtgtatatatatgtacatatatatat

SEQ ID NO: 52621 - DNA, 69 bp, Homo sapiens
agctgagcttcaaatgctattctgatttttcagtcacctgactgtagatagatagcttggggactcgct

SEQ ID NO: 52622 - DNA, 88 bp, Homo sapiens
acgtagcaaccagaagcctttaaatagaatgaattgaagtttagaatcttcacttcatttcgttcccgttgtttttttggttgtttgt

SEQ ID NO: 52623 - DNA, 82 bp, Homo sapiens
gagaagggagtgtcgagacagtggacacacccaggtctaagagcatatataacttggagtccagactatgacattcaaactc

SEQ ID NO: 52624 - DNA, 119 bp, Homo sapiens
gattttcttgaataaatgtgtctttatttgctgtgtggccttaggataattaccaaatattttaatttttctaaagtatatactaagtctgatgagggcctgatatttgatgagcagtt

SEQ ID NO: 52625 - DNA, 57 bp, Homo sapiens
tgagactgagtctcactctctccccaggctggagtgcagtgacgcaatctcggctca

SEQ ID NO: 52626 - DNA, 127 bp, Homo sapiens
atacgttcatatatatattcatacatacgttcatatatatatattcatatatacgttcatatatatatgttcatatatatgttcgtatatatgttcgtatatatgttcgtatatattcgtatatata

SEQ ID NO: 52627 - DNA, 112 bp, Homo sapiens
aaaactaatcattcctctcagacatccctctctctttaagattctatctctctcagtttctctgacagagagctgcctaaagaatgttctataagtggatatgatttctttt

SEQ ID NO: 52628 - DNA, 92 bp, Homo sapiens
tgataccaggttgaataaagggtctgtgtgtgttaatgattattttatttatttacagaggctactccaaaattctagatctggctggttca

SEQ ID NO: 52629 - DNA, 106 bp, Homo sapiens
ggatatatgtatatatctatatatggatatatgaatatatatgtatataggtatatatatgtatatatttgtatatctatgtatatatggatatgtatgtgtgtgt

SEQ ID NO: 52630 - DNA, 70 bp, Homo sapiens
ggagaaatgactttttttttctttcctataatctcatattagaagtgaaggaagtagaagtgatttcttt

SEQ ID NO: 52631 - DNA, 72 bp, Homo sapiens
atgtagacatgtatatatgtgtatatatatgtgtatatgtgtatatatgtgtgtgtatgtatatatgtgtat

SEQ ID NO: 52632 - DNA, 58 bp, Homo sapiens
tgagatggagtctcactctgtcacccaggctggagcgcagtggtgtgatctcggctca

SEQ ID NO: 52633 - DNA, 94 bp, Homo sapiens
ggcagtggagaggacggaagaggctccagggctttgctgactggtcccatgtgtcgctctgactccgtggttctttttccagagaacaaggctc

SEQ ID NO: 52634 - DNA, 103 bp, Homo sapiens
tcatggtctattatgtgtggtacttttatggttgatggaaagttttagatgagggaagacagacaattagagagggaagaataccagatgagagtagagctgg

SEQ ID NO: 52635 - DNA, 115 bp, Homo sapiens
gactcaactatgcacttgtacaccagttgagcagctttggaacatgtatttttttttttatcagttcacccttctcaaggctggttagtcactgtctgggtgtttagcttgttgc

SEQ ID NO: 52636 - DNA, 119 bp, Homo sapiens
atgttcatatacatatgaatatatatatgtgtgaatccgtgtggatatatatgaatatatataaaatatatatatggatatatatacatatatatttgagtcaagtttaaatgtttctg

SEQ ID NO: 52637 - DNA, 70 bp, Homo sapiens
cactttgggaggctgaggtaggtggatcacttgaggtcaagagttcgtgaccagcctggccaacatggtg

SEQ ID NO: 52638 - DNA, 85 bp, Homo sapiens
aaatctagcttaaaaatcaggttctctgtttcttccctctccattgagggcaaagatagaaaattgattttttttttgtttgttt

SEQ ID NO: 52639 - DNA, 94 bp, Homo sapiens
agactaaaggtttgtgagtgcttgttgtgtgtctgccacttttctaagagcttcatatatattaattcatttacacctcacttgcctgttagct

SEQ ID NO: 52640 - DNA, 102 bp, Homo sapiens
agactgtctttggctgggtgccgtgtgtcgtgcctgtaatcacagcactttgggaggctgaggtaggaggatcacttgagctcaggagtctgagaccagtct

SEQ ID NO: 52641 - DNA, 81 bp, Homo sapiens
gtgaccagtgagggagactctcactaagtatttatttttatttatttatttattttttgagacggagtctcgctctgtcac

SEQ ID NO: 52642 - DNA, 84 bp, Homo sapiens
ttctactccacgctcaacatcctcctgtgagtccatcttcctgatatgctcagcagatggagagaagaatgagtgcacacagaa

SEQ ID NO: 52643 - DNA, 107 bp, Homo sapiens
catgaattggcctattttagatactaattttaagtggaatcatgcagtatttgttcttctgtgactggcttatttcacttagcataatgtctcaaagttcatccatg

SEQ ID NO: 52644 - DNA, 102 bp, Homo sapiens
tgggcatagtttgttcttcttcttctagtggttttttttttttttgagatggagtctcgctctctcacccaggctggaatgcagtggcgcgatctcggctca

SEQ ID NO: 52645 - DNA, 82 bp, Homo sapiens
gtttccaaaagtgattttgatgtgcacctacgattgagaactgtcgtttgaggacagtgggtggagtttcgtatttggaaat

SEQ ID NO: 52646 - DNA, 61 bp, Homo sapiens
ttggcagacagaggaagcaaacttttttttttttttgagatgtgtctcactctgtcgccag

SEQ ID NO: 52647 - DNA, 125 bp, Homo sapiens
ttactagtataattcctcctatctacttatagtcagctactatatctgtaatgtttttctacttttatatagtatgttgtaaagccaactgtatatataaggaattaaatactgtagtctgattg

SEQ ID NO: 52648 - DNA, 74 bp, Homo sapiens
ggagcaaggtggactgagagaggagagtgagaccataaagaggctttgctcttccagagtttggattttgcccc

SEQ ID NO: 52649 - DNA, 67 bp, Homo sapiens
agcctgtcactccctctgcctctcactctaactgggagaggggtgaggatgggaggctcgcccaggc

SEQ ID NO: 52650 - DNA, 65 bp, Homo sapiens
atacaggaggtatatagatcaaggtgttttatatatatatgaattgatctatataccccctgtat

SEQ ID NO: 52651 - DNA, 88 bp, Homo sapiens
ctgtgccccgaggctatttgttccatagcacttatcacctctgaagtcccacagaactgagtgagcatggaatctgcctgacgcttag

SEQ ID NO: 52652 - DNA, 85 bp, Homo sapiens
ggaggtaaagttacactctggctgtgtctggccccaagtagttcaagggatgctaaactaacagctttgttaactgttaccctcc

SEQ ID NO: 52653 - DNA, 93 bp, Homo sapiens
gggtccctgggatggatgggtgaagtatttgcgtgagggcctggtgcctcctggagagtcacacacaacacactcagtccaccttcctagctc

SEQ ID NO: 52654 - DNA, 80 bp, Homo sapiens
tgagatgaagtctcactctgtcacccaagctggagtgcagtggtgtgatctcagctcaccgtgacctccacctcctgggt

SEQ ID NO: 52655 - DNA, 117 bp, Homo sapiens
tgtttgggtatatgcctttaattttgatggccttccttgaatatcagctaatactcggctttctatttatatttaagaaaggtaacgcaaagttgaaaggacatttcctgtgttgca

SEQ ID NO: 52656 - DNA, 95 bp, Homo sapiens; identical to SEQ ID NO: 68

SEQ ID NO: 52657 - DNA, 93 bp, Homo sapiens; identical to SEQ ID NO: 69

SEQ ID NO: 52658 - DNA, 76 bp, Homo sapiens
gagtctcactctgtcacccaggctggagtgcagtggcatgattgcaacctctgcctctcgggttcaagtgattctc

SEQ ID NO: 52659 - DNA, 82 bp, Homo sapiens
gtgcatgtgtgcatgcgtatgtgcacgtgtgtgtgcatgtgtgtgcatacgtgtatctgcatgtgcatatgtgtttgcgtgt

SEQ ID NO: 52660 - DNA, 116 bp, Homo sapiens
tttcttgctatgaggctttgggagtgtttctatagataatattttaatgaattttttattccaagttttcaatgttacaaaaggatgacttttagatttttcttcagtgcagggga

SEQ ID NO: 52661 - DNA, 84 bp, Homo sapiens
gggtctcactcagtcactcaggctggagtgcagtggcatgatctcagctcactgaagcttcaacttgatgagctcaagcgatcc

SEQ ID NO: 52662 - DNA, 109 bp, Homo sapiens
aagttcaggaacaatttcgtgtgagattatcctgttaatgtttaaatgctttattatacttaatatatttaaacaaggatttttttcaactaaaatgtctagtgaattt

SEQ ID NO: 52663 - DNA, 97 bp, Homo sapiens
tcatgtgcagagttcacaatagggttcgtgttcctgtaagaatccaatgctgctgcagatctgacaggagacagagctcaggtggtaatgcgagtga

SEQ ID NO: 52664 - DNA, 75 bp, Homo sapiens
ccagtggtacagggagcaggagagcccagtgggcagcacagcaaagcatttgtctctctctgtctcccaggctgg

SEQ ID NO: 52665 - DNA, 87 bp, Homo sapiens
cagtgcccagtggcttgtgtctgtgtctgtgggagctaataggtcaataggccccagtgggaagaacaggcaggcctcacagttctg

SEQ ID NO: 52666 - DNA, 76 bp, Homo sapiens
gatctcctttgactctcggtctcacatccaggtcaaattgatgcaagaggtgggttcccatggtcttgggcagatc

SEQ ID NO: 52667 - DNA, 66 bp, Homo sapiens
ggatgttgggaccatgatgcttccttcatttggggtgaagggagtctgtgtctgtgtctcatctct

SEQ ID NO: 52668 - DNA, 106 bp, Homo sapiens
gtgtgtgtgtgtgtcagagagagagagaattggcttgtccatttttatttttaaaaactgttgggattttgtggaatctatagatcaatttggggagaacttacat

SEQ ID NO: 52669 - DNA, 83 bp, Homo sapiens
ctggaagctccccacctgcctgtctgtcacactcagcatgccttctgttgatgccactgtgtggataagcatagtgtctccag

SEQ ID NO: 52670 - DNA, 114 bp, Homo sapiens
cagaaatcggatgatctcagctggtccagaatgatggtttttcttgcaaatggaatcaatacaaataatgttttgtggtaaaagccatacttctcactttgagaaaaccctctg

SEQ ID NO: 52671 - DNA, 75 bp, Homo sapiens
gagagagagagagagagaggccctgagactgcacaggggtggagtggggggagggtctgtctgcctctcagactc

SEQ ID NO: 52672 - DNA, 112 bp, Homo sapiens
tagcctggcatggtggtgtgcacctgtagtcccagctactcgggaggctgaggtggaaggatcatttgagcccgggaggttgaggctgcagtgagccatgatcgtgccacta

SEQ ID NO: 52673 - DNA, 58 bp, Homo sapiens
tgagacggagtctcgctctgtctcccaggctggagcgcagtggcatgatctcggctca

SEQ ID NO: 52674 - DNA, 74 bp, Homo sapiens
tggcagggtgtgttggttcatgcctgtaatcccagcactttgggaggctgaggtaggaggatcacttgaggcca

SEQ ID NO: 52675 - DNA, 58 bp, Homo sapiens; identical to SEQ ID NO: 5055

SEQ ID NO: 52676 - DNA, 101 bp, Homo sapiens
ggagagtttagctgagccacccgtgaaaagcatctgtcgctgcctctctggccctcacacacagtaaggaagtggcttatctggcaggttctgtcctctcc

SEQ ID NO: 52677 - DNA, 79 bp, Homo sapiens
agggcctctgtctccctgtctctgtgggagggtagaagcctagccttgataaacaccggttcacagacacagagggcct

SEQ ID NO: 52678 - DNA, 117 bp, Homo sapiens
gttggggactggatgcttccagaggggggtggtggcaggtcaatgctccctcacagtcacacagagaggcctgcatgacagtcacacagacagatctgaatagcatccgaactatgc

SEQ ID NO: 52679 - DNA, 95 bp, Homo sapiens
agaggttgctgggtcaaaggggatggacttacttaatgtttttgtgagtgacctcacaaaggctggacatagctcttgagtcccagggacaggct

SEQ ID NO: 52680 - DNA, 98 bp, Homo sapiens
gctgaaattacaagcgtgagccactgtgcttggctgctactgttatttttatttttaatttctttgtagagttgggggtctctccttgttgcccaggc

SEQ ID NO: 52681 - DNA, 118 bp, Homo sapiens
tcaaaaatcaagagaaaataatttcatgtctttattatgcataaaatggaagacttttttttttgtaaaataccatattttagcatatatagatgtgtatttttttttttttttttga

SEQ ID NO: 52682 - DNA, 70 bp, Homo sapiens
cttcagatcccggcctcactgtgtccctctgatggcagctgtcagagtcggggaagggccctttctaaag

SEQ ID NO: 52683 - DNA, 116 bp, Homo sapiens
gcttctaaatgcaaccacaagtgttcttataagaagaaggcagagggagatttgacagtaaagaaggcaatgaaacaaggtgctgttctgctggctttgaagatgggggaagaggt

SEQ ID NO: 52684 - DNA, 58 bp, Homo sapiens
tgagatggagtctcgctctgtcgctcaggctggagcgcagtggcgggatctcggctca

SEQ ID NO: 52685 - DNA, 89 bp, Homo sapiens
tagacgtgaactctgaatgcatacacgcatctgactgtgcatgtgtgtgccagtatgtgtgtgtcactgtgtgcctgttcacctgttta

SEQ ID NO: 52686 - DNA, 81 bp, Homo sapiens
gccaaaccatatcagagggaatgcagagatgtgctaaacagtgctaacagtgcacttgctgtttccagactgtgggacagc

SEQ ID NO: 52687 - DNA, 104 bp, Homo sapiens
attgtctgctctggtgtgttcaggtttggaagagtaatgatgatgatgttgatgatgataatgacaataatagctacctttattgggtgcccagggattccagt

SEQ ID NO: 52688 - DNA, 113 bp, Homo sapiens
tatagatatacattattacattgtgcatatattatgcatgagtatatatgtatatatgcatgcatatataattatgtatattatatgtatatgcgtatgtgtgtatatctatg

SEQ ID NO: 52689 - DNA, 93 bp, Homo sapiens
aggcacacccctctcagggagagaggacaagttctggtgctctctgaggctctctggtactatcttggccatctcttcttagccctgctgcct

SEQ ID NO: 52690 - DNA, 81 bp, Homo sapiens
aactcacactctccctgtgtcctagttccagagaaaagaaccacatctctggtgggaagaactgcataagatcggtgagtt

SEQ ID NO: 52691 - DNA, 66 bp, Homo sapiens
tgcccaaactctgccctgcagataggccggtgtgtgaccgtctctgtctcctacaataactgggca

SEQ ID NO: 52692 - DNA, 95 bp, Homo sapiens
actaatcaaattctctgagaactgagattttcttgtttttaaatgcctttttaaagagtaataatttctcttattttaaatgttgtttgattggt

SEQ ID NO: 52693 - DNA, 118 bp, Homo sapiens
tgaccttaacacacagcatcatcacttgggtaaaagccaaggacttttttttttttttttttttttgagacagagtctcaccctgtcacccaggctggagtgcagtggctcaatctca

SEQ ID NO: 52694 - DNA, 93 bp, Homo sapiens
tcatctctgggttagagaatgtatatgtatatatgtgtattcacctgcactcatacatgtaagaacatgagcattgcgctatcagagaactga

SEQ ID NO: 52695 - DNA, 70 bp, Homo sapiens
ttgagaccctgctagggagagctcagaggatcccagtgttgggattaatgagtcaccctcactgtcacaa

SEQ ID NO: 52696 - DNA, 76 bp, Homo sapiens
ggatgggaaactgagaaacagattggtgtgcagggttacagggcctgactcagactgactcagactttctggctcc

SEQ ID NO: 52697 - DNA, 88 bp, Homo sapiens
tctcctctgtcactctctccctgtcccaggtgggtgggtggatcagactgaggctgcagctcatggcagggggctggactgtggatga

SEQ ID NO: 52698 - DNA, 75 bp, Homo sapiens
ggttatccctctgtgtgtgtctgtatcctaatctcttcttataaggataccaattgcattgtattggggctagcc

SEQ ID NO: 52699 - DNA, 70 bp, Homo sapiens
atatgaggtgtgaatatgtacatatgtgtattttatatatatatatatatacacacacacacacacatat

SEQ ID NO: 52700 - DNA, 58 bp, Homo sapiens; identical to SEQ ID NO: 637

SEQ ID NO: 52701 - DNA, 75 bp, Homo sapiens
attacacctggatctcaaagcatcatgtgttgtttttgataagaaagtctgatgagagtgagtccatggtttgat

SEQ ID NO: 52702 - DNA, 64 bp, Homo sapiens
tctccactgcctctgtctcacagaaacacagccacatgatatggagactcacgaggcttggggg

SEQ ID NO: 52703 - DNA, 104 bp, Homo sapiens
ggcctcagagcctgtgaatgtgaccttatttggaagaagaaactgtgcacatgtaattaagttaacgatatcaagataacgtcatcctggatttagggtgggcc

SEQ ID NO: 52704 - DNA, 71 bp, Homo sapiens
gtgcaggtcttggagtcagatgagcctaagttaaaactcataacccactcactggctgtgtgacactggac

SEQ ID NO: 52705 - DNA, 75 bp, Homo sapiens
tatatatatatataatatatgatttacatacatagagatgtatgtgtttataaaaatatgctatgtgtgtgtata

SEQ ID NO: 52706 - DNA, 95 bp, Homo sapiens; identical to SEQ ID NO: 68

SEQ ID NO: 52707 - DNA, 93 bp, Homo sapiens; identical to SEQ ID NO: 69

SEQ ID NO: 52708 - DNA, 114 bp, Homo sapiens
tgtgtggtggaatgtgatgcagcttttacaaatggcatttttcttttttttttattatactttaagttttagggtacatgtgcacaacgtgcaggtttgttacatatatataca

SEQ ID NO: 52709 - DNA, 102 bp, Homo sapiens
atcattaacagacaaggaatcctggaggtcaggtatttacaatcgaaccacacaggtgagagtgaggtgttttccctgaaaggacttttccttagcagtgat

SEQ ID NO: 52710 - DNA, 58 bp, Homo sapiens; identical to SEQ ID NO: 1391

SEQ ID NO: 52711 - DNA, 56 bp, Homo sapiens; identical to SEQ ID NO: 1392

SEQ ID NO: 52712 - DNA, 91 bp, Homo sapiens
tccaggaggaatttatggaatgagtgggagatactatataaatactgtatatatatatttagatggtgtcttgctctgtcaccaggctgga

SEQ ID NO: 52713 - DNA, 88 bp, Homo sapiens
ctgtgtttaaggtctagtcattctgatgtgtgcacgcctactttggtttctgcatattttttcttgatttatgaaactttccccacag

SEQ ID NO: 52714 - DNA, 68 bp, Homo sapiens
gagatggatgtgggggtgactggaagctcagttctcactcagcccctttgtcactcacactctgcctc

SEQ ID NO: 52715 - DNA, 110 bp, Homo sapiens
ttcattgagtggaagtggatcatcataaaggtcttcatcttcatcatgttcatgtcgagtaggctgataaggaggaggaagtggaggggttggccttgctgtctcaagag

SEQ ID NO: 52716 - DNA, 103 bp, Homo sapiens
gccaggcgtggtggcatgcacctctaatcccagctactccggaggctgaggtagaagaatcacttgaatcctggaggcagaggttgctgtgagccgagatggc

SEQ ID NO: 52717 - DNA, 100 bp, Homo sapiens
tggtaccatgcaggctaatttttaaagttttctgtagagacagggtcctgccttgtttcccaggctggtcttgaactcctggcctcaagcaatcctccca

SEQ ID NO: 52718 - DNA, 58 bp, Homo sapiens
attatatatatatgtgtgtatgtatataatatgtacatatatatagtatatgtataat

SEQ ID NO: 52719 - DNA, 105 bp, Homo sapiens
tggagtaattgaagtctcctactattattgtgttgctgtctgtctcatttcttaggtctattagtaattttttaaataaattcgggagctccagtgttaggtcca

SEQ ID NO: 52720 - DNA, 86 bp, Homo sapiens
tgggggcagtgagtactgatttaagatacacacatgtgaatcattctctctgtggctgtgtctcaagtcagagcatcagaccctta

SEQ ID NO: 52721 - DNA, 117 bp, Homo sapiens
gatgtatctgccaaaatgagcaaggagagagagactgtggtccgaaggattggcccccatctcagcctctctctgtgtctatacccttgcccagcctcatcgtgcaaagaatgcatt

SEQ ID NO: 52722 - DNA, 102 bp, Homo sapiens
tgtccttggtaagtgacatggaaccattggaaaggattaggccaggtaatatcattatcagatttgattttttttaaattaatccatttatttatttattca

SEQ ID NO: 52723 - DNA, 121 bp, Homo sapiens
gagtgggtgtggagaaagcacgtgtggggctctggctggggcgtttcagttctttctgcctcactagctctgtcactcagggtgagtgcttcaactttgctgagtgtttctttgagtctag

SEQ ID NO: 52724 - DNA, 84 bp, Homo sapiens
cactgcattgtgagagtcccagaagctgtcttttcttttttttttttttttgagacggagtcttactctgtcacccaggtagtg

SEQ ID NO: 52725 - DNA, 114 bp, Homo sapiens
gggatgggcaagaacagcttggggctggaaaacaaatgcagctgtttgggtcagatctctttcgctgtctcagtcacaattttgcagtaacagtttcaaaagctgcctatcacc

SEQ ID NO: 52726 - DNA, 94 bp, Homo sapiens
gaagcatatataaagcttagtttccttttggtacagtttgctcttatatttatttttctaccatcataggagtttgctatggtttgaatgcttc

SEQ ID NO: 52727 - DNA, 113 bp, Homo sapiens
gctgctgtctctgctgagcatctgtgtatgtcttctcctctcctgttccttttttttttaattttttttcctgagacagtctcactctgtcgcctaggctggagtgcagtggc

SEQ ID NO: 52728 - DNA, 79 bp, Homo sapiens
gagggagctggggattctgttgaaatgcagatttttttttttttttttttttttttttgaggcagagtctcgctctgtc

SEQ ID NO: 52729 - DNA, 71 bp, Homo sapiens
gttcttaacctaagaaggtgaatggtgagagttgcacttgtactctgtcagtttctgagtgggatgagatc

SEQ ID NO: 52730 - DNA, 86 bp, Homo sapiens
ccaacctttttggcaccagggaccagtttcgtggaagacaatttttttttttttgagacggagtcttgctctgtcacccaggatgg

SEQ ID NO: 52731 - DNA, 82 bp, Homo sapiens
ctgggacaaggaaaaggcaggcggtgggggaccaggtcaacacaggcaacatccgctcacatcctcactcagtcagtcccag

SEQ ID NO: 52732 - DNA, 58 bp, Homo sapiens; identical to SEQ ID NO: 1215

SEQ ID NO: 52733 - DNA, 79 bp, Homo sapiens
gcctggtcaacacagtgagaccccatccctattttatttattttttgagatggaagtctcgctctgtggcccagaccgc

SEQ ID NO: 52734 - DNA, 63 bp, Homo sapiens
gagtctcactcactcagtgctcaatgttgcccaggctggagggcactggcgtggtctccgctc

SEQ ID NO: 52735 - DNA, 96 bp, Homo sapiens
tggtattcacttatatatacatatatgtgtgtgtgtgtgtatatatatatgtgtgtgtatatatatacacacacacacatacatagtggggtgcca

SEQ ID NO: 52736 - DNA, 59 bp, Homo sapiens
ttgagacagactctcactcactctgttgcccaggctggagtgcagtggcttgatctcga

SEQ ID NO: 52737 - DNA, 87 bp, Homo sapiens
caaggagcattcatttaactgaaccaaactgggaattgcgcaaatacagtgcttttcaaactttttgttttcagcagaatctttttg

SEQ ID NO: 52738 - DNA, 75 bp, Homo sapiens
gtcttccctctgtgggtctgtgtgtccaaatttccctcttctcataaggacactgaccagtggattggggtctac

SEQ ID NO: 52739 - DNA, 61 bp, Homo sapiens
tggagagagggaggcagggctctcttgcctttctgtgactctctcttttttgcattctcca

SEQ ID NO: 52740 - DNA, 95 bp, Homo sapiens
gagtgtttctcatgctatgtgctcttctcttctgtgtgtttaaatttttttacaatgtaaaataaaaacaggaggatgctgtaagaagaatattt

SEQ ID NO: 52741 - DNA, 56 bp, Homo sapiens
gagacagggtctctctctgtcacccaggctggagtgcagtggtgagattatagctc

SEQ ID NO: 52742 - DNA, 74 bp, Homo sapiens
atatatatgtatgtgtgtgtgtatatatatatgtatgtgtatatatatatatatatatatatatatatatatat

SEQ ID NO: 52743 - DNA, 113 bp, Homo sapiens
gagaagggggccccaggcagtcacacattgaaggttcataagttatttttcattttaaaaaagctgactggaagatgaattcccactgttcataaccctgctgccctctgctt

SEQ ID NO: 52744 - DNA, 117 bp, Homo sapiens
ttgttttcactgcattgacacattatgcatttatgtctctctcccaccgccttgcacacacatactagaatgccagctccctgggtgcagagacagagcatttgttcacagaaacaa

SEQ ID NO: 52745 - DNA, 95 bp, Homo sapiens; identical to SEQ ID NO: 68

SEQ ID NO: 52746 - DNA, 93 bp, Homo sapiens; identical to SEQ ID NO: 69

SEQ ID NO: 52747 - DNA, 88 bp, Homo sapiens
gggttttgtgcttgtatgtgtgaacatctttgtcactcacggtcagtgatttatacagacatgatcttaacaattcagtatggagaac

SEQ ID NO: 52748 - DNA, 58 bp, Homo sapiens; identical to SEQ ID NO: 5571

SEQ ID NO: 52749 - DNA, 115 bp, Homo sapiens
gatcaaggtgctacccggcttggtcaaattatcttctagattgtagactgctgacttttttttttttttttgagacagaatctcactctgtggcccaggctggagtgcagtggca

SEQ ID NO: 52750 - DNA, 115 bp, Homo sapiens
tgtctttgcattttcttgatatcttttgaagcacaagaatgtttgatgaagttcaatttatctatttcttcttttgttgcttctgtttttggtgtcttatctaagaagtcattgg

SEQ ID NO: 52751 - DNA, 98 bp, Homo sapiens
gtaacatactagccctgtggttgagttgtttcttcctattttttttttttttaaatatagtcagggtctcactccattgctcaggctggatggagtgc

SEQ ID NO: 52752 - DNA, 105 bp, Homo sapiens
tttgaatccatgcttctctgtgaggtggcttaaatattatatatatgtacacagtatacattatttagtatatatatttatttcatgagaataaaaggatttaag

SEQ ID NO: 52753 - DNA, 67 bp, Homo sapiens
gggcgacagagtgagaccctgtctttttttttttttttttttgagacagagtctcactctgtcaccc

SEQ ID NO: 52754 - DNA, 70 bp, Homo sapiens
gaagaaggtgaagacactcagtcagtctgtgctgtttgggcacctctgctgattttagttctgcttcttt

SEQ ID NO: 52755 - DNA, 93 bp, Homo sapiens
tttttcccctccaaaatattgtctgatgtttgctccttcgtgttacttatggagagttactgtttatgacttaaagatatgggggtggagagg

SEQ ID NO: 52756 - DNA, 77 bp, Homo sapiens
tcttcagttttgtggttgtttaaagtggaaatagcagtactagttattttcttgtacagaagcaggatatgtgagga

SEQ ID NO: 52757 - DNA, 112 bp, Homo sapiens
aattatatctatgtatatctctatatatctctatatatctatatatgtatatatctctatatacatctctatatatgtatataattatatatatctatttatatatgtaatt

SEQ ID NO: 52758 - DNA, 95 bp, Homo sapiens
ggagaggaggggttaagatggtgtcttacaggtatttctagaactttattcccaagatttatttatttacttagagacactttcactttgtcacc

SEQ ID NO: 52759 - DNA, 116 bp, Homo sapiens
gtcattttttgggggggagggggttgggggggagacagagtctcactatgtcactcaggctggagtgcaatggcgtgatctcagctcactgcaacctccgcctcctgggttcaagc

SEQ ID NO: 52760 - DNA, 94 bp, Homo sapiens
tcaagagtgaggagaaggcaggaggcatgttcagagatcattgtgtaagtcaatcatccttagaatgtccttgatgtgcttctaaaacccttga

SEQ ID NO: 52761 - DNA, 87 bp, Homo sapiens
gttctctctctctgtctctatctctcaatggttgaaacccacccaaccactatgctgtgaggtgcccagaggacaaagttggaggac

SEQ ID NO: 52762 - DNA, 115 bp, Homo sapiens
gcctcctgagtagctgggaccacagttgcacaccaccatgctcagctaatttcttattttttgtagagatgaggtcttgttttgttgtctaggctagtctcaaactcttggagtc

SEQ ID NO: 52763 - DNA, 126 bp, Homo sapiens
ttggccacgtgcacctgtcagttctgtgtctgtgacgggcacccagatgtgaggtctctccctgtttctcactgtctttgttgtcaatgtagttggagacagaacttgaaccaaatctcgtttttg

SEQ ID NO: 52764 - DNA, 128 bp, Homo sapiens
ctggctaacccaggctggaaaggcttcctgcagcctcagaacagtcacggatcacaggcatgacttctgacacattctgccagctcagactgcttgtcccaacttgaggtccaggaaatgcaatcagt

SEQ ID NO: 52765 - DNA, 59 bp, Homo sapiens
ctgcctctccctgtcactctcactggggctggggagtggtgagagttcagggttggcag

SEQ ID NO: 52766 - DNA, 99 bp, Homo sapiens
ctggcatttagggagccttagaggcttgatagctctcactcttttttttttttttttttttttttttgagatggagtctcgctctttcacccaggccag

SEQ ID NO: 52767 - DNA, 114 bp, Homo sapiens
gactaatacaccagagttgacagtctagggtagggagtcgggcaataatgagtaaataaagaaacaaagattgatgtagtcctcacctcctgcctgtcagccttctaagtggtt

SEQ ID NO: 52768 - DNA, 74 bp, Homo sapiens
ggatgctgggcatggcaaatgcactaaaagtgcccgtggtgactggcctgctgtgtccctgcctgcctcccacc

SEQ ID NO: 52769 - DNA, 85 bp, Homo sapiens
tctaaaaagtgagctcccttctctatgttggtaagtgtgctgtgctggacacagttcagtctttgatgatgtgggtgccctggga

SEQ ID NO: 52770 - DNA, 64 bp, Homo sapiens
gagggaaggcaggtgcatagagtcttggcttagcccccgagtctctctgtgtctggcagctctc

SEQ ID NO: 52771 - DNA, 90 bp, Homo sapiens
aggtgtcagcagggtgggtcccgttttggaggtgctgagggagaatccattccctgcctctctcccagcctctgatggttgcttcaatcc

SEQ ID NO: 52772 - DNA, 92 bp, Homo sapiens
agctgtgttctgtggtggatgcctgggtgtgtgtgtccgtgtgcacgtgcacacacagacacacacacacacacacacacacacacacagtt

SEQ ID NO: 52773 - DNA, 114 bp, Homo sapiens
atttatatctgatgttcattgctatggaaaagtctgagacaaatattatttttattaaattgtaggtagattgacttttctgctgaaatacttggggagtgagcttttataaat

SEQ ID NO: 52774 - DNA, 114 bp, Homo sapiens
ggggatttaagaactccagtttgctgtaatgtttttaacaagatacgtgtgagtctcagtgtgtgtgtgcatgtatgtgtgtgccttttctttataggactattctgcctcctc

SEQ ID NO: 52775 - DNA, 94 bp, Homo sapiens
ggtggcttctttatctattcagaagtataaggatgtattgaaaacaagtataattttctagtggttttcttatggtttatttgattcagccatc

SEQ ID NO: 52776 - DNA, 95 bp, Homo sapiens; identical to SEQ ID NO: 68

SEQ ID NO: 52777 - DNA, 93 bp, Homo sapiens; identical to SEQ ID NO: 69

SEQ ID NO: 52778 - DNA, 108 bp, Homo sapiens
gcctcacctctcctcctaaaattcagttcctcctcacactctcagtgcctggccccggccatgcattagatgccctgaagagcttttgaaaaggaccaatccctgggc

SEQ ID NO: 52779 - DNA, 108 bp, Homo sapiens
tagaaacccactgcaattcctctgaaaaaaaaaatccggcagtacatttttttttttacaagctgtttttaaaattacacagagggccagattgcacaggcccagcta

SEQ ID NO: 52780 - DNA, 89 bp, Homo sapiens
cctgagaccctgggcctgtctgtgcctctgtgcattcacactaatgtgacatagggcattttaaagtggaactatgcaatggtcactgg

SEQ ID NO: 52781 - DNA, 83 bp, Homo sapiens
gggaagaagtggttgggatgccaggcaaagcaatggaggagaatttatccacctcactgtctgtcacactacttccttctcac

SEQ ID NO: 52782 - DNA, 104 bp, Homo sapiens
tgtgcatacatgtatatacacatatgtatatatgtacatgtgcatacatgtatatacacatatgtgtatatgtacatgtgtacacgtgtatacatgtatacaca

SEQ ID NO: 52783 - DNA, 79 bp, Homo sapiens
ggtgggtgtatgaagtggtcctcaaaggagatttttgctctctgcagacagtctgcctgtctgtaggtcacttcctgcc

SEQ ID NO: 52784 - DNA, 83 bp, Homo sapiens
tttctttaaggctgtgcactcagcactgcactggcctggagcatccactcagggagtgtgctgacagtgtacacaaaaagaga

SEQ ID NO: 52785 - DNA, 82 bp, Homo sapiens
tggaatgggtccctgtttgtatgattctcagtatcttctgccttggatgatggcagtgagtgaatcagcaagagcatgtcca

SEQ ID NO: 52786 - DNA, 95 bp, Homo sapiens; identical to SEQ ID NO: 68

SEQ ID NO: 52787 - DNA, 93 bp, Homo sapiens; identical to SEQ ID NO: 69

SEQ ID NO: 52788 - DNA, 83 bp, Homo sapiens
gcacagcagcccgcagcagcttcagagcggctggagagacatttggggacgagcagcccctctgtggctctgcctctgtttgc

SEQ ID NO: 52789 - DNA, 110 bp, Homo sapiens
tccagtatttataaggttctaggtcttatatttaagtcgcttatctactttgagtggatttttgtgtgtggtgtgagacgagggtctaattttatttatttgcatctgga

SEQ ID NO: 52790 - DNA, 104 bp, Homo sapiens
tgtttctctttggacagatgtgctgccagtgctggaagtaggctgactgtgtctctctccctgctctgagcctggcaccagatttggcaaaaccagacagagca

SEQ ID NO: 52791 - DNA, 58 bp, Homo sapiens
tgagacagagtctcactctgtcgcccagactggagtgcagtggtgcgattttggttca

SEQ ID NO: 52792 - DNA, 68 bp, Homo sapiens
acgctgtggtgtgagagcagagtccgttctctaagtgtagagtgcgcggctcgacccttacctggcgt

SEQ ID NO: 52793 - DNA, 78 bp, Homo sapiens
ttattgtcttgttttgatggttgggtcatcgtcatcatcatcatcatgatgattagtatccccatttcgcagcagtga

SEQ ID NO: 52794 - DNA, 88 bp, Homo sapiens
acatatgtagatatgtatatatgtgtgaatgtatatatatatacatacgtacatatgtgtatatgtgtgaatgtatgatatatacatt

SEQ ID NO: 52795 - DNA, 112 bp, Homo sapiens
tcaatagtgcatggaaaaggtatcaggattgacatgattgtgtgtatgtaattatatatatagcattgtcatatccatcttgctggattttctctctccccattggccttga

SEQ ID NO: 52796 - DNA, 79 bp, Homo sapiens
cccaaatgatggaaacagtgtgtctgactctctcctttctcctgattgggggaatcttcaccagtgcatttcctctggg

SEQ ID NO: 52797 - DNA, 82 bp, Homo sapiens
gagatctgtcgcccaggctggagtgcagtggcgcgatctcggctcactgcaagttctgcctcctgggttcaatgccattctc

SEQ ID NO: 52798 - DNA, 114 bp, Homo sapiens
tgaaattttcaatgagttttgggaaatccaaatatagataaaatatttttgttaaaaattgagttgtcaaattgagatgtattttgagtctcaaatacacactggaaaatttca

SEQ ID NO: 52799 - DNA, 80 bp, Homo sapiens
tgagacggagtctcactctgtcacctaggctggagtgcagtggcgcaatctccgctcactgcaagctctgtctcctgggt

SEQ ID NO: 52800 - DNA, 116 bp, Homo sapiens
tccagcctggacaacaagagacccaaactcaaaaaacaaagaattgagactagttatctttaagtatcttttttttttttttttgagaccgagtctcactctgtcaccaggctgga

SEQ ID NO: 52801 - DNA, 58 bp, Homo sapiens
tgagacagggtctcactctgtcacccaggctggagtgcagtggtgaggtcatggctca

SEQ ID NO: 52802 - DNA, 88 bp, Homo sapiens
gaccctagcagagaggagagactgtgatgagatgccagtgacgcttgcgtgcgtttgctgatggagtattctcttatttgttgttgtt

SEQ ID NO: 52803 - DNA, 113 bp, Homo sapiens
agtgctgggattataggtgtgagccactgtgcctggccaagattgtatcttttcaattgaaagaacatacacagcttaaggacaaaagcgataacaaccttcactctaaaact

SEQ ID NO: 52804 - DNA, 104 bp, Homo sapiens
tcttcaatctattttgagttgattttttatatggtgagagataggggtctagtttcattctttttcatatggctattcagctttcccagcaccattattgaaga

SEQ ID NO: 52805 - DNA, 115 bp, Homo sapiens
ctatgagtcaattaaacctctttcctttataaattacctagtcttgtgtatttcttcatagcggcatgaaaacggattaatacagggcccatgtactagaagacagaggacatag

SEQ ID NO: 52806 - DNA, 143 bp, Homo sapiens
gggcaacatagtgagactctgtttctacaaaggagatcccccccgtccgttttttttttttgagacacagtctctgtcacccaggctggaatgcagtggcatgatcttggctcactgcaacctccgcctcccagattcaagtg

SEQ ID NO: 52807 - DNA, 90 bp, Homo sapiens
tttccaggcccacagcagttttctgaagcatgaaacaaagctttctcttggagcaaagtgaagggtgagagaacagagtgggccggggaa

SEQ ID NO: 52808 - DNA, 83 bp, Homo sapiens
taccgtgtgtgtgtgtgtgagtgcgtgtgtgtgtgcgcgcgtatgtgtgcgcatgtgcacgtgtgttctcacacacaccgcac

SEQ ID NO: 52809 - DNA, 82 bp, Homo sapiens
ttggtgttctctgtgtgtgcctgtctgtgtccaaatttcccctaattataaggacagcagggatattgtattaggggcccag

SEQ ID NO: 52810 - DNA, 124 bp, Homo sapiens
tgtatgctgtcgtgtatgtgtgtatgcatgcatgtatatatatgctgtgtgctgtgtctgtttatatgtctgtggtatgatgtgcattgtgtaaatttgcatgtgtgtgtgtataaatatatgg

SEQ ID NO: 52811 - DNA, 77 bp, Homo sapiens
tggctactcaggaggctgaggtagaaggatcacttgagcccaagaggtcaaggctgcagtgagccacgagtgtgcca

SEQ ID NO: 52812 - DNA, 109 bp, Homo sapiens
cacagctttctcaaagtcacgcagtccccaaagcccgggaagacctgtgagtctgactgactccgccctctccctcttcatgaggatgcctttgggaccaacagttgtg

SEQ ID NO: 52813 - DNA, 81 bp, Homo sapiens
ggaggaaccaaagaggaaccaggaacgttgacggcacctggatgaagcgggtggtgtgagtctgtccctctcagggacccc

SEQ ID NO: 52814 - DNA, 109 bp, Homo sapiens
gtggggttaaaaagtctcaggttttctcttttgaattttaagaatgacacaatgcaagatgtatatttttttttcaaaaagaaaataaatgactcattattgattttat

SEQ ID NO: 52815 - DNA, 109 bp, Homo sapiens
aagatagagcaatgtttagcatccgattttggctggggttttccatggattagctgatgccaggctgcctccatgccagcaggagctgggcatttttgctgactgtttt

SEQ ID NO: 52816 - DNA, 103 bp, Homo sapiens
caaagcatgagcacaattagggcccagccaccaggtccactttgcaaccaacactgcctgacttgagctggactgacgctgggtctgagtttctgctgttttg

SEQ ID NO: 52817 - DNA, 109 bp, Homo sapiens
tggcattatatgtatgtgtatatatatgtgtgtgtgtgtatgtatatatatatacatacatgaagtatatataagcacatatatatatatatatactttgtaagtgtta

SEQ ID NO: 52818 - DNA, 58 bp, Homo sapiens; identical to SEQ ID NO: 1745

SEQ ID NO: 52819 - DNA, 92 bp, Homo sapiens
cagattttgccgcaagagaaataaggagatggtgtagggttttaagcaagggaggcacatgatctctctttctctctgtgtgcatgtgtgtg

SEQ ID NO: 52820 - DNA, 71 bp, Homo sapiens
ctatagataccattatatatatgtctatatatatgactatatgtagactatatatataattatatacatag

SEQ ID NO: 52821 - DNA, 124 bp, Homo sapiens
gttctaaggatagtaatgtcagtgcgtctaggtaaagagacctttgaacacccgtgtgagtctgtgtgtgcctgtgtgaatagcaaatgagctgtcaccagaataccttcatcccagtaggtgt

SEQ ID NO: 52822 - DNA, 112 bp, Homo sapiens
tccagctaatttttaaaattttatagaaatgagggctcactctgtgactctggctagtctcaaactcctggtctcaagtcttgcccccaccctggtctccgagagtgctggg

SEQ ID NO: 52823 - DNA, 72 bp, Homo sapiens
gaacttaatgtgtgtgaggctatgaacaagactgtctcagtctctgacctgttatttgttcacactgagttc

SEQ ID NO: 52824 - DNA, 64 bp, Homo sapiens
gtggtctgagtgactcaagaggctgaggtaggtggttcccttgagcccaggagtttgaggctac

SEQ ID NO: 52825 - DNA, 96 bp, Homo sapiens
cagatactggatgtgctggtgccttattcttggatttttcagcctccagtagtgtgaggaagaaatttctattgtttacaagccacccagtttatg

SEQ ID NO: 52826 - DNA, 114 bp, Homo sapiens
gatacctgagatttacttcaaaacaatccattgccaggggtgaggttgtagcctgaattgataatttctgaagctgggggatggtacatggaggtttattatactcgttatatc

SEQ ID NO: 52827 - DNA, 67 bp, Homo sapiens
gccgtgtatggtgtgtgagctctgtatgtgtgtggggtgtgtgtgtggagtgtgtgctgtgtgtggt

SEQ ID NO: 52828 - DNA, 79 bp, Homo sapiens
ttgctttactagtgaatttcttgaattctgactcttggttataaaataaaaggcaggctttaatttcactgtaaggcag

SEQ ID NO: 52829 - DNA, 108 bp, Homo sapiens
ggggtcagattgggtttgaaaatgagcaaaattattttgtaaaaattataattatatgttatataattattacataataattttgctcattttcattccttagtctcc

SEQ ID NO: 52830 - DNA, 163 bp, Homo sapiens
gcaggagatgaggagagagagaaaggtctttgagattctaagtaggccttgggttaatacaaccatcatttttttttttttttttgagacatagtctctctctgtgacccaggctgcagtgcagtggcatgatcacagcacactgcagcctcaatctcctggg

SEQ ID NO: 52831 - DNA, 138 bp, Homo sapiens
agagtgtgtatatatatatatgtgaagatatatatatctatatatatgtgaagatatatatatctctctatatatgtgaagatctatatgtgaagatatatatatctatatatatgtgaagatatatatatatctgcg

SEQ ID NO: 52832 - DNA, 128 bp, Homo sapiens
gtccccatgtttctttggccaactctgctctagcttccatgtcaaaggtctcaccctcactcggtccctcagtgttgcagctatagcttgtggcttctttcctggtaactgtggtgttggaaaatgac

SEQ ID NO: 52833 - DNA, 91 bp, Homo sapiens
ggcacggggcttgggacactcactgcctgtgtctgctcatccctcaatgagttaaatcaccttaagtgagtcatctgatctctctgaatcc

SEQ ID NO: 52834 - DNA, 106 bp, Homo sapiens
atatacatatctacacatacgtatatgtatacacatatgtatatgtgtaaatatgtatatatgtatgccatataaatatatatgtgtatatatgtatatatgtgta

SEQ ID NO: 52835 - DNA, 70 bp, Homo sapiens
gcggccataggatggaagtccctgttttccttctgaccattggccagggtcactctcactctctggaagc

SEQ ID NO: 52836 - DNA, 118 bp, Homo sapiens
caatgtgtgtgccgcgtgtggtgtgcaatgtgtgtgccatatgtgtggcgtgtgtgatgtgtgtgtgctatgtgtgtggtgtatagcgtgtgtgtcctgtgtgctgtttgcttgtgtg

SEQ ID NO: 52837 - DNA, 62 bp, Homo sapiens
cacataacagtgacagcagacactgaacaccgcctgcagtgggctgggcactgctgtacgtg

SEQ ID NO: 52838 - DNA, 67 bp, Homo sapiens
tcaaagggggttgttctctggctggccagggtgggggtcacaaggtgctcagtgggagagcctttga

SEQ ID NO: 52839 - DNA, 111 bp, Homo sapiens
catgaagaacattgcaggtgaggacagggctggcagcgcctgtgtgtgtctcagtctatgatgcactgtggccctggttctgttcccagtgcaaatatgggatgtctgttg

SEQ ID NO: 52840 - DNA, 94 bp, Homo sapiens
agggagtcagtgggtactgggagtataggaaaaaaatgatgtcttcaccttgggcaatctagtttttctttttctttctttttcttttcttttt

SEQ ID NO: 52841 - DNA, 70 bp, Homo sapiens
cagagccctcacttcttctctctgtttctccaccatgtgaggacacagtgagaagacagtgatcagtctg

SEQ ID NO: 52842 - DNA, 87 bp, Homo sapiens
ggctggcatgggggcagctcagagtggctcagtcactggaaggttctgccctgacagtgccatccagtaccacctgtgtggctctga

SEQ ID NO: 52843 - DNA, 114 bp, Homo sapiens
ctggctaaagttataagcaatcttaatttttatgtatgtatgtatgtatgtacgtatgtatgtatgtatgtatgtacttactgagacatggtcttgctctgctgcccaggctgg

SEQ ID NO: 52844 - DNA, 103 bp, Homo sapiens
tcactttttttgttgacacatggctgtgtttttatgtatttatcaacaatggaagcaaaagaagagggtacagggggctcacagaccatctcacagcgggtga

SEQ ID NO: 52845 - DNA, 61 bp, Homo sapiens
tggatctagtttgctgatattttatttatgtatgtaaataaaatatttgcatctaagttca

SEQ ID NO: 52846 - DNA, 76 bp, Homo sapiens
ctcacatggctgtctgtctcgctgtgtcctctcttcttatgagaacaccagtctttggattcaaggcccatgtggg

SEQ ID NO: 52847 - DNA, 97 bp, Homo sapiens
ggtgttgccctacaaacaacctctctcccaggctccctgtgtgaccttctggcccttggaggaggcacagatgcgtggaacagagccagcagacacc

SEQ ID NO: 52848 - DNA, 81 bp, Homo sapiens
ggctttgagggtgcagaactctgtatctcactctctgtgcaaggaggggatgatcgctgctctgcctccttctaaagagct

SEQ ID NO: 52849 - DNA, 70 bp, Homo sapiens
gggtggggacttctgtgactgtgacagctggcctctgggccaccttttccagaaacagcattcctgattc

SEQ ID NO: 52850 - DNA, 119 bp, Homo sapiens
cctcgagagtggcattggacatttgggcaagggtcttatggaggctgagagttgactgtgggctcatcacagctattttgagggtcttgacagcccaactagcaaacaattctgcaggg

SEQ ID NO: 52851 - DNA, 91 bp, Homo sapiens
gtgtgtgtccctgtgaggggggaggggctgtgtgtgtccctgtgaggggggagggactgtgtgtgtgtccctgtgaggggggaggggctct

SEQ ID NO: 52852 - DNA, 98 bp, Homo sapiens
ctgtgatggaggaggggctgtgtgtgtccctgtgaggggggagggactgtgtatgtgtgtctctgtgaggggggaggggctgtgtgtccctgtgaggg

SEQ ID NO: 52853 - DNA, 119 bp, Homo sapiens
gtttgttcattgtgcccctataaagagtgctgaggctgggtaatttatatatacatatatgtatgtacgtatgtgtatgtatacatgtatagtttatttggctcatgattccagatggc

SEQ ID NO: 52854 - DNA, 105 bp, Homo sapiens
ggctgctgtagaagagagttcagtgctggctctcacactcagtggtatatgagaatcactctgggagctttgaaaacttccgacactctctcaacgccccgggcc

SEQ ID NO: 52855 - DNA, 58 bp, Homo sapiens; identical to SEQ ID NO: 637

SEQ ID NO: 52856 - DNA, 110 bp, Homo sapiens
gcatcccatctctgtccctcttggggaggagggctgtggtgggagtcaccccccgcactgtgtctctgtccctcctggggaggagggctgaggttggagtcaccccctgc

SEQ ID NO: 52857 - DNA, 95 bp, Homo sapiens
tacaaagtgtggcctgtgtggcctcagggcggcatgtgtgcctgtgtgtgaggctctgtgtgtctgtatgtggctgtgtgtgtctctgtgtgtgt

SEQ ID NO: 52858 - DNA, 90 bp, Homo sapiens
gtgcgtctgccctgtacacacagtgtgcacacacaggccatgatacacacccatgccatgcacacaccatgtgcacacaggcacacgcgc

SEQ ID NO: 52859 - DNA, 81 bp, Homo sapiens
tctcagaccactgacagcacagtgtgtgtttgcgtttcccgtctcctgacatgataaagggccttgctggggggtttgaga

SEQ ID NO: 52860 - DNA, 98 bp, Homo sapiens
gcctccttcctcccgtggctttgccccctgtgtctctgtatctcaaacttccctctcctgtgtcttataaggacagcaagtcgttggatttagggtcc

SEQ ID NO: 52861 - DNA, 61 bp, Homo sapiens
ctctgtgtgtgtctgtgtcctcatttcttcttataaggacaccagacatattggatcaggg

SEQ ID NO: 52862 - DNA, 80 bp, Homo sapiens
gacatgctgctgctttttttgttttagttttgagatggggtctcactctgtcacccaggctggagcacaatggcatgatc

SEQ ID NO: 52863 - DNA, 82 bp, Homo sapiens
tcagtcacactcagacactggctcataaggagtgggctggcccagagaacagcccaggtcactggaaggaagtgtgaattga

SEQ ID NO: 52864 - DNA, 90 bp, Homo sapiens
ggtgtgagccaccacgcccagccccaacttttattttacgtacagatctaaacgtatcacatgcaggtttgttatgtggtgtgtcgcacc

SEQ ID NO: 52865 - DNA, 141 bp, Homo sapiens
gtgtgtgcctgtgtgtgccgtgtgtgtgcatttgtgtgcctgtgtacctgtgtgcacaagtgtgtgcctgtgtgtgtgcctgtgtgtagctgtgtgcgtgtgtgtatatgtgtatgtgcctgtatgtgcgtctgtgtgtat

SEQ ID NO: 52866 - DNA, 104 bp, Homo sapiens
agtggctcacgtctgtagtcctagcactttgggaagctgaggtgggtggactgcctgagttcagttccagacaagcctgggcaacagggtgaaaccccgtctct

SEQ ID NO: 52867 - DNA, 82 bp, Homo sapiens
cacgtggtgtacatccgtgatattattcacaatatctgactgaggtatgacttttaatatcacagtgggtgtacaccctgtg

SEQ ID NO: 52868 - DNA, 76 bp, Homo sapiens
ccagctctgtaaaactcagaaggcctttagggcaggcactgtgccactgaccccctctctgtgtcccagggcccgg

SEQ ID NO: 52869 - DNA, 96 bp, Homo sapiens
tgtgcttatgaggcggtgtgtgagagtgtgcatgtgcatgtatggggcggtgtgcgagggtgcacttgtgtgtatgaggcggtgtgggagagtgca

SEQ ID NO: 52870 - DNA, 75 bp, Homo sapiens
ccctgggactcgctgtctcagacagagcctcacccacctcggagctggttctcctgataccacagggcccaaggg

SEQ ID NO: 52871 - DNA, 76 bp, Homo sapiens
cctgtgctcagagtcagcaatgcgcgtttctctgtccgtaagtcagcggtgcgggtctctgtgtgactgtgtcagg

SEQ ID NO: 52872 - DNA, 74 bp, Homo sapiens
aggcttcagagagactagatggcaaatgtctcttatgggaccttaaaatgtgtcagactctctgtaaaagacct

SEQ ID NO: 52873 - DNA, 71 bp, Homo sapiens
ctcggaggagctgctccatggctactcgccttgtgcacagatgtgtgtcagtcatggtgctttcatctgag

SEQ ID NO: 52874 - DNA, 98 bp, Homo sapiens
ttctcttaagagcatcttctgaagagcagaagacctatcttaattgtgataaagtttataattctttttcttcgaagaagcatgcttttgttgtagaa

SEQ ID NO: 52875 - DNA, 87 bp, Homo sapiens
gtgagggaagctctaaatacgttaagttcctcttaactagtaggtatgtttagggtgaaatgtagtgtggatggagcattccaacac

SEQ ID NO: 52876 - DNA, 76 bp, Homo sapiens
gctggaacctgggaggtggaggttgcagggagccgagattgcaccactgcactccagcctgtctgtctctctcagc

SEQ ID NO: 52877 - DNA, 115 bp, Homo sapiens
atgaatttaaataggtatctgtcttccagctactaaaatctgtatttgttttctatttttatgtaacaaattatcaccaacttggtggctaaaacaacaccatttattatttcat

SEQ ID NO: 52878 - DNA, 130 bp, Homo sapiens
cccacagtttctcggtgttctggtatggtcttcctcactgcaaagagccataaacctcactctgtcagactgtgggtctgttcctggcgaccttagactgattaggctagggcagacatttagaatttga

SEQ ID NO: 52879 - DNA, 81 bp, Homo sapiens
gcggcctcagtcttcagcctggctccaggcttctgtggcattccacaggggcgctttggggctgtgtgagacaggcattgc

SEQ ID NO: 52880 - DNA, 79 bp, Homo sapiens
gcagcggcactgggctgcccacacctctgagagccaagtacgagacccggtctctctctgggtggctgtcagttgctgc

SEQ ID NO: 52881 - DNA, 76 bp, Homo sapiens
gcacccaccttcagtgagtcagtgtgtgggtgcgtccgaggatggggccctcacctggctgcagctgtgtgtgtgt

SEQ ID NO: 52882 - DNA, 58 bp, Homo sapiens; identical to SEQ ID NO: 1065

SEQ ID NO: 52883 - DNA, 82 bp, Homo sapiens
gctgggggatgtgtaggtggttctgggttttctctgttaacagcagtgctgcagggccccgtgtgtgcctctgtctccctgc

SEQ ID NO: 52884 - DNA, 60 bp, Homo sapiens
gggcttgcagacggcattgcctccctgtttcctcatggggctgtccctctgtgtgtgtct

SEQ ID NO: 52885 - DNA, 71 bp, Homo sapiens
cgtgtctgactcactggctgaggtgggggagccaggcgccctgatgcacgctcgtgaagacattcagaacg

SEQ ID NO: 52886 - DNA, 76 bp, Homo sapiens
gcgtgtgtgtgcatccctgtgtgcgtgtgtgtgcgcccgcatgtacgcatgtgtttgcatgtgtgtgcccgcaagg

SEQ ID NO: 52887 - DNA, 112 bp, Homo sapiens
gtgctgctcctgagagtaacaagggcgtgaataactagatgtctggacacatctgtgtgtgtgtatgctgtgtgtccacgagtgtgtgtgcctgtgcatccgtgtagtgtgt

SEQ ID NO: 52888 - DNA, 60 bp, Homo sapiens
ggcatgcagacgccgactcctccgtgtatccccacagggctgtccctctgtgtgtgtgtc

SEQ ID NO: 52889 - DNA, 105 bp, Homo sapiens
tgtaaggctttactccacctggaattgtttttgtgtaggatatatatatatatgaaagctaatgtatgctgggcttaatgcctaggtgatgggatggtctatgca

SEQ ID NO: 52890 - DNA, 117 bp, Homo sapiens
gctgggcgtggtggtgcacacctgtggtctcagctacttaggaggctgaggtaggaggatggcttgagcccaggaaggttgaggctgcagtgagccatgatcataccattgcactcc

SEQ ID NO: 52891 - DNA, 122 bp, Homo sapiens
gggcagcccgtgggactctaggatgcttgggaagtagtgaagggcaccatcaactctctcgtttttttttgttttttttttttttttgagatggagtctcactctgtcgcccaggctggagt

SEQ ID NO: 52892 - DNA, 76 bp, Homo sapiens
agttcgtgatttcttttttttcttttgagacagagtcttgctctgtctcccagactagagtgcagtagcacgatct

SEQ ID NO: 52893 - DNA, 80 bp, Homo sapiens
gggccaccatgctgttgaagtggccctgctgcttgagcacgtaggactcactctgccactcccacaccagcagctggccc

SEQ ID NO: 52894 - DNA, 78 bp, Homo sapiens
gccgaatgcagactctcactcagtcggtgtgggggccaggaccctgtctctaccaagtgtgcgggagctgcccctggc

SEQ ID NO: 52895 - DNA, 73 bp, Homo sapiens
gttgttgttgagatggagtctccctctctcacccaggctggagtgcagtggcgtgatctcagctcattgcaac

SEQ ID NO: 52896 - DNA, 80 bp, Homo sapiens
ttcatcatttacttcttttttttttgactgagtctcgctctgtcacccaggctggagggcagtggtgggatctcggctca

SEQ ID NO: 52897 - DNA, 90 bp, Homo sapiens
gtctgtgtgtgcaggtctgtctctgtgtgtctgtctgcgagtccaagtgcaacatgcatccgcgttcccaggcctcaccagctggatgat

SEQ ID NO: 52898 - DNA, 64 bp, Homo sapiens
ccacgactcaggtgtggccaagacccccgcccaggcaacatggccactgtctctgagtggctgg

SEQ ID NO: 52899 - DNA, 66 bp, Homo sapiens
gggcttgcagacacagtcttctccctgtgtccttacggggctgtccctctgtgtgtgtctctgccc

SEQ ID NO: 52900 - DNA, 114 bp, Homo sapiens
gtttcattcctccggggtagatgcctagaactggactgacagggtcacagggtcacacagtgagtgacattttgaggaactgttttccaaggtgctttcactgggggttgaagc

SEQ ID NO: 52901 - DNA, 112 bp, Homo sapiens
gtcccacctctgccctggtcggcagtccacacacacccttctctttccttttcatttttttttctttgagatagagtctggctctgttgcccaggctggagtccagtggggc

SEQ ID NO: 52902 - DNA, 58 bp, Homo sapiens
tgagacagagtctcactctgtcgcccaggctggagtgtagtggtgccatctctgctca

SEQ ID NO: 52903 - DNA, 59 bp, Homo sapiens
ctgtgccatctgcctgcgtgctaggctgtcccctgtcacgctcagtgcctggctcacag

SEQ ID NO: 52904 - DNA, 118 bp, Homo sapiens
agagtgggccacgtggctccctttgtcccgatgggaccacacactctcactcacacaggtcaccgctgagtccttgtggagctcgtgagggcggagggccaggccccgtgggttctct

SEQ ID NO: 52905 - DNA, 103 bp, Homo sapiens
gtcctgctctgtcctgtcctgctctgtcctgccagggtgggagtcacggtcgcacatcctctcactctcagggcctgagtagctgggaggcagggaagggacc

SEQ ID NO: 52906 - DNA, 98 bp, Homo sapiens
ttgtttatgttcatttttaaaatctctctcatcaaacagttgtaatgcagtagagagaatgagaagagagagaggtcagaaagtcacccagtaaacaa

SEQ ID NO: 52907 - DNA, 90 bp, Homo sapiens
gatcagtgctccgcaggatattcaaggacaccctctgcgtatctccagggctcactctgtctgcatgtctcttccttccggtactctgtc

SEQ ID NO: 52908 - DNA, 97 bp, Homo sapiens
cggttctgagtgcaattcatgaactgttctttgttcaaataaactctaaagtttttctttttttgagacagaggagtctcactctgttgcccagacg

SEQ ID NO: 52909 - DNA, 60 bp, Homo sapiens
cgtctgtgtgtctgtgcatccgtgtgtctgtgcatatatgtctgtgtacgcacacagctg

SEQ ID NO: 52910 - DNA, 65 bp, Homo sapiens
agctattaaaatttttattttagctcttaaataaaagagctaaaataaaaaaacttttgaaggtt

SEQ ID NO: 52911 - DNA, 63 bp, Homo sapiens
catatgtgattgtgtatgcatgtgagcattcatgtgacacatgtaagcatgtatgtacatgtg

SEQ ID NO: 52912 - DNA, 76 bp, Homo sapiens
gctctctcctcagttgtgtttctgtgtggctgaaatcgtgtcgtaaagttagaagaaaggctgctgtggggcctgc

SEQ ID NO: 52913 - DNA, 56 bp, Homo sapiens
ggcaggtccagggagcaggaccctgtgagcacacagggtcagtgtctgagtgtgtc

SEQ ID NO: 52914 - DNA, 81 bp, Homo sapiens
gcatatggtgcattcatgtgagtgtggtgggtgtctgtgaacatgtggtgtgtccctgtgagtgtgtgtgtgtccgtgtgt

SEQ ID NO: 52915 - DNA, 72 bp, Homo sapiens
atctgtgtgtgtgtgtgtgtccatatggagtgttgtgtgtatctctgtgtgtgtgcccacgcatgcaagggt

SEQ ID NO: 52916 - DNA, 77 bp, Homo sapiens
tcagacggtgtgtgtgcatgtgtatgtgctgtggaatctgtgtggagtgtgtatgtgtgtgatgtgcttctgtgtga

SEQ ID NO: 52917 - DNA, 75 bp, Homo sapiens
ctccgcctctccactgtttggaaatgaagctgtacatttgtggcagttttctaagcagacgtcacaaaggtgtgg

SEQ ID NO: 52918 - DNA, 84 bp, Homo sapiens
ataattgtggatttatctatttggtggggggttgctttatatatttttaagctctttattaggtgtgtgaacgtttagggttat

SEQ ID NO: 52919 - DNA, 106 bp, Homo sapiens
ctcaccagtctctgcttccccactggatcccctgagagactattctttttctttttttttgagacggagtctcactcagtcgcccaagctggagtgcagtggcgag

SEQ ID NO: 52920 - DNA, 105 bp, Homo sapiens
gctcctgccaggggtgcttggggctccaggctgtcagcctctatcagtcacacaggccagcgagctgcagcctgtgcctctcttcattgcaagggcagcatgagt

SEQ ID NO: 52921 - DNA, 58 bp, Homo sapiens
ggaccctgggagggaagggatggacacacactccctgtctctccctcaaacacgggcc

SEQ ID NO: 52922 - DNA, 76 bp, Homo sapiens
gcggggcatcagtgggtaaagtcggggggtgtcctcgtcctctccaggcagcctctcacccactcactgggcgtgc

SEQ ID NO: 52923 - DNA, 106 bp, Homo sapiens
gacgatttgcaatgaggactggatgaggctgggacccaactctctgtctctgacattcctgctcatctcatggacagaggcactgattgttctagaccatctttcc

SEQ ID NO: 52924 - DNA, 89 bp, Homo sapiens
tcagggttcctctcctgcagtgcagtccacggtgtgtgcagatgccactgggcccactctgtgtcactgtttgggaaacggggctcgga

SEQ ID NO: 52925 - DNA, 126 bp, Homo sapiens
ggagccaggctggtgacactggggtctggaaagaggggcctagccctgtcacacacactgtcagccctccaaggtggcacggggacggcgaggccgacagctgcttgtgcggaactgggctggtcc

SEQ ID NO: 52926 - DNA, 450 bp, Homo sapiens
ctgtgtggacaggtcatgtggacgtggatgtttgcctgagcccgtccctcagtgtctctgtggacaggtcttctggacgtggatgttcccctgagcccgtccctcagtgtctgtgtggacaggtcgtgtggtcatggatgttcgcctgagtccgtccctcagtcactctgtggacaggtcgtgtggacgtggacatttgcctgagtccgtccctcagtgtctgtgtggacaggtcatgtggacgtggatgtttgcctgagcccgtccctcagtgtctgtgtggacaggtcgtgtggacgtggacatttgcctgagtccatccctcagtctctctgtggacaggtcatgtggacgtggatgtttgcctgagcccgtccctcagtgtctgtgtggacaggtcatgtggtcatggatgtttgcctgagcccgtccctcagtctctctgtggac

SEQ ID NO: 52927 - DNA, 94 bp, Homo sapiens
cgtgtgtgggtgtgtatgtgcatgcacgtgtgtgtgcatgtgcgtgtggatgtgtgtgcgcacatgtgtgtgtgtgtatgtgtgtccacacgtg

SEQ ID NO: 52928 - DNA, 109 bp, Homo sapiens
gggactgtttatccgaggccctcatcttggctccctctgtgcctgtgtgtggattccacgtgcatttggggcctgcctttctcacccagccttgtaaggtagacttccc

SEQ ID NO: 52929 - DNA, 75 bp, Homo sapiens
ggaaaacatttcagagggaagattagttggttcctttgtaggcacatttttttttttttttttgagatggattct

SEQ ID NO: 52930 - DNA, 82 bp, Homo sapiens
gtggagagttctgtagatatctgtcaggtacatttgatccggtgctgagttcatgtcctgaatatcttttttaattttctgt

SEQ ID NO: 52931 - DNA, 114 bp, Homo sapiens
ggtgggaatgcaaattggcacagccacttttgtttgtttgatttcttttttgtcttttttgagacgaagtctctctctgtcacccaggctggagtgcagtggcacaatctcggc

SEQ ID NO: 52932 - DNA, 76 bp, Homo sapiens
ttcatctgcccttcttccagggtgtagggaccagccccacagggtcggtgggtctctccctgtgtgcggcgatgag

SEQ ID NO: 52933 - DNA, 110 bp, Homo sapiens
ctcccagcggctctgctggaacacggggcgcgtcctttaagggcaaaccttggctgtgacagcacagggcgtgcagactgcacctcgtgtagcaaggggcgtgtggcgag

SEQ ID NO: 52934 - DNA, 78 bp, Homo sapiens
cagtctgtgtcaccctctctgccagggctggacccctggggcaaactgaggcctggtggcagagctgacactcacctg

SEQ ID NO: 52935 - DNA, 109 bp, Homo sapiens
ctctggtattctgttacggcagcctgaacagacggacactcagtgtgtcatcctgttgtttaacaacattcaacagactgagtgccaggaggcttacagtctagcaggg

SEQ ID NO: 52936 - DNA, 103 bp, Homo sapiens
caggacaagactctgactcaagaaaaaaaaaaaaaaagaaatacacacacacacacacacacacacaaatctttttttttattttaggcggagtctcaccctg

SEQ ID NO: 52937 - DNA, 58 bp, Homo sapiens; identical to SEQ ID NO: 285

SEQ ID NO: 52938 - DNA, 93 bp, Homo sapiens
agttttgggggtaatgaaatgtattttaatggtagtgttgtgtatatgactatatatatttgtccaaatgcattcatttgtacacttaaaatt

SEQ ID NO: 52939 - DNA, 95 bp, Homo sapiens; identical to SEQ ID NO: 68

SEQ ID NO: 52940 - DNA, 93 bp, Homo sapiens; identical to SEQ ID NO: 69

SEQ ID NO: 52941 - DNA, 72 bp, Homo sapiens
agcatatatatgtatatatacacatatatagtttatatatacatatatgtgtgtgtatatgcaggtatatct

SEQ ID NO: 52942 - DNA, 65 bp, Homo sapiens
gtttctgtgtgtgtatgtgtatgcatgcgtgtatgttatgtgtatatatgtatatatacacttac

SEQ ID NO: 52943 - DNA, 127 bp, Homo sapiens
gtacaacctctaatatatatgtgtgtatatatatgtatatatacacatatacatatattatatatgtatatgtatatatacacatatacatatatatgtatatgtgtatatatattagacagatata

SEQ ID NO: 52944 - DNA, 154 bp, Homo sapiens
gtgtgtgtatatatatacatatatgtatatatgtatatgtattatatacatatatatctgtctaatatatatacacatatacatatatatgtatatgtgtatatatacatatacatatataatatatgtatatgtgtatatatacatatatata

SEQ ID NO: 52945 - DNA, 89 bp, Homo sapiens
atgctgtagtctgaagtatttcattgataatactttttttttgaacgaggagggtagtgttatcactagaatgcttaagaactcagcat

SEQ ID NO: 52946 - DNA, 68 bp, Homo sapiens
gggctcagtggcttatgcctgtaatcccaacactttgggaggctgaggtaggaggatcacttgaggcc

SEQ ID NO: 52947 - DNA, 112 bp, Homo sapiens; identical to SEQ ID NO: 41221

SEQ ID NO: 52948 - DNA, 77 bp, Homo sapiens; identical to SEQ ID NO: 5161

SEQ ID NO: 52949 - DNA, 112 bp, Homo sapiens; identical to SEQ ID NO: 41220

SEQ ID NO: 52950 - DNA, 105 bp, Homo sapiens; identical to SEQ ID NO: 41223

SEQ ID NO: 52951 - DNA, 106 bp, Homo sapiens; identical to SEQ ID NO: 41218

SEQ ID NO: 52952 - DNA, 95 bp, Homo sapiens; identical to SEQ ID NO: 41217

SEQ ID NO: 52953 - DNA, 58 bp, Homo sapiens; identical to SEQ ID NO: 41216

SEQ ID NO: 52954 - DNA, 80 bp, Homo sapiens; identical to SEQ ID NO: 41215

SEQ ID NO: 52955 - DNA, 98 bp, Homo sapiens
tatatatatatatacatattcacacatacacacatacatatatatgtgtatatatatacatgtatgtatgtgtatatatatatgtgtgtgtatatata

SEQ ID NO: 52956 - DNA, 82 bp, Homo sapiens
ggtttctgactgtttgtcactcattaaggattcgaaaatactgctgctgggttcttagtgtttggccctcacgtaggattcc

SEQ ID NO: 52957 - DNA, 82 bp, Homo sapiens; identical to SEQ ID NO: 41214

SEQ ID NO: 52958 - DNA, 86 bp, Homo sapiens; identical to SEQ ID NO: 41213

SEQ ID NO: 52959 - DNA, 86 bp, Homo sapiens; identical to SEQ ID NO: 41212

SEQ ID NO: 52960 - DNA, 58 bp, Homo sapiens; identical to SEQ ID NO: 1409

SEQ ID NO: 52961 - DNA, 88 bp, Homo sapiens
gctttgttggacatttaaaagtcaggtagagtgattccttcagccttttatttttcattttttgcttgattttcttagctattaaggc

SEQ ID NO: 52962 - DNA, 103 bp, Homo sapiens; identical to SEQ ID NO: 41210

SEQ ID NO: 52963 - DNA, 95 bp, Homo sapiens; identical to SEQ ID NO: 68

SEQ ID NO: 52964 - DNA, 93 bp, Homo sapiens; identical to SEQ ID NO: 69

SEQ ID NO: 52965 - DNA, 95 bp, Homo sapiens; identical to SEQ ID NO: 68

SEQ ID NO: 52966 - DNA, 93 bp, Homo sapiens; identical to SEQ ID NO: 69

SEQ ID NO: 52967 - DNA, 79 bp, Homo sapiens
gttagggtcagggcttcgggacttgtttctcctaaattttttttttttttttgagacagtctcgctctgtcacccaggc

SEQ ID NO: 52968 - DNA, 122 bp, Homo sapiens
cctggctggctggctggctggcttggctggcttcgcaggctggctggttgggtggcttagctgtctggctggctgtctggctggcttggctggcttggtttgccaggctggagtgcaatggt

SEQ ID NO: 52969 - DNA, 99 bp, Homo sapiens
gcttggctggctggctggctggcagtgttgctggcttggctgccttggctggcttggctgcctggctgcctgtgtggcttggcttgctggctggctggc

SEQ ID NO: 52970 - DNA, 84 bp, Homo sapiens
gacaggggaggagctggggacattgggactgttggaacgtcttggaaacaatgacccactcagtgtctgaattcattttctgtc

SEQ ID NO: 52971 - DNA, 116 bp, Homo sapiens
ggaggaactccccagggttaagtgcagttgtctctcttctttttttttgagacagagtctcgctctgtcactcaggctggagtgcaatggcatgatcttggcttagtgcagcctct

SEQ ID NO: 52972 - DNA, 111 bp, Homo sapiens
tgcttaggttagtcttggctccacaggctcttttttgcttccatatgaaatttaacgtagtttttttctagttctgtgaagaaagtcaatggtagcttgatgggaatagca

SEQ ID NO: 52973 - DNA, 79 bp, Homo sapiens
gagatgggtctcttgaagatggcatacagttgggtcttgtttgtttgtttgttttaattttttgagactgatctgtctc

SEQ ID NO: 52974 - DNA, 72 bp, Homo sapiens
ctcacagaagtcagtgaggagtgtgacaagacggggattctgcagggctacctggatgggacactctgtgag

SEQ ID NO: 52975 - DNA, 71 bp, Homo sapiens
gttttttgagacagagtctcactctgtcacccaggctggagtgcagtggtgagatcttggttcactgaaac

SEQ ID NO: 52976 - DNA, 111 bp, Homo sapiens
gagttgtgaggtcttttctccgtctcctctctggccctcaggctgtctcagtgtgactgcctgcagcctggttcagcagcaaggggccttggagtcaggacacctgggctc

SEQ ID NO: 52977 - DNA, 71 bp, Homo sapiens
ggccttcagtctcagactgagtcacaccttcagctcccctggttcagaggctttcagatttgaactgagcc

SEQ ID NO: 52978 - DNA, 58 bp, Homo sapiens; identical to SEQ ID NO: 2595

SEQ ID NO: 52979 - DNA, 105 bp, Homo sapiens
cctgggtgacagagtgagaccctgtatcaaaacaaacaaacaaacaaaaacccccacttccttttttttttttttttttgagacagtctcgctctgtctcccagg

SEQ ID NO: 52980 - DNA, 110 bp, Homo sapiens
tggtcgcacaactctgaatatactaaaaaccatgtaattttatactttatatgggtgaattatatggtttgtgaataataaagtggtttattgggaggctgaggcgggca

SEQ ID NO: 52981 - DNA, 103 bp, Homo sapiens
cactttaaatgaatgagttgtatagtatgtaaataatatctcaataaagctgtttttttttttctttgagacaaggtcttgctctgtcactcaggctggagtg

SEQ ID NO: 52982 - DNA, 99 bp, Homo sapiens
aggtcttattaacactgtttttgggggggaggggcagggggcagggggcgggatggagtctcactctgtcacccagactggagtgcagtggagtgatct

SEQ ID NO: 52983 - DNA, 83 bp, Homo sapiens
tggatgtggagggtgaactgcacagtccttggatcaatggtgccagcatcacctaggagcttgtttacagatacctcactcca

SEQ ID NO: 52984 - DNA, 76 bp, Homo sapiens
gtgagccaccatgcctggcccacagaaaattttatatataatttcagtgtgtgtgtctttgagtgtggtaggttcc

SEQ ID NO: 52985 - DNA, 91 bp, Homo sapiens
gattgatttgtgttttttgtttgtttgagacagtgtctcactctgtcgcccaggctggagtacgctggcacgatctcatttcactgcaatc

SEQ ID NO: 52986 - DNA, 113 bp, Homo sapiens
tttttttggaaatcaaacagatgcactgttttttttgtttgtttgttcttgttttttatcactgctccagtcaagagagagatgcaactgttaataattaaatgccaagaaaa

SEQ ID NO: 52987 - DNA, 78 bp, Homo sapiens
tgcatgtacatacatgtatatatgtatatatacatataaaatgtatacacatataaatataataaatgtgtatatgta

SEQ ID NO: 52988 - DNA, 84 bp, Homo sapiens
gcttccttggcacttggaaaaagagcaagaggcctcggaagtcacctctcacatgtctctttttcttattgtgatatggaatgc

SEQ ID NO: 52989 - DNA, 63 bp, Homo sapiens
gatggagcgaggtgggcaaggtaaagaactatttttttttttgagacagagtctcgctctgtc

SEQ ID NO: 52990 - DNA, 56 bp, Homo sapiens
gagcctcactccgtcactgtcacccaggctggagtgcagtggtgcgatctcggctc

SEQ ID NO: 52991 - DNA, 93 bp, Homo sapiens
caccaccaccacatagtgaactattctatttatgtatatttccagaataggcaaatcaataaaaacagaatggagatcagtgggtgcctggtg

SEQ ID NO: 52992 - DNA, 102 bp, Homo sapiens
aggccttgcaaatacccctgagaacaatttcactctgagctcacagggaagcagcagtctggtgtgggctcctgtggtgtaaccatcaaatgtggaagacct

SEQ ID NO: 52993 - DNA, 87 bp, Homo sapiens
gtcagactgtgctctctccattccccaggactccacagaaccgtctggtactgctagtgctgggtgaacagtgagagcacagtccac

SEQ ID NO: 52994 - DNA, 84 bp, Homo sapiens
gccaccatgcccggccaagaatttctttttaaatttaaagtctagtgcattaaaattattagaagtacagccaggcgtggtggc

SEQ ID NO: 52995 - DNA, 75 bp, Homo sapiens
gccgagtgctgtgctctgtgtgtctttatgattctggggagatgaggaccgcctgctcaagcccagcctctcggc

SEQ ID NO: 52996 - DNA, 109 bp, Homo sapiens
tcatatataccttgtacacgtagcctaaagataattttatataatatttttaataattttatgcatgaaacaattttaggtgtgactgtcaccacgaggtctgctgtgg

SEQ ID NO: 52997 - DNA, 114 bp, Homo sapiens
ttgctctcactctgtgtgaccctgtggaacttttgcttttgaattagttttttttttttttttttttttttttttgagatggagtctcactctgttacccaggctggagtgcag

SEQ ID NO: 52998 - DNA, 72 bp, Homo sapiens
ttttctgtaagtcctatagtctgtcttagtttgaatgtttagggaataggttgtatggatttgcctaggaaa

SEQ ID NO: 52999 - DNA, 113 bp, Homo sapiens
gctgggattacaggtgtgagccactgtgcctggccaggtgtatatttttatttctcttgagtatatacctaagagtgaaattgctgggtcatatggtaactctatgtttaact

SEQ ID NO: 53000 - DNA, 77 bp, Homo sapiens
tggggcacagctatgtaattctcgggtggtttggggataggaggattctttccacacactctgacgctgtcactcca

SEQ ID NO: 53001 - DNA, 65 bp, Homo sapiens
cgccggacagagatgtcagagcccacagagggactgggaatgggtaggatgtctctggtggggcg

SEQ ID NO: 53002 - DNA, 58 bp, Homo sapiens; identical to SEQ ID NO: 315

SEQ ID NO: 53003 - DNA, 81 bp, Homo sapiens
tgtatataatctatatcatatatattgtatataatctatcatatatgttgtatataatctgtatcatatatattgtatata

SEQ ID NO: 53004 - DNA, 82 bp, Homo sapiens
ctgtctgtctgtctgtctgcctgtctatgttttagagacaaggtctagctctattgccctggcaacaatcagatgcaaccag

SEQ ID NO: 53005 - DNA, 133 bp, Homo sapiens
tatattgtatataatctatatcatatagtatataatatatatcatatattgtatataatatatgtcatacatattgtatataatatacatcatacttattgtatataatatatatcatacatattgtgtataa

SEQ ID NO: 53006 - DNA, 110 bp, Homo sapiens
attgtatctaatgtatcatatatattgtatataatctgtatcatatatattgtttataatctgtatcatatatattgtatataatctgtatcatatatattgtatataat

SEQ ID NO: 53007 - DNA, 58 bp, Homo sapiens
tgagacagtatctcactctgtcacccaagctggagtgcagtggcatgatattggctca

SEQ ID NO: 53008 - DNA, 64 bp, Homo sapiens
gacataggggcctggcaggctgtgtgccctgtaaggacacagtctgtctctgtgcctcagtttc

SEQ ID NO: 53009 - DNA, 151 bp, Homo sapiens
ccctgagtgggggacatcgggatctctcgcaggcagcatcccaggcacagtccctgactcgctttacagatggggcaatgaggcttaggaggaaagatttttttttcttttttgagttggggtcttgccatcttgcccagcccaatctcga

SEQ ID NO: 53010 - DNA, 95 bp, Homo sapiens
gcagtctagtgacacagcagtgcagacatcagagagatcagtcaggttgggatgaaatgaattactgggtttgcagtccttttggctggttctgt

SEQ ID NO: 53011 - DNA, 80 bp, Homo sapiens
tcggccaggcctggtggtgtacgcttgtaattccagctacttgggaggctgaggtaggaggatcacttgagcctggaagg

SEQ ID NO: 53012 - DNA, 105 bp, Homo sapiens
gggcaaacaccaagtctgtggtttgaaaggatgggagcctgtgtgtgtgtgtgtgcatgtgcatgtgtggcaaaaggctttgctgcatggcttttgtgtgggtct

SEQ ID NO: 53013 - DNA, 129 bp, Homo sapiens
accagtaaattactcattgtgactggttgtccctctttcctcaggttttcttctgccatctgtgacagcttcttgatctgtccccaggtgggtggctgtgttcaatgggtgttgcttgtgacagttggc

SEQ ID NO: 53014 - DNA, 75 bp, Homo sapiens
cagatggagaggctgagggcttgctctgagcgcagtggtcccacccttcacagcctccctcactgccttcatctg

SEQ ID NO: 53015 - DNA, 87 bp, Homo sapiens
ggatgacagagtgagaccctgtctcaaaacaaacaaatacgcaattctttttttttttttttttgagttggagtctcactgtcaccc

SEQ ID NO: 53016 - DNA, 63 bp, Homo sapiens
gctgtgtagctaaggagtggcaggcccctgacccctggcctgtctctgtctctgttgagcagt

SEQ ID NO: 53017 - DNA, 58 bp, Homo sapiens
tgagccggagtctcgctctgtcacccaggctggagtgcagtggcaagatctcggctta

SEQ ID NO: 53018 - DNA, 119 bp, Homo sapiens
tgtacaacaggagggtcagtgagtgtctggcagtggttgagttgtaattgttttaatattgtttatcttgaggctagtgcttgtttaactgttagaggaaaaaaaaaccacctgtgaca

SEQ ID NO: 53019 - DNA, 87 bp, Homo sapiens
gggaccacaggcgtgtgccaccatgctcagctaagttttttatttttactagagacagggcttcaccatgttgaccaggctggtctc

SEQ ID NO: 53020 - DNA, 120 bp, Homo sapiens
ggtttgaagaattctgggtagttgtgcagtgttggtgggggtgtcaggtgttctgattatgtaaatgtcagatacataccttttgaccttaagttttacttctggaactttatcccaggg

SEQ ID NO: 53021 - DNA, 65 bp, Homo sapiens
ttgagatggagtctcactctgtcactgaggctggggtgcagtggcacgatctcggctcccttcaa

SEQ ID NO: 53022 - DNA, 99 bp, Homo sapiens
ggctaattttttgtattatatttgcttgttatagatctattcagattttctatttctttttgagtcaggtttggtagtctatgtttctaagaattggtc

SEQ ID NO: 53023 - DNA, 112 bp, Homo sapiens
gtggatttgactcctctagggtacctcatgtaagtggaaccatgcagtatttgtatttgtctttctgtgactggtttatttcactgagcataatgacctcagagttcatccc

SEQ ID NO: 53024 - DNA, 70 bp, Homo sapiens
ttattttgagacacagtctcactctgtcacccacgctggagtgcagtggtgtgatcttagctcactatag

SEQ ID NO: 53025 - DNA, 102 bp, Homo sapiens
cagacatccattagcaaaatgagagagacacattttcctagatcaaatttccaaagaaatgaagtttgttgtgttttcttgtcaaaatgctggctgcctctg

SEQ ID NO: 53026 - DNA, 78 bp, Homo sapiens
ctgggcagggcagtgccgagcacagctcccagtttgggtagccagtgggactgggtctggtaccagccttgatttcgg

SEQ ID NO: 53027 - DNA, 101 bp, Homo sapiens
gcatgcagtgtgcctgtgtgtgcccatgctcacgtctgtgtgtctgatatgtgcatgtggacacatgtgcccatggtcacaatattggtatgctcacatgt

SEQ ID NO: 53028 - DNA, 115 bp, Homo sapiens
attacaggcctgagccactgtgcctggctgtgtttaaaaaaattttttaaagatagttatttattttatttaatttatttgagatgcggtcttgctctgtcccccaggctggagt

SEQ ID NO: 53029 - DNA, 118 bp, Homo sapiens
gactgggaacttcagtgaggaggatttcctgtctgcagatgtgccgattacagcgctgagtgaagacagtcagccagcactgctgcgggctcgaattcgcccgctgagttaaccagtt

SEQ ID NO: 53030 - DNA, 106 bp, Homo sapiens
tatggtggcgctctggtcggatctaggggagtctgtcctacaggatgaggcttgaactgtcctgagtgaccagacacccagcctctgcttcgagtgctcagttatg

SEQ ID NO: 53031 - DNA, 117 bp, Homo sapiens
ccgcagcaagagctcaccagtttacactctctggctattaaatggcattttttatttttatttttagatggagttttgctcttgtcgcccaggctggagtgcaatggtcctgttggg

SEQ ID NO: 53032 - DNA, 113 bp, Homo sapiens
ggcctggctcgagcagggggcgagggattggagagaaaggcagttcctgatggtcccctccccaggggctggctttcctctggtccttccctcccaatgaccgcgtcttcgtc

SEQ ID NO: 53033 - DNA, 58 bp, Homo sapiens
tgagatggagtctcactctgtcacccaggctggagtgcagtggcgtgatcccggctca

SEQ ID NO: 53034 - DNA, 115 bp, Homo sapiens
ccctgctctctgtgtccctgagtgaatggggcaggggctgcaccctgctctctgcgtctctgagtgagtggggcgggggctgcaccctgctctgtgtgtccctgagtgagtgggg

SEQ ID NO: 53035 - DNA, 72 bp, Homo sapiens
ggtctctcttagtattggggcaggtgggcagaacctgtctctcttcctgcctcactgggattgtggatgacc

SEQ ID NO: 53036 - DNA, 124 bp, Homo sapiens
gagagcatgctgcccatgtgtgcatgtgtgtgtgtgagcatgctgcccatgtgtgcgtgtgtgagagcctgctgtccatgtgtgcgtgtgtgtgtgctgcctatgtgtgcgtgtgtgtgtgagc

SEQ ID NO: 53037 - DNA, 62 bp, Homo sapiens
gggcctgctctgtttagagggggtgccagggtcctgggtccctccctctgttagagctgtct

SEQ ID NO: 53038 - DNA, 81 bp, Homo sapiens
gactgtgtatgtctgtgtgtgtgtgtactacaggcctctggttcctggaggccagggatgctgatacacaacctgcaatgc

SEQ ID NO: 53039 - DNA, 133 bp, Homo sapiens
ccaaccagggtaacatagtgacacctcatcttttttcttttttttttttttttttgagacggagtctcactctgtcacccaggctggagtgcagtggagtgatctcggctcactgcaacctctgcctcccggg

SEQ ID NO: 53040 - DNA, 58 bp, Homo sapiens; identical to SEQ ID NO: 53007

SEQ ID NO: 53041 - DNA, 109 bp, Homo sapiens
ggctgaccaggggctctggccggacataggggcctggcaggctgtgtgccctgtaaggacacagtctgtctctgtgcctcagtttctctgctgcccagatggaggggcc

SEQ ID NO: 53042 - DNA, 64 bp, Homo sapiens; identical to SEQ ID NO: 53008

SEQ ID NO: 53043 - DNA, 114 bp, Homo sapiens
ggtcagggtgagtgctgggtttgaggctcagctgtgctgtgtgaagattgagaggagcccacctcatcacatggacagaacgcacaggcttcttctctttctcccacccaggcc

SEQ ID NO: 53044 - DNA, 134 bp, Homo sapiens
gggcaacaaagtgagactctgtccctacaaaaaaaattttttttttttttttttttgagacagactctcgctctgtcgcccaggctagagtgcagtggcgtgatcttggctcattgcaacctccgcctcccggg

SEQ ID NO: 53045 - DNA, 111 bp, Homo sapiens
ggtcgccgatgtcagctgccaaggaaacaaagaggctgagtctctgtggctgtggcagaggcccctcaggaataccagccctgtttcccaggccccagactggcggtgccc

SEQ ID NO: 53046 - DNA, 120 bp, Homo sapiens
ctaccttgtggggaggtgagaggtcagggtgagtgctgggtttgaggctcagctgtgctgtgtgaagattgagaggagcccacctgatcacatggacagaacgcacaggctcctgggtgg

SEQ ID NO: 53047 - DNA, 92 bp, Homo sapiens
ctgggactacaggtgcgcgccaccacacctagctaatttttgtatgtatatatatattttttagtagagatggggtttcacctgttggccag

SEQ ID NO: 53048 - DNA, 64 bp, Homo sapiens
gttttagactcagggtctcactcagtctcccaggcgggagtgcagtggtgtgaccttggcttac

SEQ ID NO: 53049 - DNA, 71 bp, Homo sapiens
ggtccatagaagtcagttctagggcgtctggcctagtggcacagccaggacttttttttttttttgagacc

SEQ ID NO: 53050 - DNA, 86 bp, Homo sapiens
cctgacctcctgcacaccccacccagcctccaaattcaaccaccccagtagtgagacagggagagtagggtgtgaccagaaggtgg

SEQ ID NO: 53051 - DNA, 64 bp, Homo sapiens; identical to SEQ ID NO: 53008

SEQ ID NO: 53052 - DNA, 58 bp, Homo sapiens; identical to SEQ ID NO: 53007

SEQ ID NO: 53053 - DNA, 82 bp, Homo sapiens; identical to SEQ ID NO: 53004

SEQ ID NO: 53054 - DNA, 81 bp, Homo sapiens; identical to SEQ ID NO: 53003

SEQ ID NO: 53055 - DNA, 58 bp, Homo sapiens; identical to SEQ ID NO: 315

SEQ ID NO: 53056 - DNA, 111 bp, Homo sapiens
tatgtgtggtctgttcttgtcttttgtccactattctctttggtttatttcacacacacacatacacagagagacacacagatgcataaatgacatacacatacacacata

SEQ ID NO: 53057 - DNA, 138 bp, Homo sapiens
ggcattaaaaatgctgtaacaaagacagaaaatgtacatgccaaggggatatatatgtgtgtgtgtgtgtctgtgcttatgcatctgtttatgtgtgtatgtgtatgtcatttatgcatctgtgtgtctctctgtgta

SEQ ID NO: 53058 - DNA, 106 bp, Homo sapiens
gacttcgtcaggatccttttgtgggatggctcatgcatgcacacagttcactcagagcacagagtgggtcagcccactaccagggccctgccaccagcgccaggtt

SEQ ID NO: 53059 - DNA, 112 bp, Homo sapiens
cagtccagcttgcgcgacagagcaagactccgtttacaaaagaaaaaaaaatttttttttaatttttttttattttgagatggagtctctctctgtcgcccgggcgggagtg

SEQ ID NO: 53060 - DNA, 111 bp, Homo sapiens
tgccatgattccctggcatgtaactagtaagacagattccctagcatgaaaccaattttttttttttgagacaaggtcttgctgtgtcacccaggctggagtgcagtggca

SEQ ID NO: 53061 - DNA, 68 bp, Homo sapiens
cctctctctgtctgtgtctgtgaattatgtgtctgtgtctccatcaaccatagtgcagaagggggagg

SEQ ID NO: 53062 - DNA, 58 bp, Homo sapiens
tgagactgagtctcactctgtcgcccaggctggagtgcagtagcgcgatctcggctca

SEQ ID NO: 53063 - DNA, 118 bp, Homo sapiens
cctgggagacagagcaaaactcttgtctctttaaaaaagcaagaaacaggacagaatgcatctcattttctttttttttttttttttaaagacagagtctcttgctctgtcacccagg

SEQ ID NO: 53064 - DNA, 58 bp, Homo sapiens
tgagacagagtctccctctgtcacccaggctggagtgcagtggcgcgatctctgctca

SEQ ID NO: 53065 - DNA, 89 bp, Homo sapiens
ccagcctaggcaacaaagcgataccctgtccctaaaaaataaatttttgttttgtttgagatggagtctcgctctgtcacccaggctgg

SEQ ID NO: 53066 - DNA, 104 bp, Homo sapiens
aaaatgctaggattacaggcatgagccaccgtgcccagcctcttctatttttattaatagtaactggaattctgtaaggaaggttcagcctttttccccatttt

SEQ ID NO: 53067 - DNA, 116 bp, Homo sapiens
ttgaataaagggcacgagaatttttatttttgactcaagttttgtttttgtattttttttattggctggggttgggtcatataatttaaactaattttggttggctaaacatttga

SEQ ID NO: 53068 - DNA, 58 bp, Homo sapiens; identical to SEQ ID NO: 884

SEQ ID NO: 53069 - DNA, 56 bp, Homo sapiens; identical to SEQ ID NO: 885

SEQ ID NO: 53070 - DNA, 99 bp, Homo sapiens
gtttttgtttcctggtggtttgtcttcactgcatcactgtggggttgctctgtgtagctgtctcactcagtagtgagggaaatatctctggaaatgtac

SEQ ID NO: 53071 - DNA, 81 bp, Homo sapiens
gagcagagcacaggtgggtggaggaggataatttacagagggtgcagatttcaactttttttctacatctgatttctgttc

SEQ ID NO: 53072 - DNA, 71 bp, Homo sapiens
cccacagcctgggaggccttaagtaagtgattcaacctcactgagcctcactctttgcctctgaaatgggg

SEQ ID NO: 53073 - DNA, 58 bp, Homo sapiens
tgagacagagtctcgctctgtcacccaggctggagtgcaatggtgtgatctctgctca

SEQ ID NO: 53074 - DNA, 83 bp, Homo sapiens
ccgcggctacagacgctctgactctgtctggcctggcccgcagagggactgtggcctcagaggaggatgctggcccattgtgg

SEQ ID NO: 53075 - DNA, 110 bp, Homo sapiens; identical to SEQ ID NO: 53006

SEQ ID NO: 53076 - DNA, 58 bp, Homo sapiens; identical to SEQ ID NO: 53007

SEQ ID NO: 53077 - DNA, 109 bp, Homo sapiens; identical to SEQ ID NO: 53041

SEQ ID NO: 53078 - DNA, 64 bp, Homo sapiens; identical to SEQ ID NO: 53008

SEQ ID NO: 53079 - DNA, 95 bp, Homo sapiens; identical to SEQ ID NO: 53010

SEQ ID NO: 53080 - DNA, 80 bp, Homo sapiens; identical to SEQ ID NO: 53011

SEQ ID NO: 53081 - DNA, 124 bp, Homo sapiens
ggatgacacagtgagactccgtctcaaaaaaaaaaaaaaaaaaagacaaggtctcactctgtcacccaggctacagtatggagtacagtggcgcaaccacagctcactgctcactgcggccttg

SEQ ID NO: 53082 - DNA, 86 bp, Homo sapiens; identical to SEQ ID NO: 53050

SEQ ID NO: 53083 - DNA, 71 bp, Homo sapiens; identical to SEQ ID NO: 53049

SEQ ID NO: 53084 - DNA, 64 bp, Homo sapiens; identical to SEQ ID NO: 53048

SEQ ID NO: 53085 - DNA, 92 bp, Homo sapiens; identical to SEQ ID NO: 53047

SEQ ID NO: 53086 - DNA, 120 bp, Homo sapiens; identical to SEQ ID NO: 53046

SEQ ID NO: 53087 - DNA, 87 bp, Homo sapiens
gctgtttagtgagcacttgtgagtcactgacactttgtaaacatcagctcgtttactctgtgtggcaatcaggctgaggtggacagc

SEQ ID NO: 53088 - DNA, 134 bp, Homo sapiens
gggcaacaaagtgagactctgtccctacaaaaaaaattttttttttttttttttttgagacagactctcgctctgtcgcccaggctagagtgcagtggcgtgatcttggctcactgcaacctccgcctcccggg

SEQ ID NO: 53089 - DNA, 111 bp, Homo sapiens; identical to SEQ ID NO: 53045

SEQ ID NO: 53090 - DNA, 116 bp, Homo sapiens
cagactgagagacgagagagggctttctttttttttttgagagacagtctcactctgtcgcccaggctggagtgcagtagcgcaatcttggctcactgcaacctctgcctcctggg

SEQ ID NO: 53091 - DNA, 120 bp, Homo sapiens; identical to SEQ ID NO: 53046

SEQ ID NO: 53092 - DNA, 92 bp, Homo sapiens; identical to SEQ ID NO: 53047

SEQ ID NO: 53093 - DNA, 64 bp, Homo sapiens; identical to SEQ ID NO: 53048

SEQ ID NO: 53094 - DNA, 71 bp, Homo sapiens; identical to SEQ ID NO: 53049

SEQ ID NO: 53095 - DNA, 86 bp, Homo sapiens; identical to SEQ ID NO: 53050

SEQ ID NO: 53096 - DNA, 89 bp, Homo sapiens
cctgggcgaagagcgagactccgtctcaaaaaaaaaaaattaatactttttttttttttttgagacggactctcactctgtcacccagg

SEQ ID NO: 53097 - DNA, 117 bp, Homo sapiens
ggtgggattataggcatgagctactgggcacagcttgttctgaatttttttttcttttttttttgagacagttacactattgttgcccaggttggagtgcaatgttgtgatcttggc

SEQ ID NO: 53098 - DNA, 115 bp, Homo sapiens
tgggggaggcactggcaggcctgcccgacactctttccctgttgcactactataggccgctgggaagcagtgcaatgatgaaagggcatcggtcaggtccagcctgctaccctgg

SEQ ID NO: 53099 - DNA, 78 bp, Homo sapiens
atcactctgtcactcaggctgaagtgcaatggtgtaatcatgcctcactgcaaattcaacttccttgtctcaggtgat

SEQ ID NO: 53100 - DNA, 78 bp, Homo sapiens
atttgctttatcattctttgtgtgcatgtgtgtgggcactcccacgcactctgagtcatttgagagtaaattgtagat

SEQ ID NO: 53101 - DNA, 58 bp, Homo sapiens
tgagaccgagtctcactctgtcacccaggctggagtgcagtggtatgatctcggctca

SEQ ID NO: 53102 - DNA, 81 bp, Homo sapiens
agcctgggcaacaagtgagaccccgtctctctctattttttttttttttttgagatggagtctcactctgttactcaggct

SEQ ID NO: 53103 - DNA, 70 bp, Homo sapiens
tgggctccaggccaaggacgtgcctggagatgactcctgccttgtggcgctgtcactgcctcactgtcca

SEQ ID NO: 53104 - DNA, 70 bp, Homo sapiens
gaccctggatgtagctggggcactgcttaggcctcagccagtggtgccaccctctctctgtgtcagaatc

SEQ ID NO: 53105 - DNA, 122 bp, Homo sapiens
gagacagagtgtgatcgcatttgctgagggtgctgtactgcaacgccaggtgcctcagctctgtctcactgaccagctcttgagccacgggtgagagctgggggtacaggagcacgggggcg

SEQ ID NO: 53106 - DNA, 80 bp, Homo sapiens
caagggctgaggctttgctgtgtgtcgggccctgtgctgagtgctttgccctcactgtcacactgaatccttagccttgg

SEQ ID NO: 53107 - DNA, 65 bp, Homo sapiens
tgtgtgtgtgtgtgtgtgtgtgtaatagtttctacttttattatagatgaaagagtacacacaca

SEQ ID NO: 53108 - DNA, 70 bp, Homo sapiens; identical to SEQ ID NO: 53103

SEQ ID NO: 53109 - DNA, 70 bp, Homo sapiens; identical to SEQ ID NO: 53104

SEQ ID NO: 53110 - DNA, 85 bp, Homo sapiens
cgtcacttgggaaagagtgatgccccacctgttttctgagaaacagcagaggccagtggggtgtctctctctttctctgaggccg

SEQ ID NO: 53111 - DNA, 97 bp, Homo sapiens
tgagttttaatttgcctctttcttttgttttcctttttttgagacagggtctcactctgtcacccaggctggagttcagtgacgcaattatggctca

SEQ ID NO: 53112 - DNA, 132 bp, Homo sapiens
gggaggcagctcagtgagccaggggagcaaagcagagccctggtcctgccagtgccagtccctgactccctgtctccagccacctgtgccgcgactgaggagggtgaggaggagggggtgcaggccatggta

SEQ ID NO: 53113 - DNA, 114 bp, Homo sapiens
tctcagtgtgagacaaaggaccctggtgtttctccagtcatcagagtcatgtcacagccacctttgcagagactcaggagggtgaggaagagagggtccaggccatggtagaga

SEQ ID NO: 53114 - DNA, 98 bp, Homo sapiens
ttttggcttttaacacctagttaatgtgggcacaagttgtttgtttttttttttttttttttttcagacggagtcttgctgtgttgtccaggccggag

SEQ ID NO: 53115 - DNA, 58 bp, Homo sapiens
tgagacggtgtctcactctgtcacccaagctggagtgcagtggcatgatattggctca

SEQ ID NO: 53116 - DNA, 109 bp, Homo sapiens; identical to SEQ ID NO: 53041

SEQ ID NO: 53117 - DNA, 64 bp, Homo sapiens; identical to SEQ ID NO: 53008

SEQ ID NO: 53118 - DNA, 74 bp, Homo sapiens
ctgccaactctcacaatgtctcagagactgttccaaggtgaagtctactagagagctaagggaggagtttgcag

SEQ ID NO: 53119 - DNA, 87 bp, Homo sapiens
gcatgtgtgtaaacgcatatgcctgtgtgtgtgcatgtgcatgtgtgtaaatgcatacactgtgtgtgagtgtgtgtgcatgtgtgt

SEQ ID NO: 53120 - DNA, 56 bp, Homo sapiens
agagccaggccgagatgggacagttctgtggctagtccctgtctctctgtgttact

SEQ ID NO: 53121 - DNA, 105 bp, Homo sapiens
tgggacaactgtggacacggccatactggggtctctgtctctctcattatcacaagggaggataccaacagctctctcctatgcagaccgtagtcatgtttccca

SEQ ID NO: 53122 - DNA, 89 bp, Homo sapiens
gtttacagattattgccatcagcatatatatatatatatatatatatatatatatatatatactgtttctggttgggacaactgtggac

SEQ ID NO: 53123 - DNA, 72 bp, Homo sapiens
gccccacacactgcgtcactccctgtgctgagctgaaggtcagggccaggctgatccctagtcttatggggc

SEQ ID NO: 53124 - DNA, 79 bp, Homo sapiens
tgagacagggtctcactctgtcacccaggctggagtgcagtggcgcgatcttgtctcactgcaagctctgcctcctggg

SEQ ID NO: 53125 - DNA, 107 bp, Homo sapiens
gtgttcctatttctccacatcctctccagcacctgttgtttcctgactttttttttttatactttaagttttagggtacatgtgcacaatgtgcaggttagttacat

SEQ ID NO: 53126 - DNA, 99 bp, Homo sapiens
ggcttggagcacatatcctgcctctctgtgcctcagtttcttcatctgtaaaacaggagtgggcagatgtgagaacagactggcagctcgtgtccagct

SEQ ID NO: 53127 - DNA, 82 bp, Homo sapiens
tcactgcttggctacgagggcggagccacagctttgcaggatgatgtgtccgtctgtctgtctctttgcagtggtacacgcc

SEQ ID NO: 53128 - DNA, 65 bp, Homo sapiens
gccattcaggccttgaacagcaggcccagaagcttcagctcacagctctgactgtcagggccggc

SEQ ID NO: 53129 - DNA, 76 bp, Homo sapiens
gtttgttttttgagactgtgtctcgctctgtcgcccaggctggagtgcagcccagcgatctcggctcactgcaagc

SEQ ID NO: 53130 - DNA, 117 bp, Homo sapiens
tcctccttttcatagcccatggggtcaggactggggacttttactgatcattggaaagtgacttatcaattactcggtctttttctcatttcatccctgtagtttactttctgagga

SEQ ID NO: 53131 - DNA, 78 bp, Homo sapiens
cagtggcacttgagtagaggatctccccgggctgctcaattccttgctctgcctggctctctctctctgtggctgctg

SEQ ID NO: 53132 - DNA, 60 bp, Homo sapiens
gtgtcaccacagtctctctcacttgggccccagctttgtggacagagcttgtgtgagcac

SEQ ID NO: 53133 - DNA, 58 bp, Homo sapiens
tgagacggtgtctcactctgtcacccaagctggagtgcagtggaatgatattggctca

SEQ ID NO: 53134 - DNA, 63 bp, Homo sapiens
gggctgtccagtgtgttgtagggagtttactaggattcctggcctcttacacactcactgtct

SEQ ID NO: 53135 - DNA, 92 bp, Homo sapiens
agtttctgtttcacaagatgaaaaggattccagagctagacagcggtgatggctgaggtagaaggatcacttgagtctgagaggttgaggct

SEQ ID NO: 53136 - DNA, 85 bp, Homo sapiens
atatatgtatatgtatatatatgtatgtatatatatgtgtgtatatgcatatatgtatatatgtgtgtgtatatatatatatata

SEQ ID NO: 53137 - DNA, 79 bp, Homo sapiens
tatatatatatatctgtatatatgtatatatgtgtatatatatgtatatatgtgtatatatgtgtatatgtgtatatat

SEQ ID NO: 53138 - DNA, 57 bp, Homo sapiens
ctggggctgtgtgaccttgggcagaggacgctgcctctctgggtctctgagccccgg

SEQ ID NO: 53139 - DNA, 91 bp, Homo sapiens
gtacaatattttttgtctgtttccatgtgatatcaaatttattttttaatcctattgcatttacatgagtcaaggcatgaagttcttgtgc

SEQ ID NO: 53140 - DNA, 56 bp, Homo sapiens
gggtgtgtggatccttgtgtccatggaccgaccatgggaggcttcgctatccatcc

SEQ ID NO: 53141 - DNA, 82 bp, Homo sapiens
ccaacgtgacagcacagatgttcttgtctttgaagacccccttttttttttttttaagacaggtctcactctgtcaccctgg

SEQ ID NO: 53142 - DNA, 105 bp, Homo sapiens
gcccctccagtgagccccaggctgggtctctctctggctctccctgtccctgttcagaacatctgaactcacagccagtgtcccagagatggctctggaggcggt

SEQ ID NO: 53143 - DNA, 83 bp, Homo sapiens
ggagccacctggcaccgtgctcataccactggcccagatccacactccctgtgtgtgtcacccagtcttgcagccgggcctcc

SEQ ID NO: 53144 - DNA, 70 bp, Homo sapiens
tgcggggtggctggggtgtaactgggggagaggaggagagcctcactgtccctgtcgctgacacctggca

SEQ ID NO: 53145 - DNA, 108 bp, Homo sapiens
cgagcctgggtaacttagcgagacctatatcttaaaaatacgaacaaaaaaaacaaaaaaaattgattttgtttttaagacggagtctcactctgtctcacaggctgg

SEQ ID NO: 53146 - DNA, 58 bp, Homo sapiens; identical to SEQ ID NO: 1391

SEQ ID NO: 53147 - DNA, 56 bp, Homo sapiens; identical to SEQ ID NO: 1392

SEQ ID NO: 53148 - DNA, 76 bp, Homo sapiens
ggtgccactgcagtccagcctggctgacagcgagactctgactcagtcagtcaatcagtgtttggtagaattcacc

SEQ ID NO: 53149 - DNA, 111 bp, Homo sapiens
tgccccgaccttggtatgtatcctctctgggtggagactgtccctgtctgagtgggtactggctaacagctgcccactgaggggcttcagccaggcatccactaggtggca

SEQ ID NO: 53150 - DNA, 82 bp, Homo sapiens
cgtgaccctactctccccctctcacgtgtgtctgtgtcccgtggcgccacctcacagacaccctgtctgagaagggattatg

SEQ ID NO: 53151 - DNA, 116 bp, Homo sapiens
tcagcctcctgagtagctagattacaaatgtgtgccactatgtctggctaatttttttgtatttttaacagagatgggatttcacaattttggtcaggctgttctcgaactcctga

SEQ ID NO: 53152 - DNA, 58 bp, Homo sapiens; identical to SEQ ID NO: 16419

SEQ ID NO: 53153 - DNA, 71 bp, Homo sapiens
tgaagctccttgatcaaaaaggattaaggatttttttttttttttttttttttttttgatatggagtctca

SEQ ID NO: 53154 - DNA, 60 bp, Homo sapiens
gtgagacagggtctcactctgtcacccaggctggagtgcagtggtgcgatcatagctcat

SEQ ID NO: 53155 - DNA, 95 bp, Homo sapiens; identical to SEQ ID NO: 68

SEQ ID NO: 53156 - DNA, 93 bp, Homo sapiens; identical to SEQ ID NO: 69

SEQ ID NO: 53157 - DNA, 113 bp, Homo sapiens
gcagcgtgcatggtggtttgtgcctgtagtcccagctacctgagaggctgagttgagaagatggcttaagccagggaggtgaaggctgcagtgagccaagatcatgccactgc

SEQ ID NO: 53158 - DNA, 86 bp, Homo sapiens
gggctctggctggacataggggcctggcaggctgtgtggcctgtaaggacacagtctgtctctgtgcctcagtttctctgctgccc

SEQ ID NO: 53159 - DNA, 63 bp, Homo sapiens; identical to SEQ ID NO: 53134

SEQ ID NO: 53160 - DNA, 76 bp, Homo sapiens
tgaccttgtgcaagtcacccacactctgtgagccttgtttataaaggagagtggattagtagctttcagaagttcg

SEQ ID NO: 53161 - DNA, 94 bp, Homo sapiens
caggcagttaccatggacacaggatcaatctgtgactttttcttttctgttttgaaataaagtctcactctgtcacccaggcttgactgcactg

SEQ ID NO: 53162 - DNA, 74 bp, Homo sapiens
gaagaggctagagaggacactgaggccaggctgcgagggtctggaggcccctgagagaactctggctcctcttc

SEQ ID NO: 53163 - DNA, 116 bp, Homo sapiens
gcaagtgcggcggccggcgcggcgcggggtgcggagccgcaggtagcgggcggggagcgtccgtccgtcagtccgtccgtccgtccatgcgccgcagaccggccccgcgcgctcgc

SEQ ID NO: 53164 - DNA, 105 bp, Homo sapiens
ggttggtggagagctgtgattgtcccggtttggtctcactcactctgggactcccggaaggagtgtaagaatgtcaagggtaatcctcacacagccctgtgagcc

SEQ ID NO: 53165 - DNA, 61 bp, Homo sapiens
taccatgaatggaacttgcaggactggaggttgctctgggtgtgtcagtgagtgagtggtg

SEQ ID NO: 53166 - DNA, 82 bp, Homo sapiens
gtcagaacaagactctgtctcagaaaacaaaaagtgtgttaatttttttttttttttttttgagatggagtcttgctctgtc

SEQ ID NO: 53167 - DNA, 88 bp, Homo sapiens
acagagtgagaccctgtttcagaagaaaacaaaaagttcttttttttccttttcctttttttttttttgagatggagtctcactctgt

SEQ ID NO: 53168 - DNA, 88 bp, Homo sapiens
gtgatgattattgtcttgtgagaacagaggcgaaacacagttgttttgtgtgtgtgtgtgtgtgtgtgtttttgagatggagtctcac

SEQ ID NO: 53169 - DNA, 109 bp, Homo sapiens
ggctgaccaggggctctggccggacataggggcctggcaggctgtgtggcctgtaaggacacagtctgtctctgtgcctcagtttctctgctgcccagatggagaggcc

SEQ ID NO: 53170 - DNA, 63 bp, Homo sapiens; identical to SEQ ID NO: 53134

SEQ ID NO: 53171 - DNA, 119 bp, Homo sapiens
agtctggctgctcaccagtcaggatccaaaatgcaagaagtgaagtgtgctgaaaggaaagtaactttcttttttttttttttttttgagatggagtcttgcactgtcgcccaggctgg

SEQ ID NO: 53172 - DNA, 108 bp, Homo sapiens
ctgggattacagacgtgagccaccacacccagtctttttttcttttctttttcttttcttttctttttttttttttttttttgagatggagtctcactctgtcaccag

SEQ ID NO: 53173 - DNA, 61 bp, Homo sapiens
gcaaggcagggagaggcagagctgggctcccacccactctgtctcactccagatcctgtgt

SEQ ID NO: 53174 - DNA, 64 bp, Homo sapiens
ggggtagaaaggaaggtggccagtgactctgtgggcttgctgtgcctctgtctgtctctaatcc

SEQ ID NO: 53175 - DNA, 86 bp, Homo sapiens
gatcccagaaggtaagcagaaacacacactgtctcttggtctcagcttctctggcataaagtcatttctgccacattctgttggtc

SEQ ID NO: 53176 - DNA, 89 bp, Homo sapiens
gacagagctatatgacatgattttagttggtatggtgagaaagtcattctttttttttttttttttttgagacagagtctcgctctgtc

SEQ ID NO: 53177 - DNA, 83 bp, Homo sapiens
agcccaaggtggccacagagtggctgtgggtcatttttttttttttttttttttgagacggagtctcactgtgtcaccaggct

SEQ ID NO: 53178 - DNA, 67 bp, Homo sapiens
gagccgtgaatggggaggtcagagcctggggttcgggacctggctctgccactcactcactgtgctt

SEQ ID NO: 53179 - DNA, 70 bp, Homo sapiens
atatatgtatacatatatatttatttatatatttattatatatgcatatatgtatatatgttgcatatat

SEQ ID NO: 53180 - DNA, 67 bp, Homo sapiens
gccaagtaagttggtagtattgttaatggtagaagccaatttcctaattttgccaatgtgctatggt

SEQ ID NO: 53181 - DNA, 134 bp, Homo sapiens
ggattgctgcgttgaatggtagttctttgttaagttctttgggaaatctccaaacagcttttcacagtggctgaactaatttacatttccaccagcagtgtgtaggcgttcccttttctccaaagccttatcag

SEQ ID NO: 53182 - DNA, 78 bp, Homo sapiens
tatgtatgtatgtatgtatatatgggtgtgtgtatgtatatatatacatatacatgtatatgcatatatatatgtata

SEQ ID NO: 53183 - DNA, 78 bp, Homo sapiens
tggggttgctttctgtggggtatgtgtttaatgaaaatccttgtttttaaataaatatatcctgctttagaacgccca

SEQ ID NO: 53184 - DNA, 93 bp, Homo sapiens
gtgcatgactgtagttccagctacttgggaggctgtggtaggaggatcacttgagcccaggaggttaaggctgtagtgagccatgatcacacc

SEQ ID NO: 53185 - DNA, 104 bp, Homo sapiens
gttatttccatttcaaatcataaatagaatgtttttgttttttgttttttgttttttttttgagacagagtctcattctgtcacccaggctggagtgcagtggc

SEQ ID NO: 53186 - DNA, 72 bp, Homo sapiens
acttataagctggtgacctggagcaggcagtgaatcctctgcgtgtttcagcttctccatctgcagaaaagt

SEQ ID NO: 53187 - DNA, 117 bp, Homo sapiens
gaccttgggtataggagagagctatttgatggaaagagcctgggtccctgaatgactgtgtggagcaccgtggtttccaacccatgctatcttggacttctttgacaaaccgttgtt

SEQ ID NO: 53188 - DNA, 56 bp, Homo sapiens
tgtgacacgctctcgctctgtcacccaggctggagtacagtagtggtgtgatcaca

SEQ ID NO: 53189 - DNA, 75 bp, Homo sapiens
ggaactgactgtgtcactgtcaatcaggggatctgtcaggggaggcccttcactgtgacagaaacaaacacttcc

SEQ ID NO: 53190 - DNA, 72 bp, Homo sapiens
agctgagcatttactgtccagtctccaggcttcattccccaggctgggggaaaagacgagaaggtggaggct

SEQ ID NO: 53191 - DNA, 58 bp, Homo sapiens
tgagacggggtctcactctctcacccaggctggagtgcagtggtgtgatcccagctta

SEQ ID NO: 53192 - DNA, 90 bp, Homo sapiens
cttggggcaggtacccactctcagtgcctctgttttgtcaactgtaaaatggaaataatatttgtacccatggagtggggctgtcatgag

SEQ ID NO: 53193 - DNA, 77 bp, Homo sapiens
ttgatagcaattgaactcatagtgggtggggaaaaacagctatgttatttctctctctcgctctcattttgtatcga

SEQ ID NO: 53194 - DNA, 93 bp, Homo sapiens
gactgagctcccctcatgtgacaggcactgtgtctgccaccaaaatcaatgagcaagacagacaaggtgcctgtcctcatggagcttatagtc

SEQ ID NO: 53195 - DNA, 67 bp, Homo sapiens
gttttgagagagtctcgctctgtcacccaggctagagtgtggtggcgcgatctcggctcactgaaac

SEQ ID NO: 53196 - DNA, 70 bp, Homo sapiens
tgctttgacaggctgaggtaggaggatcacttgaggccaggagttcaagaccagcctgggcaacatagca

SEQ ID NO: 53197 - DNA, 56 bp, Homo sapiens
gagacagggtctctctctgtcacccaggctggagtgcagtggcgtgatcttggctc

SEQ ID NO: 53198 - DNA, 92 bp, Homo sapiens
gactcacaggtcattacatatatatttttccatgaatatatgcatatatatatacataggaaaagtgtgaccagaaccccgatttgtgattc

SEQ ID NO: 53199 - DNA, 154 bp, Homo sapiens
gtgtgtatatgtgtatatgtaaaactgtgtgtttgtgtatatatgtatatgtgtatattgtgtatatgtatatatgtatgcatgtgtttatgtgcatatatgtgcatatgtgtatatgtataaatgtatgcatgtttgtatgtatatgtgtata

SEQ ID NO: 53200 - DNA, 77 bp, Homo sapiens
gctatgtgtgtgtgcaaatgcatgtgtgggcatgtgtacatgaatgcatgtgtgtgcatgcatgtgtgtgtgcatgt

SEQ ID NO: 53201 - DNA, 121 bp, Homo sapiens
gggggatacatgatgcaaggtctggcagggtgggggtgtgaataaatgtgcattgatggagaaagtagtcactgagcataggctgtctgatgacctcaaaatcaagcccctgattaatcat

SEQ ID NO: 53202 - DNA, 105 bp, Homo sapiens
tggcaagcagtgctgagtgctgtggatgcaacagactctgtctctggctctccagggctgacagtctagtgaagtctggcaacacaagggcccaaaccacttcca

SEQ ID NO: 53203 - DNA, 60 bp, Homo sapiens
accttaagcagctgcatttaggaacaagctgggctgactgactgtggctgtctggaaggt

SEQ ID NO: 53204 - DNA, 81 bp, Homo sapiens
ttgctcagtgacaaaaatgacagtcctcacatgtccatgatgattaaaactgggactgaattgattttgatgtcactgcaa

SEQ ID NO: 53205 - DNA, 75 bp, Homo sapiens
tgagatggagtctcactgtctcacccaggctggagtgcaatggtatggtgtcggctcactgtgacctccatctca

SEQ ID NO: 53206 - DNA, 82 bp, Homo sapiens
aggctttgggggaggtggcctgaattcctggtcagcagtcagccgtgagactttgagcaggtcactgagtctctctctgcct

SEQ ID NO: 53207 - DNA, 121 bp, Homo sapiens
tatgtatatatatgtatgtatatatatgtatgtgtgtatctatatatatgtatatatatgtgtgtgtgtatatatatgtatatatatgtatgtgtgtatatatctgtgtgtatatatatat

SEQ ID NO: 53208 - DNA, 87 bp, Homo sapiens
gctttgcttcttgattctgactgccacccggctctctgtgaggagacaggggagggcaggtgtcagacccactctcagcatcctagc

SEQ ID NO: 53209 - DNA, 95 bp, Homo sapiens; identical to SEQ ID NO: 68

SEQ ID NO: 53210 - DNA, 93 bp, Homo sapiens; identical to SEQ ID NO: 69

SEQ ID NO: 53211 - DNA, 75 bp, Homo sapiens
ttgagagatatgttgaaactaggacccatggaaggaacaccaggtttatggttcctaagtcacactcactctcag

SEQ ID NO: 53212 - DNA, 102 bp, Homo sapiens
taatcaccatgcttcactgcctgttcctgtctctgtgggtgtctctgggccttagtgactcccatataaaacagggatagtcatccttgggcagagtggttg

SEQ ID NO: 53213 - DNA, 80 bp, Homo sapiens
ggtcttggcgggtcccgcagtcacactgtgactttgctcagcaccgtgggttagcacctgtacctgtggctgtcatcacc

SEQ ID NO: 53214 - DNA, 74 bp, Homo sapiens
gggtcagagagaacagagtgcacaaggcctcctgagacctaggctcaagactgatgtattatcacttctgcccc

SEQ ID NO: 53215 - DNA, 77 bp, Homo sapiens
tttgttttgttttgagatggagtctcactctgtcacccaggctggagtgcagtggcacgatcttggctcactgcaaa

SEQ ID NO: 53216 - DNA, 84 bp, Homo sapiens
tcaaccaggccttttctctctctgacactcagtttcttcaactgcaaagtggggatcgtggggcatagaagacatcctcgttgg

SEQ ID NO: 53217 - DNA, 70 bp, Homo sapiens
gtttttgagacaaggtctcactctgtctcccaggctggagtacagtggcacaatcttggctcactgaaac

SEQ ID NO: 53218 - DNA, 70 bp, Homo sapiens
gtgtgtatatatgtatatatatacgtgtgtatgtatacatacacacatatgtatatacatatacgtacac

SEQ ID NO: 53219 - DNA, 168 bp, Homo sapiens
tatgcttataatcatatatatgtgtgtgtatatgtatatatatacatgtgtatatatgtatatatatacgtgtgtatatatgtatatatatacgtgtgtatatatgtatatatatacgtgtgtatatatgtatatatatacgtgtgtatatatgtatatatatacgtg

SEQ ID NO: 53220 - DNA, 81 bp, Homo sapiens
caaaatactgtgttgtagggggatggtaggggagtgcttcaggagagtatatgtaatgatctcactgccactgtgtctttg

SEQ ID NO: 53221 - DNA, 82 bp, Homo sapiens
ctgtctcttactgtctctttatatatatatatatatatatatatatatatatatatatatatagagagagagagagagagag

SEQ ID NO: 53222 - DNA, 94 bp, Homo sapiens
gtgcctggcttgactctgcatgtctgtcagcctctgtgtatgagcaggttagccagaacatgcttctttcatggcagggacagagatgcaagag

SEQ ID NO: 53223 - DNA, 116 bp, Homo sapiens
gggattcagcttttttccccaagcctcagtttgctcacttgtgaaataggggtcattatagtctctctcactgtgagaactaaatgaactgatgtcaggaaatgtttagaataccc

SEQ ID NO: 53224 - DNA, 98 bp, Homo sapiens
gtatagtttttctaaaggcgagttgtatagttttttaaatgtgagttgtatggttctatagtttttttttaaaggtgagttgcttttaaaaactgtat

SEQ ID NO: 53225 - DNA, 84 bp, Homo sapiens
tatatgtctatatgtttcatatatgttcctctaaattatatgtatatattacatatgtgcatatatattatatataaacatata

SEQ ID NO: 53226 - DNA, 89 bp, Homo sapiens
gaatacagtagtgcatggtcacaatttataagcatgtgtatttgtttatatatgtatgtttgtatgtatctgtgcatatgtttgtattt

SEQ ID NO: 53227 - DNA, 79 bp, Homo sapiens
cttgactggaccacagagtgcccagatatttggtgaaacagtatctctcactgtgtctgtgagggtatttccgggtgag

SEQ ID NO: 53228 - DNA, 107 bp, Homo sapiens
gtgaaataatttaatggcaaaaacatgcattctccttcctctctgagcctcactgtgttgtgaggattaaatgagttaattgctgtaaagtgcttagaaagttccac

SEQ ID NO: 53229 - DNA, 93 bp, Homo sapiens
gtctccctcacctcctaccccggcctcagtctccctgtctgttaaatgagctcgccggggacttgatggtctctgaggcttctccagggatgc

SEQ ID NO: 53230 - DNA, 82 bp, Homo sapiens
agatggatggatagatagacagccagacatatgtgtgtatgtatatatatacttgtgtatatctgtatctctatcttcatct

SEQ ID NO: 53231 - DNA, 65 bp, Homo sapiens
gtgacactgacacactctcctaccggaatgggtggggcaagtaaatgagggtgtgggttctccac

SEQ ID NO: 53232 - DNA, 108 bp, Homo sapiens
ggcatggtggcatgtgcctgtagttccagttacctgagaggctgaggtggtaggatggcttgagcccaggagtttggggctgcagtgagctatgatcacgccactgcc

SEQ ID NO: 53233 - DNA, 90 bp, Homo sapiens
gcctggggccggatggtgtcacggagacatctgggggcagtctggcaaccccctcagcctctgggtctctgagacatcctgggccgtggc

SEQ ID NO: 53234 - DNA, 109 bp, Homo sapiens
gatgatacctcctgggccaggctgggcacctcagagactctcagagagtggctggccccaccagtcaggggctccatctctccctttgtaggttcctctcctccactgg

SEQ ID NO: 53235 - DNA, 58 bp, Homo sapiens
tgagacagaatctcactctgtcacccaggctggagtgcagtggtgtgatcttggctca

SEQ ID NO: 53236 - DNA, 91 bp, Homo sapiens
ccgggcatggtggcatgcagctgtggtcccagctactcaggaggctgaggtaggaggatgacttgaggctagcagttcgagaccaacctgg

SEQ ID NO: 53237 - DNA, 91 bp, Homo sapiens
aagtgcgtgtgtgtgtgtgtgtgtatatatataggtgtatatataggtatgtgtgtctatatatgtatctatatatatctaatggcttctt

SEQ ID NO: 53238 - DNA, 58 bp, Homo sapiens; identical to SEQ ID NO: 1435

SEQ ID NO: 53239 - DNA, 83 bp, Homo sapiens
tgtgtgtggctctcactgcctggctctcctctgtcccttcacggaaagcactatggaccagaactcagtaaggctcactcaca

SEQ ID NO: 53240 - DNA, 93 bp, Homo sapiens
cgcggaggactggtaggccagcacatgcatgtaagtgtctgtgtgtgtgtcaggggaggttctgtgggaatgtatgtatgtatttgtatgtgc

SEQ ID NO: 53241 - DNA, 121 bp, Homo sapiens
acatgtatttgtgtgtatatagatgtatacagatatatacatatgtatacctatagatacatgtttatatatacatgtatgtatacaccatttatatacatatatctgtagctatttctgt

SEQ ID NO: 53242 - DNA, 90 bp, Homo sapiens
gtatggcaactggtgatgcttaagatggtggctgacttcccagtctgggtccctgagtgactatagtgagcagaggctttgatgacctgc

SEQ ID NO: 53243 - DNA, 58 bp, Homo sapiens; identical to SEQ ID NO: 884

SEQ ID NO: 53244 - DNA, 56 bp, Homo sapiens; identical to SEQ ID NO: 885

SEQ ID NO: 53245 - DNA, 65 bp, Homo sapiens
gtgagactctgtctcaaaaaaaaaaaaaatttttttttttttttttggttaagatgaggttttgc

SEQ ID NO: 53246 - DNA, 83 bp, Homo sapiens
ttgaacacaatttagaggtctgtaggaaaattaacatatttttcaaatatgttaatttttgaacaaattttgaattggttcaa

SEQ ID NO: 53247 - DNA, 93 bp, Homo sapiens
gtgtatgaaaaagaggagtaggactggtggtgatgggaagaacgacttttaatttttattttatatccttctatctccttgcatttttaccac

SEQ ID NO: 53248 - DNA, 90 bp, Homo sapiens
cctcctaggtcttttgtcacagagactgttctaggaaattatatctttatttctgatgattttagctgtaacatttcaacctggattagg

SEQ ID NO: 53249 - DNA, 65 bp, Homo sapiens
gggtttctctgtgtgcctgagtggctgctctgcagatacttcacatagctctgtgtattggaccc

SEQ ID NO: 53250 - DNA, 172 bp, Homo sapiens
gcttagaatgatggcctccagctccatccatgttgctgcagagggcatgatttcattctttttttaaggctgcatagtataccatggtgtatggaatttatattttctttatcttgtccaccattgatgggcatctaggttgattccatatctttgctattgtgaacagtgc

SEQ ID NO: 53251 - DNA, 76 bp, Homo sapiens
tggacactggctgagttctgccccgtgttgctttccaatgtaacagggtagcactgagtttcaatgtaaagttcca

SEQ ID NO: 53252 - DNA, 109 bp, Homo sapiens
tatagctatacatatctatgtgtagctacatgtgtatgtatgtatgtgtatatataatgtatgtatatataactatacatacgtgtagctgtatgtatgtatagctata

SEQ ID NO: 53253 - DNA, 96 bp, Homo sapiens
ctatgtatatagttatacgtatatatacactatatatagctatacatatgtatgtatagttatatatgtatatagctatgtatactatatatgtag

SEQ ID NO: 53254 - DNA, 93 bp, Homo sapiens
gtataactatatacatagctacatattactaattatatatagttatatgtatagttatatatagttatatgtatagttatatataactatata

SEQ ID NO: 53255 - DNA, 108 bp, Homo sapiens
gtgtatatatatatatacacacacatgcatttgtatatgtgactatatattgataaatgaatatatagttatatataactatacatataactatatataactatacat

SEQ ID NO: 53256 - DNA, 83 bp, Homo sapiens
cacatatacaaatgcatgtgtgtgtatatatatatatacacgaaaaaattatatagtcacatatacaaatgtgtgtgtgtgtg

SEQ ID NO: 53257 - DNA, 71 bp, Homo sapiens
tcaggtgaggtggtgtgtacctgcagtttagctacttgggaggctgaggtaggaggatcacttgagcctgg

SEQ ID NO: 53258 - DNA, 95 bp, Homo sapiens; identical to SEQ ID NO: 68

SEQ ID NO: 53259 - DNA, 93 bp, Homo sapiens; identical to SEQ ID NO: 69

SEQ ID NO: 53260 - DNA, 116 bp, Homo sapiens
ttgcagtcctgagaatatttttaaagggaacctatacaaatatatatttgtaaatatctatttatgtgatacaaatatatatctgtttatgtgagttaacctattcctcaatgcaa

SEQ ID NO: 53261 - DNA, 111 bp, Homo sapiens
ctggctctgttgcccaggctggagtgcagtgacacaatccttttttattttttatttttttttgagacggagtctcgctttgtcacccaggctggagtacagtggcgccag

SEQ ID NO: 53262 - DNA, 109 bp, Homo sapiens
gagattacagatgtgagccactgtgcctgccttcatgaactttttttttttttaaagcttgtttaagtagggttctgttgggctttcagcatgatggtttctgtgttcc

SEQ ID NO: 53263 - DNA, 94 bp, Homo sapiens
ccagcctgggcaacatagggagaccctgtttctctctcttttttttttttttttttttttttgagatggagtttcactctgtcacccaggctgg

SEQ ID NO: 53264 - DNA, 59 bp, Homo sapiens
agccctagacacttggaggctgaggtggaaggatcacttgagtctaggaggtagaggct

SEQ ID NO: 53265 - DNA, 86 bp, Homo sapiens
ggggagcaggctttgcatctaaaacataagctcttcagaggacagtctttttttttttttgagacagagtttcactcttgttgccc

SEQ ID NO: 53266 - DNA, 129 bp, Homo sapiens
gcaaggagagtgaaccaggagctcatcagatgggttggcaggagctggatcacacagaactgagtgagatgctaacatttattattatttttgagacagggtcttgctgtgttgcctaggctgaagtgc

SEQ ID NO: 53267 - DNA, 73 bp, Homo sapiens
tcaaggtccatgtcttctgatttttttcagtgttcactggtctagaaaaggtgagaaggaggcttgattttgg

SEQ ID NO: 53268 - DNA, 129 bp, Homo sapiens
tatatacatatatatatacatatatacatatatatacacatatatacatatatatacatatatacatatatatacacatatatacatgtatatatgcatatatatacatgtatatatatacatatatat

SEQ ID NO: 53269 - DNA, 96 bp, Homo sapiens
gcaaacaggcttgggagtgggctcaaatcctgactcctgtgctttttttttttttttttaagacagagtcttgctctgtctcccaggctggagtgc

SEQ ID NO: 53270 - DNA, 85 bp, Homo sapiens
ggcctggcagatagggccacagatcttataaaatgtttttatttatttattttttgagatggagtctcgctctgtctcccaggct

SEQ ID NO: 53271 - DNA, 67 bp, Homo sapiens
cagggaagggggccactccctctgtggctgggtgcagtcagcggtcctgggtggaatcctggccctg

SEQ ID NO: 53272 - DNA, 128 bp, Homo sapiens
gtcgggggctgtcgtggtcatcctggtgagagactgagccgggcagtgggtgggagccagtgaggacagacagccgtcgatggagcaaaaagacacttgtgtgctggtctggctgcaaaagggagtga

SEQ ID NO: 53273 - DNA, 73 bp, Homo sapiens
gggcttggggaaggctggcaggcaggggctgggccgtctgtccgtctgtctgtctctactcaccatagagccc

SEQ ID NO: 53274 - DNA, 58 bp, Homo sapiens
tgagacacggtctcactctgtcacccaggctggagtgcagtagtgcgatgttggctca

SEQ ID NO: 53275 - DNA, 58 bp, Homo sapiens; identical to SEQ ID NO: 285

SEQ ID NO: 53276 - DNA, 70 bp, Homo sapiens
gttttttttgaggagtctcactctgtcacccaggctggagtgcagcagtgtaatctcagctcactgaaac

SEQ ID NO: 53277 - DNA, 94 bp, Homo sapiens
aggttgttggctattatatgactttatttatatgaaatgtctagaataggcaaatctatagagacagaaaatagattagtggctacctaaacct

SEQ ID NO: 53278 - DNA, 59 bp, Homo sapiens
gggtcacccagggaagctttattttattttatttgagacagagtctccctctgttgccc

SEQ ID NO: 53279 - DNA, 88 bp, Homo sapiens
cagagatacaggacagtgagaccaggtaacatttgaggagaatattttttttttattgagacagggtcttgctctgttgtccaggctg

SEQ ID NO: 53280 - DNA, 105 bp, Homo sapiens
gtccagaacactcttttttggggacagggggaggtaaagcaactttttttttttttttttgagacggagtcttgctctgtcacccaggctggagtgcagtggcac

SEQ ID NO: 53281 - DNA, 87 bp, Homo sapiens
ccactgacttaggtggtggcatttgggggcttcttttagtttattcactcagtaagtggttgtcaaatgcttaccatgtggcagggg

SEQ ID NO: 53282 - DNA, 103 bp, Homo sapiens
gtgtgtgtgtgtgtaggcagggagtgatgcagagaagggacctgcagtttctgtctgtctctctcacacacacatacacagcagctctctttttctgtctgtc

SEQ ID NO: 53283 - DNA, 93 bp, Homo sapiens
gctgctgtgtatgtgtgtgtgagagagacagacagaaactgcaggtcccttctctgcatcactccctgcctacacacacacacacacacacac

SEQ ID NO: 53284 - DNA, 69 bp, Homo sapiens
gactgggtctcactctgtcacccagactggagtgcggtggggtgatcagggctcattgcaggctcaatc

SEQ ID NO: 53285 - DNA, 74 bp, Homo sapiens
aagtgttctcagggatgttaggataaggtggctcagctgagctgacttatcagagtgtgcatgcctgattgctt

SEQ ID NO: 53286 - DNA, 95 bp, Homo sapiens
ttcctgactagtttattcatattttttgtagagacaggtttatttatatttttcgtagagatgggtctcaacatattgcccaggctggtcttgaa

SEQ ID NO: 53287 - DNA, 97 bp, Homo sapiens
catatatgtatatatgtgtatatatatgtatgtatatatgtgtgtatatatgtatatatgtgtgtatatgtatatatgtgtgtatatatgtatatat

SEQ ID NO: 53288 - DNA, 95 bp, Homo sapiens
taggcacagtgtctggcacagattaaatagccaatgtataaagaatgaatgtttaacacatacatagtatttgttatgtgccaggcattgttcta

SEQ ID NO: 53289 - DNA, 91 bp, Homo sapiens
cacaggtgcaccactgcgggctgctctgactcacacaggcctgaggtcagtgtgcctgtgtgtgtctctgccacatacctgtgtgtctgtg

SEQ ID NO: 53290 - DNA, 117 bp, Homo sapiens
ggggggcatttctttggagtttgacttttttttttttttttaatggagtctcgctctgtctcccaggctggagtgcagtggcacaatctcagctcactgcaacctccacctcccggg

SEQ ID NO: 53291 - DNA, 104 bp, Homo sapiens
ggtgagggatgtgcctaagtcacatattacaaaggtcagtggtggagccatcactgacactctgaccctgtgcctggttcagagccctttctcaaacactagcc

SEQ ID NO: 53292 - DNA, 67 bp, Homo sapiens
ggcttgtctccaggagagacttagtcgaggtctcggcctcttttttttttttttttgagatgaagtt

SEQ ID NO: 53293 - DNA, 73 bp, Homo sapiens
ggttggcagcctgtctccctgtgagcgtgtggtatgacctggtcacctgggctgagaggactaagggccagcc

SEQ ID NO: 53294 - DNA, 101 bp, Homo sapiens
cacagaagcagctcaccctgcagaagcccctgactagcctcaggagactgtgcacactccctgctctgccctatcaatgtgtgtctgtgggcaagctcttc

SEQ ID NO: 53295 - DNA, 70 bp, Homo sapiens
gtacgctgagggtgataacactgtctttgtcccaggattgttgtgaggcaggttggtttcttggctgtat

SEQ ID NO: 53296 - DNA, 56 bp, Homo sapiens
gcaggcggtgttggagtgagcacctctctgtagctgtctctcacactcttgtctgt

SEQ ID NO: 53297 - DNA, 85 bp, Homo sapiens
aacttagccaggcgtggtgttgcctgcctgtgttcccagctactggggaggctgaggtaggaggatcacttgagcctgggaagtt

SEQ ID NO: 53298 - DNA, 106 bp, Homo sapiens
tccaggtggttgtcagtctatctctccagtgcctctctgtccctgtctggaccctgctggggggccacagagcaggcaaaggcagggctcaactgccaggcctggg

SEQ ID NO: 53299 - DNA, 84 bp, Homo sapiens
acatatatatgtgtgtatatatatatacatatatatgtgtgtatatatatgtatacatatatatgtgtgtctgtatatatatat

SEQ ID NO: 53300 - DNA, 113 bp, Homo sapiens
tatatatatatatatatatgtgtgtgtgtgtgtgtgtatatatgtatacatatatatgtgtgtatatatgtatacatatatatgtgtgtatatatgtatacatatatatgtgt

SEQ ID NO: 53301 - DNA, 80 bp, Homo sapiens
agtgctgagattacaggcgtgagccaccatgccaggccttttttttttttgacatggagtctcactctgtgactcaggct

SEQ ID NO: 53302 - DNA, 71 bp, Homo sapiens
ctgactgatgtcactgatgtctgcaaggaggaatgagttcacacctgtgcagaaaagagttcacacagcag

SEQ ID NO: 53303 - DNA, 71 bp, Homo sapiens
ctccagttgtgtgacagtggtatgcaggtctgtcactcacactgccttgcacattgtggtcactgcaggag

SEQ ID NO: 53304 - DNA, 96 bp, Homo sapiens
ttgtttttgttttttggtggagggggctgaagagtctcactctgtctcccaggccgaagtgcagtggtgcgatctcagctcactacaacctctgcc

SEQ ID NO: 53305 - DNA, 114 bp, Homo sapiens
aatggagaatcgaagtgacttgcacagggtgggagatggcagccaggccactgcatgaaatcagggctggactagaagttacccagcagtgatcataccagattataacccatt

SEQ ID NO: 53306 - DNA, 58 bp, Homo sapiens
tgagacagagtctcactctttcacccaagctggagtgaagtggtgcgatctcggctca

SEQ ID NO: 53307 - DNA, 58 bp, Homo sapiens; identical to SEQ ID NO: 9893

SEQ ID NO: 53308 - DNA, 115 bp, Homo sapiens
cagaggcctcatgagaaaaaaatgaggtggcggggggtctggaatagtgttttggtttgtttttaattttatttttaaaattttattttttttttagagatggggtcttactctg

SEQ ID NO: 53309 - DNA, 104 bp, Homo sapiens
tcaagctgagtgttcaactggttgccttaggtgttttttttttttttttaaacctgttctggttcatttgtaaagtttccttggggcctccgtgataggtttga

SEQ ID NO: 53310 - DNA, 114 bp, Homo sapiens
gtggtgtgtgcctgtagtctcagctgctcgggaggctgaggtaggaggatcacttgagcccgagaggtggaggttgcagtgagcctagatagcacactgcattccagcctgggt

SEQ ID NO: 53311 - DNA, 74 bp, Homo sapiens
gttgttttttgagacagagtctcccactgtcacccaggctggagtgcagtggcgggatctcggctcactgcaac

SEQ ID NO: 53312 - DNA, 100 bp, Homo sapiens
gttacattcctcctgttgtggggctggcgtgcatgcgtgcatgcgtgcgtgcgtgtgtatgtgtgtctgtgtctgtatgtgtggtgggagttggaggggc

SEQ ID NO: 53313 - DNA, 85 bp, Homo sapiens
gcccagggctgtgattctagaggctgagctcttttttattttttaagacaggatctctgtcacccaagctggagtgcagtggtgc

SEQ ID NO: 53314 - DNA, 75 bp, Homo sapiens
gggatcttgggtagtccactttgcattgtggttcacagagcacacaactgtgagtggacagccagaaactgccca

SEQ ID NO: 53315 - DNA, 65 bp, Homo sapiens
tgtatataaatatatatgcatattatatacaacatgtatataaatatatatgcatattatataca

SEQ ID NO: 53316 - DNA, 118 bp, Homo sapiens
gaggttcactgtaatagtctgtgtgtgtgtttgaaaattacaataaaaggtattttttttttcttttttttgagatggtctcgctctgttgcccaggctggagtgcagtggtgcaatc

SEQ ID NO: 53317 - DNA, 100 bp, Homo sapiens
cggatgccggtcagatttttctcttctgggtgtggcaggtggctcacgatgtcctgagtgtgcacaaagtgctggggaggagggctctgtcccatttccg

SEQ ID NO: 53318 - DNA, 58 bp, Homo sapiens
tgagtcagggtctctctctgtcactcaggctggagtgcggtgatgccatcatggctca

SEQ ID NO: 53319 - DNA, 58 bp, Homo sapiens
tgagatggagtctcgctctgtcgctcaggctggagtgcagtggcgtgatctctgctca

SEQ ID NO: 53320 - DNA, 58 bp, Homo sapiens
tgagactgagtctcactctgtcacccaggctggactgcagtggtgtgatcttggctca

SEQ ID NO: 53321 - DNA, 71 bp, Homo sapiens
tgatagtggggctttggtttctttttttttttttttttttttttttgtgagacaagagtctcactctgtca

SEQ ID NO: 53322 - DNA, 83 bp, Homo sapiens
cctcctgagtagcggggaccacacttggtgaattttttttttttttttttttaaacggagtctcgctctgtcacccaggctgg

SEQ ID NO: 53323 - DNA, 58 bp, Homo sapiens
tgagacagggtctcactctgtcacccaggctggagtacagtggtgggatctcagctca

SEQ ID NO: 53324 - DNA, 120 bp, Homo sapiens
ggggaaaagattgagaggtcggatggttgccgtgtctgtgtggaagggagtagacatgggagacttttcattttgttctgcactaagaaaaattcctctgccttgggatcctgttgatct

SEQ ID NO: 53325 - DNA, 82 bp, Homo sapiens
gggagtgagatcctcagaacacacagtggacactgaaaggccccaaagcaggacagtctctatagtgactgggctgcctccc

SEQ ID NO: 53326 - DNA, 79 bp, Homo sapiens
ttgtccccaggccatcgtctgtcttaggtgctccaggcttccctgaaggaagagagaacagaggggcctgaggggatga

SEQ ID NO: 53327 - DNA, 82 bp, Homo sapiens
cagcctggtgacagagcgagacgctgtctcagggggaaaaaaaggaaaaaaaagacaggctctcactctgtcatccagtctg

SEQ ID NO: 53328 - DNA, 86 bp, Homo sapiens
gagtctcactctgtccctctggctgaagtgcagtggtgcgatctcggctcactgcaacctctgcctcccaggttcaagtgattctc

SEQ ID NO: 53329 - DNA, 58 bp, Homo sapiens; identical to SEQ ID NO: 2263

SEQ ID NO: 53330 - DNA, 111 bp, Homo sapiens
gaggcaggagaattgcttgaacccatgaggcagaagttgcagtgagctgacagcgcgcacagtcttggctcactgcaacctctgcctctaaaaaagttttttttagacctc

SEQ ID NO: 53331 - DNA, 71 bp, Homo sapiens
tctcaatttgtcagctgtcttttgactgtgggatattttgtcaatatagcaagagctcttataaattgaga

SEQ ID NO: 53332 - DNA, 56 bp, Homo sapiens
tgagacagtctcactctgtcacccaggctgcagtgcagtggcatgataatgtctca

SEQ ID NO: 53333 - DNA, 90 bp, Homo sapiens
tctgaatttccttaatagtaatgtaccaatgttaacctagttttgacaaatgtaacttggttatgaaatgttaatattagaggaaacaga

SEQ ID NO: 53334 - DNA, 88 bp, Homo sapiens
gatcaaaggaatcttggcttggcttggttgttctttgaggcatgatttttactctcttgaacacttgtcattttcttgattcctgatt

SEQ ID NO: 53335 - DNA, 62 bp, Homo sapiens
tctgctgggagccagttgtcagttgacttctccctgacttgactgtgtgctctgaggccaga

SEQ ID NO: 53336 - DNA, 70 bp, Homo sapiens
cctgggaaacagagtaagaccttgtcttttttttttttttttgagagggagtctcgctctgtcacccagg

SEQ ID NO: 53337 - DNA, 58 bp, Homo sapiens
tgagaccaagtctcgctctgtcacccaggctggagtgcggaggtacgatcttggctca

SEQ ID NO: 53338 - DNA, 77 bp, Homo sapiens
ggcagcactccctccctccctcagacacaacctcattcctcctgaatgaagaggtctagtgaggacagggacatgcc

SEQ ID NO: 53339 - DNA, 88 bp, Homo sapiens
tttaatgaagtctgtctctgtcactgaggctggagtgcagtggcatgatctcagttcactgcaacctctgcctcccaggttcatcaag

SEQ ID NO: 53340 - DNA, 56 bp, Homo sapiens
tgtgtgtgcatgtgtgtgtgtgtatatatatatatatatatatatatgtacacaca

SEQ ID NO: 53341 - DNA, 105 bp, Homo sapiens
gtgctaagcatataccatgttatctcattagtatgtaatagtatgaatagtattaactactaatattggcttattaattggataatataattatctcattagcat

SEQ ID NO: 53342 - DNA, 76 bp, Homo sapiens
aggcagagattttctcacttgtctcagagtcaccgtggacggactctgtctttgcatcaggatatagtttctgttt

SEQ ID NO: 53343 - DNA, 131 bp, Homo sapiens
atatatacatatatgtatagatatatatgtatacatatatgtatacatatatagatatatatgtatacatatatgtatatatatacacacatacatatatagtgtgtatatatatagtgtgtgtatatata

SEQ ID NO: 53344 - DNA, 66 bp, Homo sapiens
tatacatatatatctatacatatatatggatatatatatctatatatgtatacatatatatctata

SEQ ID NO: 53345 - DNA, 116 bp, Homo sapiens
atgtatatgtgtgtctgtctgtctgtctgtctgtctgtgtgtctgtatgtgtgcatgtgcttgttctttcttgtctcatagaaaaacatttagtttccattttgcacacacatcgt

SEQ ID NO: 53346 - DNA, 96 bp, Homo sapiens
gaaggtccacaagccaagcctctttaatgtctcactgtctcttattttggttccttgtagtcctcagtaatgttgctgattcttgggtggatcttt

SEQ ID NO: 53347 - DNA, 84 bp, Homo sapiens
gtttccaggctgtggctatggagggttttttgtttttttttttttttgagacagagtcttgctctgtctcccagactggagtgc

SEQ ID NO: 53348 - DNA, 118 bp, Homo sapiens
agattaagtattttgtaactgctacttcaaaatggtcttgacaaagatttttttttttttttgagacggagtcttgctgcgtagcccaggctggagtgcagtggtacgatctcggctc

SEQ ID NO: 53349 - DNA, 58 bp, Homo sapiens
tgagacagggtctcactctgtcactcaggctggagtgcagtggcttgatcatggctca

SEQ ID NO: 53350 - DNA, 76 bp, Homo sapiens
ggtttttttttttttgagacagtctcactgtcacccaggctggagtgcagtggcatgatcttggctcactacaacc

SEQ ID NO: 53351 - DNA, 197 bp, Homo sapiens
gtatatacgtatatatgtatatatgtatgtatacgtatatatgtatgtatgtatacgtatatatgtatgtatgtatatatgtatatgtatatatgtgtatatgtatatatgtatacatgtatacatgtatatatgtatatatgtatacatgtatatgtatatatgtatatgtatgtatatacatatacacatataca

SEQ ID NO: 53352 - DNA, 113 bp, Homo sapiens
gggaacagcccggcatcttccagcttgtaactaaagatttgagtgaggttttttttttttttagacgaagtctcgctcttgtgccccaggctggagtgcgatggcatgatctc

SEQ ID NO: 53353 - DNA, 78 bp, Homo sapiens
ttgtttttgttttttgagatggaatctcactctgtcactcaggccggagtgcaatgatgtgatctcagctcactacaa

SEQ ID NO: 53354 - DNA, 71 bp, Homo sapiens
cagcacagtggttatgagtcaaacatgttgagctccatttctccatttctgactctctcacttacttgctg

SEQ ID NO: 53355 - DNA, 80 bp, Homo sapiens
aggtttctggccatcatggggctcctagggcaaaggggaaattcttccccctcactgggtccctgtctgtgatctcgcct

SEQ ID NO: 53356 - DNA, 60 bp, Homo sapiens
agagcagaaggaagagagaggaggaagtgctacactttctttctttttctttctttcttt

SEQ ID NO: 53357 - DNA, 69 bp, Homo sapiens
ctgtgcacagggtggcttttttattttttatttttattttttgagatggagtctcactctgttgctcag

SEQ ID NO: 53358 - DNA, 57 bp, Homo sapiens
tgaggcggagtctcactctgtcgctgggctggagtgcaatggtgagatctccgctca

SEQ ID NO: 53359 - DNA, 79 bp, Homo sapiens
tcaaactgaggaatgacattggtggcattctttttttttttttttttgagatggagtctcgctctgtcacccaggctgg

SEQ ID NO: 53360 - DNA, 80 bp, Homo sapiens
gtgatggttctgtctgtctctcagcccaaatctgcttttcattcctgcccacagttgttgagcatagatggaagcactgc

SEQ ID NO: 53361 - DNA, 75 bp, Homo sapiens
tctggctctgtttctcactgtgtctgggtggaaatctgcccatttcctggataacaagggagagtcagaaacaga

SEQ ID NO: 53362 - DNA, 59 bp, Homo sapiens
gtctgtatgactttgggcaaggctgtctgtacctcagtgtctttgtctgtcaaatgggc

SEQ ID NO: 53363 - DNA, 110 bp, Homo sapiens
tgtccaactttggtgatggaaatttgcacagtctttcagctcagtctctcactgtttggggaacaatatgcctggctcgtaaagaagtgcaaactatggtaagactgaca

SEQ ID NO: 53364 - DNA, 69 bp, Homo sapiens
aatctgtctttgactctgtggatctggccaaagtcagcaatgtcccctcactgtcaagtctaacagatt

SEQ ID NO: 53365 - DNA, 80 bp, Homo sapiens
ctggccagtttgttggatggtatggatattttaaatttttaacaaataatgaatctgcctctctctatcagtctggctag

SEQ ID NO: 53366 - DNA, 88 bp, Homo sapiens
tcagggcacttctgcatccaaatggcttgtgtctgtagctgttacttgacagtcagcagtctgaggctaggattcttttacccactga

SEQ ID NO: 53367 - DNA, 130 bp, Homo sapiens
caccagggcaccatctgcacagaggcaacgtgaacagtgtcccttggagttgagtgacacggcagtgttgagactaggtgctgatgtggtcagaattgtgggttttgtttgtttgtgtttttgagacaga

SEQ ID NO: 53368 - DNA, 88 bp, Homo sapiens
ccactgcactccagcctgggtgacacagtgagactctgactcaaaaaaaaagagtagagcctcagtggagagccaggggagacaatgg

SEQ ID NO: 53369 - DNA, 63 bp, Homo sapiens
cctggctctccactgaggctctactctttttttttgagtcagagtctcactgtgtcacccagg

SEQ ID NO: 53370 - DNA, 90 bp, Homo sapiens
gcttgggacctccaagacaattgtttttgttgcactgcctccattttgcagatgagacagatgagatggggagagggtcttggatcaggt

SEQ ID NO: 53371 - DNA, 126 bp, Homo sapiens
tctatgaatatatatatacacacatatgcaggcataactgtgcatcatcgtgtgtgtgtgtgtgtgtgtgtggacacacatagactagccgactgaaagaaagctatgtgagatgtatacacacac

SEQ ID NO: 53372 - DNA, 106 bp, Homo sapiens
acacgatgatgcacagttatgcctgcatatgtgtgtatatatatattcatagacatatgcacacacatatgtatcacaggtgtatactgccagccctctgtatctc

SEQ ID NO: 53373 - DNA, 56 bp, Homo sapiens
gagtcagggtctcactctgtcacccaggctggagtgcggtggtgtgatcagagctc

SEQ ID NO: 53374 - DNA, 89 bp, Homo sapiens
gagaaatgctgtagtcaactgtgagctgcaggggagcatgtctgtgactctctctttgtattcacaaccccttgccttgtgtatttttt

SEQ ID NO: 53375 - DNA, 117 bp, Homo sapiens
cattgagggttccaatatctgcaaattcttaatcactgtttgttatatatcttttttatttttgccattctagtgggtaagtggcttattgtggttttgatatgcatttccctaatg

SEQ ID NO: 53376 - DNA, 102 bp, Homo sapiens
tcttggctagatgggctcttttttggttccatatgaaatttaaagtagttttttctaattctttgaagaaagtcaatggtagcttgatgggaatagcattga

SEQ ID NO: 53377 - DNA, 66 bp, Homo sapiens
cacttaccatgaatggagcctgtagaactggaagtttctttctctgggtgagtcagtgagtgagtg

SEQ ID NO: 53378 - DNA, 73 bp, Homo sapiens
ttaggtagtaattagcatgcttgtagccccacctactagggaggctgaggtaggaggatcgcttgaaccctgg

SEQ ID NO: 53379 - DNA, 98 bp, Homo sapiens
ggaactgaaatgcctctttttgactctgtctcacagtggtttacttgtgtcttttactcgatggtgcaggtaactgttatgggttgaattctgtctcc

SEQ ID NO: 53380 - DNA, 68 bp, Homo sapiens
gtcaggattgatgggtagtgggaaaaagccacagtgggcttcgttccctctctctgtcaccatctgat

SEQ ID NO: 53381 - DNA, 96 bp, Homo sapiens
ggatacgaacaggatatatacacacacacatatatagtatacatatatgtgtttatatatacatgtgtgtatgtatatatatcctgtcctgtctcc

SEQ ID NO: 53382 - DNA, 83 bp, Homo sapiens
gaagggcacatatgtgaggctggagatgtgaaaatttattttcttagaagtatccacatctgcatactccatgaaaagtcttc

SEQ ID NO: 53383 - DNA, 83 bp, Homo sapiens
aggctctgtgacactgtctctttgtggggtttccttcacttgctcagccaacgttgatcaagctcctactgtgtgcaggtcct

SEQ ID NO: 53384 - DNA, 87 bp, Homo sapiens
gtgtctctggctctgtctgtctgttggttccttgctgcatgcctgcctgagcatgctcatcccaggagtcagaaggcagtaggatac

SEQ ID NO: 53385 - DNA, 92 bp, Homo sapiens
ttccttcccagtggtcacagcctggttcctttcgtctttttttttttttttttttttttgagatggagccttgctctgcctccaggctggag

SEQ ID NO: 53386 - DNA, 86 bp, Homo sapiens
tgcttttatttatgtatgtatgtacgtacgtacgtacgtacgtacgtacgtatgtatgtatgtatgtatgtatttatggcatatat

SEQ ID NO: 53387 - DNA, 183 bp, Homo sapiens
gagagcaagggtatatagtatataaattaatctgtaaatatacgttttataaatgtatatctatatgttcatatatacatatataaaccctctctctccatatacctacatatatatgtatgtatatattcaatggaaaaggatgaaataaatatgtgtatatatatatatgtattctattgg

SEQ ID NO: 53388 - DNA, 81 bp, Homo sapiens
tttctctgggcatggtggtacatgcttgtggtcttagctacactggaggctgaggtaggaggatcacttgagcccaggaga

SEQ ID NO: 53389 - DNA, 58 bp, Homo sapiens; identical to SEQ ID NO: 17746

SEQ ID NO: 53390 - DNA, 66 bp, Homo sapiens
ctaattgtgtatatgtatatatatactatatattgtgtgtgtatatatatgtgtatatatatagag

SEQ ID NO: 53391 - DNA, 70 bp, Homo sapiens
gtgtgtatgtatgcatgtatgtatgtatatatttgtatgtatatatgtatgcatgtgtttgcatatatat

SEQ ID NO: 53392 - DNA, 130 bp, Homo sapiens
atggataaagaaattgtgtggtgtaggtatgtatgcgtatacatatatatatatatatatatacacacagacacacacacatatacatatatacacatatacataatatacatacatacatacatataca

SEQ ID NO: 53393 - DNA, 65 bp, Homo sapiens
ttgaggtggagtctcgctctgtcaccctggctggagtgcagtggtgcgatctctgctcacttcaa

SEQ ID NO: 53394 - DNA, 76 bp, Homo sapiens
atacacatgtatgtatatgtatgtgtatatacatgtatgtatgtgtatgtacacatgtatgtatatgtgtgtgtat

SEQ ID NO: 53395 - DNA, 76 bp, Homo sapiens
tgtgtttggggcggggagtggggcagaggtaaggtggctgtctgtctgtctgtcttagtagaaagaatcaaacaga

SEQ ID NO: 53396 - DNA, 95 bp, Homo sapiens; identical to SEQ ID NO: 68

SEQ ID NO: 53397 - DNA, 93 bp, Homo sapiens; identical to SEQ ID NO: 69

SEQ ID NO: 53398 - DNA, 95 bp, Homo sapiens; identical to SEQ ID NO: 68

SEQ ID NO: 53399 - DNA, 93 bp, Homo sapiens; identical to SEQ ID NO: 69

SEQ ID NO: 53400 - DNA, 93 bp, Homo sapiens
ccggactaggggagacaaagatgaatctcacatatttacctatttggcaaatattcactgatcactgctctttgtttatcccatggtcatagg

SEQ ID NO: 53401 - DNA, 74 bp, Homo sapiens
catatattcatatatattcttataaacatatatgtataagcatatatgtatgtaagtatatatacacataggtg

SEQ ID NO: 53402 - DNA, 103 bp, Homo sapiens
agtgaataagtgtcatgagatctgatggttttacaaagaggagtttccctgcacaagctctcttctctttgactgtggccatccatttaagacatgatttgct

SEQ ID NO: 53403 - DNA, 87 bp, Homo sapiens
ggactcatttcttgctttgtaggggctgctgccagacagggtgaggaggcacccaagactgacagcttctgcttatggatttcagcc

SEQ ID NO: 53404 - DNA, 81 bp, Homo sapiens
gagcatgaggcatgtgacattccagtttcttcaaatggtctcttcccaggactctgtgactgactgggtgggcttgggttc

SEQ ID NO: 53405 - DNA, 115 bp, Homo sapiens
gttattgatttttgtatgttgacactgtgtcctgcaactttactgaatttgtttatgagttccaacaattttttagtggagtctgtagggttttctatatacaagattatgttgc

SEQ ID NO: 53406 - DNA, 71 bp, Homo sapiens
ttgtttttgagatagagtctcactctgtcacccaggctggagtgcagtgttgtgatctcggctcaccgcaa

SEQ ID NO: 53407 - DNA, 70 bp, Homo sapiens
attgtcttctcttctgtgtgtctgtctgaaatctttagatttggggcccaccaggataatccaggataat

SEQ ID NO: 53408 - DNA, 96 bp, Homo sapiens
ggtcactggcacaaatccaggaccccagttcagaggcagcagagtggtacaagcagccctgtcctgaatgtctagagtcctgggttggaggggact

SEQ ID NO: 53409 - DNA, 96 bp, Homo sapiens
gtatatgtgtatatatacacatacatatggatatatatacatatatgtagatatatatacatatatacacatatgtaggtatatatacatatatac

SEQ ID NO: 53410 - DNA, 130 bp, Homo sapiens
gtatatacgtacatatgtgtgtatatatacgtatatatgtacatgtatatatgtgtatatatacatatatgtatgtatatatgtggtgtatatatatacacatatatatatacacacacacacacataca

SEQ ID NO: 53411 - DNA, 89 bp, Homo sapiens
tgtatgtgtgtgtgtgtgtatatatatatgtgtatatatatacaccacatatatacatacatatatgtatatatacacatatatacatg

SEQ ID NO: 53412 - DNA, 122 bp, Homo sapiens
gagaagctgaaggtctgtttgaggaagttcttgactttacctggagctgagtcaagttagagagctgagctgagcgaaatacaggggtagaggaagcagcagggaggccctgggagctcagt

SEQ ID NO: 53413 - DNA, 70 bp, Homo sapiens
ggggcaggggcagggacctcagggatgacttgatccaggtaccaagcatctctgagcctctctctgtgtc

SEQ ID NO: 53414 - DNA, 114 bp, Homo sapiens
tttgtggtttttttgagataaacagatgtgtgtgtgtatatatatataatatattattttatatatattatatatacacacacacatactgataaacagatatagatctacaga

SEQ ID NO: 53415 - DNA, 58 bp, Homo sapiens
tgagacggagtctcgctctgtctcccaggctggagtgcagtggtgcaatctctgctca

SEQ ID NO: 53416 - DNA, 80 bp, Homo sapiens
cagtgcctgccaggagtcagacagacgtgagcttggatcccaactgtctctgatgactgtgtgctctgggcaagtgaatg

SEQ ID NO: 53417 - DNA, 118 bp, Homo sapiens
tgttgatgttgagacccacagtttgaaaagctctgcctggccgtgtgtgggggcctgtctcagtctgtctccataactcgtgtcttttctgtcttgtaggtttgaacggttccgaaca

SEQ ID NO: 53418 - DNA, 81 bp, Homo sapiens
gagcctgcccctctctgtgcctcagtttccccctctgatcagactatgtaagattctggcatacagtgggtcattaggctc

SEQ ID NO: 53419 - DNA, 101 bp, Homo sapiens
ggccatgtgtgggcaggggtggcgaggagctaagcttaggaagggcagatagttcttttttttttttttttgagccggagtctcgctctgtctctcaggct

SEQ ID NO: 53420 - DNA, 108 bp, Homo sapiens
cgcgccctccagtggccctggcgctgccgtccctccgccatcagcgtgactctctctcacccagatgggaggcggctgcgggaaaagcctcagtgactggatggtgag

SEQ ID NO: 53421 - DNA, 58 bp, Homo sapiens
tgagccagagtctcgctctgtcacccaggctggagtgcagtggcgcaatcttggctca

SEQ ID NO: 53422 - DNA, 134 bp, Homo sapiens
ctggtctgtttgagaatacagaaggtgagcttttcttttctttttttttttttttgagatggagtctcactctgtcacccaggctggagtgcagtggcgtgatcttggttcactgcaagctccacctcccaggt

SEQ ID NO: 53423 - DNA, 58 bp, Homo sapiens
tgagacagagtctcactctttcacccaggctggagtgcagtggtgggatcttggctca

SEQ ID NO: 53424 - DNA, 82 bp, Homo sapiens
gcataggacagcatggtgtcagtgtgcagacctggccatgggaccacacactctgacagtcggcgctgggctgacctttagc

SEQ ID NO: 53425 - DNA, 85 bp, Homo sapiens
gggctaggggagctctgagtctctgaccttggacatggcctggccccatgtcgacccagtctgacccactcactcactcttactc

SEQ ID NO: 53426 - DNA, 72 bp, Homo sapiens
ctgggcgtggtggtgtgtgcctgtagtcccagctacgcgggaggctgaggtaggaggatcacttgggcccag

SEQ ID NO: 53427 - DNA, 78 bp, Homo sapiens
gagacagggtctcactctgtcacccaagctggagtgcagtggtgtgatctcggctcgctgcaacttctgccttctggg

SEQ ID NO: 53428 - DNA, 111 bp, Homo sapiens
tccaacccaggatgccagacatcttcatttttaatccagggtagaaagaaagagacatcccctctctcgctctctcagatctctcatgaaagatgaatccttggggctggg

SEQ ID NO: 53429 - DNA, 84 bp, Homo sapiens
ggggctttatttacataacacagccagctttttgctagccagaccaaactcaaagagcaatggctgtacttctgaaatagcaac

SEQ ID NO: 53430 - DNA, 80 bp, Homo sapiens
gcatagtgtgagactctgtctctggaaaaaaaaaaaaaaagtttttggagaccagagctttatcttgcagacgaagtctc

SEQ ID NO: 53431 - DNA, 92 bp, Homo sapiens
tgcccatgcagcccttgggcagtggaagccttagaaagtcttctacctgaatgactgcctgactgcctgcctgcctccctgcgtggacagca

SEQ ID NO: 53432 - DNA, 117 bp, Homo sapiens
taagaataaagtatgtgtgaaatatttaaatatctgaccattggtaaaggaaaaagtgtgattttttttcttttgttttttgaagcctgggtaagtcattagattatacatttctta

SEQ ID NO: 53433 - DNA, 120 bp, Homo sapiens
gtgtgtgtgtgtgtgtgtgtgtatacatatataattatatcattataatatgtgtgtatatgtatgtgtgtgtgtgtatatatatatatagatggatagagatataccgatatatatatg

SEQ ID NO: 53434 - DNA, 112 bp, Homo sapiens
tgtcccagggcacatgctttctactttgctttttgtgttttttttggagacaggatctctctctgtccctcaggctggagtgcagtggcggagcctcgaactcctgggctca

SEQ ID NO: 53435 - DNA, 122 bp, Homo sapiens
ctgcaacagcaggattgatatttaaacctaaagccaaggagggtgtgtgcatatgtgtgtgtgtctgtgtctgttgggggggcaggggtgtctgtctgtctgtctgcagagaaattgccaca

SEQ ID NO: 53436 - DNA, 107 bp, Homo sapiens
cagtcagtgcttgctgtgattattgtcggtaataattatatatttctttgaattacagaattctgaggtagaatgtgcctggagatagtatagctcagtagtccctg

SEQ ID NO: 53437 - DNA, 90 bp, Homo sapiens
tcttgtgcttctttcgggctgggtttgttcatgtgccacaaaaagctatttttgatacagaaagaccatctggatttgaaggactctaga

SEQ ID NO: 53438 - DNA, 100 bp, Homo sapiens
gggaggcccttcagctttcttggtgttttgaagatagattgtatattttactttaaggtaggacaatacttaactatttcagacaggtatgaatctttcc

SEQ ID NO: 53439 - DNA, 113 bp, Homo sapiens
gtgtgtatatatatgtatatatatgtacgtgtgtatatatatgtgtgtatatatatacacacacatatacaggtacacatgtatatatatatacatatatatacacacacaca

SEQ ID NO: 53440 - DNA, 107 bp, Homo sapiens
atatatgtgtgtgtgtgtgtgtgtgtatatatatgtatatatatgtacgtgtgtgtatatatgtatatatatgtacgtgtgtatatatatgtatatatgtacgtgtg

SEQ ID NO: 53441 - DNA, 76 bp, Homo sapiens
taatctagatgttgcttgaaggcattttgtagatgtgatttgtctataattagtttacttcaagtaagggagatta

SEQ ID NO: 53442 - DNA, 86 bp, Homo sapiens
gtgagccactgcacctggcctccttttttttttttttttttttaaaaaaagcacagagattgattgggatggtgtaggaggcttgc

SEQ ID NO: 53443 - DNA, 95 bp, Homo sapiens; identical to SEQ ID NO: 68

SEQ ID NO: 53444 - DNA, 93 bp, Homo sapiens; identical to SEQ ID NO: 69

SEQ ID NO: 53445 - DNA, 87 bp, Homo sapiens
gaagcaccttaaactctatatagaggggctgacttcacttcacagaaattagcccactgtccctctgagagtgtctaactgtgcttc

SEQ ID NO: 53446 - DNA, 60 bp, Homo sapiens
ggatgagggtgtttgcagactggatgagggtatttgctgtctggctgtctctctctgtcc

SEQ ID NO: 53447 - DNA, 84 bp, Homo sapiens
ggcagcattcacagcaggaggtggtggtggccacaaagcctcatctcatgtgagggatgccagtttcacacacacacacactct

SEQ ID NO: 53448 - DNA, 58 bp, Homo sapiens; identical to SEQ ID NO: 2442

SEQ ID NO: 53449 - DNA, 117 bp, Homo sapiens
ctcctgcaggcactggggaaaagtcggagggtttattttatttaattaacttatttattaatcaattaattttttgagatggagtctcactctgtcacccaagctggagtgcagtgg

SEQ ID NO: 53450 - DNA, 102 bp, Homo sapiens
tttcaaaacagatttgatttccagggttgcctgctgtcagtccagccttctttccattatattacagctgggcagcagcccgcaaagatcaggggtttgaga

SEQ ID NO: 53451 - DNA, 56 bp, Homo sapiens
gcagacagactctgtgactgcctcatcggagagcagcacaacatccctggtcctgc

SEQ ID NO: 53452 - DNA, 113 bp, Homo sapiens
ggtgtttgagaggaaggccatggggccagggagctctgccactcactcactgagaccaaccctgggcaagtgactggatctcatggggcctcgcttttctcatctgtaagact

SEQ ID NO: 53453 - DNA, 173 bp, Homo sapiens
tacgtatgcgtatgtgtacatatgtttgtgtgggctcatgtgcatgtacatgtgtgcatgtatgtgtgcatgtgtatgtgtgcgtacatatgtgtatgtgtgcatgtgcttgtgtaggcagtgtgtgcttaggtgtatgcacgtgtgagcagtgtatgcatgtatatgtgtgc

SEQ ID NO: 53454 - DNA, 68 bp, Homo sapiens
ggctggggaaggtttggacagggcaggaagggtcatcccgcaccctctgtctgcctcacaccttagcc

SEQ ID NO: 53455 - DNA, 82 bp, Homo sapiens
gtattcaggtggaagctgtcaacccaggttgggtcagttggacaggtgactctgcctgtcagtgccagtcacacttctttac

SEQ ID NO: 53456 - DNA, 84 bp, Homo sapiens
gaggagcagggcctgggaagagcgtgaggttggaatcctgggcgagttacccagcctctctgagcctcagtctcttcatctgtc

SEQ ID NO: 53457 - DNA, 84 bp, Homo sapiens
ccttgacagaggtgtgtgtccgtgtgtgcctgcatctgcgcggtgtgtctgtgtgtggtatgtgtggtgtgtgtctgtgtgtgg

SEQ ID NO: 53458 - DNA, 58 bp, Homo sapiens
tgagactgggtctcactctgtcacccaggctggagtacagtggtgtgatctcagctca

SEQ ID NO: 53459 - DNA, 58 bp, Homo sapiens
tgagacagactctcactctgtcacccaggctggagtgcagtggtgtgattttggctca

SEQ ID NO: 53460 - DNA, 67 bp, Homo sapiens
gggacacagagccaaactgtatctttttttttttttttttttgagatggagtctcactctgtcaccc

SEQ ID NO: 53461 - DNA, 97 bp, Homo sapiens
acacctgctcctcggagaccagctggtccaccacattgctcccaaacttgtggcgaatgttgttaggaatgatgctgcccttctggttcgtgggcgt

SEQ ID NO: 53462 - DNA, 77 bp, Homo sapiens
tgtttccctcactctacagtgtgagctccctgaggacaggccctgtccccactctgccatattgcaggtgtcaaaca

SEQ ID NO: 53463 - DNA, 103 bp, Homo sapiens
ccggaggctggggtgacaggaatgcagtgttgacaggcatggggagagctctgtctctctttctctggctgatccagtatctcaaattctgcctggtgagggc

SEQ ID NO: 53464 - DNA, 59 bp, Homo sapiens
ggtctccctctgtgggtcacagcaatgcctgtttgttgagtgactgacagactttagcc

SEQ ID NO: 53465 - DNA, 111 bp, Homo sapiens
ctggtgcctagatcgaacacacagtcggtgcacagtcactgttttgaatgaatgaatgaatgaatgaatgatgcaggtggtactgctttgtaagttctagcagtgcatcag

SEQ ID NO: 53466 - DNA, 107 bp, Homo sapiens
cggggccctgtccagaacactgctctcaggactggggatgcccgtgtgcacatgtcagctgtctctgtgtctgggtccccgccggtccatctaggtctgtcattcgc

SEQ ID NO: 53467 - DNA, 69 bp, Homo sapiens
cagggtcataaacacagtaagaggtggagctagggctccaggctcactctctcatgctgtcccaccctg

SEQ ID NO: 53468 - DNA, 58 bp, Homo sapiens
tccaatctcactctcactgaccatggaggaaaccagggtgcagtgggtgtttcctgga

SEQ ID NO: 53469 - DNA, 88 bp, Homo sapiens
ggagaattgtttgaatccaggaggcagagactacagtgagcccagatcgtgccattgcactccagcctgggagacagagcgagactct

SEQ ID NO: 53470 - DNA, 100 bp, Homo sapiens
gctggggagagagaaacagaaccgcagctgaagcatttgtcagtgggtctgtctgcctctcgcccggcttacagctcagcccccaccactggctcccttc

SEQ ID NO: 53471 - DNA, 68 bp, Homo sapiens
gggcagccaccagccccagccaggacggagcagctccttctgcctgcctgtctgcctgtttgcggcct

SEQ ID NO: 53472 - DNA, 139 bp, Homo sapiens
gtgtgcgtgtgtgtgtggacatggggtggaccctgctctctgtctgtacacacacaagcgcacacacgcacactgtcagtggcctggcaggatttcctcggaatgtttggagggaagggagctgatgtgtgtgtgtgtg

SEQ ID NO: 53473 - DNA, 81 bp, Homo sapiens
gtcaccaagctggagtgcagtgacgcgatctcagctcactgaagagctgagatctctctctgcctcccgggttcaagtgat

SEQ ID NO: 53474 - DNA, 69 bp, Homo sapiens
gccatctcctgatgcttggtgttagacgtgtgtgtgcgcagggcacacgtctgtgagtgtctgtgtggc

SEQ ID NO: 53475 - DNA, 58 bp, Homo sapiens
cagtgagtagactgggggtgtggacagatctctgtcactccctctctgctggccactg

SEQ ID NO: 53476 - DNA, 80 bp, Homo sapiens
aggcagctctcaccattggctccctttcccacaccagcgtgtgggccccaggctccctgtgtgagtgagtgcatatgcct

SEQ ID NO: 53477 - DNA, 77 bp, Homo sapiens
ccggccttgagtgccatgccaaggattttttttttttttttttttgagatggagtctcgctctgtcacccaggctgg

SEQ ID NO: 53478 - DNA, 60 bp, Homo sapiens
cccaggagacggagtctcactctgtcacccaggagacggagtctcactctgtcacccagg

SEQ ID NO: 53479 - DNA, 56 bp, Homo sapiens
gagacagagtctcgctctgtcactaagactgtagtgcagtggtgcgatctcggctc

SEQ ID NO: 53480 - DNA, 80 bp, Homo sapiens
gggtgccaggaggaaggcggggcgctcctggggaggcaggtgctgtggctggctccctgggtgcccacctcctgctgccc

SEQ ID NO: 53481 - DNA, 58 bp, Homo sapiens
tgagactgagtctcgctctgtcacccaggctggagtgcactggcgtgatctcggctca

SEQ ID NO: 53482 - DNA, 112 bp, Homo sapiens
ctcatgtggtgacctcctccatctctagcgcagtctctctctctcatgcacacaaggtagtcagggaacacacagaacaagctgcgggatgtcaaaaggggcggtcagtggg

SEQ ID NO: 53483 - DNA, 68 bp, Homo sapiens
caagggatgggagacggggtaaggagggctgcggccaagaactgtgggtctctcagtttctgaccttg

SEQ ID NO: 53484 - DNA, 140 bp, Homo sapiens
ggtaggtgtgtgtgcacacgtgtgtatgcctgtgtgtgcatgtgtatgtgtgtacaagtgcctctgtgtgtgtgtgtgtggttctatgcaatttcatcatgagtagattcaagtagccaccatcacaattaagatacaga

SEQ ID NO: 53485 - DNA, 91 bp, Homo sapiens
ctttcccactctgtcatactgcttcctatagcatgcaggtcactgtgtgactcactgacagtgtggtaaggaggtggagggtggctgtgtg

SEQ ID NO: 53486 - DNA, 89 bp, Homo sapiens
ccaagcccctctttcaccctctctggctgagtgacctgcacaagtcctgttagctctctctagaatgatgatacctgggccgggcatgg

SEQ ID NO: 53487 - DNA, 67 bp, Homo sapiens
ctggtgtgagccaccgcgcccggccttgttttgttttaagacagggtctcactgtcgctcaggctgg

SEQ ID NO: 53488 - DNA, 57 bp, Homo sapiens
gatttggagtctcactctgtcacccaggccggagtgcagtggtgtgatcttcaactc

SEQ ID NO: 53489 - DNA, 80 bp, Homo sapiens
agggctgccggcccctcctctctcactgacactccccagagctgtggggtctgtgggaggcgagcagggtctgggtctct

SEQ ID NO: 53490 - DNA, 107 bp, Homo sapiens
agcaagcacaacttgaattgacttgtaactatattctttcagaactgaagctattattctatatcatagtttattttgatcaagtataacctttagtttgtgctgtt

SEQ ID NO: 53491 - DNA, 96 bp, Homo sapiens
gacagagtgactgttttagctgaattgtttagttaaataatagttatcctatgtattattttagtttagtttagtttttgagacagggtctctgtt

SEQ ID NO: 53492 - DNA, 100 bp, Homo sapiens
gatttttgtatgttgattttgtatcctgcaactttactgaatttgtttatcagttctaatagctttttggtggagtctgggtttttccaaacataagatc

SEQ ID NO: 53493 - DNA, 129 bp, Homo sapiens
atatgtgtatatatatgtgtatatgtatatatgtgtgtatatatgtatatgtatatgtgtatatatgtatatgtatacacatatatgtatatatgtgtatataacgtgtgtatatatgtgtacatgtat

SEQ ID NO: 53494 - DNA, 97 bp, Homo sapiens
gggcaacaagagcgaaactctgtctcaaaaaaaaattttttttaattaattttaactaaattaaattttttagaggcagactctcagtctgttgtcc

SEQ ID NO: 53495 - DNA, 108 bp, Homo sapiens
atggggtgctcgtggtcttttcccttctgactatcaacacattcttgccgtgctgctgcagactggcatagttctggagaaagtacacaatcagagggctcttcccat

SEQ ID NO: 53496 - DNA, 95 bp, Homo sapiens
acagagtgagactctgcctcaaaaaaacaaacaaacaaaaaaaaaactttccctttccattttattatttattttgagacagagtctcactctgt

SEQ ID NO: 53497 - DNA, 60 bp, Homo sapiens
tgagactgagtctctcgctctcttgtccaggctggattgcagtggcatgatctcggctca

SEQ ID NO: 53498 - DNA, 113 bp, Homo sapiens
ttgaatccactttttgttgttgttgtttatgagacacagtctcgctctgtcacccaggctagagtgcagtagctcgatcatggctcactgcagccacaacctcccaggctcaa

SEQ ID NO: 53499 - DNA, 91 bp, Homo sapiens
cctggaccgcagccacatgcaggcggtgaatgcgtagagctcgggcagagccttccgcacgcgggcgtacatgtagttgttacggatgggg

SEQ ID NO: 53500 - DNA, 108 bp, Homo sapiens
ccagcaaaacaggaagagcaggaagagaacaagtttgcacagagctgagagatgaaagacatcacgccagagctttgcatctcttctcatctgcttcgcattcactgg

SEQ ID NO: 53501 - DNA, 78 bp, Homo sapiens
gggctgaatggcgggattaggaagtgataccagtctttgaaagtctccctcactgagtcacttgatcctcattcactc

SEQ ID NO: 53502 - DNA, 117 bp, Homo sapiens
agcctgaggccatgtttgtcatcagatgaagtggtttacagatgtgaaattgttgtttgtagtctaacatttctggtttgtaaacccatccgtgatgggctcccagcccaacccgct

SEQ ID NO: 53503 - DNA, 58 bp, Homo sapiens
tgatacagagtctcgctctgtcagccaggctggagtgcaatggtgagatcctggctca

SEQ ID NO: 53504 - DNA, 76 bp, Homo sapiens
ccccctattgagtgactcaccctctctgtgccttggcttggagctcattaaggcaggtaaagtattcaatggatgg

SEQ ID NO: 53505 - DNA, 120 bp, Homo sapiens
gggggcttgggtcaagcttgggtggggtgtgcaggggtccccgttctgtgtgtctgtctcccaggcgagtcctgccctgactcccacagcccctccctccagaccatggcttccccacct

SEQ ID NO: 53506 - DNA, 58 bp, Homo sapiens; identical to SEQ ID NO: 11865

SEQ ID NO: 53507 - DNA, 66 bp, Homo sapiens
gatggacagagaattcactgaggtgacgggaacaggaaactgcgggtgtctctgggtgaggccatc

SEQ ID NO: 53508 - DNA, 66 bp, Homo sapiens
ctctggcactgtgtggctgagatcggagggagggcagctccgcgaggtctctgctgtggtccagag

SEQ ID NO: 53509 - DNA, 58 bp, Homo sapiens; identical to SEQ ID NO: 2381

SEQ ID NO: 53510 - DNA, 57 bp, Homo sapiens
gagacaagagtctcactctctggcccaggctggagtgcagtggtgcaatcttggctc

SEQ ID NO: 53511 - DNA, 76 bp, Homo sapiens
gagcgaccccatcagtctctctcacactcttatcccaagttcttggagttaagggaagaagatggcgatggagttc

SEQ ID NO: 53512 - DNA, 85 bp, Homo sapiens
gctacccttgtccttggtgccatgaggaacctcagaaaggactcagtcctgagcactcccaggctcccactctgacacatgtagt

SEQ ID NO: 53513 - DNA, 95 bp, Homo sapiens
cctaactcactgcctgcgtgcctgaagtctctctcacaaactcattccgaggtaggaggtcggacttgactccagaggcacagctcagacactgg

SEQ ID NO: 53514 - DNA, 93 bp, Homo sapiens
ggtggggagggggacagatgagatcagggtaggccacaaagggcttggtgcttctggggtctctgtttctatgtgtctctgaatccagtagcc

SEQ ID NO: 53515 - DNA, 58 bp, Homo sapiens
tgagactgagtctcactctgtcatccaggctggagtgcagtggtgtgatctcagctca

SEQ ID NO: 53516 - DNA, 92 bp, Homo sapiens
ctccgacttataagctagcctcagtcactctctctggcactgggacctccaagtaccagggagagtaactgagactggcttttaagtcggag

SEQ ID NO: 53517 - DNA, 75 bp, Homo sapiens
tcaccatgtctctctctctctctcgggtggcagggctgacaccaaagctccaggagtgttcaggggccatggtgg

SEQ ID NO: 53518 - DNA, 134 bp, Homo sapiens
ggagcttctgctactggttccttccctggggtatggcagagggagtcggcatctcaggagtcagaagacagtgagcacctccccggactctgaaactaaatgcagcttgaggtttcaggatcccacatggggag

SEQ ID NO: 53519 - DNA, 77 bp, Homo sapiens
acttgagtgtcactgcaagggctttttcttttttcttttttttttttgagatgggagtcttactctgtcactcaggt

SEQ ID NO: 53520 - DNA, 63 bp, Homo sapiens
gctctgtgtgcctgtgagcagggttccttcacagagagagccacacacagtgtcacacaaggc

SEQ ID NO: 53521 - DNA, 71 bp, Homo sapiens
ctgtcacagaacaaacagagctgtgacttccgtttcccagggtacgtggctgtttcatgttctcctgacag

SEQ ID NO: 53522 - DNA, 70 bp, Homo sapiens
gttccctttgagtctcaggctccctgtctgtaaaatggtgataatacagggcttgagattgagaggagat

SEQ ID NO: 53523 - DNA, 80 bp, Homo sapiens
atatatatatatatgtctgtctatgtgtgtgtgtatacacatatatatatatatatatatatatatgcatatatatatat

SEQ ID NO: 53524 - DNA, 76 bp, Homo sapiens
gtggcactgggtctggctgttctctctgtatttctgtgaaatactgaccccgacctgagctgggcccgcgggaagc

SEQ ID NO: 53525 - DNA, 75 bp, Homo sapiens
ggctcccagaactgggagaccatcagcttctggtattttaagtcacccagtctgtggctccctgttagggcagcc

SEQ ID NO: 53526 - DNA, 68 bp, Homo sapiens
tgttttgagacagagtctcgctctgtcacccaggttggagtacagtggcgcgatctcggctcaccgca

SEQ ID NO: 53527 - DNA, 95 bp, Homo sapiens; identical to SEQ ID NO: 68

SEQ ID NO: 53528 - DNA, 93 bp, Homo sapiens; identical to SEQ ID NO: 69

SEQ ID NO: 53529 - DNA, 73 bp, Homo sapiens
gatcccataactgctacactttaacattacatgtaaaagtatatgtgtgaggagagtgaacagagtggagatt

SEQ ID NO: 53530 - DNA, 85 bp, Homo sapiens
agattagagctctccccagcaaaataggaagtgatagcaatttaggacctgtctccttctctcactgggtcctgagcctgaatct

SEQ ID NO: 53531 - DNA, 92 bp, Homo sapiens
ctgcctgtagtcccagctactccagacgcagaggtagtaggatcactcgagctcaggagtttgagactgcagtgagctatgattgtgccacc

SEQ ID NO: 53532 - DNA, 78 bp, Homo sapiens
ccccggagtggacttacagcaagaccatgtgtagactgggaaactcttggttcttatttgcaaagccagagtaagggg

SEQ ID NO: 53533 - DNA, 80 bp, Homo sapiens
tctggtggatttatgcttgctgaaatcatttcgtaaaaatatatatttttttgagatggagtctcgctctgtcacccagg

SEQ ID NO: 53534 - DNA, 92 bp, Homo sapiens
tgcaaaccactaagcaaggttctttttttatttattgaactggtgctaggtaagtacttataatctagaatctcttgtttttcaggtttggg

SEQ ID NO: 53535 - DNA, 68 bp, Homo sapiens
tatacacacatatatgtacatatatagatatatacacctatatatgtatgtttatatatgtatgtata

SEQ ID NO: 53536 - DNA, 58 bp, Homo sapiens
ggcatgagcctccatgtctggctaattttttatttttagtagagatggggtctcagtc

SEQ ID NO: 53537 - DNA, 84 bp, Homo sapiens
ggggtgctgtaagtagtttataaattatttaatggaggggacccctccaatattaataaatgagagtagactcaaggttaccct

SEQ ID NO: 53538 - DNA, 125 bp, Homo sapiens
aaacaaagtgctctctctctgtcaagctgccatgcattcgattcacagggtgccttacctggcgcagtcccactctcactctgcagcagcgctcctgtcacttgtgcgttgtttgggtttgctcc

SEQ ID NO: 53539 - DNA, 57 bp, Homo sapiens
gaggtagagtctcactctgtcacccaggctggagtgcagtggtgtgatccatagctc

SEQ ID NO: 53540 - DNA, 80 bp, Homo sapiens
gcagatgtgcaaggcgtgtccaagggaggaaaggtgaatcaattttttttttttttttttgagacagagtctcactctgt

SEQ ID NO: 53541 - DNA, 56 bp, Homo sapiens
gagacagagtctcactctgtcacctagattggggtacagtggtgtgatctcagctc

SEQ ID NO: 53542 - DNA, 86 bp, Homo sapiens
tcacagtaatggtacagagcagtggccataatctgccatctatggagggtgattttggtgaactgaatttgttaaagtgaattact

SEQ ID NO: 53543 - DNA, 80 bp, Homo sapiens
cacacctgaccactcagtagcatttagctgtgtaatcacttcccctccttaacacacagtctctctgggtgtctatgtgt

SEQ ID NO: 53544 - DNA, 116 bp, Homo sapiens
ctcccaagtgctggcatgacaggtgtgagccactgtgcccaacccatcataacctttttttttttttttttttttttttttgagacagggtgtcactctgtttcccagtgttggag

SEQ ID NO: 53545 - DNA, 80 bp, Homo sapiens
tgagaccgagtctcactctgtcacccaggctggagggcagtggcgtgatctcggctcactgcaacctctgcctcctgggt

SEQ ID NO: 53546 - DNA, 90 bp, Homo sapiens
catcctggcgacagaatgagacctatctttttattttaattttaatttttttttttttattgagacagtctcactctgtcacccaggctg

SEQ ID NO: 53547 - DNA, 110 bp, Homo sapiens
caccttcagtatgtgttctaatgaaaattttagcagagcacctgccctttctgggtaggtaattatttttttttgttatgaacttttcctatgccatttgaatttctgtg

SEQ ID NO: 53548 - DNA, 92 bp, Homo sapiens
gagtgagaccctgtctccaaaaaaaaaaaaagaaaaaaaaaatgtccacagatttttttttttttttaagttaagagacagggtcttgattt

SEQ ID NO: 53549 - DNA, 58 bp, Homo sapiens
cagcgtgtctcactctgtcgctcaggctggagtgcagtggtgtaatcatagctcgctg

SEQ ID NO: 53550 - DNA, 58 bp, Homo sapiens
tgagattgagtctcactctgtcgcacaggctggagtgcagtggtgtgatctcggctca

SEQ ID NO: 53551 - DNA, 118 bp, Homo sapiens
ttgaatttcaagtttgggtgaggatgtccgtaagacaaaggtctctggaatgctttttattttattttattttattttggagacagagtcttgctctgtcacccaggctggagtgcag

SEQ ID NO: 53552 - DNA, 124 bp, Homo sapiens
atatatatatatatatacgtatatgtgtgtatatatatatatatatatatatacgtatatatacgtatatatatatacgtatatatatatatatacgtgtatatatatatgtatgtatgtgtgt

SEQ ID NO: 53553 - DNA, 71 bp, Homo sapiens
gaagttgagagacagatgaaggggaacatacatgtttaagaatgttttcttttatttgtttgttttttctt

SEQ ID NO: 53554 - DNA, 109 bp, Homo sapiens
ttccattaataaaatatttttatttaacttttcggacatctacaatagaaacaaatttatgtttttgttgatgaagttggcaagaaataagagagagtgataagtggag

SEQ ID NO: 53555 - DNA, 58 bp, Homo sapiens; identical to SEQ ID NO: 3368

SEQ ID NO: 53556 - DNA, 95 bp, Homo sapiens
tgaaacgggctaggctggacatgaaagaggtttgggagtggggtaatcaggggctcaatttttttctgtttttgttgttgttgttgtttgtttta

SEQ ID NO: 53557 - DNA, 97 bp, Homo sapiens
ctggggcataaaaggccttaaaaaattatccagaggtagaatatacatatatatatatttatttatttttgagacaaggtctcgctctgtcacccag

SEQ ID NO: 53558 - DNA, 111 bp, Homo sapiens
gtgtgtgcataggtgtgtatgtgtgtgtatatgtgtgtatatatgtgtgtatatgtgtatatatatgtgtgtgtatatatatgtgggtgcatatagacccatcgtagccac

SEQ ID NO: 53559 - DNA, 65 bp, Homo sapiens
ctggttcaatgggatggcagcagggagagttcgaaatctcagtcctgattctgtctctgaatcag

SEQ ID NO: 53560 - DNA, 87 bp, Homo sapiens
tagctgagtgtggtgacacttgcctgtggttccagctacgtgggaggctgaggtaggaggatcacttgagtggggcggcagaggttg

SEQ ID NO: 53561 - DNA, 113 bp, Homo sapiens
aggcccttagctgagactacaggcttgcaccatcacgtccaactaatttttgtattttttgtcgagacagggtttgaccatgttgcccaggctggtctcacactctctcgcct

SEQ ID NO: 53562 - DNA, 80 bp, Homo sapiens
ccagcactgccgtgacgatggaaatgacatttttttttttttttttttggaatagggtctcactctgtcacccaggctgg

SEQ ID NO: 53563 - DNA, 111 bp, Homo sapiens
gtcctccatatgcctttgacaagcctggctctgagcctcagtttccccatctgtcaaaaagagagaatagactgggcacagtggcactttcagaggccaagatgagcggat

SEQ ID NO: 53564 - DNA, 74 bp, Homo sapiens
ctgggattacaggcgtgaggcgctgtgcccgactattttattttttcgagatggagtctcactctgtcacccag

SEQ ID NO: 53565 - DNA, 106 bp, Homo sapiens
ctctgtcttcacctcctctgggaagccttcctcagtctctggctctcaggtcgcccgtgcatacctgtcctgaaactgctttcccacctgtgttcccagggcagag

SEQ ID NO: 53566 - DNA, 92 bp, Homo sapiens
ctagccttggcaacatagtgaggcccctgtccctacaaaaaaaaaaaaatttttttttttgagatggagtctcactctgtcacccaggctgg

SEQ ID NO: 53567 - DNA, 85 bp, Homo sapiens
cctgcctctgcctctcaaagtattcggattatatgcataagccactgcgcctggcctaattttttgtatttttagtagagacggg

SEQ ID NO: 53568 - DNA, 57 bp, Homo sapiens
tcctgccaggtgctctggaaggggccatgcaggcctccctgtctgcctgagcagtga

SEQ ID NO: 53569 - DNA, 103 bp, Homo sapiens
gggcagctggggtccaggcactgcctcctgcggcgtccgcgctctgtctctctctggctcgtggagctggcaggcaggggatgggtctggaagatgtgtgtgt

SEQ ID NO: 53570 - DNA, 73 bp, Homo sapiens
gtctgtgtctgtgtctgtgtctgtgtctgggacctgcgtctggctcaggaggcagagagcagcagatacctgc

SEQ ID NO: 53571 - DNA, 118 bp, Homo sapiens
ctgagtttaaatccttgttccactgcaacccagttttgtgaccctccctttttttttttttttttgagacggaggatcgctctgtcgcccaggctggagtgcagtggcgcgatcttgg

SEQ ID NO: 53572 - DNA, 58 bp, Homo sapiens; identical to SEQ ID NO: 6639

SEQ ID NO: 53573 - DNA, 70 bp, Homo sapiens
tttttttgagaccgagtctcactctgtcacctaggctggagtgcagtggcgtgatctcggctcactggaa

SEQ ID NO: 53574 - DNA, 58 bp, Homo sapiens
tgagacggagtctcgctctgtcacccgggctgtagtgcagtggcgtgatcttggctca

SEQ ID NO: 53575 - DNA, 85 bp, Homo sapiens
gtgatagagtgagaccctgtctcaacaacaaaaagggtgtaattctttttttttttttttttgagatggagtttcactctttcgc

SEQ ID NO: 53576 - DNA, 67 bp, Homo sapiens
gtgtgtgtctctgtgactgccatgttcttaagaaagcttggatggccaggtgcacacacacacacac

SEQ ID NO: 53577 - DNA, 58 bp, Homo sapiens; identical to SEQ ID NO: 6359

SEQ ID NO: 53578 - DNA, 111 bp, Homo sapiens
attcaaggtcggcctaggcaacaaagtgagacaaggtcactaaataaataaattttattttattattttttgagacagagtctcactctgtcgcccaggctggagtgcagt

SEQ ID NO: 53579 - DNA, 87 bp, Homo sapiens
ttgagaacagcctgggcaacacagcgagactctgtctctcttttttttgagatagggtattgctctgtcacccaggttggagtgcag

SEQ ID NO: 53580 - DNA, 118 bp, Homo sapiens
ttggctggccgcatacctcctggcgggcagctgtggtgcattgtagttgcattgcatgttctggtggtacccatgcaatgtttccacagtgcatcacagaggcctgcctggccctcga

SEQ ID NO: 53581 - DNA, 99 bp, Homo sapiens
ggtgtctgggtaggagggagattctgagctgtacctgcaagggtccctctctctggcactgtggcccacgtccagggcaggtggcccagggcaggggat

SEQ ID NO: 53582 - DNA, 82 bp, Homo sapiens
caggtccagtgaggcaggctctgtggctctgtccatggcagcattagtgttgtccagggctaggtctgtggatctgcttggc

SEQ ID NO: 53583 - DNA, 64 bp, Homo sapiens
ttgagacggagtctcactctgtcacccaggctggagtggagtagagtggcgcgatctcggctca

SEQ ID NO: 53584 - DNA, 118 bp, Homo sapiens
gagctgggtcccagaaactcctatgacacaataaatccactttctctgacagtgtcagagcttcaagccgatactgcagcctacctcggatttaagtgcacaggagactccccaggtt

SEQ ID NO: 53585 - DNA, 111 bp, Homo sapiens
gtccaagcctccagaacttctgagcttcaagttcccatgaccccttctttttttttttttttttttgagatggagtctcactctgtcgcccaggctggagtgcagtggtgc

SEQ ID NO: 53586 - DNA, 118 bp, Homo sapiens
gctctagatctgtccagctgtgtggccttggatatatcacttagtctctgtgtgcctctgttttctcgcctggagctgcagtgagatgtaaactggaaaccacagtgtagattgcagt

SEQ ID NO: 53587 - DNA, 129 bp, Homo sapiens
gccccaggcttgggataggcagcagttggggcagggccacctcctgggatgattgaatctcactgtggctgtgccactcactagctgagggtcactctctaaggcatgtggttctgtttctgcaagcct

SEQ ID NO: 53588 - DNA, 58 bp, Homo sapiens
tgagacagagtctcactctgtcgcccaggctggagtgcagtggtgagatctcagctca

SEQ ID NO: 53589 - DNA, 84 bp, Homo sapiens
ggctgggactatgagtgtgagacactgcacttggctaattttttaattttttgtagagacaaggtctcactatattgcccaggc

SEQ ID NO: 53590 - DNA, 79 bp, Homo sapiens
ccaagtgcagtgtctcacactcatagtcccagccacccgggaggctgaggtgggaagatagctggagaccgggaggtgg

SEQ ID NO: 53591 - DNA, 117 bp, Homo sapiens
accagtgtcccagctcagctcacagtcaggcagacagagcgaattctatctcaccgtttttttttttttttgagatggagtctcactctgtcacccaggctggagtgcagtggtaca

SEQ ID NO: 53592 - DNA, 99 bp, Homo sapiens
ttccttctgggtgtggggaggaccctctttggaatggtggtcttattattattattattatttttgagacagagtcttgctctgtcgtccaggctggag

SEQ ID NO: 53593 - DNA, 66 bp, Homo sapiens
cctgggtagaatctgagtttgatcttttttttttttttgacacagagtctcactctgtcacccagg

SEQ ID NO: 53594 - DNA, 58 bp, Homo sapiens
tgagacagagtctcgctctgtcacccaggcgggagtacagtggcgtgatgtcggctca

SEQ ID NO: 53595 - DNA, 94 bp, Homo sapiens
aggtggcgccccagagggagggcagtggtggcctgtccttggccactctgtagaggccaggctccctgtttccctgctggatcctgggctgcct

SEQ ID NO: 53596 - DNA, 58 bp, Homo sapiens; identical to SEQ ID NO: 23944

SEQ ID NO: 53597 - DNA, 59 bp, Homo sapiens
ggcccggctcagtgaggctgcagtgagcaagagccgactgtccctctctcagtggggcc

SEQ ID NO: 53598 - DNA, 94 bp, Homo sapiens
aggtggcgccccagagggagggcggtggtgtcctgtccttggccactctgtagaggccaggctccctgtttccctgctggatcctgggctgcct

SEQ ID NO: 53599 - DNA, 93 bp, Homo sapiens
ggcatctctcatactgggtcagtcactggcactctcccactgctgcattccagtggctggagtgagattggctgtcagttcctctgctaatga

SEQ ID NO: 53600 - DNA, 104 bp, Homo sapiens
ggttggacagaaccagttttcttcatctacaaataataatacaactctccttttttttttttttttttttttttttttttgagacagagtctggctctgtcgcc

SEQ ID NO: 53601 - DNA, 86 bp, Homo sapiens
ccatcctggttttggtggggtttttttgtttgtttgttttggtttggtttttttgagacagagtctcgctctgtcacccaggctgg

SEQ ID NO: 53602 - DNA, 102 bp, Homo sapiens
tgctacttctgtgcttccttacagtgtgggcctcacagagttgttttttttttttttttttatggagtctcactctgtcacccaggctggagtgcagtggca

SEQ ID NO: 53603 - DNA, 79 bp, Homo sapiens
atagatgccagacccccaggcttccttattttattattattttttttgtctgagatggagtcctggagtctctctctgt

SEQ ID NO: 53604 - DNA, 120 bp, Homo sapiens
tcgggcagtggacaggttacccagccttgccccagcgtcccctggcagcctgcctcccagcctgagcccctcccctggcttccctgcagtgctcagtgacatgcagggagggcactcagc

SEQ ID NO: 53605 - DNA, 81 bp, Homo sapiens
ctgtgacacgagtgttgtctggttcccactgtcacttcccgaagggaacagctgttattgaacctcgatatgctggcatag

SEQ ID NO: 53606 - DNA, 78 bp, Homo sapiens
tccgccactgaagccacaaattcagaccagtttgttctgacactgtctgtgtgtggctcagctggaaagctaaatgga

SEQ ID NO: 53607 - DNA, 65 bp, Homo sapiens
actgtttccctgaggctctctggctcacacattccaaagagagttgaagaacctctggatacagt

SEQ ID NO: 53608 - DNA, 118 bp, Homo sapiens
tgtatgtgtgtgtcagtatggtgagatagtaattagacaagggttattgatttgaatgaatgaatgaatgaatgacattgtttgcttttccatagtgattacttttgaaggcactata

SEQ ID NO: 53609 - DNA, 84 bp, Homo sapiens
ggggtggagaggaaaggaaaagaggactaattcccaaagcttatgttgttgttgttgttccttctcctcgtcctcctcctcctc

SEQ ID NO: 53610 - DNA, 119 bp, Homo sapiens
ttatatatacatatatacacacacatatatatacacacatatgtatatatatgtatatatatatatatacacacacatatgtgtgtatatatatgtgtgtgtatatatgtaagatgtaa

SEQ ID NO: 53611 - DNA, 112 bp, Homo sapiens
tttggatcactaaacaccttttctgtatgtgaaaaggctacttatttgtttttgttattttttcttgccacatttttcatagggacagtttgtagggcttgagtgttttgag

SEQ ID NO: 53612 - DNA, 72 bp, Homo sapiens
tttgttttgagacggagtctcactctgacacccaggctggagtgcagtggcgtgagctcagctcactgcaag

SEQ ID NO: 53613 - DNA, 78 bp, Homo sapiens
gtgacaggagacaccttctcattttatagcatgtttacttttttttttttcttttgagatggagtctcactctgttgc

SEQ ID NO: 53614 - DNA, 58 bp, Homo sapiens
tgaggtggagtctcactctgtcacccaggctggagtgcagtggtgcgatctccgctca

SEQ ID NO: 53615 - DNA, 73 bp, Homo sapiens
cccaccaaccttgggtcctgctgtgggtggggtgaacacacacatacacacacagtcactcacatgtgttggg

SEQ ID NO: 53616 - DNA, 151 bp, Homo sapiens
tatatatgtatatatgtgtatatgtgtatatatgtatatatgtatatatgtgtatatgtgtatatatgtatatgtgtatatatgtgtatatatgtatatatgtgtatatatatgtatatgtgtgtatatatatatgtgtatatatatatat

SEQ ID NO: 53617 - DNA, 78 bp, Homo sapiens
gcagaaagtgagagagcgagcagggctttctggagatttttttttttttgagacagagtctgtctctgtcacccaggc

SEQ ID NO: 53618 - DNA, 115 bp, Homo sapiens
cctcttctggtgtgtgtggagcagaggggtccctggcacagccacactcacgccctgtctgccacaagccggcaaggggggcttctgggcagattctggagccaggctgtgtggg

SEQ ID NO: 53619 - DNA, 64 bp, Homo sapiens
gttgggggaggagtttgagggagtggtgggtgggcacggcctgtcactctcagtcactcaaggc

SEQ ID NO: 53620 - DNA, 113 bp, Homo sapiens
ccactttgcatgcaagtgtctagtgtctctctgtgtcctaatctcctcttcttttttttttttttttttttttgagatggagtcttgctctgtcacccaagcatgcagtggtg

SEQ ID NO: 53621 - DNA, 58 bp, Homo sapiens; identical to SEQ ID NO: 37024

SEQ ID NO: 53622 - DNA, 70 bp, Homo sapiens
gccatgctgtggcttctggacaagctgacagctgtgtgctgtgtgtctgtctgtgtccacccctgcaggc

SEQ ID NO: 53623 - DNA, 70 bp, Homo sapiens
gccgtgctgtggcttctggacaagctgacggctgtgtgctgtgtgtctgtctgtgtccacccctgcaggc

SEQ ID NO: 53624 - DNA, 70 bp, Homo sapiens
ttattttgagacagggtctcactctgtcacccaggctggagtgcagtggtgtgatcttggctcactgtaa

SEQ ID NO: 53625 - DNA, 58 bp, Homo sapiens; identical to SEQ ID NO: 6617

SEQ ID NO: 53626 - DNA, 56 bp, Homo sapiens; identical to SEQ ID NO: 6618

SEQ ID NO: 53627 - DNA, 58 bp, Homo sapiens; identical to SEQ ID NO: 637

SEQ ID NO: 53628 - DNA, 101 bp, Homo sapiens
cacctccggcaaccattgacttgctctctgtcactgtcactatagatttaccttttctaagtgttctcataaatggagtcatacagtggtagtcttttgtg

SEQ ID NO: 53629 - DNA, 108 bp, Homo sapiens
gtgagtgatggtgtatgtgagtatatgtgcatatgtatgtgaatgtatgtgtgtgagagatgtgtgagtacatgcatgtgtgtgtgaatatatgtgtatgtgattgat

SEQ ID NO: 53630 - DNA, 126 bp, Homo sapiens
cctgagaaacagcaacagctagacttttttttgtttttggaggcagggtctctctctgtggctcaggctgaacatggctcactgcagcctcaccctcctgggtccaagggatcctcccacctcagc

SEQ ID NO: 53631 - DNA, 60 bp, Homo sapiens
gctgtagtgtgtagggaccagccccacagggtcggtgggtctctccctgtgtgcggtgac

SEQ ID NO: 53632 - DNA, 65 bp, Homo sapiens
cctgagtgtctgaacacagagctcagcacagacggcttggctcgttggcttcatcggcatttggg

SEQ ID NO: 53633 - DNA, 116 bp, Homo sapiens
tcttgcaaaaccacagggtgggctgggcagggcctggaactctgcatttctttttctttttttcttttccgagatgtagtctcgctctgtcaccaggctgtagtgcagtggcacga

SEQ ID NO: 53634 - DNA, 91 bp, Homo sapiens
gcttctttttagttctattaaagagaagtgaaagaaagctgacaagctttatttatttaactttttttttttttaacttttttgagacagt

SEQ ID NO: 53635 - DNA, 165 bp, Homo sapiens
ctgtgttcacagttgagagaaatgtaaacaaatgtaaagatgcagtacttatgtatttatttattttattgtatttattttatttttttgagacagtctcattctgtcacccaggctggagtgcagtggcatgattttggctcactgcaatgtctgcctcctggg

SEQ ID NO: 53636 - DNA, 73 bp, Homo sapiens
ggagatgtcttcagtgagaggtgcattcagccagagacctggtttctcaccctctctcagggcctcagtttcc

SEQ ID NO: 53637 - DNA, 77 bp, Homo sapiens
ccatctggcacatggagtgagtaggttttattgccaaagccgtcccggccttggcctcagcctctgtgtggctctgg

SEQ ID NO: 53638 - DNA, 76 bp, Homo sapiens
ttgtgtgtgtgtctctgtgtccaaatgtcccccttttatcaggacgtggtcatgttggattagagcccacccatgg

SEQ ID NO: 53639 - DNA, 84 bp, Homo sapiens
gcaggtgggcagtgggtggggtgggcagcctgagagccgctgagagctttgatctctcctacctctttcactgcgttcactttc

SEQ ID NO: 53640 - DNA, 72 bp, Homo sapiens
agatcaaggcactggcagatgtggggtctggggaagactcactctctgcctccaatatagcgccttgttgct

SEQ ID NO: 53641 - DNA, 83 bp, Homo sapiens
tccccccaaagtgtctgactctgtgggaccctcagggatcccagcccaaggactcagggtcctggaggatgcccaggtgggga

SEQ ID NO: 53642 - DNA, 109 bp, Homo sapiens
tggccgttactagggtgtgaggtgctggcccttctcactcactgtcagccgtggagcccggcaccccagctgcaggcgaacgggctgcttctctgtccttctccagcca

SEQ ID NO: 53643 - DNA, 89 bp, Homo sapiens
ccagctctgctgtgtgctggctgtgtgaccctggggcatcctttagcctctctgtgcctcagtggctccctctggaaagcaagcatggt

SEQ ID NO: 53644 - DNA, 129 bp, Homo sapiens
ccccagagtaggggagaaggttggggtgtagggccttccacgtggaacagacagcccctgtgtctctgtctcttggggacctgagtttgggtggggtggcagttggcacagcgcagatgcggtagagat

SEQ ID NO: 53645 - DNA, 73 bp, Homo sapiens
atgtatatatgtatgtatatgtgtatgtgtgtgtatatataatatgcatatatgtgtgtgtatatatatatat

SEQ ID NO: 53646 - DNA, 75 bp, Homo sapiens
tcaacttggaggattggaggataactgacttttttttttttttgagatggagtctcactctgtcacccaggctgg

SEQ ID NO: 53647 - DNA, 103 bp, Homo sapiens
ggtgtggtggcatgtatctgtagtcccagctactcaggaggctgaggtagtaggatcacttgagcctggggaggttgaggttgcagtgagccaaggtcacacc

SEQ ID NO: 53648 - DNA, 75 bp, Homo sapiens
gttctgtgtcatggagtgggaggctggcctgacctgacagccagcaggtgagggctcagctctgtctctctgagc

SEQ ID NO: 53649 - DNA, 67 bp, Homo sapiens
gggacactcagtgagtcaccgccagacaccaggcagcgacggcgtgatggagtgaagtcgctgaccc

SEQ ID NO: 53650 - DNA, 81 bp, Homo sapiens
ggggccagggagcaggctggactgggcgttgggacatttggatccaactctgcctctgtcactgctccactgtgatctccc

SEQ ID NO: 53651 - DNA, 82 bp, Homo sapiens
tgttttgagacagtctcactctgtcgcccaggctggagtgcagtggtgcgatctcagctcactgcaacctctctctcctggg

SEQ ID NO: 53652 - DNA, 80 bp, Homo sapiens
tggagctggaggttcaaggttaagtccacaccttgctgccagttagcaagtcactctccctctctgagccttagttgcca

SEQ ID NO: 53653 - DNA, 86 bp, Homo sapiens
ttgtttttttgagacagggtctcaccactctgtcactctgtcacccaggctggagtgcagtggtgtgatcttggctcactgtgcaa

SEQ ID NO: 53654 - DNA, 98 bp, Homo sapiens
agtatgggagaaagagcaggttctgctgttgattttttaaaatttattattttattattattatttttgagattgagtctcactctgtcacccaggct

SEQ ID NO: 53655 - DNA, 65 bp, Homo sapiens
ggcaggtgcggtgaagggagccagaagtccccccttcagagcctgggtccctccatccgtctgtc

SEQ ID NO: 53656 - DNA, 76 bp, Homo sapiens
tgacagagcaagatcccatcccaaaaaacaagcgatatccttttttttttttttgagacacagtctcgctctgtca

SEQ ID NO: 53657 - DNA, 131 bp, Homo sapiens
cagactctttgcatcttaggatgctaaggttctagaatcttcggcgcgtcgagtctgactcagtcactgcatttagcactcggtatgtcggcaccttccgagatgttgagtggagacagagatgagggagg

SEQ ID NO: 53658 - DNA, 115 bp, Homo sapiens
aggctgggtttcagctggcatttgtaaaattttggggggcttgtatttttataggagaaaattttttctttttgtctacacctctgtcaacaatggcatggtgagatgtaggact

SEQ ID NO: 53659 - DNA, 69 bp, Homo sapiens
gccactaatagtccatagaatttgaaatttgggatatcctatttttcatttttaggaatcctgtttggc

SEQ ID NO: 53660 - DNA, 111 bp, Homo sapiens
ctgtattctggaaggtcactgagcgaggacagggagcaggcacgggtgctcaggagagagtgcagactgtgcctgggcaggactaaggggcatggtaacacccagatacag

SEQ ID NO: 53661 - DNA, 91 bp, Homo sapiens
acatggcctcctcctctgtgtcactgcgactcagtctcccctgctgctcttaaaagttcaggcttggccaggtgcggtggctcacgcctgt

SEQ ID NO: 53662 - DNA, 107 bp, Homo sapiens
gctccaccagcccctcgctgggtgaagcggctcagcctctgtgagtctcaggtcccttctcagcaaagtgggggtcatgggggccgtgcttccccatggggctgtgc

SEQ ID NO: 53663 - DNA, 117 bp, Homo sapiens
gctcgagtgcaggcatgaagaggagctgggagagcagaatgctgctgacctcagtgaggacacatggggctttctgcagttccctcaatgagaggctgtttcatgccttggagcctt

SEQ ID NO: 53664 - DNA, 82 bp, Homo sapiens
acagcgagcacaggctgggttgggtctttttctttttcttttttttttttaaccttccaagtagaacagcctgtctgggtgt

SEQ ID NO: 53665 - DNA, 79 bp, Homo sapiens
ttgagctccttctgtatgccactggggcactgtgtatttctctctctgtgtctgtgggagcagggaaggggaggctcaa

SEQ ID NO: 53666 - DNA, 99 bp, Homo sapiens
agtggcggggggtggggggggtctctctgcctgagtctcatgtctctgactctagacactggtttataaagagacctagagttacagcctcgagttcct

SEQ ID NO: 53667 - DNA, 116 bp, Homo sapiens
gccggacgtcgtggcatgtgccagtagtctcagctgcttgggaggctgaggtaggaggatcacttgagcctgggaggtcgaggctgtggtgagctgtgattgtaccaccgcactcc

SEQ ID NO: 53668 - DNA, 68 bp, Homo sapiens
acatatacatatatatatatacacacacacacacacgtgtgtgtgtgtatatatatgtgtgtgtgtgt

SEQ ID NO: 53669 - DNA, 105 bp, Homo sapiens
cacagtgagtgctctgtaaacttttagggatgaacaaatgaatatttttaaatctgttcattgttttcacagttaaacttttctaagcacttatgtaatactgtg

SEQ ID NO: 53670 - DNA, 94 bp, Homo sapiens
ctttcgccaatgagggggagacaaaatgatctctcaatatgtcaaacgatagtacagaaaagtgattatgttcttgggccttgtgggcagaaag

SEQ ID NO: 53671 - DNA, 68 bp, Homo sapiens
gtcacagctctgtgtgagtcagaccccctcactgtctggggtctgctgtccgttacagtggctgtgcc

SEQ ID NO: 53672 - DNA, 118 bp, Homo sapiens
tgggggggtccggctcccagtggccctgagccaagcccgaggtgacttcggggtgacaccgtctgtctgcctcacttgctccagacatccgcccggccctgaaatggccacctgccca

SEQ ID NO: 53673 - DNA, 96 bp, Homo sapiens
actgccctttggggtgaggtagtaggttgtatagtttggggctctgccctgctatgggataactatacaatctactgtctttcctgaagtggctgt

SEQ ID NO: 53674 - DNA, 68 bp, Homo sapiens
ggcagtaggttgtatagttatcttccgaggggcaacatcactgccctgaaaccacacaacctactacc

SEQ ID NO: 53675 - DNA, 112 bp, Homo sapiens
caactgcaacctctggtccaggaggcaagacaatgcaaacagcactgaattagatcttcagtttcatagcacagacagagtctcacaaaagctgagaggtgagggacaggtg

SEQ ID NO: 53676 - DNA, 100 bp, Homo sapiens
ctgagtccttaaagctgagatgccctttgcaataggtgtatgtctgtttccaccagtgatgtactagattgtttagtgttaaagattttaattgggccgg

SEQ ID NO: 53677 - DNA, 118 bp, Homo sapiens
gactcagaagtgacacagatgatagaaattgtggctaagagttttttttttttttttttttgagatggagtttcgctcttgttgcccaggctggagtccaatggtgtgatctcggctc

SEQ ID NO: 53678 - DNA, 65 bp, Homo sapiens
ttgagatggagtctcactctgtcacccaggctggagtgcaccggtgtgatctcggctccctgcaa

SEQ ID NO: 53679 - DNA, 86 bp, Homo sapiens
atgtatttcctctctcttgactcagtttgttcttgtctatttagattaaagaacataatgttacaaagaagagagctaagcaacat

SEQ ID NO: 53680 - DNA, 119 bp, Homo sapiens
gctggcaaatggagggatgtcatgaggcaccaggaaggtggcgaccagcgctgtgggagtgatctgactgcctgtgtacaccaacactgtgaacagcaccatcacttctgttactatgt

SEQ ID NO: 53681 - DNA, 58 bp, Homo sapiens; identical to SEQ ID NO: 5276

SEQ ID NO: 53682 - DNA, 109 bp, Homo sapiens
tttggcaggaaacctttgcagataggacagaagtgactgtgttgatctgaaaacaaaacaagccgatcaatgtcttctctctcgtcactgcagacctccaactgccaaa

SEQ ID NO: 53683 - DNA, 114 bp, Homo sapiens
ccagtggccatcggggctgagggcaataatgtattttttataaggaattgggaattttagtcttttttttttttgagacatggtcttgttctttcgcgcaggctggaaggctgg

SEQ ID NO: 53684 - DNA, 125 bp, Homo sapiens
cctcttttggctcctgtctcatgagatggaaattagagggcaggaccctgtgtgtctgagtgtgtcttatggctggaggagagcaggacccatgcactccaggtagaagtgccatgtcgacatgt

SEQ ID NO: 53685 - DNA, 110 bp, Homo sapiens
catggcagcgtgcttttctggaactcacagggtagggaaggatcggacctttttttttttttttttgagacagtcttgctctgtctcccaggctggagtgcaatggcatg

SEQ ID NO: 53686 - DNA, 85 bp, Homo sapiens
agcctgggtaacataatgaaaccccatctctaaaaaaaaaaaatttttttttttttgagacggactctcactctgtccccaggct

SEQ ID NO: 53687 - DNA, 58 bp, Homo sapiens; identical to SEQ ID NO: 1435

SEQ ID NO: 53688 - DNA, 141 bp, Homo sapiens
ggacacgagccctgggcagctgtggctccgacgtggccctttgggctgggtggtcccggcacagcctctgtctctgtgtttgagcctcccttgcggccctgctaagccggcactcaaggttgctccacaggggctgggggc

SEQ ID NO: 53689 - DNA, 86 bp, Homo sapiens
cgtgtgtatgtagacagtggtagttaaccctgtgcgtgcctgtgtgcctgtgtgcagcggtggttaaccctgtgtgtgtgtgcacg

SEQ ID NO: 53690 - DNA, 122 bp, Homo sapiens
ggtcttggtgtcctgcatctgccctgctgtccttttttttcaagacagcgtctcagtctgtctcacccaggctggagtgcagtggcacgatctcggctcactgcaacctccatcccctgagt

SEQ ID NO: 53691 - DNA, 65 bp, Homo sapiens
gtatatgtgtgtatacatatatatgtatatgtgtgtatacatatatatgtatatgtatatatacg

SEQ ID NO: 53692 - DNA, 140 bp, Homo sapiens
tatatgtgtgtatacatatatatgtatatgtgtgtatacatatatatgtatatgtgtgtatactatatatgtatatgtgtgtatacatatatatgtatatgtgtgtatacatatatatgtatatgtgtgtatacatatat

SEQ ID NO: 53693 - DNA, 109 bp, Homo sapiens
gtgcggtgcatgtgtgtttgtgtatatatgtatatatgtatatgtgtgtatacatatatatgtatatgtgtgtatacatatatatgtatatgtgtgtatacatatatat

SEQ ID NO: 53694 - DNA, 116 bp, Homo sapiens
taggtgtgttgcttcactgcactgttctctcgatctttgtgcatgtttgaaattttttataacacagttttttttgttttttaagtgtgagagatggtaaaggtggcccaggcctg

SEQ ID NO: 53695 - DNA, 117 bp, Homo sapiens
agctctagtgtggttgaacttaacagtcttttaaggtgagcactgatgcatgttatctaaagaacttttttctacacatgaaggtgttcacccagattttcatccagaagttttgct

SEQ ID NO: 53696 - DNA, 91 bp, Homo sapiens
tattccgtatatatattctgtgtatatatattccgtatatatattctgtatatatattctgtatatatattctatatatatatatattgta

SEQ ID NO: 53697 - DNA, 77 bp, Homo sapiens
tgttggaggcaggtaagaagcacttagttaaattggaggtaacagaagagactcaggcccttttgcctgctccatca

SEQ ID NO: 53698 - DNA, 115 bp, Homo sapiens
tttcctgtagtagtttcatagtttgaggtcttagatttaagactgtattttttttatttttgtatatgacaagagatacaggtctagtttcattcttctgtatatggagattcag

SEQ ID NO: 53699 - DNA, 60 bp, Homo sapiens
gccatgtacacgtgtgtgcttatgtatatatctatgtacataagcacacacttgtaaagc

SEQ ID NO: 53700 - DNA, 66 bp, Homo sapiens
cacgtctctctgagtctcactttcctcacctgccaagtgtgggagtgatgatgacagctacttgtg

SEQ ID NO: 53701 - DNA, 62 bp, Homo sapiens
tgagacagggtctctgtcgctctgtcgcataggctggagtgcagtggcaagatcttggctca

SEQ ID NO: 53702 - DNA, 73 bp, Homo sapiens
gattagcatccagccagggtctcaaggagagctttttgaaggtttctgagctctctctctgtgtggctacttc

SEQ ID NO: 53703 - DNA, 57 bp, Homo sapiens
ggtgggaggatcacttgagtctgggaggcacagaccacagtgagctgagatcccacc

SEQ ID NO: 53704 - DNA, 70 bp, Homo sapiens
gggacagagccaggcaagggactctgccgggcgggaggcctcccccagggactcacagccactctctctc

SEQ ID NO: 53705 - DNA, 76 bp, Homo sapiens
tctcaggttcatgtgcagaaccatcactgttcagaccatgagcaaaagtgagtgaggacacatccagagcccctga

SEQ ID NO: 53706 - DNA, 79 bp, Homo sapiens
tcacactcaggctgtgtctgtgcatatgagtgtgtgcttaaggcatggacaccgtatgtgcattatgtttggggtgtga

SEQ ID NO: 53707 - DNA, 86 bp, Homo sapiens
gagtggctgcttcctgagagagcacacacagcccctcgtgtttccacaccgaggccctgccccagtgcccttaaaagcgccccctc

SEQ ID NO: 53708 - DNA, 58 bp, Homo sapiens; identical to SEQ ID NO: 1847

SEQ ID NO: 53709 - DNA, 78 bp, Homo sapiens
gtatgtatatatgtgtatggatgtatgtatatatgtgtgtacacatgtttatgtatgtttatacgtgtatgtgtgtat

SEQ ID NO: 53710 - DNA, 77 bp, Homo sapiens
caacagggactcactatctgacagttctggaggctgaaagtcggaggccagggcgtgggcagggttggtttctcctg

SEQ ID NO: 53711 - DNA, 84 bp, Homo sapiens
gttctttagagagggcccctgactcccgtgttgccttaattggtcattgatcaacttaagtctgtcattttctctcttctgaac

SEQ ID NO: 53712 - DNA, 113 bp, Homo sapiens
ataatgtgcctcaatatgattctctctgagtttatacttcttgaagttcattgagcttcttggatgtttagattcatatcttccatcaaatttgaaaagtttttggccattat

SEQ ID NO: 53713 - DNA, 73 bp, Homo sapiens
gtgagacagaaatgactgcagacagctgggggcacacagggaaccccaggctgctggtaatattccatttcat

SEQ ID NO: 53714 - DNA, 86 bp, Homo sapiens
ggttgtatactgtgatatcttgttttaaaaaaacaaaaccattgtatttttttttttttttgagacggaatctcgctgtgtcaccc

SEQ ID NO: 53715 - DNA, 70 bp, Homo sapiens
agaccctggatccctgtacacacctagcaaggactctgatgtttttttctagatgtgatgggaagggttt

SEQ ID NO: 53716 - DNA, 102 bp, Homo sapiens
cacctgggcaggcacgggtgacagagagactcctcagcctagagtttctggcttccaggctcaggctctgactcacacactggctttgctgtccacaacgtg

SEQ ID NO: 53717 - DNA, 62 bp, Homo sapiens
ggtgtcagcaatattctgtttcttttttttttttttctgagacagagtcttgctctgtcacc

SEQ ID NO: 53718 - DNA, 74 bp, Homo sapiens
ggggcctgtagcttcttgtaacatcagagctggaagggcttggagcctgactctcccacactgttacaggaacc

SEQ ID NO: 53719 - DNA, 87 bp, Homo sapiens
cattgtgcagaaatagccccagtattatatttcattaattgctttttgggaattcaatataatgctgtgtgcatgtgtgtgtgcgtg

SEQ ID NO: 53720 - DNA, 91 bp, Homo sapiens
gctgggatgtgtgtggctctctgaggctgtcagaaccagtcttgtcaaaagccctcatgttgacagcctgaattctgccccccatgccagc

SEQ ID NO: 53721 - DNA, 82 bp, Homo sapiens
caaaacattgacagagcatcaggatctgcaaagctcgctaggacagcaggaatgcaaccgggggatggtggtcacttttttg

SEQ ID NO: 53722 - DNA, 76 bp, Homo sapiens
catgccagttaggtagggtggaagcctgttgctacgatgtggggaaggttgtctgcttctcaacctgtggccagtg

SEQ ID NO: 53723 - DNA, 56 bp, Homo sapiens
gagacaaggtctcactctgtcacccaggctggagggcagtggtgtgatcatggctc

SEQ ID NO: 53724 - DNA, 106 bp, Homo sapiens
ctgggtcagttctgagttcgtttcaatgaatttatctcccaatgttgtatttttttattctttgggtgcctggtgatttattggatgccagaaattgtgaatttag

SEQ ID NO: 53725 - DNA, 97 bp, Homo sapiens
gaggctgaggcaggaggattgcttgaactcactgggcagaggttgcagtgagccgagatcataccactgcactccagctcggatgacagagcgagac

SEQ ID NO: 53726 - DNA, 78 bp, Homo sapiens
cacagtgtgtgggagtgtgactgtgtgtgtgtggatgaaaagacacacttttaagagtcacacacacatactacagtg

SEQ ID NO: 53727 - DNA, 106 bp, Homo sapiens
ccaagcaggcttgccagtctgacctgctcccagcctgtgtctctcactccgtgcctgctggacacctgctccggtgagctcgcaccagccggggggcagaacagat

SEQ ID NO: 53728 - DNA, 77 bp, Homo sapiens
gccggcacacggtgacttagggcctttgcaagcatgattttacccagctgactctgtctctatcaccacctggtggc

SEQ ID NO: 53729 - DNA, 94 bp, Homo sapiens
gcacctatagatacgtgtttgtgagcatgcatgtaaatgggcatgtgtgtgcctgtgtgtgtgcctgcatgcctttgcgtgtggtgtgtggtgt

SEQ ID NO: 53730 - DNA, 80 bp, Homo sapiens
gaggcctctcctcgggtttaaggtggcgtcttctccctgagtcctctcttgggcgtccctctgtgcctgtctgcgttctc

SEQ ID NO: 53731 - DNA, 76 bp, Homo sapiens
atatattatatgtgtgtatatatgtgtgtatatattatatatgtgtgtatatatgtgtgtatatatgtgtgtatgt

SEQ ID NO: 53732 - DNA, 122 bp, Homo sapiens
caggtgtgagccacctgtcctgtttccatcacagacacagctcatcttttctttctttatttttgaaggggagtcttgctctgtctcccaggctggagtgcagtggtgcaatcttggctcac

SEQ ID NO: 53733 - DNA, 136 bp, Homo sapiens
atatctgtatatacacatgtatatatacatatctgtatatctgtgtatacacatgtatatatgtatatatacatatacacagatatgtatacgtatatacatatacgtatatgtgtatatgtatgtatatgtatat

SEQ ID NO: 53734 - DNA, 99 bp, Homo sapiens
gtatacatatctgtgtatatgtatatatacatatatacatgtgtatacacagatatacagatatgtatatatacatgtgtatatacagatatacagata

SEQ ID NO: 53735 - DNA, 95 bp, Homo sapiens; identical to SEQ ID NO: 68

SEQ ID NO: 53736 - DNA, 93 bp, Homo sapiens; identical to SEQ ID NO: 69

SEQ ID NO: 53737 - DNA, 109 bp, Homo sapiens
gcataatggaatctggagctctttggaaagaaatgggaagaagtgagggtcatttgctgagtgtaactgcatctccaggtcccaggatatcctggctgcagctaatagc

SEQ ID NO: 53738 - DNA, 112 bp, Homo sapiens
ggccatgaagcaggctgccctgtgccgcagggaaggcaggagagaagaattgaagtcccagcctctcactgactccatggggaagaagcagggccaagatcagaacgtggtt

SEQ ID NO: 53739 - DNA, 69 bp, Homo sapiens
atttgtacattgtatacatatatgtatatttgtatatcggtgtgtgcatgtgtgtgtacacgtgtgagt

SEQ ID NO: 53740 - DNA, 74 bp, Homo sapiens
caggcagcaatggacaagggcagtctccctggggtgatggtggattagcggggctgtctctgtctctgtccctg

SEQ ID NO: 53741 - DNA, 104 bp, Homo sapiens
ccctctgccctggggctccttctcttaggtcgagggagaaaaagtgtcctgaatcccacactctgaccctcagactccagctcagccgcacccagcccacaggg

SEQ ID NO: 53742 - DNA, 61 bp, Homo sapiens
cagctctgagggtcatgggtgctatctgggtttgaactcagtctctgtgacatacaagctg

SEQ ID NO: 53743 - DNA, 56 bp, Homo sapiens
gagactgagtctcgctctgtcatccagtctggagtgcagtggcacgatcttggctc

SEQ ID NO: 53744 - DNA, 69 bp, Homo sapiens
cttcctggttcactgatcagtgtctggtgaggacccacttcctggttcacagatcagtgtctggtgagg

SEQ ID NO: 53745 - DNA, 97 bp, Homo sapiens
ctagttgacagatcagtgtctcatgaggacccacttcctggctgacagatcagtgtctggtgaggacccatttcctggttcactgatcagtgtctgg

SEQ ID NO: 53746 - DNA, 80 bp, Homo sapiens
acagatctgcacgtctgtgctcgtatatgcacaggtcagcatccttgcaggcccacgtgtacctcactctgtgtgtctgt

SEQ ID NO: 53747 - DNA, 77 bp, Homo sapiens
gttggagtgagtgtatgcagcaacccgacctccacccctccactcggagccacacccactctgcgtgtcctcccagc

SEQ ID NO: 53748 - DNA, 117 bp, Homo sapiens
gtggcagaggtatgctcaagtgtctttttttttttttttgagatgcagtctcactctgtcaccaggctggagtgcagtggctcaatcttggctcactgcaacctctgcctcccaggt

SEQ ID NO: 53749 - DNA, 64 bp, Homo sapiens
gcaagatgggctttgggtctgtctctgactgtccccagcggcattgtcacagagcaagtcttgt

SEQ ID NO: 53750 - DNA, 64 bp, Homo sapiens; identical to SEQ ID NO: 53749

SEQ ID NO: 53751 - DNA, 87 bp, Homo sapiens
ttgagtcattgtgaacattgggtgtaacaggtgattcgaggccacctgtgtctcagtcacattgtgttttccttacaatggccccag

SEQ ID NO: 53752 - DNA, 130 bp, Homo sapiens
gaggggactggtgtgtggtggtagggacgcaggtgctcaggagggctcctcaggctgcctctctgcctgttactgctgctccctccctggtcctggggactcgctcaggcctggatgtgtggttttggac

SEQ ID NO: 53753 - DNA, 100 bp, Homo sapiens
aggaggggacgtggtgtctgcggctctccgtgtgtctgtgcgtgattaatggagcatgcatgagctaaccgagcagctggtgtggggcctggaccctgct

SEQ ID NO: 53754 - DNA, 110 bp, Homo sapiens
ccgtggagacaggaagaagatcagtggtagccaagagctcgggggcggggggatgaagagacagagcacagggagttttagggccggggaccatctctgtctgatactgg

SEQ ID NO: 53755 - DNA, 108 bp, Homo sapiens
ggacctgtgggggcacttgaagccacccaggcgaggcaggaagatggacagagcagccagcctgcctgtgagcctctgcggggtggggtcctggtgcctctgccctcc

SEQ ID NO: 53756 - DNA, 58 bp, Homo sapiens
tgagacagagtctcgctctgtcacccaggctggagtatagtggcgcgatctctgctca

SEQ ID NO: 53757 - DNA, 80 bp, Homo sapiens
ggcgggaaggtcactgaggaccccccagcacctaaagcccgtgattctgggggacgtctctgacagtcactcttacagtc

SEQ ID NO: 53758 - DNA, 72 bp, Homo sapiens
ggatggggccgcatctacacctgtgcctgtgtgtgcctgacctgcggtcactccgtgtctgtgtgtccctct

SEQ ID NO: 53759 - DNA, 58 bp, Homo sapiens; identical to SEQ ID NO: 13985

SEQ ID NO: 53760 - DNA, 67 bp, Homo sapiens
ggcatggtggctcactcctgtaaccacagcactttaggaggctgaggtaggaggatcacttgaggcc

SEQ ID NO: 53761 - DNA, 164 bp, Homo sapiens
gctctttggctacacagtggcactgttcgtatagaaaggcaggtcgatgtttcagtccttcccttaatttttttttttttttttgagacagtctcactctgtcgcccaggctggagtacagtggggcaatctcagctcactgcaacctccctctcccgggttca

SEQ ID NO: 53762 - DNA, 116 bp, Homo sapiens
actgcactccagcctgggcgacagagcaagactccatctcaaaaaaaaaaaaaaaaagacttcattattattattttagacagagtctcactctgtcaaccaggctggggtgcagt

SEQ ID NO: 53763 - DNA, 106 bp, Homo sapiens
atgacatgtgcccaaggtggtcagagcacagcttggttttatttatttatttatttattttaagacagagtctcgctctgtcgcccaggctggagtacagtggcgt

SEQ ID NO: 53764 - DNA, 82 bp, Homo sapiens
ctgagtctgactctgtcgctcaggctggagtgcagtggctcgcggcaacaaggcctgggttcaagggattgtcacgcctcag

SEQ ID NO: 53765 - DNA, 110 bp, Homo sapiens
acaggcgtgagccactgtgcctggctgtaaattgtcactgatttctatctagtggtgaggtcgttacaaaatatttcatttctcagctgggtgtggtggcttacgcctgt

SEQ ID NO: 53766 - DNA, 68 bp, Homo sapiens
ccaagctctgttctgtgtgggtcagggtgtttaggatggtccaggttgtcacgcgggggagggtaggg

SEQ ID NO: 53767 - DNA, 103 bp, Homo sapiens
gtaagtgagcatgcccatcccatgcctcttgccgtccacacgctgtgcctgtctgcctgggtctctgctctgcgtggctgtgagaggctctggtgccactgac

SEQ ID NO: 53768 - DNA, 78 bp, Homo sapiens; identical to SEQ ID NO: 4711

SEQ ID NO: 53769 - DNA, 113 bp, Homo sapiens
tttgattggtccttaataagtagtgtagtagctttctgaaattctgtgtaactgcttcttgaaatgtcaagatactgaactagagacctggtattaaacttggacatatcgga

SEQ ID NO: 53770 - DNA, 58 bp, Homo sapiens; identical to SEQ ID NO: 9581

SEQ ID NO: 53771 - DNA, 78 bp, Homo sapiens
cttctctgcttgtgtgtgcgtgagtgtgtgcgcgtgcgcgcgcgcgcgcacacacacacacacacacacacagagtag

SEQ ID NO: 53772 - DNA, 72 bp, Homo sapiens
gctgagggcaacatagtgagacattgtttctttttttttttttttgagacagtctcactctgtcacccaggc

SEQ ID NO: 53773 - DNA, 117 bp, Homo sapiens
taagctttatatcacatagcaatccaagaaagtacaaacatctgaattgaaagttttagaataccctaaacttcaattagagtatgctgggtataatgtaagagtgatacaaattta

SEQ ID NO: 53774 - DNA, 92 bp, Homo sapiens
gagaccattcaaataggcgagcatctacacatagccagctggctatttgcaaaactatatgctttttttttttttttttgagatggagtctc

SEQ ID NO: 53775 - DNA, 68 bp, Homo sapiens
gggatacctctgtgtggcatgtgggtgacggaattcagcctcaccctcagtccctctcagagcctccc

SEQ ID NO: 53776 - DNA, 87 bp, Homo sapiens
gtgggaaagggttagagtttttttttttttaatagtgatgggttaactggatatctatatagaaaaaaatgaactatctcaaaccac

SEQ ID NO: 53777 - DNA, 122 bp, Homo sapiens
tatatatatatatatatatatagtgtgtgtgtgtatatatccgtaatatatatatagtatgtgtatgtatatatatatatccatctatatatatatatcctgtgtgtgtatatatatcctgt

SEQ ID NO: 53778 - DNA, 59 bp, Homo sapiens
tgggtgacttgtcgggggtggggaggacggggtttgaggcagtctcactctgtcaccca

SEQ ID NO: 53779 - DNA, 119 bp, Homo sapiens
gagtgagaacatgtgatatttatctttctgtgactgagactgctttctttctttttttttttgagacagagtttcgctcttgtcgcccaggctggagtgcaatggcatgatctcagctc

SEQ ID NO: 53780 - DNA, 131 bp, Homo sapiens
attgcatgcgtttttctccaaccttatttcttttttttttttttttgagatggagtctcactctctcacccaggctggagcggctcactgcaatctctgcctcctgggttcaagtggttctcctgcctcag

SEQ ID NO: 53781 - DNA, 68 bp, Homo sapiens
ggtaaatcccgaggagtccaggaatagcagattcactgattcactgactctctgggactcgggctgcc

SEQ ID NO: 53782 - DNA, 149 bp, Homo sapiens
tatatatgtttatatgtatgtatatatgtacatatatgtacatatgtttatatgtaagtatatatgtacatatatgtacatatgtttatatgtaagtatatatgtacatataggtacatatatgtatatgtgtacgtacatgtgtacat

SEQ ID NO: 53783 - DNA, 108 bp, Homo sapiens
tatgtgtaaattaaatttatcctttcatctgcctgactctcactccctgacccaaagattttcactgaaaataggtgcatgttctccagatgtgtttatgtacacgta

SEQ ID NO: 53784 - DNA, 58 bp, Homo sapiens
tgagacagagtctcgctctgtcacccaggctggagtacagtggcacgattttggctca

SEQ ID NO: 53785 - DNA, 77 bp, Homo sapiens
cactgcttctttcatggccacttccctggctttggccttgacctcagtcagagtcactgcctctgtcatgaccagtg

SEQ ID NO: 53786 - DNA, 95 bp, Homo sapiens; identical to SEQ ID NO: 68

SEQ ID NO: 53787 - DNA, 93 bp, Homo sapiens; identical to SEQ ID NO: 69

SEQ ID NO: 53788 - DNA, 60 bp, Homo sapiens
tatactatatatgtgtgtgtgtgtatatatatatatatatacactatacatgtgtgtgtg

SEQ ID NO: 53789 - DNA, 95 bp, Homo sapiens; identical to SEQ ID NO: 68

SEQ ID NO: 53790 - DNA, 93 bp, Homo sapiens; identical to SEQ ID NO: 69

SEQ ID NO: 53791 - DNA, 93 bp, Homo sapiens
ccacatatcagcaggggacattgtggagtgcactcatgctggcagcagtggcacagcacagtgcatgtgcaagtgcatgctgatgagagaggg

SEQ ID NO: 53792 - DNA, 89 bp, Homo sapiens
tatctcatcatttttgtgggtcagaaatctggatgtggcttacctgggtgcctctggctcagagtctctcacagagggcagttaagata

SEQ ID NO: 53793 - DNA, 69 bp, Homo sapiens
cttgatgacctgtctaatactgtcagtggggtattaaagtctcccactcttactgtgtggttatctaag

SEQ ID NO: 53794 - DNA, 78 bp, Homo sapiens
ctgtctgacattctctctctatgaaaactgatcaaatgttggaaggtaagtttcaagtgtggagagagaccaagggag

SEQ ID NO: 53795 - DNA, 72 bp, Homo sapiens
ggatacgggggaggggtggcatcggcgatttaagactgactgtctctgtctgacctcttgaatgtctgttcc

SEQ ID NO: 53796 - DNA, 80 bp, Homo sapiens
ccctcttggtgtaacacatccagattttggataaattataacattgttttttaatgcaatttctggtctgcagtaaaggg

SEQ ID NO: 53797 - DNA, 66 bp, Homo sapiens
cgactggggaacattctgcttccaagtttcctcaggttgttggtagaattcatttccttgtggttg

SEQ ID NO: 53798 - DNA, 72 bp, Homo sapiens; identical to SEQ ID NO: 53795

SEQ ID NO: 53799 - DNA, 89 bp, Homo sapiens
gactgtgttgtaggagctaaaatttttgaaaaatgagtggggaatagttgaatttttattttttattttttattttttgagacagagtc

SEQ ID NO: 53800 - DNA, 101 bp, Homo sapiens
cacctcggcctcccaaagtgctgggattacagatgagagccaccacacccggccctccctactgtttgaatctgcatttcccagattatgtcatgagagtg

SEQ ID NO: 53801 - DNA, 74 bp, Homo sapiens
tgcatgtaatacgttttgcaaaaaaaattctccaaatccgttgctggtctttatttgtttatgtattgcatgta

SEQ ID NO: 53802 - DNA, 106 bp, Homo sapiens
tgattttatcgtgttgattttgtatcctgcaactttactgaatttgttgatcagttctaatagttttcttgtggagtctttcaggttttacaaatacagatcatac

SEQ ID NO: 53803 - DNA, 102 bp, Homo sapiens
tatatatacgtatatgtgtatatatatgtatatatatatgtatatatatacgtatatgtgtatatatatgtatatatatacgtatatgtgtatatatatata

SEQ ID NO: 53804 - DNA, 95 bp, Homo sapiens; identical to SEQ ID NO: 68

SEQ ID NO: 53805 - DNA, 93 bp, Homo sapiens; identical to SEQ ID NO: 69

SEQ ID NO: 53806 - DNA, 95 bp, Homo sapiens; identical to SEQ ID NO: 68

SEQ ID NO: 53807 - DNA, 93 bp, Homo sapiens; identical to SEQ ID NO: 69

SEQ ID NO: 53808 - DNA, 93 bp, Homo sapiens
tgtgatatatgtgtatatatatacacacatatatacacatacactcatatatgtatgtatgtatatctgtgtatatatatatatacacacaca

SEQ ID NO: 53809 - DNA, 108 bp, Homo sapiens
atactgtattggatatgtgactctggatgtggcatgcaatattattttatttgaattcaactgggcatctcatatttttatctgcaaaatctggcaaccctacggtgt

SEQ ID NO: 53810 - DNA, 95 bp, Homo sapiens; identical to SEQ ID NO: 68

SEQ ID NO: 53811 - DNA, 93 bp, Homo sapiens; identical to SEQ ID NO: 69

SEQ ID NO: 53812 - DNA, 129 bp, Homo sapiens
tataatatatacgtatatacatatgtatacatgtatatacgtatataatatacatgtatatatgtatatacatgtatattataattatatacgtatatacatgtatatgtatattatatctatatacgt

SEQ ID NO: 53813 - DNA, 121 bp, Homo sapiens
gccagggtaccagggagggacaatctctttttttttttttttgagacagagtctctctctgtcgcccaggctggagtgcagtggtgcaatctcggctcactgcaagctccgcctcctgggt

SEQ ID NO: 53814 - DNA, 58 bp, Homo sapiens
tgagacggagtctcactctgtcacccaggcttgggtgcagtggtgtgatctcgtctca

SEQ ID NO: 53815 - DNA, 58 bp, Homo sapiens; identical to SEQ ID NO: 18579

SEQ ID NO: 53816 - DNA, 87 bp, Homo sapiens
ttaacttgtgcccaatcttgtcagaaccttgttgagttgtgatacaacacactgagctgatgaaaagagctgaggcaacagagggag

SEQ ID NO: 53817 - DNA, 81 bp, Homo sapiens
tttggcttggtggtgcatgcctgtgatcccagctattcaggaggctgaggtggaaggatcacttgaggccaggaggtcaag

SEQ ID NO: 53818 - DNA, 101 bp, Homo sapiens
gctaaattccaaagtggagagtaaggtaataaaagcaggttttgcaatggacatgaatgagcactgattttgttgcacttaaataaccaccgacttgcagc

SEQ ID NO: 53819 - DNA, 84 bp, Homo sapiens
caatatatgatgcatttttagtaaatttttctataagctgtgaggcatgtattgaagtttgtattttggacatgcatctagttg

SEQ ID NO: 53820 - DNA, 95 bp, Homo sapiens; identical to SEQ ID NO: 68

SEQ ID NO: 53821 - DNA, 93 bp, Homo sapiens; identical to SEQ ID NO: 69

SEQ ID NO: 53822 - DNA, 112 bp, Homo sapiens
aagtatatatgtacatatatacatatatacacatatatgtgtgtatatatacatatatacatatatatacacatatatatgtgtgtatatatatgtatgtatatagtttctt

SEQ ID NO: 53823 - DNA, 85 bp, Homo sapiens
ggtgtgggagcagtctgggaaaagtgtgtccttagcacgaatcatgaatgtaagggtagactgactcagtgactgcttccttgct

SEQ ID NO: 53824 - DNA, 68 bp, Homo sapiens
gatgccctgatctgagtcccagttgggcaggctctattgctcagtgctgtagctgtctccagggcatt

SEQ ID NO: 53825 - DNA, 67 bp, Homo sapiens
cctcccaattctcagtgagatgggagtgaggactgttattcccattttacagatgagaaaactgagg

SEQ ID NO: 53826 - DNA, 74 bp, Homo sapiens
ttctctctctctctcattcacttgagccaggtccacaagtatttgactttggtgtgaaagagtttcagagtgaa

SEQ ID NO: 53827 - DNA, 95 bp, Homo sapiens; identical to SEQ ID NO: 68

SEQ ID NO: 53828 - DNA, 93 bp, Homo sapiens; identical to SEQ ID NO: 69

SEQ ID NO: 53829 - DNA, 79 bp, Homo sapiens
ccggtagaagtattgaggaccttcatgccaaagctgtctcacagcctctgacactgccatggcatggatctgttgccgg

SEQ ID NO: 53830 - DNA, 115 bp, Homo sapiens
gattgccatctctaccaaatatatatgttcatatatatatatatatatatatatatatatatatatatatatatatatatatgaatcataccatttgatgtgatgtctagtaatt

SEQ ID NO: 53831 - DNA, 62 bp, Homo sapiens
tacctcctacactctatgtgtatatatacatatatatatatatagagagaaagtagcaggta

SEQ ID NO: 53832 - DNA, 109 bp, Homo sapiens
actggcttgtattgccattggcaagttgcctggctctttgggccccagtcttctgtattttttttaaaaaatgggggatgataggccgggcgcggtggctcacgcctgt

SEQ ID NO: 53833 - DNA, 71 bp, Homo sapiens
tacactgttagtcactctcttatactgccttccagctgtctgctggggcaaggcagaggatgtgtggtgtg

SEQ ID NO: 53834 - DNA, 110 bp, Homo sapiens
agtctgggcaacagagcgagaccctgcctcttaaatatataaatatatattttatatatatatatatgtattttttttttgagacagagtctcgctctgtcacccaggct

SEQ ID NO: 53835 - DNA, 119 bp, Homo sapiens
catgtgatgtaactcctgtcattgattggtacagtgtgggagtgaaagggcaaggcagtcagtgtgtccgtcagtcctgggtgtgcctggaacaggtctggtttatgtctgttgtcatg

SEQ ID NO: 53836 - DNA, 75 bp, Homo sapiens
ggcaacatggcaagtactgtatttttctatttgatgattcaattagctagaaaaagcatgactttggtggaagcc

SEQ ID NO: 53837 - DNA, 86 bp, Homo sapiens
tggaatgagctaagcctggcagtaaaagtttctaggaagcctgggtgacttctagtaactctctgcttgatcttactcattgacca

SEQ ID NO: 53838 - DNA, 76 bp, Homo sapiens
ggaggctgaggtaggaggatcacttgagctctggagaacgaagctacagtgaccggtgatcataccactgcactcc

SEQ ID NO: 53839 - DNA, 131 bp, Homo sapiens
ttatatatataccgtgtatgtaatattaaatatatatatatatatacacacacgatgtttttatatatgtgtgtacataatgtatgcatacgtgtgtatgtgaaacctgtgtgtatatacatatattttaa

SEQ ID NO: 53840 - DNA, 95 bp, Homo sapiens; identical to SEQ ID NO: 68

SEQ ID NO: 53841 - DNA, 93 bp, Homo sapiens; identical to SEQ ID NO: 69

SEQ ID NO: 53842 - DNA, 229 bp, Homo sapiens
tatatataatatatattatataatatataatatataatatattatataatatatataatatattatatatatattatatatcatatattatatatatacacatatatacatatatgtgtatatataatacatatacatgtgtgtatgtgtgtatatatacatatgtgtgtatatatatgtgtgtgtgtatatatgtctttttgtgcatatgttatgtatggtttatata

SEQ ID NO: 53843 - DNA, 90 bp, Homo sapiens
tgcgggctcttttttggttccatatgaaatttaaagtagtttttttccaattctattaagaaagtcagtggtagcttgatgggggtagca

SEQ ID NO: 53844 - DNA, 109 bp, Homo sapiens
gcagtgaatgagctcctttctactctgttgttttggaatgaaaagatattttatctgccagagtggagacatgctttgaatgtctgttatttctgccaggtgagtttct

SEQ ID NO: 53845 - DNA, 115 bp, Homo sapiens
tgggtgtacaaatatctctttgagactctgctttcaattattattattattattattattattattattattattattattattattttgagacagagtctccctctgtcaccca

SEQ ID NO: 53846 - DNA, 92 bp, Homo sapiens
cctgtttcattctctatatgtttgtttttgtaccagtaacatgctgttttggttacaaaacaaactaaccttgtagtatagtttgaagttgg

SEQ ID NO: 53847 - DNA, 63 bp, Homo sapiens
tatgtatacaatattatgtatataatattatgttaatattatgtatataatattatgtatata

SEQ ID NO: 53848 - DNA, 114 bp, Homo sapiens
tggctagtctgccgtgatatccagtgtgccacacaaatactctctttttctttttttatattattattatactttaagttttagggtacatgtgcacaatgtgcaggttagtta

SEQ ID NO: 53849 - DNA, 100 bp, Homo sapiens
ttggttttatttaaaaggttgttgatgtttttttgaccagacatatgctgtgagaactttactctatttgtttatatcaattaacctgtggtaaaattgg

SEQ ID NO: 53850 - DNA, 106 bp, Homo sapiens
tggtatcatattcatagagtggaactatcattagaagcatttgaaatgtttggtatttcacctcaagtgtaatcataatggtaaagattcttaatattggtgacta

SEQ ID NO: 53851 - DNA, 78 bp, Homo sapiens
gtggtactgggcagggaccagttgagggatcttactgcatggagcggcttccaactcaccttgtctctctctttctgc

SEQ ID NO: 53852 - DNA, 116 bp, Homo sapiens
ggttcacaataaggtttgcgctcctatgagagtctaatgccgccgctgatctgacaagagagagagctcaggcgataatgctcactcactggccactcatctcctactgtgtagcc

SEQ ID NO: 53853 - DNA, 114 bp, Homo sapiens
agggttcctgtttctccatatcatcaccagcatttgtcattatgtctttttaattataaccattctagtaattgtggagaggtatctcattgtgcttttgatttgcatttccct

SEQ ID NO: 53854 - DNA, 113 bp, Homo sapiens
tcagtggttgttagtagtagtgtaaatggtaaaagcagtagtagaattgttattgtttattaataacaacaataaatttagtattatttattctcagcctgataaatcagtga

SEQ ID NO: 53855 - DNA, 86 bp, Homo sapiens
gcaaattgagtagaatgtctgtgagagtacactggaattcagcaagaaaatgacagactctctgagacacaaaagcttgagatggc

SEQ ID NO: 53856 - DNA, 89 bp, Homo sapiens
ttagagtctgcattgggtctaggtctcattgagagcagacagagagcacactgtgcaacctctagattcggcattgggcctaggtctca

SEQ ID NO: 53857 - DNA, 88 bp, Homo sapiens
tagatatgtgtgtgtatatatatgtatatgtgtgtgtatatatatatatatatatatatatatatatatatatacacacacatacata

SEQ ID NO: 53858 - DNA, 79 bp, Homo sapiens
agagcctggacttactggaggagaggaaaacccacaaatgggcaaacctgtttggcactctctctcggtctctctctct

SEQ ID NO: 53859 - DNA, 74 bp, Homo sapiens
gtgtcttcctcctcactggctctctctcaggtcgtttgcgcagagggaaatttacagccatgtcatgaggacat

SEQ ID NO: 53860 - DNA, 112 bp, Homo sapiens
tttattttgcttttgcgtatatatatgtatgtatgtgtctgtgtgtgtgtgtatatatatatatatacatagagagagagttatataattatggtcagattttcagagtaaa

SEQ ID NO: 53861 - DNA, 76 bp, Homo sapiens
ctcattgatctatcttatgctatgaatagatgttttgcttatgcatgatttttaacttcatgcattgatcagttgg

SEQ ID NO: 53862 - DNA, 76 bp, Homo sapiens
attactaccctatattaaatatataggaagtgttttcttaagagagaatattttttattattggaggattagtaat

SEQ ID NO: 53863 - DNA, 95 bp, Homo sapiens; identical to SEQ ID NO: 68

SEQ ID NO: 53864 - DNA, 93 bp, Homo sapiens; identical to SEQ ID NO: 69

SEQ ID NO: 53865 - DNA, 89 bp, Homo sapiens
ctaggtattctgacttcatggctattttcctctataaagaaacaatatatattttttgagagggagttttgctctgtcacccaggctgg

SEQ ID NO: 53866 - DNA, 95 bp, Homo sapiens; identical to SEQ ID NO: 68

SEQ ID NO: 53867 - DNA, 93 bp, Homo sapiens; identical to SEQ ID NO: 69

SEQ ID NO: 53868 - DNA, 95 bp, Homo sapiens; identical to SEQ ID NO: 68

SEQ ID NO: 53869 - DNA, 93 bp, Homo sapiens; identical to SEQ ID NO: 69

SEQ ID NO: 53870 - DNA, 111 bp, Homo sapiens
tgatttctgtgtgagtcttcatgtcagttattggtggggatttttcttctagatatttataatattttgaatggaatttcaatcacactctacatgctgtctcatagtcgg

SEQ ID NO: 53871 - DNA, 74 bp, Homo sapiens
tcattgtatttttgtttgggtccaggagatacagaccctattgtctttgtctgcctgctccaggtgaacagtgg

SEQ ID NO: 53872 - DNA, 81 bp, Homo sapiens
agcaggcaaagatagagcttgtgcagagaaactcccgtttttgtttttttgtgggtttttgtttgtttgtttttgtttgtt

SEQ ID NO: 53873 - DNA, 81 bp, Homo sapiens; identical to SEQ ID NO: 53872

SEQ ID NO: 53874 - DNA, 92 bp, Homo sapiens
gttacagcttgtttttttgagagaatcaaatgagtttacttttgttcctgttgtttgtaaactagtttgtagtttaaagatggaagctaagc

SEQ ID NO: 53875 - DNA, 110 bp, Homo sapiens
gcatctgtgtgtttgagtatatatgtgaccatgctcctgtttgagattttgttaatgtgtaggtgagggtgaatgggttagtggaaacatttgagtttttatactggtgt

SEQ ID NO: 53876 - DNA, 107 bp, Homo sapiens
gtagaatgtgagtgaatttgtaagtgtgtgcaaatgactatatgtgattatatatattcacacatatagtcatttgcctaaatgcttacatacacacacatatagac

SEQ ID NO: 53877 - DNA, 105 bp, Homo sapiens
tctgccatcaaactcaatgtatcattatggcagccacagaagtttgctgtttggatctcccttcaagcaagaacttgccattcagcaaggagtgaagtgagctga

SEQ ID NO: 53878 - DNA, 95 bp, Homo sapiens; identical to SEQ ID NO: 68

SEQ ID NO: 53879 - DNA, 93 bp, Homo sapiens; identical to SEQ ID NO: 69

SEQ ID NO: 53880 - DNA, 70 bp, Homo sapiens
ttgttttgagatggagtctcactctgtcacccaggctggagtgcagtggtgcgatctcagctcacagcag

SEQ ID NO: 53881 - DNA, 58 bp, Homo sapiens; identical to SEQ ID NO: 2051

SEQ ID NO: 53882 - DNA, 109 bp, Homo sapiens
cttccattcttgagatgaacttcacttcaccatgatgtataattatttttatatatttatagatttgcaaatatcatggtgaagatttttatatctataatcatgaaag

SEQ ID NO: 53883 - DNA, 96 bp, Homo sapiens
tgtgtgtgtgtgtgtggtagaaacacttaagatcaactctcttagcaaatttcaagtaggtagtaaagtgttaactatagtcaccatgctgcacat

SEQ ID NO: 53884 - DNA, 84 bp, Homo sapiens
gggtcgcagaggctagacctctaggagcagaagacacagagcagtgaagatgagacctggagctctggctgcagtgagaaaccc

SEQ ID NO: 53885 - DNA, 103 bp, Homo sapiens
tgtcagactgataccagaccccagctttgttctctggctcctcgagagtaggaacctgctgcactggaggggccaatttgctcctggactgttggtcacgaca

SEQ ID NO: 53886 - DNA, 73 bp, Homo sapiens
ggagtctcactctgtcacccaggctggagtgcagccactgcaacctctgcctcccaggttcaagtgattctcc

SEQ ID NO: 53887 - DNA, 66 bp, Homo sapiens
tgagacaggatctctcactctgtcacccaggctggagggcagtgatagtgatgtgattatagctca

SEQ ID NO: 53888 - DNA, 95 bp, Homo sapiens; identical to SEQ ID NO: 68

SEQ ID NO: 53889 - DNA, 93 bp, Homo sapiens; identical to SEQ ID NO: 69

SEQ ID NO: 53890 - DNA, 91 bp, Homo sapiens
gaattgctggcaagggtgtggagaaaaagggaactttttttttgttttgaaacagggtttccgtctgttgcccaggctatagtgcagtggc

SEQ ID NO: 53891 - DNA, 73 bp, Homo sapiens
gcacaatgtatagtagtgtgtgtacatgtatatataaatatatgtgcatgtctctatcacatctgtaatgtgc

SEQ ID NO: 53892 - DNA, 101 bp, Homo sapiens
ttaggttgttgatttctaatttaattatattgcgattggagaacatcctttgtatgattgtcaatatttttaaattcactgaggtttgttttacaacctaa

SEQ ID NO: 53893 - DNA, 93 bp, Homo sapiens
tatctgtatctttgcatctaaagtgtgttttatatatatatatattatatatatatatatatataatatatatatatagattaactacaggta

SEQ ID NO: 53894 - DNA, 86 bp, Homo sapiens
tctttgttctagacaatgtaaagaaactcgctcttgcgttttgacaaggagcgtatgtctatttatatatatggcgagaacggtga

SEQ ID NO: 53895 - DNA, 70 bp, Homo sapiens
tgggatacatcccctctgcatatatacacacgtaagtgcagacttgtatgtatgtatgaatgtatccaca

SEQ ID NO: 53896 - DNA, 78 bp, Homo sapiens
gaagaactggagttgctgcagtttcaatgactaccaactcagaagacagatgtgtgactgcagcattgccatcaagtc

SEQ ID NO: 53897 - DNA, 88 bp, Homo sapiens
ttaattgttacttaatctctctgagtctgtatcttcatttttaaaatgagggataatatctatcttttaggggttttgtaaggattaa

SEQ ID NO: 53898 - DNA, 185 bp, Homo sapiens
tgtagtcatatatatatatatatctgaatatatatatatctgaatatatatatatatatctgaatatatatatatctgaatatatatatatatctgaatatatatatatatctgaatatatatatatatatctgaatatatatatatatatatatatatatctgaatatatatatatattcaaga

SEQ ID NO: 53899 - DNA, 95 bp, Homo sapiens; identical to SEQ ID NO: 68

SEQ ID NO: 53900 - DNA, 93 bp, Homo sapiens; identical to SEQ ID NO: 69

SEQ ID NO: 53901 - DNA, 94 bp, Homo sapiens
catctgtattacatatatacacttgtacaccacacatacatatatataattaaatattagtagtatgagcaggcatataaatgtaatacatttg

SEQ ID NO: 53902 - DNA, 118 bp, Homo sapiens
attgactgtgctagcattctcccacctcctacttgttctaagtattcttttatttttttaaatccaggactgagtgagcaaccaggacccagaaaagcttgctagcataatcctcagt

SEQ ID NO: 53903 - DNA, 83 bp, Homo sapiens
gttcttctctgctcccctcagtactaggaatgtaactttttattttcaaagctactgctgagctagggaggagggagtggaat

SEQ ID NO: 53904 - DNA, 108 bp, Homo sapiens
ttgcatcaatgttcatcaggtttattggcctattgctttttaaaatacgtctttgtctggttttgatatcagagtaatactggcctcataaaatgagtttggaagtaa

SEQ ID NO: 53905 - DNA, 120 bp, Homo sapiens
gagtatatgtagagcattagggacagtatttggtacacagtaagcatcaataaatagatgatgatgatgatgatggtgatgatgatgatggtatctgactggctaacttggcattgcctc

SEQ ID NO: 53906 - DNA, 122 bp, Homo sapiens
gtgtggtctttgcatggggctgactgtgtggctgagcgccgggtatgttgtgcggctgtgtgtgcgtgtgtgtgcgcctccgtgtccgcttgtgaacatggccccgggaaccacgcacatgc

SEQ ID NO: 53907 - DNA, 102 bp, Homo sapiens
ggatgagtttttaatgagagcagcaggtatcatggttagattaaaggaggaactttctcactttctcacagtaagaggccatctgctctgttttttttttcc

SEQ ID NO: 53908 - DNA, 97 bp, Homo sapiens
gtgctgtgtctgggagagtagtgtggagggaatagaggagagcctatctcaagacatatctatttcttttttctttttctttttttagacactgtat

SEQ ID NO: 53909 - DNA, 96 bp, Homo sapiens
gcagctaaagtatccttaagaccaatacaataatcatggttttttttttttttttaaatgagacagggttttggtcttgaactcttggcttcaagc

SEQ ID NO: 53910 - DNA, 96 bp, Homo sapiens
cccagctgtttccatgctttggaacgaatgagtatgggatgcgagcaaggcattggcagctcagtctctctcagcctcagtatggagtaggagggg

SEQ ID NO: 53911 - DNA, 112 bp, Homo sapiens
gtatgaacttgctgttgctgggaagcatgctaaacacagaatttattttattttattttattattatactttaagttttagggtacatgtgcacaatgtgcaggtttgttac

SEQ ID NO: 53912 - DNA, 95 bp, Homo sapiens; identical to SEQ ID NO: 68

SEQ ID NO: 53913 - DNA, 93 bp, Homo sapiens; identical to SEQ ID NO: 69

SEQ ID NO: 53914 - DNA, 93 bp, Homo sapiens
tctggattgacactgacagatatctcaggaggtgactttatatatatatatttatttatttatttgagacagagtctggctctgtcgcccagg

SEQ ID NO: 53915 - DNA, 58 bp, Homo sapiens
ggtcttagtagggttggctgggaggctgggacctctctgtctctctctctacatgact

SEQ ID NO: 53916 - DNA, 63 bp, Homo sapiens
ttgagacagagtctcgctctctcgctctgtctcccaggctggagtgcaatgacttgatctcgg

SEQ ID NO: 53917 - DNA, 81 bp, Homo sapiens
tctcagctggcaccaatatcaaagagggatttagggctagcaggcctgacgctctgagtgagtggcagccatacagctgga

SEQ ID NO: 53918 - DNA, 87 bp, Homo sapiens
atggatggcaagaatgacttctaaggtggttgctcagttctgacagtctcagtctcgatctcctcagatgcagctatttgcaaccat

SEQ ID NO: 53919 - DNA, 123 bp, Homo sapiens
tatagatatctatagatctatatatagatatctatatatagatctatagatatctatatatatagatctatagatatctatatttatatatagatatctagatatctatatatagagagatat

SEQ ID NO: 53920 - DNA, 123 bp, Homo sapiens
atatctctctatatatagatatctagatatctatatataaatatagatatctatagatctatatatatagatatctatagatctatatatagatatctatatatagatctatagatatctata

SEQ ID NO: 53921 - DNA, 126 bp, Homo sapiens
gtgtatatatatatatacacacatgtatgtgtgtgcatatgtgtatatgtatgtgtatatgagtgtatatatatgtgtatatatgtatattatgtgtatatatgtgtgtatattatgtgtatatat

SEQ ID NO: 53922 - DNA, 106 bp, Homo sapiens
gcatgtcaccttccaaacaattgacttgagagtgaactttgagagctcagcctgtctgcagcttggaggctccctgtatgtcaatatatggagtggtcacaaaggc

SEQ ID NO: 53923 - DNA, 125 bp, Homo sapiens
gagtgaccactaatgagtataaggcttcctttttttttttttttgagatggagtctcactctgtcactcaggctggagtatgcagtgatgcaatcttggctcaatgcaatctctgcctatcgggt

SEQ ID NO: 53924 - DNA, 115 bp, Homo sapiens
gatgtcttttatttttttcttgcttaattgctctgtctaggacttctagtagtatgttgaatagaagtggtgagagtgggcatccttgtgttgttcctgatcttagagaaaaaga

SEQ ID NO: 53925 - DNA, 105 bp, Homo sapiens
agatgtttgtacagccagtttttttaagtgagacaaggtatttttcttttagaatttacaggtgcttgaaagttgttggccagtattttgtagcttataacatct

SEQ ID NO: 53926 - DNA, 86 bp, Homo sapiens
ttgtaagtaagagtaactgcatctggatgtgtttttattatacaattctatgtgtatctttagatgcagtgaaattcagattgcag

SEQ ID NO: 53927 - DNA, 58 bp, Homo sapiens
cacaagaggcaggactccagcaatcttcactctttgttcttctgtgctgtctcctgtg

SEQ ID NO: 53928 - DNA, 70 bp, Homo sapiens
tacagcgggatgattgcaggtccagtgtctttttctctgcaatatctgcaagtgtctgtgtctctctgtg

SEQ ID NO: 53929 - DNA, 81 bp, Homo sapiens
tacatatatatgtgtgaatatatatatgtgtgtgtgtgtatataacatacatacacacacacacacacacatatatatgta

SEQ ID NO: 53930 - DNA, 98 bp, Homo sapiens
gttggggagaagcttgagcagagtgtgaccacaccggcagcctgcctctcaggcgagcatgcctccaaggacccatggccaagtgtcttttactcagc

SEQ ID NO: 53931 - DNA, 63 bp, Homo sapiens
gctaagactagtgtctgagagcttgtagacctagctagctctcacctctctctgtgtctaagt

SEQ ID NO: 53932 - DNA, 108 bp, Homo sapiens
tatctatctatccatccctctctctgtccatcaatccatcctatttttaaatttttattttaagttctggggtacatgcacaggacgtgtaggtttgttacataggta

SEQ ID NO: 53933 - DNA, 61 bp, Homo sapiens
ttgcttggtgtgatcagagaagagtgatagctctcttatcattctcctgtgaattaagcaa

SEQ ID NO: 53934 - DNA, 95 bp, Homo sapiens; identical to SEQ ID NO: 68

SEQ ID NO: 53935 - DNA, 93 bp, Homo sapiens; identical to SEQ ID NO: 69

SEQ ID NO: 53936 - DNA, 108 bp, Homo sapiens
ggtggcctgtggtgtgtgggaaagcaaggaaggtcaaagtcatgggtatctttgtagcaccagactgaagattgtgtgcttgctgtgttcctagcactaatgcttgcc

SEQ ID NO: 53937 - DNA, 68 bp, Homo sapiens
gtatgtatgtgtatatatatgtgtgtgtttctgtatatatttatacacatacatatatacatacacac

SEQ ID NO: 53938 - DNA, 95 bp, Homo sapiens
ctttgtgcactgtctggtcccagagtaggtgctcagtaaatggtggctggtgttctctcactcactcttacacttactctgaaaagagcacaaag

SEQ ID NO: 53939 - DNA, 95 bp, Homo sapiens; identical to SEQ ID NO: 580

SEQ ID NO: 53940 - DNA, 93 bp, Homo sapiens; identical to SEQ ID NO: 69

SEQ ID NO: 53941 - DNA, 115 bp, Homo sapiens
ttctacagcaatttcagcttttgttttctaaaccaagtgtccatattagtactttacagtagtgagtgagaaaagctgggtgcctagaaaacataatgacctgcaattgctagaa

SEQ ID NO: 53942 - DNA, 102 bp, Homo sapiens
tatcttggagaaagttcgtgggcttttgaatagaatgtgtattctgtggttgttggatggaatgttctgtatatatctgttaagtccatttgttccaaggta

SEQ ID NO: 53943 - DNA, 93 bp, Homo sapiens
agaggtccttcatgtcccttgtaagttggattcctaggtattttattttctttgaagcaattgtgaatgggagttcactgatgatttgcctct

SEQ ID NO: 53944 - DNA, 95 bp, Homo sapiens
tatatgaatgtgcccatttctacatattcaatcatccttgagtatttctatatttttcatggctaaactgatgtgtgagaagtggttttcttata

SEQ ID NO: 53945 - DNA, 115 bp, Homo sapiens
gagcttatttttttcttgctaatttgagttccttgtagattctggatattattccttttttggatgtatagtttgcaaagattttctcccagtctgtgggattgtctgtttgctc

SEQ ID NO: 53946 - DNA, 66 bp, Homo sapiens
ttgagcctatgtgtgtctctgtatgtgagatgtgtctcctgaatacagcacgctgatgggtcttga

SEQ ID NO: 53947 - DNA, 93 bp, Homo sapiens; identical to SEQ ID NO: 69

SEQ ID NO: 53948 - DNA, 91 bp, Homo sapiens
tggtctgtgtccatttttgtagagtactatgctgtttgggttactgtagccttatagtacagtttgaagtcgcgtaatctgatgctggtca

SEQ ID NO: 53949 - DNA, 82 bp, Homo sapiens
gacttgcctttctagcctggctcagagctcagtggaacaaaaggcacatgagatgtgagaacacagaatgcagaggcaggcc

SEQ ID NO: 53950 - DNA, 97 bp, Homo sapiens
ctcgtatatacatatatacgagtatatatatgagtatatatatacgagtatatatatacatatatacgagtatatatatatactcgtatatatatac

SEQ ID NO: 53951 - DNA, 79 bp, Homo sapiens
ggccacatcttttgtcccattagaaaattggagatttggtgagaaaccaagccagaagccagtgagtacagattgggtc

SEQ ID NO: 53952 - DNA, 74 bp, Homo sapiens
atatatatatgtgtgtgtgtatatatgtgcgtgtgtatatatatgtgtatatatatatgtgcgtgtatatatgt

SEQ ID NO: 53953 - DNA, 68 bp, Homo sapiens
gtgcagctctatggaagttggttgaattgaactgagttgagtttggctagttgccaaaggacagacac

SEQ ID NO: 53954 - DNA, 102 bp, Homo sapiens
caaaagaggtaaaggagttattgagggggatgggagagcagtgggtctcaccctcactgaatccttctcttttcagccttactccctccttctgttgtacct

SEQ ID NO: 53955 - DNA, 110 bp, Homo sapiens
tggctgtcttgtgtgactgactagtttgctgtggtcagacattgtctctgtgtctgaacatggctttggtcctgaccatgggggattcagagatacaaataaaacagtta

SEQ ID NO: 53956 - DNA, 136 bp, Homo sapiens
ttcagcaaagagtaatggtctgaagaggcctattctttttttttttttttttttttttgagtcggtgtctcactctgttgctcaggctggagtgcagtggcacgatctcggctcactgaaagctccgcctcccagg

SEQ ID NO: 53957 - DNA, 68 bp, Homo sapiens
gggtgtggtggtgtgcacctatggttccagctactcaggaggctgaggtaggaggatcacttgagccc

SEQ ID NO: 53958 - DNA, 89 bp, Homo sapiens
ttttggctctgccatttcctagctggtgatgtgggatgaatgactccttcactctcagtatctttagctctgaaatggggacactaaga

SEQ ID NO: 53959 - DNA, 102 bp, Homo sapiens
gtataatgactagatgctaatcatccctgtctctctgacagtcattccagatttatcgtttcaggagtgggggaagagggaggataaggatctttatcctac

SEQ ID NO: 53960 - DNA, 105 bp, Homo sapiens
gcctgtgaattgaattgtctttgccaatcgaccagctgtgtttgcagaaagactctgactgactgtgttctggctgttgctagcaaagagacatttcattcaggt

SEQ ID NO: 53961 - DNA, 114 bp, Homo sapiens
acagtccaccaggtgaagtcaggcaagtcacagactgtgggagatgtagaaggcagggcaacagtgcctgtgtcagcggcctgtgcctactgatcccagctcacaggggaatgt

SEQ ID NO: 53962 - DNA, 111 bp, Homo sapiens
agggtttctagggcaatgagactactattctgtgtaatactataatggtggatacatttcattatatatttgtcaaaactcatagaatatacaataccaaaagtgaaccct

SEQ ID NO: 53963 - DNA, 99 bp, Homo sapiens
gtgtatatgtgtacatgtctatgtcatatttgtgtgtgtgtatatgtgtttatgaatatgtatatgtgtgcatatgttgatgcatgtatatgtatgtgt

SEQ ID NO: 53964 - DNA, 87 bp, Homo sapiens
gttttgagtttcctttggttgagctatcagcttctatggaataagaaaccacaagtcagagctgggttcaatcatctcttatagaac

SEQ ID NO: 53965 - DNA, 156 bp, Homo sapiens
atatgtgtgtgtgtgtgtgtatacatatatatgtatatatatgagtatacacatgtatatatgtatacatatatacaatatatgtattgtatatatatgtattgtatatgtatatacatatatatgtatatgtatacatatatatatatatatata

SEQ ID NO: 53966 - DNA, 104 bp, Homo sapiens
gagtcagtatgtgtgtgtatatatatatatatatatatgtttctattgattatatatatgtgtgtatatatatatgtgtgtgtgtatatatatgaatactactc

SEQ ID NO: 53967 - DNA, 103 bp, Homo sapiens
gggacactattggtaataaatcatttctgcctttaatggagaaagattcattaatgaagttgtttttttctctaataataacagttattgttttactgagcct

SEQ ID NO: 53968 - DNA, 71 bp, Homo sapiens
gagaggaaattcctgcgttgaagttggtaaatttttgtgcaaaaagtaaatgtaatgcaggtatgcctgtc

SEQ ID NO: 53969 - DNA, 80 bp, Homo sapiens
ggcaagatggggaggagggggagaaggaagctagctggcaagctggctggctggctgactgactgactggctggcttgct

SEQ ID NO: 53970 - DNA, 108 bp, Homo sapiens
cagtgtgtgatgttcccctctctgtgtccatgtgttctcattgttcaactcccacttatgagtgagaacacacggtgtttggttttctcatcttgtgttacattgctg

SEQ ID NO: 53971 - DNA, 68 bp, Homo sapiens
ccttccctcacttgctgtgtgagttgggccaaatcacctaaactctctgtgcctcagtgggagagagg

SEQ ID NO: 53972 - DNA, 104 bp, Homo sapiens
ctgtctacttagctaccaggaaagtgaattaagtactgtggtttttcctttttttattaaaaaaaaatgccattttgcttcatcctctgatttgtgggtcacag

SEQ ID NO: 53973 - DNA, 114 bp, Homo sapiens
ttcttatattgattatatgttgaaatgctgaaaatttgaatatattggcttaataaatatattattaaaatttatttcacctattttttacattttaatatgtggttactagaa

SEQ ID NO: 53974 - DNA, 95 bp, Homo sapiens; identical to SEQ ID NO: 68

SEQ ID NO: 53975 - DNA, 93 bp, Homo sapiens; identical to SEQ ID NO: 69

SEQ ID NO: 53976 - DNA, 171 bp, Homo sapiens
actgtgtgtgtgtgtatatatatgtatgtgtgtgtatgtgtatatgtatatgtatatgtgtatatatatacacacatatacgtatatatatacacacatatatatgtaaatatgtatatgtatatatacacacatacatatatgtatatgtatatatgtatatatatatac

SEQ ID NO: 53977 - DNA, 70 bp, Homo sapiens
tacatatatgtatatgtatgtatatatacacacacacatatatgtagatatacacacacacatatatgta

SEQ ID NO: 53978 - DNA, 56 bp, Homo sapiens
gagtcagagtctcactctgtcacccaggctggagtgcagtggtgtgaatttggctc

SEQ ID NO: 53979 - DNA, 101 bp, Homo sapiens
gttgctgtgaggcttaaatgggataatggttgtaaagtatttggcacagtgcctggcacagaataagtaataaatattagctaagtggcacacatagtaac

SEQ ID NO: 53980 - DNA, 109 bp, Homo sapiens
cttaagtgatcctgtgaagaggaagtgccaggtaaactgggatcagtttctgaatctgtctgtatctctctttaccttgagaatttacctttgttcactctagctctgg

SEQ ID NO: 53981 - DNA, 79 bp, Homo sapiens
atgtttatacctatagtcacatgagatagttgtagttttcttttcctgtgatgccttcatgtggttttggtatcaaggt

SEQ ID NO: 53982 - DNA, 95 bp, Homo sapiens; identical to SEQ ID NO: 68

SEQ ID NO: 53983 - DNA, 93 bp, Homo sapiens; identical to SEQ ID NO: 69

SEQ ID NO: 53984 - DNA, 58 bp, Homo sapiens; identical to SEQ ID NO: 2540

SEQ ID NO: 53985 - DNA, 97 bp, Homo sapiens
tatatccatatatccatatatttgcatatatatccatatatatacatatatatacatatatccatatatatatgcatcatatatatatatgcatata

SEQ ID NO: 53986 - DNA, 119 bp, Homo sapiens
tatatggatatatatatatatcccccatatatatccagatagccatatatatatgcatatatatatccatatatatgcatatatccatatatctgcatatatatgcatatatccatata

SEQ ID NO: 53987 - DNA, 148 bp, Homo sapiens
tatatggatatatgcatatatatgcagatatatggatatatgcatatatatggatatatatatgcatatatatatggctatctggatatatatgggggatatatatatatatccatatatatatacccatatatatatatggagggtt

SEQ ID NO: 53988 - DNA, 67 bp, Homo sapiens
tttgaggtgagttctcactctgtcacccaagacagggtgcagtggtgcaatcatagctcacttcaag

SEQ ID NO: 53989 - DNA, 95 bp, Homo sapiens
ggagcatagtgagcaagggaatataatagaagatgaagttgggtgggggtagcttatgtaagagttctgattttattcatgtttattgagaagcc

SEQ ID NO: 53990 - DNA, 101 bp, Homo sapiens
acatttattgtatgtttttgttccaggcactgtgctaagcacttttttttttttttttgagacaaagtctcgctcttgcccaggctggagtgcaatgatgt

SEQ ID NO: 53991 - DNA, 79 bp, Homo sapiens
cgttggctggcactcctggaagtgaggttcccctgtctccttgcccccatatccacacatctgggagcagccatcaatg

SEQ ID NO: 53992 - DNA, 92 bp, Homo sapiens
tctatctatgtgtgtgtgtatatatgtatgtgtgtatatatatatattttatatatatatgtatatatatatatatgtatattttagatgga

SEQ ID NO: 53993 - DNA, 115 bp, Homo sapiens
tgatactaattgtatggcattgcagaaggtacttattctctctaaacctgagtttattcatttatattttgaggatgatgttgacacctatctcaagtggatgccataataatca

SEQ ID NO: 53994 - DNA, 102 bp, Homo sapiens
tgtatttacacgcgttcaacaacagattttgttaatgacaccttttttttgttttttgtttttttaaacagagtttcgctttgttgcccgggatggagtgca

SEQ ID NO: 53995 - DNA, 58 bp, Homo sapiens; identical to SEQ ID NO: 1265

SEQ ID NO: 53996 - DNA, 79 bp, Homo sapiens
accaagtctgtattttgtctctccttttctagaatataacctttgagtagaggaggaaacagaagatagaaagcagggt

SEQ ID NO: 53997 - DNA, 92 bp, Homo sapiens
gtaagacattcttagacaaaagctgaggaagtttgttgtttactgacctgtccaacaatagatgctaaagggagtccttgagattggattgc

SEQ ID NO: 53998 - DNA, 85 bp, Homo sapiens
cttgcctgaggttagaggatagtgacagagaaggctccaattgtgtcttgctggtctgtgactgactctgtgggacctcaggaag

SEQ ID NO: 53999 - DNA, 110 bp, Homo sapiens
taagtcatgatggcatcttccaattgtaccctccaggacagttactgatttatagtgatgtgtaactctctctcacagagtatctacttgggtgtggcttcatcctctta

SEQ ID NO: 54000 - DNA, 104 bp, Homo sapiens
tgagggtgaggagagcagagaaggatagggcagactacattgcatgacagattcctgtcctcagtgtgtctgtcttagtgaactcaaaatctctttcaggctca

SEQ ID NO: 54001 - DNA, 76 bp, Homo sapiens
tgaggcacagacacactcagataattcagctagtaagtggtaaaaccaggcagtctgattctgtggtctttgctca

SEQ ID NO: 54002 - DNA, 83 bp, Homo sapiens
gctcccttagcataaccatatggatgacaagcgcaactgtctcatgcagacagtcagattgactctgtggtattggggaaggc

SEQ ID NO: 54003 - DNA, 88 bp, Homo sapiens
ggtccacttggtctacagtgcagattaagttcaatgtttctttattgattttctatctggataagctgtccaatactgaaagtgggtt

SEQ ID NO: 54004 - DNA, 106 bp, Homo sapiens
agtctatcttgatgaatgttccatgtgatcttaagaagaatgtagatcctgctgtcaggtgaatttttctatagatgtcaattgtatagagtcgtttgatggtgct

SEQ ID NO: 54005 - DNA, 95 bp, Homo sapiens; identical to SEQ ID NO: 68

SEQ ID NO: 54006 - DNA, 93 bp, Homo sapiens; identical to SEQ ID NO: 69

SEQ ID NO: 54007 - DNA, 117 bp, Homo sapiens
atatatatattcacgtatatatgttttcatatatatattcacgtatatatgaaaacatatatatgtgaatatgtatatatgaaaacatatatacgtgaatatatatatgatggaata

SEQ ID NO: 54008 - DNA, 80 bp, Homo sapiens
tgagtctggaacactttgttgttaccaagaagcttgaatactttcaagggtggtgctaactggacaaatggaccagctta

SEQ ID NO: 54009 - DNA, 104 bp, Homo sapiens
tatatatatgttcatatgtgtgtgtatcttatatatatatacacacacatctttgtatattatatatacacacaggtgtgtgtgtgtgtgtgtgtgtgtgtgtg

SEQ ID NO: 54010 - DNA, 106 bp, Homo sapiens
gcactgagcatggggcctgatacatagtaaatgctcaataaacattagttatttattattactactacaaaatagacagttgcctatgtggtatcagttcaggagt

SEQ ID NO: 54011 - DNA, 116 bp, Homo sapiens
tgaaggaagctactcctctgagagcagaggtaatgaggtgtgacattagagagacagcaccactgaagacataccctagtgacttaacacttgctagcccaggtgtagaaatttca

SEQ ID NO: 54012 - DNA, 89 bp, Homo sapiens
agcacttgctatgtacgaggcactttatgtatattaattcttggaacacctccataaaatacagtcagccttccgtatctgtaggttct

SEQ ID NO: 54013 - DNA, 90 bp, Homo sapiens
tatgtgtgtgtataacatatgcatatatatgtgtatgtatatcaaagacagcatgactatacataatatgaagatgtaatataatatata

SEQ ID NO: 54014 - DNA, 115 bp, Homo sapiens
gtcatgtagtcaattagaccaaaatgtggaggtagcaagaaggtttttttttttttttttttttttttgagatggagtcagtcttgctctgtcacccaggctggagtgcagtggc

SEQ ID NO: 54015 - DNA, 81 bp, Homo sapiens
cgaaatctgaaaacactttttttttttttgagacagagtttcgctatgtcgcccaagctggagagcagtggcatgatctcg

SEQ ID NO: 54016 - DNA, 113 bp, Homo sapiens
aacagcaatggaaaagtggtccctgttcacctcatccatgccaacatctactgttttttgattttttgattatggtaattcttgcaggagtaaagtggtatcacattgtggtt

SEQ ID NO: 54017 - DNA, 97 bp, Homo sapiens
ttgctgcattgtaagttagctctatttttagttttttgaggaacttccaaactgttctctcagtggctgtactaatttacattcccaccaacagtga

SEQ ID NO: 54018 - DNA, 134 bp, Homo sapiens
ggatttgtgggacctgtaggaagtgaactggcctcctctcctttgattgactgcagcttgttggaagtatagataaggcacttagggtctttgctgtttcattagtccaagggtatcaagggcagttccactgc

SEQ ID NO: 54019 - DNA, 80 bp, Homo sapiens
ggggataagagttgtgacttatgtgattggtgaatttggaataaggaaccagacatgtatcactcagcctctgcctctcc

SEQ ID NO: 54020 - DNA, 77 bp, Homo sapiens
tcgagctcttttttggtttcatatgaacttcagaatagtttttttctagttctgtgaagatgccattggtagtttga

SEQ ID NO: 54021 - DNA, 90 bp, Homo sapiens
gaagtgggattgctagatcatatggcgaggtctatttttaattttttgaggaccctccgtacgtttttttcatagtggttgaaccatttt

SEQ ID NO: 54022 - DNA, 93 bp, Homo sapiens
ttggtattttgattgttacactgacatggaagacatgctgccagcatcatgttacaattcactgtacagtcttctacaacaaagaattatcaa

SEQ ID NO: 54023 - DNA, 104 bp, Homo sapiens
gaatatacactggggaagggacagtctcttcaataaatggtgcttggaaaactgaatatcctttgcaatggaatgaaactagacccttttctctaatcatattc

SEQ ID NO: 54024 - DNA, 94 bp, Homo sapiens
gttgtaattagggaatgctacagaggaaagttgtgtggagcatatgggaatgaggacatcttgacacatgtcaatgtggaacaataatgacagc

SEQ ID NO: 54025 - DNA, 85 bp, Homo sapiens
gaattacctgggtgtgatggtgcacaccggtagtcctagccacttgggaggctgaggtaggaggatcacttgaacccaggagttt

SEQ ID NO: 54026 - DNA, 111 bp, Homo sapiens
agctgcttggattatgatggtggaaagatacctagagctaaggatgctgggttgagcagtaaagtttttgttctagtgaaacaatcaagaaaccaagtgagcaaagtagtt

SEQ ID NO: 54027 - DNA, 115 bp, Homo sapiens
actcacttagtgacagcagggtatgcagtttgagctctattttctttttttatttatttatgtatttattttgagacagggtctggctgtgttgcccaggctggagtacagtggt

SEQ ID NO: 54028 - DNA, 114 bp, Homo sapiens
tgaagtcaaatacaccttttgcttgattgatcttaaccagattagagaaagacagccagctttgtccattaaatttgacgtaatctcaggtagcaagaagttttgtgggtctca

SEQ ID NO: 54029 - DNA, 58 bp, Homo sapiens; identical to SEQ ID NO: 37785

SEQ ID NO: 54030 - DNA, 115 bp, Homo sapiens
ccagatctggcttcttgaccttggacataccagttttcagaactgtaagaaatatgtttatattctttaaaaattgcccagtttctggtattctgttataagcaaactaaaatgg

SEQ ID NO: 54031 - DNA, 66 bp, Homo sapiens
gcaattgacttctgaagtgagagagcagtcttgcgggactgaacccttaacccatggggtctgagc

SEQ ID NO: 54032 - DNA, 76 bp, Homo sapiens
cacacacgtatatacatatatacatacatatatatatatctatgtgtatgtatatatggccccatatatggcagtg

SEQ ID NO: 54033 - DNA, 58 bp, Homo sapiens; identical to SEQ ID NO: 37425

SEQ ID NO: 54034 - DNA, 58 bp, Homo sapiens; identical to SEQ ID NO: 1409

SEQ ID NO: 54035 - DNA, 115 bp, Homo sapiens
tttaatagcatttggtgtcatcgtattctgcataaatatttagcatttgtaatgttatcaaatgtcgggattgtttctgccaaatgagtaaaattgccattatcatgctcataaa

SEQ ID NO: 54036 - DNA, 81 bp, Homo sapiens
gaagccatctgcctggtctgagttgaggcagtcccctttggatgaagcatacaccctccactcagcctgcctcactccttc

SEQ ID NO: 54037 - DNA, 112 bp, Homo sapiens
tagatattacgataaacttagtgagttacaaatacagtaagaaaaaatatgcagtttttttgtttgtttttgtttgcttttgttttgttttgttgttattgtttttattctg

SEQ ID NO: 54038 - DNA, 112 bp, Homo sapiens
catgatgctgaatttgacagcattttggtgaggatttttgtttctatttatggttcatatggatctgtagttttattttcttgtgatgtctttgtcaggttttgttatcagg

SEQ ID NO: 54039 - DNA, 108 bp, Homo sapiens
gttttaaatttcaaggctaaccttaattttcctttgagtctgatttcactgagaacagtgagtttttggggcataggaataaggaggtaacatttgttgggaaaaagc

SEQ ID NO: 54040 - DNA, 113 bp, Homo sapiens
gagagccagggttttctttttctctgctttctcacaaattccctgcatctgtctctgtctctggggccaagtgataggaaagtaaaaagagaaagtaagcaacagactttccc

SEQ ID NO: 54041 - DNA, 95 bp, Homo sapiens; identical to SEQ ID NO: 580

SEQ ID NO: 54042 - DNA, 93 bp, Homo sapiens; identical to SEQ ID NO: 69

SEQ ID NO: 54043 - DNA, 95 bp, Homo sapiens; identical to SEQ ID NO: 68

SEQ ID NO: 54044 - DNA, 93 bp, Homo sapiens; identical to SEQ ID NO: 69

SEQ ID NO: 54045 - DNA, 119 bp, Homo sapiens
ttaaattaattttgtttgtagcatatgtttttattttgtgccaggctagaaatgaatagagacacaatttgttctgctaccacaaaatcttggacatggttatgtcaaaatcaatctaa

SEQ ID NO: 54046 - DNA, 95 bp, Homo sapiens
cactttggtctttgatttattttgagtttaccttttttttttttttttttgagagggagaggatctggctctgtggctcaggctggcaagcagtg

SEQ ID NO: 54047 - DNA, 105 bp, Homo sapiens
gtaataccttccgtaaagccttacttatgctacctattctactgtgctatagatgtatgtatatatttatatcacagtcaaagtaacaatttaggtaatgtattc

SEQ ID NO: 54048 - DNA, 102 bp, Homo sapiens
gttaaattcagacttagagttcagtcttgcctctgtggtgagtggattcaatgtattttgtttttataaccttggctacgctgctttgagtctgtcccacac

SEQ ID NO: 54049 - DNA, 95 bp, Homo sapiens; identical to SEQ ID NO: 68

SEQ ID NO: 54050 - DNA, 93 bp, Homo sapiens; identical to SEQ ID NO: 69

SEQ ID NO: 54051 - DNA, 90 bp, Homo sapiens
acttcgtataattgttgggctctgttgttaggtacatatatgtttataattgttatatgttcttgatggcttgaaatcaatagatgatgt

SEQ ID NO: 54052 - DNA, 110 bp, Homo sapiens
gctttatgtttattttgctgttcttcaagtgtcttagatggaagctcaggttattgacttgagactttttttttcttaatacaggcatttaaaatgataaacttctaagc

SEQ ID NO: 54053 - DNA, 112 bp, Homo sapiens
gggtactatattttttatgatactatagatacagattatttaatttttcaattacttgttgtgagtatatggaaataccatctatgtttgtgtgttatacgatctgttactc

SEQ ID NO: 54054 - DNA, 94 bp, Homo sapiens
tgcatattagagcacttgtcagtgtctcacagattgttgatgttttgtttatttaaaaaataaatctggctgggcacagtgactcacacctgta

SEQ ID NO: 54055 - DNA, 62 bp, Homo sapiens
tatatatatatgtatatgtgtgtgaatatatgtatatttgcacatatatggatgtgtgtgta

SEQ ID NO: 54056 - DNA, 87 bp, Homo sapiens
tgggatgttttgttttgttttgtttgatacctcagtagctaaaatggtcaactggcagaagtcattctgcaaagctttataatccca

SEQ ID NO: 54057 - DNA, 95 bp, Homo sapiens; identical to SEQ ID NO: 68

SEQ ID NO: 54058 - DNA, 93 bp, Homo sapiens; identical to SEQ ID NO: 69

SEQ ID NO: 54059 - DNA, 136 bp, Homo sapiens
tacattgatatatatatacgtatatatatacgtgtatatatatatgtatatatatgtatatatatacatatatatatacgtatatatatgtgtatatatatatgtgtgtgtgtatatatatatatatatatatata

SEQ ID NO: 54060 - DNA, 82 bp, Homo sapiens
gctcctcacaagtctatcttaccatgtatcaaggaggatcacagagtattcccccaagacttgagacagattgtggttgagc

SEQ ID NO: 54061 - DNA, 95 bp, Homo sapiens; identical to SEQ ID NO: 580

SEQ ID NO: 54062 - DNA, 93 bp, Homo sapiens; identical to SEQ ID NO: 69

SEQ ID NO: 54063 - DNA, 85 bp, Homo sapiens
agccattctgaggctcaatcatccatgggtaagtggactctcaaggttttgggcctacagagctgagagagagaacactttacct

SEQ ID NO: 54064 - DNA, 112 bp, Homo sapiens
tatacatatatttgtggaatatatattatacatgtgtgtatatatacatatataatatgtggaatatatatgtatacacatatatgtatatacacatacacatatacgtata

SEQ ID NO: 54065 - DNA, 210 bp, Homo sapiens
atgtatatatgcacatatatgtatgtatgcacatatatgtatgtatatgtatatatacatatatgtatgtatatgtatatgtatatatacatgtatgtatgcatatgtatatatacatatatgtatgcatatgtatatatacatatatgtatgtatatgtatatatacatatatgtatgtatatgtatatatacatatatgtatgtatat

SEQ ID NO: 54066 - DNA, 116 bp, Homo sapiens
tgtatatatgcatatacatgtgtacatatatgtgtatacatatacatatatacatatgtgtatatatatgtgtgtatacatatacatacatatgtatatgtatacacatatataca

SEQ ID NO: 54067 - DNA, 65 bp, Homo sapiens
gaggcgattctgtcagtgagtcagtctgttcctggagacttctcactgatgccaaggacagcttc

SEQ ID NO: 54068 - DNA, 75 bp, Homo sapiens
ttccaaagtggtgattagggtttttttgtttgtttgtttttttgacagggtctcactctgtcacccaagttggaa

SEQ ID NO: 54069 - DNA, 68 bp, Homo sapiens
gggcacagtggctcatacccataatcccagcactttgggaggcagtggtataaggatcacttgagccc

SEQ ID NO: 54070 - DNA, 96 bp, Homo sapiens
ctcacatgctctacaattttctatcctgagggtctctctctcactcaaaaaaagaaaagaaaggagaggggaataggagaaaagtggaggggtggg

SEQ ID NO: 54071 - DNA, 83 bp, Homo sapiens
tggagacagggtctcactctgtcacccaggctggagcgcagtggcacaatcagcctggctaacatggtgaaaccccgtttcta

SEQ ID NO: 54072 - DNA, 95 bp, Homo sapiens; identical to SEQ ID NO: 68

SEQ ID NO: 54073 - DNA, 93 bp, Homo sapiens; identical to SEQ ID NO: 69

SEQ ID NO: 54074 - DNA, 106 bp, Homo sapiens
gagagagagtctcactctgtcacccaggctggagtgcagtggtgtgattttttttttttttttttttgagacggagtttctctcttgttgcccaggctggagtgca

SEQ ID NO: 54075 - DNA, 105 bp, Homo sapiens
tgactttgaaaacttcatccacatgaagtaccttcttttgtttttttttagacagggtcttgctctgtcactcaggctggactgcagtggcatgatcacaggtca

SEQ ID NO: 54076 - DNA, 119 bp, Homo sapiens
atatatattcagtatatatactatatatattcagtatatatatagtatatatatatattcagtatatatatagtacatatatattcagtatatatggtacatatatattcagtatatat

SEQ ID NO: 54077 - DNA, 82 bp, Homo sapiens
ccctcttagagttcagcctgagcacacaagtcctcattagtcaggagaagggccatagtgcagcaagccaggcccaggaggg

SEQ ID NO: 54078 - DNA, 95 bp, Homo sapiens; identical to SEQ ID NO: 68

SEQ ID NO: 54079 - DNA, 93 bp, Homo sapiens; identical to SEQ ID NO: 69

SEQ ID NO: 54080 - DNA, 58 bp, Homo sapiens
tgagatggagtctcactctgtcacccaggctggagtgcagtagtgagatctcagctca

SEQ ID NO: 54081 - DNA, 64 bp, Homo sapiens
ggctctcttctcactgtgtctctcccttttttatagggacatcagtcatattggattaagagcc

SEQ ID NO: 54082 - DNA, 104 bp, Homo sapiens
tatatgtgtatatatgtatacatatatgtgtatatatgtatacatatatgtgtgtatatatgtgtgtatatatgtgtgtatatatatgtgtgtatatataagac

SEQ ID NO: 54083 - DNA, 70 bp, Homo sapiens
tgtgtatatatacatgtatgtatatatgatgaaatacatatatatgtatatatacatgtatgtatatata

SEQ ID NO: 54084 - DNA, 131 bp, Homo sapiens
gtacctgtatatatacatatgcacatgcatgtatatatacatatattccgtcatatatgtttatatataaatgtatgtatatatacgtgtgtatatatgtatatatacatgtatgcatatatgatggaata

SEQ ID NO: 54085 - DNA, 114 bp, Homo sapiens
tggtagttttgatttgtatttctctgatgatcaacgatgtcaagcaccttttcatatgcctatttgccatttgtatgtcttcttttgagaaatgtctattcagatcttttgcca

SEQ ID NO: 54086 - DNA, 119 bp, Homo sapiens
tttggattgtggacttttgaattaatgctgaaatgagttaagacttcaggggaatgttggcaaggcatgattggttttgaaatgtgaggacatgagatttgacaggggccaggggcaga

SEQ ID NO: 54087 - DNA, 110 bp, Homo sapiens
gtgtgtgtgtgtgtatatatatataccagtatatacctatatatatacatctattatatatatatataggtatatacatatatatatgtatatacctactacatacaggc

SEQ ID NO: 54088 - DNA, 95 bp, Homo sapiens; identical to SEQ ID NO: 68

SEQ ID NO: 54089 - DNA, 93 bp, Homo sapiens; identical to SEQ ID NO: 69

SEQ ID NO: 54090 - DNA, 95 bp, Homo sapiens
ttgttaaatgcgaattaggtttaaaaatatggtcaggtttgaaaagttgtttctaaaatctggaaatatttttatctgtatattctttttaacag

SEQ ID NO: 54091 - DNA, 109 bp, Homo sapiens
gtatttattattgcctgtcttaaaaaattgtgggtgcataataggtgtgtgtatatatatatatgggttacattagatactttgataaaggcatgcaatgcataataac

SEQ ID NO: 54092 - DNA, 98 bp, Homo sapiens
gagactatgttgttaggtacatagtaacttaatattattatatatttttggttaactgaaaatttaaaatatattttatgtctcttaagcttggtttc

SEQ ID NO: 54093 - DNA, 118 bp, Homo sapiens
ggtaggtgtgaagtggtatcacattatagttttgatttgtatttacctgatgaccaataatattgaatatctttttatgtgcttcttggctatttgtatatctttctgaataaatatc

SEQ ID NO: 54094 - DNA, 111 bp, Homo sapiens
ctaggttttctaatttgcgtgcatagaggtgttcataatagtctctgaaagttttttctatttttgttgtgtcagtaatttctgtggtcatttctgagtgtgtttacttag

SEQ ID NO: 54095 - DNA, 90 bp, Homo sapiens
acacatagcgtgtgttgaatagatgtatatatacatatatatgtatatgtatatgcatatatatgtatatatacacatatacgtatgtgt

SEQ ID NO: 54096 - DNA, 121 bp, Homo sapiens
tatgtgcatgtatatatgtatatgtgtatatatgtatatatgtgtatatatgtacatgcgtatatatgtatatatacatgtgtatatatgaatatgtctatatgtatatatacatatgtat

SEQ ID NO: 54097 - DNA, 90 bp, Homo sapiens
tgtacatgtttatagatgcacatatgtacatagacccatatatatacatatatgtatatatacatatgtacacatatatacatatgtaca

SEQ ID NO: 54098 - DNA, 77 bp, Homo sapiens
tagtgagtgagttctcatgagatctgatggttttataaggggtttcccccttcactcagttctcattctctctcctg

SEQ ID NO: 54099 - DNA, 106 bp, Homo sapiens
ggtatgatctaatcactccctgggaggtttttatataggcaaaatagagtacagtatttgaagttgagttgtatataaaacatgttacagagtagaattggtctcc

SEQ ID NO: 54100 - DNA, 102 bp, Homo sapiens
tctgcagagaccatggccacctctccccctaggggctcaggcccagggagatcagagctctgtccctctgtccctgggtggagttgctggagttcctgcaga

SEQ ID NO: 54101 - DNA, 101 bp, Homo sapiens
gagagagagagatggggaaagagagagagagaagaggaagagagaagatatttatttattttttattcatttttttttttgagatggagtctcactctgtc

SEQ ID NO: 54102 - DNA, 58 bp, Homo sapiens; identical to SEQ ID NO: 20050

SEQ ID NO: 54103 - DNA, 85 bp, Homo sapiens
gcaaataattggctatgtaggcaagggggtgggagaagtcaaagattatttcatttttaagtctctgtgactgagaggtgtttgc

SEQ ID NO: 54104 - DNA, 103 bp, Homo sapiens
ttaattggagcatttagtccatttacatttaaggttaatattgttatgtgtgaatttgaacttgtcattatgatgttagctggttattttgctcgttagttga

SEQ ID NO: 54105 - DNA, 102 bp, Homo sapiens
cacagtggcatgttcctctagtcctagctacttggaggatgaggtagtatgatcatttgagcccaggactttggggctgtagtgaacctggacaacaaagtg

SEQ ID NO: 54106 - DNA, 64 bp, Homo sapiens
tacatgggttagtgtgtatatatgtatatgtatatacatacatatatacatacatatacatgta

SEQ ID NO: 54107 - DNA, 58 bp, Homo sapiens
tctgtacatatatatgtgtatgtgtatatatatatatatatatatatatatatacagg

SEQ ID NO: 54108 - DNA, 145 bp, Homo sapiens
tacattgtatatgtatatataaatatatatttatatatctacattgtatatgtatatataaatatatatttatatatctacattgtatatgtatatataaatatatatttataagtagatacatatttatacacatgtgcatata

SEQ ID NO: 54109 - DNA, 80 bp, Homo sapiens
taatgtgtgctgtggcatattattctttactacaatccttggaaatagtatgaatttatgttctagttttccatacatta

SEQ ID NO: 54110 - DNA, 58 bp, Homo sapiens; identical to SEQ ID NO: 2441

SEQ ID NO: 54111 - DNA, 101 bp, Homo sapiens
tgctggggaaaagacagtctgtcttcaataattgatgcttggaaaactggatatccatatacagaagaatgaaaccagatccctatttctccccatatgca

SEQ ID NO: 54112 - DNA, 83 bp, Homo sapiens
ggagaaggagtagaatacagtttttgaagataaaatctggtcaagtgacaaattttgttgctcaaaatttctagcccttatcc

SEQ ID NO: 54113 - DNA, 85 bp, Homo sapiens
ggaggagaaaagcatactttgcgtagtgaatttgatgatgaaatgaaattattgaatagagcggaaaagtagtctctctctctct

SEQ ID NO: 54114 - DNA, 95 bp, Homo sapiens; identical to SEQ ID NO: 68

SEQ ID NO: 54115 - DNA, 93 bp, Homo sapiens; identical to SEQ ID NO: 69

SEQ ID NO: 54116 - DNA, 95 bp, Homo sapiens; identical to SEQ ID NO: 68

SEQ ID NO: 54117 - DNA, 93 bp, Homo sapiens; identical to SEQ ID NO: 69

SEQ ID NO: 54118 - DNA, 105 bp, Homo sapiens
ttaccaacatttatgagtaatgctaagtgctagatgctgtctctgtctctgttttacagacggtagttaagtgctcacggtaacacagttcagtggtagagctag

SEQ ID NO: 54119 - DNA, 118 bp, Homo sapiens
tcatgggcacgtaccttaatgactaatgattttgagcatctttccatatatttatttgttattccatatatctttgagtatgtgttcagatttttgcccattaaggaaaaaaactaga

SEQ ID NO: 54120 - DNA, 95 bp, Homo sapiens; identical to SEQ ID NO: 68

SEQ ID NO: 54121 - DNA, 93 bp, Homo sapiens; identical to SEQ ID NO: 69

SEQ ID NO: 54122 - DNA, 83 bp, Homo sapiens
gttgggaggctgaggtaggaggatcatttgatcattttcactccagcctgggaaaatgagtgagaccctgtcttcagattgat

SEQ ID NO: 54123 - DNA, 79 bp, Homo sapiens
ggtgaaggtggggagaattcacagtgtagttaatgaggcctcttggtctgagactgacgcctgaaatctcatctttact

SEQ ID NO: 54124 - DNA, 72 bp, Homo sapiens
gtgtatgtgtgtaagtgtgggtatgtatatgtgtgtctgtgtgtgtatgtgtctgtgtgtatgtgtgtgcac

SEQ ID NO: 54125 - DNA, 95 bp, Homo sapiens; identical to SEQ ID NO: 68

SEQ ID NO: 54126 - DNA, 93 bp, Homo sapiens; identical to SEQ ID NO: 69

SEQ ID NO: 54127 - DNA, 95 bp, Homo sapiens; identical to SEQ ID NO: 580

SEQ ID NO: 54128 - DNA, 93 bp, Homo sapiens; identical to SEQ ID NO: 69

SEQ ID NO: 54129 - DNA, 114 bp, Homo sapiens
gagaaggctttggaaagttactgggacctgggacaggcttacttctcaaatgacagtgagatgagaggacagcaagcagaggctgtgagtgactaatctctatagttgagtctt

SEQ ID NO: 54130 - DNA, 89 bp, Homo sapiens
ggcttaggctttgtgggtcacacagtctctgtcccagctactcaactctgccatgatagcggccatgtgcaatatataaacaaatagtc

SEQ ID NO: 54131 - DNA, 88 bp, Homo sapiens
ttgatgctatgaagcttcaaaggttggtttactagaagagactgagcacaagatcagtattttgaaaatgggcagtttacagtatcag

SEQ ID NO: 54132 - DNA, 94 bp, Homo sapiens
gaatggcacggtaatcatatttaaaagaagggttatcagaggtatatatagaagtatctactgataaaattattagtgtctagatcttgctttc

SEQ ID NO: 54133 - DNA, 109 bp, Homo sapiens
ccgcatagtgaaggggcttattgagatgttggtgtttgactcacactcaaaatctgaaaggtgacagttgagctggctaatttctttgaaggtaccgcatagtgaaggg

SEQ ID NO: 54134 - DNA, 75 bp, Homo sapiens
tgtatgtatagatatgtatacatctatatatacagtatatatgtgtatttatagatgtgtatatatacacataga

SEQ ID NO: 54135 - DNA, 60 bp, Homo sapiens; identical to SEQ ID NO: 45696

SEQ ID NO: 54136 - DNA, 104 bp, Homo sapiens
tatatactatatatacacactatatagtgtgtatatatatatacacactatatatgtgtgtatatatatatacacacatatatatgtgtgtgtatatatatata

SEQ ID NO: 54137 - DNA, 58 bp, Homo sapiens; identical to SEQ ID NO: 40861

SEQ ID NO: 54138 - DNA, 80 bp, Homo sapiens
tgtgcttgtaatcccagctactcgggaggctgaggtaggaggatggcttgagcctgagaggcagaggttgcagtgagcca

SEQ ID NO: 54139 - DNA, 116 bp, Homo sapiens
cacttgggatgattagggatttgaaactctttttttttttttttttttttttttttaatgagacggagtctcactctgtcgcccaggctggagtacagtggcgcaatttcgtctca

SEQ ID NO: 54140 - DNA, 65 bp, Homo sapiens; identical to SEQ ID NO: 48220

SEQ ID NO: 54141 - DNA, 123 bp, Homo sapiens
tgatgaagttcggccctgtgggattagaatgataccttttgatttgagatgtgtgagaggtctgaaatggtgctcaatgctaagaaataggaactccagcttacattaagaggtgggacaggg

SEQ ID NO: 54142 - DNA, 56 bp, Homo sapiens; identical to SEQ ID NO: 14407

SEQ ID NO: 54143 - DNA, 81 bp, Homo sapiens
ggattggtcggaaggtcttcctggacctcagagttctgcttcccaaggcggagatgttctggaagactagtgaagatgtct

SEQ ID NO: 54144 - DNA, 140 bp, Homo sapiens
gggtgttgcctgttatcccaacattaagtggaaacctctgtgggttgttgtggctttaggtctctccctctgtcccaccctgaccctgatgttggtctgcaaatggaaaggacttggccacttctgttgactgacagagg

SEQ ID NO: 54145 - DNA, 96 bp, Homo sapiens
ctccaggctggtactgggggttgtctgcagagtcctgtgatgtgagccatctatgggtctctcagtagatagataccagtgcctgttctggtggag

SEQ ID NO: 54146 - DNA, 74 bp, Homo sapiens
attgaagtatatgtatgtatatatatgtatgtacacatgtaaatgtatgtatatatgtgtgtatatgcatcaat

SEQ ID NO: 54147 - DNA, 121 bp, Homo sapiens
ttgctgttgttttgctgtcaacattactggacgttctccaccagacatttttttaaaatttaattttaagttctgggatacatgtgcaggatgtgcaggtttgttacataggtaaacgtgc

SEQ ID NO: 54148 - DNA, 85 bp, Homo sapiens
cagagcaagactccatctcaaaaaaaaaaaaaagtgcaaaatctaatttttctttttcttttttttgagagggagtctcgctctg

SEQ ID NO: 54149 - DNA, 81 bp, Homo sapiens
tcttcttcatctctgtgttatcactgtttagtattgtgtctcagagagagagagagacagagagaaaaagagagaaagaga

SEQ ID NO: 54150 - DNA, 95 bp, Homo sapiens; identical to SEQ ID NO: 68

SEQ ID NO: 54151 - DNA, 93 bp, Homo sapiens; identical to SEQ ID NO: 69

SEQ ID NO: 54152 - DNA, 120 bp, Homo sapiens
cagcttcttggacctctctgggctttctgtctctgttttattttattttatttcattattttattttattttatctgtgtatggagacagagtctccctttgtttctcaggctggtctgg

SEQ ID NO: 54153 - DNA, 83 bp, Homo sapiens
atatataaacatctctatgtatctctatgtatgtagagatatgtatatatctctacagatatatagatgtttatatatatata

SEQ ID NO: 54154 - DNA, 112 bp, Homo sapiens
gataaagaagaaagccagtggagatgggaattgttttagtgactggttaagaacctttcttaagttcataatgattacaataaccccaatgaggctgaccttagaagttgtc

SEQ ID NO: 54155 - DNA, 101 bp, Homo sapiens
tgccttgtaaaacaactctgggaagaggaactattctgtgaaattgctgggtcatatagtagttgcatgtttagttttttaagaaaccatagtcaggtgca

SEQ ID NO: 54156 - DNA, 62 bp, Homo sapiens
cacttactatgaatggagcctgcaggactggaagttgttctgggtcagtcagtgagtgagtg

SEQ ID NO: 54157 - DNA, 95 bp, Homo sapiens; identical to SEQ ID NO: 68

SEQ ID NO: 54158 - DNA, 93 bp, Homo sapiens; identical to SEQ ID NO: 69

SEQ ID NO: 54159 - DNA, 79 bp, Homo sapiens
gtatgcatataaaatgtatatacataatgtgtatatattatgtgtatgtgtatatgtgtatatatagtgtgtatgtata

SEQ ID NO: 54160 - DNA, 99 bp, Homo sapiens
agtaggcaggagggaatgggatctggtgcagaagcagtacaataataggatttatttatttatttttttgagatggagtctcactctgtcacccaggct

SEQ ID NO: 54161 - DNA, 92 bp, Homo sapiens
gtgtataccctccagatgtaagcacttcaggagcagaaagtttattttttcttataaagttcctagaatttagtctgacatatggtagacac

SEQ ID NO: 54162 - DNA, 74 bp, Homo sapiens
gggagacagagcaagactccctctcaaaaaaaaaaaaaaaaaaaaaaaagagacagggtctcactctgtcaccc

SEQ ID NO: 54163 - DNA, 80 bp, Homo sapiens
ggagaaaagggaggtgtgagagcttgggcccaccagtaggtgactgaagagagtccggtttcagtgtttcttttctttcc

SEQ ID NO: 54164 - DNA, 85 bp, Homo sapiens
gcagaactgtttcttggtactataagactgaggtccccactctcttgctggctgtcagcttgagctactcacagagaccacttgc

SEQ ID NO: 54165 - DNA, 58 bp, Homo sapiens; identical to SEQ ID NO: 8845

SEQ ID NO: 54166 - DNA, 58 bp, Homo sapiens; identical to SEQ ID NO: 884

SEQ ID NO: 54167 - DNA, 56 bp, Homo sapiens; identical to SEQ ID NO: 885

SEQ ID NO: 54168 - DNA, 58 bp, Homo sapiens; identical to SEQ ID NO: 315

SEQ ID NO: 54169 - DNA, 113 bp, Homo sapiens
gcataatgttttcaaggttcatccatgttgtagcatgaatcagtatttcattttttttagaagtggggtctcactatattgcccaggctggtcttgaactcctgagctcaagc

SEQ ID NO: 54170 - DNA, 67 bp, Homo sapiens
agcctggacaacaaagcaagacctcttttttttttttgagacggagtctcgctctgtctcccaggtt

SEQ ID NO: 54171 - DNA, 58 bp, Homo sapiens
tgagtcggagtctcactctgtcacccaggcgggagtgcagtggtgcgatctgggctca

SEQ ID NO: 54172 - DNA, 111 bp, Homo sapiens
gccaggtggaatggtgcacgctgatagtcccagctactcaggaggatgaggtggaaggatcacttgaacctaggaggtcgaggctgcagtgagccatgattgcaccactgc

SEQ ID NO: 54173 - DNA, 146 bp, Homo sapiens
tatagatatatatatatatatgtatatgtaggagatatagatatatatatgcatatgtaggatatatatatgtatatgtaggatatatatatgtatatatatacagaacttatatatatatatacagaatatatatatatatatac

SEQ ID NO: 54174 - DNA, 99 bp, Homo sapiens
gctacccttatctcctctgcacttatgttatcaataaagaggcaaattctcaatatatttgtttttgtgtgccaattgtggttagtagggtataggtgc

SEQ ID NO: 54175 - DNA, 71 bp, Homo sapiens
gctcctgcactcattcactcacacattccctcctacgaggggttgagtggggtgggctgagtaaatggggc

SEQ ID NO: 54176 - DNA, 111 bp, Homo sapiens; identical to SEQ ID NO: 54172

SEQ ID NO: 54177 - DNA, 112 bp, Homo sapiens
ggcaggggagggggtgggttgtaggcaggtgaaagatggttttattcagcagctctcttacactgtctgtctctgtcttggctaactgctgtacctgctcccacgcgcagcc

SEQ ID NO: 54178 - DNA, 95 bp, Homo sapiens
ttgggcgcactctgtgtcgtgtgtgtgtgtataaaatatgtacatttggttatgtgtgtatatatgtacatatataataaataggactggctcaa

SEQ ID NO: 54179 - DNA, 78 bp, Homo sapiens
gcctgggcatatggcactcactgcctctctaaatcccactacagagatgacatgagaggcagcaggccagttttaggt

SEQ ID NO: 54180 - DNA, 111 bp, Homo sapiens
ggtagttacagaaggtgtggtaggaggtaagacagaggtgtagccagagatcagatgatagagagctcattggccataggaatgacttcagacttgaccctgtaggcaact

SEQ ID NO: 54181 - DNA, 73 bp, Homo sapiens
ttggagggagagaagagtcattgcagagggtcctggctgggaactgtgttgctagaagttttagtccctgcag

SEQ ID NO: 54182 - DNA, 108 bp, Homo sapiens
ttgagtcatttcgatttatttttggctggtgggatgcaccattgtacattttttttcaaaaagggtattgtgttttgtcactgttccaggatgatccggatgaagcga

SEQ ID NO: 54183 - DNA, 97 bp, Homo sapiens
gttcataccttcaattatctcatatctgtaaaccatactatttttaatttagaaaatactatgtctgcaggtgctgagatagtattgaggtgagtac

SEQ ID NO: 54184 - DNA, 77 bp, Homo sapiens
gttgaatgagtgatgagagtgaacatccatgcctggtttctaaacaggtggaagccagttactctttcaccattaac

SEQ ID NO: 54185 - DNA, 97 bp, Homo sapiens
tggggttagggttattgttttcggttactgaatatattatttttctatgtaaagctaacagacatatatggtgatcaaatctgtaaccacaacctca

SEQ ID NO: 54186 - DNA, 110 bp, Homo sapiens
tgtttaggcttgtcttggctatgtgggctattttttggttccatatgaaatttaaagtagttttttctaatgctgtgaagaaagtcaatggtagcttgatgggaatagca

SEQ ID NO: 54187 - DNA, 178 bp, Homo sapiens
tatacatatatatataaaaatatatatatataaatatatatgtgtgtatatatataaatatatatgtgtatatatataaatatatatgtgtatatatataaatatatatgtgtgtatatatatgtgtgtgtatatatatatatatatatatatatatatatatatatatatatatttg

SEQ ID NO: 54188 - DNA, 115 bp, Homo sapiens
ggtgagaacatttaagatatcaagtatttagcagagaattttaataaactatggtaatcatgctgtagattaaaattaccaaaacttcttcatcttataattgaaagtttttacc

SEQ ID NO: 54189 - DNA, 104 bp, Homo sapiens
ggttttgatttgcatttccctgatgattagtgattttgaacatttttttcatatacctgtttactattagtatgttttctttggagaaatgtctattcaggtcc

SEQ ID NO: 54190 - DNA, 58 bp, Homo sapiens; identical to SEQ ID NO: 6327

SEQ ID NO: 54191 - DNA, 116 bp, Homo sapiens
agagcagtaagaaagaaaggtttcaggggaagcaaagtcagaaaccagagtgcagagggacctcatgggaattgtacttggcttcatggcagcttcagggacctcagcagggttct

SEQ ID NO: 54192 - DNA, 58 bp, Homo sapiens
tgagactgagtctcgctctgtcacccaggctggagtgcagtggggacatctcagctca

SEQ ID NO: 54193 - DNA, 66 bp, Homo sapiens
tcaattcgtcacactcactctctgtccagtttgttcccttgctggcgaggagttgtgatcctttgg

SEQ ID NO: 54194 - DNA, 78 bp, Homo sapiens
ttaggaatgattagagctatgggttcaaattatgtcatgagggcttgatctcagtctgtatctctgatcattgcttag

SEQ ID NO: 54195 - DNA, 76 bp, Homo sapiens
tatatgtgtatatatgtatatatgtgtatatatatgtgtacatatatgtatacatatatatatgtatatatatata

SEQ ID NO: 54196 - DNA, 98 bp, Homo sapiens
ttgtggcaacctcacatagaacaagtctatcggcaccatttttccaacagtgtgtgctcacttggtatctctgtgtcatattttggtaattctcgcaa

SEQ ID NO: 54197 - DNA, 69 bp, Homo sapiens
gggcaggcctgaaagagtgttttgtttgtttttgttttttttttgagacagagtctcactctgtcgccc

SEQ ID NO: 54198 - DNA, 83 bp, Homo sapiens
cagaacattagctgggcatggtggcactcaactgtcgtcccagctacttgggaggctgaggtaggaggatcgcttgagcccag

SEQ ID NO: 54199 - DNA, 102 bp, Homo sapiens
catgcatgaatatatactgagtatatatgtatgaatatatactgagtatatatacatgtatgaatatactgtatttacttagtttatatatatatacatgta

SEQ ID NO: 54200 - DNA, 72 bp, Homo sapiens
tggtgtatatgtgtatgtgtgtacatatatatatatatatatatatatatatatatatatatatatgcacca

SEQ ID NO: 54201 - DNA, 115 bp, Homo sapiens
gaccattggataagaatgtctttttcttgggcccatgtggagtttttattactttgtcattgttgccaggtaaaatattaagaatgtggttaagaattggataacagccttggtt

SEQ ID NO: 54202 - DNA, 72 bp, Homo sapiens
gttgggtgctggtgtaggtgaggctgtctggctctgtgcttggctaacctccaactgcaatggcaatctggc

SEQ ID NO: 54203 - DNA, 76 bp, Homo sapiens
gagagagaagaatgagagctgagtgaagggggaagcccttgtaaaaccattagatctcgtgagaacttactatctc

SEQ ID NO: 54204 - DNA, 58 bp, Homo sapiens; identical to SEQ ID NO: 1673

SEQ ID NO: 54205 - DNA, 103 bp, Homo sapiens
gcacttcgtgtgcagcagccagagaggaaataaattataaataaataaataaataaataaataattcattcattctctggcagatgacgcagaaggaaatggc

SEQ ID NO: 54206 - DNA, 110 bp, Homo sapiens
ggcttgtgtgtcatcttcctgagagatggatgtaatttcagtgccaggattgatgtccttgacttgacttttttttatctctgggtttgctaagaatatggaaatgtgct

SEQ ID NO: 54207 - DNA, 108 bp, Homo sapiens
tttttaaggtcagctactggtactttattctgttccttgggtggtgtcatatttctttgattattcatgatccttgtagttttgtgttggtatctgcacatttgaaaa

SEQ ID NO: 54208 - DNA, 114 bp, Homo sapiens
cctgggcaacagagcaagactctgtctccaaaaaaaaaaaaaaaaaaaaaaaaagaaagaaaaaaaaataagaaaaagaaaagaaagaaatggagtcaagaatgtgagctcagg

SEQ ID NO: 54209 - DNA, 92 bp, Homo sapiens
gggaaatgtggatttggagccctcacacagagtctccgctggggcactgcctagtggagctgtgagaagagagacaccatcctccagacccc

SEQ ID NO: 54210 - DNA, 113 bp, Homo sapiens
tgaattttgtgactttggcttctcattacaaggtaaaagtaaagcttttattcagagaacagtgagagcttttttgcctggtgatcaaaaagtcagtattataccttttgtca

SEQ ID NO: 54211 - DNA, 88 bp, Homo sapiens
aacagtgctgcaataaacgtgagtacagatgtctttttgaagttatgatttccttttctgtggatatgtactcagaagtggtattgtt

SEQ ID NO: 54212 - DNA, 95 bp, Homo sapiens; identical to SEQ ID NO: 68

SEQ ID NO: 54213 - DNA, 93 bp, Homo sapiens; identical to SEQ ID NO: 69

SEQ ID NO: 54214 - DNA, 79 bp, Homo sapiens
aggctggagtacagtggtatgatctctgttcactgcaacctccacctcccagattcaagcgattcttgtgcctcagcct

SEQ ID NO: 54215 - DNA, 93 bp, Homo sapiens
ctcatctattatttcctgtgataaaatcagtttggctaacatgtttgttttttttgttaatatgtgactagattgatttgttagatatttggg

SEQ ID NO: 54216 - DNA, 66 bp, Homo sapiens
ttgagcctatgtgtgtctctgtatgtgagacgggtttcctgaatacagcacactgatgggtcttga

SEQ ID NO: 54217 - DNA, 81 bp, Homo sapiens
ccatggagataatcattgcaattttggtgcatatctctgtatctgtgtcggtgactgtgtgcctgtgttttgattatgtgg

SEQ ID NO: 54218 - DNA, 71 bp, Homo sapiens
gctggagctctcctgtgtgaggtgtctgtcaaaccctgctgagaagtgtctctctgtcaggaggcttgggt

SEQ ID NO: 54219 - DNA, 74 bp, Homo sapiens
cctgggatatgtgactttgtaagtgtgatgatttttttttttttttgagacaaagtctcgctctgtcacccagg

SEQ ID NO: 54220 - DNA, 87 bp, Homo sapiens
gtattttctaagtaaagcatttaggctatttacattcaatatcattgagatgtggggtactagtctatttgttgttctagttgttgc

SEQ ID NO: 54221 - DNA, 100 bp, Homo sapiens
gcatgggagtgctgataactgtttgacatgctgattttatttttttggatatataccaggaggtggtattactggatcaaatgacagttatttcttatgc

SEQ ID NO: 54222 - DNA, 108 bp, Homo sapiens
agatttttaaagaacatttttaagaattatgcagaatcctattttattttaaaaatattttttgttaaactgaaatttatctctgtgtaaagtttgagatgaaaatct

SEQ ID NO: 54223 - DNA, 124 bp, Homo sapiens
ggaatggtactgatttttttacgttgattttgaatcctgcaactttactgaatttctttatcagttgtaatagttttcttgtggagtcttcaggtttttccaagtaagagatcatatcatgtgc

SEQ ID NO: 54224 - DNA, 161 bp, Homo sapiens
gtgttgtgtgtatatatatatgtgtgtatatatagatatgtatatacatatatgtatgtatatatgtatatatagatatgtatatatgtatatacatatatgtgtatatatgtatatacacgtatgtgtgtatatgtatgtgcatatatatgtatatgtat

SEQ ID NO: 54225 - DNA, 84 bp, Homo sapiens
gtaaactatatatatgtattttaccatctttgtcattttaagtggacacagttcagtggtaataaatacatttgtttaggaggc

SEQ ID NO: 54226 - DNA, 119 bp, Homo sapiens
acagtgttataataatctgtgattttgtatgtagttactatttccagtgagtttttttttattattatacttaaagttttagggtacatgtgcacaatgtgcaggttagttacatatgt

SEQ ID NO: 54227 - DNA, 84 bp, Homo sapiens
ccaggggaaaagtggactgcagaaagacactcactcaccctctctcatagtggggattcactctcagttcctggtctatcatgg

SEQ ID NO: 54228 - DNA, 80 bp, Homo sapiens
tcacatgctgacagagctggcctccctttcaactgggtttgaggtatttcctcagaggagagtgagctctgagttgtaga

SEQ ID NO: 54229 - DNA, 115 bp, Homo sapiens
gcagaagattcattatttccttatttgtaattctggaaatcaaaatgtgtcttaaaaatatattttatttttagctcccacaaataataagaacatgtgatgtttgtctttctgt

SEQ ID NO: 54230 - DNA, 83 bp, Homo sapiens
tagagtttcttgatctgcagaactgagcagaactccttagacctgagtgatgacagtctgcatttcccaaagaaatacttctg

SEQ ID NO: 54231 - DNA, 108 bp, Homo sapiens
tacccaagagatcagtcatacctgttatgtaccccttgtcccattttgtatgtaagaaagttagtatttcagagctgggacaggtatttaaagctatgactttgagta

SEQ ID NO: 54232 - DNA, 109 bp, Homo sapiens
tctctctcacacacatatatatctgtatatatatgtatatatgtgtatatctcatatatatctatatatgtatatataaagatatttgtgtgtatatatatgagactga

SEQ ID NO: 54233 - DNA, 100 bp, Homo sapiens
gaagtagcattgcctttgccccagtacacaagattctgaaattataatctttatttgtaattcatgtgccactggtgaacagggatgctcagaaaacttt

SEQ ID NO: 54234 - DNA, 113 bp, Homo sapiens
tttgtgaatacatcataggtatatatatatgtgtgtgtgcatatgtgtatatatatatgtgtcatatatatatatggtacatgatatattttgatacaggcatgcaatgtata

SEQ ID NO: 54235 - DNA, 170 bp, Homo sapiens
aaaacaaacccacatctcttccatcaagaaagcagagagattatcttattttatttttgtgaagtacccctcacatctctacagaactgtgtctggagagtctttaggtttattttattttatttaagttccaggatacatgtgcaggatgtgcaggtttataacatagg

SEQ ID NO: 54236 - DNA, 72 bp, Homo sapiens
cttgaggtggcagtgtttcacctgtgtacctaatttttttttttgagatggagtctcacactgtcacccagg

SEQ ID NO: 54237 - DNA, 67 bp, Homo sapiens
gatcctagaagaaatgccagtccgtcttcccaaacactgggagacagattttttctttttaatcagg

SEQ ID NO: 54238 - DNA, 82 bp, Homo sapiens
tggggggaaagttggcagtaacaggcctcacctagctcccacacagcccaaaaggccagtctcactctcactgtgccctcca

SEQ ID NO: 54239 - DNA, 112 bp, Homo sapiens
ccattcttttgcatttgctgaggagtgttttactttctttcttttcttttcttttcttttttttttttttgagatggagtctcactctttcacccaggccggactgcagtgg

SEQ ID NO: 54240 - DNA, 115 bp, Homo sapiens
caaagtatcagagtgcagatttctctacatctttgtcaacactggttattttctgtttttgttttttattatagccattccagtaagtgtgaagtggtgtctcattgtggttttg

SEQ ID NO: 54241 - DNA, 77 bp, Homo sapiens
gggatagtggtagagggcggggtatctctctcttttttttttttttttttttgagatggagtctcactctgtcgccc

SEQ ID NO: 54242 - DNA, 103 bp, Homo sapiens
ttgagatggagtcttgcttttgtcgcccaggctggagtgcagtggcgcgatcttgactcactgcaactgcatctcctgggttcaagcaattctcctgcctcag

SEQ ID NO: 54243 - DNA, 84 bp, Homo sapiens
ggtggcataggttgggccctctttttctttttttaatttttttctttttaattaattattgagacagggtctctctctgtcacc

SEQ ID NO: 54244 - DNA, 85 bp, Homo sapiens
tttcatcttgattgtgaaggcaaaaagaaattagaagagggagactgtccacgtttcttttttcttctttttttttgagatggag

SEQ ID NO: 54245 - DNA, 68 bp, Homo sapiens
tgagacagtgtctcactctgtcgcccaggctggagtgcagtggcgccgagtgcagtggcatcagctca

SEQ ID NO: 54246 - DNA, 111 bp, Homo sapiens
gccaggcgtgatggtgcgtgcctgtagtcccagctacttgggaggctgaggtggaaggatcacttgagtctgggaagttgaggctgcagggagccctgatcatgccactgc

SEQ ID NO: 54247 - DNA, 89 bp, Homo sapiens
cccccatctctacaaaatatttttttagttaaccaggtgtagggatccacgcctgtagtcctagaaacttgggaggctgaggtaggatg

SEQ ID NO: 54248 - DNA, 76 bp, Homo sapiens
gttcagttagtattagttcttgttcatgttagtcactgtcagtgactttttatagattttgaactgtataatgaac

SEQ ID NO: 54249 - DNA, 94 bp, Homo sapiens
ggagggcatgctccgtgcagcaaatatgtgacatggctactcgtgactcagattgatccgagtgttcactggctccaagagtagtgtgatctct

SEQ ID NO: 54250 - DNA, 65 bp, Homo sapiens
ttgcgatggagtctcactctgtcacccaggctggagtgtggtggcatgatctccgttcactgcaa

SEQ ID NO: 54251 - DNA, 76 bp, Homo sapiens
accctaagttgaaaagtatattaatagatgttgatatccaaatgggaccagcatatctagtcatttttcagagggt

SEQ ID NO: 54252 - DNA, 103 bp, Homo sapiens
ggatgtatacacactagtgggattgttggatcatatagtagttatatttttaattttttgaggacttgccatactgttttccacattagttataccactttcc

SEQ ID NO: 54253 - DNA, 79 bp, Homo sapiens
tcaaagtatagtctgtctgtgtcactctctccatagcaagagctgggtgcagtctgacatcagccatcatctgccctga

SEQ ID NO: 54254 - DNA, 77 bp, Homo sapiens
cagtgttttcctctaatgcttctgagctcttattttttaattaaaaaaatttttgtttttgaagcagggtctcactg

SEQ ID NO: 54255 - DNA, 112 bp, Homo sapiens
gtaatgctgacctcatagaatgagcttggagttagtcccttttcttcaattttttttttttttttttgaggtggagtctccctctgtcacccaggctggagtgcagtggcac

SEQ ID NO: 54256 - DNA, 107 bp, Homo sapiens
tatttcttactgtcaaaattatggggattttctagtttttattattgatatctattttaatgcactgaagttggaaaacacacacatgatttcaattatttgaaatg

SEQ ID NO: 54257 - DNA, 86 bp, Homo sapiens
gagtgttgtcaagatgggtctgatgaaattgattgtaaagtatattcacttacaatgtgccattgtgctcagctgtgctcacactt

SEQ ID NO: 54258 - DNA, 109 bp, Homo sapiens
ttgggcacaagtttgggtcaatagagatcttttggttaggacacatgcttttttttttttttttttttttttaatggtgtcttgctctgtcacccaggctggagtacag

SEQ ID NO: 54259 - DNA, 118 bp, Homo sapiens
tttgattcattctattcacatatgtgactgttttaactgataatatatatgtgtgtgtgcacacacgcacgtgtatatgcagaactgaactttaggtggcattatgtataggctcaag

SEQ ID NO: 54260 - DNA, 121 bp, Homo sapiens
gaatgttgggactatgctgtatgctctataatctctttaaatgtctaatactgattttgtagaattgtggtaaaatcagaattttggacccagatgagagctacactgaattttcttttat

SEQ ID NO: 54261 - DNA, 91 bp, Homo sapiens
atatatgagtatatattcacatacatatatacatgtatatctatatgtatgtgtatatatgtatatgtgtatatatacatatatatatata

SEQ ID NO: 54262 - DNA, 117 bp, Homo sapiens
ctgggtgtgatggtgcacacctgtggtaccagctactcgggaggctgaggtaggaggatcacttgagcccaggaagtcgaagttgcagtgagctgaggttgcaccactgcattccag

SEQ ID NO: 54263 - DNA, 75 bp, Homo sapiens
tctccactttccctgggctgatagggaatctagatgacaacctagagtccttcttcacagtagataatctggaga

SEQ ID NO: 54264 - DNA, 82 bp, Homo sapiens
gaaataaggtaacagatgagtgttagcacatggtgcacaacatgttagttctcaactaacacttctctttttcctactgttc

SEQ ID NO: 54265 - DNA, 83 bp, Homo sapiens
gtgtgtgtgtgtgtggtgtgtgtgtgtgtgtgtgcatatgtatgtgtgtatatatatatatccagtcatccattgatggacac

SEQ ID NO: 54266 - DNA, 119 bp, Homo sapiens
tgcttaggattgtcttggctatatgggctcttttctcgttccatatgaaatataaagtagtttttttttttcgtaattctgtgaagaaagtcaatggtagcttgatggggatagcattg

SEQ ID NO: 54267 - DNA, 96 bp, Homo sapiens
gttagctgaaaacttatgaagtgacagtcttgttaataaagacaaatgagatggcttgttttattaatattaatgttgcacataatgtagctttgc

SEQ ID NO: 54268 - DNA, 95 bp, Homo sapiens
actaagcagccattaaacataatatgggaactgttagatgttaatgatcacttcatataatttctatgtatatctttaatttgctgcttctaagt

SEQ ID NO: 54269 - DNA, 94 bp, Homo sapiens
gcctcggtttcccttttgaaatcaccatatatttatttttcaattgtttttctatttagttgaaaggtgttgtaagtattcaggatgctgatgc

SEQ ID NO: 54270 - DNA, 74 bp, Homo sapiens
aatgtatagagattttgtagtttgctagacgtgctgtggtacaatttagcaagaccagcaaaattgcttacatt

SEQ ID NO: 54271 - DNA, 86 bp, Homo sapiens
ctacaccattgtctctctggctctcaggccttcaaactatatcactggctttcctgggccttcaatttgaagacagcaaattgtgg

SEQ ID NO: 54272 - DNA, 79 bp, Homo sapiens
tgtgaagtggctatgttgtctggggcatataccctagggtttgttgtcatgcaccaggaaaatttaggacacattcaca

SEQ ID NO: 54273 - DNA, 58 bp, Homo sapiens; identical to SEQ ID NO: 4546

SEQ ID NO: 54274 - DNA, 79 bp, Homo sapiens
tgagatggagtctcactctgtcacccaggctggagtgcagtggtgtgatctcaactcactgcaagctctgcctcctggg

SEQ ID NO: 54275 - DNA, 88 bp, Homo sapiens
agtgattctcaactggtggcaattttgtctcccaggaggtatttgacagtctggaggcatttttgattgtcacaatttggggcgtgct

SEQ ID NO: 54276 - DNA, 88 bp, Homo sapiens
gccaatagattagatatagatatagatatttatctttctatatttatatcagatatttgtttatgtccatatctatatttatacttgc

SEQ ID NO: 54277 - DNA, 66 bp, Homo sapiens
gtcatggattattaaagccaaggatgttagggtaagtccctgacttctgatgttgatgtcaaggac

SEQ ID NO: 54278 - DNA, 81 bp, Homo sapiens
gaaactagagacatagacaagtatgttacatatttggagaggcaaatatgttatatcaatttctttatgtctttgactttc

SEQ ID NO: 54279 - DNA, 75 bp, Homo sapiens
gctttctacccatctctttcaaggacaccagttagtcatagattttttatctttgaagagcaggaggttgagggc

SEQ ID NO: 54280 - DNA, 74 bp, Homo sapiens
tgttttgagtgcaaagcttctgcctcattgactctccctgagtcacaaagcaggtgactgtaaactcaccgaca

SEQ ID NO: 54281 - DNA, 58 bp, Homo sapiens; identical to SEQ ID NO: 2051

SEQ ID NO: 54282 - DNA, 118 bp, Homo sapiens
tccagctttgtacttttggcttggtattgtcttggctatatgggctcttttttgttccatatgaaatttaaagtagtttttctagttctgtaaataaagtcaatggtagcttgatggg

SEQ ID NO: 54283 - DNA, 95 bp, Homo sapiens; identical to SEQ ID NO: 580

SEQ ID NO: 54284 - DNA, 93 bp, Homo sapiens; identical to SEQ ID NO: 69

SEQ ID NO: 54285 - DNA, 95 bp, Homo sapiens; identical to SEQ ID NO: 68

SEQ ID NO: 54286 - DNA, 93 bp, Homo sapiens; identical to SEQ ID NO: 69

SEQ ID NO: 54287 - DNA, 57 bp, Homo sapiens
tgagacggagtctcgctctgtctcccaggctggagtgcagtggcgcatctccgctca

SEQ ID NO: 54288 - DNA, 58 bp, Homo sapiens
gtgtttgtgtgtatatatgtatgtatatatacatatgtatatatatacacacatatac

SEQ ID NO: 54289 - DNA, 112 bp, Homo sapiens
tctgattatggcactttttcttatttatagcactgaaatggagtttttcaatttaattattctgtactgtcatttccataagattgtaagaaggagatgtctgccattttga

SEQ ID NO: 54290 - DNA, 110 bp, Homo sapiens
gtatatctgtttgtatatgttacttcccatgtgagaagaaagcatagatatatatcattttatatgtgcagctatttcttatatattgaactacacatattaagacttac

SEQ ID NO: 54291 - DNA, 80 bp, Homo sapiens
cacagtaattggttttcttgacaccagatgtgtgtggggggcatgtgtgtgtattgtgtctgtgtgagtccctgactgtg

SEQ ID NO: 54292 - DNA, 86 bp, Homo sapiens
tctgaacaggtatttttttatctttgttatgtctaaaatataaattttggacatttaaaagtggtaacagttaatatgcctgtgga

SEQ ID NO: 54293 - DNA, 111 bp, Homo sapiens
gaaacctgcagcccctgagagatggatttaatatctggtcaatatcactgccagctaactatagtggcctagtgttctggatataggcaagcttcagcagctgttggtgtc

SEQ ID NO: 54294 - DNA, 96 bp, Homo sapiens
agaaaattctcagcaagtacaactggacacttggataagatttcaatatattttaattttatcctaatagttttcagcactttgttcaagtttttt

SEQ ID NO: 54295 - DNA, 75 bp, Homo sapiens
cccttgtaagttggattcctaggtattttattctttttgaagcaattgtgaatgggagttcactcatgatttggg

SEQ ID NO: 54296 - DNA, 71 bp, Homo sapiens
gagagagagactgtttttttttttttttttttttgagagaaagtgagttaagagaacaacagtcttgtctt

SEQ ID NO: 54297 - DNA, 118 bp, Homo sapiens
ggttggattgggtctgctagtataatgttgagggtttttgcattaatattaataataaatttttataattttattttcttgtgatgtctttagctcttgtatcagaataatgctggtc

SEQ ID NO: 54298 - DNA, 120 bp, Homo sapiens
ggtcatttcaaccctattatgaagagagagatgatttagatttggggcatgttaaaaacaatttatttttttctaagattagctggatatttttcttgatgatttatgtttggaataact

SEQ ID NO: 54299 - DNA, 105 bp, Homo sapiens
atatatacatatgtatatatattgcataaatgtgtatgtatatatatgtgtgtatatatgtgtgtatatatacacacatatgcatatatacacatatataagcaa

SEQ ID NO: 54300 - DNA, 110 bp, Homo sapiens
atatatcctaccaatgtatttgcacaagcttgaaaagatagacatttaaaaatatatgtctttgtattttttaattttttaatttttgtgagtacatagtaggtgtatat

SEQ ID NO: 54301 - DNA, 100 bp, Homo sapiens
atttaggaataggaaatgctttctatatcacttctgtgcgtgtgatagagacacacacacatacataagtgatatagaaaacattgacaattctgagaat

SEQ ID NO: 54302 - DNA, 56 bp, Homo sapiens; identical to SEQ ID NO: 688

SEQ ID NO: 54303 - DNA, 98 bp, Homo sapiens
tgtctatgtgtgtgagatatgtgtgtatgtgtatatataaatatacacatatgtgtttatttaactatatttacaaggtatgcatacagcaagtgtct

SEQ ID NO: 54304 - DNA, 92 bp, Homo sapiens
gatatacattttaatgatataattgtcaataatgtgtgtatatatatatatatatatatacacatacatcattgacatttgaagtgattgtt

SEQ ID NO: 54305 - DNA, 103 bp, Homo sapiens
aaataaggagttagtaatgaataaaaatgatttgagatctacttgttaatgactcagattattttttctatttgttgtgtgctatattgactaatctttattt

SEQ ID NO: 54306 - DNA, 124 bp, Homo sapiens
agagacagttcatgcagtgaagagggcaagtaacgtggggtaagagaaatgacttcagatttagttcttctatgatttggcttcgagatctccaggtaattattagtctctctgagatttgcat

SEQ ID NO: 54307 - DNA, 95 bp, Homo sapiens; identical to SEQ ID NO: 68

SEQ ID NO: 54308 - DNA, 93 bp, Homo sapiens; identical to SEQ ID NO: 69

SEQ ID NO: 54309 - DNA, 113 bp, Homo sapiens
tactgtaggtaactgtttgttatatagtggtgagtatttttgtatataaacatgtctaaagatagaaaaggtacagtaaaaatatggcattataatctcatgtgaccacagtg

SEQ ID NO: 54310 - DNA, 95 bp, Homo sapiens; identical to SEQ ID NO: 68

SEQ ID NO: 54311 - DNA, 93 bp, Homo sapiens; identical to SEQ ID NO: 69

SEQ ID NO: 54312 - DNA, 114 bp, Homo sapiens
tccaaagatatccacaccacaactcctgggtcctgaatgttatcttacatgtcaaaagtgattttgtatatgtgattaaagctaaggatcttgagatgggaagactttcctgga

SEQ ID NO: 54313 - DNA, 100 bp, Homo sapiens
atctggaattctgatgcaaatggaatattgttctgggtagatgccttagactctctctgaaacacagccaacttgattctattttatttggttttgagat

SEQ ID NO: 54314 - DNA, 94 bp, Homo sapiens
gtatatatacataacaataaatgtacatgtaatgtgtgtatatatatacataaatgtgatatatacacacacacacatatgcatatatatatac

SEQ ID NO: 54315 - DNA, 112 bp, Homo sapiens
agtatggctcttcagggttttttggtggttctatgcaaattttaggattttttttctattttaatgatgaatgccattggaattttcacagagattgtgttcagtctatatt

SEQ ID NO: 54316 - DNA, 120 bp, Homo sapiens
tctcgagtaggtaggactacagatgtgtgccaccacacctgactatgtttttatttttgtatttttagtagagatgtagtttcactatgttggctagactggtcttgaactcctgacctc

SEQ ID NO: 54317 - DNA, 106 bp, Homo sapiens
atatatatacacatatatatgtgcatgtatgtatgtgtgtatatatatgtgtgtatatacatgtgtatatacacatatatgtgtatatatgtatgtgtgtgtgtgt

SEQ ID NO: 54318 - DNA, 115 bp, Homo sapiens
gtatatatgtacatatacatacatagtatgtatgtagatactatatagagagtctttgtctctctatttatatggtgtgtttatgtgtgtgtgtatgtagtaattctttgtgtat

SEQ ID NO: 54319 - DNA, 85 bp, Homo sapiens
accctctggcttctttcaaggtttttttctttatatctgactttgtacagttttaatataatatgcctggatgtaggctttgggt

SEQ ID NO: 54320 - DNA, 210 bp, Homo sapiens
atattttatatatatatgtatatatatgtatatatatgtgtatatatgtgtatatatgtatatatgtgtatatatgtatatatatgtgtatatatgtatatatacgtatatatgtgtatatatacgtatatatgtgtatatatacgtatatatatgtgtatatatatacgtatatatgtgtatatatatacgtatatatgtatacaaata

SEQ ID NO: 54321 - DNA, 120 bp, Homo sapiens
ttgagatggtcatatgatttattttcttcattctgttaacgtggtttatcatatttattgattaatgtatgttgaactatacttactgcaatgagcatatgaatgcatgtgtctttttgg

SEQ ID NO: 54322 - DNA, 95 bp, Homo sapiens; identical to SEQ ID NO: 68

SEQ ID NO: 54323 - DNA, 93 bp, Homo sapiens; identical to SEQ ID NO: 69

SEQ ID NO: 54324 - DNA, 107 bp, Homo sapiens
tttaggaactaactagcttacttttgattttacaggcttataggagaaagggacttactttgtctcagatgagactgtggactgtgggcttttgggttaatgctgaa

SEQ ID NO: 54325 - DNA, 95 bp, Homo sapiens; identical to SEQ ID NO: 68

SEQ ID NO: 54326 - DNA, 93 bp, Homo sapiens; identical to SEQ ID NO: 69

SEQ ID NO: 54327 - DNA, 98 bp, Homo sapiens
ttgcggttgtctgtttactctgctggtgctgataatgatgatgatgatgatgacgatgattattattattattattttgctgggcagaagctctgtag

SEQ ID NO: 54328 - DNA, 83 bp, Homo sapiens
gttggtatgatggagatacacttaaaagtgactagtaatttttttttcattactggttttataattatctctttgatattgac

SEQ ID NO: 54329 - DNA, 90 bp, Homo sapiens
ggtcttttgtagttccatatgaattttaggattgttttatctatttctttaaaaaatgccaatgaaattttgataggaattgcattgact

SEQ ID NO: 54330 - DNA, 102 bp, Homo sapiens
tgtgtgtgtgtgtgtgtgtgtgtgtgtatcatcatgtatatatgatatatatatattttttatgtacatatgcatgtttatatgtatatatacacacataca

SEQ ID NO: 54331 - DNA, 116 bp, Homo sapiens
gttcttgggcttggagtgccctctattgcagatatggcttacatcaaaatcctcagtatatatatatatatctggaaagctttttcaaaatggatgggcacaaacaagcccagaat

SEQ ID NO: 54332 - DNA, 105 bp, Homo sapiens
tggcttgccactgcttaggagagagaagatgttccttgaatagtttttaattatgcttttgggaatagttctataatctgtttttcttagtggcatttggctcca

SEQ ID NO: 54333 - DNA, 81 bp, Homo sapiens
tctggttgactttacataaaatgtgtattatttatctttcaaatgtttagcacacatattttacaagtcaagtcaactagg

SEQ ID NO: 54334 - DNA, 68 bp, Homo sapiens
ggttcagtggtgatctggaggtcctgtgagggcattacactagacaggtaactcacactgggtcacac

SEQ ID NO: 54335 - DNA, 93 bp, Homo sapiens
aggctttggaccaaggaatgatgctgataagaatgataaaatagcctccactactattatttttatgtttcaatctgtttggtaaacttgtct

SEQ ID NO: 54336 - DNA, 106 bp, Homo sapiens
gcactctcttttctccacagcctcaccagcatctgttgttttttactttttaatagcagccattctaactggtgtgaaatggcatctcattgtggttttgatttgc

SEQ ID NO: 54337 - DNA, 100 bp, Homo sapiens
cttagttatagttattcttatcaagttattatggagctagtgttattttattcatatagtactatagctatagtatggtgatagagttatagtgaaatag

SEQ ID NO: 54338 - DNA, 88 bp, Homo sapiens
gaaggacatggtttcattgtttatgaatagcactgtgataaacatacaagtgcaggtgtctttttaatataatgatttcttttccttt

SEQ ID NO: 54339 - DNA, 110 bp, Homo sapiens
tgtttccttggtatttttagccatgtgaaatccttgtttatttctttaattgctaatattttctggatttttataaacaactgatatcactggaaggaaatcttgaagca

SEQ ID NO: 54340 - DNA, 82 bp, Homo sapiens
gtgatatatatgtgtatatacatatgatggaatactacaataaactgtgctatgtgtgtgtgtgtgtatatatatatatgat

SEQ ID NO: 54341 - DNA, 73 bp, Homo sapiens
cagtgactctttagtatatcgtcctgttttattttctttataacagttattgatagctgaggctgtcttgctg

SEQ ID NO: 54342 - DNA, 81 bp, Homo sapiens
tgtatgtatgtatagttgtactagtggtatatatatatatatatatatacacacacacacacatctttgtatatagatata

SEQ ID NO: 54343 - DNA, 105 bp, Homo sapiens
tttttctggcttagcagtgtatatcttatcccatgtataatgttatgtaatatattatatttattacaatatgataagggccatgtatcagcttgaacagagaga

SEQ ID NO: 54344 - DNA, 103 bp, Homo sapiens
ctttatagagtagtaaagagatcctaggagggttactgtttttgattatatgtctaactacaggattttgctgttttgcagggtttgttctatacttatgaag

SEQ ID NO: 54345 - DNA, 86 bp, Homo sapiens
gttgatagatgaatggataaagaatatgtttttatatatataatatgaatatataaaaaattttctgtattccttcatccatcaac

SEQ ID NO: 54346 - DNA, 92 bp, Homo sapiens
gagatgatggggttttctaaatataaaatcatgttgcctgcaaacaaagacaatttgacttcctctctttgtatttgaataccctttatttc

SEQ ID NO: 54347 - DNA, 156 bp, Homo sapiens
tatatatatatatacacacacatatatatacacacacatatgtgtatatatatgcacatataaatgtatgtgtatatatatgcacataaatgtatgtgtgtatatattatatatatattttatatatatactatatagtatatatatattttatat

SEQ ID NO: 54348 - DNA, 88 bp, Homo sapiens
tgtgcatatatatacacatacatttatatgtgcatatatatacacatatgtgtgtgtatatatatgtgtgtgtatatatatatataga

SEQ ID NO: 54349 - DNA, 91 bp, Homo sapiens
gactgcaacactgtgacagaaagactagtgacttaggtgtcaggagatccgtattcaagtcattaattagttctgtgactttgggaaagtc

SEQ ID NO: 54350 - DNA, 91 bp, Homo sapiens
gactttcccaaagtcacagaactaattaatgacttgaatacggatctcctgacacctaagtcactagtctttctgtcacagtgttgcagtc

SEQ ID NO: 54351 - DNA, 99 bp, Homo sapiens
cttggaaaaacagaaactgacccttccggtcctaaagcttgaaacttccttttttttttttttttttttttagagaccgagtctcactctgtcgctagg

SEQ ID NO: 54352 - DNA, 61 bp, Homo sapiens
gtgtgtgtgtctgcctgtctgtttctcccaactttcaggaggcactaagaggacatcacac

SEQ ID NO: 54353 - DNA, 109 bp, Homo sapiens
taaggtccttaatggattcctcggttctgtagggaagggtggagacttttttttttaaataagcaccagttttattaagccgaaacaacagcatttaagaaggctctta

SEQ ID NO: 54354 - DNA, 66 bp, Homo sapiens
tcctaggtcagagaatatatatgtgtgtgtgtgcatatatatatatatatctccaatgatctctga

SEQ ID NO: 54355 - DNA, 105 bp, Homo sapiens
tgtgatatatatatatgaatatatattatatatatgaatatatataacatgtgaatatatattatatatatgaatatatataacatatgtgaatatgtattatat

SEQ ID NO: 54356 - DNA, 116 bp, Homo sapiens
atctgttgttatatacatctgttgtgtgtatatatatatatatatatatataacagattatatatataacagattatatatatatataacagatcatatatacatatatatataac

SEQ ID NO: 54357 - DNA, 89 bp, Homo sapiens
gcagaggagtgacatgatctgacagattttttaaaggatatttatagctctactattttttatttttttgagacagagtctctctctgt

SEQ ID NO: 54358 - DNA, 90 bp, Homo sapiens
cccattaacagctattacatgagattctgggttacttgataaaaaattatcaggtcacagagagcagagtcctgatagaatgggactggg

SEQ ID NO: 54359 - DNA, 61 bp, Homo sapiens
cccagctgtttcagttcagttcatgtatatttatttacatggtttttgaaccacatttggg

SEQ ID NO: 54360 - DNA, 95 bp, Homo sapiens
ttttaggaggaaaatcaaactgaaaggtatgactgaaatgtaggcaaaactgtagatatgtcactgcctcttctttattttggcatttcctggag

SEQ ID NO: 54361 - DNA, 95 bp, Homo sapiens
ctatatatgtgtgtatgtgttcacatgtatgatgtgtatgtatatatatgtatacacacatacatttatatttagatatacacacatgcatttgg

SEQ ID NO: 54362 - DNA, 95 bp, Homo sapiens; identical to SEQ ID NO: 580

SEQ ID NO: 54363 - DNA, 93 bp, Homo sapiens; identical to SEQ ID NO: 69

SEQ ID NO: 54364 - DNA, 234 bp, Homo sapiens
tgtacatatatatatgtgtgtgttatatatgtgtatatatacacacatatatgtgtgtatatgtgtatatatatatgtgtgtatatgtgtatatatatgtgtgtatatatacacacatatatgtgtgtatatgtgtatatatatgtgtgtatatatacacacatatatgtgtgtatatgtgtatatatatgtgtgtatatatacacacatgtgtgtatatgtgtatatatatgt

SEQ ID NO: 54365 - DNA, 95 bp, Homo sapiens; identical to SEQ ID NO: 68

SEQ ID NO: 54366 - DNA, 93 bp, Homo sapiens; identical to SEQ ID NO: 69

SEQ ID NO: 54367 - DNA, 166 bp, Homo sapiens
gtgtgtgtgtgtgtatgtatgtatatgtatatatatatgtatatgtgtatatatatgtatgtgtatatatatgtatatgtgtatatatgcatgtatatgtgtatatatatgtatatgtatacataatctatatatatatataaatatatatgtgtgtgtgtgtata

SEQ ID NO: 54368 - DNA, 151 bp, Homo sapiens
gtggaataatataaaattaggtatagagatgtttaaaagaagtaaattattgtatttatatgtttgtattaagaaggaagttctgtatatctgattatatatttgtgatacatgagagaattcaccttgtgacagccatgtaaatataata

SEQ ID NO: 54369 - DNA, 113 bp, Homo sapiens
gcagtttggtttcggacatattaaatttcagattcctattagacatccaaatggaatgacaagtagtcagttggatatacaaatctggagtttggaagagagatctgggctgc

SEQ ID NO: 54370 - DNA, 116 bp, Homo sapiens
agacaggagagaagaaacctgggcgccttttaccattatcttgataaaatggcagtgacacgcactctgcctgccacaattagggtgataaatgctagtttctttcaggcttgttt

SEQ ID NO: 54371 - DNA, 106 bp, Homo sapiens
gttattaggggtgtgtgtatgtgtgtgtataaatgtgtatatatatgtgtgtgtgtgtgtgtttatgtatatatgcattccacgtatctatacatatataatatgc

SEQ ID NO: 54372 - DNA, 70 bp, Homo sapiens
gggtatttgctgatttttgaatattttttgagaatatagtcgaagaaatgtgaattagttgaagataccc

SEQ ID NO: 54373 - DNA, 115 bp, Homo sapiens
cattcttgtgcatctgattttgtgagttgacatttctttttttttcttctcttctctctctttttttttttttttttctgagatggagtctcactctgtcacccaggctggagtg

SEQ ID NO: 54374 - DNA, 75 bp, Homo sapiens
tggccatcttaacttgggcaggtggctggaggcaatgcaactcactaagtcactgactcccagactgagattcca

SEQ ID NO: 54375 - DNA, 115 bp, Homo sapiens
tgcctaggattgtcttggctatatgggctcttttttggttccaaatgaaatttaaagtagttttttctaattctgtgaagaaagccaatggtagcttgatagggatagcattgca

SEQ ID NO: 54376 - DNA, 149 bp, Homo sapiens
gtgtatatatgtatgtgtatatgtatatatgtatatgtgtatatgtatatgtgtatatgtgtatgtatataagtatatatgtatatatgtatatgtatatatgtatatatgtatatgtatgtatgtatatatgtatatgaatgtatatg

SEQ ID NO: 54377 - DNA, 97 bp, Homo sapiens
gtttacttcatgtctctgtgtcacatgttggtaattctcacaatatttcaaagatcattattattatatctgttacggtgacctgtggtcagtgagc

SEQ ID NO: 54378 - DNA, 56 bp, Homo sapiens
tgagacagtctcgctctgtcacccaggccggagtgcagtggtgcgatctgagctca

SEQ ID NO: 54379 - DNA, 115 bp, Homo sapiens
tggggatggagtagagatgcccttccctgagcaggaggggtacagtaggctctcctcacactcccactgtgactgcaggctttgagctgggcctgcggagggggaggagaagggg

SEQ ID NO: 54380 - DNA, 118 bp, Homo sapiens
ggcccatgcataggattcaggctcaatctgaaacaggtctgggctcagcctcagtctgtggctggcagcccagtccagctcactgggcccgacgtggcctgcgtccatgtgcttggct

SEQ ID NO: 54381 - DNA, 100 bp, Homo sapiens
ccgcatcagaggcacttcagctgagtggttagttgtgtgggccctggccaagaccagacctgcatttaacgctgggctccactgcttactagctgtgtgg

SEQ ID NO: 54382 - DNA, 130 bp, Homo sapiens
gtgggtttggggcttcagttcctcaagcccttatctcgggtgtctgcagtctatcccactctatctgtctggccatctgtgaaccctggttcctgtgtgtatcttctggtcttgactgtttatcttgata

SEQ ID NO: 54383 - DNA, 68 bp, Homo sapiens
gcatctcactgtgtgtgtgtgtgcgcgcgcgtgtgtgtgtgtgcgcgcgcgcgcgcgtgtgtgtaggc

SEQ ID NO: 54384 - DNA, 110 bp, Homo sapiens
atgtacatgcagtaacttctatactagactgtgactcagacgctcacaatcacactcaaacacagtctagtgtttttcacagcctggtatagaaggtactgcctgtacat

SEQ ID NO: 54385 - DNA, 101 bp, Homo sapiens
ttcactctgattctgatgctgattggccctgaagaacagctctctactctctttggctgttctatttcatcccaagcttagctcagcccagaatcaatgaa

SEQ ID NO: 54386 - DNA, 70 bp, Homo sapiens
tctcactgcgccagcgtagtgactgcctgccctcctcgaaagggtgtctcactgtgccagtgtagtggga

SEQ ID NO: 54387 - DNA, 129 bp, Homo sapiens
gatcagtttcagagcagtgctagggtcccaggccaagttgcaatggatctcagtgaggacagactgaggtaagcagttgggtatagtgattaaggtcccagcatctagagctgtccatgatgatatcca

SEQ ID NO: 54388 - DNA, 118 bp, Homo sapiens
gattggctagctgtgcagccagctggctccctggctgtctgcctggctgtctgtgtctatctgattgtccacaggggctaactgtgctctgttctctggggccatacctggtggatat

SEQ ID NO: 54389 - DNA, 58 bp, Homo sapiens; identical to SEQ ID NO: 1673

SEQ ID NO: 54390 - DNA, 138 bp, Homo sapiens
gggatgtggtcaaaattctgtactaatatcttacagtgttatttagaatttttttttttgagaccgtgtctcgctctgtcacccaggctggggtgcagtggcgccatctcggctcactgcaagctccgcctcccaggt

SEQ ID NO: 54391 - DNA, 111 bp, Homo sapiens
ctgctgctcatttgtactctgtcagtctcttgcctcactttatttctttatttaagaaatatttgagtgcctaatatatgccaaggactgttttaggtactggggatacag

SEQ ID NO: 54392 - DNA, 57 bp, Homo sapiens
cagtgactcctactctctctctaagattaatacagcagagagtgggactttgtcctg

SEQ ID NO: 54393 - DNA, 95 bp, Homo sapiens; identical to SEQ ID NO: 68

SEQ ID NO: 54394 - DNA, 93 bp, Homo sapiens; identical to SEQ ID NO: 69

SEQ ID NO: 54395 - DNA, 58 bp, Homo sapiens; identical to SEQ ID NO: 1847

SEQ ID NO: 54396 - DNA, 113 bp, Homo sapiens
gctgtgctaaggttcagggactgttgttatttctctctcaccctctgacccattatactgctgaggaaattggggtgcagagaagttaagggacttccttaaggtcacatagc

SEQ ID NO: 54397 - DNA, 102 bp, Homo sapiens
ggtcacagtagaaagcctgtggaggattttaagcaaagaagtgacataatctatcacttattaatattttttttaaatctctcttgggtgggtgcggtggct

SEQ ID NO: 54398 - DNA, 95 bp, Homo sapiens; identical to SEQ ID NO: 68

SEQ ID NO: 54399 - DNA, 93 bp, Homo sapiens; identical to SEQ ID NO: 69

SEQ ID NO: 54400 - DNA, 84 bp, Homo sapiens
aaaccatatcaatgatgaggatgatgatgatgatgattattattattattattattatattattcagtttttgtatataggttt

SEQ ID NO: 54401 - DNA, 95 bp, Homo sapiens; identical to SEQ ID NO: 68

SEQ ID NO: 54402 - DNA, 93 bp, Homo sapiens; identical to SEQ ID NO: 69

SEQ ID NO: 54403 - DNA, 95 bp, Homo sapiens; identical to SEQ ID NO: 580

SEQ ID NO: 54404 - DNA, 93 bp, Homo sapiens; identical to SEQ ID NO: 69

SEQ ID NO: 54405 - DNA, 101 bp, Homo sapiens
cagcacctaaatagggtgatgacttcatcacagaatttttttttttttttttttttttttttttttttttgagacggagtctcgctctgtcacccaggctg

SEQ ID NO: 54406 - DNA, 58 bp, Homo sapiens; identical to SEQ ID NO: 884

SEQ ID NO: 54407 - DNA, 56 bp, Homo sapiens; identical to SEQ ID NO: 885

SEQ ID NO: 54408 - DNA, 107 bp, Homo sapiens
ttcctgacccctgatctctgcctggctatcatatgttatactatatgaaaatataatgatatatttgtgtatttataagtgagatatagcaggaatttgtataggag

SEQ ID NO: 54409 - DNA, 130 bp, Homo sapiens
caagtaatgatgtggtgcttaactagggataaggcaatggcaatagagaggacagaagagactgtggtcagtggtcaatttacttaattttaagataccacattcttttgattttcctcctactcctgct

SEQ ID NO: 54410 - DNA, 115 bp, Homo sapiens
gagtttgtatgtgccaaacttgttcccccttatagaagactagtgatttatatgtactacaaatgactgttgggaggaaatgattgcaagttctttaaggcaaggactgtgactt

SEQ ID NO: 54411 - DNA, 89 bp, Homo sapiens
cctattctcttactctgtttctctgtgggtatgggtgttgaagagataagatgggagggagggagggatggagggagggagagaaaggg

SEQ ID NO: 54412 - DNA, 109 bp, Homo sapiens
atggaagcatatgtatatatgtgtgtatatatatatgtgtacatatatatatgtgtgtgtatatatgtatatgtaagcatatatatatatttatacattgtttattcat

SEQ ID NO: 54413 - DNA, 124 bp, Homo sapiens
gtatatgtatgtgtgtatatgtgtatatatgtacatatatgtgtatatatgtatatatgtacatatgtgtatatatgtatatgtgtacatatgtgtatatatacatgtatatatgtatgcacat

SEQ ID NO: 54414 - DNA, 93 bp, Homo sapiens; identical to SEQ ID NO: 69

SEQ ID NO: 54415 - DNA, 118 bp, Homo sapiens
tgccacaggatgattcagaacatttggccttaattactttgattgtccgccaggatttaatatatgaatattacattgcgatcttcaatttaatttcttgtgtaaatggattgtggca

SEQ ID NO: 54416 - DNA, 95 bp, Homo sapiens; identical to SEQ ID NO: 68

SEQ ID NO: 54417 - DNA, 93 bp, Homo sapiens; identical to SEQ ID NO: 69

SEQ ID NO: 54418 - DNA, 91 bp, Homo sapiens
atatatatacggaatatatatacggaatatatatgtatatgtatacggaatatatatacggaatatatgtatatgtatacggaatatatat

SEQ ID NO: 54419 - DNA, 80 bp, Homo sapiens
tctccctcccttccccttctctctctctatatctatctatctatctatctatatatatatagagagagagagagagagaa

SEQ ID NO: 54420 - DNA, 95 bp, Homo sapiens; identical to SEQ ID NO: 580

SEQ ID NO: 54421 - DNA, 93 bp, Homo sapiens; identical to SEQ ID NO: 69

SEQ ID NO: 54422 - DNA, 95 bp, Homo sapiens
gcctcatttaatcctcagtactcattttgtatatcagtcaaggcagatatcattctcctgattttagagatgaagaaactgtgtctcagagaggt

SEQ ID NO: 54423 - DNA, 115 bp, Homo sapiens
aggactatgctctgacttccagatctcatccactctgctctgctctactctggaacctcagaggagaaagtgagcacagccatggtaagattcaagatgtctgataggtagtcct

SEQ ID NO: 54424 - DNA, 63 bp, Homo sapiens
acatatattatatatgtatatatgtgtacatatatacacatacatacatgtgtgtatatatgt

SEQ ID NO: 54425 - DNA, 79 bp, Homo sapiens
tgagacagagtctcgctctgtcacccaggctggagtgcagtggcgcgatcttggctcactgcaacctctgcttcctggg

SEQ ID NO: 54426 - DNA, 58 bp, Homo sapiens; identical to SEQ ID NO: 1725

SEQ ID NO: 54427 - DNA, 141 bp, Homo sapiens
atatgcatatatatatatatacgtatgtttatatacgtatatatatgtgtatatacatgtatatatatgtgtgtatatatacgtatatatgtgtgtatatatatacgtatatatgtgtgtgtgtgtgtatatatatatata

SEQ ID NO: 54428 - DNA, 95 bp, Homo sapiens; identical to SEQ ID NO: 68

SEQ ID NO: 54429 - DNA, 93 bp, Homo sapiens; identical to SEQ ID NO: 69

SEQ ID NO: 54430 - DNA, 95 bp, Homo sapiens; identical to SEQ ID NO: 68

SEQ ID NO: 54431 - DNA, 93 bp, Homo sapiens; identical to SEQ ID NO: 69

SEQ ID NO: 54432 - DNA, 95 bp, Homo sapiens; identical to SEQ ID NO: 580

SEQ ID NO: 54433 - DNA, 93 bp, Homo sapiens; identical to SEQ ID NO: 69

SEQ ID NO: 54434 - DNA, 77 bp, Homo sapiens
tctctccaacaaaggagaaaaatgtaacacatttcaatactctgcggagtgagttctttttttctttatctgaggga

SEQ ID NO: 54435 - DNA, 86 bp, Homo sapiens
atatatatacatgtatgtatatatatacacacatatgtatagatatatatctgtgtgtgtatgtgtatacatatatatatatatat

SEQ ID NO: 54436 - DNA, 91 bp, Homo sapiens
atatacactgtatatacatagtatacatataatcattgtatatgtatatatgtatacaatgtctgtatgtatcactgtgtatactgtatat

SEQ ID NO: 54437 - DNA, 117 bp, Homo sapiens
ttcacttttgaagcttaatttgactggatatgaaactctgggttgaaaatttttttctttaagaatgttgaatattggcccccagtctcttctggcttgtagggtttctgcagagag

SEQ ID NO: 54438 - DNA, 71 bp, Homo sapiens
cctgatgatctgtcactgtctctcatgacccccagatgggatcatctagttgcaggaaaacaaggctcagg

SEQ ID NO: 54439 - DNA, 147 bp, Homo sapiens
atatatatatatgcatatctgtgtgtatatatatatatatatatgtgtgtgtgtgtgtgtgtatatacatatgtgtgtgtatatacatatatgtgtatatatatatgtgtgtatatatacatatacatattcagcatcaccttatat

SEQ ID NO: 54440 - DNA, 79 bp, Homo sapiens
gacggagtctcactctgtcacccaggatccttaaattttttctttcttttctttttttgagacggagtctctctctgtc

SEQ ID NO: 54441 - DNA, 58 bp, Homo sapiens
tgagtcaggctctcactctgtcgcccagactggagtgcagtggtgcgatctcggctca

SEQ ID NO: 54442 - DNA, 78 bp, Homo sapiens
tgtttctaagttgatgaggcactatatattttatgcatttatatatgttaaacattatgctacattattttagaaaca

SEQ ID NO: 54443 - DNA, 93 bp, Homo sapiens
cttcctttggcatgaggtcatcaggatctatatgaatgctctgggatgggggtctttgtgtctgcctgtgtctgcctgtcttgtcttagttgg

SEQ ID NO: 54444 - DNA, 88 bp, Homo sapiens
atgtatatatgtatatatatttgcccctcgtatatatgtgtgtgtatatatatgaggggcaaatatatatacatctatatatgtatac

SEQ ID NO: 54445 - DNA, 85 bp, Homo sapiens
tgtatacatatatactgtatacatatatatgtatgtatacatatatactgtatacatatatactgtatacatatatatgtataca

SEQ ID NO: 54446 - DNA, 84 bp, Homo sapiens
agcattaaaattacaactactcaatttctagatctgaaaataaggaatccttatttgttctggaaatcagtggtggtgagggct

SEQ ID NO: 54447 - DNA, 95 bp, Homo sapiens; identical to SEQ ID NO: 68

SEQ ID NO: 54448 - DNA, 93 bp, Homo sapiens; identical to SEQ ID NO: 69

SEQ ID NO: 54449 - DNA, 99 bp, Homo sapiens
catacatgcatatatatgatggttaccaatagttatatatatatacaatggcatacatgtaatacatatacatataccgtcatgtgtcagttaatgatg

SEQ ID NO: 54450 - DNA, 95 bp, Homo sapiens; identical to SEQ ID NO: 580

SEQ ID NO: 54451 - DNA, 93 bp, Homo sapiens; identical to SEQ ID NO: 69

SEQ ID NO: 54452 - DNA, 117 bp, Homo sapiens
gttggattatgggcctgctttaccctgttatgacctcattttaatatgattatatctacaacaaacatatttccaaataaggtcacattctgaggtactggcggttagggcttcaat

SEQ ID NO: 54453 - DNA, 112 bp, Homo sapiens
tatgtgaaaccttcagaattccatgggcaaataaaccattctttcttttttaaattaattttaatttttaagttctcgggtacatgtgcaggatgtgcaggtttgttacata

SEQ ID NO: 54454 - DNA, 74 bp, Homo sapiens
tatatatatacacatacatgtatgtatatatacgtatatatgtatatacgtatatatatgcatatatatataca

SEQ ID NO: 54455 - DNA, 67 bp, Homo sapiens
gcatatgcatattatgctatgtacagtgtatatatatatacatatatagtgtatatatgatatgtgt

SEQ ID NO: 54456 - DNA, 96 bp, Homo sapiens
gaaacgaactcttggagaccagttcattcataaggcagagcttgatagcactgtatatttttctgtcttctatgtaaactatcaggaagttcattc

SEQ ID NO: 54457 - DNA, 73 bp, Homo sapiens
ccaggcatggtggtgctggcctgtagacccaactagttatgaggctgaggtaggaggatcacttgggcccagg

SEQ ID NO: 54458 - DNA, 90 bp, Homo sapiens
gcaataagtttttaattttgatgaagtccaatttaactatttctttcttttgacattgtgcttttggtgctgcatctaagaaactattgc

SEQ ID NO: 54459 - DNA, 127 bp, Homo sapiens
ccagccttgttctttttgttgaggattgtcttggctatgcgggttcttttttggttccatatgaaatttaaagtagttttttccaattctgtgaagaaagtcagtggtagcttgatggggatagcat

SEQ ID NO: 54460 - DNA, 107 bp, Homo sapiens
tctgacctagaagtcgccataattagagctgtaggcatggtgaggaagttgcatgtatacgggtgccagctttcaacgggcttagaattggagggggcgggggcaga

SEQ ID NO: 54461 - DNA, 134 bp, Homo sapiens
catggactgagctggcccagaatcttgaaaaatagccaaccactgataaatgctttctagttaagagttcagactctggagtcaggaagttctggcagcaagcctcagcttgtgtttattacttcacctctcta

SEQ ID NO: 54462 - DNA, 104 bp, Homo sapiens
aaggaacaaatgaagtaggaagaaatgcattcccttctgtgactctcctcagccactgtctgtgtcactgtctataatatatactccttgcttttcatttcctt

SEQ ID NO: 54463 - DNA, 93 bp, Homo sapiens
ggtaccagaactcttgatgtgtaaagggctggccatatggagactgaacaaagtcagtgaagcttggctcctgtgcaaatcagagatgggctc

SEQ ID NO: 54464 - DNA, 76 bp, Homo sapiens
gatatatcatatataaatataaatgctgctcagatagatcaatctatgtatctatgtatttatgtatgtatgtatc

SEQ ID NO: 54465 - DNA, 93 bp, Homo sapiens
ggctttccgctccggccccggactgaccgtctgtctgtccgcagggtggcctgcgtgatggttggcagagcgtgcgggggaggcggccgagcg

SEQ ID NO: 54466 - DNA, 93 bp, Homo sapiens
gaaaacaatgtttgagtcccagttctgcctctggctcactgtgtgaccctgggtgagtcacttgatgtctctgggatttagttgccaactttc

SEQ ID NO: 54467 - DNA, 58 bp, Homo sapiens
tgagacagggtctcactctgtcacccaggctggagtgcagtagtgcgatctcgtctca

SEQ ID NO: 54468 - DNA, 84 bp, Homo sapiens
ggttgataggagatgaacatagacagtagagagtgatgtctgaagtccctgtcattgacatgtgaaactgatctccagtcaccc

SEQ ID NO: 54469 - DNA, 80 bp, Homo sapiens
ggtagaggagacccttcagaaggaataagaggaacgtactcctccttgtacagatctgcctgactgtctcactcgatacc

SEQ ID NO: 54470 - DNA, 111 bp, Homo sapiens
gtattcacaatcccttagctagacaaaaaggttctctaagtccccaccagatcagctagacacagagcacagattggtgcatttacaaaccttgagctagacacagagtgc

SEQ ID NO: 54471 - DNA, 70 bp, Homo sapiens
atgtacatgtgtgcatgtatacatatgtgtatgtatgtatgtatgtatatgtgtacatatacatgtacat

SEQ ID NO: 54472 - DNA, 113 bp, Homo sapiens
tgcaaaagtggaccaggccattggagaattcaagatttcttttaaaatatataatatttaagatatatttggaagtactggaagcatactggcagtctgaagagatttgagca

SEQ ID NO: 54473 - DNA, 76 bp, Homo sapiens
gcattcatagtgaatacacaatgtggtattttgtttttatcacttgacatcataccataagtgtttttgttgttgc

SEQ ID NO: 54474 - DNA, 80 bp, Homo sapiens
gcccaaccttttgtagtctgagaaaaccagtggtgtgctctataagtgagacagtattcagtgtgcagaaggtacttggc

SEQ ID NO: 54475 - DNA, 71 bp, Homo sapiens
ttgcttttgattcaggctctcgctctgtcaccctggctggagtgcagtggtgtgaccatggctcaccgcag

SEQ ID NO: 54476 - DNA, 92 bp, Homo sapiens
ttgtggttcttctgtccttttgattggaagagggtttcccacatgtctgtgtgtctcacttttaaaaataaaacaaaggaaagaaaccccaa

SEQ ID NO: 54477 - DNA, 80 bp, Homo sapiens
cctagactcaggcagttctttatagtaatgcgagaacggactaatacacatgagtatattgaatgatgctgaggtttagg

SEQ ID NO: 54478 - DNA, 99 bp, Homo sapiens
aagtcagaatatgagaaacagaagacaagttattatcttcttctcagggaagctgtaattaatggtgacttgactttatccagaagctcaggctggctt

SEQ ID NO: 54479 - DNA, 59 bp, Homo sapiens
tgagacagggtctctcagtgtcacccaaggctggagtgcagtggcatgatcatgtctca

SEQ ID NO: 54480 - DNA, 58 bp, Homo sapiens
tgagacagagtctcgctctgtcacccaggctggagtgcagtggtgtgatcatggctca

SEQ ID NO: 54481 - DNA, 58 bp, Homo sapiens
tgagacagactctggctctgtctcccaggctggagcacagtggcagaatctcagctca

SEQ ID NO: 54482 - DNA, 100 bp, Homo sapiens
ccatggcaaaggagtcaaaaggaagaatatgaagtatgttaaaagttgccacatatcacttttttttttttgagacagtgtttcgttctttttgcccagg

SEQ ID NO: 54483 - DNA, 82 bp, Homo sapiens
aaagttgctgcagtagagagcaattagctgaagctgccttgttgctggcacctgcttccaagtctctctgtctcagttcttt

SEQ ID NO: 54484 - DNA, 84 bp, Homo sapiens
tcctgctttcataggctgtgtaaccttgggcaactcagttctcctctctgagcctcagtgtctgcatgcttagagtgctttgga

SEQ ID NO: 54485 - DNA, 109 bp, Homo sapiens
tctctgtggaattattttgataagtttggagctgtttattttttctttcattctgttgtctcttgtgcagatggaagagaagcctcctatattagcttagtttaagtga

SEQ ID NO: 54486 - DNA, 68 bp, Homo sapiens
gagtgagggataaaggggggactttcactttttttttttcttttctagacagtctccctctgtcaccc

SEQ ID NO: 54487 - DNA, 96 bp, Homo sapiens
ttgttttgtttttgagacaaagtctcactctgtcacccaggctggagtgcagtgccgtgatctcagctcactgcaacctctgcctctgggctcagg

SEQ ID NO: 54488 - DNA, 69 bp, Homo sapiens
gtgcactttggaaggtatatccagtatgtctcagatcactagacacacataccccttccaccattgcac

SEQ ID NO: 54489 - DNA, 112 bp, Homo sapiens
ttacaggcatgagccactgcttcaagcccataaatattcctttagtgaatgaatgaatgaatgaatgaataaggaagttttctgggcagggcacagtggctcatgcctgtaa

SEQ ID NO: 54490 - DNA, 77 bp, Homo sapiens
ttcatccctgggtggggatttgttgcattacttgtgttctatataaagtattgcacttgtcccggcctgtggaagaa

SEQ ID NO: 54491 - DNA, 113 bp, Homo sapiens
agacattgctacttacaattagttttgcaggtttgcatttcagcgtatatatgtatatgtggctgtgcaaatccatgcaaaactgattgtgataatgtgtgcttcctacgtct

SEQ ID NO: 54492 - DNA, 100 bp, Homo sapiens
agattgggtcctagtagtaccaaagtgctcatagtgcaggtagttttggcatgactctactgtagtatgggcacttccagtactcttggataacaaatct

SEQ ID NO: 54493 - DNA, 91 bp, Homo sapiens
gtagttgatgcttttgagctgcttcttataatgtgtctcttgtgttaaggtgcatctagtgcagttagtgaagcagcttagaatctactgc

SEQ ID NO: 54494 - DNA, 111 bp, Homo sapiens
gctacaggaataggccttggccatgtaaaagtgcttacagtgcaggtagctttttgagatctactgcaatgtaagcacttcttacattaccatggtgatttagtcaatggc

SEQ ID NO: 54495 - DNA, 111 bp, Homo sapiens
tacatgttaactgtgagtgaggatgaactttttttaatgcttttctggatatttgtatttctttaaagaagcactttcctcaagtgagccggaaattcatagaaatatgtg

SEQ ID NO: 54496 - DNA, 91 bp, Homo sapiens
gagcaattgatcatttgagagaagtctgtggcatacttgatagaagacaatcaggaaagggctatttatcttgttcttttttctcatgctc

SEQ ID NO: 54497 - DNA, 94 bp, Homo sapiens
cattcctttactcatgcatcttacattgttaatttatttcaaagtaaatactttggtatgaattgactacagtgtattgacttgtttttgaatg

SEQ ID NO: 54498 - DNA, 74 bp, Homo sapiens
gtttcctcatctgtaagttctggataattttgtctattcacaggattgttgtgaggatcagatgagatgtgaac

SEQ ID NO: 54499 - DNA, 58 bp, Homo sapiens; identical to SEQ ID NO: 31434

SEQ ID NO: 54500 - DNA, 79 bp, Homo sapiens
tgagacagagtctcactctgtcgcccaggctggggtgcagtggtgcgatctcggctcactgtaacctctgcctcccggg

SEQ ID NO: 54501 - DNA, 89 bp, Homo sapiens
tgcagatttatgtcttctgattttcatgtggtcagtgacatcattgtgccctgtgagtggctgataaatgcggacaaatgatttatgca

SEQ ID NO: 54502 - DNA, 108 bp, Homo sapiens
ggcttctgagacagagtttgagttctctcttcaactaccataacacttaacctgtatctttttttttttttttttttttagacggagtctcgctctgtcactcaggct

SEQ ID NO: 54503 - DNA, 98 bp, Homo sapiens
ttctctgtatgtagtcgatttctttgaggtatacttttctctccagaatagttagatgtaggtataccactttgatgttgacactagtttacctagaa

SEQ ID NO: 54504 - DNA, 58 bp, Homo sapiens
tgagacagggtctcactctgtcacccaggctggagtgtagtggtgcaatctcatctca

SEQ ID NO: 54505 - DNA, 66 bp, Homo sapiens
gtatgtatgtatatatgtgtgtgtgtgtatatatatatatacacacacatatataaatatatatac

SEQ ID NO: 54506 - DNA, 75 bp, Homo sapiens
gtgaacaaaagagacaaagaccctgctcttgtggtgtttccctaccacattgagttgtgcctctgtctctgtcac

SEQ ID NO: 54507 - DNA, 112 bp, Homo sapiens
tgcaactaaagtcacaactcctctgcctacttccagaccccccataatgttttttgttttttttttgagacagagtctcagtctgtcgcccaggctagagcgcagtgatgca

SEQ ID NO: 54508 - DNA, 106 bp, Homo sapiens
gcatatcattgcaaatatatatgcatatatatatacatatgtatatatgcatatatatacatatgtgtatatgcatatatacatatgtatatgtatgtgtgtgtgt

SEQ ID NO: 54509 - DNA, 78 bp, Homo sapiens
atatacatatgtatatatgcatatacacatatgtatatatatgcatatatacatatgtatatatatatgcatatatat

SEQ ID NO: 54510 - DNA, 99 bp, Homo sapiens
ccagacactgaggcctcatattgtatgattttatttacatgaaatatccaggataggtaaatttgtagagttggggcactgatgatttccagagtctgg

SEQ ID NO: 54511 - DNA, 112 bp, Homo sapiens
ggaaaaaggatattatgcaatttaggcttagaaagttatgtttgagtatatcccagcagctctgttactctctcttaaacatcttctgataaattccattggtttttttttc

SEQ ID NO: 54512 - DNA, 115 bp, Homo sapiens
ctcaaagtgctgggattacaggcgtgagccaccacgcccggcccgattttttttatataaaaactggatcctggccaagcacggtggctcacgcctgtaatcccaacactttggg

SEQ ID NO: 54513 - DNA, 83 bp, Homo sapiens
tgtagccctcagtttttctgaggcaaaatgaaggtgataataatgcctacctcatggggttgctgtgagaattgagtgagata

SEQ ID NO: 54514 - DNA, 69 bp, Homo sapiens
aaagtgctgggattacaggcatgagccactgcgtgtggcctgctagtatcttttttttttaaacgcttt

SEQ ID NO: 54515 - DNA, 98 bp, Homo sapiens
taagactcaggcttggtttaactttcagatgtcaaatcaaatagatgttagtttgttcttctgaacctggcttaaaccggcaagttgatgttgtctta

SEQ ID NO: 54516 - DNA, 113 bp, Homo sapiens
acaaaatatctgaatattggagagatatagtcatgaactggaagatttgatattgttagtatatcaattctcccaaaattgatgtatagattcaaagtcccagcaagtgtttt

SEQ ID NO: 54517 - DNA, 103 bp, Homo sapiens
gggtagcaaagtgggtaaaaagcatatgaagagacacgcattatcattagtaataatagaaatgtaattttttttttagaaacagggtctcactctgtcaccc

SEQ ID NO: 54518 - DNA, 88 bp, Homo sapiens
aggccaggagcaccaaggaatcagcaccctcctgggagcagccttcaatcaatgccagatgggagttggtatatatatgccccagcct

SEQ ID NO: 54519 - DNA, 72 bp, Homo sapiens
tgtatgtgtgtgtgtatatgcatgtatgtacattttaacatgtatatttattatcttacacacacacacaca

SEQ ID NO: 54520 - DNA, 90 bp, Homo sapiens
tggtagcttgcagggagggtatactagcaaaacagtgattttttttttaaatgcacatttctgtagacatgcccccaaagagcctggcca

SEQ ID NO: 54521 - DNA, 86 bp, Homo sapiens
gcatgtatgtatgtgtgtgtgtatatgcatgtatgtacattttaacatgtatatttattatcttacacacacacacacacacacac

SEQ ID NO: 54522 - DNA, 72 bp, Homo sapiens; identical to SEQ ID NO: 54519

SEQ ID NO: 54523 - DNA, 77 bp, Homo sapiens
gccagggattagaggctgagtggagagtgcgcacacggtgtcaggagacactcttcttctaatctttcatttctggt

SEQ ID NO: 54524 - DNA, 81 bp, Homo sapiens
ttcctgttatacttttgagaatggctactattttaaaaatattttttaaatatgttgtccattgttatggtgtgtttggaa

SEQ ID NO: 54525 - DNA, 58 bp, Homo sapiens
tgagacatggtctcgctctgtcactcaggctggagtgcattggcatgatcatggctca

SEQ ID NO: 54526 - DNA, 100 bp, Homo sapiens
agccaccgcacctggccgttgtttttttgttgttcattttcccccaaggtaattttgagagcaaagttcacaggccagagtgaccttttttattgtggtt

SEQ ID NO: 54527 - DNA, 89 bp, Homo sapiens
agtcgaaggccaaagttagagcctggaatgtgtcggtaaatgcactggcttcctctgagaacagtctgaggttttgcttgcactggatt

SEQ ID NO: 54528 - DNA, 60 bp, Homo sapiens
ctgtggagaggattcttctgtgggcttctgattcagccctgtggggaagactcttcctag

SEQ ID NO: 54529 - DNA, 105 bp, Homo sapiens
taatgggagattagaaagtgtgtgtgtgcatgtatatataccccctaccaacacacacacacacacacacacacacacacacacacacattaaaatctcccatta

SEQ ID NO: 54530 - DNA, 117 bp, Homo sapiens
taatgggagattagaaagtgtgtgtgtgcatgtatatataccccctaccaacacacacacacacacacacacacacacacacacacacacacacacacacattaaaatctcccatta

SEQ ID NO: 54531 - DNA, 105 bp, Homo sapiens; identical to SEQ ID NO: 54529

SEQ ID NO: 54532 - DNA, 96 bp, Homo sapiens
tagataggtatttaacattatatatgcatatatacatacatatatttatatgtgtgtgtgtgtgtgtgtcagatcatgcgaatgccttttactcta

SEQ ID NO: 54533 - DNA, 109 bp, Homo sapiens
gaggactacctgttagaggcaatgaagaggtagagagaaaattgtaaatatttataataatgtttgtgttatttagtattatcaatctttatactcacagatagttctt

SEQ ID NO: 54534 - DNA, 104 bp, Homo sapiens
aggcacgagaatcactggaacctgggaggtggaagttgcagtgagctgagactgtgtcactgtcactacactccggcctgggaaacagagcgagactcctgtct

SEQ ID NO: 54535 - DNA, 100 bp, Homo sapiens
ctgtaatggccagtgattggcacttgtgagcatttcttattttattttatttttattttttgagacacagtcttgctctgtcgcccaggctggagtgcag

SEQ ID NO: 54536 - DNA, 111 bp, Homo sapiens
ctgtggtctgagtgaggccagtagacatgttttgtttggatagcttagtataaaacaattttttattttaaacacctttaggcaagatatgtactcactagatcagcacag

SEQ ID NO: 54537 - DNA, 107 bp, Homo sapiens
gacatctcattgtctccaggtggtgatgtggtgagtttcagttctttgatacttttttttgacagagtctcattctgctacccaggctggagtgcaatggcagtatc

SEQ ID NO: 54538 - DNA, 58 bp, Homo sapiens; identical to SEQ ID NO: 10482

SEQ ID NO: 54539 - DNA, 73 bp, Homo sapiens
ccacgtggcttgaaatttttcaattcttatgtattgttttaaaaacaagacagaacaatgtcaggtgaggtgg

SEQ ID NO: 54540 - DNA, 95 bp, Homo sapiens; identical to SEQ ID NO: 68

SEQ ID NO: 54541 - DNA, 93 bp, Homo sapiens; identical to SEQ ID NO: 69

SEQ ID NO: 54542 - DNA, 84 bp, Homo sapiens
atgtatgtatgtatacatatatgtatatgtatgtatacctatatataggcgtatatatgtgtatatatatgtatatacatatat

SEQ ID NO: 54543 - DNA, 93 bp, Homo sapiens
ggcatagctggaacttgaacacagactagagagaggccaccacctgtgttatttgccaccacactatactgtatctcagagttccacaatgct

SEQ ID NO: 54544 - DNA, 117 bp, Homo sapiens
ctgtgtaaatagttgttatactgcattgggttttaaatttgtattgttttttgttttttctgaacattttcaatgcacggttggttgaatccacagatgtgaaacatgtggatatgg

SEQ ID NO: 54545 - DNA, 84 bp, Homo sapiens
cttctctcctgtgcttgcttcagtgtggcattcatcctttttcacgagggagagggttaaatgagagatcagagagaagaggag

SEQ ID NO: 54546 - DNA, 108 bp, Homo sapiens
tgtagatgcactttattaagttgaagaaattcttctttattcttatttttttccatgagttattttttttcgaataggtgtttaattttgttaagtgctttttctgca

SEQ ID NO: 54547 - DNA, 98 bp, Homo sapiens
ttatagcagtgtgagaatggaataatacaggttgtcactattttttttaatgttagccaacctgatagttatatagcgatatctcactacagttttaa

SEQ ID NO: 54548 - DNA, 58 bp, Homo sapiens; identical to SEQ ID NO: 1673

SEQ ID NO: 54549 - DNA, 111 bp, Homo sapiens
tgagtggctgggattataggtgtgtgccaccacggccgactaatttttgtatttttagtacagatgcagtttcaccatgttggccaggctggttttgaattcctgatctca

SEQ ID NO: 54550 - DNA, 58 bp, Homo sapiens
tgagacagagtctcactctgtcacccaggcaggagtgcagtggtgtgatctctgctca

SEQ ID NO: 54551 - DNA, 76 bp, Homo sapiens
ttgtttttgttttgagatggagtctcactctgtcactcaggcaggagtgcagtgacacgatctcagctcactgcag

SEQ ID NO: 54552 - DNA, 104 bp, Homo sapiens
gctggcgcgtgcgtgcgtgcgctttctctgcttgtctctcacactgtctctggctccggggagttttggtcgctagcgctagcgcatgcgcgtgcgctctctgt

SEQ ID NO: 54553 - DNA, 115 bp, Homo sapiens
tgtgcataggtaacatgcaaacactatgccactttattctttattttttattttgtattatactttaagttctagggtacatgtgcacaatgtgcaggtttgttacatatgtata

SEQ ID NO: 54554 - DNA, 110 bp, Homo sapiens
ggattatcatgggagggtactggtggtttcataagaagaggaagagagacctgagttagcacactcagcccccttgccatgtgatgctctgtaccaccttgggactgtcc

SEQ ID NO: 54555 - DNA, 91 bp, Homo sapiens
ataaaaatatatatatataaatatatatctcttgctggttctggtttttgctagaatctatatgtgtgtatatgtgtatatatatgtgtgt

SEQ ID NO: 54556 - DNA, 64 bp, Homo sapiens
gttatatatagaagtgtgtatatatatatatgtgaacatatatacacacacacatatatatggc

SEQ ID NO: 54557 - DNA, 110 bp, Homo sapiens
gagagtgtgtgtgagctgtctttgtgtttactttcaagagaaaatgactattctcattttctagatctccacttgagccctattccaatgtgattatgcccaccattctt

SEQ ID NO: 54558 - DNA, 90 bp, Homo sapiens
gatgttgcacttcccagcctccataactgtgagagataaattttcattgtttataaattaccagtctggccaggtgggattactcacgtc

SEQ ID NO: 54559 - DNA, 71 bp, Homo sapiens
tgtgtatatatgtgtgtatatatgtatatgtagtatactatataccatatatgtacacacacacacacaca

SEQ ID NO: 54560 - DNA, 58 bp, Homo sapiens
tgagatgaagtctcactctgtcacccacgctggagtgcaatggtgtgatctcagctca

SEQ ID NO: 54561 - DNA, 69 bp, Homo sapiens
tttttttgagacgagtctcactctgtcacccaggctggagtgcagtggtgtgatctcagctcactgaag

SEQ ID NO: 54562 - DNA, 95 bp, Homo sapiens; identical to SEQ ID NO: 68

SEQ ID NO: 54563 - DNA, 93 bp, Homo sapiens; identical to SEQ ID NO: 69

SEQ ID NO: 54564 - DNA, 79 bp, Homo sapiens
tgatggtgaagacgaactgcagctggggatagagaagggcctgatcctttcataatctctctcagtcagtcttccctca

SEQ ID NO: 54565 - DNA, 58 bp, Homo sapiens
gagaccgagtctcactctctgtcgctggagctggagtagagtggcgcgatcttggctc

SEQ ID NO: 54566 - DNA, 83 bp, Homo sapiens
tggagaacttctatactgtttttcatgatggatgtactaccttacactcccaccaacagtgtacaagacttatattttctcca

SEQ ID NO: 54567 - DNA, 73 bp, Homo sapiens
ccatttctcaaggggaatgcttccggcttttgtccattcagtgtgatgttggctgtgaatttctcagagatgg

SEQ ID NO: 54568 - DNA, 95 bp, Homo sapiens; identical to SEQ ID NO: 68

SEQ ID NO: 54569 - DNA, 93 bp, Homo sapiens; identical to SEQ ID NO: 69

SEQ ID NO: 54570 - DNA, 76 bp, Homo sapiens
tgctgctctgtctgtctgagtgggagctgcaatctagtcttgcatcccatctgccatgatccccctgacagcagca

SEQ ID NO: 54571 - DNA, 108 bp, Homo sapiens
tgcagtatatttctttcaggtatattcactaaatgaatatcaggtctattcactgaatgaatgaatgaatgaatgaatgaatgaatatacctaaatgaaaatgccgta

SEQ ID NO: 54572 - DNA, 112 bp, Homo sapiens
tatctcagtggacagaggtaggaaatgcatgcatatatactaacttttgtatacataaacatgtatatttatttctgtatgtatctatctcagtggttctcaactgatgatg

SEQ ID NO: 54573 - DNA, 76 bp, Homo sapiens
gagtccattaaagctctttttctttataaattacccagtcttgggtatttctttatagcagtatgaaaatggactc

SEQ ID NO: 54574 - DNA, 120 bp, Homo sapiens
gatcactgcatccatgccaacatctactgttgttgttgttcttgtttttttattattatagctattcttgcaggagtaaggtggtatcacattgtggttttgatttgcatttccctgatc

SEQ ID NO: 54575 - DNA, 95 bp, Homo sapiens; identical to SEQ ID NO: 68

SEQ ID NO: 54576 - DNA, 93 bp, Homo sapiens; identical to SEQ ID NO: 69

SEQ ID NO: 54577 - DNA, 70 bp, Homo sapiens
ggaaagtgacaggagagactctggacagcatgggacggaggctgagtctctcctctttgtcccttgttcc

SEQ ID NO: 54578 - DNA, 87 bp, Homo sapiens
gtagcattcattgctgtttgataggattttacccacagtattttttttttcaaaattgtaggcaattctctcaagtcatgctgctgc

SEQ ID NO: 54579 - DNA, 65 bp, Homo sapiens
ctgcttctctctctcactggctgagcctgaggtttttatgggcacaggatgggggagtggggtgg

SEQ ID NO: 54580 - DNA, 102 bp, Homo sapiens
tccacattttcaggtatctttatagcagtgccccacttctccagtaccaattttctgtattagttgttctcacattgctataaagaactgccagagactgga

SEQ ID NO: 54581 - DNA, 102 bp, Homo sapiens
aaatgccctgtgttttcctaaatatagtctatatgtatgtatgtatgtatgtatgtatgtatgtatgcatgtgtgtaggcttgtgtccatgcttgtgtattt

SEQ ID NO: 54582 - DNA, 95 bp, Homo sapiens; identical to SEQ ID NO: 68

SEQ ID NO: 54583 - DNA, 93 bp, Homo sapiens; identical to SEQ ID NO: 69

SEQ ID NO: 54584 - DNA, 88 bp, Homo sapiens
tcctaattcctggaacctttgactatattacattatatggtaaaagggattttgtagatgtgattaagttaaggatcttgaggaggga

SEQ ID NO: 54585 - DNA, 87 bp, Homo sapiens
ggttgattgttaccattctgattgaaagatctttatatattttagattacagtataagaggttgttagtctttggtagctattaatc

SEQ ID NO: 54586 - DNA, 95 bp, Homo sapiens; identical to SEQ ID NO: 68

SEQ ID NO: 54587 - DNA, 93 bp, Homo sapiens; identical to SEQ ID NO: 69

SEQ ID NO: 54588 - DNA, 81 bp, Homo sapiens
gcggtgcttggttttctgttaaaaggaagcttttatatttcatatttaaaatgactttttgatggaagaaatagtaccgac

SEQ ID NO: 54589 - DNA, 85 bp, Homo sapiens
gctaggaatttaacaaatatgttggcctcaatgtgaacaagttatatatttttttcagacttgaggcttgttaactctttcaggc

SEQ ID NO: 54590 - DNA, 73 bp, Homo sapiens
gataatttgggtgcagaaatgagtacagatgagggttcatatctagcctgtgtgtatttctgtgtgtgttatt

SEQ ID NO: 54591 - DNA, 115 bp, Homo sapiens
gcctggatgttttgatatatatgtatgcgtatatgcattacatatatgtgtgtgtgtatatatatatatacacacatgtatatgtgtatgtttgtatatacatatattctggagt

SEQ ID NO: 54592 - DNA, 105 bp, Homo sapiens
ttggaggaacctgtgcttaaataccgttagtgatctctgggtggaggggttctgtgtgactgacactgtctgccttagaactttttgtattgtccattcttttga

SEQ ID NO: 54593 - DNA, 104 bp, Homo sapiens
agagaaggacgccataatcattcagtgagagaacacagaatgctcagacagtatgtggaccctgtagctggacattacttttccctgctgatggttttctcttc

SEQ ID NO: 54594 - DNA, 78 bp, Homo sapiens
ttttattttagattcaggaagtgcatgtgcaggttcatcacatgggtatactgcataatgctgagatttggggtagga

SEQ ID NO: 54595 - DNA, 79 bp, Homo sapiens
gaagtggacgtcatagagagatctgtgaagccacactatctgactgtcacagcctcctgagaacaatgacttctgcttc

SEQ ID NO: 54596 - DNA, 63 bp, Homo sapiens
gtgccaggatgatgaggcggtggtccttaactcactgactcactaacttgatcatccattcac

SEQ ID NO: 54597 - DNA, 81 bp, Homo sapiens
cctttgtgactggcctcaagccttccattgcacccctaccccaccctctacatgactgagaagactgaggtcagccagagg

SEQ ID NO: 54598 - DNA, 115 bp, Homo sapiens
aggagaattgggcagctggggtgcaaaatttatggaggccctcactctcagtgtcattcaagtgtcttcttaagagtgatgtgcctagggcccctttttttctgtgttcgcttct

SEQ ID NO: 54599 - DNA, 67 bp, Homo sapiens
tgtgtatgtgtatatgtatgtgagcatttatgtgtatacatatgtatatattatatatacatgcaca

SEQ ID NO: 54600 - DNA, 114 bp, Homo sapiens
agtaaaagtgatgagagtggacatccttatctaccttctgatgttagggagaaaacattattttttttttcactaatgagtaagatgttggctgtaggtttttcatagattgct

SEQ ID NO: 54601 - DNA, 228 bp, Homo sapiens
atatatatatggatatatatatatggatatatatggatatatatatatgatatatatatggatatatatatgatatatatatggatatatatatatgatatatatatggatatatatatgatatatatatggatatatatatgatatatatatggatatatatatatcgatatatatatggatatatatatatcgatatatatatggatatatatggatatatatatg

SEQ ID NO: 54602 - DNA, 101 bp, Homo sapiens
tatgtgtgtgtgtgtacatatatatatacatatatgtgtgtacatatatatacatatatgtgtgtacatatatatgtgtgtgtatatatgtatacatatat

SEQ ID NO: 54603 - DNA, 93 bp, Homo sapiens
gtgattaagagcacagacttaggggcaaatgaaggctttgccagctgggggaaggtatccttaaactctctgagtctcactttctttatttgt

SEQ ID NO: 54604 - DNA, 99 bp, Homo sapiens
tgctggagagcttcccatgactgcctctcactgcctctttatagcttagagctgtgctgcccaggtcagtggtgactagccacacatggctgttgagca

SEQ ID NO: 54605 - DNA, 115 bp, Homo sapiens
tttgtacgttgatttcgtattctgcacctttactgaatttgtttatcagttctaagagttttttattattattattatactttaagttctagggtacaagcgcacaacgtgcagg

SEQ ID NO: 54606 - DNA, 111 bp, Homo sapiens
ctaggctgaaacaggtggcaagtgatgcaacatccaaagccacttttcaagctttttttttttttttttttttttttttgagatggagtctcgctctgtcacccaggctgg

SEQ ID NO: 54607 - DNA, 98 bp, Homo sapiens
ctttttaggtgacagaaaatttgattattttgatttcagtggtgattacaatttatataattttgtcaaaattcatcgatttttacatacctaaaaag

SEQ ID NO: 54608 - DNA, 95 bp, Homo sapiens; identical to SEQ ID NO: 68

SEQ ID NO: 54609 - DNA, 93 bp, Homo sapiens; identical to SEQ ID NO: 69

SEQ ID NO: 54610 - DNA, 83 bp, Homo sapiens
ggcagcagagatggttacttgggatggtttgcttttgccagcggcttctgggcttgctcttctgattttcattttctgttgtc

SEQ ID NO: 54611 - DNA, 85 bp, Homo sapiens
acacatatttttatgcactattgtatatatattaatgcagcatatatatgtatgtatatatgacaatgcatataaaaagatgtgt

SEQ ID NO: 54612 - DNA, 70 bp, Homo sapiens
agtcaggctccctgaattcagagatctgagaggtggctttttttttttttttttttagtggggtcttgct

SEQ ID NO: 54613 - DNA, 140 bp, Homo sapiens
acatatgtgtgtatatacatgtgtgtgtatatacatatatacatatgtgtgtgtgtatatacacacacacacacacacacagggtttggtgctatctgagatttcaggcattcactgggggtttcagaatgtatcccctg

SEQ ID NO: 54614 - DNA, 113 bp, Homo sapiens
aatttgaattaagtgtgccctttagttaataataatatattaatatttgttcatcaattgtaacaaatgtgctatactaaagtgtcaataagaggggaaactggttgcagatt

SEQ ID NO: 54615 - DNA, 83 bp, Homo sapiens; identical to SEQ ID NO: 54610

SEQ ID NO: 54616 - DNA, 85 bp, Homo sapiens
gagtctcagaaaggtgaaggggcttgtggcttcttttgtcagtcctatgcagctcagctcaagtgtctgtgtctctctctctctc

SEQ ID NO: 54617 - DNA, 118 bp, Homo sapiens
ctttttaattgaatatctgtctcctaataatctgtagttatcctgaggtctgagaccatattttatttatttatttattttctgagggagactgctctggaccaggctctgtggaggg

SEQ ID NO: 54618 - DNA, 140 bp, Homo sapiens
gtgcatacatacgtgcatacatatgtatgtatatatgtgtgtatacatacgtgcatacatatgtatgtatatatacatatatacgtatatacacatgtatgtatatatacatatatacgtatatacatatatatgtatat

SEQ ID NO: 54619 - DNA, 105 bp, Homo sapiens
tatgtgtacacgcacgtgcatacatatgtatatatgtgtacacgcacgtgcatacatatgtatgtatatatgtgtgtatacatacgtgcatacatatgtatgtat

SEQ ID NO: 54620 - DNA, 248 bp, Homo sapiens
atacatatatgcatatgtgtatatatgtgtatatatgtgtatatatatacacatacgcatatgtgtatatatgtgtatatatgtgtatatatatacacatacgcatatgtgtatatatgtgtatatatgtgtatatatgtacacatatgcatatgtgtatatatgtgtatatatgtgtatatatgtacacatatgcatatgtgtatatgtgtgtatatatgtgtatatatatatacacatatgtatat

SEQ ID NO: 54621 - DNA, 95 bp, Homo sapiens; identical to SEQ ID NO: 68

SEQ ID NO: 54622 - DNA, 93 bp, Homo sapiens; identical to SEQ ID NO: 69

SEQ ID NO: 54623 - DNA, 77 bp, Homo sapiens
ctcatgatgatgatgatgatgatgatgatgattattattattattattattattattattattacatattttttgag

SEQ ID NO: 54624 - DNA, 58 bp, Homo sapiens; identical to SEQ ID NO: 35157

SEQ ID NO: 54625 - DNA, 116 bp, Homo sapiens
cgttcagtaggtcagtttggaaaaggagaggagagaattttctaagaatatcactgtatctgtctctcagattgtctccaagcctagccttcacagacctgagtcctgcagcaatg

SEQ ID NO: 54626 - DNA, 115 bp, Homo sapiens
tgtgctttacatatgtgtgtgtatatatatatatacattcatatatatatattcatatatatgaatatataggtatatgtatgtatatatacatatacgcatatgtacatataca

SEQ ID NO: 54627 - DNA, 61 bp, Homo sapiens
tgtaaaatatgtatatatacatatacacatatacttatatgtatatatacatgtacataca

SEQ ID NO: 54628 - DNA, 96 bp, Homo sapiens
tgtatagacacctggtgtgtgtgtatatatatatgtgtggatatataagaacataacacttatatgtaatgtatatactatattatatgttataca

SEQ ID NO: 54629 - DNA, 105 bp, Homo sapiens
agcaaagaagtattgaagtcttttagggctaagattattataagattattattatattagtgactctttacctcttagtagaacgacaaaacacatatttcggct

SEQ ID NO: 54630 - DNA, 101 bp, Homo sapiens
cctacatattctgcaaagcgaccagattgattttttttttcatgaactgggaccataaatcagaaagtcatgtctgggaaaaacttttagaaattatcagg

SEQ ID NO: 54631 - DNA, 87 bp, Homo sapiens
gcatattccatatatatacacatatatacacatatatgtgtatatatatatatgtgtgtgtgtgtgtgtgtgttttatagggtgggc

SEQ ID NO: 54632 - DNA, 115 bp, Homo sapiens
tgctgcccataccccacccccatgcgggcacccctctgtgccactgcatctgctggcacatgtaagtgagcacagatctggctggcactgcctgtgtgaaacactttggccagca

SEQ ID NO: 54633 - DNA, 78 bp, Homo sapiens
ttcacagtctcactcagcctctctagccacttttgcaagaggctcacttggggttagaggcacagttagagacttgaa

SEQ ID NO: 54634 - DNA, 107 bp, Homo sapiens
gatacatatggtgtggaatatatatctgaatatatgtgtgtatacacacacacacacacacacacacacacacacacacagagatatatatttaatatcagcgaatc

SEQ ID NO: 54635 - DNA, 81 bp, Homo sapiens
ggagtctcactctgtcacccaggcaggagtgcagtggcgcagtctctgcaacctccgctttctgggttcaagtgattctcc

SEQ ID NO: 54636 - DNA, 92 bp, Homo sapiens
catggccatgtctgttcatatatatatatattgtctagatctgctttcacattataacagcagagttgaatagttgagacagagatggtatg

SEQ ID NO: 54637 - DNA, 117 bp, Homo sapiens
ctctaattgtgtgtgtgtgtgtgtgtgtgtgtatatgtctatatatatatgtgtgttgtatatacatacatatgtatgtgtgtgtatatatatatatgtgtatatatagagagagag

SEQ ID NO: 54638 - DNA, 58 bp, Homo sapiens; identical to SEQ ID NO: 47

SEQ ID NO: 54639 - DNA, 71 bp, Homo sapiens
gagaacatgtagcatgaatagtactctatccattttatggatagggaattaatcacttaccagtgttgctc

SEQ ID NO: 54640 - DNA, 91 bp, Homo sapiens
aatgtcttcatcagaagtgaatccctagatcttggcacactatatggcacagaagtaggtgcttaggaagtgatagatgaatgaagccatt

SEQ ID NO: 54641 - DNA, 68 bp, Homo sapiens
gagcacacaaatatctccttttatgttttatttttaaaatcgaatgtattgagatttatttgtgtgcc

SEQ ID NO: 54642 - DNA, 95 bp, Homo sapiens; identical to SEQ ID NO: 68

SEQ ID NO: 54643 - DNA, 93 bp, Homo sapiens; identical to SEQ ID NO: 69

SEQ ID NO: 54644 - DNA, 110 bp, Homo sapiens
tgcttaggattgtcttggctatatagggtcttctttgattccatatgaaatgtaaagtagttttttataattctgtgaagaatgtcaatggtagtttgatgggaatagta

SEQ ID NO: 54645 - DNA, 84 bp, Homo sapiens
gtgagatgggtttcttgaagacagcataccaatggggtttggttttttttgtttgtttttttgattttttttaacctatattgc

SEQ ID NO: 54646 - DNA, 107 bp, Homo sapiens
gggagtttgttctggtatctcatagtggctcatgctctggtctttttttcttattattttgtaaagaagacagtgagatgagtgatttgtcagagttatagattttt

SEQ ID NO: 54647 - DNA, 121 bp, Homo sapiens
gtgtgtgtgtgtgtgtgtgtgtgtgtgtgtgtgtatgtctatatatatatgtgtgttgtatatacatacatatgtatgtgtgtgtatatatatatatgtgtatatatatatagagagagac

SEQ ID NO: 54648 - DNA, 61 bp, Homo sapiens
atatatatgtgcgttatatgtatatatatctatgtgtgtatatgtgtgtgtgtgtgtgtgt

SEQ ID NO: 54649 - DNA, 86 bp, Homo sapiens
gctcatcagtgacatgtaaggagcagtaaacagcttggttttttgtttgtttatttgtgtctgtgtgtgtgtttttgagatggagt

SEQ ID NO: 54650 - DNA, 71 bp, Homo sapiens; identical to SEQ ID NO: 54639

SEQ ID NO: 54651 - DNA, 86 bp, Homo sapiens
ggcctttgtcagagccatcatgggtgagtttctcagctgaggccactggcactgtccctctctccctcagtcctgtgggatcccat

SEQ ID NO: 54652 - DNA, 116 bp, Homo sapiens
tttgctttggctatgtaggctctttttcggatccatatgaattctaggattgtctgtttctagttctgtgaagaataattgtggtatttttatgggaattacatggaatttgtaga

SEQ ID NO: 54653 - DNA, 79 bp, Homo sapiens
ggtggcaggagagagaagtgagagtgcgggaaaaaaatactgccacttttaaaaccatcagatctcctgataactcact

SEQ ID NO: 54654 - DNA, 79 bp, Homo sapiens
cttgctgagaacaaagtgaggagagagggattcgctcagttgcactgagtgtgtgatttcttggcctgttcttagcagg

SEQ ID NO: 54655 - DNA, 59 bp, Homo sapiens
acacatgtatatgctgtgtatatatatatacatgtatacatataaaactatacatgtgt

SEQ ID NO: 54656 - DNA, 95 bp, Homo sapiens; identical to SEQ ID NO: 68

SEQ ID NO: 54657 - DNA, 93 bp, Homo sapiens; identical to SEQ ID NO: 69

SEQ ID NO: 54658 - DNA, 105 bp, Homo sapiens
tttcttgtattcagagttaatttctgctacttttttgaatatgccaagccaagcaagggatacatatttaatttttaagaacaagaaaataaagggtatgaggag

SEQ ID NO: 54659 - DNA, 90 bp, Homo sapiens
gccaaagttcaaatggttttgcttagtacttttactaaagtttcttgtttagtttagtcttaagtggggtgacaatttgaagctgcttgc

SEQ ID NO: 54660 - DNA, 97 bp, Homo sapiens
atatacatttttatgtataatatataaatgtagttatacatgtatatatattaatttttagagatgcatttatatatgtttgcataaatgtgtgtgt

SEQ ID NO: 54661 - DNA, 81 bp, Homo sapiens
tattatgtgtgtatatatacatatatatatatatatatatatatgcatgtgtgtatgtatacatatctatatatatacaca

SEQ ID NO: 54662 - DNA, 95 bp, Homo sapiens; identical to SEQ ID NO: 68

SEQ ID NO: 54663 - DNA, 93 bp, Homo sapiens; identical to SEQ ID NO: 69

SEQ ID NO: 54664 - DNA, 198 bp, Homo sapiens
tatatatatacacacatatatatgtgtatatatatacatatatatagacacatgtatacatacacatatatatacatatatatgtatacacatatatatgtgtatatgtatatatatgtatacatatatatatatacacacatatatgtgtgtgtatgtgtgtatatatatatatatatatatatatatatatatatg

SEQ ID NO: 54665 - DNA, 204 bp, Homo sapiens
tatatatatatatatatatatatatatatatatacacacatacacacacatatatgtgtgtatatatatatatgtatacatatatatacatatacacatatatatgtgtatacatatatatgtatatatatgtgtatgtatacatgtgtctatatatatgtatatatatacacatatatatgtgtgtatatatatatttggaga

SEQ ID NO: 54666 - DNA, 95 bp, Homo sapiens; identical to SEQ ID NO: 68

SEQ ID NO: 54667 - DNA, 93 bp, Homo sapiens; identical to SEQ ID NO: 69

SEQ ID NO: 54668 - DNA, 74 bp, Homo sapiens
gtgcgtgtgtgcgtgtgtgcgtgtgtgcatgtatgcctgtgtatgtgtgcacatgtgtgcatgcctgtgtgtat

SEQ ID NO: 54669 - DNA, 100 bp, Homo sapiens
gttggcatatagaaatattattgatttttgtatgcagattttgtatcctgcaactttactgaatttgtttatcagttctaatagtttttttggtgtagac

SEQ ID NO: 54670 - DNA, 98 bp, Homo sapiens
ataaacgatacgatgttttgatacatgcatgcttaattatatatatataattagccattttacaatgtatgcatgtatcaaaacatcatgttgtttat

SEQ ID NO: 54671 - DNA, 82 bp, Homo sapiens
ttcaaagctttaagagactatatatatatatatatatatatatatatatatatatatatatatagtctcttaaagctttgaa

SEQ ID NO: 54672 - DNA, 82 bp, Homo sapiens; identical to SEQ ID NO: 54671

SEQ ID NO: 54673 - DNA, 74 bp, Homo sapiens
tacatatatatcttgtacatatatatcttgtgtgtatatatatatatatatatagtgtacaagatttgaacgta

SEQ ID NO: 54674 - DNA, 58 bp, Homo sapiens
atacacataggtatacttatatatacatatgtatatatatatgtgtgtgtgtgtgtat

SEQ ID NO: 54675 - DNA, 65 bp, Homo sapiens
tgccttggtgctgatcctagcaatagacagaatctctgtcattcactggatgtgttatttgggca

SEQ ID NO: 54676 - DNA, 101 bp, Homo sapiens
taggcctttacatttggaacagtttggaaacatatatgtataataactcatgcatacatgtatctatctatctaatatccatatttgtatttctatgccta

SEQ ID NO: 54677 - DNA, 74 bp, Homo sapiens
gtatgtatgtgtatacatataagtgtgtgtgtgtgtgtgtatatatatatatgtgtgtgtgtatatatatatat

SEQ ID NO: 54678 - DNA, 92 bp, Homo sapiens
tatatgtatatgtgtatatgtatatatgtgtatatgtatatatacacgcatatacatgtacgtatatatacgcgcatatacatgtacgtata

SEQ ID NO: 54679 - DNA, 100 bp, Homo sapiens
atcttcatactcttattaatatatgtctttggatatgtatgtgtctttgcaaaattatacaacatatagcatagtggttaagagtgaagattctgaagat

SEQ ID NO: 54680 - DNA, 86 bp, Homo sapiens
gtagtaaataagtctcatgagagctgattgttttataaggggaaacccttttttggttggctctcattttctctctcgtctgctgc

SEQ ID NO: 54681 - DNA, 87 bp, Homo sapiens
atatatatttctctatctatgtatatatagatatgcatatgtatagatagaaatatatatttctatatctatatatacatatataga

SEQ ID NO: 54682 - DNA, 104 bp, Homo sapiens
tatctatatagatatatataatctctatctatatatacatatatataatctctatctatctatatgtatatatggttagagaaatatatagatctatatatata

SEQ ID NO: 54683 - DNA, 140 bp, Homo sapiens
atatgtatgtatatatgtatatgtgtgtgcatatatgtacacatatacatacatatatgtatatatacatgtatatatgtatacatgtattcatacacatacatgcatgtatatgtatgcatatgtgtgtgtgcatacat

SEQ ID NO: 54684 - DNA, 98 bp, Homo sapiens
ttggaagactgagtgtagaaggtggatagagagcattataagttaggccaattttgtaaatattctctctctctctgtcatttgctgctacatttcaa

SEQ ID NO: 54685 - DNA, 113 bp, Homo sapiens
ggatatcatagagcccaggagagactgataaggcatatttgaaatattgatgggaaaagttttttgtttttttttttttttgccctagattagtacatctggtgaaaatatcc

SEQ ID NO: 54686 - DNA, 75 bp, Homo sapiens
gcagctaaatttaatctccttcccccaggagttgggtacagatcgtggggaacttgagaatatatttatatctgt

SEQ ID NO: 54687 - DNA, 95 bp, Homo sapiens; identical to SEQ ID NO: 68

SEQ ID NO: 54688 - DNA, 93 bp, Homo sapiens; identical to SEQ ID NO: 69

SEQ ID NO: 54689 - DNA, 88 bp, Homo sapiens
acaattcaacatgagatttgagtgtggacacagagccaaactgtatcacacagtgtactgaatatacttgttgcttattgtttattgt

SEQ ID NO: 54690 - DNA, 117 bp, Homo sapiens
tgcatagacgtgtctctgcgtgcataggtgcaaatgtttatgtgtgcacgtgtgtctgtgcatgtacatgtctacacctgtgtatatctgcaggtgtatatatgtgtgcataggtgc

SEQ ID NO: 54691 - DNA, 89 bp, Homo sapiens
gttctcccattatagtggtcagaatttattttttaatatagtgcagattagtgcttatgttcctgtatcacctgtgacacgtgggatac

SEQ ID NO: 54692 - DNA, 92 bp, Homo sapiens
gtgggattgctggatatggcagttctatttttgattttttgaggaaactccatactgtttcccgtaatggctatgctagtctacactcctac

SEQ ID NO: 54693 - DNA, 113 bp, Homo sapiens
agtgtaccttgtagtggtcatcaggcttccaatctctccttcctgttactgtctccctctgtgcttttcttgattaaatgaagttggctacagtctgatgggctgtgtagatt

SEQ ID NO: 54694 - DNA, 119 bp, Homo sapiens
gacattttatatatatggtagctattattaatgggattgctttcttcttttttcttttttttttagattgttcactgttggtatatataaaatgctactgatttttgtatgttgatgtt

SEQ ID NO: 54695 - DNA, 86 bp, Homo sapiens
ttatatgctcaacatctagtacagtgcttggcatgagtaagcactcaataaatcttccaagaatgaatagatgtatgaatatataa

SEQ ID NO: 54696 - DNA, 93 bp, Homo sapiens
gattactgtagctttgtaatatatttttaaatcaaggagtgtgatgccttcagcgttgttctctttgctcaagactgttttggctatgtagtc

SEQ ID NO: 54697 - DNA, 80 bp, Homo sapiens
atatatatatatgtaatattttcatatatatccttatataagtatataaggatatatatgcaatatgtatatatgtatgt

SEQ ID NO: 54698 - DNA, 92 bp, Homo sapiens
gctcccagcaacatgtcatgtgtctggatgggaagtggaggctcagcctgccactctctcactatgtctccaaggactgtgctgtggtttgt

SEQ ID NO: 54699 - DNA, 89 bp, Homo sapiens
atcacctgtgtatgagaaagtttttttttttttattatggtaacgtgcatttagaaagatttagagatgtgctggtttcacagtgtgat

SEQ ID NO: 54700 - DNA, 76 bp, Homo sapiens
gttgttgttgttgagacacagtctcactctgtcacccaggtgggagtgcagtggcatgatcttggctcactgcaac

SEQ ID NO: 54701 - DNA, 85 bp, Homo sapiens
gtatgatggaggcatacatatatatatatatatacacacacatatatgtatgtatatgtgtgtatgtctgtatatgtatatttat

SEQ ID NO: 54702 - DNA, 64 bp, Homo sapiens
tatatatacatacatacgagtgtgtgtgtgtgtatatatatatgtctgtgtgtgtgtgtgtgta

SEQ ID NO: 54703 - DNA, 70 bp, Homo sapiens
atataagttatatatacatatatatgctttgtaccttatagatatgtatgtatatgtatgtaacttatgt

SEQ ID NO: 54704 - DNA, 220 bp, Homo sapiens
tatacatatatgtatatgtatatatatgtatgtgtatatatatacacatatacacatatatgtgtatgtatatatatgtgtgtatatacgtatatatatacatatatacaatttttgtatatatacatatatacacatatatatgtgtatgtgtatatatatacacatatatatgtgtgtgtatatatatacacatatatatgtgtgtatatatatatat

SEQ ID NO: 54705 - DNA, 80 bp, Homo sapiens; identical to SEQ ID NO: 8920

SEQ ID NO: 54706 - DNA, 111 bp, Homo sapiens
caaatttctatcaggttctcgaggcacaatgaatgcctttttatttttaaaacaatttttattttatttttttaggttccgaggtacatgtgcagaatgtgctggtttgtt

SEQ ID NO: 54707 - DNA, 111 bp, Homo sapiens
gattccgagaatgctgaaaagaagctgaatttggaaagagtgaattatttgaagttgaacaatatttttatatttgcaagtaagttagcattttgtagctgacatggaatt

SEQ ID NO: 54708 - DNA, 89 bp, Homo sapiens; identical to SEQ ID NO: 8919

SEQ ID NO: 54709 - DNA, 118 bp, Homo sapiens
aggtacataaaagtgcctaaaattttcactgaattagttgaatttgaataaaaatctttgtttttcattataaaaatgttcaagccatgaagaaatagtgggcatatttgaggtatct

SEQ ID NO: 54710 - DNA, 95 bp, Homo sapiens; identical to SEQ ID NO: 68

SEQ ID NO: 54711 - DNA, 93 bp, Homo sapiens; identical to SEQ ID NO: 69

SEQ ID NO: 54712 - DNA, 111 bp, Homo sapiens
gcgtttgctcattgatttctttcctgagagagctactctgcacacttatgactgactacagacactttcagccatgcagaagccactaaagggagcatatgagcaaaaggc

SEQ ID NO: 54713 - DNA, 84 bp, Homo sapiens
gtctatatgtatatgtgtatgcacattgtgtgtgactatatatgaatgtgtgtatatatatgtatgtatacacatatatatgta

SEQ ID NO: 54714 - DNA, 82 bp, Homo sapiens
ggctagaatctccagtactatgatgaaaagaagtggcaaaagtgagcatacttgtcttgttccagttactgggggaaatgct

SEQ ID NO: 54715 - DNA, 116 bp, Homo sapiens
tccagctttgttctttttgctcagggttgtcttggctatatgggctcttttttggttccatatgaaatttaaagtagttttttctaattctgtgaagaaagtcactggtagcttga

SEQ ID NO: 54716 - DNA, 91 bp, Homo sapiens
atatatgtacacgtatatatatgtatatatgtatatgtatatacgtatatacatatacatatacacacttatgtacatatatacatatgca

SEQ ID NO: 54717 - DNA, 70 bp, Homo sapiens
tatctatctatcagtatgtgtgtgtgtatatatatacatatatacatacacacacaatgtatgatgtata

SEQ ID NO: 54718 - DNA, 110 bp, Homo sapiens
gaaacttgtatacacagagggccagctttccatatatccaggttttgtcaagccaactgtgtgacttgagtgtgtgcagatttgcgtattgtgtgtgtatggtgggggtc

SEQ ID NO: 54719 - DNA, 116 bp, Homo sapiens
ggtctgaatggcttttatggtttcttttagttccaatagtctgtgaaataaatactttgtttttttgtaagtattcactagactgtatccactaaacaacatattcaccactttcc

SEQ ID NO: 54720 - DNA, 110 bp, Homo sapiens
gtctatgctgcttgcctgggagaaacgttgccatctatggttttagaatcaaggaacaattctgagagtatacactgtgctgtgtccccacctgcagtctgagtttgggc

SEQ ID NO: 54721 - DNA, 94 bp, Homo sapiens
gattcagtccatctctgtactgcttcggtacctccgtatccatttttcatggactcatggaacacagtaagcacacagggatatgatttcaatc

SEQ ID NO: 54722 - DNA, 95 bp, Homo sapiens; identical to SEQ ID NO: 68

SEQ ID NO: 54723 - DNA, 93 bp, Homo sapiens; identical to SEQ ID NO: 69

SEQ ID NO: 54724 - DNA, 83 bp, Homo sapiens
agtcattaaacctttaagtcccaaaatgatctcctttgactctatgtctcacatctagatcatgttgatgcaagaggtgggct

SEQ ID NO: 54725 - DNA, 93 bp, Homo sapiens
catatattatagaaatgtcttattttttatatttggaggatgtaagccaacttctggagttctttacgatatggtttccatttctagtgtatg

SEQ ID NO: 54726 - DNA, 84 bp, Homo sapiens
ttcccctactttatgtttttgtttattttgcatggcaaaaggaacagtcagcagagtaaacagacaacccacagagtgggagaa

SEQ ID NO: 54727 - DNA, 84 bp, Homo sapiens
agatattgagtgttatcttaggatttatacactggctgtactctctatgtcagtgttgagagtaggagatggtgttacagattt

SEQ ID NO: 54728 - DNA, 73 bp, Homo sapiens
ctgccaaaatatacagtgtgtgtgcatatatatatatgtgtgtgtgtgcctgtgtgcgtgtgtattaaggaag

SEQ ID NO: 54729 - DNA, 90 bp, Homo sapiens
tgattcatgttgaaggcttctttcctcatatgtgtagcagttaattcaggctgttggctgagaccacagaggcacctgtcagctgaaaca

SEQ ID NO: 54730 - DNA, 107 bp, Homo sapiens
taagatggtgtaaaagtttgacctcaattttctgtgtgtgcatgtgcatgggcttgcccataaatgcacatggaaaaaagactgaaagaaaatacaccaaagtctta

SEQ ID NO: 54731 - DNA, 80 bp, Homo sapiens
atatatatatacacacatatatataagtgtgtatgtgtatatatatatacacatatatataagtgtgtgtgtatatatat

SEQ ID NO: 54732 - DNA, 99 bp, Homo sapiens
gagcaatgaagtccttgccctcatagggataaaagtctaaaattaagagtgtatatttatatgtgtaacagtatgggaacaggatattcttattgcctc

SEQ ID NO: 54733 - DNA, 116 bp, Homo sapiens
ctgaaaagccactgggagaagtgagccttgagggagatatatgtatatgtgtgtgtgtatatatatatatatatatattttttttttcactgaatctcaacagtttgttgtgacag

SEQ ID NO: 54734 - DNA, 169 bp, Homo sapiens
gtatatatatatatatgtatatatgtatatatatatgtatatatgtatatatatgtgtatatatgtatatatatgtgtatatatgtatatatatgtgtgtatatatatgcatatatatgcatatatatgtgtgtatatatatgtgtgtgtgtatatatatatatactac

SEQ ID NO: 54735 - DNA, 91 bp, Homo sapiens
gagaaggaggaaaatgaaatcagaatatttatttatctggctccttccttggagaatttctgtaatttctgaaatttcgatttcatttctt

SEQ ID NO: 54736 - DNA, 108 bp, Homo sapiens
ggtacttggacatcacatttaaagggtgtttctttaactagctcaagattatatttttagttataaccacagctggggctagaaccttatataatatgagtcactatc

SEQ ID NO: 54737 - DNA, 71 bp, Homo sapiens
ggaaactcaaacttcctgctagggcccatgaggtcctgtgtgacctatgtgcctccctgtttgccatttcc

SEQ ID NO: 54738 - DNA, 67 bp, Homo sapiens
tacatatgtatatgtatatatatagacatacatatgtatatgtatatatgtatatacaatgtatatg

SEQ ID NO: 54739 - DNA, 92 bp, Homo sapiens
ggggtgtggttgcatgtatctttgaatatattaaatactgttgaattttatacttttaatggttaaatttcatgatatatgaattatatttc

SEQ ID NO: 54740 - DNA, 95 bp, Homo sapiens; identical to SEQ ID NO: 68

SEQ ID NO: 54741 - DNA, 93 bp, Homo sapiens; identical to SEQ ID NO: 69

SEQ ID NO: 54742 - DNA, 105 bp, Homo sapiens
tgtatatttgtgatgcagaaacaaaggtccaaatagtggagaatgtagactgaagagtgtttccaaaggttggagctctgttcagtgtcattatttcaaataacg

SEQ ID NO: 54743 - DNA, 80 bp, Homo sapiens
tactgaaccccaatacctccgctgtgtaaagcagaaaagttttatttgttttcatacttgagctctattgtgggtcagta

SEQ ID NO: 54744 - DNA, 79 bp, Homo sapiens
gagggagagggtggactgtcgttacctgtcaagtctttggttttaaccgttactgagtttgttgttcactttctggttc

SEQ ID NO: 54745 - DNA, 116 bp, Homo sapiens
tattactagtccagaatgtgctggttcaaccaatgatgtatattgctaatgtttatttttaaatgcatccaagtgtctcattataaagctagcatgtccttatttttctagtggta

SEQ ID NO: 54746 - DNA, 66 bp, Homo sapiens
tgcagttgtacaaacatggtatctcttcatttcttgaggaagtatcaatgtttctatatatatgca

SEQ ID NO: 54747 - DNA, 63 bp, Homo sapiens
ttggtttgagacagccttaaatcagtgcgattcatgcctgagtgcctgagtctgtctctctag

SEQ ID NO: 54748 - DNA, 80 bp, Homo sapiens
gggaagatcaagggcagctgggccttagggacatttggaatcagagactcagactcagagtgctgccagtgctctgtccc

SEQ ID NO: 54749 - DNA, 74 bp, Homo sapiens
gctcaaaatgtaactgtgactctgtcctcctaaggagctcagggtgggacagattatttatataacatttctgc

SEQ ID NO: 54750 - DNA, 116 bp, Homo sapiens
ttccagcccaaacaagccgccttccaattagcagtaaccgtcctgtgtgtgtatatgtgtgtgcacatgcatgtggatgcatgtgtgtatttgatggcattatatatgggctagaa

SEQ ID NO: 54751 - DNA, 74 bp, Homo sapiens
gtctgcgtgtctgtgtgtgtgtgtatgtgcgtgtgtgtctgtatgtgtctgtgtgcgcatgtgtgtgtgtctgc

SEQ ID NO: 54752 - DNA, 75 bp, Homo sapiens
tctgaagtatatcaggggatgggagaggtttgtgagagaaactgactgtagtctgtcactctgatttactggggg

SEQ ID NO: 54753 - DNA, 95 bp, Homo sapiens
gttgttttgggccccggctttgttctctgggtcctcgatgttaagaacctactgtgcttgaggggtcaaggtgtttgcggaccactggtcacaac

SEQ ID NO: 54754 - DNA, 103 bp, Homo sapiens
tcattacctaataaccattttgaaatacatactgctaaccattgggaattttaatatttctatttagctagtaatgtgttatcatttgattccaggtttatga

SEQ ID NO: 54755 - DNA, 95 bp, Homo sapiens; identical to SEQ ID NO: 68

SEQ ID NO: 54756 - DNA, 93 bp, Homo sapiens; identical to SEQ ID NO: 69

SEQ ID NO: 54757 - DNA, 86 bp, Homo sapiens
gtttctaggcatatcactgtatattctgaatgtgtttatattttaaacacacccagaaagacacgacctgacatgtgctgagagat

SEQ ID NO: 54758 - DNA, 128 bp, Homo sapiens
atacatatatatgtgtgtatatatatacatatacatatgtgtatatatatacacacatatatgtgtgtatatatatacacacatatatgtgtatatatatatacacatatgtatatgtatatatatat

SEQ ID NO: 54759 - DNA, 95 bp, Homo sapiens; identical to SEQ ID NO: 68

SEQ ID NO: 54760 - DNA, 93 bp, Homo sapiens; identical to SEQ ID NO: 69

SEQ ID NO: 54761 - DNA, 283 bp, Homo sapiens
gtgtgtatatatacatatatacatatatatgtgtgtatatatgtgtatatatacatatatacatatatatgtgtgtatatatgtgtatatatatacatatatatgtgtgtatatgtgtatatatatacatatatacatatatatgtgtgtatatatatacatatatacatatatatgtgtgtatatatgtgtatatatacatatatatgtgtatatatacatatgtgtgtgtgtatatatatgtgtgtgtgtgtgtgtatatatatatatatatattcttatg

SEQ ID NO: 54762 - DNA, 111 bp, Homo sapiens
ttaggattgtcttggctatatgggctcttttttggttccatatgaaatttaaagtagttttttctaattctgtgaagaaagtcattggtagcttgatggggatagtattga

SEQ ID NO: 54763 - DNA, 99 bp, Homo sapiens
agtataagattagatgcatgcatagaactgtgcatgtgcatgtatatgtatatatgtaaatgcacatgcagatgtgtttgtatacattgattttgaact

SEQ ID NO: 54764 - DNA, 193 bp, Homo sapiens
atatatatatgtgtgtgtgtatatatacacatatatgtgtatatatatacatatatatgcatgtatatatatacatgtatatgtgtatatgtatgtgtatatatatatacacatatatatgtatgtgtatatatatatacacatatatatgtatgtgtatatatatatatacacatacatatatatatatata

SEQ ID NO: 54765 - DNA, 83 bp, Homo sapiens
tatatatatatacacatacatatatatgtgtatatatatatacacatacatatatatgtgtatatatatatacacatacatat

SEQ ID NO: 54766 - DNA, 109 bp, Homo sapiens
acattgattttgtatcctgaaattttgctgaagtgtttttttttttttttaatcacctgaaggagcttttggataaagactatggggttttctagatatagaatcatgt

SEQ ID NO: 54767 - DNA, 111 bp, Homo sapiens
atggtctgctttaattgcttttttgtgtggatatcttctcatgtgtgtgtgtgtgtgtgtgtgtgtgtgtgtgtgtgtatctggggttactataaggcttgcaaataccat

SEQ ID NO: 54768 - DNA, 118 bp, Homo sapiens
tatatgtgtgtatatatgtgtgtatatacatatatgtgtacatacatatatacacgtgtatatatgtgtatatatatacatatatatgtgtatatacacatatataaagtaacatata

SEQ ID NO: 54769 - DNA, 118 bp, Homo sapiens; identical to SEQ ID NO: 54768

SEQ ID NO: 54770 - DNA, 115 bp, Homo sapiens
tacatatatacatgtatatgtatacatatatacatgtatacatatatacacataatatatatgtatatatacacataaatacacatatatgtatgtgtatatacacatacatgta

SEQ ID NO: 54771 - DNA, 119 bp, Homo sapiens
gtgtgtatatacatacatatatgtatacatacacgtgtgtgtgtatatacatacatatatgtatatatatgtgtatatatacatatatatgtgtgtatatacatatatgtaatgctcac

SEQ ID NO: 54772 - DNA, 141 bp, Homo sapiens
gtgtgtatatatatacgtatatatacttacatatatacatgtatatttatatacatatatacatgtatatttatatacatatatacatatatacatatggaatacattatatatttataatactcatatacatgtatatat

SEQ ID NO: 54773 - DNA, 92 bp, Homo sapiens
tatgtatataaatatacatgtatatatgtaagtatatatacgtatatatatacacactcatatgtatataaatatattatcatgtatatata

SEQ ID NO: 54774 - DNA, 183 bp, Homo sapiens
atatatatgtgtgtatatatgtatatatgtgtgtatatgagtatatatgtgtatatacgtatatatatgtgtatatatgtgtatatatgtatatacatatgtgtgtacatatatgtatatacatatgtgtgtatatatatgtgtgtatatatatatgtatacacacacacatctatatatata

SEQ ID NO: 54775 - DNA, 58 bp, Homo sapiens
tgagacagagtctcactctctcactcaggctggagtgcagtggtgtgatcttggctca

SEQ ID NO: 54776 - DNA, 114 bp, Homo sapiens
atgtttgtatttttagtagagacggggtttcaccatgttggctaggatggtgtcgatctcttgacatcatgatctgcccgccttggcctcccaaattgctgggattacaggtgt

SEQ ID NO: 54777 - DNA, 58 bp, Homo sapiens; identical to SEQ ID NO: 1847

SEQ ID NO: 54778 - DNA, 85 bp, Homo sapiens
atgtacacatatatgtatatatgtatacatatatgtacatatatacacatatgtatacatatatgtatatgtatacatatatata

SEQ ID NO: 54779 - DNA, 95 bp, Homo sapiens; identical to SEQ ID NO: 68

SEQ ID NO: 54780 - DNA, 93 bp, Homo sapiens; identical to SEQ ID NO: 69

SEQ ID NO: 54781 - DNA, 74 bp, Homo sapiens
tttattttttgagatggagtctctctctgtcactcaggctggagtgtagtggcgtgatttcggctcactgtaaa

SEQ ID NO: 54782 - DNA, 85 bp, Homo sapiens
tgagaccgagtctcgctctgtcacccaggctggagtgcagtggcacgatctcggctcactgcaagctccatgtcctgggttgaca

SEQ ID NO: 54783 - DNA, 68 bp, Homo sapiens
gtactctacccacagacgtaccaatcatttttaattatacatgattgccactgtctgcagtagggtac

SEQ ID NO: 54784 - DNA, 68 bp, Homo sapiens; identical to SEQ ID NO: 54783

SEQ ID NO: 54785 - DNA, 60 bp, Homo sapiens
tatgtgtatatatacatacacagacatgcatatatgtatatatgtgtatatatatacgtg

SEQ ID NO: 54786 - DNA, 106 bp, Homo sapiens
atgattttgactactttagatacttcatgtgagtggaatcatagagtatttatatttttgtacctggcttattttacttagcataatgtccttgaggttcattcgt

SEQ ID NO: 54787 - DNA, 166 bp, Homo sapiens
tatactcttcccctgttgtgtatatatatatatatatatatatatatatacacacacatatatatatgtgtgtatgtatatatgtgtatatgtgtatgtgtatatgtgtgtatatatgtgtatatatgtgtgtatatatgtgcatgtatatgtctgtatatatata

SEQ ID NO: 54788 - DNA, 111 bp, Homo sapiens
taagattgtaaaatactctggagcaggtcccaggttttttttttcagtatttttacacatagtaagtgctcaaaaaggattgttgattgttgcacagagaatacaatatta

SEQ ID NO: 54789 - DNA, 99 bp, Homo sapiens
gctcagagtatgccagtcttgagggtctctggctcagagtatgccagtcttgggttgggtagaactctcagtgtaagaagctcttgcaggctgcatctt

SEQ ID NO: 54790 - DNA, 245 bp, Homo sapiens
tatatatacacatacatacatatatacacaggtgtgtatatatgcgcatatgtgtatatatgtatatgtgtgtatatgtgtatatatgtatatctgtgtatgtgtatatatgtaatatgtgtgtatatatgtatatatgtgtgtatatgtgtatatatgtatatgtgtgtatacgtgcatatatacatatatatacatgtatacacacatatacatatatacacacacatatacatatatacaca

SEQ ID NO: 54791 - DNA, 118 bp, Homo sapiens
gtatatatgtatatgtgtgtgtatatatgtatatgtgtgtatacatgtatatatatgtatatatgcacgtatacacacatatacatatatacacatatacacacatatatacatatat

SEQ ID NO: 54792 - DNA, 59 bp, Homo sapiens
gacacatgtgtatatgtatgtatgtgtattcacatatatatatatatatattttggatc

SEQ ID NO: 54793 - DNA, 118 bp, Homo sapiens
atatgtgtatatatatgtattatacataagtgtatatacttatatatgtatatataagtgatataatatattgtatatacatatatcatatatacttatacatattaaattatatata

SEQ ID NO: 54794 - DNA, 117 bp, Homo sapiens
aggatccttacatatatataagtatataaggattcattatattaattaaatatataagtatataatgtatatataagtatgtaatgtatataatgtatacttatatataaggatcct

SEQ ID NO: 54795 - DNA, 120 bp, Homo sapiens
atatggataagtacatatataagtatataaggatatgtaagtatacatataagtatataaggatatatatataagtatataaggattcattatatacattaaatatataagtatacatgt

SEQ ID NO: 54796 - DNA, 130 bp, Homo sapiens
tatatgtatgtaaggatccttatatatatacttatatatttaatgtatataatgaatccttatatacttatatatatgtaaggatccttacatatatacttatatatatgtaaggatccttacatatata

SEQ ID NO: 54797 - DNA, 102 bp, Homo sapiens
gaatccttatatatttatatatatgtaaggatccttacatatatacttatatatttaatgtatataatgaatccttatatacttatatatatgtaaggatcc

SEQ ID NO: 54798 - DNA, 118 bp, Homo sapiens
atatacgtgtatatgtgtgtgtatatgtatatacacgtgtatatatacgtgtatatacatatatacatgtgtatatatacgtgtatatacatatatacacgtgtatatatacgtgtat

SEQ ID NO: 54799 - DNA, 93 bp, Homo sapiens; identical to SEQ ID NO: 69

SEQ ID NO: 54800 - DNA, 90 bp, Homo sapiens
agattaaatatatgtatatacatatatatgtatgtatatacacatatatatgtgtacacatatatatgtatgtatatatgtacgtagttt

SEQ ID NO: 54801 - DNA, 112 bp, Homo sapiens
ctccagctttgttctttttgcttaggattgtcttggctatatgggctcttttttggtgccatatgaaatctaaagtagttttttctagttctgtgaagaaagtcaatggtag

SEQ ID NO: 54802 - DNA, 91 bp, Homo sapiens
tgcagtccaggtgtcaagtttcggaattggggaacccaagaacccatttggtgctctgtccctctgtggctgtgttgatacctaaggtgca

SEQ ID NO: 54803 - DNA, 56 bp, Homo sapiens
gagacagggtctcactctgtcacccaggctggagtgcaatgttatgatcctagctc

SEQ ID NO: 54804 - DNA, 87 bp, Homo sapiens
gtatatataaatgtacgtatgtgtatatatgtacatatacacacatgtgtgtgtatatatatgtgtgtatatatatgtgtgtgtatc

SEQ ID NO: 54805 - DNA, 80 bp, Homo sapiens
ggcatcagtcagcagactgtgagctcacatccattatctataatagagactcatagcaagcctactgtctaccctgtgcc

SEQ ID NO: 54806 - DNA, 116 bp, Homo sapiens
agatggtatctcattgtggttttgatttgcatttctctgattaccagtgatgatgagcttttttttatatgtttgttggctgcataaatgtcttctcaaaataataagagctattt

SEQ ID NO: 54807 - DNA, 115 bp, Homo sapiens
tagtagatttgtagactgaagagccagcagtgaggtttgtacttaatgcagttattcacagtatacagtgagaactgaaatctgaactgtgctcttggggagctagtgttcttta

SEQ ID NO: 54808 - DNA, 73 bp, Homo sapiens
gctgctgtcagagagaactatgtgtggatactaggactggggaaactacgtggcaattctgactcattgcagc

SEQ ID NO: 54809 - DNA, 106 bp, Homo sapiens
gccctacccatgtcaggttgtgattctggaagttactttattctttaaaagtttgagcaactggagaatagatatagccaaagagacctcattatatgactagggc

SEQ ID NO: 54810 - DNA, 90 bp, Homo sapiens
gaaagttgtagttagagaacacagagtgtactaaaattctatcttgagaaggaataaaatagaggcatgctattttcttctatccctttc

SEQ ID NO: 54811 - DNA, 57 bp, Homo sapiens
tgaggcagggtctgtctcgctctgtctcccaggctggagtgtggtgatcttggctca

SEQ ID NO: 54812 - DNA, 95 bp, Homo sapiens; identical to SEQ ID NO: 68

SEQ ID NO: 54813 - DNA, 93 bp, Homo sapiens; identical to SEQ ID NO: 69

SEQ ID NO: 54814 - DNA, 72 bp, Homo sapiens
ttgataatgtactgtctctctcagtgatagggagtgtttacattgcatgagagagagctcttgccttgttga

SEQ ID NO: 54815 - DNA, 77 bp, Homo sapiens
tatatacatacatgtatacagaatatctatatacttcatatatacatacatatatactgtatatatgtatgtgcatg

SEQ ID NO: 54816 - DNA, 85 bp, Homo sapiens
gtttcactgaggtataattgccaaataaaaaattatatatatttacagtgtataacatatttggtatatgtatacattgtgaaat

SEQ ID NO: 54817 - DNA, 97 bp, Homo sapiens
gcctgatgcttcctgtgaaaccatacatctctcactgtcaccatattggcatatacttggcagatgacaatggccctcagagttgagcaactactgc

SEQ ID NO: 54818 - DNA, 81 bp, Homo sapiens
cacttagccacaagtctgaagacccctgcctaggaccagcttcatggctctcggcaagctgtcaaactctgtgcctgagtg

SEQ ID NO: 54819 - DNA, 58 bp, Homo sapiens; identical to SEQ ID NO: 2531

SEQ ID NO: 54820 - DNA, 95 bp, Homo sapiens; identical to SEQ ID NO: 68

SEQ ID NO: 54821 - DNA, 93 bp, Homo sapiens; identical to SEQ ID NO: 69

SEQ ID NO: 54822 - DNA, 103 bp, Homo sapiens
gctatgcttggaatcatccggagcatgcacgcatgtgtgtgtgtatgtctgtgtgtgccagcgagcacacactagtgggagtggaatggtgtacatatatgtg

SEQ ID NO: 54823 - DNA, 95 bp, Homo sapiens; identical to SEQ ID NO: 68

SEQ ID NO: 54824 - DNA, 93 bp, Homo sapiens; identical to SEQ ID NO: 69

SEQ ID NO: 54825 - DNA, 65 bp, Homo sapiens
atatacatatgtacacacataatatatatatatcactaagcatatatatgtgtgcatgtgtatat

SEQ ID NO: 54826 - DNA, 110 bp, Homo sapiens
tgcttaggattgtcttggctatacgggctcttttttggttccatatgaaatttaaagtagttttttctaattctgtgaagaaagtcaatggtagcttgatgggaatagca

SEQ ID NO: 54827 - DNA, 78 bp, Homo sapiens
gcaactacagtcatgcaatgcctgcctgtctgccactaaagcaaccagcggggattcagtgcattctgtacagtgagc

SEQ ID NO: 54828 - DNA, 95 bp, Homo sapiens; identical to SEQ ID NO: 68

SEQ ID NO: 54829 - DNA, 93 bp, Homo sapiens; identical to SEQ ID NO: 69

SEQ ID NO: 54830 - DNA, 118 bp, Homo sapiens
gcatctgtattggtgaggtattttgttgaatgaccataaactgggaattgtctgattttttttcataactagattggtattatgggttttggggaggaaagccacagaagtaaagtgc

SEQ ID NO: 54831 - DNA, 60 bp, Homo sapiens
gaatatatatatacatatatatacatattccattgtgtgtgtatatgtatacatatattc

SEQ ID NO: 54832 - DNA, 71 bp, Homo sapiens
ctgaggcctctcatttaggcttgcagatggctgtgttctctatgtgtctgtgtctgtgtgtcatccctcgg

SEQ ID NO: 54833 - DNA, 96 bp, Homo sapiens
ttaaagaggtaattaagttaaaatggggtcattcagtcattacttgatatgactgactggtactcttttttttttttttttttttgacagtgtctc

SEQ ID NO: 54834 - DNA, 95 bp, Homo sapiens; identical to SEQ ID NO: 68

SEQ ID NO: 54835 - DNA, 93 bp, Homo sapiens; identical to SEQ ID NO: 69

SEQ ID NO: 54836 - DNA, 111 bp, Homo sapiens
aacaacctctgtttgtagatgatataatccctttttgttatgtgtttttatattattattattataatactttaagttctagggtacatgtgcacaacgtgcaggtttgtt

SEQ ID NO: 54837 - DNA, 117 bp, Homo sapiens
gttgagcttcctcaaatagctattttgaattacatgtccgaaaagtcacatatctctgtctctctgggactgatcactggtgccttatttagttcttttggtgaggtcatgcttttc

SEQ ID NO: 54838 - DNA, 93 bp, Homo sapiens; identical to SEQ ID NO: 69

SEQ ID NO: 54839 - DNA, 81 bp, Homo sapiens
ggttattcactgatttccagacttgtataaatgggtcttgctagcaagatgatttgtctcagtggaattttgtgtcggtcc

SEQ ID NO: 54840 - DNA, 96 bp, Homo sapiens
ttggcgcaagccacgtagttgtacaggagggaaaaaccattctggtcctccaaatctaagtctgtctctctctgttgtgctcatgcttgaccccaa

SEQ ID NO: 54841 - DNA, 95 bp, Homo sapiens
ctatgtgggcaggtgaagctgacactagtggtcagagacagtgtctaggcagagactcacatactgacagtcagaaattgggccaatatatatgg

SEQ ID NO: 54842 - DNA, 58 bp, Homo sapiens
tatgtgtgtatatatgtgtgtgtgtgtagatatgtatatgtatatatatgcgtgtata

SEQ ID NO: 54843 - DNA, 65 bp, Homo sapiens
cacaggatgtaagattctgagttgaaagttttttttttttttttgagacagagtctcactctgtg

SEQ ID NO: 54844 - DNA, 116 bp, Homo sapiens
tagatgctgtcctggactgtctgcatctcttgcagatgcccatgatgaggggattgttctctggtggggccagcgagagtggagctgttcatgaacactgtatttttgatgtagac

SEQ ID NO: 54845 - DNA, 85 bp, Homo sapiens
cacactccccgctactgagaacattgactgctctcttcaaacacagagtgaagaatgggcctcatgtaacaggacagggaaggtg

SEQ ID NO: 54846 - DNA, 92 bp, Homo sapiens
aaagcataaaggcctgatatatatatatatgcttgctttatacatatatatatgtatgtgtatgtgtatatgtatgtatatttacctgtttt

SEQ ID NO: 54847 - DNA, 73 bp, Homo sapiens
ctatcatctatatatctatatatatctcatatatatcagatatatatgagatatatatatatatatctcatag

SEQ ID NO: 54848 - DNA, 98 bp, Homo sapiens
gtatgtatatgtttatattatatatgtgtaattatatgaatgtatgtgtatatatctttacatatatttatacatatatgtatgtcgactatacgtac

SEQ ID NO: 54849 - DNA, 116 bp, Homo sapiens; identical to SEQ ID NO: 54844

SEQ ID NO: 54850 - DNA, 82 bp, Homo sapiens
agggacacaaatattcagaccatagcaggtgtattcatggatatgtatctatgtgtatatgtatatgtatatagttgtccct

SEQ ID NO: 54851 - DNA, 96 bp, Homo sapiens
cactgattgcccagaccagaatctctctctgcctgagtgctgccagttgaatctggaaaacacaacagctctgagggagatgtagtgcattgagtg

SEQ ID NO: 54852 - DNA, 95 bp, Homo sapiens; identical to SEQ ID NO: 580

SEQ ID NO: 54853 - DNA, 93 bp, Homo sapiens; identical to SEQ ID NO: 69

SEQ ID NO: 54854 - DNA, 120 bp, Homo sapiens
aggcactcagtacatcctgcaggagttgcttgaattttagagatctgggggccttccctgtgaccctatcatctgatctctccattcagctcttcccaagggaattagagttctttgcct

SEQ ID NO: 54855 - DNA, 67 bp, Homo sapiens
ggaggctttaggacagtaggcagatgtggcctgtccttcctcactctgcctctggctctctttctcc

SEQ ID NO: 54856 - DNA, 83 bp, Homo sapiens
tccatgtgattctgcctctctctgtgtgtatatgcatgtatttatgtgtgtgtttattacacacacagacaggcgggagagga

SEQ ID NO: 54857 - DNA, 77 bp, Homo sapiens
gctgacaaacgtcaggtgacaagggacaactggagacttgcactgctccactgtctctgcctctctggctgtagggc

SEQ ID NO: 54858 - DNA, 88 bp, Homo sapiens
gagcaaagtagtttcggtgtgacccagttaatctattttttttttaatagattatgattttggtgtcaagtctaagaattcttcactc

SEQ ID NO: 54859 - DNA, 104 bp, Homo sapiens
gagctgcagctgtggctaattagagcataattagatttgagaaaggtcactctgtccctcactcaagcccattttgctgtcattattgagtacctgttgcattc

SEQ ID NO: 54860 - DNA, 85 bp, Homo sapiens
tgctccagggagcacaggtgggtatggtgagaaatgtgcagggttgatctgtgacactcactgcctctttatgtccttggaagca

SEQ ID NO: 54861 - DNA, 103 bp, Homo sapiens
tccccttcattggctagaggaaagtctcagtctctctctgggaaaactgtgctctgtcatgaggagagaaattgccctgatgagtgagctgcatttttcttgg

SEQ ID NO: 54862 - DNA, 91 bp, Homo sapiens
ggaggaacgaagggagggaacgaaggagggaagaagggagagaggaagggaatcttttttttttttttgagacggactctctctgtctccc

SEQ ID NO: 54863 - DNA, 117 bp, Homo sapiens
cacctcccctccaccttgagtctggggggatggggtcattttattttatttttatttttattttatttttttagatggagtctctctctgtcacccaggctggagtgcagtggtgtg

SEQ ID NO: 54864 - DNA, 61 bp, Homo sapiens
ttgccagaggagcccacccagccaagccctccacagggctggctgcctgactctctgacag

SEQ ID NO: 54865 - DNA, 100 bp, Homo sapiens
tcccagctcttgcctcaaacactcgcttttttctttatttttttctctcccctggaagaatgaccagggctgagttcttaggtcttagagttaataggga

SEQ ID NO: 54866 - DNA, 112 bp, Homo sapiens
gggttgggctggaagctggttaaggagcaggcagatctctgaatcccctctctgactctgtgtccccaggcatctgcctgtcccccaccctggaagaggtctggcttgaccc

SEQ ID NO: 54867 - DNA, 182 bp, Homo sapiens
tatacatgtatatatacacagtatatatacatgtatatatacacagtatatatacactgtatatatgtatatatatactgtgtatatatatacagtatatatacagtatatatatacatgtatatgtatatatatactgtatatatgtgtatatatacgtatatatactgtatatatatata

SEQ ID NO: 54868 - DNA, 105 bp, Homo sapiens
atgtatatatacacgtatatactgtatatatacagtatatactgtatatatatactgtatatatgtgtatatatatatacagtatatatacagtatacatatata

SEQ ID NO: 54869 - DNA, 81 bp, Homo sapiens
gtaaatatatacatgtatatatgtatatatacactatatatgtatatatatagtgtatatatatacatgtatatatgtata

SEQ ID NO: 54870 - DNA, 117 bp, Homo sapiens; identical to SEQ ID NO: 54863

SEQ ID NO: 54871 - DNA, 89 bp, Homo sapiens
gagcttgttgagctgacagaactgagaaaggaggccatgattcctcccccatcccttctctgtagtctgtgcaattgccctctatactc

SEQ ID NO: 54872 - DNA, 98 bp, Homo sapiens
gtcaacagggctgatgacagtatgagaaattcaatatactccacatctatttgtatatattagattggaatattgtggcttttgtggcaatctgtggc

SEQ ID NO: 54873 - DNA, 85 bp, Homo sapiens
aagaatcactagtaatatttctgactgcgtgctcggagtactttttctatgcacaagtatatatttgtaaatatttgtgattttt

SEQ ID NO: 54874 - DNA, 97 bp, Homo sapiens
gtactgaaatgtctagcattgcaatatgaaaaaatatatacagattggaaaggaagaactatatatgtttctatttgcagatgacatgatcatgtac

SEQ ID NO: 54875 - DNA, 92 bp, Homo sapiens
gtttccttattgatttttctgtctggatgacttgtccattgttgaaaatggaatattttcatcttcttaaacaggtcttttacagaggaaat

SEQ ID NO: 54876 - DNA, 58 bp, Homo sapiens
tgaggcggaatctcactctgtcgctcaggctggagtgcagtggtgcaatcttggctca

SEQ ID NO: 54877 - DNA, 97 bp, Homo sapiens
tgactccttttcttgacaactaaaagctcctggcatgagctctctcagtctcactctctgagctctggatcacagggtgagtgtggaaaggtgggca

SEQ ID NO: 54878 - DNA, 98 bp, Homo sapiens
gggtaagggagctctctgaggcctcttctttttttttttcttttcttttttttttttttttttttttttttttgagacagagtctcgctctgtcaccc

SEQ ID NO: 54879 - DNA, 57 bp, Homo sapiens
tgagatagagtctcgctctgtcacccaggctggagtgcagtgtgtgatctcggctca

SEQ ID NO: 54880 - DNA, 58 bp, Homo sapiens; identical to SEQ ID NO: 2626

SEQ ID NO: 54881 - DNA, 256 bp, Homo sapiens
gtgtatatatgtatatgtgtatatatgtatatatgtgtatatgtgtatatgtgtatatatgtgtatatatgtgtatatatgtatatatatgtgtatatatgtatatacagtgtatatatgtatatatgtatatatgtgtatatatgtgtatatatgtatatatgtatatatgtgtatatatgtatatatgtgtatatatatgtgtgtatatatatgtgtatatatatgtgtgtatatatatgtgtatatatatata

SEQ ID NO: 54882 - DNA, 81 bp, Homo sapiens
gttgatgacagaagactcaaagctgatagcaagattcatagcccatgggacagggagtcagctctgtggctgtcctttgac

SEQ ID NO: 54883 - DNA, 118 bp, Homo sapiens
tggtccagatgagagatggtggtttctcaacccgggaggatagcagtatggtagtgagaagtgactgtgctctgaatgtgttctgatggtagagttgaccaaatttgctgatggatta

SEQ ID NO: 54884 - DNA, 73 bp, Homo sapiens
gttctcccctctgtgtctctgtgtcactgcgtcttcacgtggtattttttcataaggacactaggcattgaat

SEQ ID NO: 54885 - DNA, 114 bp, Homo sapiens
gttctttttgcttaggattgtcttggctatacgggctattttttggttccatatgaaatttaaagtagttttttctaattctgtgaagaaagtcagtggtagcttgatgggaat

SEQ ID NO: 54886 - DNA, 111 bp, Homo sapiens
gccaggagtttgagaccagcctgggtgacatagtgagaccccatctatacaaatttttttttttttttgagacagagtctggctctgtcgtccaggcttgagtgcagtggc

SEQ ID NO: 54887 - DNA, 76 bp, Homo sapiens
agggtaaggaaaagagaagcattaaggatggaatctagattttgtcccaaatgtggcaatctctctctctctctct

SEQ ID NO: 54888 - DNA, 77 bp, Homo sapiens
ggccttctccctgcgtctgtgtttctgtccaaattttccctttttataaggacaccagtcataatgcattaggggcc

SEQ ID NO: 54889 - DNA, 58 bp, Homo sapiens; identical to SEQ ID NO: 42624

SEQ ID NO: 54890 - DNA, 120 bp, Homo sapiens
gatttgtgtgggtatagttttcttcatgtttcttgaacttgggctccgttgagcttcttggttctatgggtgtatagtttcatcaaatttggaaaatttttggtcattatcccctcaaat

SEQ ID NO: 54891 - DNA, 111 bp, Homo sapiens
ccagaaatgtgctctgcagatcagtctgtcctccctcacccagtctgtcagtcagcttagccagactgacagagagaaagaaaactctgtggcctcccagtgcagtaatgg

SEQ ID NO: 54892 - DNA, 58 bp, Homo sapiens
atacacaaaggtacacatacatatagatatgtatctttatatgtaggtacatgtgtat

SEQ ID NO: 54893 - DNA, 90 bp, Homo sapiens
tgtatatgcatatgtatgtgtatacatgcctgtatatgtatatgtgtgtatatatgcatgtacatgtatatacatacatgtacttgtata

SEQ ID NO: 54894 - DNA, 86 bp, Homo sapiens
gggaggggtggtgctggacagtctggagagagagagctcagggaggtagagggtgctctctagccggactgtggtcctgccccccc

SEQ ID NO: 54895 - DNA, 135 bp, Homo sapiens
agcccactgaggaccagagagaaagaggtggagcagggacagagcaggctctgggactcaagcttctctctctctctctctctactctaacttccctccctctgccgctctgtatcgctgactgtatctctctct

SEQ ID NO: 54896 - DNA, 125 bp, Homo sapiens
gtatatatatacatatatatgtgcatatatatacatatatatgtgtatatatatatacacatatatatgtatatatatacatatatatatacatatatatatacatatacatatatatatatata

SEQ ID NO: 54897 - DNA, 119 bp, Homo sapiens
tatatatatgtatatgtatatatatatgtatatatatatgtatatatatacatatatatgtgtatatatatatacacatatatatgtatatatatgcacatatatatgtatatatatac

SEQ ID NO: 54898 - DNA, 93 bp, Homo sapiens
tgtgtgtgtgtgtatatatatacgtatatatatatacgtatatgtatgtatatatatatacgtatatatatacaaaaaatcaaaattatacca

SEQ ID NO: 54899 - DNA, 57 bp, Homo sapiens; identical to SEQ ID NO: 2636

SEQ ID NO: 54900 - DNA, 100 bp, Homo sapiens
atgtatataacaaatatacatatatgtatatgtatatatgtttatatatgcatatataacaaatatacatgtttatatgtgtatatgcaaatatatacat

SEQ ID NO: 54901 - DNA, 95 bp, Homo sapiens
ggcccaggggctttcaagtcactagtggttccgtttagtagatgattgtgcattgtttcaaaatggtgccctagtgactacaaagccccagagcc

SEQ ID NO: 54902 - DNA, 106 bp, Homo sapiens
tgtaattaagtattttattaccataagtgattgttaggcaaatttagatttatatttctaaaagatgtttaggacactcatatgtgggagttgaacaatgagaaca

SEQ ID NO: 54903 - DNA, 68 bp, Homo sapiens
gggcaaagtggcaaaatctcatctcgattatgtatttatatatgcatgatggtgcctgactttagtcc

SEQ ID NO: 54904 - DNA, 171 bp, Homo sapiens
ctatatgtattcacgcaaatgtatttacacatatgtatatgtttatacaaatgtacatttatatacataaatatatacatatatttgtacatatacatacgtgtatacatgaagatatacatatatctttgtatatatgtatatatacacgaatatgtatatacgcaaatg

SEQ ID NO: 54905 - DNA, 107 bp, Homo sapiens
tctggcagcttggctctgagtgttgaaggacaggttcatctggaactgttgactggagtttctatacatggcctctccttgtggcttcttatagcatggcttctggg

SEQ ID NO: 54906 - DNA, 97 bp, Homo sapiens
actcagcactttgtcctatatcagtgctctgtctgtatatgtgtgtatatatatatggatatatgccttacttttcttagaccatcaggtcctgagt

SEQ ID NO: 54907 - DNA, 82 bp, Homo sapiens
cattctaccctctgcttctgtgagttcaatttttttttttttttttgagatggagtctcgctctgtcgctcaggctggagtg

SEQ ID NO: 54908 - DNA, 58 bp, Homo sapiens; identical to SEQ ID NO: 10

SEQ ID NO: 54909 - DNA, 132 bp, Homo sapiens
gtgtatatatacatatacgtgtatgtatacatatgtgtgtatatatacgtgtatgtatatatatacatatatatgtgtatatatacatatgtgtgtatatatacatatatgtgtgtatatatatatatacac

SEQ ID NO: 54910 - DNA, 95 bp, Homo sapiens; identical to SEQ ID NO: 68

SEQ ID NO: 54911 - DNA, 93 bp, Homo sapiens; identical to SEQ ID NO: 69

SEQ ID NO: 54912 - DNA, 117 bp, Homo sapiens
ggggaatgatcgagttggatcccacacacaggtccccactggggcactgcctagtggagctgtgagaagagagccagcatcctgcagaccccagaatggtagatccatggacagctt

SEQ ID NO: 54913 - DNA, 85 bp, Homo sapiens
tttttgcttgatctatgccttgagatatgatttttcatgccattttgagaatttgttcttcaatataggaggattagggcaaaag

SEQ ID NO: 54914 - DNA, 106 bp, Homo sapiens
cttgctctgttgccaggctggagtgcagtggcgtgatcttggctcactaccatctctgcctcccggattcaagccattctcctgcctcagcctcccaactagctgg

SEQ ID NO: 54915 - DNA, 103 bp, Homo sapiens
gagtttggccaccttggctgaagatcagaggaagacgaaaagactgggcatgtaactccctggctctctccctgtgaaatcttctcaggctggctgtttcctc

SEQ ID NO: 54916 - DNA, 95 bp, Homo sapiens; identical to SEQ ID NO: 68

SEQ ID NO: 54917 - DNA, 93 bp, Homo sapiens; identical to SEQ ID NO: 69

SEQ ID NO: 54918 - DNA, 117 bp, Homo sapiens
gcttctgttgcagaacctgagtgtgcatcgtggtcaaatgctcagactcctgtggtggctgctcatgcaccacggatgtttgagcatgtgctacggtgtctacttttgctacattgc

SEQ ID NO: 54919 - DNA, 112 bp, Homo sapiens
atgttgcagatcttctgtgtgtgcatcgtggtcaaatgctcagactcctgtggtggctgcttatgcaccacggatgtttgagcatgtgctatggtgtctacttttgcaacat

SEQ ID NO: 54920 - DNA, 97 bp, Homo sapiens
atcttctttggggaaatgtttttggaataatattcattttgaatattatactgtgttcactgtggagattaaattttcccacttccccaggattggt

SEQ ID NO: 54921 - DNA, 111 bp, Homo sapiens
gtgtggtatcctgcttggaatttattgagcttgttgaatctgtaaatgtatgtgttttattatatttgtttttttttcaaacagctttattgagttatagttgatatacac

SEQ ID NO: 54922 - DNA, 95 bp, Homo sapiens; identical to SEQ ID NO: 68

SEQ ID NO: 54923 - DNA, 93 bp, Homo sapiens; identical to SEQ ID NO: 69

SEQ ID NO: 54924 - DNA, 114 bp, Homo sapiens
atggttaaaatatacctagttctaaatatgtgctggcagctttctaaatattttacatatattaactaatttagtctcagaataagctcatgaggtagaaactagtattaccat

SEQ ID NO: 54925 - DNA, 90 bp, Homo sapiens
tgtgtgattcttttagttgtcttgagtttgtttaaattttaaaatatctttccagcatattaagaaatttaggataggaaaggacacgca

SEQ ID NO: 54926 - DNA, 79 bp, Homo sapiens
ggaggggagatcgctcaggctttctccagtggccaggggggcctggcctgagagagaagtgagtgggctgaggctttcc

SEQ ID NO: 54927 - DNA, 66 bp, Homo sapiens
ctttcctctgtgtgtgtctgtgtcctaatgtcctcttcttataaggacaccagtcatattggattg

SEQ ID NO: 54928 - DNA, 92 bp, Homo sapiens
tactgccttaaaaatgctttagaattttttttaaatcatgaagtcagacaagccatcatgagagtagatgttggagatgatttaatgcagta

SEQ ID NO: 54929 - DNA, 104 bp, Homo sapiens
gcctggaccgccatcctctgccgattgtgtctgctcccctcagaccaagtctctgactctgagtccccctgaagtggcactgggggaggggtgcggtcggggtg

SEQ ID NO: 54930 - DNA, 66 bp, Homo sapiens; identical to SEQ ID NO: 54927

SEQ ID NO: 54931 - DNA, 101 bp, Homo sapiens
aaagtcgttttgtgtatgtttgcctttttttgcatgtatggatggatgtttttattatttttgtgcatgtgcaggttttaaaaatcatatttgattgcttt

SEQ ID NO: 54932 - DNA, 72 bp, Homo sapiens
aagggctccaagtaccccctcaccagcactggagtggtgtcagaggtgactgagtagagagcttgagctttt

SEQ ID NO: 54933 - DNA, 97 bp, Homo sapiens
ttgactagagggattcctggaacctaaaatagtaagcaaaattgtgcatatgtgcatttttctggaagcagggttcataggtttgtctgactattaa

SEQ ID NO: 54934 - DNA, 73 bp, Homo sapiens
ctcctggaaaacactcagaacagtgtctggccacataaagctgttctcatagtaacttttttttttttgggag

SEQ ID NO: 54935 - DNA, 90 bp, Homo sapiens
cttcaaataagttgggaatagggtgggtgtggcattttttttttctttttttttttttgagacagtctcactctgtcaccctggctggag

SEQ ID NO: 54936 - DNA, 68 bp, Homo sapiens
tatggatttagtggggaatgtcttacccaaccttctcagggtggagtcacattctctgtgtctctgta

SEQ ID NO: 54937 - DNA, 66 bp, Homo sapiens
tctatatatgtatatgtatatgtatatcatatatatgatgtatatctcatatatatatgtttttga

SEQ ID NO: 54938 - DNA, 140 bp, Homo sapiens
tcctgtttgctgagtgacatgtatgtggagaggtgtccctttatgaattgctcctgagtagagagtactgagtgaggtcatgtcctaagatctgtcccctgagcagagaggactgagaaaactcctgctccctcattggc

SEQ ID NO: 54939 - DNA, 78 bp, Homo sapiens
ggtctctttctgatcagagaggactgagagaggtcccatcttctagtctgtcccctgagcaaacaaaactgagaggtc

SEQ ID NO: 54940 - DNA, 67 bp, Homo sapiens
aggctgtgccattgaaggtgagcatgcatgtcgctgaatgtgtgtgacactgtgagtgtgtcagtgt

SEQ ID NO: 54941 - DNA, 76 bp, Homo sapiens
ggaggggacgggatcattgacttggacgtggcgagggtctcccggggctcactcagtctgtgtccacacacttcct

SEQ ID NO: 54942 - DNA, 94 bp, Homo sapiens
agatctgtatttgtatctgtgtgtatgtttatgtatacatgtatgtatgtatatgtgtatgttatgtatatgtgatattttcctgactatagat

SEQ ID NO: 54943 - DNA, 58 bp, Homo sapiens; identical to SEQ ID NO: 14767

SEQ ID NO: 54944 - DNA, 56 bp, Homo sapiens; identical to SEQ ID NO: 14768

SEQ ID NO: 54945 - DNA, 128 bp, Homo sapiens
ctgggcccttgacccctggtgtgtctccacagtgctggccccgtggtgtggtgacatctgtctgtctgtctggtctagcatccagcacagtcctgggcacatgaattggtgctgatgctgctgaagga

SEQ ID NO: 54946 - DNA, 100 bp, Homo sapiens
tctttgagctttaaatgctgagtgcctgaatatgggacattctccctgaggtccaaactcactgtctccgtggctctcatccagggtgaggtcttgaaga

SEQ ID NO: 54947 - DNA, 102 bp, Homo sapiens
gtgtgtaagtttgtgtataatatgtatatatacatatatacgtgtgtgtgtttgtaaatagacatgtgcgtgcacatacacacacactcacacatatatatg

SEQ ID NO: 54948 - DNA, 95 bp, Homo sapiens; identical to SEQ ID NO: 68

SEQ ID NO: 54949 - DNA, 93 bp, Homo sapiens; identical to SEQ ID NO: 69

SEQ ID NO: 54950 - DNA, 140 bp, Homo sapiens; identical to SEQ ID NO: 54938

SEQ ID NO: 54951 - DNA, 78 bp, Homo sapiens; identical to SEQ ID NO: 54939

SEQ ID NO: 54952 - DNA, 67 bp, Homo sapiens; identical to SEQ ID NO: 54940

SEQ ID NO: 54953 - DNA, 76 bp, Homo sapiens; identical to SEQ ID NO: 54941

SEQ ID NO: 54954 - DNA, 112 bp, Homo sapiens
tcctgctttccctctgccatggccaccctaaaatctgctctctgggtctctgagttttagccacccagcacagcatcctctgtggcccacactcacatgcagacaagcaaga

SEQ ID NO: 54955 - DNA, 61 bp, Homo sapiens
tgcaatgtgtgtgtatatatgtgtgtgtgtatgtatgtatatatatatacacacacatgta

SEQ ID NO: 54956 - DNA, 106 bp, Homo sapiens
tatgtgtcatgagtatatgtgtgttagagcgtgtgtatatatatatgtgtgtgtattaatacagttgtaatgcagtaagcacaaacacacagcaactaaatgcata

SEQ ID NO: 54957 - DNA, 68 bp, Homo sapiens
cggggcgtgtgtctcagtggctgtgagctagcgagggggtggcgagcgagccggctgcgcaggtcctg

SEQ ID NO: 54958 - DNA, 101 bp, Homo sapiens
agctggggctgcacacactgtctgtctgtccgtctgtgtccttgcccccatgtctggacccaccctctcccaatgcacacagtgccacaggccccaaagct

SEQ ID NO: 54959 - DNA, 78 bp, Homo sapiens
gcatcacataagtggcagttattattttgattaatttacggtaacttgaacaggagctgggctgagatttatgtctgc

SEQ ID NO: 54960 - DNA, 98 bp, Homo sapiens
ccagctcctaggaaccacactttctgtctctatttatttgtctattctgactattttatataaaaggaatcatatggtatgtggccttttgtggttgg

SEQ ID NO: 54961 - DNA, 62 bp, Homo sapiens
ctctccctgtctgtgtgtccctggccggcactcatcagtccaagccaggggctaggagaggg

SEQ ID NO: 54962 - DNA, 75 bp, Homo sapiens
ttgagacagggtctcactctgtctcccaggctgaagtgcagtggcgtgatcaggagcaggtgagaccatctacag

SEQ ID NO: 54963 - DNA, 58 bp, Homo sapiens
tgagacagggtctcactctgtcacccaggctggagtgtagtggtgtgatcatggctca

SEQ ID NO: 54964 - DNA, 83 bp, Homo sapiens
ggccaggactgcccaggtgagcccttcccaaattcctttttttttttttttttaaggcagggtctcactctgtcagccaggct

SEQ ID NO: 54965 - DNA, 113 bp, Homo sapiens
tagtattttgtgtaacttcttttttttttttatattttttttggtggggaggaggcatagtctctcactctgtcacccggtatactgaaagcttttatcacaagtgagtattg

SEQ ID NO: 54966 - DNA, 65 bp, Homo sapiens
cagtgtgagccaccacgtccagccaaaaaaaaatttttttttttttgagatggagtctcactctg

SEQ ID NO: 54967 - DNA, 69 bp, Homo sapiens
ctggtagcgatgcagtggcatctgggcgggtcctgcaggcgctagctgtcactgtctctgttattccag

SEQ ID NO: 54968 - DNA, 72 bp, Homo sapiens
cactgagacactctgcctgtgccagtttgatttctcacatttttaaagggccaaagcttgtgtctcaaagtg

SEQ ID NO: 54969 - DNA, 58 bp, Homo sapiens; identical to SEQ ID NO: 285

SEQ ID NO: 54970 - DNA, 58 bp, Homo sapiens
tgagaccgagtctcactctgtcacccaggcaggagtgcagtggtgtgatcttggctca

SEQ ID NO: 54971 - DNA, 80 bp, Homo sapiens
ggcatctaggggatactctgttcgtcacctccctgtcctacacagagaagagtcacagcaggaaaacagacctatttgcc

SEQ ID NO: 54972 - DNA, 108 bp, Homo sapiens
cttcctgatgaggacacagtgaccaccacgctcaaggacacagagggtggacgtgccacattcacactctgtgacttagagcggctggacgggcagggacttaggagg

SEQ ID NO: 54973 - DNA, 70 bp, Homo sapiens
ctgggtgaagtggtgcacctgtaggcccagctcctcaggaggctgaggtaggaggatcacttgagcccag

SEQ ID NO: 54974 - DNA, 62 bp, Homo sapiens
caggtcggccactgtgtctgagtgactgcccaaagacatgttggcacatgatggctgttctg

SEQ ID NO: 54975 - DNA, 70 bp, Homo sapiens; identical to SEQ ID NO: 54973

SEQ ID NO: 54976 - DNA, 62 bp, Homo sapiens; identical to SEQ ID NO: 54974

SEQ ID NO: 54977 - DNA, 70 bp, Homo sapiens; identical to SEQ ID NO: 54973

SEQ ID NO: 54978 - DNA, 62 bp, Homo sapiens; identical to SEQ ID NO: 54974

SEQ ID NO: 54979 - DNA, 101 bp, Homo sapiens
agttcggttcttcctgtcagtgtacttggtttttatcagctgctgaaacaggaggctctgtcactgcgtccttctagggtcctggcagtagcaacctgttt

SEQ ID NO: 54980 - DNA, 139 bp, Homo sapiens
caaactggctacagaaagctcattttaacgcccactagagagtgaggagactgtaggtgcaatttcttttttcttttttttctgagacagatgagtcttgctctgtggtcccaggctggagtgcagtggtgtgatcttg

SEQ ID NO: 54981 - DNA, 79 bp, Homo sapiens
ctctgtgtgtgtctgtgtcctcgtctcttcttatgagatggcttagtccatctcaggctgctgtcacagaataccagag

SEQ ID NO: 54982 - DNA, 79 bp, Homo sapiens; identical to SEQ ID NO: 54981

SEQ ID NO: 54983 - DNA, 84 bp, Homo sapiens
ctggggctttggcggggtggtgggtgaatggcccagccctctgtggctcgaggcctctgactcccacacaccgtctctccctag

SEQ ID NO: 54984 - DNA, 67 bp, Homo sapiens
tctcagccactgactctgtcctagggcaagagaagggggctcgggcctggcaggggtggggcttgga

SEQ ID NO: 54985 - DNA, 79 bp, Homo sapiens; identical to SEQ ID NO: 54981

SEQ ID NO: 54986 - DNA, 79 bp, Homo sapiens; identical to SEQ ID NO: 54981

SEQ ID NO: 54987 - DNA, 95 bp, Homo sapiens
cagagggccgaagcctctgccaggcagaagacactgagttctcagcaaagagaacacctttcagtgctgtggtcaaagggatgtcaagcctcctg

SEQ ID NO: 54988 - DNA, 79 bp, Homo sapiens; identical to SEQ ID NO: 54981

SEQ ID NO: 54989 - DNA, 79 bp, Homo sapiens; identical to SEQ ID NO: 54981

SEQ ID NO: 54990 - DNA, 79 bp, Homo sapiens
tccattcacctctcactcagtccctcccttaacacatggggattatggggattacaatttgaatcgagatttggttggg

SEQ ID NO: 54991 - DNA, 79 bp, Homo sapiens; identical to SEQ ID NO: 54981

SEQ ID NO: 54992 - DNA, 79 bp, Homo sapiens; identical to SEQ ID NO: 54981

SEQ ID NO: 54993 - DNA, 97 bp, Homo sapiens
gcctgcacggcagacagttatccctttctagtctggctcgtgggactctagagggagtcagtctgcaacagtaagtggtgagttcttctgtccagcg

SEQ ID NO: 54994 - DNA, 86 bp, Homo sapiens
gggcacatagtagactctcagtaatacttgttgatttttaattaagacatttcacagtgaggattgcacacagcctctctgtgcct

SEQ ID NO: 54995 - DNA, 79 bp, Homo sapiens; identical to SEQ ID NO: 54981

SEQ ID NO: 54996 - DNA, 95 bp, Homo sapiens; identical to SEQ ID NO: 68

SEQ ID NO: 54997 - DNA, 93 bp, Homo sapiens; identical to SEQ ID NO: 69

SEQ ID NO: 54998 - DNA, 79 bp, Homo sapiens; identical to SEQ ID NO: 54981

SEQ ID NO: 54999 - DNA, 79 bp, Homo sapiens; identical to SEQ ID NO: 54981

SEQ ID NO: 55000 - DNA, 79 bp, Homo sapiens; identical to SEQ ID NO: 54981

SEQ ID NO: 55001 - DNA, 59 bp, Homo sapiens
tgggactgagtctcgctgtgtcacccatgctggagtgcagtggtgcgatccttggctca

SEQ ID NO: 55002 - DNA, 115 bp, Homo sapiens
cctgtcagtgggccgtactttgtttccttgcatgcctcatacttttttgtttaaaactggacattttgatgttataatgtggtggctctggaaatcagatgtccctctccccagg

SEQ ID NO: 55003 - DNA, 104 bp, Homo sapiens
taggttgtctgtttaattgcttattaatttatttatatttcaatagctttaggggtacaagtggtttttggttacatgggtgaattgtatagtagtgaagcctg

SEQ ID NO: 55004 - DNA, 96 bp, Homo sapiens
aaatacatatatatgtatttatagttatgtaaatacatataaatatatatgtatttatagttatataaatatatatacgtatttatagttatataa

SEQ ID NO: 55005 - DNA, 284 bp, Homo sapiens
atatacatgtatatatgaatacctatatatttatatatatgcatatatatgtatgtatatgtatatatgtatgtatatgtatatgtatatatgtatgtatatgtatatacgtatgtatgtatacatatgtgtatatatgtgcatatattatatatgtatatatttatatataaatgtgcatatatttatatatataaatctgtatatatttatatatataaatgcgtatatatacatacgtatacatttgtatgtataaatacgtatatatttgtatatataaa

SEQ ID NO: 55006 - DNA, 284 bp, Homo sapiens; identical to SEQ ID NO: 55005

SEQ ID NO: 55007 - DNA, 96 bp, Homo sapiens; identical to SEQ ID NO: 55004

SEQ ID NO: 55008 - DNA, 95 bp, Homo sapiens; identical to SEQ ID NO: 68

SEQ ID NO: 55009 - DNA, 93 bp, Homo sapiens; identical to SEQ ID NO: 69

SEQ ID NO: 55010 - DNA, 95 bp, Homo sapiens
gtttcgtgtgtgtgtgtgctctgttgtattattttattttattttattttattattattatactttaagttttagggtacatgtgcacaatgtgc

SEQ ID NO: 55011 - DNA, 117 bp, Homo sapiens
tcagcctccctgagtatctgggactacaagtgcacaccaccatggccaactaattttttttatttttagtagagatggggtttcaccatattgcccagcctggtctcaaactcctga

SEQ ID NO: 55012 - DNA, 84 bp, Homo sapiens
ccaatagaatgtgacagaagtgacattgcactagttttgagctcacgcctcaagagccttgtacactttcactttctcttttgg

SEQ ID NO: 55013 - DNA, 97 bp, Homo sapiens
agtctcttccttgtttttatgtaggtaggtatgtatgtatgtatgtatgtatgtatgtatgtacgtattatatataaactgtatgcatatattgact

SEQ ID NO: 55014 - DNA, 95 bp, Homo sapiens; identical to SEQ ID NO: 68

SEQ ID NO: 55015 - DNA, 93 bp, Homo sapiens; identical to SEQ ID NO: 69

SEQ ID NO: 55016 - DNA, 95 bp, Homo sapiens; identical to SEQ ID NO: 68

SEQ ID NO: 55017 - DNA, 93 bp, Homo sapiens; identical to SEQ ID NO: 69

SEQ ID NO: 55018 - DNA, 121 bp, Homo sapiens
gtacatagtaggtgggtatgtgtatatatatatatcttcagcatatatatgtatatgtatatatatcagcatgtatatatacattatacatatatgtatatatatatcagcatatatatgt

SEQ ID NO: 55019 - DNA, 71 bp, Homo sapiens
tgggcacataggtgattccatgtcttttctattttttttttttttgagacggagtctcgctctgttgccca

SEQ ID NO: 55020 - DNA, 129 bp, Homo sapiens
ggtgtgacagagtcaggtttgttttatttatttatttatttatttatttagaaacagagtctcactctgtcacccaggctggagtgcagtggtgcgatcttggctcactgcaacctccatctcccaggt

SEQ ID NO: 55021 - DNA, 123 bp, Homo sapiens
gttaccaggggctgagagtaaggggaatggggagttattattacttaatggttacagagtttttgttaaggggtgataaaaaagttttggaaatagctagtagtgatggatgcacaacattgt

SEQ ID NO: 55022 - DNA, 119 bp, Homo sapiens
cgtctttgtgggtgcaggtggcgtccgtgtcttgaagagcttggcggcgaggccctcactgtctccctgtcgttgcagctgacatcatgtacacgggcaccgtcgactgttggaggaag

SEQ ID NO: 55023 - DNA, 58 bp, Homo sapiens
tgagacagagtcacgctctgtcacccaggctggagtgcagtggtgcgatctcggctca

SEQ ID NO: 55024 - DNA, 71 bp, Homo sapiens
ttgtttcattttattttgctttgtgagacagggtctcactctgtcacccaggctggagtgcagtggcacaa

SEQ ID NO: 55025 - DNA, 118 bp, Homo sapiens
atacatatgtgtgggttttggcatgcatatgatgtatgtatatatgcctgtatctgtgtatttgtatttgtgtctgtgtaggtctatgtatgtatatgtgtgtttgtgtttggaatgt

SEQ ID NO: 55026 - DNA, 129 bp, Homo sapiens
tgcactataactatatataatgagctacataattatatatatgtgtgtatatatatgtgtgtgtatatataactatatataatgagctacataattatatatatgtgtgtgtatatatatgtgtgtgtg

SEQ ID NO: 55027 - DNA, 92 bp, Homo sapiens
tatacatgtatatgtgtgtatgcgtgtatatacacacgtatacatatatacgtgcgtgtgtatgtgtatatatatatatgtgtatatatata

SEQ ID NO: 55028 - DNA, 105 bp, Homo sapiens
ctctgtctctattttgtgtgcatgtatgtgtgtgtgtatatatatatgtgtgttcgtgtgtgtatatatatatagatatatatattcacacatgtatctgcagtg

SEQ ID NO: 55029 - DNA, 203 bp, Homo sapiens
gtgtgtccgtgcgtgtctgtctgtgcccatctgtgcatgtctgcgtctgtgtgtgcctgttgctgtgcatgtctgcgtctgtgtgtgcctgtcgctatatctgtatgtccatgtgtgtgtgcccatctgtgcatgtctgcgtctgtgtgtgcctgttggtgtatcactgtgtgtccgtgcgtgagtgtgcccatctgtgcatg

SEQ ID NO: 55030 - DNA, 128 bp, Homo sapiens
gtgtatctgtatgtccgtgtgtgtgtgtgcccatctgtgcatgtctgcgtctgtgtgtgcctgtcactgtatctgtatgtccgtgtgtgtgtgtgtccagctgtgcatgtctgcgtctgtgtgcgtgc

SEQ ID NO: 55031 - DNA, 118 bp, Homo sapiens
tcattaagatggataaatatcactctcatgagattgggttaatttttgagggagtgagttctcactctctcaggatgggattggttggttacttcaagagtgggttgttataaagtga

SEQ ID NO: 55032 - DNA, 142 bp, Homo sapiens
ctgtgatttgagtttaaagttctctggttaatgaaatttcaggcaggagattggggtaactgtgtccctctttggcagtcaggtttccaggtagataacagaacttctgagaacagcttcatcttatgctttgagagagaca

SEQ ID NO: 55033 - DNA, 87 bp, Homo sapiens
gtgagactccatctcaagaaaaaaaaaaaagcaatacttgcagatggttagcaagaaagtttatttttttcttaccatggcattcac

SEQ ID NO: 55034 - DNA, 83 bp, Homo sapiens
ctgttgagtttagcatttgttttgggattttcatttttaaggaagtaatactatgaatagatgtatttatataaactgagcag

SEQ ID NO: 55035 - DNA, 116 bp, Homo sapiens
agctgtaatcatgccactatactccagcctgggtgaaagagtgagaccctgtctaaatatatatatatttgggagtaggagaattttttggaaggcctgtgtgagcaggaagagtt

SEQ ID NO: 55036 - DNA, 116 bp, Homo sapiens
catgcattttgctttcaggaaagagttttcaaggactaaatagtgtgcggagagaatattttatattttcatgagccacttccagaaagagtttttagaagttccactgcagggca

SEQ ID NO: 55037 - DNA, 111 bp, Homo sapiens
actttttctttgctgcaacacctgctgttcacattgttttttttttttttggtgaggggcgtcaggctgtgacaatacctttattttaaaatgaagcaggtaggagaatgt

SEQ ID NO: 55038 - DNA, 82 bp, Homo sapiens
ctccatctccagttgtcctgcctttccagatggaaccaatgttcattttacatatgtttgagaggtgacagcgagctggcag

SEQ ID NO: 55039 - DNA, 101 bp, Homo sapiens
cgagactcgtctcaaaaaaaaaaaaaaaaaaaaagtaaaactttcctgggatgaaattattttttttgtttttacttttcttctttagagacagggtctcg

SEQ ID NO: 55040 - DNA, 65 bp, Homo sapiens
gacagagtgagaccctgtctcaaaacaaaacaatttttttttttgagacagagtctcgctctgtc

SEQ ID NO: 55041 - DNA, 91 bp, Homo sapiens
ctctgcctccatctccacgtggccttctctgtgtctgtgtctcctaggacacctgtcattgcatttaggggccacctagataaatccaggg

SEQ ID NO: 55042 - DNA, 102 bp, Homo sapiens
cagctcctgggggctccaggcgtccctgggcttgtggccgcatcactccagtctctgcctctgtctgtggccttcttctctgtgtctgtgtctcctcttctg

SEQ ID NO: 55043 - DNA, 84 bp, Homo sapiens
gaagctagtggataatattctgaaattgttgatgagacacctagcttcatcttcagttgtctgcagacactcatccagtgcctc

SEQ ID NO: 55044 - DNA, 102 bp, Homo sapiens
cagctcctgggggctccaggcgtccctgggcttgtggccgcatcactccagtctctgcctctgtctgtggcctcctcctctgtgtctgtgtctcctcttctg

SEQ ID NO: 55045 - DNA, 102 bp, Homo sapiens
cagctcctgggggctccaggcgtccctgggcttgaggccgcatcactccagtctctgcctctgtctgtggccttctcctctgtgtctgtgtctcctcttctg

SEQ ID NO: 55046 - DNA, 58 bp, Homo sapiens; identical to SEQ ID NO: 2263

SEQ ID NO: 55047 - DNA, 114 bp, Homo sapiens
gtatgtatatgtgtgtatatatgtgtgtatgtatatgtgtgtatatatacacacacgtacatatatatacatatatatacacacacgtacatatatatacacacacgtacatat

SEQ ID NO: 55048 - DNA, 67 bp, Homo sapiens
atgtacatgcaaatataggtattcatatatattaatatgtgtgtgtatgcactatatgtatttatat

SEQ ID NO: 55049 - DNA, 95 bp, Homo sapiens; identical to SEQ ID NO: 68

SEQ ID NO: 55050 - DNA, 93 bp, Homo sapiens; identical to SEQ ID NO: 69

SEQ ID NO: 55051 - DNA, 98 bp, Homo sapiens
atcaagacactgtggtactggcataaggatagacctatagaccaacagaacagaactgagagtccagaaataaatccttatgtttatggttaattgat

SEQ ID NO: 55052 - DNA, 62 bp, Homo sapiens
tctggctggcagggtgtttgcctattgcctgtggccacaccaacagacgccctgcttacagg

SEQ ID NO: 55053 - DNA, 167 bp, Homo sapiens
tgtgtatatatacacatatacgtatatgatgtgtgtatatgcacatatatgtatatatgtatatgatgtgtatatatacacatatatgtatatatgtatatgtgtatatatacacatatatgtatagatgtatatgtgtatatatacacatatatgtatagatgtat

SEQ ID NO: 55054 - DNA, 76 bp, Homo sapiens
gtttggaactcagagaagggagagtgcactatttattggtccctgacactctcaacacttgctaagagctccaaat

SEQ ID NO: 55055 - DNA, 95 bp, Homo sapiens; identical to SEQ ID NO: 68

SEQ ID NO: 55056 - DNA, 93 bp, Homo sapiens; identical to SEQ ID NO: 69

SEQ ID NO: 55057 - DNA, 102 bp, Homo sapiens
ttggaaggggtgagggagctctctggggtccattttattttattttattttgttgttgtttttgttttttgagatggagtctcgctctgtcactgaggctgg

SEQ ID NO: 55058 - DNA, 85 bp, Homo sapiens
tatgtgactacctgtgtatttagcgcttgtgtgtgtgtgcgtgcacacacgcacacacatacacacaagaatgaaggtttacatg

SEQ ID NO: 55059 - DNA, 116 bp, Homo sapiens
agaccaaagtgctggcatggtaggtaggacaatgcatggatcagcacagaacaaagacagtaatgccttattttatgccttgctactaacttggcttatcagttggcatgacctct

SEQ ID NO: 55060 - DNA, 65 bp, Homo sapiens
tggtagccattcaggccctgagagcttgaccccaattcttctctgtgtgtctgtctggccatcca

SEQ ID NO: 55061 - DNA, 58 bp, Homo sapiens
tgagacagggtctgtctctgtcacccacgctggcgttcagtggcacgatcatagctca

SEQ ID NO: 55062 - DNA, 111 bp, Homo sapiens
tatatatatatgtgtatatatgtgtatatatatacgtatatatatgtgtatatatacgtatatatatacgtatatatgtgtatatatactatatatatacgtatatatata

SEQ ID NO: 55063 - DNA, 94 bp, Homo sapiens
gcatgcggaagcctacagtctagtccagtgaaagagcttggcctggttccccctctcactttctcagactggatggatatgtggcgtcagcagc

SEQ ID NO: 55064 - DNA, 81 bp, Homo sapiens
tccgagtctgttttctgcttggtccaacgaggatcacccctcccccaagggttgtgacagttcagagagatcaagatggga

SEQ ID NO: 55065 - DNA, 74 bp, Homo sapiens
caggggttgcaggggtgggagttgaggggtgggtattgttacttaaggtgattctcagatactctgtatctctg

SEQ ID NO: 55066 - DNA, 109 bp, Homo sapiens
ttaattagggtgaagaaataagtgtaggggcatggaggggtgggggaaaacccagcttcattatctgtctgtctcactctttcctagtcaacttttctgccctgtttaa

SEQ ID NO: 55067 - DNA, 72 bp, Homo sapiens
caaagaggtacagcaactagatgtgagactcaaggtcatacagctgagttgtgattgacccgtgcctatttg

SEQ ID NO: 55068 - DNA, 85 bp, Homo sapiens
tcaagttttctgtagagtctcagcactgtgatgctgaaaggtcaccctgtgtgtgtctgctgatgactctatgggactctgtgga

SEQ ID NO: 55069 - DNA, 104 bp, Homo sapiens
ggagttcttgtttaaaatgcaaattgctacgtcccactctctctagacactgaatcagcatcagggagtgcagcccaggaatctgccttttcaacacgtgcccc

SEQ ID NO: 55070 - DNA, 77 bp, Homo sapiens
tcagacagaaatgagtgtgcacctgagccaccactgcctagttgtatgacttaggacaagtcactctgtctctctga

SEQ ID NO: 55071 - DNA, 116 bp, Homo sapiens
ccaggaggactgtttgttttgttgacttctccaaattagctccctttgaagtgattttcataatctgtgttcccaagggggtgggggaaaaattccactaacatgggtctccttgg

SEQ ID NO: 55072 - DNA, 120 bp, Homo sapiens
ctcacaatcatggtggaaagcaaatgggaaacaaggaccttcttcacatggcagcaggagagagaagtgtgtgtgaacaaaggaaaaactaccatttataaaaccatcagatctcgtgag

SEQ ID NO: 55073 - DNA, 58 bp, Homo sapiens
tgagacagggtttcactctgtcactcaggctggagtgcaatggagtgatctctgctta

SEQ ID NO: 55074 - DNA, 89 bp, Homo sapiens
ttgctgagtcttatggtactagcatgtttagttttataagaaactgccaaacagtttcctagagaggctgtactattgtttatttccaa

SEQ ID NO: 55075 - DNA, 80 bp, Homo sapiens
agtctgagatcaaggtgtcagcaggtttttttttttttgttttttttttttgagacagagtctcacctgtcacccaggct

SEQ ID NO: 55076 - DNA, 76 bp, Homo sapiens
gctccagtgtaccaccattacatatgtgtgtatgcatttctatatgtatgtatacatattatatgtggtattaagc

SEQ ID NO: 55077 - DNA, 93 bp, Homo sapiens
gggttaaggaaggagttcctggatcgggaggagatttttttgctttttttttttttttttttttttttttttgagacagagtccctgtgactc

SEQ ID NO: 55078 - DNA, 176 bp, Homo sapiens
tgtgtatacacacatatatatgtgtacacatatatatatgtatacacacatatatatgtatatacatatatatgtgtgtgtatatatatatacacacatatatatgtgtatacatatatatgtgtgtatatatatatatatatatacacacacacagatttttatatgtatatgta

SEQ ID NO: 55079 - DNA, 128 bp, Homo sapiens
tatacacacatatatatgtatacacatatatatgtgtgtatatatatatacacacacatatatatgtatatacatatatatgtgtgtatacatatatatatgtgtacacatatatatgtgtgtataca

SEQ ID NO: 55080 - DNA, 73 bp, Homo sapiens
cccagggaaggtgacgctctcactgtcaccttggcttcagctggtgtctgggagccgatgcctgcctcccggg

SEQ ID NO: 55081 - DNA, 121 bp, Homo sapiens
attgcaatttgcttttttaatgcatatttaatgaaataatgaaaagagcctcacacacagacacacaaacctgtctcttgtgaagctattattaggcaattgtgtaaagtaaatgaagtgg

SEQ ID NO: 55082 - DNA, 59 bp, Homo sapiens
tggccagattttaggggggcctgctcccaacaattttgagacagggtctctgtctgtca

SEQ ID NO: 55083 - DNA, 99 bp, Homo sapiens
agacagaaaaagaaagtgtgactgatatacgtgtgtggatttatatattatatatatatagatatatcacattatatctatctatctatctatctatct

SEQ ID NO: 55084 - DNA, 99 bp, Homo sapiens
agatagatagatagatagatagatataatgtgatatatctatatatatataatatataaatccacacacgtatatcagtcacactttctttttctgtct

SEQ ID NO: 55085 - DNA, 115 bp, Homo sapiens
atgagtttacactaatgtatattatacttatacaaatactaatgagtttatactagtatatatattagtttctgctagtttatgttgatattatactaatatatattacacttat

SEQ ID NO: 55086 - DNA, 75 bp, Homo sapiens
gcacctggccctgtctacacatcttgacatcttgtttctagtgatgttaatcttgatggtgaaggtggtatgtgc

SEQ ID NO: 55087 - DNA, 115 bp, Homo sapiens
ggtacagcatcaagaagtcagagcaggcaaaaatggaatatatgttcttttagaatatattcttttaaatatatttaataaatatattcctcactgtgaagaaatcttatgttcc

SEQ ID NO: 55088 - DNA, 110 bp, Homo sapiens
tctctatgtgtgtatatatatttacatatatagatatatgcatgtgtttatatgtgtatatatttacatatatacagatacatgcatatatgtttatatgtatatatatg

SEQ ID NO: 55089 - DNA, 146 bp, Homo sapiens
caggcaaacggggaaagagagagagtgatgggaatcaggtgggagatttttttttttttttttgagatggagtctctctcactctgtcacccaggctggagtgcagtggcacaatatcggatcactgcaacctccgcctcccaggt

SEQ ID NO: 55090 - DNA, 140 bp, Homo sapiens
tgggattacaggagtgagccaccgcacccagcgcattttctttcttcttcttcttcttctttttttttttttttttgtttgtttgaggcggagtctcgctctgtctcccaagctggagagcagtggcatgatctcggctc

SEQ ID NO: 55091 - DNA, 103 bp, Homo sapiens
acacatatacaaacccatatagtggatggagtatgtggtaggtttgttagatggtgtctctctgtccatctctctctctccatgtatgtctatgtgtgtgtgt

SEQ ID NO: 55092 - DNA, 82 bp, Homo sapiens
atgcatacatacatacatagacagctatagataaatgatagatgacgtgtctatctatatttctatgtatctatgttctcat

SEQ ID NO: 55093 - DNA, 96 bp, Homo sapiens
ctctgtgtatatttacttgcaatgtccaagataattttgattatttgattatctaacaagttagccttgtgcttgtagttaaaatatatatgtgag

SEQ ID NO: 55094 - DNA, 78 bp, Homo sapiens
ggaatgagacagcttttggaatagggtctatgaagatatccttcttttttttttttttttcagatggagtctcactct

SEQ ID NO: 55095 - DNA, 98 bp, Homo sapiens
ttgtaccctaatcaaaccccacgtgcccatgaaattttaaatccacagatacactgtgtatctgtttttatatttgtggccttttggagggtcagcaa

SEQ ID NO: 55096 - DNA, 82 bp, Homo sapiens
gaaaataggaagaatatttgaatctcctgaggcagcctgtagggcccaagctacagaagcattttttgtttttttttttttt

SEQ ID NO: 55097 - DNA, 58 bp, Homo sapiens; identical to SEQ ID NO: 13889

SEQ ID NO: 55098 - DNA, 58 bp, Homo sapiens; identical to SEQ ID NO: 26566

SEQ ID NO: 55099 - DNA, 58 bp, Homo sapiens
tgagacagagtctcactctgtcgcccaggttggagtgcagtggtgtgatctcagctca

SEQ ID NO: 55100 - DNA, 88 bp, Homo sapiens
gccaaggtgacgtgtctgttgtgtggctccagaattgaaagcctgagatttgacgtctgcatcttcacagtcgacctgttagaagggc

SEQ ID NO: 55101 - DNA, 78 bp, Homo sapiens
gagtctcactctgtcacccaggctggagtacaatctcagttcactgcaacctccacctcccaggttcaagtgattctc

SEQ ID NO: 55102 - DNA, 100 bp, Homo sapiens
ttcagacttagatatggcattgctattaaagtatcagagagagaattttattttattttatttattttagatgaagtcttgctgtgtcacccaggctgga

SEQ ID NO: 55103 - DNA, 58 bp, Homo sapiens; identical to SEQ ID NO: 2263

SEQ ID NO: 55104 - DNA, 85 bp, Homo sapiens
gtgagcagttgtttctgctgtttttgagagtctaagttccccgttagccttctgtaacaatgacacagcacacacactgcttcat

SEQ ID NO: 55105 - DNA, 74 bp, Homo sapiens
gtgtgtgtgtgtgtgtatttagacatatatatatgtgtatgtatatatatgtgtgtgtatatatatattcagac

SEQ ID NO: 55106 - DNA, 121 bp, Homo sapiens
gggcatttataggtatgtactcatgtatggagaaaaattaagacactaaattattttgattttataaaagtttgctagaaataagtggtcttgtttttctctgtgagttgttcatatttgt

SEQ ID NO: 55107 - DNA, 76 bp, Homo sapiens
tcctggatcgtggagtcacaacgctgtctgtggttagatgtgaggagcagacagtgtcagtgactcaggggcaggg

SEQ ID NO: 55108 - DNA, 144 bp, Homo sapiens
tgtgtatatgcatatgtatacacatacacgtgtatatgtatacatatatgtatatttatacatatacaatatatgtatacatatacacgtgtatgtgtatacatatatgtatatacatatacaatatatgtctacatatacatg

SEQ ID NO: 55109 - DNA, 93 bp, Homo sapiens
tatgtatacacatacacgtgtatatgtatacatatattgtatatgtataaatatacatatatgtatacatatacacgtgtatgtgtatacata

SEQ ID NO: 55110 - DNA, 84 bp, Homo sapiens
tctagcttgacaacctggttttttttttttttttttttttttttttagagagagacagggtctcactctgtcaccaaagctgga

SEQ ID NO: 55111 - DNA, 95 bp, Homo sapiens; identical to SEQ ID NO: 68

SEQ ID NO: 55112 - DNA, 93 bp, Homo sapiens; identical to SEQ ID NO: 69

SEQ ID NO: 55113 - DNA, 72 bp, Homo sapiens
gtatatatacatatgtatgtgtgtatacatgtatatgtatatatgtatgtgtatatatgtatgtgtgtatat

SEQ ID NO: 55114 - DNA, 138 bp, Homo sapiens
tgcatatatgtatgtgtatatatgtacacgtatatatgagtatatatgtgatttgtatatatgtatgtgtatatatgtgcgtatgtatatgtatatgtgtgtatgtttatatgtacatgtgtatatatgtacatgtgt

SEQ ID NO: 55115 - DNA, 140 bp, Homo sapiens
tgtacatatgtgtgtatatatgtatatgtttatatgcacgtatgtacatgtatatatgtgtgtatatatgtacatgtatatatatatgtgtgtatatatgtgtgtatatatgtatgtgtgtgcatatgtatgtgtatgtg

SEQ ID NO: 55116 - DNA, 85 bp, Homo sapiens
gtatatgtacgtgtgtatatatgtgtgaatatgtatgtgtgtatatatgtatatgtgtattcgtgtatgtatacactacatttat

SEQ ID NO: 55117 - DNA, 78 bp, Homo sapiens
ctcctgcccagggagagagttcaggcccagggactgtctgtcactggggtccgtgttctgagcctgtctttgttgggg

SEQ ID NO: 55118 - DNA, 95 bp, Homo sapiens; identical to SEQ ID NO: 68

SEQ ID NO: 55119 - DNA, 93 bp, Homo sapiens; identical to SEQ ID NO: 69

SEQ ID NO: 55120 - DNA, 73 bp, Homo sapiens
gaggaacctaatcgtatgcagctctacagtcccagggcaccctaacagactgtctcacacagggtaggccctc

SEQ ID NO: 55121 - DNA, 98 bp, Homo sapiens
gagggttttttgttttttggggttttttttctgagtgtctcactctgtccctgaggctggggtgcagtggcatgctcttagctcaatgcaacctcctc

SEQ ID NO: 55122 - DNA, 58 bp, Homo sapiens; identical to SEQ ID NO: 198

SEQ ID NO: 55123 - DNA, 81 bp, Homo sapiens
aacattcgggcttggtggtgcacctgtagtccccactacttgggaggctgaggtaggaggatcacttgagccagggaggtt

SEQ ID NO: 55124 - DNA, 91 bp, Homo sapiens
attatccttttttctttcagaattaccgagaatgacttgaagttttgtttttagaactgtttttcatgtattcactagaagggaggatgat

SEQ ID NO: 55125 - DNA, 95 bp, Homo sapiens; identical to SEQ ID NO: 68

SEQ ID NO: 55126 - DNA, 93 bp, Homo sapiens; identical to SEQ ID NO: 69

SEQ ID NO: 55127 - DNA, 58 bp, Homo sapiens; identical to SEQ ID NO: 7533

SEQ ID NO: 55128 - DNA, 88 bp, Homo sapiens
gcttcttcatatgttctcttcaacaggacagtcaaactttttttttttttgagacaaagttttgctcttgttgcccaggctggagtgc

SEQ ID NO: 55129 - DNA, 90 bp, Homo sapiens
gctggatatgataaacactatctcacagtgtctgtggctcatcatcgggagcggcttagctgtgtggtcgtggctcatgctcttacaggc

SEQ ID NO: 55130 - DNA, 93 bp, Homo sapiens; identical to SEQ ID NO: 69

SEQ ID NO: 55131 - DNA, 72 bp, Homo sapiens
gtggaactgagagtctattggggtaggtagacctagtgggttgaatagttgccccccaaaagatatgcacac

SEQ ID NO: 55132 - DNA, 119 bp, Homo sapiens
tcaaatcttgtggtctttcgtctttttgataattttgtcttttgattccacaacaggtgtgaggtgacatctctcactgtggttttaatttgcatttctctgatgattaatgacattga

SEQ ID NO: 55133 - DNA, 98 bp, Homo sapiens
tgggtgttagagaaagcaagtcccactgtgcgagaaaaagtgagtgtcaattcatttctgatgatagagaggactaattagagaaagctaacagctca

SEQ ID NO: 55134 - DNA, 95 bp, Homo sapiens; identical to SEQ ID NO: 68

SEQ ID NO: 55135 - DNA, 93 bp, Homo sapiens; identical to SEQ ID NO: 69

SEQ ID NO: 55136 - DNA, 62 bp, Homo sapiens
ctgcacgacagtgtctctctccctgtgtcctcactttgaggagacaagacagagctatgcag

SEQ ID NO: 55137 - DNA, 122 bp, Homo sapiens
gtaaatgacatttaaatatttgtatacatatatgtatatataatatatgtatatatatatttgtatatataatatatgtatatatatatttgtatttttatatctgtatatcaagggatttg

SEQ ID NO: 55138 - DNA, 69 bp, Homo sapiens
atgtgaggatagcagacagatctgagtgtgttcagtgggagcattccctcgggcctgccgtgtctccat

SEQ ID NO: 55139 - DNA, 95 bp, Homo sapiens; identical to SEQ ID NO: 68

SEQ ID NO: 55140 - DNA, 93 bp, Homo sapiens; identical to SEQ ID NO: 69

SEQ ID NO: 55141 - DNA, 102 bp, Homo sapiens
ggtgtagtggtgcatgcctgtagtctcagctacttgggaggctgaggtggaaggatcatttgagcccaggaggtcaaggctgcagtgaaccatgatcatgcc

SEQ ID NO: 55142 - DNA, 131 bp, Homo sapiens
acatacatacatgtaatatatattatgtaaatatataatgtatatatattatgtaatatatattatgtatataatgtaatatgtattatgtatctatattatgtaatatatatattatgtgtatatatata

SEQ ID NO: 55143 - DNA, 81 bp, Homo sapiens
ttccagacatacagattctctctctctttgtgctaagctgcctggagctggaaggagggggagagaacaccaagactggga

SEQ ID NO: 55144 - DNA, 139 bp, Homo sapiens
caagagtgggttgttataaaagtgagttcagctctctcttgctctctcatacacaccttctcttgcccttctgccgtgggttattattgttgattgctgtttggtgaatggattgaacaagtaggttacccaagggcag

SEQ ID NO: 55145 - DNA, 89 bp, Homo sapiens
gtatgctatgggccttgggtgagactctgagatgtgcaggcttcagatgagacccagcacactccgagctctggtggctaaggtgagac

SEQ ID NO: 55146 - DNA, 112 bp, Homo sapiens
aaactctatctcttattcgttttggggttacccttgaaattttactatgcatatttaatgtaaacttttatttaaacaccaatgtgaatgataatgggaactttagaagttt

SEQ ID NO: 55147 - DNA, 90 bp, Homo sapiens
tggaggctagaaatctgagatcaaggtgttagcagggttggtttcttctaaagactctctccttggcatatggacagccatcttcttcca

SEQ ID NO: 55148 - DNA, 107 bp, Homo sapiens
tggttttcagtgaaccattacatagatgtgtatatatatatatatatatatatatatatatatatatatatatatatacatacacacatatatggtcttgttggcta

SEQ ID NO: 55149 - DNA, 109 bp, Homo sapiens
ctagcctcatatactaagtggtactgtatactattttattattctaaaaaattattcttgtgaaaaaagtaatatacaagtatacatacaaccttttggtaaaggctgg

SEQ ID NO: 55150 - DNA, 110 bp, Homo sapiens
tgaggtaaccagttctgaagaagtggcagcaaatatcaagccctccagaaatttaattttttatactgagattgcgtaagttgcctcctttcttttactcagttttctca

SEQ ID NO: 55151 - DNA, 81 bp, Homo sapiens
ggaggctgaggtaggaggatcacttgaggatgggaggttgagcctcctgtgagctgtgatcacaccactgcactccagcct

SEQ ID NO: 55152 - DNA, 216 bp, Homo sapiens
gtgtgtgtgtgtgtgtgtgtgtgtatatatacacatatatatgtatatgtgtatatatatatacacctatatatatgtatatgtgtatatataaatatatgtatatgtgtatatatgtatatatgtatatgtgtatatatatgtatatataaatatatgtatatgtgtatatatgtatatatgtatatataaatgtgtgtgtgtatatgtatagat

SEQ ID NO: 55153 - DNA, 100 bp, Homo sapiens
tcatttagtcaaactttgtcccttttctctgaaatcttgtttttctttttaaacaaatgtgacaaacaagccccagtgagagtacggtttgtctggatga

SEQ ID NO: 55154 - DNA, 88 bp, Homo sapiens
cctgctgccatttatttcttttctcagcctcctttgcagccacgagacccagttccagccaaagagatgtgaggggaagtcagcttgg

SEQ ID NO: 55155 - DNA, 74 bp, Homo sapiens
agatatatgtatgtatatgtgtgtgtatacacacacacacacacacacacacacatatgcatatacatatatgt

SEQ ID NO: 55156 - DNA, 71 bp, Homo sapiens
cacactgccaggaacatgattaattatctatttagattagccaacagaatctatgttcctgtgtttctgtg

SEQ ID NO: 55157 - DNA, 64 bp, Homo sapiens
tggcagattgggaattgcagtaggacgaagccaggaaggcttgtgactttgttgtttcaggcca

SEQ ID NO: 55158 - DNA, 127 bp, Homo sapiens
gctgcttctcccttcttatattactcccactgccagtctaggggattaggcctctttctctgactgagtggctgtggggacagtggcactgactctttggtaggtggtgcatggtacagaattagag

SEQ ID NO: 55159 - DNA, 88 bp, Homo sapiens
ctgaatggtcctaaatttattggcatgtgactctcacacacaggctttgagtgaggtggtgagagttttcttgcagagggcgaaacag

SEQ ID NO: 55160 - DNA, 74 bp, Homo sapiens
ggcaggacttgcaatttcagacagtttgtgcagttggcaggacagagaacacagagtggggatacggtcctgtc

SEQ ID NO: 55161 - DNA, 83 bp, Homo sapiens
tgttcctgagtctcagcatcttcatctgtgaaacgggtcaatgtttctgaactcatggatttgttgtaagaattaagtgagca

SEQ ID NO: 55162 - DNA, 68 bp, Homo sapiens
gtgagacaacactgcttccgattttgtcacttgacaatttagtttgtgtcagagtcagtgtctctcac

SEQ ID NO: 55163 - DNA, 68 bp, Homo sapiens
aacctgcttctttttgtcatttgtattttattttaagttccaggatacatgtgcaggatgtgcaggtt

SEQ ID NO: 55164 - DNA, 125 bp, Homo sapiens
atgaccagataagaataaccagcatggcgaagggtctggatatcttggggttttactttttttttttttctttttgagacggagtctcactctctcgcccgggttggattgtagtggcgtgatct

SEQ ID NO: 55165 - DNA, 70 bp, Homo sapiens
cataaccatatatatatatatatatatatatatatatatatatatatatgtttgtgtgtatgtgtgtatg

SEQ ID NO: 55166 - DNA, 86 bp, Homo sapiens
tacagtttggaaatgcaatctattttataagcgaggaaaataaattccatgcagaaatttaagagaaagaataattccaaactgta

SEQ ID NO: 55167 - DNA, 124 bp, Homo sapiens
gtgtacatatatacatcgatgtatatgtgtgtgtacatatatacatcatgtatatatgtgtacttatgtatatatatatatgtgtgtagttatgtatatatgtgtgtgtgtatatatgtgtata

SEQ ID NO: 55168 - DNA, 90 bp, Homo sapiens
ggcttgcaggatagctcaggagtctggagaacacaggttattttgtttatttgtttgttttgagacaggtcttgctctgtcacccaggct

SEQ ID NO: 55169 - DNA, 117 bp, Homo sapiens
gcccctattgtgacttccttgattctcctctttgactctgtttgactctcccactgacttcctagggaagatgtcaggagttgggttctgggattaaaattagattgggtggggagt

SEQ ID NO: 55170 - DNA, 58 bp, Homo sapiens
ggtacctcagttggaaatgcagaagtcacctgtcttctgtgtcactcagctgggagct

SEQ ID NO: 55171 - DNA, 58 bp, Homo sapiens; identical to SEQ ID NO: 49955

SEQ ID NO: 55172 - DNA, 95 bp, Homo sapiens
tttttatttagtgcctctgatcttgttaaaggtagaatccatttttattttttaatcaagaattctgtctttgatagtgagttactgaaaaagga

SEQ ID NO: 55173 - DNA, 58 bp, Homo sapiens; identical to SEQ ID NO: 2224

SEQ ID NO: 55174 - DNA, 56 bp, Homo sapiens; identical to SEQ ID NO: 335

SEQ ID NO: 55175 - DNA, 95 bp, Homo sapiens; identical to SEQ ID NO: 68

SEQ ID NO: 55176 - DNA, 93 bp, Homo sapiens; identical to SEQ ID NO: 69

SEQ ID NO: 55177 - DNA, 105 bp, Homo sapiens
gctatttggggtcttttgtggtttcatgtgaattttgaatttttttctatttctgtgaagaatgacattgaaattttggtaggaattgcattgaatctatacagt

SEQ ID NO: 55178 - DNA, 99 bp, Homo sapiens
atttcagatacacaacaaataatttttaaatataagtatgctccaaatattgcatgaggcatacatatactggcaaattattcattgtttatctgaaat

SEQ ID NO: 55179 - DNA, 115 bp, Homo sapiens
ggatcggtgtcataacaaacaattccaaaaatctcagtggcttaatacaatgagagtttatttattgttcatgtcagattttaactcagatagggaatgtgggtgattctattcc

SEQ ID NO: 55180 - DNA, 70 bp, Homo sapiens
ggcttgggaacaaggtgaaattctttttttttttttttttgagacggagtctcgctctgtctcccaggct

SEQ ID NO: 55181 - DNA, 79 bp, Homo sapiens
gtttgtttttttttgagatggagtctcactctgtcacccaggctggagtgcagtggcgccatctcagctcactgcaagc

SEQ ID NO: 55182 - DNA, 92 bp, Homo sapiens
ggtctcaaactggaaacattttacattctctttttacaagattaatttttttacaagattaagagatttgttgatgttttcactgagggacc

SEQ ID NO: 55183 - DNA, 130 bp, Homo sapiens
tgggcaacatagcaagacccagtatctccaaaacattttgtttatttttttgagactgagtctcgctctgtcacccaggctggagtgcagtggcgtgatctcagctcactgcaacctccgcctctcaggt

SEQ ID NO: 55184 - DNA, 58 bp, Homo sapiens; identical to SEQ ID NO: 10174

SEQ ID NO: 55185 - DNA, 56 bp, Homo sapiens; identical to SEQ ID NO: 10175

SEQ ID NO: 55186 - DNA, 94 bp, Homo sapiens
gcttagaggggatgctatcactccctctcagagaatggtggtgggcattttctccaccaacatgagggagggacaatgattgcttcccccttgc

SEQ ID NO: 55187 - DNA, 93 bp, Homo sapiens
cttcagaaagcctgactgatgcccatgaaggttgagagacacaggaactagtgtctgactcacacagtgaaaatcaagaggctgtggctggag

SEQ ID NO: 55188 - DNA, 77 bp, Homo sapiens
ccatgtttgatgtaactgacagtaatactgttttattttgtttgtttgagacagtgtcactctgtctcccaggctgg

SEQ ID NO: 55189 - DNA, 95 bp, Homo sapiens
agtgagctatgaagtaaggaagaaagtgtgaggtgttataaggaaagaggattttttacttatctttttttttttttttgactcagagcctcact

SEQ ID NO: 55190 - DNA, 75 bp, Homo sapiens
gcattcaagagtattcgggtaatggtaactttttttttttttgagacagtctcactgtcacccaggctggagtgc

SEQ ID NO: 55191 - DNA, 56 bp, Homo sapiens
gagtcagggtctcactctgtctccaaggctggagtgcagaggtgcaatcatagctc

SEQ ID NO: 55192 - DNA, 134 bp, Homo sapiens
tgtgttatatatatatacttgtatatatacgtatatatacacacatatatatgtgtatatatatgtatatatatatacctatatatgtgtatatatatgtatgtgtgtgtatatatatatggctgaacgtggtg

SEQ ID NO: 55193 - DNA, 58 bp, Homo sapiens
tgagacagggtctcactctgtcactcaggctggagtgcagtggcgagatcatggctca

SEQ ID NO: 55194 - DNA, 64 bp, Homo sapiens
ctggttcaacacttcagctgtgggctgctcatcttccccactcacagtctgagactgaggccag

SEQ ID NO: 55195 - DNA, 77 bp, Homo sapiens
ggctccccggagtgctcactgtggtgtctgtgcagacacacacgcacaccaaagctaaagtgagggctgcgggagcc

SEQ ID NO: 55196 - DNA, 104 bp, Homo sapiens
ccatgaggcctgttgatatttgtagacttttatgacgtaaaggtttaatttataatctatatgtatatgtgttccacacccatgtcctttctaggctagactgg

SEQ ID NO: 55197 - DNA, 83 bp, Homo sapiens
cagtgatgggtggttgtctgtgcttatttcttattattttatttatttttttgagatggagtctcactctgtcacccaggctg

SEQ ID NO: 55198 - DNA, 101 bp, Homo sapiens
ggcgtggcagtgcctgcctgtaatcccggctactgggaggctgaggtagtagaatcacttgaacctgggaggcggaggttgcagtgaactgagatcatgcc

SEQ ID NO: 55199 - DNA, 66 bp, Homo sapiens
ggctggagaatgtctgagatggccacttgcagagaggagcaggctggctgcgtctctcactgtgcc

SEQ ID NO: 55200 - DNA, 82 bp, Homo sapiens
tatatgtgtgtatatacatatatatgtatatgtgtgtatatacatatatgtatatgtgtgtgtgtgtatatatatatatata

SEQ ID NO: 55201 - DNA, 115 bp, Homo sapiens
gctcactgacaatgcacctagtcacccaagagccctgatgaagatgtacaaggagattaatcttttttttttcagacagcatctctctctgtcacccaggctggagttcagtggc

SEQ ID NO: 55202 - DNA, 91 bp, Homo sapiens
ctgccaaactgttttccagagtggctgtactttttaacattcccaccagccatcactaccttttattttggccactctgataggtgtgcag

SEQ ID NO: 55203 - DNA, 58 bp, Homo sapiens; identical to SEQ ID NO: 1725

SEQ ID NO: 55204 - DNA, 114 bp, Homo sapiens
tgtttgaattttatttagagggagcaagaagccattaaacatttttgaacagaggaatgatgtcacctagctttagaaaaatgacttgtgtttctgttaattgaaattttaata

SEQ ID NO: 55205 - DNA, 57 bp, Homo sapiens
gagacagtctcactctgtcaccagcgtgcagtggctagagtgcagtggcatgatctc

SEQ ID NO: 55206 - DNA, 102 bp, Homo sapiens
ctgaagtctattttgttttactgatgtttgtcatttttgtgccaatgtcatattgtttttctcacaatagtctggtgaaccagaaggcaagtccctctttag

SEQ ID NO: 55207 - DNA, 133 bp, Homo sapiens
ccaggcatgatggtgtacacctgtaattccagctactcaggaggctgaggtggctgaggtaggaggatcatttgtgcctgggaggcggaggctgcagtgagctataattatccaactgcactccagcctgggc

SEQ ID NO: 55208 - DNA, 70 bp, Homo sapiens
ctacaccgggtgcccaggagggttttttgtttttttgagatggagtctcactctgtcacccaggctgtgg

SEQ ID NO: 55209 - DNA, 58 bp, Homo sapiens; identical to SEQ ID NO: 9046

SEQ ID NO: 55210 - DNA, 85 bp, Homo sapiens
ggctaaaacgttctaagaaaaagtgtcttcctgtaatacaaagaactgttgctagatttattttttcttatcatagtgccaggcc

SEQ ID NO: 55211 - DNA, 96 bp, Homo sapiens
ggcattttcaatcctgtgattctgttggcttccttattcttattctttttcttttttctttttttttgcaacagggtctcagggtctcactctgtc

SEQ ID NO: 55212 - DNA, 103 bp, Homo sapiens
catatttctcctcctcaccccagatcttgcaactattattttaaactttcaaattttatttttaaaatcacctcaagttctttggggaaggaggtggaatatg

SEQ ID NO: 55213 - DNA, 99 bp, Homo sapiens
agcactggaccaatatatatatgtgtgtatatatatatatgtatatacacacatatatacatatatacacacatatgtatatatatttgtgcccatgct

SEQ ID NO: 55214 - DNA, 105 bp, Homo sapiens
acatcctctccagcatctgttgtttcctgactttttaatgatcaagttgatgaatgagcaacatcatctggtcttcaggagatgaataatgctccataaagatgt

SEQ ID NO: 55215 - DNA, 111 bp, Homo sapiens
agtttgcttttttgccatgttatagagatattttattgtgtgtgtgttaaacatatatatgtatatatatgcatgcatatctctggctcagaatcagcatagaggcaaact

SEQ ID NO: 55216 - DNA, 75 bp, Homo sapiens
ggggccctgctcaggtttgagaatgaaatctttgaaggttattattatttttttttaattttgagacagggtctc

SEQ ID NO: 55217 - DNA, 82 bp, Homo sapiens
catatatatatatatgtgtatatatatgtgtgtgtatatatatatatgtgtgtgtgtatgtatatgtatatgtatatgtata

SEQ ID NO: 55218 - DNA, 95 bp, Homo sapiens
gtaacgcgcagcctcggaagtctgtctgtctgtctgtctctcatacacacagaggctgggggcagggaggaggcaggagtcaaacagggttacac

SEQ ID NO: 55219 - DNA, 79 bp, Homo sapiens
ggtagagagtgtgagcatcagtaactgcaagtaacacacgcatggtgatggtgcaaagttgagtgtgaacactaccacc

SEQ ID NO: 55220 - DNA, 84 bp, Homo sapiens
agctgggattgtgtgtgtgtgtatatatacatatataaatataaatatatgtatatatatatatacaaatataaagttggggtt

SEQ ID NO: 55221 - DNA, 65 bp, Homo sapiens
gtatgtatatgcatgtgtatgtatacatgtgtaacatatttttatatatacatatatacacatac

SEQ ID NO: 55222 - DNA, 102 bp, Homo sapiens
catatggtctatcttagagaaagttccatgcactcttgaataggatgtatgttctgtggttgttggatggaatgttctgtatatatctgttaagtccatttg

SEQ ID NO: 55223 - DNA, 84 bp, Homo sapiens
cattgaaattagcacttggcacaatataattctctgattgcaaactatgtggagttgcctgtgctaattggttgattttatttg

SEQ ID NO: 55224 - DNA, 92 bp, Homo sapiens
gtgtgtgtgagatgtgtgtatgtgtgtgtacatatatatatatatggtatgtttgtgtgtatacatatgtatatatgtgtatgtatacacac

SEQ ID NO: 55225 - DNA, 108 bp, Homo sapiens
gaaacaatattgagtgggcatttttattctttttttatttattttatccaaatctataactccttgaggtaaggggggaaataaaaatgcaatgtcttattatttttc

SEQ ID NO: 55226 - DNA, 95 bp, Homo sapiens
tgtgttacttctaggtatgacacacacagacacgtacacatgtatatatatgttatatctctctgtgtttgtgtgtgcatacacatatatgcata

SEQ ID NO: 55227 - DNA, 112 bp, Homo sapiens
cggccaaaaagaactaaagaaaagttaaacataataatatgatttttaattgatttatttgtttcatggaggcatcatattagggacttgagattttctagtttagaggtgg

SEQ ID NO: 55228 - DNA, 96 bp, Homo sapiens
atatgtgtaaatatatgtgtgtgtgtatgtatatgtgagtgtgtatatatatatatattacatatatgtacataatgtgggtatgcttgcatatgt

SEQ ID NO: 55229 - DNA, 98 bp, Homo sapiens
tttttatcaattaatgaacctatattcatgtttataaaagatatcagatagattttttgttgtacacagttgatataaatgtttaatgttgatgaaga

SEQ ID NO: 55230 - DNA, 76 bp, Homo sapiens
ggtagttattctctgtagatttgaacaccagatattgaaattgtctttttgttcttctaaaatgggaatggcaact

SEQ ID NO: 55231 - DNA, 128 bp, Homo sapiens
gtgtatgtatatatgtgtgtatatatgtatatgtgtgtatatgtatatatgtgtatatgtgtatatatgtatatgtgtatatatgtatatatgtgtatgtgtgtatatatatgtgtgtgtatatatat

SEQ ID NO: 55232 - DNA, 95 bp, Homo sapiens; identical to SEQ ID NO: 68

SEQ ID NO: 55233 - DNA, 93 bp, Homo sapiens; identical to SEQ ID NO: 69

SEQ ID NO: 55234 - DNA, 84 bp, Homo sapiens
tctgcacactgcatgtacaatataaatgctaactatttttattcatattagaggaattacattttataagcatcagtgagcaga

SEQ ID NO: 55235 - DNA, 87 bp, Homo sapiens
tcagtgtaattgttacgtgtgtgtgtgtgtgcgcgcgtgtgtgtctgtgtgtatgtgtgtgtgacatgggtaaatttaagttactgg

SEQ ID NO: 55236 - DNA, 102 bp, Homo sapiens
tagatagatagatagatagatagatacatagagatagagatatatttatagatatatagatatatatgtgtgtgtgtgtgtgtgcatgtgtgtatgtaacta

SEQ ID NO: 55237 - DNA, 85 bp, Homo sapiens
gttacagagatcactatatatctatatgaataactgtgctgatttgtcaaccaagttcatataggtgtataagcagcttcatagc

SEQ ID NO: 55238 - DNA, 138 bp, Homo sapiens
tatttgtaatatgtatgttataaatatatgtatatattatatgtagatatgtatttatatatgtgtatatttatatgtatatatacatatatgtacataccatatgtatagatacatgtatgtatatgtgtacatgtg

SEQ ID NO: 55239 - DNA, 151 bp, Homo sapiens
gtacattttatttataatatgcatatataatatgtacattttatatatattatccatatataatatgcatatataatatgtacattttatatataatatgcatatataatatgcatatataatctgtacatattatatataatatgcatat

SEQ ID NO: 55240 - DNA, 65 bp, Homo sapiens
tgtatatgtatatatgtatatatgtatgtttaatatgtatctatgtgtacatatgtatatgtata

SEQ ID NO: 55241 - DNA, 74 bp, Homo sapiens
gtatgtatggtttgtatatatgtataaaatatgtatatatcatgtatgtgtatatatgtacatatcatatgtat

SEQ ID NO: 55242 - DNA, 63 bp, Homo sapiens
aagtgctgggattacaggcatgagccatcgcacctggctgttgtgtctttgatcttgttactt

SEQ ID NO: 55243 - DNA, 84 bp, Homo sapiens
ttgggtgaggtgaggacggggcaggtttccatggtacatttatttattttttgagacggagtctcgctctgtcgcccagcctgg

SEQ ID NO: 55244 - DNA, 95 bp, Homo sapiens; identical to SEQ ID NO: 68

SEQ ID NO: 55245 - DNA, 93 bp, Homo sapiens; identical to SEQ ID NO: 69

SEQ ID NO: 55246 - DNA, 59 bp, Homo sapiens
gagagaaaatagggaagagacttggtggaaacacacagtcactctttatgtgtctactc

SEQ ID NO: 55247 - DNA, 72 bp, Homo sapiens
gttgttttgagacaaggtctcactctgtcacccaggctggagtgcagtggtgcaatctgggctcactgcagc

SEQ ID NO: 55248 - DNA, 95 bp, Homo sapiens; identical to SEQ ID NO: 68

SEQ ID NO: 55249 - DNA, 93 bp, Homo sapiens; identical to SEQ ID NO: 69

SEQ ID NO: 55250 - DNA, 122 bp, Homo sapiens
cacctgtgtgcatgcatatatgggtgtgcatgtgcactgcaggagtatgtgcatgtgcttgtgtgttttcatgtgtgctcacgtgcacatgtgacttgctgtgtgggtgcacacgtgtgcat

SEQ ID NO: 55251 - DNA, 86 bp, Homo sapiens
gaggtgatttcagatgagtgtgtgcttactgttgactgcctgtgcagtgtaatgcccatgttcatgtaatggaaaatgtacatttc

SEQ ID NO: 55252 - DNA, 99 bp, Homo sapiens
tttccttaagtattttagctgagttgtacgtgtgtatgtatgtatgtaagtttgtgtgtctgtgtatgttgactacaggattgagtgtctaaatggaaa

SEQ ID NO: 55253 - DNA, 87 bp, Homo sapiens
tttcatatggttgagcctgtatattagatactacactgagcactttaatacacaatcttatttaatattcatgaaaaccatgtgaag

SEQ ID NO: 55254 - DNA, 67 bp, Homo sapiens
ggtcagctcaggcgtctgagatgttctgaggatcttggtgctctcagactgactgtctctgccagcc

SEQ ID NO: 55255 - DNA, 79 bp, Homo sapiens
gacagacagagaccctgtctctagatataaaaataaaaatacctttttttttttttttgagacggagtctcactctgtc

SEQ ID NO: 55256 - DNA, 112 bp, Homo sapiens
aatagggttaaaaatgactactcgatagtgttattttgagagtaagctatgtaaagtagtttgagtagctagcacagttgacattaaagaagtggtagtcaataatgttatt

SEQ ID NO: 55257 - DNA, 115 bp, Homo sapiens
aggacgcagggacaataacgagttattgtatatctattcaggtgggaaagagttctgagtgagcactgttgtggccctcagtagattatgacaatggtggcaggtccccagtcct

SEQ ID NO: 55258 - DNA, 119 bp, Homo sapiens
gagtgctggccaggcaattgttacatttttttctcaattggaatttgtctaatttttttcatgattagaatggagttgaaagtttggaaggaaggccacaaagataaattgccattctc

SEQ ID NO: 55259 - DNA, 97 bp, Homo sapiens
ggtctctgattattacgacttgcagacaatagctttatgagaaaaatgtatatttacatttttacattggaaagactttggctacaagtaacagacc

SEQ ID NO: 55260 - DNA, 80 bp, Homo sapiens
tgttacttgtagccaaagtctttccaatgtaaaaatgtaaatatacatttttctcataaagctattgtctgcaagtcgta

SEQ ID NO: 55261 - DNA, 146 bp, Homo sapiens
caaatacatatgtttatatatgtgtgtatatatataatgttttacatatgtgtgtgtatatatatgttttacatatgtgtgtgtacatatgtgtgtgagtatatatatacatatatatacacacacatatatgtatgtatatatat

SEQ ID NO: 55262 - DNA, 98 bp, Homo sapiens
atcgttatatacatatatatatccattatatatggatatatttatataatccatatggacatgtccatatatatagatagatagatagatagatagat

SEQ ID NO: 55263 - DNA, 95 bp, Homo sapiens; identical to SEQ ID NO: 68

SEQ ID NO: 55264 - DNA, 93 bp, Homo sapiens; identical to SEQ ID NO: 69

SEQ ID NO: 55265 - DNA, 99 bp, Homo sapiens
tatatatatatatatatatgagtatatatatatgtgtgtgcgtgtgtgtgtatatataatgcatatatatatgtgtgtgtgtatatatatatataacat

SEQ ID NO: 55266 - DNA, 80 bp, Homo sapiens
ttgcctcagtctctctctctgccttatgcctcttggttgaattctttcttctgaggaggcaagaatggaggttgctgcag

SEQ ID NO: 55267 - DNA, 93 bp, Homo sapiens
ttgggcaatgtaactctagatctataagttttattctagtgaagaaactggatttttaatgtaaaaatgtgtgtggattagaaagatgcttga

SEQ ID NO: 55268 - DNA, 178 bp, Homo sapiens
atacatatttacatatggatatatatgcgtatatacatagttacatatatgcatatatacatatatttatgtatatgcatacatgtatatttacatatgtttatgtatatacatatatgtgtatatttacatatatttacatatatgcatatatacatatgtttgtgtatatgcatgc

SEQ ID NO: 55269 - DNA, 80 bp, Homo sapiens
tatgtatatatacacatgtatgtatatatacacatgtgtatacatacatatatgtgtatatatgtgtatacatacatata

SEQ ID NO: 55270 - DNA, 57 bp, Homo sapiens
tgagacggagtctcactctgtctccaggctggagtacagtggtgtgatctcagctca

SEQ ID NO: 55271 - DNA, 171 bp, Homo sapiens
gtgtgtaaatatatgtatacatgtatatgtgtgtaaatatatgtatgtatacatatatgtatatgtgtgaatatgtatgtgtatatgtaaatatatttacatatatgcataacgtgaatatgtatatatgtaaatatatttacatatatttacatatacgtatatatttac

SEQ ID NO: 55272 - DNA, 120 bp, Homo sapiens
tataatacatactagatattacatatatttgaagcttctatatcatatgatattatagaagtttctatataatatagtagcttcagatatatgtaatacataatatagtatataattata

SEQ ID NO: 55273 - DNA, 91 bp, Homo sapiens
tccctgaaacttctacacacactctctgatttacagtgtgccttgcgtaccaatctcaagatacaaagtcagtggtgaagaacatcaagga

SEQ ID NO: 55274 - DNA, 102 bp, Homo sapiens
aattatatacgtgtatatataatatgtatacatatatacgtgtatatataatatgcacgtatatatgtatatatgtatatataatatatattcaatataatt

SEQ ID NO: 55275 - DNA, 95 bp, Homo sapiens; identical to SEQ ID NO: 68

SEQ ID NO: 55276 - DNA, 93 bp, Homo sapiens; identical to SEQ ID NO: 69

SEQ ID NO: 55277 - DNA, 102 bp, Homo sapiens
ggcagaggagatagtccacttagattgttgcaggaggccatcgaattttattttgggtttacatagctttttttttttttttaggtggagtctcgctctgtc

SEQ ID NO: 55278 - DNA, 118 bp, Homo sapiens
gtgtatatgtatatatgacatatatagtatatatcatatatgtgtatatgtatatgtatatatgacatatacatatacacatataagacatatacatgtgtgtgtatatatatatctc

SEQ ID NO: 55279 - DNA, 100 bp, Homo sapiens
gatatatatatacacacacatgtatatgtcttatatgtgtatatgtatatgtcatatatacatatacatatacacatatatgatatatactatatatgtc

SEQ ID NO: 55280 - DNA, 272 bp, Homo sapiens
gtgtatatatgtacacatatatgtatatatgacatatatagtatatatcatatatgtgtatatgtatatatgacatatagtatatatcatatatgtgtatatgtatatatgacatatagtatatatcatatatgtgtatatgtatatatgacatatatagtatatatcatatatgtgtatatgtatatatgacatatatagtatatatcatatatgtgtatatgtatatatgacatatatagtatatatcatatatgtgtatatgtatatat

SEQ ID NO: 55281 - DNA, 67 bp, Homo sapiens
accatgcatgtgtgtatatatatgtatatatgaacatatgtatatgtacatatatacttgtgtgtgt

SEQ ID NO: 55282 - DNA, 144 bp, Homo sapiens
atatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacat

SEQ ID NO: 55283 - DNA, 103 bp, Homo sapiens
tatattactataatactatagattatctcatgtagtaacatatatataaagttatgtgtgtgtatatgtgtgtagatctatgtgtgtgtagttatatagtagt

SEQ ID NO: 55284 - DNA, 70 bp, Homo sapiens
tagtttatacacacatatacatataaatatgtatatgtatgtatctatatgtgtgtgttaatgtaaacta

SEQ ID NO: 55285 - DNA, 85 bp, Homo sapiens
catatttttctctgtgtttgctcatgaggttaattttaattttttaattttttttatttttgtgggtacatagtaggtgtatatg

SEQ ID NO: 55286 - DNA, 138 bp, Homo sapiens
cagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaa

SEQ ID NO: 55287 - DNA, 58 bp, Homo sapiens
tgagatggagtctcactctgtcactcaggctggagtgcaatggtgcagtctccgctca

SEQ ID NO: 55288 - DNA, 98 bp, Homo sapiens
acacagtggcaagcacctgtagtcctagctactccagaggctgaggtggaaggatgacttgggcccaagaagttgaggctgaggtgagccatgattgt

SEQ ID NO: 55289 - DNA, 117 bp, Homo sapiens; identical to SEQ ID NO: 37077

SEQ ID NO: 55290 - DNA, 91 bp, Homo sapiens
tgcctgtctttataagtgaagtgaatttcttgactcaatgttttttgtttagagagttcaatccatttacattcaaggttattgataggta

SEQ ID NO: 55291 - DNA, 95 bp, Homo sapiens
gtatgcaattccaaaaagtaaagcagatatatacatatatatatatatataaataatacatatatatatatgtttgcttaactaggaaatgttac

SEQ ID NO: 55292 - DNA, 113 bp, Homo sapiens
caatttgtgtctctgtgtcacattttggcaattctcacaatacttgaaactttttcatttttattgtatctgttgtggtgatctgctatcagtgatattagatgttactattg

SEQ ID NO: 55293 - DNA, 78 bp, Homo sapiens
acacacatatgtatattatatatgcatatatgtgcatgtatacatatatatgtatatataaggtagctcaaaaagtgt

SEQ ID NO: 55294 - DNA, 74 bp, Homo sapiens
ccacaagattgattgactgattgattgattgattgattttttgcgatggagtctcgctcagtcactcaggctgg

SEQ ID NO: 55295 - DNA, 108 bp, Homo sapiens
tatatttatatacacgtgtgtatgtatatttatatacacgtgtgtatgtatatttatatacacgtgtgtatacacatgtgtatatatacacatgtgtatgtacatata

SEQ ID NO: 55296 - DNA, 90 bp, Homo sapiens
ctgagaaccctaattaccccaggatagagagtcccacagagcttggcctgtgctttcatctgtctctgtgtctccggcaggtgtggtcag

SEQ ID NO: 55297 - DNA, 72 bp, Homo sapiens
cagtgcctctgactctgtccccaagggctggtctccgaagctcttgccattgcccagggagtgaaggttctg

SEQ ID NO: 55298 - DNA, 66 bp, Homo sapiens
tgtataaccattcatgcccagtttcagttttgcaaaaggaaaagaactctggagattggttataca

SEQ ID NO: 55299 - DNA, 81 bp, Homo sapiens
aatgtgtatatatgtatacatatgtatgtacatatactatatatatatacatacgtatatgtgcatacatatatacacatt

SEQ ID NO: 55300 - DNA, 84 bp, Homo sapiens
tcctctcactgtgtgtctctcctatgtgggtctctgataaggacccttgtcgttggatttagggcacgccaggataattcagga

SEQ ID NO: 55301 - DNA, 97 bp, Homo sapiens
cccgcctgggtgacagagcgagacactgtctcaaagaaaaaaaaaaagaaatcttttttttttttgaggcggagtctctctctgtcacccaggctgg

SEQ ID NO: 55302 - DNA, 110 bp, Homo sapiens
tatttgttttaatagctaatattgcaattgtagctatcataatttttttaaaataaaatatgactaaaacaacccttaggtgcatttcaggatttagctattaattagta

SEQ ID NO: 55303 - DNA, 85 bp, Homo sapiens
gtgagaccctttctatatatgtatatatgacatttaaacaactgtaatggtggatacatgtcattatacatatgtgaaatcccat

SEQ ID NO: 55304 - DNA, 89 bp, Homo sapiens
gggcatctgcaaactcaacgtggctttcgctccagccttcaatcagtcatgagagctgagcgtgggagtgccgggcacgcagtatcccc

SEQ ID NO: 55305 - DNA, 131 bp, Homo sapiens
ggtacatctctatagggtgcttaccatgaatggagcttgcaggaatgaaagttgctctgggtgagtcagtgagtgagtgctgagtgaaagtgaaggccaaggactttactgtgcactactgtagtctttat

SEQ ID NO: 55306 - DNA, 95 bp, Homo sapiens
tcccctggacatcatgctcaagtcgtgggaggatgggagtaggccagtggacttgccctcagacactcagactcaagtactatcttcaataggga

SEQ ID NO: 55307 - DNA, 95 bp, Homo sapiens; identical to SEQ ID NO: 68

SEQ ID NO: 55308 - DNA, 93 bp, Homo sapiens; identical to SEQ ID NO: 69

SEQ ID NO: 55309 - DNA, 79 bp, Homo sapiens
agtctcactctgtcacccaggctggagtgcagtggcacggtctcactgcaacctccacttcctgggttcaagtgattct

SEQ ID NO: 55310 - DNA, 104 bp, Homo sapiens
ttcgcccacttttggatggggttgtttgtttttttcttataaatttgtttgagttcattgtagattctggatattagccctttgtcagatgagtaggttgcgaa

SEQ ID NO: 55311 - DNA, 85 bp, Homo sapiens
ccttacaaaaggacagggaggagtgtctgttcctactctcacatagcggaggaaagttagagcctctcagtctctgtttatgagg

SEQ ID NO: 55312 - DNA, 116 bp, Homo sapiens
cttgtttttcgagacacggtcttgctgttgcccaggctggagtgcagtgtgtgatcacagcgtgatccatttttattctacttgtttttcgagacacggtcttgctgttgcccagg

SEQ ID NO: 55313 - DNA, 116 bp, Homo sapiens; identical to SEQ ID NO: 55312

SEQ ID NO: 55314 - DNA, 80 bp, Homo sapiens
ttacagagcctcactctgtcactcaggctagagtgcagtggtgcaatcatggctcactgtaaccttgacgttctgggctc

SEQ ID NO: 55315 - DNA, 102 bp, Homo sapiens
tgcttttaaagcaagctaggtgctggtagcaaagattactatttttttttaagacagatcttttaaaatgcttaacaatgtgcatcctcagttgctgtggca

SEQ ID NO: 55316 - DNA, 81 bp, Homo sapiens
gtagatacagtacatgtatatatatatatatatatatatatatatatatatatatatatatatcactatgtttatgcagta

SEQ ID NO: 55317 - DNA, 105 bp, Homo sapiens
tgttgactttgatgttcttcttgtctgaactcattggcaagatgaattctaaatttatctttcaatttacgacaatgaaaccaggatgtagctctaaaagtagca

SEQ ID NO: 55318 - DNA, 95 bp, Homo sapiens
ccagcctgggaaacatagtgaaatcctgtctctagaaaatataaacattaattttttttttttgagacggagtctcgctctgtcacccaggctgg

SEQ ID NO: 55319 - DNA, 88 bp, Homo sapiens
caggataggaatggtggttgaagacactctcccacagtgactctacactgtgtttttacaagagtgtttacacagtttcagaaaactg

SEQ ID NO: 55320 - DNA, 92 bp, Homo sapiens
agtgattgacattttcacgaatccttatgtggcataaacacgcacacacacactgtgtgtgtgtatatatatgtttgtagaggtcccttgct

SEQ ID NO: 55321 - DNA, 108 bp, Homo sapiens
ggcatagtggcatgtgcctgtagtttcagctacttgggaggctgaggtaggaggatcgcttgagcccaagaatttgaggctgcagtgaactatggtcgcaccattgct

SEQ ID NO: 55322 - DNA, 136 bp, Homo sapiens
gtttgctgttgtatcaacctgcatttgactatgattctgttctaaatgtaagtcttgtctcaatttttgaatttgttatggagtcttttaaagagacaggaacatatcaatagaagaaacagattctactgtgtgt

SEQ ID NO: 55323 - DNA, 71 bp, Homo sapiens
gatgtgtacgtatatgtacatgttttatgtatctatacatatatgtacatatatattttaaagtatatatt

SEQ ID NO: 55324 - DNA, 96 bp, Homo sapiens
gagaccgacattatataatatttcagttgagtgtgatgtgtctgttatgtacagattttggcaccacagtgcatggaaatatatacaaagagtctt

SEQ ID NO: 55325 - DNA, 93 bp, Homo sapiens
tgtgtatatatttatgcatgtgtgtatagtatatgtatatatgtttgtatatgtatatgtgtgtgcatttgcatatgtataaatatgtgtata

SEQ ID NO: 55326 - DNA, 125 bp, Homo sapiens
atatatgtgtatggtataggtttttatatatgtatatgtgtgtatgcatgatgtatgtatatgtgtgtatgtatatttatatgcataggtgtgtatatatgtgtatggcatatatgtgtgtatat

SEQ ID NO: 55327 - DNA, 123 bp, Homo sapiens
atatgtacatgtgtgttacttgtatatatacgcatatatatgcatgtgtctatgtgtgtatagtatatatatgtttatatgtatgtatatggtacttgtatgtgcatatatgtatgtgtgtgc

SEQ ID NO: 55328 - DNA, 79 bp, Homo sapiens
gaatatgtgtttatatgtgtatatatatgcatatgtgtatatgtacatgtctatgtgtatgtcaatatgcatgtgtgta

SEQ ID NO: 55329 - DNA, 97 bp, Homo sapiens
ctatgcttctccttaaacactgaagtgagtcagaagaaagaactcttaccctttctatttacactcactgctttggtggtatcactgaatctcatgg

SEQ ID NO: 55330 - DNA, 58 bp, Homo sapiens; identical to SEQ ID NO: 7346

SEQ ID NO: 55331 - DNA, 84 bp, Homo sapiens
aggagggtggaaatggctaaatatggtgaataaaaagacgatattctcaattcatccatgtttctgtctctgtctcacctaact

SEQ ID NO: 55332 - DNA, 66 bp, Homo sapiens
ccatcgctgggtgtgtgtgtggtgtgcacgcatgcacacgcacacacacacactcactcagactgg

SEQ ID NO: 55333 - DNA, 99 bp, Homo sapiens
attgtgagggtttgaggagacgatgtgaataaaacacttagtaccttgtttggtatataataagtggctgttatttttctatgaaagtctgattacagt

SEQ ID NO: 55334 - DNA, 76 bp, Homo sapiens
cttgctcctctgttctgtctcagttattttgtcctcatcagacaagattataattaagagagagaaaaggtaaaag

SEQ ID NO: 55335 - DNA, 58 bp, Homo sapiens; identical to SEQ ID NO: 1911

SEQ ID NO: 55336 - DNA, 66 bp, Homo sapiens
ctgagtgatagagctttagggtttttgttttttttttttgagacagagtctcgctctgtcacccag

SEQ ID NO: 55337 - DNA, 79 bp, Homo sapiens
gagcctcactctgtctcccaggctgtagaacagtgttgtcagtggtgtgatttggctcactgcaacctccaccccctgg

SEQ ID NO: 55338 - DNA, 84 bp, Homo sapiens
taacttgtgtatacatataaaccatatggggtgtgtgtatatatatatgtatataacatatggtgtgtgtgtgtatatagctta

SEQ ID NO: 55339 - DNA, 102 bp, Homo sapiens
ataaattctaaagtaaaccattcatttttgccaaatatttatttaaattatgtgtagttaaattttttattatggttctgaatggtttcatgaagaatatat

SEQ ID NO: 55340 - DNA, 90 bp, Homo sapiens
aggagcatgtagcgctgactcactgtctgattatcatcactcttttaatgatgccaagatcgattagtgggttcaactggttacagcctc

SEQ ID NO: 55341 - DNA, 84 bp, Homo sapiens
gatcttcagagcctcactgggactctctgtgcctgagttataaagtcttcctttcttggcactaacagcctttctgatgagatc

SEQ ID NO: 55342 - DNA, 75 bp, Homo sapiens
taaaatatatgtgagtatatttgtaactgggaaaaaaagcaattttttttcctgttatatatttattttatttta

SEQ ID NO: 55343 - DNA, 97 bp, Homo sapiens
gttttctgaatgaggcaggcggtgtaatgtgtatatattattattattgtttttatttttgagacacagtctcgctgtgttgcccaggctggagtac

SEQ ID NO: 55344 - DNA, 118 bp, Homo sapiens
ttagatgatgacttgctctgatataatccacatattcatgttatatttcatatgtgtatatatatatgtatatatgtgtgtatatgtatattaatttcagaacaaagcaagcatttga

SEQ ID NO: 55345 - DNA, 63 bp, Homo sapiens
ggaacacactgtgtgtctgtcatcaaacagctgtatcttgatgacagtgcatattgctaagcc

SEQ ID NO: 55346 - DNA, 84 bp, Homo sapiens
tacatatgtacacatatatgtatatatgtacacatatatacacatatatatgtatacatatatacatatatgtatacatatgta

SEQ ID NO: 55347 - DNA, 114 bp, Homo sapiens
tatgtatacatgtatacatatatgtatatatgtgtatacatgtatgcatatatgtatatatgtgtatacatgcatacacatatgcatacatatatgtatatatgtatacatata

SEQ ID NO: 55348 - DNA, 89 bp, Homo sapiens
atgtatacatgtatacacatatgtatatatgtgtatatgtgtatatgtgtatatatgtatacatctatgtatatatgtgtgtatatatg

SEQ ID NO: 55349 - DNA, 76 bp, Homo sapiens
tatacatatatgtatacatatatacatatatacatatatacacatatgtatacatagatgtatacatatatgtata

SEQ ID NO: 55350 - DNA, 76 bp, Homo sapiens
tgtgtgtgtatatatacacgtgtgtatatatgtatatatgtgtatatatatacacgcgtgtatatatatacacaca

SEQ ID NO: 55351 - DNA, 58 bp, Homo sapiens
tgagacagtgtctccctctgtcacccaggctggagtgcagtggggagatctcagctca

SEQ ID NO: 55352 - DNA, 58 bp, Homo sapiens; identical to SEQ ID NO: 35020

SEQ ID NO: 55353 - DNA, 95 bp, Homo sapiens
gcagaaaatatatatatttttctctctatatatatgtatatatatgtgtgtttatatatgtatacatatatgtgtatatatgtgtgtgtgtgtat

SEQ ID NO: 55354 - DNA, 95 bp, Homo sapiens; identical to SEQ ID NO: 68

SEQ ID NO: 55355 - DNA, 93 bp, Homo sapiens; identical to SEQ ID NO: 69

SEQ ID NO: 55356 - DNA, 87 bp, Homo sapiens
atatattcataatatatggatatgtaatataataaatgtatgatatatactttatatattatagaatatattcatatatgaatatat

SEQ ID NO: 55357 - DNA, 93 bp, Homo sapiens
aaaaatgggagattgtgggcaaccagggagaaatgggtgaaagaaactttctttatttttctatatgcttcttgctacattatttccattttt

SEQ ID NO: 55358 - DNA, 111 bp, Homo sapiens; identical to SEQ ID NO: 13350

SEQ ID NO: 55359 - DNA, 81 bp, Homo sapiens; identical to SEQ ID NO: 7982

SEQ ID NO: 55360 - DNA, 99 bp, Homo sapiens
gctggggttggtatgggctcttctgtgtgtcttttttttttttttttttttttttgagaaggagtttcactcttgttgcccaggctggaatgcaatggc

SEQ ID NO: 55361 - DNA, 115 bp, Homo sapiens
ttgggattacaagcgtgagccagagccctgccttaaaattaaaaaaaaaaaaagtttatatctatttatttatttatttatttattttgagatggagtctcgctctgtcacccag

SEQ ID NO: 55362 - DNA, 76 bp, Homo sapiens
gtaaataaaactatctatctatctatctatctatctatagatagatagatatgttgatgtaagtgtatttgtttat

SEQ ID NO: 55363 - DNA, 75 bp, Homo sapiens
gctctcattgtaactttttttttttagcttctccagactctgagttagaagcaaatgaagattggtggcaagagc

SEQ ID NO: 55364 - DNA, 97 bp, Homo sapiens
gacatatatatatttagatatatgtatatgtatatatgtatatgcatacatatatgcatatatatgtttatatacacacaaatatgtatatatatgc

SEQ ID NO: 55365 - DNA, 68 bp, Homo sapiens
tatatataaacatatacacacagacacacgtattatatatatgtgtgtgtatatgtatgtgtatatat

SEQ ID NO: 55366 - DNA, 84 bp, Homo sapiens
ccagagtgagggtcatattgctctatacttaccatacataccaatcaactgcagtggtgagtgagcaaacttggccaattaggg

SEQ ID NO: 55367 - DNA, 87 bp, Homo sapiens
gctgtaatgtgggaagactagaaggagacatttttatttcttttttttttttgagactgagtctcgctctgtcgcccaggctggagt

SEQ ID NO: 55368 - DNA, 85 bp, Homo sapiens
taacataaagcagaaagtattgagatacacggagaagctctgaggggctcagtgggtctctctttccctggactgtgttacatgc

SEQ ID NO: 55369 - DNA, 74 bp, Homo sapiens
gtcacttccgctgctttttttttttttgagacagggtctcactctgtcacccaggatagatgcagtggcatgat

SEQ ID NO: 55370 - DNA, 117 bp, Homo sapiens
ttcagctcccaactcctagactgcatgctctaactctggggtactggttttgggccccaactttgttctctggcacctcgaagttaggaacccactgttctgggttgtggggctgag

SEQ ID NO: 55371 - DNA, 112 bp, Homo sapiens
gtgggtacaaatttgtaataccttggacatgtatatatacgtgtgtgtatatatatacatgtatatatatacacacacgtatatatacatacatatatacatacatatacac

SEQ ID NO: 55372 - DNA, 64 bp, Homo sapiens
tatgtatatatacgtgtgtgtatatatatacatgtatatatatacacacacgtatatatacatg

SEQ ID NO: 55373 - DNA, 81 bp, Homo sapiens
taattcatgagatctttttagattcttaagggcagcactaattcttgcaacccccaaggatgtgatattgtttttgagtta

SEQ ID NO: 55374 - DNA, 90 bp, Homo sapiens
tctttccagagtctccaggtgtggagaggctgccacctcctagcatggggaagggagctgcttctgcaagtccaagtgactgtggaggga

SEQ ID NO: 55375 - DNA, 118 bp, Homo sapiens
gtgtgtatatatacatgtatatacatatatatgtatgtgtatatatacacatacgtatatatacgtatgtgtatatatacacatatatacgtatatatatgtgtgtacatatatacac

SEQ ID NO: 55376 - DNA, 95 bp, Homo sapiens; identical to SEQ ID NO: 68

SEQ ID NO: 55377 - DNA, 93 bp, Homo sapiens; identical to SEQ ID NO: 69

SEQ ID NO: 55378 - DNA, 87 bp, Homo sapiens
gtctctctctctctttctctctctctcatccgtgcgaataaccaattcaaaatagaagaggagatgagtttgtaggctaagggaggc

SEQ ID NO: 55379 - DNA, 77 bp, Homo sapiens
actgttctgtatgaggctatactggtggatacatgtgattatgtatttgtcaaaacctatagaatgtgcaacacagt

SEQ ID NO: 55380 - DNA, 71 bp, Homo sapiens
ggttggctgactctcccactcacatcttggctctttcaaggaggaggaggttttagcagagtcccccaccc

SEQ ID NO: 55381 - DNA, 58 bp, Homo sapiens; identical to SEQ ID NO: 18547

SEQ ID NO: 55382 - DNA, 113 bp, Homo sapiens
gttccagtgtgtgtgtatgtgattatgatggggcagggaaggaatgaggggaggctgttgttattttcctttttttttttttttttattgtgtcaaggacatttttgagcata

SEQ ID NO: 55383 - DNA, 91 bp, Homo sapiens
gtagaaaaagatcttagggatctaacagagggatgttgtagttattatcagactatatctaatttttttttaagacagggtctgtctctgc

SEQ ID NO: 55384 - DNA, 113 bp, Homo sapiens
gtgtattgaatgtgtgtgtctgtaaagtatgtgtgtgtgtgtgtgtatatatatatatatatatatatacacacacacacatacatagttagatatatacatagtatatatac

SEQ ID NO: 55385 - DNA, 95 bp, Homo sapiens; identical to SEQ ID NO: 68

SEQ ID NO: 55386 - DNA, 93 bp, Homo sapiens; identical to SEQ ID NO: 69

SEQ ID NO: 55387 - DNA, 119 bp, Homo sapiens
catctttcccgtctttccttttcttctggtcatgattcctcaactcccaagctcaaaagtagtgaaaatgttgttataaaggaacagaaaaaaaattaggagaggaatagagagtgaaa

SEQ ID NO: 55388 - DNA, 118 bp, Homo sapiens
taagttgtacaggatgaacacgccccctaaaactttgtttcagatatttcaatttttattttattttattattattatactttaagttttagggtacatgtgcacaatgtgcaggtta

SEQ ID NO: 55389 - DNA, 88 bp, Homo sapiens
ctatatatatatagctatatagacatataactgtatatagtttatatatatattacatgtcactatatatggttatatatacagatag

SEQ ID NO: 55390 - DNA, 58 bp, Homo sapiens; identical to SEQ ID NO: 47

SEQ ID NO: 55391 - DNA, 90 bp, Homo sapiens
tatatgtgtgtgatatacatgtatatacatatatgtgtattagatatgataaatacacatatcaacatatatgtataatatgcacatata

SEQ ID NO: 55392 - DNA, 86 bp, Homo sapiens
gggggtaaggggacgtgtcttgagttcattagttcattctgtcgatcatatgtccaacatccacacactgtctctcttttgcccct

SEQ ID NO: 55393 - DNA, 97 bp, Homo sapiens
attgaacattcttgtcataggtctctgtgtttatctctgatattcccctaggaaaattcatagaagtagcattttggagttgaagggaatgagtaat

SEQ ID NO: 55394 - DNA, 65 bp, Homo sapiens
ttcattttaatgtatgtatgtatgtatgtatgtacgtacgtatgtatgtatgtatttgagatgga

SEQ ID NO: 55395 - DNA, 89 bp, Homo sapiens
gtgcttatcaactcacttgcggccctagggagaggatggcatttccgaagttccaaattctctctgtgtgtatctgtgtgcttgagcgc

SEQ ID NO: 55396 - DNA, 103 bp, Homo sapiens
atgtatatattttacatgcgtatggacatttgggttgtttttatgtttttgttcatcacaaaccacaacacacatgtgttcttgtatatgttttatagtgcat

SEQ ID NO: 55397 - DNA, 117 bp, Homo sapiens
aatatacttatgaatagtttattactatgggacaggtatggataagtgtcgatttctttactttttattattttttgtaggtacatagtatgtatatatatttgtgggttacttatt

SEQ ID NO: 55398 - DNA, 106 bp, Homo sapiens
tatacgtatatatacacacatatatatacgtatatatgtgtatatatatacgtatatatatacacatatatacatatatgtgtgtgtgtatatatatatatgaaac

SEQ ID NO: 55399 - DNA, 90 bp, Homo sapiens
tatatatacacacacacatatatgtatatatgtgtatatatatacgtatatatatacacatatatacgtatatatatgtgtgtatatata

SEQ ID NO: 55400 - DNA, 100 bp, Homo sapiens
cctgggcgacagagcgagactccaactcaaaaaaaaaataaaactaaaaaaagagttattttttttttttttgagacaaagtctggctctgtcgcccagg

SEQ ID NO: 55401 - DNA, 116 bp, Homo sapiens
acactattgattgcaaaactgttttatctttggtggcttagattttttttgtatgatatgtaacgtcttgcatacctaaggcaacacgaagctaaatagatttgcatatagcatgt

SEQ ID NO: 55402 - DNA, 116 bp, Homo sapiens
tgagctcgaataatatttgctttatatatctgtactccagtgttgtatatatatttgctttatatatatatactccagtgttgagtgcatatataattgttatatcctgttgctga

SEQ ID NO: 55403 - DNA, 86 bp, Homo sapiens
cccatgcaattcacttttcatttcactgtctgactcagtgcttttcccatgctatgtctcagtaaatgttgactgaattctgaggg

SEQ ID NO: 55404 - DNA, 93 bp, Homo sapiens
tcaagtccccaggtgactcatctggtttgtgcaggaagagcaggataaacttaatttttctataataatatctaggaagttcttgagactaga

SEQ ID NO: 55405 - DNA, 84 bp, Homo sapiens
gccttgaaaattgctgctaaaattcatgtagcagtttctatatatatgtattacaactgtaatatgagatttggacaatcgggc

SEQ ID NO: 55406 - DNA, 113 bp, Homo sapiens
acatgcatcaaacttaaggacggtgatctatttttctgaaatcacacgcattttcattttagtcctgttttatggaagttgtggttttatctccctttgtattttctgcatgt

SEQ ID NO: 55407 - DNA, 108 bp, Homo sapiens
tagtggtgcaggcccatagtcacagctactcaagaggctgaggtaggaggatcacttgagcccaagagtttgaggctgctgtgagctatgatcacaccactgcactac

SEQ ID NO: 55408 - DNA, 101 bp, Homo sapiens
tggctgaatagtactgtattgtgtataggtaccatattttcttttttttattattatactttaagttttagggtacatgtgcacattgtgcaggttagtca

SEQ ID NO: 55409 - DNA, 114 bp, Homo sapiens
gataacttgttctattttattagttgttaatctcttactatgcctaatttataaattaaattttataggtatgtatgagtaggaaaaaatctagtgtatatagggttaggtatc

SEQ ID NO: 55410 - DNA, 75 bp, Homo sapiens
agttatgtatatatacattatacagaggtatattgtaatcattttatatatataatgtatagtatgtatatgatt

SEQ ID NO: 55411 - DNA, 83 bp, Homo sapiens
ctatctatcatctgtctgtctttctgtctatccatccatcatctatggcagtggtttgcaaccaggcatcaggtgttccttag

SEQ ID NO: 55412 - DNA, 58 bp, Homo sapiens; identical to SEQ ID NO: 9336

SEQ ID NO: 55413 - DNA, 114 bp, Homo sapiens
gtcatgtagttcagtgtgtctggagggctttttgtggttctctatctgcttttttttttttttttttttttgagatggagtctcactgtgtcacccaggctggagtgcagtggc

SEQ ID NO: 55414 - DNA, 107 bp, Homo sapiens
tgtttgcatttgaactttaatgttgcctcggatagttgaaaaatattaataattaaactgttcagctatatggatggaggacaaaaatggatcaggatttgaaaaca

SEQ ID NO: 55415 - DNA, 80 bp, Homo sapiens
agaaaacacagatttctgggtctcactccctgagatactaaccaagtaagtctgggagagtcctgaaattcggtatttct

SEQ ID NO: 55416 - DNA, 159 bp, Homo sapiens
tgtgggtacatactaggggtgtgtgtgtatatatatggtatatatgtgtatatatatgtgtgtatatatataccatatatgtgtatatatatgtgtgtatatatataccatatatgtgtacatatatgtgtgtatatatggtgtatatataccatatat

SEQ ID NO: 55417 - DNA, 58 bp, Homo sapiens; identical to SEQ ID NO: 14767

SEQ ID NO: 55418 - DNA, 56 bp, Homo sapiens; identical to SEQ ID NO: 14768

SEQ ID NO: 55419 - DNA, 58 bp, Homo sapiens; identical to SEQ ID NO: 315

SEQ ID NO: 55420 - DNA, 100 bp, Homo sapiens
tatgtatgtggtagcatattttatctatgtatgtggtacatacatgttttatgtatatgtatgtatacatgcatatatgtatgtataaaatacatacata

SEQ ID NO: 55421 - DNA, 83 bp, Homo sapiens
aagcattttttaaagtttaaaaagcaaaatgtggagtgaatattttttggttactatgctttttaaatttttagaatttgttt

SEQ ID NO: 55422 - DNA, 137 bp, Homo sapiens
gcacatgtgtatatatacatgtatatgcacatatgtgcacatgtgtgtatatatgtatatatacgtgtatatatacatgtgtgtatatgtatatatgcatatatttgtgtatgtatatatgcatatgtgtgtgtata

SEQ ID NO: 55423 - DNA, 91 bp, Homo sapiens
gcttttggcagagggttttgggtatgtttcaaagacatctgaatgtatgctttcaactgactcatttactctctgctttctgacagaaagt

SEQ ID NO: 55424 - DNA, 89 bp, Homo sapiens
gcaggtatgtcattcataggagtttcgttgctttagtcttttacggtattgctgctttgtttagatgtaaggagatccttgatgtttgc

SEQ ID NO: 55425 - DNA, 98 bp, Homo sapiens
tttatatacatattttacatatgtatatgtttatatgtgttactatataaccagttacatatataaatatatatgtattgtgtatatatgtatataaa

SEQ ID NO: 55426 - DNA, 95 bp, Homo sapiens
cagagagaattgatttgggtcttaaagacagtatacaaacggaaattttattttattttgttttatttatttttttgagacagggtctcactctg

SEQ ID NO: 55427 - DNA, 95 bp, Homo sapiens; identical to SEQ ID NO: 68

SEQ ID NO: 55428 - DNA, 93 bp, Homo sapiens; identical to SEQ ID NO: 69

SEQ ID NO: 55429 - DNA, 107 bp, Homo sapiens
cccagcctctgatcttttactctttctaaggatgactcgtgagtgaaatgtcaaactcttttatttatttatttatttttacaaaattaaaaaagatataatctggg

SEQ ID NO: 55430 - DNA, 129 bp, Homo sapiens
tgtgtgtatgcatacatatgtgtatctatatattaaagtaggtatatacagtatgaagtatgtatgtatatatgcatatatatgcatgaattatattaagtatatgtatatgtgttagatatttatgta

SEQ ID NO: 55431 - DNA, 75 bp, Homo sapiens
tgtgtgtatgcatacatatgtgtgtatctatatattaaagtatgtatatgcaatatgaaggtatgtatatatgca

SEQ ID NO: 55432 - DNA, 79 bp, Homo sapiens
gggtgtccttctgtgtgtgtctgtgtccttatctcctcttcttataaggaccccagtcatattgaattagggcccaccc

SEQ ID NO: 55433 - DNA, 119 bp, Homo sapiens
attgttggtgtgtagcagtgctattgatttgtgtacattgattttgtatcctgaaattttactgaatttgtttatcagggttttctaggtacatgatattatcagcatacaacaacagt

SEQ ID NO: 55434 - DNA, 83 bp, Homo sapiens
cacataaacaaatatatatgtttatatgtatatatgtgtattcacatcttatagacatatgaaataaatgttatgtatatgtg

SEQ ID NO: 55435 - DNA, 115 bp, Homo sapiens
ctactatgtacgtatatagatgtatatatgtgtatatatatgtgtatatatatagatgtatatatgtgtatatatatgtgtgtgtgtatatatatatatatattccttgaagtgg

SEQ ID NO: 55436 - DNA, 116 bp, Homo sapiens
gaataatattttattggatgtgcatggatgtgtatatactatatatacacatacattattgtatttatatatctgtatatgtagttgaccctccaacagcatgaatttgaatagtc

SEQ ID NO: 55437 - DNA, 63 bp, Homo sapiens
agtcaattgccagtctgtgactcagtttctttgtctgagaaaaggacacagactgtagtgagt

SEQ ID NO: 55438 - DNA, 81 bp, Homo sapiens
cagaagtgggattgctgcagtatatggtaatatcatttttaatattttgaggaacctctatactgtttttcccagtggctg

SEQ ID NO: 55439 - DNA, 132 bp, Homo sapiens
gtgtatatgtaagtctgtgcacgtctgtctgtgtgtatagatacctgtgtgtgtgcctgggcatgttggagtgtgtgtctgtgtgtgtgcatgtgcatgcatcagtggctgggctttcactctaccctgggc

SEQ ID NO: 55440 - DNA, 112 bp, Homo sapiens
tcagatttttttttcagaagaaaatcagctaagtagtttttatctttaaaaaaaaggaataaagattatctttgatctgatcttgaggtctactataaaaagatctttctgg

SEQ ID NO: 55441 - DNA, 73 bp, Homo sapiens
gatgaatagtttgcaaatatttcttccattctgtcttaatagtttggatgaatagtttgcaaatattttcttc

SEQ ID NO: 55442 - DNA, 114 bp, Homo sapiens
aggctgaactacatatcttgaaatacaagtattataattataggagaaatattgttatgtttgataattattatttttcttggtaatgctttgttttcattgttacatttacct

SEQ ID NO: 55443 - DNA, 106 bp, Homo sapiens
agattcatagtgaagcattgaggaggtctaataacaattaaattgtataacatttattgtataaattacctttcatgaatcctttcacggcttacactgaccatct

SEQ ID NO: 55444 - DNA, 66 bp, Homo sapiens
tgcacagatagtgatagatagccctaaaatacttaagttttgtcagtgtctctcagtgtcagtgca

SEQ ID NO: 55445 - DNA, 58 bp, Homo sapiens
tgagatggagtctcactctgtcacccaggctggagtgcagtggtgtgatttccactca

SEQ ID NO: 55446 - DNA, 99 bp, Homo sapiens
ggttttgatttgcacttctctgatgattagtgatgctgaaaattttttttatgttttttggccacttttatgtcttctgaaaagtgtctgttaatgtcc

SEQ ID NO: 55447 - DNA, 88 bp, Homo sapiens
aaatcatgaccaaatcatatgtatatgtatatatatgtatgtatatatgtatatatacatacatatacatatgatttggccatgattt

SEQ ID NO: 55448 - DNA, 116 bp, Homo sapiens
aactaccttgtataattaagtgcgactgttggtactttttttaaaattttatttatttatttattattattatactttaagttttagggtacatgtgcacaatgtgcaggttagtt

SEQ ID NO: 55449 - DNA, 103 bp, Homo sapiens
cagaacgggaaggctctgaccaatgacagagtgaagtgagtcaccagcggacactggaaacaaatgctcattctttatgtctgggtcaccgcttctcggtttg

SEQ ID NO: 55450 - DNA, 58 bp, Homo sapiens; identical to SEQ ID NO: 39076

SEQ ID NO: 55451 - DNA, 99 bp, Homo sapiens
gagtttcagttggcattggggtcactattcttttttttttttttttttttttttttttttttgagacagagtctggctctgtcgcccaggctggagtgc

SEQ ID NO: 55452 - DNA, 102 bp, Homo sapiens
acaatgtgatttgctccggggaaggttcagcttgttgcttgaaatgtgttgatattgatgcatttttacaaatagctccgcaagcctggaagtcactattgt

SEQ ID NO: 55453 - DNA, 98 bp, Homo sapiens
tgctggtgtcagcgaagagaaagggaaataaagagagaggacctgccggcgattttctttctttctctctctttctctctctctctctcacacacaca

SEQ ID NO: 55454 - DNA, 86 bp, Homo sapiens
gattttgtaccctgaaactttgctgaaattgttgatcagatctaggaacttttcagcagacaatggggttttctacgtataaaatc

SEQ ID NO: 55455 - DNA, 77 bp, Homo sapiens
gaacatgtggatttgtttatctgttcctgcattagtttgctaaggataatggcctcgagctccatccatctgtgttc

SEQ ID NO: 55456 - DNA, 98 bp, Homo sapiens
ggtaggcatgtgtagtatacttactatgaatggaggttgcaggactggatgttgctctgggtgagtcagtgagtgagtagtgagtggatatgaaggcc

SEQ ID NO: 55457 - DNA, 95 bp, Homo sapiens; identical to SEQ ID NO: 68

SEQ ID NO: 55458 - DNA, 93 bp, Homo sapiens; identical to SEQ ID NO: 69

SEQ ID NO: 55459 - DNA, 60 bp, Homo sapiens; identical to SEQ ID NO: 26199

SEQ ID NO: 55460 - DNA, 95 bp, Homo sapiens; identical to SEQ ID NO: 68

SEQ ID NO: 55461 - DNA, 93 bp, Homo sapiens; identical to SEQ ID NO: 69

SEQ ID NO: 55462 - DNA, 97 bp, Homo sapiens
gccaaaaataagagtgataaatccatctttgttttataatggaaaggataatttttttttttttttttgagacagagtttcgctctgtcgcccaggc

SEQ ID NO: 55463 - DNA, 170 bp, Homo sapiens
tatagttatatatatatgtgtatatatatgtatatatgtatatatgtatatgtatatgtatgtatatacgtatgtatatgtatatatgtatgtatatgtatatgtatatatgtatatgtatatacgtatatatgtgtgtatatatatatgtataaggaatatatatatat

SEQ ID NO: 55464 - DNA, 92 bp, Homo sapiens
gtgtgtgtatatatatacacacatatatttatgtgtatgtgtatatgtatatatagtgtgtgtgtttatgtatatatacatacacacatata

SEQ ID NO: 55465 - DNA, 86 bp, Homo sapiens
tatgtgtttgtgtgtatatatatatacatacatatatttatgtgtttgtgtatatatatacagataaatatatgtatgtatatata

SEQ ID NO: 55466 - DNA, 86 bp, Homo sapiens
tcaggagccatggagaacaatggagatgcgagttctatacagagatcagtatctgtactttctcactgtctgtttcttgggatttc

SEQ ID NO: 55467 - DNA, 82 bp, Homo sapiens
gaatgaacaaggacagcgtagaggttagaagcaagatggagttggttagatcagatctcttacactgtctcagttataattt

SEQ ID NO: 55468 - DNA, 161 bp, Homo sapiens
gcaggagatatatatatatatgtatatatatatatgtatatatatgtatatatatatatgtatatatatgtatatatatgtgtgtgtatatatatacacatatgtgtatatatatacatatctgtatatatatatacatatgtgtgtatatatatatatat

SEQ ID NO: 55469 - DNA, 137 bp, Homo sapiens
cagctggggatacacatattctggctcatttccccatggaacttttatttttattttttgagatgagtctctctgtgtcgccgaggctggagtgcaatggtgcgatctcagctcactgcaacctccgcctcccgggt

SEQ ID NO: 55470 - DNA, 195 bp, Homo sapiens
gtatgtgtatatataaatatatgtgtgtatatattaacgtgtatatgtgtataagtatgtatatattaacgtgtgtatgtctataagtatgtgtatatattaatgtgtgtatgtgtataagtatgtatatatcaatctatgtgtgtatatatgtatgtgtgtgtgtatatattactatgtatgcatgtgagtata

SEQ ID NO: 55471 - DNA, 75 bp, Homo sapiens
ttgtttttttttgagactgactctacctctgtcacccagactggagtgcagtggctcagtctcagctcactgcaa

SEQ ID NO: 55472 - DNA, 124 bp, Homo sapiens
tgtgtgtgtgtttgtgtttatatatatgtatagatatgtgtatatctatatatgtagatatacatatgtttgtgtatatatacatatatagatatacatacatacacacacaaagatatatata

SEQ ID NO: 55473 - DNA, 78 bp, Homo sapiens
tgtatagatatgtgtatatctatatatgtatatatacatgtttgtgtatatatacatatatagatatacatacataca

SEQ ID NO: 55474 - DNA, 76 bp, Homo sapiens
cagtcaggtggtttctccctgtgtggctgggtccctggttgtttatagactcagaatggggagtgtatgctggctg

SEQ ID NO: 55475 - DNA, 77 bp, Homo sapiens
ccaggctggagtgcagtggcacaatcttggctcactgtaacctctgctttcttgtctcgctctgtcacccaggctgg

SEQ ID NO: 55476 - DNA, 66 bp, Homo sapiens
tagaggttaacatctacacttgatcttagccaaaaggctgagaagtgatatagaagttaacatcta

SEQ ID NO: 55477 - DNA, 100 bp, Homo sapiens
gtcagggaaccaacgtaggcattttgccagctactgagtatatctatttcaattatgcttttccaaattggggaaataactacagaattggtttagggac

SEQ ID NO: 55478 - DNA, 58 bp, Homo sapiens
tgagactgagtctcactctgtggcccaggctggagtgcagtggcgagatattggctca

SEQ ID NO: 55479 - DNA, 118 bp, Homo sapiens
tccattgataatatactgttgtataaaaaagtaagactctcttttttcaatttttatataaactctaatttttagagagttttatgttcacagcaaagttgagtggaacagagagttt

SEQ ID NO: 55480 - DNA, 111 bp, Homo sapiens
tatatatatatatatatatatacacacacatacatatatgtgtgtgtatatgtatgtgtgtaaatatgccaatgtatatacacacatacatatacatgcatacatacacac

SEQ ID NO: 55481 - DNA, 107 bp, Homo sapiens
tatgtctgaatagttctccattgtgtatatgtaccccatttttctttttttattattatactttaagttttagggtacatgtgcacaatgtgcaggttagttacata

SEQ ID NO: 55482 - DNA, 122 bp, Homo sapiens
gtgtatatatatatatatgtgtgtatatatatatgtacatatatgtatatatgtacatatatatgtgtatatatgtacatgtgtatatatgtacatatatatgtgtatatatgtacatgtgt

SEQ ID NO: 55483 - DNA, 108 bp, Homo sapiens
gataaaggccatccaaaaatactgacagctaaaatcgtcaggaaaggatgtctcactgtttttttttgtttgtttgttttgttttgtttttttgagacagtctcactc

SEQ ID NO: 55484 - DNA, 94 bp, Homo sapiens
ttgaggtccaggggagttttatttttttctataatctaaattgtatatactcagtgaatgttttgtgaataaagttagtccaactggatctgaa

SEQ ID NO: 55485 - DNA, 115 bp, Homo sapiens
tttgttccttatctttagtgatacccagctctgtacaaattctgtccacgtaagcaaagtctttttttttttttccagatagggtctggctctgtcactgaggctggagtgcaga

SEQ ID NO: 55486 - DNA, 103 bp, Homo sapiens
gcctcactaccagagagatgtacatatttgttttgtctcacatgattcagagctcactctgtgtgcacaattctctctccagggttctgtcaaatatataggt

SEQ ID NO: 55487 - DNA, 109 bp, Homo sapiens
ttattgtttgtatatagaaacactactgatttttgtatattaattttgtatgctgaatctttacagaattcatttatcaaatctcagaggtttttagtagagtctttaa

SEQ ID NO: 55488 - DNA, 122 bp, Homo sapiens
tcagctctctactcctagactgcgtgctctaactctggggaatatgtgccaggccctgactttgttctctggctcctcgagtttaggaatggactgcactgggtgggggtggaggatgaggt

SEQ ID NO: 55489 - DNA, 95 bp, Homo sapiens; identical to SEQ ID NO: 68

SEQ ID NO: 55490 - DNA, 93 bp, Homo sapiens; identical to SEQ ID NO: 69

SEQ ID NO: 55491 - DNA, 70 bp, Homo sapiens
ccttggtgaaggaggcccctttcttctttatttttattttttgaaatagggtctcactctgtcacctagg

SEQ ID NO: 55492 - DNA, 97 bp, Homo sapiens
cttttagaacatattcctacccaccccctcctagtgattcatatttaatttttcttgagtggggcctgggtatgggcattattttaagttctccagg

SEQ ID NO: 55493 - DNA, 112 bp, Homo sapiens
actcaggcgcaagttatttaattttcatgtatgtgtgtggttttgagaaatcttcttgatattaatttttattactattgcactgtgatctgagaatgtgctgggcatgagt

SEQ ID NO: 55494 - DNA, 109 bp, Homo sapiens
atataatacataataaatataatacataatacatatatgatatgtgtataatatatgataatatatatacacacatacatatacatgtatatacttataattggtatat

SEQ ID NO: 55495 - DNA, 69 bp, Homo sapiens
tgacagagctgagataccatcccagttatacttatttttttttttttgagacagagtctcactctgtca

SEQ ID NO: 55496 - DNA, 111 bp, Homo sapiens
atgtgtatatgtgtgtgtatatatgtatgtgtatatatgtgtgtatctatgtgtatatgtatatatgtgtgtgtgtatatatatatataaacacacagctaaatacatata

SEQ ID NO: 55497 - DNA, 82 bp, Homo sapiens
gcaatcccatttacagtagctacaaataatataaatatgagtgtgtttgtgtttgtttgtgtgtgtgtgtgtgtgtgtgtgt

SEQ ID NO: 55498 - DNA, 98 bp, Homo sapiens
gacagagcaataaacctgtcatttaaatgatttccagtgttatctactttattattattattattactattatttttgagacagagtcttgctctgtc

SEQ ID NO: 55499 - DNA, 103 bp, Homo sapiens
gatactgatgttgtagttttgtttgcctttttttgttttgagattaagaaatttctagttatttttaaaagaaggacaaaacagtgagtaaagagtcagtttc

SEQ ID NO: 55500 - DNA, 103 bp, Homo sapiens
ccatatgattcagtaattctacttctgggtatatatgcaaaataacaacttcctttgaaattacatttttatacttagaattatagaatctagaatcatttgg

SEQ ID NO: 55501 - DNA, 69 bp, Homo sapiens
ggcagagtctcactctgtcacccaggctggagtgcagtggggtgactggggtgatcttgactcactgcc

SEQ ID NO: 55502 - DNA, 74 bp, Homo sapiens
tccaattccagtttcaacaggatttctttggctgctgtgctgagagtagactgtgagagctaggggtagaagga

SEQ ID NO: 55503 - DNA, 113 bp, Homo sapiens
gaatttcgaggagaaacgagtttatatgtgtggtggagaaaatatttgtttttagattcatagtatttcaggtggtggcaagatatccaggtgtagatttctctgaggcattt

SEQ ID NO: 55504 - DNA, 88 bp, Homo sapiens
gattctgggggcctctcaagtcttttctgtgaatatgtcttctctagacatgtgtgcagattcctaactagagggatttgccagtttc

SEQ ID NO: 55505 - DNA, 101 bp, Homo sapiens
atctgttaatatacattccacgaaaacccgaacttattatttgtattataatttttttattatactttaagttctagggtacatgtgcacactgtgcaggt

SEQ ID NO: 55506 - DNA, 86 bp, Homo sapiens
acatgcatgttatatatatatataatatacatatacacacacatatatacatgtatgtatatatatgtatgtgtgtatatgtatgt

SEQ ID NO: 55507 - DNA, 58 bp, Homo sapiens; identical to SEQ ID NO: 20501

SEQ ID NO: 55508 - DNA, 112 bp, Homo sapiens
gtctgttgctttagagaaataacagagtctggctgtaagatggaggatggtagatggttgttttctgtattatgattactctctgtagacattgaatcttcagtaaaatgac

SEQ ID NO: 55509 - DNA, 111 bp, Homo sapiens
ggaagggttagggccgcagtatttgagtcaggcattgatggatgaatagtgtctcactgtttttctctctgctctatgtttgactttttctctccaccctaatatacttcc

SEQ ID NO: 55510 - DNA, 119 bp, Homo sapiens
atctagatttctcagggcagagttttatatgaggaagtattatttaatgaaaattctgtcaatttatttttatttcttataaggccttatggagaaaatctctttgaaaatgattagat

SEQ ID NO: 55511 - DNA, 68 bp, Homo sapiens
gtgtgtgtgtgtgtgtgtgtgtgtatatgtgtgtgtgtgtgtgtgtgtgtgtatatatatatatatat

SEQ ID NO: 55512 - DNA, 123 bp, Homo sapiens
tctctgtgtcacattttggcaattctcacagtatttcaaacttttcattattattatattcattatggtgatctgtaatcagtgatctttgatggtactattgtcattgtttaggggtgccat

SEQ ID NO: 55513 - DNA, 145 bp, Homo sapiens
atatatagtatagagtgtggtatgttatatatacatatatagtatatgtgtatatattatacatacatatattgtatatatgtatatacacaatatatgtatatctgtatatacaattatatacatatatactaatatacgtata

SEQ ID NO: 55514 - DNA, 102 bp, Homo sapiens
gtatatatgtatataattgtatatacagatatacatatattgtgtatatacatatatacaatatatgtatgtataatatatacacatatactatatatgtat

SEQ ID NO: 55515 - DNA, 120 bp, Homo sapiens
gctgtttgcgggcaggactctacagtttgtcaccactgagtgtttctgccctcttacgtgtctcagtttctctctccagaggtctatgacctctgaaagggctcaaaacgctgggtaatg

SEQ ID NO: 55516 - DNA, 73 bp, Homo sapiens
acctcaccactgcagcatggctaggtttcaactctgtttgtatcagagcatgttctttatgctgctgaaaggt

SEQ ID NO: 55517 - DNA, 198 bp, Homo sapiens
ccttactctgtgttacacctgtaaatgcactgggagtctctttctcactccgatggaaagtggacctctctttttttcagaaagcaggaggtggtgggtgtcatctgcttatttcacatccatgctcagatagtctcagtggttccctactacttttggatatggtttgaataaatactaaccctcaccctggcactc

SEQ ID NO: 55518 - DNA, 72 bp, Homo sapiens
gctggctctgtgcatgggctgacaatgctttcatagccaggaaagaaatgctctcagacagacagacccagt

SEQ ID NO: 55519 - DNA, 94 bp, Homo sapiens
accactgaaacatatttgtcattttatttgaatgtgtacttgtgaaacatgttttgtgtgcatacatttttaatttacaaattggtattgtggt

SEQ ID NO: 55520 - DNA, 113 bp, Homo sapiens
cagaacgctttttaaacttttctcaaggttgaaagcattgtgagacaaccaagaaagagtatttattttttttttccattgtaaccttgccatgggtgctagtaagaattttg

SEQ ID NO: 55521 - DNA, 109 bp, Homo sapiens
atgttgtgttttccttggctgctctttatgtaggaaacatttatattgtatttatatccttaaaatgcaatgtaacattttttaacagagtaaaagatgagacacacat

SEQ ID NO: 55522 - DNA, 85 bp, Homo sapiens
taattgtgtttgtgtatgtgagatgcatgctgtattatatatacaaatatagatatatatacatgcatacatatacatacagtta

SEQ ID NO: 55523 - DNA, 109 bp, Homo sapiens
gataatgagtggccaacttgaaggtcccttcaaatgcctctatcactgtcacttaaagtgcctttatcccaggccaaaggaggtcttcatttggctttgctgtattatc

SEQ ID NO: 55524 - DNA, 62 bp, Homo sapiens
acatatatatatgtatatatatacacacacacatgtatatacacatatacatatgtatatgt

SEQ ID NO: 55525 - DNA, 71 bp, Homo sapiens
ccacatgtcttcactcacagccaagggctgtctgaagccctggcacacactgtgagtgactgtgaccaagg

SEQ ID NO: 55526 - DNA, 103 bp, Homo sapiens
tagtgtgcatctgtggtcccagctacttggcaggctgaggtaggaggatcacttgagcctaggaggcagaggttgtagtgagccgaaactgcacttcagcctg

SEQ ID NO: 55527 - DNA, 69 bp, Homo sapiens
gtcatgtttaacactgtcccacacactctgaggaggctcttctgggaacttgtggcagtgcagaatgac

SEQ ID NO: 55528 - DNA, 79 bp, Homo sapiens
agttcccctctcttgctatggtcctctcttggagaatttgcaatgcacacttcaaatctgtcagcagagagtgggctct

SEQ ID NO: 55529 - DNA, 92 bp, Homo sapiens
ccatgcgactgagctcaaggtaggttgatctcactcactctgtggatgtacaatgctccctatgcatggtaatctgggatgtggaagaggtc

SEQ ID NO: 55530 - DNA, 121 bp, Homo sapiens
tacatatatgtgtgtatatatatataatatgtgtatgtatgtgtgtatatatatacacatatatgtgtgtgtgtatatatatacatatatgtgtgtgtgtatatatacacacacatatata

SEQ ID NO: 55531 - DNA, 115 bp, Homo sapiens
ccaaaggacctgccattttgggggttagggcttcaacatataatttttatttatttatttatttattttttttgatgtggagtctctctctgtcacccaggctggaccatagtgg

SEQ ID NO: 55532 - DNA, 102 bp, Homo sapiens
catatggtctatcttgaagaatgttccatgcactgttaagaagaatgtatattctgcagctgttagatgggatgttctgtaaatatctgttaggtccatttg

SEQ ID NO: 55533 - DNA, 58 bp, Homo sapiens; identical to SEQ ID NO: 605

SEQ ID NO: 55534 - DNA, 69 bp, Homo sapiens
tggaatgctgccagttggagatgagtctgagctcacaagaaactgaccacctctagctgaggcttgcca

SEQ ID NO: 55535 - DNA, 67 bp, Homo sapiens
ccacagagttgacagtgaggttacttgctaagatggagcaagaggaaccagactgtgcagccagagg

SEQ ID NO: 55536 - DNA, 110 bp, Homo sapiens
ggtaaaatggggaacaccctttgtctaaacaaccatcagtgtctggcacacaaagtcactcagacactgatacgtgaaaatgagaagtgttccccctggaaaaaatggcc

SEQ ID NO: 55537 - DNA, 69 bp, Homo sapiens
tgctctctccttcagatttactcagggccacaggaacccactgtcactgagtgtctttgccagaaagca

SEQ ID NO: 55538 - DNA, 111 bp, Homo sapiens
ggtctgtcttggagaaagttccaggctctgttgaatagaatgtgtatcctgtggttgttggatgaaatgttctgtatatatctgttaagtccatttgttccaaggtgtagc

SEQ ID NO: 55539 - DNA, 95 bp, Homo sapiens
gcaggaggagacagcatgagagaagagaagcagctgaggtctttggttctcacaggtatctcctttcctcacactcaatgactttttccaacctc

SEQ ID NO: 55540 - DNA, 112 bp, Homo sapiens
gcatgtggacacatagaatgatttcacctcttattttcatggtgactgatgccagtgagcagtcagttgtgggagaggcacggcagggagggtgctgtgtagaattcacagc

SEQ ID NO: 55541 - DNA, 82 bp, Homo sapiens
tgagtctctcaccctgtctttcaacagtaacctcctccaaccccccccacccgcccattggagaggcagggatgatgactta

SEQ ID NO: 55542 - DNA, 78 bp, Homo sapiens
gggtgagactgaagatgtcagcagaggccagactgtgcacacagcgtggcagactgccccacatttagtttttagccc

SEQ ID NO: 55543 - DNA, 60 bp, Homo sapiens
tgcgtgcatgtgtgcgtgtgcatgcgtgcacacacacacactcatgcacacatgcacaca

SEQ ID NO: 55544 - DNA, 93 bp, Homo sapiens
agatacgatgcacaggtgattatattattatattactcaaatgacttcagatgactatatgattatatgattaaacatgcatatagaaggtct

SEQ ID NO: 55545 - DNA, 98 bp, Homo sapiens
cagaggtgagagccgtgccagggctgagccacgcttcaggagagaccagctatgtctctctctgtgttgggagccgttgggtaaagcggggacttctg

SEQ ID NO: 55546 - DNA, 98 bp, Homo sapiens
gttcattaggctgtgaatccctgggcccaccatccacagagacgctgctgcagcttgttttctgtctgagtctgtctcaggggacacactctctgcac

SEQ ID NO: 55547 - DNA, 118 bp, Homo sapiens
atgtgtgtacatgtttctgcatgtctgtgcatgcatatgcctgtgtgtctctgtgtgtatgcgtgtgagtggcattcatgtgtgtgtatttgcgtgaggtgggcatgcctatgcacgt

SEQ ID NO: 55548 - DNA, 84 bp, Homo sapiens
gtctcattaatttatattttttgtagtctaactgctaaggtgtcaactggggcaggcatgttacaactgatggccaggtgaacc

SEQ ID NO: 55549 - DNA, 97 bp, Homo sapiens
cactatgtcctaggcactgccactgctgagaccttttttttttttttttttttttttttttgagacggactctcgctctgttgcttaggctggagtg

SEQ ID NO: 55550 - DNA, 101 bp, Homo sapiens
tctctcaactcccttcattctggagccagggcatttgcactttgaaattctttttcattgattctgtacccaatggaacccgggttaagtaagaggaggga

SEQ ID NO: 55551 - DNA, 84 bp, Homo sapiens
gatttcatgtcatctgtgtctgtgactgagcagggctcccccgtctcctggctcgccccgcccatgcacctttggacgtgagtc

SEQ ID NO: 55552 - DNA, 65 bp, Homo sapiens
acttgctcaaggtcacacaggggtgattgatggggtcacccagactgtctgactcttgtgtgggt

SEQ ID NO: 55553 - DNA, 69 bp, Homo sapiens
cacaatgtcacacacactctgctcactgacacctggggggagggggagaagggtgtgtgtgtgcacgtg

SEQ ID NO: 55554 - DNA, 85 bp, Homo sapiens
gtaaagttctgtggaagtgagtgcacgcatgtggacataccctatgtgtccacacatgtgtctgtcttgttctgtgaagagaggc

SEQ ID NO: 55555 - DNA, 86 bp, Homo sapiens
gggttataccacagacagcctcggtgggtcaacatgcaggtagtaatgatactaatagcagaactgactgagctctggccctgccc

SEQ ID NO: 55556 - DNA, 73 bp, Homo sapiens
gggctctctctggctgtctctcgggtcacaagctgacatgtcatgagggcaccagcagcctatggagagaccc

SEQ ID NO: 55557 - DNA, 70 bp, Homo sapiens
ggcggcgacggcgggggtgggggtggagagggcgcgctctcagtcgctgtcacccgaggatcgcagcccc

SEQ ID NO: 55558 - DNA, 80 bp, Homo sapiens
agggccagagttagtaggggctagatgtgctactggaagctggtgttttccctcagtgtgtctgtctgtctgtctgtctt

SEQ ID NO: 55559 - DNA, 62 bp, Homo sapiens
gctgcagggagcaaggtcatcgagtgccaaaacctcggggctcacagacacgcactctgagt

SEQ ID NO: 55560 - DNA, 66 bp, Homo sapiens
ttgactgtggagtctcactctgtcacccaggctggagtgcagtggcgagatctcagctcaagtcaa

SEQ ID NO: 55561 - DNA, 93 bp, Homo sapiens
tgggggtgggtgagttccctcagagctgtcacagctgagtgtgttcacagaagttaatggcaagcctagagggcacatgtctcacagcctcca

SEQ ID NO: 55562 - DNA, 58 bp, Homo sapiens
tgagactgagtctcgctctgtcacccaggcgggagtgcagtggcgcgatcttggctca

SEQ ID NO: 55563 - DNA, 110 bp, Homo sapiens
ctgctggggttacaggtgtgagccactgtgcccggccaaagtctcattttctttttctttttttctttctttttttctccagacggcgtctcactctgtcgccctggttg

SEQ ID NO: 55564 - DNA, 74 bp, Homo sapiens
tgggggcagaatgggagaaacgtttactttttttttttttttttttttgagacggagtctcactctgttaccca

SEQ ID NO: 55565 - DNA, 87 bp, Homo sapiens
gagtccccatctggttccactctggcagtttgagtcttcccagctcaggaggcagacaagtgagtgagatgactccagctctagcca

SEQ ID NO: 55566 - DNA, 98 bp, Homo sapiens
tatgtgtgtgtgtatacataggtatatgtgtatatatatatgcgtgtatatatatatagtatatgtgtatagatatatccatgtatttatacatatat

SEQ ID NO: 55567 - DNA, 98 bp, Homo sapiens
gcccagtccttgatcacggtagagattttacttatttatttgttggtttatttatttatttaacagacaaggtctcactctgtcactcaggctggagt

SEQ ID NO: 55568 - DNA, 84 bp, Homo sapiens
atatgtgtatatgtgcatatgtatatttgtgtgcatgtgcgtatctgtgtatgtgtcgatgtgcatgtgtatatatatgtatat

SEQ ID NO: 55569 - DNA, 74 bp, Homo sapiens
gagtcttcatgcgtgcgtgtgtgtctgtgtgcgtgcgcgcgcacagacacacacacatacacggagttctgctc

SEQ ID NO: 55570 - DNA, 117 bp, Homo sapiens
cttctgaaattaggctataagaggttttggtttgtatcttgcccactctatcttgctgtgtcactcagtggctctgaaggaagccagccgccatcttgtgagctgccctatgggaag

SEQ ID NO: 55571 - DNA, 58 bp, Homo sapiens; identical to SEQ ID NO: 884

SEQ ID NO: 55572 - DNA, 56 bp, Homo sapiens; identical to SEQ ID NO: 885

SEQ ID NO: 55573 - DNA, 90 bp, Homo sapiens
tggagagtcctgaaccaagctcactgttgtcactgtccaggaaaacacctctcctgaattttgcgacagtgcctttagttttgttttcca

SEQ ID NO: 55574 - DNA, 78 bp, Homo sapiens
gggcaacacagtgatgagacttcatctctcttttatttatttatttattttttgagatggagtctcactctgtcaccc

SEQ ID NO: 55575 - DNA, 58 bp, Homo sapiens; identical to SEQ ID NO: 36223

SEQ ID NO: 55576 - DNA, 87 bp, Homo sapiens
agactggaggcacagacagtagtgaacaagaggccaagttgagaacggcttggaggaatgggtgctctgatctcagtgtgtcagttt

SEQ ID NO: 55577 - DNA, 80 bp, Homo sapiens
tgatatatgtatatatgtatatgtgtatacatatgtatacacaaatacatttgtttatatatacatatatgtatatgtat

SEQ ID NO: 55578 - DNA, 145 bp, Homo sapiens
gcacatatatgtatacatgtgtgtgcgtgtgtgcttgcatgtatgtatagatgtatgtgtatatatatgtatgtatacatatatgtatagatgtatgtgtacatatgtatgtgtgtacatatatgtatacatgtatgtgtgtgca

SEQ ID NO: 55579 - DNA, 77 bp, Homo sapiens
tatgttcatatatacgtgtgtacatatatatatacatgtgtatatatatgtgtgtatgtatatatatatacacacac

SEQ ID NO: 55580 - DNA, 69 bp, Homo sapiens
ggcataagcgtggtggtgcccagcaattgtttttatttttaaaacagacagggtttcaccatgttagcc

SEQ ID NO: 55581 - DNA, 58 bp, Homo sapiens; identical to SEQ ID NO: 2442

SEQ ID NO: 55582 - DNA, 111 bp, Homo sapiens
gctggccaaaaatatgggcttcgtaatgcagggtcctttaattagactttatttatttatttacttatttatttatttgagaaggagcctcactctgtcacccaggctggt

SEQ ID NO: 55583 - DNA, 109 bp, Homo sapiens
gagtagctaggactacaggggcccgccgtgatgcccaactaatttttgtatttttcgtaaagacggggtttcaccatgttggccaggctggtctcaaactcctgggctc

SEQ ID NO: 55584 - DNA, 56 bp, Homo sapiens
gagatagagtctcactctgtgttccaagctggagtgcagtggcacagtctcagctc

SEQ ID NO: 55585 - DNA, 101 bp, Homo sapiens
gagactgcttttgatgtgtttgagacctctttaatatgttaaatattaaatatatttaatatgaacctttgagacatttttgtttgtttggagacagtctc

SEQ ID NO: 55586 - DNA, 116 bp, Homo sapiens
atctttgctattgtgaatattgctgggataaacatacaagtgcacttttttttttttttttgagacagagtctcactgtgtttccccaggctggagtgcagtggcacgatctcagc

SEQ ID NO: 55587 - DNA, 142 bp, Homo sapiens
atatatacatatacacacatatatatgcatatatatacacatatatgtgtatatgtgtatatatatacatatacacatgtatatgcatatatatgtgtatatatatacatatacacatgtatatgcatatatatgtgtatat

SEQ ID NO: 55588 - DNA, 143 bp, Homo sapiens
acacatatatatgcatatacatgtgtatatgtatatatatacacatatatatgcatatacatgtgtatatgtatatatatacacatatacacatatatgtgtatatatatgcatatatatgtgtgtatatgtatatatgtgtg

SEQ ID NO: 55589 - DNA, 107 bp, Homo sapiens
taagcgtcttacctctagaacccaaagacaggggattggatatggaatcaattctagttgcccccaacccacccaccccatgactggattgtggagaattaagctta

SEQ ID NO: 55590 - DNA, 107 bp, Homo sapiens
gaatctggatacccttcacccgtaacaatattgctattttttttgttttgtttttgccaaaaggaatatgatgtagtgatgttcctggagtcaaaatatctgtgttc

SEQ ID NO: 55591 - DNA, 56 bp, Homo sapiens
acagagtctcactctgtcacccaggctggagtacagtggcgtgatcttggctctgt

SEQ ID NO: 55592 - DNA, 69 bp, Homo sapiens
tgtttttgaggcagaatctcactctgtcacccaagctggggtgtggtggtgcggtcttggctcactgca

SEQ ID NO: 55593 - DNA, 67 bp, Homo sapiens
tgaaacagagtctcactctgtcacccaggctggagaggctggagggcaatggtgtgatctcggctca

SEQ ID NO: 55594 - DNA, 115 bp, Homo sapiens
ggaattggtctgttaccatagtttgccagcccctagttaagagcagtgatttttttttttaagaggaggggtctcgctgtcactcaggctggattgtggtgacgcaatcatagct

SEQ ID NO: 55595 - DNA, 57 bp, Homo sapiens
gagacaagagtctcactctgtcacccaggctggagtgcagtggtgcaatcttggctc

SEQ ID NO: 55596 - DNA, 80 bp, Homo sapiens
ggcatgccgtcctggaacatctctcttctctatcttggattcggttctatggtaaatgtagtgcgaccaggaaagcagct

SEQ ID NO: 55597 - DNA, 58 bp, Homo sapiens; identical to SEQ ID NO: 315

SEQ ID NO: 55598 - DNA, 100 bp, Homo sapiens
tttgcagtatgattaagaattttttgcattgtaaggaagtatggttctggataatctttccagtcatgaactcaaaataagcataagtttttagggcaga

SEQ ID NO: 55599 - DNA, 111 bp, Homo sapiens
gtgtgtgccaggtgggtgtacaggcagcaccagaacccggcagggagtcgttctcacagggggtgtctctgtgcctgtctgcaagtggacatttgcctggaaatgagccat

SEQ ID NO: 55600 - DNA, 95 bp, Homo sapiens; identical to SEQ ID NO: 68

SEQ ID NO: 55601 - DNA, 93 bp, Homo sapiens; identical to SEQ ID NO: 69

SEQ ID NO: 55602 - DNA, 58 bp, Homo sapiens; identical to SEQ ID NO: 35157

SEQ ID NO: 55603 - DNA, 87 bp, Homo sapiens
cctactttgttttttgtttgacatctgctgcaatgggagagaaacctactttggatgcaatgtaaagaacgatgatttcagaagagg

SEQ ID NO: 55604 - DNA, 91 bp, Homo sapiens
gtatttagaggatgttccaaaaatgattcttctggcagactctctgtctttgagatagggttatttttgtacttaacacctctttccttac

SEQ ID NO: 55605 - DNA, 74 bp, Homo sapiens
gtgtgtgtgtgtgtgtgtgtcagggcctcagtctgtcactccggctggagtgcggtcatgcaatcatagcacat

SEQ ID NO: 55606 - DNA, 85 bp, Homo sapiens
ctgggcgtgatggcatgtgcctgtagtcctagctaccaggagggtagggagccagggctgaggtaggaggatcacttgagcccag

SEQ ID NO: 55607 - DNA, 72 bp, Homo sapiens
taagtggtgcatgactgtatatttctatatatctatggacatatatggatatatacaaacatataccattta

SEQ ID NO: 55608 - DNA, 58 bp, Homo sapiens; identical to SEQ ID NO: 7309

SEQ ID NO: 55609 - DNA, 95 bp, Homo sapiens; identical to SEQ ID NO: 68

SEQ ID NO: 55610 - DNA, 93 bp, Homo sapiens; identical to SEQ ID NO: 69

SEQ ID NO: 55611 - DNA, 87 bp, Homo sapiens
cagccttgtgtttccagttgtgagaccctacagtttggttttttttttttttttttgagacggagtcttgctctgtcacccaggctg

SEQ ID NO: 55612 - DNA, 80 bp, Homo sapiens
tgtatatatatacgtatatatgtatatgtatgtgaatatatgtatatatatacatatatatgtatatgtatgtgtatata

SEQ ID NO: 55613 - DNA, 66 bp, Homo sapiens
catcattattttgcatatatattgatataccatatgtatcattatatatatgtatgatgcatgatg

SEQ ID NO: 55614 - DNA, 66 bp, Homo sapiens
ctgggtgtggtggcctgcagtgtcagctaatgaggaggctgaggtggtaggatcacttgagcttgg

SEQ ID NO: 55615 - DNA, 75 bp, Homo sapiens
gtggttactggactgtatggaaagaggatgtttagttttgtaagaagctgccaaactctcttctaaagtggctgc

SEQ ID NO: 55616 - DNA, 73 bp, Homo sapiens
cagaatggccactgcctgtgactggctgactcccacaaataagaaaagcctagtcacgggtttggcctcactg

SEQ ID NO: 55617 - DNA, 123 bp, Homo sapiens
tttttttattttaatttaaagttcacatattataaaagagagggtttattttgtttatttattttaacagtagaaccctttgcaggtgaaacggtgtggatgtccagtgtataattagatgaa

SEQ ID NO: 55618 - DNA, 94 bp, Homo sapiens
tggaagaggggtggtcacagactcacagacacaggacagtggggatttacacagcatttcctggtattgtaagctttttgttttttttttttca

SEQ ID NO: 55619 - DNA, 69 bp, Homo sapiens
ctatatgtatatgtatatatgtgtgtgtatatacacatacacacatacatatcaaacatatatgtacag

SEQ ID NO: 55620 - DNA, 100 bp, Homo sapiens
catctacccaatgcctgtaccctcattgtgtcttgaaagtaactaacttgttttttattttacaggctcacaggtggagggacttgcattgtctcagatg

SEQ ID NO: 55621 - DNA, 95 bp, Homo sapiens; identical to SEQ ID NO: 580

SEQ ID NO: 55622 - DNA, 93 bp, Homo sapiens; identical to SEQ ID NO: 69

SEQ ID NO: 55623 - DNA, 60 bp, Homo sapiens
gtgtgtgtgtgtgtgtgtgtgtgtgtataaaattacatatgtgtgtacacacacacacat

SEQ ID NO: 55624 - DNA, 58 bp, Homo sapiens
tgagtcaaagtctcactccgtcacccaggctggagtgcagtggcgcaatcttggctca

SEQ ID NO: 55625 - DNA, 70 bp, Homo sapiens
ggtgaggcagtcttcttcagtggaggcaatttccaaaaaggctgacagctgaagacagtctgcaggcagc

SEQ ID NO: 55626 - DNA, 64 bp, Homo sapiens
tatacagaatgtgtatgtgtgtgtgtatatatatatatacctacatacatatatatactatata

SEQ ID NO: 55627 - DNA, 110 bp, Homo sapiens
gattgttttggctatatgggctcctttttggttccatatgaaatttaaagtagttttttctaattatgtgaagaaagtcaatggtagcttgatgggaatagcattgaatc

SEQ ID NO: 55628 - DNA, 107 bp, Homo sapiens
tgtgtgtgtgtgtatttccatgaatctatatatctacgtgtatgtatatgtatgtgtgtatatatataaatatgtacaattaaggatattaaatatacataaatgta

SEQ ID NO: 55629 - DNA, 118 bp, Homo sapiens
tcttattattttgaggtaggttcctttgatgcttagtttcttcaggtttttttttttaatcatgaagcgatgttggattttatcaaaagatttttctgcatctattgagattatcaga

SEQ ID NO: 55630 - DNA, 179 bp, Homo sapiens
tatatatacacatatatatactatgtgtatatatatacatatatactatgtatatatgtatgtatatgtatatgtatgtatatgcatgtatgtatatgtatgtgtgtatatgtatacatatatacatacgtatatactatgtatatatacatatatatagtatatgtatgtgtatatat

SEQ ID NO: 55631 - DNA, 79 bp, Homo sapiens
tcttgtattcactctgagtctcactgaactcccatggatagctaatccacaggaatcggggactcatgtgccatcatga

SEQ ID NO: 55632 - DNA, 114 bp, Homo sapiens
aatgttgatttgtgctctttcagtctttttgatgtaggtgttcagggctatgaactttcctcttagcagtgcccttgttgtaccccagaggttttggtaggttgtgtcattatt

SEQ ID NO: 55633 - DNA, 125 bp, Homo sapiens
gattttagatctctcctgatttctcttgtggacatttagtgctataaatttccctctacacactgctctaactgtgtcccagagattctggtacgctgtgtctttgttctctttggtttcgtgga

SEQ ID NO: 55634 - DNA, 116 bp, Homo sapiens
cttcacttatgaagcttagtttagctggatatgaaattctgggttgaaaatttttttctttaagaatgctgaatattggcccccactctcttctggcttgtagggtttctgtggag

SEQ ID NO: 55635 - DNA, 95 bp, Homo sapiens; identical to SEQ ID NO: 580

SEQ ID NO: 55636 - DNA, 93 bp, Homo sapiens; identical to SEQ ID NO: 69

SEQ ID NO: 55637 - DNA, 85 bp, Homo sapiens
tatatatatatatatatatatatctcatgtatatacatgtatattcatgtacctaaacatgtatatgtatatatgtgtatatata

SEQ ID NO: 55638 - DNA, 89 bp, Homo sapiens
gcaggaagaaagactgaagtctgtcagcacagctggatagacttttgtcataaaacactgtctactctgcgggcccaacagactttgtc

SEQ ID NO: 55639 - DNA, 103 bp, Homo sapiens
agtttttgaaatatatacactgtgcagggtttttttttttttttttttttttgtaaggtgacttacggcaggtgaaaaaccttttgcagagtttttgaagact

SEQ ID NO: 55640 - DNA, 115 bp, Homo sapiens
ttatacttcagaggccatgtgtcccatttctgatatttgagttttatttattcaaaatatatttttgagtacctgctatgtgctagatcatagggtacatatcctttgtaaataa

SEQ ID NO: 55641 - DNA, 67 bp, Homo sapiens
ggcatggatgagggcacattcttattcttattcttattaatgagacagtgtctcactctgtcatcca

SEQ ID NO: 55642 - DNA, 68 bp, Homo sapiens
ggggttgcactatcagtcactgcctcccttggcttgggtgggggttcctttggctctgtgccactccc

SEQ ID NO: 55643 - DNA, 101 bp, Homo sapiens
gtagttttgatttgcattcctctgatcagtgatgtcaagcaccttttcatatgcttgtttgccatttgtatgtcttagaaatgtcgagtcaaatcatttgc

SEQ ID NO: 55644 - DNA, 95 bp, Homo sapiens; identical to SEQ ID NO: 68

SEQ ID NO: 55645 - DNA, 93 bp, Homo sapiens; identical to SEQ ID NO: 69

SEQ ID NO: 55646 - DNA, 100 bp, Homo sapiens
cagtactatgttaaatagaagtggtgaaagtgggcattcttgtcttgttccagttctcaaggagaatgatttcaacttttcgccatttagcataatattg

SEQ ID NO: 55647 - DNA, 58 bp, Homo sapiens; identical to SEQ ID NO: 3385

SEQ ID NO: 55648 - DNA, 56 bp, Homo sapiens; identical to SEQ ID NO: 3386

SEQ ID NO: 55649 - DNA, 58 bp, Homo sapiens
tgagacagggtctcactctgtcactctggttggagtgcagtggtgagattacagctta

SEQ ID NO: 55650 - DNA, 95 bp, Homo sapiens; identical to SEQ ID NO: 68

SEQ ID NO: 55651 - DNA, 93 bp, Homo sapiens; identical to SEQ ID NO: 69

SEQ ID NO: 55652 - DNA, 60 bp, Homo sapiens
tggctcatgactgtaatctcagcattttgggaggctgaggtaggtggatcacttgagtta

SEQ ID NO: 55653 - DNA, 77 bp, Homo sapiens
ggagtatctagctcttattgtattggggcctatgtctctctttagctctaatatttgtttatatatctgggtgctct

SEQ ID NO: 55654 - DNA, 114 bp, Homo sapiens
tctatatgtatgtatgtctatttgtatctttgtgtaaggatatattacttatattttcaaaaatatataggaaggataaatcatatatggagaaatgaatgaaaatgggatgga

SEQ ID NO: 55655 - DNA, 114 bp, Homo sapiens
gcccgtggtgatcagtcactggatgcaactgctattggaaggaggcatgacctagtaggtaacatagttttttttagcagaggcaatctccaaagagggctgacatcagtaggc

SEQ ID NO: 55656 - DNA, 100 bp, Homo sapiens
aggttagaacaagttgtttctctacgttaccaacataccaatgccttatgtaaaactcaggtttggaatgtaaggaactaaaaggcaactcatctgccct

SEQ ID NO: 55657 - DNA, 105 bp, Homo sapiens
ctatatagtatgtatatatactttataagatatatatatacacctataaagtatatatatatacttcataggtgtatatatactttataggtgtatatacatact

SEQ ID NO: 55658 - DNA, 61 bp, Homo sapiens
ggtgacagagcgagactctctctgttttttgttttttgagacagactctcactctgtcacc

SEQ ID NO: 55659 - DNA, 110 bp, Homo sapiens
tgcttaggattgtcttggctatatgggctcttttctggttccatatgaaatttaaagtagttttttctaattctgtgaagaaagtcaatggtagcttgatgggggtagca

SEQ ID NO: 55660 - DNA, 63 bp, Homo sapiens
tttatatttatctattttgccttgtttcagaaatggatttaaggtaagctagaaagatgtaga

SEQ ID NO: 55661 - DNA, 88 bp, Homo sapiens
gcactcccttggagagagtaggcagttggctattttaaaagttttttctttttctgttttgtttgttcgcttcattgcatttgagtgc

SEQ ID NO: 55662 - DNA, 59 bp, Homo sapiens
atagcaaatatatttgtatatttgctatctaatagcaaacatatttgtatatttgctat

SEQ ID NO: 55663 - DNA, 136 bp, Homo sapiens
tacacatatataaatatataaatatatttgtgtatatatatggatacatttgtatatatgtgtgtgtatatatatatacaatctgtatatatatatgttgatcatatatataactatacagattgtgtatatatgt

SEQ ID NO: 55664 - DNA, 73 bp, Homo sapiens
tgtatatttttaaattttttgaggtaaatttcatgtaacatgaaattaaccactaactatttaaaagtataca

SEQ ID NO: 55665 - DNA, 201 bp, Homo sapiens
cggatatatatatatatgtatatatatgtgtgtatatatatatgtatatatatgtgtgtatatatatatgtatatatgtgtgtgtatatatatatacatgtatatatgtacatgtatatatgtacatgtgtatatatatacatgtatatatatgtatacatatatgtgtatatatatgtatacatatatatatatatatat

SEQ ID NO: 55666 - DNA, 65 bp, Homo sapiens
tgagatgaagtctctctctgtcacccaggctggagtgtggagtgcagtggtgtgatctcagctca

SEQ ID NO: 55667 - DNA, 90 bp, Homo sapiens
tagctgggaccacaagtgtgcgacaccatgtctggctaattttttatattttatttttgagatggagtctcgctctgtctcccaggctgg

SEQ ID NO: 55668 - DNA, 67 bp, Homo sapiens
agctaggaaggacagagctggatttttttttttttttgagatggagtctcgctctgtcacccaagct

SEQ ID NO: 55669 - DNA, 82 bp, Homo sapiens
gagtctcactctcacacaggctggagtgcagtgacacaatctcagcttactgcatcctctgcctcctgggttcaagagattc

SEQ ID NO: 55670 - DNA, 67 bp, Homo sapiens
gacagaggagtctcactctgtcacgtcagccaggctggagtgcagcggcgtgatcttggctcactgc

SEQ ID NO: 55671 - DNA, 58 bp, Homo sapiens; identical to SEQ ID NO: 37427

SEQ ID NO: 55672 - DNA, 58 bp, Homo sapiens; identical to SEQ ID NO: 1391

SEQ ID NO: 55673 - DNA, 56 bp, Homo sapiens; identical to SEQ ID NO: 1392

SEQ ID NO: 55674 - DNA, 98 bp, Homo sapiens
aagtaaatatttgttgttgttgttttgagacacggtctcactctgtcatctagggtggagtgcagtggtacaaacacagctgactgcagccttgactt

SEQ ID NO: 55675 - DNA, 105 bp, Homo sapiens
tgacttaacacacatggcattcacccaagttgttgagtatgtaaatctttttctttgatttaatggccgaataaaatgttgtgaagatgccattttgttgaacca

SEQ ID NO: 55676 - DNA, 77 bp, Homo sapiens
tgtgactcagtcactgagtgagcacatgctgttggaaaaatggttccaatagatttgtgatacacaggactgccaca

SEQ ID NO: 55677 - DNA, 95 bp, Homo sapiens
tatatatattttatatatatatatatatatatatggtggagaaattgtatttttggctcactatatatatgtgtgtgtgtgtatatatatatatg

SEQ ID NO: 55678 - DNA, 76 bp, Homo sapiens
ggcaatgggagctgtgattgggctcaaatttttaatttttaattaaaattttgtgcttggctgagtttcttcagcc

SEQ ID NO: 55679 - DNA, 58 bp, Homo sapiens
tatgtgtgtgtgcatgtgtgtatatatgtgtgtgtgtatatatatgtatatgtacgtg

SEQ ID NO: 55680 - DNA, 116 bp, Homo sapiens
ccaaagtgctgggattacaggcgtgagccactgtacccagccactgttattttttaaaatatttttctttagtagccaggcatggtggcacgtgcctgaagtcctagctactcagg

SEQ ID NO: 55681 - DNA, 79 bp, Homo sapiens
tctccctgtgtgtctctgtctttatgtggctgtcttcttataagaaaactagtcatattggattaggggcccagtatga

SEQ ID NO: 55682 - DNA, 101 bp, Homo sapiens
gtccggtgttgaggtctccagctgttataatattggtatctatctgtctttttcactctaataatatgtgctttatatatctgggtgctccaggtctggat

SEQ ID NO: 55683 - DNA, 90 bp, Homo sapiens
ggaaaaaagatttatttggctcatgacgctggatagctggaaagctcaagattgagcatctgcatctggtgagggtctcatactgcttcc

SEQ ID NO: 55684 - DNA, 133 bp, Homo sapiens
gctggatgtccacctctggttttctttccccactgtagaaactatgactcctgaagaattctctctgtgtgacactgtggaaggaagaggggtgacacaaccagtgagatcatttcttttaccctctcttgtg

SEQ ID NO: 55685 - DNA, 73 bp, Homo sapiens
gagacctgcagctggcacttgaatttatttttctttcttagaagatgagtgttatcactgtcaagaaggtctt

SEQ ID NO: 55686 - DNA, 99 bp, Homo sapiens
gcataatttccctttattaagctacagtacatagaaagcacattatagacactgtaggtggaaatgtgggtggatacataggaggggaaatgagagagc

SEQ ID NO: 55687 - DNA, 58 bp, Homo sapiens; identical to SEQ ID NO: 315

SEQ ID NO: 55688 - DNA, 72 bp, Homo sapiens
tatacatgcatatatacatgtacgtggatctatacatgaacatatatttatatatgtacatgtgcatgtatg

SEQ ID NO: 55689 - DNA, 100 bp, Homo sapiens
cagcattatattaaatagcagtggtgagagtgagcattcttgtcttgttctggtcctcaaggggaatgcttccagcttttgctcattcagtatgatattg

SEQ ID NO: 55690 - DNA, 108 bp, Homo sapiens
gtgtatatataatgtgcatatatatacatatatatgtgtgtatatatattacatacatatatactacatatatatatatatatatgacctgcatgatgtgttaaaaac

SEQ ID NO: 55691 - DNA, 104 bp, Homo sapiens
gcacacatatatatgtgtatatatatgcatatgcatatatatgtgtatatatatgcatatgcatatatatgtatatgtatatgtatacgtatatatattttagc

SEQ ID NO: 55692 - DNA, 60 bp, Homo sapiens
gcatgtgtgcatgtgtgtgtgtgtatatatgtatatatagacacatatatgtagatatgt

SEQ ID NO: 55693 - DNA, 111 bp, Homo sapiens
gtgctgggattacagtcatgagctactgtgtccagccctgattttttcttttagaatagaatatagctaattatctttatagttgagctactgtaatccttttaaaagtac

SEQ ID NO: 55694 - DNA, 113 bp, Homo sapiens
gctgaacatccaggtctggggcatgaacctggcatacaatgtagatttctgtgttcgttaggcaacagctacattgtctgctgggtttcaggctacctggaaacatgttctcc

SEQ ID NO: 55695 - DNA, 116 bp, Homo sapiens
cagctgctggaaggtgtaggtaccctcaatggctcagtagccagtgtagatcctgtctttcgtaatcagcagctacatctggctactgggtctctgatggcatcttctagcttctg

SEQ ID NO: 55696 - DNA, 76 bp, Homo sapiens
gggtctcactgtgtcactcaggctggagtgcagctggcgtgatcatagctcactgcagcctagacctccagggctc

SEQ ID NO: 55697 - DNA, 107 bp, Homo sapiens
agatgacagaacagagagaacagagtttatttattttcttcttctcttactagaatgtaaggtccttgagagtgaagaatttctatgctttgatgactgctgtatct

SEQ ID NO: 55698 - DNA, 58 bp, Homo sapiens; identical to SEQ ID NO: 1435

SEQ ID NO: 55699 - DNA, 77 bp, Homo sapiens
tatcattattatttttttttgagacagagtctcactctgtcgcccaggctggagtgcagtggtgtgatctcggctca

SEQ ID NO: 55700 - DNA, 58 bp, Homo sapiens; identical to SEQ ID NO: 2626

SEQ ID NO: 55701 - DNA, 153 bp, Homo sapiens
catatatatatatatacacacacatatacgtatatatatgtatatatgtgtatatatatacacgtatatgtgtatatatatgtgtatatattatatatgtatatatatacgtgtatatataatatatgtatgtatgtatatatacgtgtatat

SEQ ID NO: 55702 - DNA, 58 bp, Homo sapiens
tgagactgtgactcactctgtcgccaagcatggagcgcagtggtgtgatctcagctca

SEQ ID NO: 55703 - DNA, 66 bp, Homo sapiens
gggtcttctctccctctgtcacccaggctggtggaaggctggagtgcagtggcgtgatcatagctc

SEQ ID NO: 55704 - DNA, 58 bp, Homo sapiens
tgagatgaggtctcactctgtcacccaggttggagtgcagtggcatgacctcggctca

SEQ ID NO: 55705 - DNA, 70 bp, Homo sapiens
ggtcgccttcggtcaggatgaaatcagagtcttcctctctcagtggctcttggttctgaaaagtgcaacc

SEQ ID NO: 55706 - DNA, 106 bp, Homo sapiens
gaagattaattttcactatgctcttgaaacatcacatattttggggagatgctgaaaatatgttatgtttagaagttttatcataggcacacaagatataattttt

SEQ ID NO: 55707 - DNA, 63 bp, Homo sapiens
ttgatggagtctcgctctgtctcccaggctggagtgcagtagcgtgatcttggctcactgcaa

SEQ ID NO: 55708 - DNA, 107 bp, Homo sapiens
ggggttgccttcttgatttctttttctgctagttcattataatgtatacatatacatatacaatgtatatattacaatatatggtcgatatatagaaatgctactgc

SEQ ID NO: 55709 - DNA, 182 bp, Homo sapiens
gtatatgttatatataaaacgtacataatgtatatatacacacatacatgtgaatatgtatatgtgtatatatgtataatacatgtatatgaaatatatatatatgtatattaatatatttatatatatttaatgtatacacacattatatattatatatatttattacatatattatatat

SEQ ID NO: 55710 - DNA, 58 bp, Homo sapiens; identical to SEQ ID NO: 31816

SEQ ID NO: 55711 - DNA, 72 bp, Homo sapiens
ttgtttttggaggcagggtctcactctgtcactcaggctggagtgcagtggtgcaatcttggctcactgcaa

SEQ ID NO: 55712 - DNA, 63 bp, Homo sapiens
gggagagtggaaggcagccagaggggagaagcttccttcctggttctttttttttttttttcc

SEQ ID NO: 55713 - DNA, 106 bp, Homo sapiens
tgcactatatgtatatgtatgtatgtatgtatgtatatacacatacaccatatatatgtgtgtatatatatacatacatatacaaaacaattgcttactagatgca

SEQ ID NO: 55714 - DNA, 93 bp, Homo sapiens
gcaattgttttgtatatgtatgtatatatatacacacatatatatggtgtatgtgtatatacatacatacatacatacatatacatatagtgc

SEQ ID NO: 55715 - DNA, 123 bp, Homo sapiens
tacacacatatgtgtgtgtgtatatacacacatgtgtgtgtgtacatacacacatgtgtgtgtgtatatatatacacacatatatgtgtatatgtgtatatatgtgtgtatatatgtgtatat

SEQ ID NO: 55716 - DNA, 114 bp, Homo sapiens
aggaccatgacattcctctgctctaaaactgcctataaagtatgatctatatttttatttttaattgctctaaaaataagtgacggttcaggccaggcacagtggctcactcct

SEQ ID NO: 55717 - DNA, 115 bp, Homo sapiens
gcagcatgctttcagtatttttgtggtagaaatatgcattctttattttttatttttatttttattttttgagatggagtctcactttgttgcccaggctggagtgcagtggtgc

SEQ ID NO: 55718 - DNA, 89 bp, Homo sapiens
aggaagatcacttgagcccaggaatttgaggctgtagagagctatgattacaccactgcactccagcctgggtgacagagtgcgaccct

SEQ ID NO: 55719 - DNA, 84 bp, Homo sapiens
tcccttactttcttcctctgtggaaataggctgtctccttgcaccagggttgctgtctctcagtctggcagatggagtagggga

SEQ ID NO: 55720 - DNA, 86 bp, Homo sapiens
ttatgtactacctttttataaatgtatatatgtaatatatatacatatatgtttatatacacatatataaaattgtgtatacataa

SEQ ID NO: 55721 - DNA, 58 bp, Homo sapiens
tgagacagagtctccctctgtcacccaccctggagtgcagtggtgtgatctcggctca

SEQ ID NO: 55722 - DNA, 104 bp, Homo sapiens
cagttttataacatgggagaaagaacaagacccagagtgaagatgaatagaacttttttatttttatttttttgagatggagtctcactctgtcacccaggctg

SEQ ID NO: 55723 - DNA, 97 bp, Homo sapiens
cctgagctgtcttatctgtgttttattgtctgttcttttctggctgcttgtagttagaagagaagtgatttccttgaaatgcgtgaggctagaaagg

SEQ ID NO: 55724 - DNA, 71 bp, Homo sapiens
accttggttcgggctgtgagactaaggcttttttttttttttgagatggagtctcactctgtcaccaaggt

SEQ ID NO: 55725 - DNA, 96 bp, Homo sapiens
agcctggatgcagtggcatgatcatggcccattgcagcctcaacaccccagcctcaagtaagtctccacacttcatggctcactgcagcccaggct

SEQ ID NO: 55726 - DNA, 86 bp, Homo sapiens
cttgccctggtctctcactctgtcttatgcccctcaaattcttttttctgaggaggcaagaattgaggttgctgcagacccgtatg

SEQ ID NO: 55727 - DNA, 58 bp, Homo sapiens
tgagactgagtccctctctgtcacccaggctggagtgcagtggtgcgatctcagctca

SEQ ID NO: 55728 - DNA, 60 bp, Homo sapiens
ttgagacagagtctcactctgtcacccagactggagtgcagtggcgagatcttggctcaa

SEQ ID NO: 55729 - DNA, 90 bp, Homo sapiens
atatatatgtgtgtatatatatgtatatatgtatatgtatatatgtatatatagtatatatgtgtatacatgtatgtatatatgtatata

SEQ ID NO: 55730 - DNA, 111 bp, Homo sapiens
ggcccatagctttctttttaaatatatgagtcatgttgatatatatatatatatatatatatatatatatatatatatatatatatatatgcacgtgtgtgtgtgtatgcc

SEQ ID NO: 55731 - DNA, 58 bp, Homo sapiens; identical to SEQ ID NO: 1409

SEQ ID NO: 55732 - DNA, 58 bp, Homo sapiens; identical to SEQ ID NO: 285

SEQ ID NO: 55733 - DNA, 77 bp, Homo sapiens
gttgttatttttagacagggtctctccctctgtcacccaggctagggtgcagtggtgtgatcttggctcaccacaac

SEQ ID NO: 55734 - DNA, 129 bp, Homo sapiens
gtttaattttaaaaaatcattattactatagcagctattgtaacagctgtgggtaataaatacttttttttttagacaaggtttcactctgtcacccaggctggagtgcagtggtgcaatcttgtctga

SEQ ID NO: 55735 - DNA, 97 bp, Homo sapiens
ggaataagatgggctgggcgcagtggctcatgcctgttatctcagcaccttgggaggctgaggtaggtggatcacttgagcccaggagttcgagacc

SEQ ID NO: 55736 - DNA, 85 bp, Homo sapiens
tctagctgtccgttgggggaggtggtcaccagcaggtgattgtataagcagttatctgggtcgaccacattgaggaacaggtgga

SEQ ID NO: 55737 - DNA, 113 bp, Homo sapiens
cccaattggaacacagggaaatatgagtcatatgacaatgatgatgatcatgatgatcattattattataaatatttatgtggcaattactatttgctgtgtatttatctggg

SEQ ID NO: 55738 - DNA, 95 bp, Homo sapiens; identical to SEQ ID NO: 68

SEQ ID NO: 55739 - DNA, 93 bp, Homo sapiens; identical to SEQ ID NO: 69

SEQ ID NO: 55740 - DNA, 116 bp, Homo sapiens
aataatgagattgagcactgtctcacgtgtctattagccatctgaatatcttcatctgttacatatctgttcaagaaggcctctgactagtgggtattctgctttttcttgttgtt

SEQ ID NO: 55741 - DNA, 90 bp, Homo sapiens
ggtgaggttccctcttactcagtctctgtgttctattccggtcttcaatagattggagaggacccaccaacagcaggggggcaatccact

SEQ ID NO: 55742 - DNA, 70 bp, Homo sapiens
cttggacactgctcagaggactgtgtgtgcagacgtgatactggagaattacagtcagctggtgtctggg

SEQ ID NO: 55743 - DNA, 59 bp, Homo sapiens
atataggacagatatgtatacgtatacatacatatatgtatatatatgtgtatatatat

SEQ ID NO: 55744 - DNA, 80 bp, Homo sapiens
atatgtatacatatgtatatgtatatatatgcatatacgtgtgtatatgtatacatatgcatatacatgtgtgtatatgt

SEQ ID NO: 55745 - DNA, 112 bp, Homo sapiens
caggtatttctttgtagcaatgtgagaacggattaatactgtaggtttccctaggaaacttttttttttttgagacagagtctcgctctgttgcccaggctggagtgcagtg

SEQ ID NO: 55746 - DNA, 58 bp, Homo sapiens
tgagattgagactcactctgtcacccaggctggagtgcagtggcgagatctcggctca

SEQ ID NO: 55747 - DNA, 99 bp, Homo sapiens
gctttctatcacacagtctttgggtccaggcatgtttcccccttttgggtcctatgatggggaaaagttggaagatgagggttgggtaggttggagagt

SEQ ID NO: 55748 - DNA, 150 bp, Homo sapiens
cttacggagttactcgtcatcttcctgagggtcgctgatctcttcataaatcaccagttgctttctctcacgcactctgtgggtccaggcatgtttcccccttttgggtcctatgatggagaagagttggaagatgagggttgggtagat

SEQ ID NO: 55749 - DNA, 120 bp, Homo sapiens
gacagaggtactggggacaaggaccagggtctccggggacatctggaaccttgggagcctctcactctcgctctgtcatcacctagcatccctggagacaagtctgtgaccgtggaatac

SEQ ID NO: 55750 - DNA, 67 bp, Homo sapiens
gagaatgaggagatttatttcctgccaagtattcaggagtgcttgagaggacagagtgtgctttctc

SEQ ID NO: 55751 - DNA, 68 bp, Homo sapiens
ttgctgttgctgagacagagtctcactctgtcgcccaggctagagtgcagtgtctcggcttacagcaa

SEQ ID NO: 55752 - DNA, 95 bp, Homo sapiens; identical to SEQ ID NO: 68

SEQ ID NO: 55753 - DNA, 93 bp, Homo sapiens; identical to SEQ ID NO: 69

SEQ ID NO: 55754 - DNA, 82 bp, Homo sapiens
gtgctggcagatttgatttctagtgagggctctcttcctggctggcagatagccaccgtctcactgtgtctttatgtggcac

SEQ ID NO: 55755 - DNA, 77 bp, Homo sapiens
ttgttttgttttttgagacagtgtctggctctgtcacccaggctggaatgcagtggcaccatctcggctcacagcaa

SEQ ID NO: 55756 - DNA, 95 bp, Homo sapiens; identical to SEQ ID NO: 68

SEQ ID NO: 55757 - DNA, 93 bp, Homo sapiens; identical to SEQ ID NO: 69

SEQ ID NO: 55758 - DNA, 93 bp, Homo sapiens
ggatcatcagactgttgctctacctgtcagacataccacgatcgtgactcactctctttgtgtctggcaccttgtgttgcactgattttctcc

SEQ ID NO: 55759 - DNA, 71 bp, Homo sapiens
gaccacgtggagaagggatagcctctcctcccagaccccagactcacgctgtctctcttgccatctgtgtc

SEQ ID NO: 55760 - DNA, 132 bp, Homo sapiens
agagagaaggagactatggcttttctgtttgtacaaaaatcatgtcagcctatgagtgcctctctctgtgactggagctgtatgtggttacatgtggtcacaagtgcacattcaagttcacatacacagaga

SEQ ID NO: 55761 - DNA, 77 bp, Homo sapiens
gtcaatgggatgagtgattagagctctgtagagtcagtgatgagtgagtctgtagagtgagtgaagtgattaggggc

SEQ ID NO: 55762 - DNA, 98 bp, Homo sapiens
gccagtcagaaattgaatgggggtttttcctggaaccggataaaattatcttaaggtttctatagaagaattcacatttaagaatagctaagacaggc

SEQ ID NO: 55763 - DNA, 58 bp, Homo sapiens; identical to SEQ ID NO: 5571

SEQ ID NO: 55764 - DNA, 66 bp, Homo sapiens
aggtgagacttggatatcggcattgagtgaacctgtttgtcacactctgtcatgaccctctcacct

SEQ ID NO: 55765 - DNA, 77 bp, Homo sapiens
ccacctcacacaggggttaggagtgtttttttgttggtttttttccagacagggtctcactctgtctcccaggctgg

SEQ ID NO: 55766 - DNA, 111 bp, Homo sapiens
ctccagcctgggcaacaagagtgaaacttcgtttcaaaaaaaaaaaaattcttcctattttttttttttttttttttgagacagaatctcactctgtctcccaggctggag

SEQ ID NO: 55767 - DNA, 66 bp, Homo sapiens
aagtgagtcactcactctgagagtcaggaattacagttgcatgcctctgagagtgagtgcctcctt

SEQ ID NO: 55768 - DNA, 95 bp, Homo sapiens
tttattatctcactcagctgggggtggctcatacctgtaatcccagccttttgggaggctgaggtaggtggatcccttgagccgaggagtttgag

SEQ ID NO: 55769 - DNA, 66 bp, Homo sapiens
agactctttgtcagaaatgtaagatcataagtttttttttatttttatttttttgagacagagtct

SEQ ID NO: 55770 - DNA, 97 bp, Homo sapiens
ggaggctgggcacagtagctcacacctgtaatcccagcactatgagaggcagaagcaagatcatctgagaacagactgagcaacatagctagacccc

SEQ ID NO: 55771 - DNA, 92 bp, Homo sapiens
tagctctctcatctctttgtgggtgtgtaccccaagatatcaagtatttttaattattctgagtgtgtatttgccaggatgtgagatcgcta

SEQ ID NO: 55772 - DNA, 74 bp, Homo sapiens
ggtgtacatctcaagagtgtgaggtctctgatatctttttttttttttttgagacacagtcttgatctgtcacc

SEQ ID NO: 55773 - DNA, 76 bp, Homo sapiens
gttgttgttgagatggagtctcactctgtcatttaggctgctggagtgaagtggtgtgatctctgctcactgcaac

SEQ ID NO: 55774 - DNA, 58 bp, Homo sapiens; identical to SEQ ID NO: 8774

SEQ ID NO: 55775 - DNA, 58 bp, Homo sapiens
tgagacggagtctcactctgtcacccaggctggtgtgcagtggtgcgatctcagctca

SEQ ID NO: 55776 - DNA, 113 bp, Homo sapiens
ggacatcttcaagaggatcagagggcaaagctactgggcggtgagaccgtcaatctgtcagtctgatgcagaacccccggactgcttatctctccggtcccagcttatagccc

SEQ ID NO: 55777 - DNA, 116 bp, Homo sapiens
agatgagaacattgtttgcacacttttgccttctagagtatatctcttttttttttttttgagacagagtttcgctcttgttgcccaggctggaacgcaatggggtgatcttagct

SEQ ID NO: 55778 - DNA, 58 bp, Homo sapiens; identical to SEQ ID NO: 32787

SEQ ID NO: 55779 - DNA, 70 bp, Homo sapiens
tgttttttgagtcaaggtctcactctgtcacccaggctggagtgcagtggcatgatcacggctcactgca

SEQ ID NO: 55780 - DNA, 58 bp, Homo sapiens
tgagacggagtctcgctctgtcacccacactgaagtgcggtggcgcgatctcggctca

SEQ ID NO: 55781 - DNA, 102 bp, Homo sapiens
aaagcgctgggattataggcatgagccaccgtgcccagtccatttaattatatttatagcagctggtcatgcagtgactcacgcctgtaatctcagcacttt

SEQ ID NO: 55782 - DNA, 58 bp, Homo sapiens
tgaggcggagtctcgctctgtcacccaggctggagtgcaatggcgtgatctcggctca

SEQ ID NO: 55783 - DNA, 83 bp, Homo sapiens
tgcctgaaactggtgttgttggcttgctgcagggacctaggcaggtccctgagcctctcagaccctgagtttcttatttggca

SEQ ID NO: 55784 - DNA, 116 bp, Homo sapiens
tatatatatgtatatagatgtatacatatgtgtatatatatgtgtatatatacgtatatatgtgtatatatatacgtatatgtgtatatatatacacgtatatgtacgtgtatata

SEQ ID NO: 55785 - DNA, 95 bp, Homo sapiens
gtgatttggccaaatagtgggggagtctcagaaacctgtgcggggattgtgtctgtgggtctctgtcatcccaccctgcaggaggtaaacatcat

SEQ ID NO: 55786 - DNA, 70 bp, Homo sapiens
tttttttgagacagggtctcgctctgtcgctcaggctggagtgcagtagcgtgatcttggctcactggaa

SEQ ID NO: 55787 - DNA, 73 bp, Homo sapiens
tttgagacggtgtctcgctctgtcacccaggctggactacaatggcatgatcagggctcaaggcagcctcaaa

SEQ ID NO: 55788 - DNA, 95 bp, Homo sapiens; identical to SEQ ID NO: 68

SEQ ID NO: 55789 - DNA, 93 bp, Homo sapiens; identical to SEQ ID NO: 69

SEQ ID NO: 55790 - DNA, 73 bp, Homo sapiens
ttgtttttgtgagataatctctcactctgtcgcccaggctggagtgcagtggtgtgatttcggctcactgcaa

SEQ ID NO: 55791 - DNA, 105 bp, Homo sapiens
tgagtgtctatgtaacgtgacatatcatcatcgttgtcatcatcttaatcatcattatgatcatgatgatgatgatcatcattatcaccaccaccatcaacatca

SEQ ID NO: 55792 - DNA, 65 bp, Homo sapiens
catatatctttatatctgtctatatctatatatagataggtagatagatataaagtcacagtatg

SEQ ID NO: 55793 - DNA, 107 bp, Homo sapiens
tatatatgtgtatatatatacacacatatatgtatatgtatatatatatatacacacacatatatatgtatatgtatatatatatgtatatgtatatatatatatat

SEQ ID NO: 55794 - DNA, 77 bp, Homo sapiens
atcagatctccagagaaagaagatgggcagaggggagaaggagcccctgggaacacttctgaatttgtagtgatgat

SEQ ID NO: 55795 - DNA, 102 bp, Homo sapiens
tcagtctgcaattcaaatgtaaatctcttccagaaacaccttcacagacacacccagtgtcttagtctgtttttgctgctataacataataccacagactgg

SEQ ID NO: 55796 - DNA, 83 bp, Homo sapiens
ggaatatcctgcctgttgagagtgtctttgttcatctgagaggtcaggtgagatagtttatgctaacagtgtgacttattgcc

SEQ ID NO: 55797 - DNA, 58 bp, Homo sapiens; identical to SEQ ID NO: 3385

SEQ ID NO: 55798 - DNA, 56 bp, Homo sapiens; identical to SEQ ID NO: 3386

SEQ ID NO: 55799 - DNA, 98 bp, Homo sapiens
ttagatatttgggggttcatattcaggatgtgagggccttgaaatctttgcaagtctgtgtggttttttttttttacattttagccttaggtgtttgg

SEQ ID NO: 55800 - DNA, 58 bp, Homo sapiens; identical to SEQ ID NO: 47933

SEQ ID NO: 55801 - DNA, 76 bp, Homo sapiens
gtacactagactctgacacacaatgggctagtagctaacagcccaacctcttgggtgtctctcaatctctctgtgc

SEQ ID NO: 55802 - DNA, 91 bp, Homo sapiens
tcattttatgaacttcagacctcgagtcttttttttttttaaagtaataccctctcagagaggagagagtgggctggcctctgtgaaatga

SEQ ID NO: 55803 - DNA, 72 bp, Homo sapiens
acacacacactaccattcaaggcaaatgggagggtgaacacatcagatgtctcagactgtgtgtgtgtgtgt

SEQ ID NO: 55804 - DNA, 58 bp, Homo sapiens; identical to SEQ ID NO: 884

SEQ ID NO: 55805 - DNA, 56 bp, Homo sapiens; identical to SEQ ID NO: 885

SEQ ID NO: 55806 - DNA, 103 bp, Homo sapiens
gtaactatggaaggtgatatgcatgtaagtttatttcaatgtagtaacaatttcgctatatgtatatatataaaacatcatgttgtacaccttaaatacatac

SEQ ID NO: 55807 - DNA, 142 bp, Homo sapiens
cccaagaatccaaaggatctggcaagaaggggagtgtcagtgtgcctcagacccctctcttttttttttattatacttttaagttttagggtacatgtgcacattgtgcaggttagttacatatgtatacatgtgccatgct

SEQ ID NO: 55808 - DNA, 81 bp, Homo sapiens
tgagacaagagtctcactctgtcgttcaggctggagtgcagtggcacgatctcgtctcactacaacctctgcctcctggac

SEQ ID NO: 55809 - DNA, 78 bp, Homo sapiens
gggtgagtcagtgtgtgagtgaatggaaggcctgggacattcctgtacactaccatagactttataaacactgtacct

SEQ ID NO: 55810 - DNA, 109 bp, Homo sapiens
gtgtttttatgacctatatagatgattttgtagtttaaacttttagaattttttagttttgttttttaaactgttatgatcttaaagatatagggagacataaagttat

SEQ ID NO: 55811 - DNA, 73 bp, Homo sapiens
gcctgacttggctcctctatggctgcatgcattgacacctgcacacacactcacagagtgggaaccaagttgc

SEQ ID NO: 55812 - DNA, 72 bp, Homo sapiens
ggaggtgggagtggaggaggggagtgagaattagctgactcatcagtctcactcacacattttggtttccat

SEQ ID NO: 55813 - DNA, 88 bp, Homo sapiens
tcttctcatctctgtgctagcagtgtcagaagagggagagcagtcactatttcagaagccttttctgtgctggctcaaagattgaaga

SEQ ID NO: 55814 - DNA, 91 bp, Homo sapiens
ttatgatgatgttatatatacatatacagacacacatgtgtatatatacatatgtgtatatatgtgtatatgtatatacacacacacataa

SEQ ID NO: 55815 - DNA, 68 bp, Homo sapiens
tgtatatacatatacacatatatacacatatgtatatatacacatgtgtgtctgtatatgtatatata

SEQ ID NO: 55816 - DNA, 89 bp, Homo sapiens
ccagcctgcacactggggtggagccttgggaagttcatgccatttgcaacagggaggtgcctgactccttctctctgtgtggaacctgg

SEQ ID NO: 55817 - DNA, 101 bp, Homo sapiens
tggattatgtatccaaggagcctgcagaatcttggatgtcctttgctttaggattatctgactgtctctgtggctctgagtgtgtggcccaagaatctgta

SEQ ID NO: 55818 - DNA, 96 bp, Homo sapiens
ccagtagggctatctcactgaggcctccactggctttctcctaaagaggctctctgtgtggctcagactggatctaaggggttggcctcaagtgag

SEQ ID NO: 55819 - DNA, 71 bp, Homo sapiens
ccagtagggctatctcactgaggcctccactggctttctcctaaagaggctctctgtgtggctcagactgg

SEQ ID NO: 55820 - DNA, 109 bp, Homo sapiens
gttggagtggtacttcatggaggagattttgtgtgatatcttccacttgactctgagttggcactcagaggagagtgagcacatgtttctgggcagggagggctgcaac

SEQ ID NO: 55821 - DNA, 71 bp, Homo sapiens; identical to SEQ ID NO: 55819

SEQ ID NO: 55822 - DNA, 116 bp, Homo sapiens
tttttgtattaactcaagggtttttgtcataggaagacagtcatttcattgtatgcatatttttatgtatataagaggattactttccataaaaataattacaatgaaaacaaaaa

SEQ ID NO: 55823 - DNA, 70 bp, Homo sapiens
tgtaaatatataaatgtatatgtatgtatatacaagtgtatatataaatatgtatgtgtacatgtataca

SEQ ID NO: 55824 - DNA, 95 bp, Homo sapiens; identical to SEQ ID NO: 580

SEQ ID NO: 55825 - DNA, 93 bp, Homo sapiens; identical to SEQ ID NO: 69

SEQ ID NO: 55826 - DNA, 113 bp, Homo sapiens
tagccaaatagtactccattgtgtataggtaccacattttctttatccattcatctatttttttattatactttaagttctagggtacatgtgcacaatgtgcagttttgtta

SEQ ID NO: 55827 - DNA, 75 bp, Homo sapiens
gggtctctctctgtcacccaggctgcagcgcagtgatgtgatcatggctcactgcatccttgacctctgggaccc

SEQ ID NO: 55828 - DNA, 116 bp, Homo sapiens
agatgtatatgtacataaaagtttgagaagtacctatggtaatatctttagtcaagtctatttcttgttttcatccaggagcccatcttatctttaaatgtgattttcatacatct

SEQ ID NO: 55829 - DNA, 102 bp, Homo sapiens
acttttcctgtttctttgcatatctcttaactttttgtttaaaaattgacattttacaggaaacaacaggtgctggagaggatgtggagaaataagaacagt

SEQ ID NO: 55830 - DNA, 65 bp, Homo sapiens
gccgtagagagaagaaccctgaggtcccctgattttggttgcacctttgtctctctcttactggc

SEQ ID NO: 55831 - DNA, 66 bp, Homo sapiens
tgggttggggatgaactcataggggattggagctgtcttcagtctctgtgtgggagccacaagaca

SEQ ID NO: 55832 - DNA, 90 bp, Homo sapiens
gtgtggatgaaaagcccaaatcccccttgaaatgaagtttgaatgcggtggtagaacactagctatcctttactgaggggtgggtcacac

SEQ ID NO: 55833 - DNA, 108 bp, Homo sapiens
tcctgtactttgcctacctgtgccccgtcacgtagtgttgaatggaaaaagctatctctgtttctcacacagtatattgggagatgttaggatctagagaaaatagga

SEQ ID NO: 55834 - DNA, 74 bp, Homo sapiens
tatataaatggaaatatataatatataatataaatattacgtattttatatgtgtatgtatttctatttacata

SEQ ID NO: 55835 - DNA, 90 bp, Homo sapiens
cttgtgatgttgccatgtgttgatgatatcaactttacactatttcataaggtatttcatagtttatatttcatatgtagcattcacaag

SEQ ID NO: 55836 - DNA, 119 bp, Homo sapiens
gtgtgtgtctgtgcatatatatatatgtatatatacatatatgtacgtatatatacgtatatatatgtgtatatatacatacgtgtatatatgtatgtgtatatatatatatacagaca

SEQ ID NO: 55837 - DNA, 114 bp, Homo sapiens
gccttttccagaatgtcaaatacttggaatcatacagtatgtagccttttctttcttttttttttctttgtttttttgagacagggactcgctctgttgtccaggctggggtgc

SEQ ID NO: 55838 - DNA, 95 bp, Homo sapiens; identical to SEQ ID NO: 68

SEQ ID NO: 55839 - DNA, 93 bp, Homo sapiens; identical to SEQ ID NO: 69

SEQ ID NO: 55840 - DNA, 134 bp, Homo sapiens
accccagcctgggcgccagggcaagactccgtctctttttgttttgtttcattttgagacagggtctcactctgtcacccaggctggagttcagtggcacgatctcggctcactgcaatctccgcctcctgggt

SEQ ID NO: 55841 - DNA, 95 bp, Homo sapiens; identical to SEQ ID NO: 68

SEQ ID NO: 55842 - DNA, 93 bp, Homo sapiens; identical to SEQ ID NO: 69

SEQ ID NO: 55843 - DNA, 114 bp, Homo sapiens
ggtggaaaaaacagcacccagaaatgcaggaactacagcccagacctgaggcatcatggagatgcagggctggtgcaatccctgccaaaaaggcctcaggctgagatttcctcc

SEQ ID NO: 55844 - DNA, 94 bp, Homo sapiens
acatgtatacccaatgtatacatgtttcaatatatgttaccattatacaatgtatacatgtattgaaacatcacagtgtaccccataaacatgt

SEQ ID NO: 55845 - DNA, 113 bp, Homo sapiens
ttgacttggcaatgcaggctcttttttggttccatatgaaatttaaagtagttttttctagttctgtgaagaaagtaaatggtagcttgatgagaatagcattgagtatacaa

SEQ ID NO: 55846 - DNA, 85 bp, Homo sapiens
gccaatgtgtgatgttccccttcctgtgtccatgtgttctcattgttcaattaccacatatgagtgagaacacacagtgtttggt

SEQ ID NO: 55847 - DNA, 75 bp, Homo sapiens
ttatgaacataacctattgaaatgatatatatatatatatatatatgtcatttcatagatatataaatttcatag

SEQ ID NO: 55848 - DNA, 73 bp, Homo sapiens
tatgaaatttatatatctatgaaatgacatatatatatatatatatatatcatttcaataggttatgttcata

SEQ ID NO: 55849 - DNA, 101 bp, Homo sapiens
ctagaccttgcatcttctggtcctggcctggacactggatctgctggaatgtgaacccacataagctggtctaaagggtggggctacaggagccagtctgg

SEQ ID NO: 55850 - DNA, 129 bp, Homo sapiens
ctgaatagattagttatttaaaagtggattgtttaatttccaaatagatatttcttgatatattattattatagataactcatttaataatgatctgatcagaaaatataatctgaatttcagtcctct

SEQ ID NO: 55851 - DNA, 118 bp, Homo sapiens
tattgtcagatttctaaatatttgcaatctcacaggtgtaaaatgttaaggttttacagtttagtttttatttttcaagttacaaatgaggttgattgtattttgtttgttggtcata

SEQ ID NO: 55852 - DNA, 72 bp, Homo sapiens
gagatgagcccagtgagctcactgtgagtcactgtgacccacatgcagtcattagagccatgcatcatcatc

SEQ ID NO: 55853 - DNA, 95 bp, Homo sapiens; identical to SEQ ID NO: 68

SEQ ID NO: 55854 - DNA, 93 bp, Homo sapiens; identical to SEQ ID NO: 69

SEQ ID NO: 55855 - DNA, 112 bp, Homo sapiens
taacaattaggccgagttggttgataccattgttcaagccttctgcatatatatatatatatatcctgattttcttgtacactgtttctaccaattgctgagagaaatgttg

SEQ ID NO: 55856 - DNA, 112 bp, Homo sapiens; identical to SEQ ID NO: 55855

SEQ ID NO: 55857 - DNA, 95 bp, Homo sapiens; identical to SEQ ID NO: 68

SEQ ID NO: 55858 - DNA, 93 bp, Homo sapiens; identical to SEQ ID NO: 69

SEQ ID NO: 55859 - DNA, 112 bp, Homo sapiens; identical to SEQ ID NO: 55855

SEQ ID NO: 55860 - DNA, 101 bp, Homo sapiens
attccattcacctgggcttctcttagggaaataccttgagttggaaataaaagtttgctcagtctctctgtctctctctcaaaagcaatgtgagtaggaat

SEQ ID NO: 55861 - DNA, 58 bp, Homo sapiens
agacccaacatctatgctatcactgagtatctctgattcagtgtggtattgcggggct

SEQ ID NO: 55862 - DNA, 84 bp, Homo sapiens
agatttggcatattcaggtggtatggccatagactgtttttttttttttttgagacatagtctcactctgtctgttgccaggct

SEQ ID NO: 55863 - DNA, 83 bp, Homo sapiens
tgcataattttttttttttttgagatggagtctcacactgttgccaaggctggagtgcagtggtgagatctcggctcactgca

SEQ ID NO: 55864 - DNA, 92 bp, Homo sapiens
tcatgctgaagcctctcaagtggatggtactacaggtgcgaacaccacacctgagcaattaatttattttttagaacgttgtttcagtctga

SEQ ID NO: 55865 - DNA, 104 bp, Homo sapiens
tggctgcttagtattccatagtgtatatgtgccacattttcttttttttattattattatactttaagttttagggtacatgtgcacaatgtgcaggttagtta

SEQ ID NO: 55866 - DNA, 76 bp, Homo sapiens
gatttcgctcagaaaacagtagtatcattggtcttttattaagtcaccaatgaatttatttttttgagacaaagtc

SEQ ID NO: 55867 - DNA, 104 bp, Homo sapiens
tattgattggaatagtttcagaaggaatggtagcagctcctccttatgcctctggtagaattcagctgtgaatccatctggtcctggactttttttggtcggta

SEQ ID NO: 55868 - DNA, 64 bp, Homo sapiens
agagcctggccttgcatggggaggggaacgacagcttctctcttctgtgtgtctgtcagattct

SEQ ID NO: 55869 - DNA, 64 bp, Homo sapiens; identical to SEQ ID NO: 55868

SEQ ID NO: 55870 - DNA, 95 bp, Homo sapiens
ctgtctggtgggcaaattttcttaatttttgaaattatacagtaaaatggacacttgaggtatagttctgtgaatttgaacacctgtatagatag

SEQ ID NO: 55871 - DNA, 94 bp, Homo sapiens
acatacgtatgtatatatacacatatgtatgtgtatatatatgtgtgtgtatatatatacacgtgtatatatgtatgtgtgtgtatatttatac

SEQ ID NO: 55872 - DNA, 72 bp, Homo sapiens
ccacaaggctctctgtctctgtttcagatgtccatgttgtgtctgagaccccccggatcttgtggccttgtg

SEQ ID NO: 55873 - DNA, 85 bp, Homo sapiens
agtgtgtaggttcatgtagtttggttcatatgtatgtatgtatgtaagtgcctatgtaaatggcgaacgcatttcgcctagacct

SEQ ID NO: 55874 - DNA, 116 bp, Homo sapiens
ctgggcgacagagtgagaccctgtgtcacacacaaaaattgtattgagagttttatttttattttattttattttattttttattttttgagacggagtcttgctctgttgcccag

SEQ ID NO: 55875 - DNA, 114 bp, Homo sapiens
gggtaactggtcccaagtaagtccaaaatccaacagaaaaaaaaaaaacattgtcttcttcttttttttttttttttttttttttttgagttaaggtctccctctctgtcaccc

SEQ ID NO: 55876 - DNA, 73 bp, Homo sapiens
tgggtgactgagcgagaccttgtctctttttttttttttttttttttgagacagagtctcactctgtcaccca

SEQ ID NO: 55877 - DNA, 92 bp, Homo sapiens
ggagactcgcttgaacctgagaggtggagattgcagtgagtgagctgagatcatgccactgcactccagcttgggtgacagagtgagactct

SEQ ID NO: 55878 - DNA, 99 bp, Homo sapiens
tatgtatgtatgtatgtatgtatgtataatagaattatatgcatggtgctttatctcccacatttataattatatatatatataaaacccacatatata

SEQ ID NO: 55879 - DNA, 58 bp, Homo sapiens
taccacgggcacatactctagtttgtctcctctcaactgtggtgtgtgtgtgtgtgtg

SEQ ID NO: 55880 - DNA, 67 bp, Homo sapiens
tgaggtggagtctcgctctgtcacccacccactccaggctggagtgcagtggcgcgatctcggctca

SEQ ID NO: 55881 - DNA, 82 bp, Homo sapiens
ggcctagagtctgtgtctgtgtgtgccagcctggtacttgaatctagaagtgctctcctggtgtcggggcaggcctgcggcc

SEQ ID NO: 55882 - DNA, 58 bp, Homo sapiens
tgagacagagtctcactctgtcacccaggctggagtgcagtggtgtgatcatgtctca

SEQ ID NO: 55883 - DNA, 69 bp, Homo sapiens
gtgaccctctctattgggaccttgggcttctctgattgactggaaggtgacaaatgagagagaggtggc

SEQ ID NO: 55884 - DNA, 162 bp, Homo sapiens
tttcagcctggagaaatcagggaaggcttcttggaagagatcattttgggattgaatttttttttttttttttttttttttttgacatggagtttcactctgtcactcaggctggagtggagtggcatgatctcggctcattgcaacctctacctcctgggt

SEQ ID NO: 55885 - DNA, 71 bp, Homo sapiens
ggttgacaagtgaggttccttgtcatcttcttttttttttttttctgagacaggatctcactctgttgccc

SEQ ID NO: 55886 - DNA, 87 bp, Homo sapiens
tgagcctaaacaataaacatttattatttcatacagtttctgggtgccaggaagctgggaatggcatggctgagtggttctggttca

SEQ ID NO: 55887 - DNA, 69 bp, Homo sapiens
cacgtgtgtctgtgtgtgtgtgaccatcctgcctgacaactgtcaccctaaaggccacagcctcacgtg

SEQ ID NO: 55888 - DNA, 88 bp, Homo sapiens
cctctggggttaaagcagatgggtatttagatttatttacaaactattttgtctacaataagtaaagtactgctgtccaccactgagg

SEQ ID NO: 55889 - DNA, 109 bp, Homo sapiens
catgttttgtagttttgtagatttgggtccagtacacattttgttatattttattcctaagtatttcattgttttactgctattgaaaacagtattgcagtcgggcgtg

SEQ ID NO: 55890 - DNA, 58 bp, Homo sapiens
tgagacgaagtctcactctgtcacccaggctggcgtgtagtggtgcgatcttggctca

SEQ ID NO: 55891 - DNA, 58 bp, Homo sapiens; identical to SEQ ID NO: 1868

SEQ ID NO: 55892 - DNA, 72 bp, Homo sapiens
tttgcttctgactagttgtgagaacttgggaagtggcttaacttttcagtactcactttcttcatctgtaaa

SEQ ID NO: 55893 - DNA, 101 bp, Homo sapiens
gtggtggcacatgcctgtagtcccaactacttgggaggctgaggtggaaggatcacttgagcccaggagtttgaggctgcagtgaaccatgattgcgccac

SEQ ID NO: 55894 - DNA, 86 bp, Homo sapiens
gaggctgtgcctgtgctggcttctgtctattcatctgtgcctctgactgaagagagagagagagagagagctggcaagaacacctt

SEQ ID NO: 55895 - DNA, 117 bp, Homo sapiens
gctgaagtggagtgggcacagtatcagtggagtagagctcacagaacaaagagaccagggttagactctggattttttttctgagaccgagtctatctctgttgcccaggctgaagt

SEQ ID NO: 55896 - DNA, 115 bp, Homo sapiens
tttattctttagtagagagacaatcatgtcacatgcaaaagataatcaaatgatctttttattatctttttctgatgttgggatgaacacaatgtcttttatccttaagaatgag

SEQ ID NO: 55897 - DNA, 117 bp, Homo sapiens
tatggacataaattaggctggtgcaaaaataactgcggtttttgccattttttttttttttttaagtaatgccaaaaatcacatttacttttgcaccaacctaatagtatgtgtata

SEQ ID NO: 55898 - DNA, 133 bp, Homo sapiens
gatggaggcaacactgctaagactaagtgtgaatatgccacacaccagggaaagtagtaagttgtatagttatcttctaattggggcctaatatccctaccccacaacaatacaacttactacctcaccctgg

SEQ ID NO: 55899 - DNA, 88 bp, Homo sapiens
tatgtgcttttataactgttttcttcatacatttaatggaatattggttgctatgtatgtttatgacagaagatagtcttggtagata

SEQ ID NO: 55900 - DNA, 95 bp, Homo sapiens; identical to SEQ ID NO: 68

SEQ ID NO: 55901 - DNA, 93 bp, Homo sapiens; identical to SEQ ID NO: 69

SEQ ID NO: 55902 - DNA, 87 bp, Homo sapiens
tccagtgcgcctggccctgcttgtgacttctaagaatttaaaaatttcttttttgaagtggagtctcactctgtcacccaggctgga

SEQ ID NO: 55903 - DNA, 64 bp, Homo sapiens
gcggagtctcactcactcagtgctcaatgttgcccaggctggagtgcagtggcgtgatctccgc

SEQ ID NO: 55904 - DNA, 58 bp, Homo sapiens; identical to SEQ ID NO: 315

SEQ ID NO: 55905 - DNA, 68 bp, Homo sapiens
gacagcaggtgctctcttctctctctgtctctcttttttttttctttgagacagagtctcgctctgtc

SEQ ID NO: 55906 - DNA, 58 bp, Homo sapiens
tgagatggactctcactctgtctcccaggctggagtgcagtggggcgatctcatctca

SEQ ID NO: 55907 - DNA, 110 bp, Homo sapiens
gggtggtggttgctgaaggctgaggtagctgtgacaatttctttctttcttttttttttgagatggagtttcggtcttgtcacacaggctggagtgcaatggtgcgatct

SEQ ID NO: 55908 - DNA, 83 bp, Homo sapiens
actcctggcctcaagcaatcctcctgctgccttggtgtcccaaagtgctaggatgagagatgtgagccaccacgccagcctgt

SEQ ID NO: 55909 - DNA, 70 bp, Homo sapiens
gagtggcgagagagggcattcttgtcttgtgccagttttcaaggggaatgcttccatcttttgcccattt

SEQ ID NO: 55910 - DNA, 122 bp, Homo sapiens
gggtgtgagccacccggccgctcttttttttttttttttttttgagacggagtctggctctgtcactcaggctggagtgcagtggcgccatctcagctcactacaacctccgcctcctgggt

SEQ ID NO: 55911 - DNA, 64 bp, Homo sapiens
tgtatgtatgtgtgtatatatgtgtgtatatatatatacacacatatatacacacatacacaca

SEQ ID NO: 55912 - DNA, 95 bp, Homo sapiens; identical to SEQ ID NO: 68

SEQ ID NO: 55913 - DNA, 93 bp, Homo sapiens; identical to SEQ ID NO: 69

SEQ ID NO: 55914 - DNA, 56 bp, Homo sapiens
ggtagggatatgtgtgtgtatatatatgttagtatacacatgtatagttccttatc

SEQ ID NO: 55915 - DNA, 115 bp, Homo sapiens
agttttatagtacatttggaaatcaggaaatgtgagtcctccaactttgttctttttaaatattttttggctattcagagtcccctgtgattccatatgaattttagtataagct

SEQ ID NO: 55916 - DNA, 85 bp, Homo sapiens
tatttcagtgggagaaactgcataggatactgactttttttttttttttaagacagagtcttgctctgttgcccaggctggagtg

SEQ ID NO: 55917 - DNA, 58 bp, Homo sapiens; identical to SEQ ID NO: 16534

SEQ ID NO: 55918 - DNA, 99 bp, Homo sapiens
catgattgtattatgtatatgtatatgtacatgtgtatatatataatatagtacatacattgtgttttatatatatatatgtgtatatatatatgtgta

SEQ ID NO: 55919 - DNA, 117 bp, Homo sapiens
ccatttccctcttgatgggcatgcaggtttcttggtacttttatttttcgttttattttattattattgttttttgagatgtagtctcgctctgttgcccaggctggagtgcagtgg

SEQ ID NO: 55920 - DNA, 114 bp, Homo sapiens
tgggctacaggcagagagattggcaaggaggctggtgtagtttattttattttattttattttagtgagataaaagcactcggccgggcgtggtggctcatgcctttaatccca

SEQ ID NO: 55921 - DNA, 58 bp, Homo sapiens; identical to SEQ ID NO: 35157

SEQ ID NO: 55922 - DNA, 69 bp, Homo sapiens
ggaggggtctctgcatggcagggtgcctggctttactcactgcctctctggccctgtcagctcctctct

SEQ ID NO: 55923 - DNA, 73 bp, Homo sapiens
gaggcagggtctcagtctgtctcccagtatggaatgtagtggtgcgctcttggctcactgtagtctctgcctc

SEQ ID NO: 55924 - DNA, 76 bp, Homo sapiens
gaaattttgatagggattgttttatatctgtacatccttttggatagtattgatgtattaacaatattaaatcttc

SEQ ID NO: 55925 - DNA, 90 bp, Homo sapiens
caatatatatttacatattacatacatatatacattatatatatatatgtatgctgtatgtgtgcatgtgtatgtgtatgtatcaggttg

SEQ ID NO: 55926 - DNA, 91 bp, Homo sapiens
caggaaagttgaacattagagcagccgggaattattcttattttttattacataatccaggatggttcccatttcagtgtgtagttttctg

SEQ ID NO: 55927 - DNA, 90 bp, Homo sapiens
ctcgcaaagatatagaactgcggctgatggtgatagtataggcccggggtttgtctgtagtgactgtgatgatctggaagtaggtgcgag

SEQ ID NO: 55928 - DNA, 95 bp, Homo sapiens; identical to SEQ ID NO: 68

SEQ ID NO: 55929 - DNA, 93 bp, Homo sapiens; identical to SEQ ID NO: 69

SEQ ID NO: 55930 - DNA, 79 bp, Homo sapiens
gcagtcagtgtgtgtccaggagacagacagacagacacacagacaaggtctaggtctcctctcattcccccactgctgt

SEQ ID NO: 55931 - DNA, 82 bp, Homo sapiens
tatgtgtatgtatgcacatatatgtatattaaagtatattaaacttttaaatcatgtgtgtatatgtgtatacatatatgta

SEQ ID NO: 55932 - DNA, 73 bp, Homo sapiens
cagcagtggggggatgggaggagacctagaccttgtctgtgtgtctgtctgtctcctggacacacactgactg

SEQ ID NO: 55933 - DNA, 74 bp, Homo sapiens
actcagctacaacctgtatgtaatactacttgtatttaaatagtagttaccacgtgccaggctttgtgttgggt

SEQ ID NO: 55934 - DNA, 81 bp, Homo sapiens
ctgatggtagtaggataacagggaaagagtaggatggtttctaaatctggggctggctctgactctgtgtctttgccagag

SEQ ID NO: 55935 - DNA, 109 bp, Homo sapiens
tgtatgacttatgcacctctctgtatatgtgctacatttcaatagagttttttaaaattttattttaagttccaggatacatgtgcaggatgtgcaagtttgtcacata

SEQ ID NO: 55936 - DNA, 98 bp, Homo sapiens
atgtatgtatgtatatatgtatgtgtatatatgtatgtatatacgtatgtatgtatatatacatatatgtatatacatatatatgtgtttatatatgt

SEQ ID NO: 55937 - DNA, 75 bp, Homo sapiens
gtggagctatgagaagagagtcaccatcttccagaccccacaatggtagatgtactgacagcttgcatagtacac

SEQ ID NO: 55938 - DNA, 117 bp, Homo sapiens
tgaattgaaacaaggtgagttgtatagatttttaaatagttgtatagattctattataaatttaatttttgagctggaaaataacttacaactcagtgtctgttctaacttcatctt

SEQ ID NO: 55939 - DNA, 114 bp, Homo sapiens
gctgtcttttctgtgttttactgtctgctctttctggctgcttgtagttagaagagaagtgatttccttgaaatgcttgaggctagaaagggagctggaacttaaagtggcagt

SEQ ID NO: 55940 - DNA, 109 bp, Homo sapiens
tgcctaggagtgtaatttctgggttgcatggtagttgcatgtttagttttctaaggaattactaaactattttaaagactgacagtgccattttacattctcattagca

SEQ ID NO: 55941 - DNA, 79 bp, Homo sapiens
gtgtcatgaccctaagggcatttgtctgtccctgtcactagactgtgaccactgcaggacactgtgtctgttttgccat

SEQ ID NO: 55942 - DNA, 79 bp, Homo sapiens
catatgatttgtgtgtgtatgtgtatatatataatatatatagcatatatatatatacacatgcacacatctatatatg

SEQ ID NO: 55943 - DNA, 129 bp, Homo sapiens
tagatatatgcactgtatataaacataatgtggtagatatatgcacgatataggtatgtatgtatgtatgtataaaagcagggcagtatatatatcgtgcatatatctaccacattttaaaggctctgc

SEQ ID NO: 55944 - DNA, 91 bp, Homo sapiens
gatggaaggagcctcaagtctctcaatcactgtcaaactgtgaggtggggcctgacaggagcagtggaggaaaaggtggtttaaggtcgtc

SEQ ID NO: 55945 - DNA, 91 bp, Homo sapiens; identical to SEQ ID NO: 55944

SEQ ID NO: 55946 - DNA, 107 bp, Homo sapiens
atatatgtatatgtatatgtgtatatgtgtgtgtgtacacacatatatatgtatatatatgtatatatatacacatatgtgtgtgtacacatatatatgtatgtata

SEQ ID NO: 55947 - DNA, 99 bp, Homo sapiens
gtatatatatcctttatatatccatatatatgtcctttatatatatatatccatatatatgtcctttatatatatatccatatatatccatatatatat

SEQ ID NO: 55948 - DNA, 115 bp, Homo sapiens
tcaggtttgttctttttgcttaggactgtcttggctatgtgggcacttttttggttccatatgaaatttaaagtagttttttccaattctgtgcagaaaatcaatggtagcttga

SEQ ID NO: 55949 - DNA, 66 bp, Homo sapiens; identical to SEQ ID NO: 8248

SEQ ID NO: 55950 - DNA, 80 bp, Homo sapiens
tactatttttttttggatgggtccttactggttccagtaatgctggtcagtacagagagtgatcacagacagtttgggta

SEQ ID NO: 55951 - DNA, 92 bp, Homo sapiens
tgtgtgtgtgtgtgtgtgtgtgtatatctgtatatacacatatatatttgtgtgtatgtatatatatatatctgtacatcatagaacattca

SEQ ID NO: 55952 - DNA, 117 bp, Homo sapiens
tggtacacatgtgcacaataggaaagcctaacaacaggccctgtcaacctgccacagtcaacagactgaagagacaacctgtagaatggaagaaaatatttgcaaactatgaatcca

SEQ ID NO: 55953 - DNA, 171 bp, Homo sapiens
cactatatatatatatatatatatatatatatatatatatatatatgtatatatatgtatatatatgtgtatatatacgtatatatatgtgtgtatatatatatacacgtatatatatgtgtatatatatatgtatatatatatgtgtgtatatatatatatatatgccca

SEQ ID NO: 55954 - DNA, 94 bp, Homo sapiens
atgaaatttttcagctgtttctaggaaagtatttattttttcttcgtgtctgaaagatactttcactagatatgctattctgggataagtttat

SEQ ID NO: 55955 - DNA, 67 bp, Homo sapiens
tacagagtctctctgtctcttctgagccatctaaagctgggagtggagtgacacaagaacctctgtg

SEQ ID NO: 55956 - DNA, 109 bp, Homo sapiens
tgcgaataaatataagaagaagatggccaataacctttcaaacatgagacaataaatgtctgttgtttaagccaatcagttgtggtactttgttatgttagccctagca

SEQ ID NO: 55957 - DNA, 104 bp, Homo sapiens
agccaggcggaatgcattaccaattgaaaatgcatgttttagttgaaagtttttaaattttagggaaaacaaaacacgtgtgagctttagttggtctgtaggct

SEQ ID NO: 55958 - DNA, 117 bp, Homo sapiens
tgggactccacactgtttcaccattgagtcatttctaccctcttatgtgtctcagtttctctctccaaagatctagcacctccaagagggctcaaggcacagaatgaccagctccta

SEQ ID NO: 55959 - DNA, 103 bp, Homo sapiens
ctaggttagtttaatccctggatacagagggccaactgtgtgtgtgtgtgtgtgtgtgtatatatatatacacaagccaataagtatctagctttatatgtag

SEQ ID NO: 55960 - DNA, 115 bp, Homo sapiens
tcagcctcccaagtagctggcaccacaggcgcacaccatcatacccatctaatgtttgtatttttagtagaaatgaggtttcaccatgttggccagactggccttgaactcctga

SEQ ID NO: 55961 - DNA, 95 bp, Homo sapiens; identical to SEQ ID NO: 68

SEQ ID NO: 55962 - DNA, 93 bp, Homo sapiens; identical to SEQ ID NO: 69

SEQ ID NO: 55963 - DNA, 97 bp, Homo sapiens
tgctatagtctgagagaatgttatgatttcagttcttttgcatctgctgaggtgtatttgacttctgattatgtaattaatttcagagtgagtggca

SEQ ID NO: 55964 - DNA, 292 bp, Homo sapiens
gtgtatatatttatacatatatgtgtatatgtttatacatatatatgtatatatttatacatatatatgtatatatgtataaatatatatatgcatatgtgtctatatacccatatatgtgtatatgtatatatacacatatatgtacacacatatatgtacatatatgtgtatatatacatatatgtgtatatgtgtatatacatatatgtgtatatgtgtatatatgtatatatgttatatatatgtgtatatatgtgtatatgtgtatatatgtgtatatatgttatat

SEQ ID NO: 55965 - DNA, 108 bp, Homo sapiens
tatatgtataaatatatacactataacaatattgttatatatatgtataacaaaattgttatatatatgtataacaatatatgtataacaatatatgttatatatata

SEQ ID NO: 55966 - DNA, 69 bp, Homo sapiens
atgcatatctatgaatatatctatgtacattatgtatctgtatatatgtatgtgtgtctaggtgtgtgt

SEQ ID NO: 55967 - DNA, 77 bp, Homo sapiens
acagattcccatgacatcacaaagggctaaggatcccaacaggactctctctgcctctatctgaaaggggagtctgt

SEQ ID NO: 55968 - DNA, 110 bp, Homo sapiens
ccaggcactttggcatctgtttccactaggatgagtctgaagtctgagtccacagaaactggactgacactgggccagccagtaacctaaggatgaaggagtggctctgg

SEQ ID NO: 55969 - DNA, 104 bp, Homo sapiens
ctgcagactctccagagcccagagacttcaaaggcggggactgtgagacaacaaagatagcacaccacccttcccactgggagctctgtctcagggagatacag

SEQ ID NO: 55970 - DNA, 96 bp, Homo sapiens
aggtgctttattgtgtagatttttttttttttgagatacagtctcactcttccccaggctggagtgcagtgggacagtctcagctcactgcaacct

SEQ ID NO: 55971 - DNA, 117 bp, Homo sapiens
gatatttgctctgccagtgcatctgaaaaatccacccgtagatttatttatttatttagttttattattattatactttaagttttagggtacatgtgcacaatgtgcaggtttgtt

SEQ ID NO: 55972 - DNA, 88 bp, Homo sapiens
catgtatttacaagcatattgtgtgtgggtatgtgtgtatcaggttttttttttttttttacacaaatggtggcatactatacatgct

SEQ ID NO: 55973 - DNA, 95 bp, Homo sapiens; identical to SEQ ID NO: 68

SEQ ID NO: 55974 - DNA, 93 bp, Homo sapiens; identical to SEQ ID NO: 69

SEQ ID NO: 55975 - DNA, 140 bp, Homo sapiens
tataagtatatatatttatatataggtatctataagtatatatatataggtatatatgtatatatataggtatatatgtatatatgtatatatacatatatatgtgtatatatatacatatatatgtatatatgtatata

SEQ ID NO: 55976 - DNA, 120 bp, Homo sapiens
atttctggaactgtacacagaattcatagttttatacatgtgcatgtgcttggagatatatatatatatacatacatacacatttgcatatggtcgtaaaggattcatgtctccataaat

SEQ ID NO: 55977 - DNA, 110 bp, Homo sapiens
gctttgattttttttctcttaggattgtcttggctacacaggctcatttttggttccgtgtgaaatgtaaagtagttttttctagttctgtgaagaaagtcaatagtagc

SEQ ID NO: 55978 - DNA, 84 bp, Homo sapiens
agataattgaggtttaatttttttctatttctgtaagaatgatgttggaattttgatagagatagcattgaatctctagttgct

SEQ ID NO: 55979 - DNA, 72 bp, Homo sapiens
taaaccagaccacttggagccaaagagatgtgtatgtgtgtgtgtgcatctgcttctgtgtgtgtgtgtttg

SEQ ID NO: 55980 - DNA, 97 bp, Homo sapiens
tattcggttggtgcaaaagtaattgtgattttgtaattgagattttgacattacttttaatggcaaaaatcacaattacttttgcaccaacctaata

SEQ ID NO: 55981 - DNA, 202 bp, Homo sapiens
atatatatatataaaacatttaaaatatatatgtgtataaaacattatatatgtgtatatatgtatatatgtgtatatatatgtgtatatatgcatgtatgtatatatatgtatctatgtgtatatatgtatatatatgtatatatgtgtatatacacacatatatacatatatattaaaatagatatatataaaacattta

SEQ ID NO: 55982 - DNA, 63 bp, Homo sapiens
gtctctcagtcacaccctctcaacaggaaaacccaagtgctgttggggaggttggctgatgat

SEQ ID NO: 55983 - DNA, 84 bp, Homo sapiens
agccaaagtgaacacctttatcttattccttatgaggaaaagctctcagcttttcaccattgagtctgatgttagctgtgggct

SEQ ID NO: 55984 - DNA, 122 bp, Homo sapiens
tacatatatacacgtgtatgtatgtatatacatatatacgtatatatgtgtatatatatacatatgtatatatgtacatatgtgtatacatatacgtatgtatatatgtacatatgtgtata

SEQ ID NO: 55985 - DNA, 116 bp, Homo sapiens
tgtagttttactgatatctatatctatatcactatatatatatcagtatatatatcagtatatatagatataagtatatagatatagatatagatatagatatcagtaaaactaca

SEQ ID NO: 55986 - DNA, 100 bp, Homo sapiens
gacactgatgttatgataggaaaagtattaaatctgtagattgcttagagcagtatggtaattttgtttatatttttccaatccaatagcatgggatgtt

SEQ ID NO: 55987 - DNA, 95 bp, Homo sapiens; identical to SEQ ID NO: 68

SEQ ID NO: 55988 - DNA, 93 bp, Homo sapiens; identical to SEQ ID NO: 69

SEQ ID NO: 55989 - DNA, 98 bp, Homo sapiens
tgtggtttgagattgtgctagatattttattttaaaaaatgcagtgaaaagggaacacttctacgctgctggatggaatgtaaactagtataaccacg

SEQ ID NO: 55990 - DNA, 95 bp, Homo sapiens
agaggtccttcaagtcccttgtaagttggattcctaggtattttattttctttgaagcaattgtgaatgggagttcactcatgatttggctctct

SEQ ID NO: 55991 - DNA, 88 bp, Homo sapiens
agatctaataatatttgctttatataactatgtgctccagcgttgggtgcatatatattttaaatagttatatattttaaatagatct

SEQ ID NO: 55992 - DNA, 99 bp, Homo sapiens
tttggttgaatgttgtacattatttattgggtaatagaaactgaggaatgcatacacaaattatttgtttttgtattcagtaagagtgaacaatccaaa

SEQ ID NO: 55993 - DNA, 100 bp, Homo sapiens
gaagaggtctttctcatcccttgtaagttggattcctaggtattttattctttttgaagcaattgtaaatgggagttcactcatgatttggctctctgtc

SEQ ID NO: 55994 - DNA, 95 bp, Homo sapiens; identical to SEQ ID NO: 68

SEQ ID NO: 55995 - DNA, 93 bp, Homo sapiens; identical to SEQ ID NO: 69

SEQ ID NO: 55996 - DNA, 215 bp, Homo sapiens
atatatatatatgtgtatatatatatatgtgtatatatatatgtgtatatatatatgtgtatatatatatgtgtatatatatatatgtgtatatatatatgtgtatatatatatgtgtatatatatatgtgtatatatatatatgtgtatatatatatgtgtatatatatgtgtgtgtatatatatatatgtgtatatatatatatatatgctac

SEQ ID NO: 55997 - DNA, 80 bp, Homo sapiens
atacagagtggtgagtgagggcatccttgtctcgtaccagatttcaaaggggatgcttccagtttttgcccattccgtat

SEQ ID NO: 55998 - DNA, 110 bp, Homo sapiens
gttaacaaagcctactgggtatgatactatcagttatgagtttgcaaagatagatatatctatatctatattcaaaaaatgtttagaaaaatgcttatgttttgtatagc

SEQ ID NO: 55999 - DNA, 100 bp, Homo sapiens
atgcacatacacacacacacatatgtgtatatatgtatatatgtgtatatgtgtatatatgtgtatatgtgtatatatgtgtgtgtgtgtgtgtgtgtgt

SEQ ID NO: 56000 - DNA, 75 bp, Homo sapiens
tatatatatatatatatacgtgtgtatatatatatatatatgtgtatatatatatgtgtatatatatatacacac

SEQ ID NO: 56001 - DNA, 123 bp, Homo sapiens
gttctttttgcttaggattgtcttggctatacagggtttttttattttagttccatatgaaatttaaagtagtttttttctaattctgtgaagaaagtcaatggtagcttgatggggatagca

SEQ ID NO: 56002 - DNA, 85 bp, Homo sapiens
gacatggcatgtaattacagacagaagtgtgactgtaaacatattagtgtttctgttagtgttggcataagcttgcctttttgtt

SEQ ID NO: 56003 - DNA, 89 bp, Homo sapiens
ctactttggtactttagctagtttgtcagcttccaggttgtattgtttgctgtgagctgaggtatggtgtacaaagatgcacagagtgg

SEQ ID NO: 56004 - DNA, 112 bp, Homo sapiens
tagcaaattttgtttgttgattttgtgctctccaactttactgaatttgttgatcatttctataagtattttggtagagtttttagggttttacatatataagatgatgtta

SEQ ID NO: 56005 - DNA, 113 bp, Homo sapiens
ttcctgatttggcttgtagcttcgaagttgttggtgtataggaatgctactgatttttgtacattaattttgtattctgaaactttgctgaagttttttatcaggccaaggag

SEQ ID NO: 56006 - DNA, 95 bp, Homo sapiens; identical to SEQ ID NO: 68

SEQ ID NO: 56007 - DNA, 93 bp, Homo sapiens; identical to SEQ ID NO: 69

SEQ ID NO: 56008 - DNA, 64 bp, Homo sapiens
cccaggcactctgggcctctgggcactcaggcactctggcactcaggcactcaggcactctggg

SEQ ID NO: 56009 - DNA, 111 bp, Homo sapiens
ccccttccctcctggggctttcttgccactgtggggtgcccccagtgggtgagacacgcacactgggtgaaatccagggactgcaagaatccttcgagcccagcacagggg

SEQ ID NO: 56010 - DNA, 83 bp, Homo sapiens
gtccctggatttcacccagtgtgcgtgtctcacccactgggggcaccccacagtggcaagaaagccccaggagggaaggggac

SEQ ID NO: 56011 - DNA, 72 bp, Homo sapiens
ctcccacccagggtgtgtgtctctttcactgaaggcaccccaaagtggaaagaagttcaccaagggatggag

SEQ ID NO: 56012 - DNA, 87 bp, Homo sapiens
gtctcaacctctgcctaaaaccctggctgcctgtttccgacccctggagtacttcttgcagctcggggggactttgcttggagaggc

SEQ ID NO: 56013 - DNA, 96 bp, Homo sapiens
tgagtaatgtcattctttattaaaaatgtatatgtatatatgtgtacacaaaagtatacatatatgtgtatatatcctaaatgattctattattta

SEQ ID NO: 56014 - DNA, 93 bp, Homo sapiens
tttcttttcattcagcaatttggaaacaatgtttttgtatagtctgcaaaaggatattttgcatcacattgagacctatggtgaaaaaggaaa

SEQ ID NO: 56015 - DNA, 113 bp, Homo sapiens
gtgtgcgttcatcacgcagagttacaactttcacttcactgagcagtttttcaaaactgtttttgtagaaactgagaagggaattttgggagcaggtggaggcctatggtgaa

SEQ ID NO: 56016 - DNA, 95 bp, Homo sapiens; identical to SEQ ID NO: 68

SEQ ID NO: 56017 - DNA, 93 bp, Homo sapiens; identical to SEQ ID NO: 69

SEQ ID NO: 56018 - DNA, 107 bp, Homo sapiens
ctatggaaacctatgctcctcaaaacacacattctcacatatacacgtatatctgtatttgtatttgtgaatatgtctatgtatgtgtaaatgtgtccatagctttc

SEQ ID NO: 56019 - DNA, 349 bp, Homo sapiens
tatatctgtatatacgtgtgtatacatatgtgaatctatgtgtgtgtgtacatgtaaatatatgtgtatatgtatatatgtgtatatgtgtgtatatatagtgtgtatatatgtgcatctatgtgtgtgtgtacatgtaaatatatgtgtatatatgtatatatgtgtatatgtgtgtatatatagtgtatatatgtgcatctatgtgtgtgtgtacgtgtaaatatatgtgtatatgtatatatgtgtatatgtgtgtatatatagtgtgtatatatgtgcatctatgtgtgtgtacatgtaaatatatgtgtatatatgtatatatgcatatatatagtgtatatat

SEQ ID NO: 56020 - DNA, 101 bp, Homo sapiens
tgctaataaaggttatctggtgttggaaaacatattttatttttacatgtacatagtaggtgtatatatttgtgggtacatgagatattttgatataggca

SEQ ID NO: 56021 - DNA, 204 bp, Homo sapiens
tatatgtatatatgtgtggacatatgtatatatttgtgtgtatgtgtatatagtgtgtatatatgtgtatatatgtatatatgtgtatatatgtatatatatcagtgtatgtatgtgtgtatatatgtatatatgtgtatatatgtatatatatcagtgtatgtatgtgtgtatatatgtatatatgtgtatatatgtatatat

SEQ ID NO: 56022 - DNA, 262 bp, Homo sapiens
gtgtgtatatatgtatatatgtgtatatatgtttatatatcagtgtatatctgtgtatatatgtatatctgtgtatatatgtgtgtatatatgtatatatgtgtatatatgtatatatatcagtgtatatatgtgtatatatgtatatctgtgtatatatgtatatctgtgtatatatgtgtgtatatatgtatatatagtgtatatatgtgtgtatatatatgtacatatgtatgtatatgcacatatgtatatatatgca

SEQ ID NO: 56023 - DNA, 135 bp, Homo sapiens
gggtcatggggtctgtcattttctcttattttaattattattcatttatttatttttgagacagtgtctcactctgtcacccaggctggagtgcagtggtgcaatctcagctcactgcaacctccacctcccggg

SEQ ID NO: 56024 - DNA, 100 bp, Homo sapiens
ggccacacttcggggtacatctcataaagtagacaaacacagatgaaggtcacctgtctgactcactgtatgtaaacctctcagaaattcacccttggct

SEQ ID NO: 56025 - DNA, 61 bp, Homo sapiens
tatatatatggtttgtgtgtgtgtatatatatatatacacacacacacatacatatatata

SEQ ID NO: 56026 - DNA, 99 bp, Homo sapiens
tatgtaaatatctatagctatatctttttatatatctatatctatatatttccatgtgtgtatatagatagatataggtatcaaaacaagtattatata

SEQ ID NO: 56027 - DNA, 72 bp, Homo sapiens
ctgggcgtggaggcacacacctgtagacccagctactgaggaggctgaggtagcaggatctcttgagctcag

SEQ ID NO: 56028 - DNA, 126 bp, Homo sapiens
tgtgtgtgtctgtgtatgtgaatatattatgtgtgtgtgtgtctgtgtatgtgaatatgtgtatatatatatttatgtgtatatacatatacacacacacacacacacacaaaatgacagaattac

SEQ ID NO: 56029 - DNA, 117 bp, Homo sapiens
gtatgttatataatatatagattataatttataaatatgtcttaatatatgtatattatgtaagttatatgacatatatttacatgtttatctagaagtattttacatataatatat

SEQ ID NO: 56030 - DNA, 156 bp, Homo sapiens
gtgtgtgtgtgtgtagtgtgtgtatatatacacacaaaacacccagataccgataagtatatatatatatatatgcacacacacacctatatatgcacacatatatatgtatatatacgtgtgtgtgtatatatatatgtatatatatatatatat

SEQ ID NO: 56031 - DNA, 58 bp, Homo sapiens; identical to SEQ ID NO: 2531

SEQ ID NO: 56032 - DNA, 79 bp, Homo sapiens
tatatatatacacatatacattcatctatatatgtgtatatatacacatgtgggtgtgtgtattatgtgtatatatgta

SEQ ID NO: 56033 - DNA, 104 bp, Homo sapiens
ttcatctcacaggattgaagctttcttttgactgatcagttttgaaacagtcttttacaggatctgcaagtggttatttggagcgctttgaggcctatggtgga

SEQ ID NO: 56034 - DNA, 95 bp, Homo sapiens; identical to SEQ ID NO: 68

SEQ ID NO: 56035 - DNA, 93 bp, Homo sapiens; identical to SEQ ID NO: 69

SEQ ID NO: 56036 - DNA, 56 bp, Homo sapiens; identical to SEQ ID NO: 9059

SEQ ID NO: 56037 - DNA, 68 bp, Homo sapiens
ttgtgtgtgtgtctctattactttatttatttttattatactttaagttttagggtacatgtgcacaa

SEQ ID NO: 56038 - DNA, 108 bp, Homo sapiens
gatccgatggttttaaaagtgcctggtatttcccctcctgtcactcattctctctcctgccctgtgaagaggtgtgttctgccatgattgtaagtttcctgaggactc

SEQ ID NO: 56039 - DNA, 103 bp, Homo sapiens
gtctgcattttagaataaccatgcttatttctgtaaacaccccagtcatgtctggctgcaggtcacaagacaaaatagggatgagtaatgtaaaaatctggac

SEQ ID NO: 56040 - DNA, 58 bp, Homo sapiens; identical to SEQ ID NO: 5651

SEQ ID NO: 56041 - DNA, 95 bp, Homo sapiens; identical to SEQ ID NO: 68

SEQ ID NO: 56042 - DNA, 93 bp, Homo sapiens; identical to SEQ ID NO: 69

SEQ ID NO: 56043 - DNA, 257 bp, Homo sapiens
tatatatgtatatatacacatatatatttatatatgtgtatatatacatacataaatatgtgtatatatacatatataaatatgtgtatatatacatatatgtgtatatatgtgtatatatacatatatatgtgtatatatgtataaatatatatgtatatatttacatatataaatatatatatgtatatatttacatatataaatatatatgtatatatttacatatataaatatatatgtatatatttacatat

SEQ ID NO: 56044 - DNA, 93 bp, Homo sapiens
atgggattgaggtcaagttgtagtactgttttaagttctttgagaaatctccaaactgcttttcacagtggctgaactaatttacattcccat

SEQ ID NO: 56045 - DNA, 118 bp, Homo sapiens
ttgtaactttattccactatggtccaacaagatacttgatataatttcaattttttttttaatttattgaatcttgctttgtcacctattatgtggtttatttggaggaaagttccaa

SEQ ID NO: 56046 - DNA, 108 bp, Homo sapiens
ctctttcgcttatgaagcttagtttggctggatatgaaattctcggttgaaaatttttttctttaagaatgttgaatattggcccccactctcttctggcttgtaggg

SEQ ID NO: 56047 - DNA, 72 bp, Homo sapiens
gtggggagcagagtttcaaggcagcacagggcactagcatctcaatttgttcttgaaacagttttgtcctac

SEQ ID NO: 56048 - DNA, 58 bp, Homo sapiens
tgagacagagtctcgctctgtggctcaggctggagtgccatggcgggatctcagctca

SEQ ID NO: 56049 - DNA, 105 bp, Homo sapiens
gtaatgacactagctgttggcctcttgtatatgactttttttttcctttttttaaattacactttaagttctagggtacatgtgcacaacgtgcaggtttgttac

SEQ ID NO: 56050 - DNA, 83 bp, Homo sapiens
caggtaccgggaggccagaaggctggttgggaatatctgtcaaaccgtaattgaggagctctgtctctctgtctctgcacctg

SEQ ID NO: 56051 - DNA, 95 bp, Homo sapiens; identical to SEQ ID NO: 68

SEQ ID NO: 56052 - DNA, 93 bp, Homo sapiens; identical to SEQ ID NO: 69

SEQ ID NO: 56053 - DNA, 77 bp, Homo sapiens
gagtatctgcagaatgggagaaaatacttgaaatacatgcatcatggagtttttgtacttcatctctgtagatattc

SEQ ID NO: 56054 - DNA, 95 bp, Homo sapiens; identical to SEQ ID NO: 68

SEQ ID NO: 56055 - DNA, 93 bp, Homo sapiens; identical to SEQ ID NO: 69

SEQ ID NO: 56056 - DNA, 84 bp, Homo sapiens
gtatatgtatatacgtatatacatatacacatatatatgtatgtgtatatgtatgtgtatatgtatgtgtgtgtatatgtatat

SEQ ID NO: 56057 - DNA, 170 bp, Homo sapiens
atatacacatacatgtgtatatatgtatatacgtatatacatgtacacatatgtgtatatgtatatacatatatacacatatgtgtatgtttatatatgtatatacatatatacagatatatgtgaatatatgtatatatgtatatacatatacagatatgcgtatatgt

SEQ ID NO: 56058 - DNA, 98 bp, Homo sapiens
tgtatatgtatatacatacatatatacgcatatatctgtatatgtatatacatatatacatgcatatacgcatatctgtatatgtatatatatacgca

SEQ ID NO: 56059 - DNA, 100 bp, Homo sapiens
tgtatatacatatgcagatatatgtgtatgtatatgtatatatgtatatgtatatacagatatatgtgtatgtatgtacatatatgtatatacatatata

SEQ ID NO: 56060 - DNA, 122 bp, Homo sapiens
tatatatatgtacatacatatacacatatatatgtgtatatctatgtatatgtaagtaaatacttaataaactcccctatatatgtatatacatatatgtacatacatacacatatatctgt

SEQ ID NO: 56061 - DNA, 83 bp, Homo sapiens
tacatttttctgggctggaacatgaaccacacagttttaagccccctgtcctctgtgtgtgtatgtgtgtgccatatcttgta

SEQ ID NO: 56062 - DNA, 117 bp, Homo sapiens
ccagagcctagtatgtctgggttggtctgtgcctgtgtgcctgtctatctgtctctttcaccctaccatctctggacgtgtcttagctacaatggagcagggagagcagtgagcata

SEQ ID NO: 56063 - DNA, 87 bp, Homo sapiens
gtgtgtgtgtgtgtatgtgaagtgggagctctgcttgcaactaaccaggttcctctcagtccctcacattcacctttgtatccacac

SEQ ID NO: 56064 - DNA, 68 bp, Homo sapiens
gcctttcagtgtctgtctgtgtttttgcatagtttgtctgtgagcaagtgtgattggacacataaggc

SEQ ID NO: 56065 - DNA, 103 bp, Homo sapiens
tgtactgtggagtaggaatttattgagtgagtttaagtaaattcagaattaattttttttaaatctgaacttacttgtcagtaaaacacctgaaagcagtacg

SEQ ID NO: 56066 - DNA, 58 bp, Homo sapiens; identical to SEQ ID NO: 315

SEQ ID NO: 56067 - DNA, 95 bp, Homo sapiens; identical to SEQ ID NO: 68

SEQ ID NO: 56068 - DNA, 93 bp, Homo sapiens; identical to SEQ ID NO: 69

SEQ ID NO: 56069 - DNA, 92 bp, Homo sapiens
catggcagaactcttgtgtagtcccagctattcagaaggctgaggtaggaggatcacttgagcctaggatgttgaggctgcagtgagccatg

SEQ ID NO: 56070 - DNA, 95 bp, Homo sapiens; identical to SEQ ID NO: 68

SEQ ID NO: 56071 - DNA, 93 bp, Homo sapiens; identical to SEQ ID NO: 69

SEQ ID NO: 56072 - DNA, 84 bp, Homo sapiens
actagttacatgttaatacagagtatggattctgctgttgttaggcggagtttttttaatatatttcttttaggtgtaattggt

SEQ ID NO: 56073 - DNA, 99 bp, Homo sapiens
gtaatatatatgtctgtgtgtatgtatgtatgtgtgtgtatatatatgtatatatatatgtatatatatatatatatataatcataataaaataattac

SEQ ID NO: 56074 - DNA, 92 bp, Homo sapiens
tctatctatctatctatctatctatatctatatctgtctatctatctatcttaaatggagaggtgtgtgtgaaagaaagagagagagacaga

SEQ ID NO: 56075 - DNA, 95 bp, Homo sapiens; identical to SEQ ID NO: 580

SEQ ID NO: 56076 - DNA, 93 bp, Homo sapiens; identical to SEQ ID NO: 69

SEQ ID NO: 56077 - DNA, 167 bp, Homo sapiens
gtacaatttatatacatacatacatacgtatatatgtatatacatatatatgtatatacatatatatatgtttatacatatatgtgtgtatatgtgtatatatatatgtatgtgtatatatatatatatatatatatatatatatatatatatatatatataaatgt

SEQ ID NO: 56078 - DNA, 124 bp, Homo sapiens
ggaagcaacatgcctggctagtgagcgcacagggttgcacatggacagtgaacctggctggtgagtgtgctgactgtgcacatcactgggcagtactcagtttctttacttggcaagattacct

SEQ ID NO: 56079 - DNA, 238 bp, Homo sapiens
tatatatatatagagagaaagtgagacatatgctatctctctgtctctctctgtacatatatatacatatatgtatatatttgtatatctatctgtagatatatatcatatacatgtacatatatgtatatctatctgtagatctatatatcatatacatgtacatatatgtatatatatgtacagagagagaaagatataaatctctctatgtatatatatatatatatatagatat

SEQ ID NO: 56080 - DNA, 95 bp, Homo sapiens; identical to SEQ ID NO: 68

SEQ ID NO: 56081 - DNA, 93 bp, Homo sapiens; identical to SEQ ID NO: 69

SEQ ID NO: 56082 - DNA, 131 bp, Homo sapiens
catatatatacatatgacatatagtcatgtatatgtatactatatatgtatatatatgactgtatatagttctctacatatatagatctatatatatagaaataataagatatatatatatcctatacata

SEQ ID NO: 56083 - DNA, 95 bp, Homo sapiens; identical to SEQ ID NO: 68

SEQ ID NO: 56084 - DNA, 93 bp, Homo sapiens; identical to SEQ ID NO: 69

SEQ ID NO: 56085 - DNA, 82 bp, Homo sapiens
ttttgtatatggtgagagatagtgatctagttttattcttcttcatatggctagaaattttttccagcaccatttaataaaa

SEQ ID NO: 56086 - DNA, 107 bp, Homo sapiens
tttttctttgacatgtaatatttgtatttattattattttattgtaattatattttgggggtacagtgtgattttgatacatgtgtacaatgtgtaataaaggagaa

SEQ ID NO: 56087 - DNA, 100 bp, Homo sapiens
tgtaggctcttttttggttccatatgaaatttaaagtagttttttctaattctgtgaagaaagtcaatggtagcttgatggggagagcattaaatctata

SEQ ID NO: 56088 - DNA, 116 bp, Homo sapiens
tgcccccctctctctttctctgaggatagattgagccatctcatcacccactatttttttttttttttttttgagacggagtctcgctctgtcgcccagactggagtgcagtggca

SEQ ID NO: 56089 - DNA, 117 bp, Homo sapiens
gatttgtacttttattgcaccatggtccaagagtatatttggtatgacttaaattttttttaaatgtactgagacttgctttatggctgaccatgtaattgatcttggagtatattc

SEQ ID NO: 56090 - DNA, 79 bp, Homo sapiens
gtaatgctatatatattgcactgtatatagcatatacagcatatatttatatatatattgcactatacatagcatgtac

SEQ ID NO: 56091 - DNA, 91 bp, Homo sapiens
agatatgtatgctatatatatatatatatatttatatgctgtacatgctatgtatagtgcaatatatatataaatatatgctgtatatgct

SEQ ID NO: 56092 - DNA, 101 bp, Homo sapiens
atatatatatatatatgtgtgtatatatatatatatgtacacatacatgtatatatatatgtacacatacatgtatatatatgtacacatacatgtatata

SEQ ID NO: 56093 - DNA, 89 bp, Homo sapiens
acagataacagcccatgtatgtatgtatgtatatatgtgtatatacatacggtagatatatatatatatgtaactttgtatttatttgt

SEQ ID NO: 56094 - DNA, 93 bp, Homo sapiens
gtagttgtgaggaagatgttagtaatgatgattagcttcctgagaagccaaggatgatgatgatgatgatgatgatgacttactcagaattcc

SEQ ID NO: 56095 - DNA, 118 bp, Homo sapiens
ttttgccttctgccatgattgtgaggcctccccagccatgttgaactgtgagtccattaaatgtctttttgtttataaattacccagtttgggatatgtctttatcatcagtgtgaaa

SEQ ID NO: 56096 - DNA, 116 bp, Homo sapiens
tcattgtggttttgatttgcatttctctgaagaccagtgatgatgagcttttttttatatgtttgttggctgcataaatgtcttcttttgagaaaaactgaaagcattccctttga

SEQ ID NO: 56097 - DNA, 101 bp, Homo sapiens
tctagcctataacaagtccttggttagtggggcctgaattaatgaaattttgttgtactgtaatttggaccccactgattcagaatttgtaataattcaga

SEQ ID NO: 56098 - DNA, 107 bp, Homo sapiens
tcccttacaagtgcagtccacaatagggtttgcgctcctgtgagaatctaatgctgctgctgatctgacaagagacagagctcaggtggtaatgtgagcaatgggga

SEQ ID NO: 56099 - DNA, 114 bp, Homo sapiens
ctgtgtcttttaattggagcatttagcccatttacatttaaggttaatattgttatgtgtgaatttgatcttgtcacgatattagctggttattttgttcattagttgatgcag

SEQ ID NO: 56100 - DNA, 126 bp, Homo sapiens
ccagctttgttctttttgcttaggattgtcttggctatgcaggctcttttatggttccatatgaaatttaaagtagttttttctaattctgtgaagaaagtcaatggtagcttgatgataatagta

SEQ ID NO: 56101 - DNA, 74 bp, Homo sapiens
ggccgtctcctctgtgtctgtgtcttccctgctgtctcttagaaggacacctgtcactgggtttacggactgcc

SEQ ID NO: 56102 - DNA, 95 bp, Homo sapiens; identical to SEQ ID NO: 580

SEQ ID NO: 56103 - DNA, 93 bp, Homo sapiens; identical to SEQ ID NO: 69

SEQ ID NO: 56104 - DNA, 95 bp, Homo sapiens; identical to SEQ ID NO: 68

SEQ ID NO: 56105 - DNA, 93 bp, Homo sapiens; identical to SEQ ID NO: 69

SEQ ID NO: 56106 - DNA, 95 bp, Homo sapiens; identical to SEQ ID NO: 68

SEQ ID NO: 56107 - DNA, 93 bp, Homo sapiens; identical to SEQ ID NO: 69

SEQ ID NO: 56108 - DNA, 136 bp, Homo sapiens
tttggaagatcaaataggcaagattagccacgaaaaaaattttttttttgtggtggagtctcgctctgtcacccagtctggagtgcagtggcgtgatctcggctcactgcaacctctcgatttcgagcgattctcc

SEQ ID NO: 56109 - DNA, 76 bp, Homo sapiens
tgtggttccatacaaattttgcaattacttttttatattttgtaagaaatgtcattgtattttgatggaaattgca

SEQ ID NO: 56110 - DNA, 81 bp, Homo sapiens
gctttctgttattttattgtattttttgagacagggtcttgctctgttgcccatgcttgagtgcagtggcacagtcatggc

SEQ ID NO: 56111 - DNA, 77 bp, Homo sapiens
ggaagtttgttgtatagattatctaatcacccaggtattaaacatggtacctgataggtaatctttcacctctctcc

SEQ ID NO: 56112 - DNA, 88 bp, Homo sapiens
tctggcactccctagtgagatgaacctggtacctcagatggagatgcagaaatcacccttctgagtcactcacactgggagctgtaga

SEQ ID NO: 56113 - DNA, 111 bp, Homo sapiens
gatttgcatttctctgatggccagtgatggggttgtttgttttttttcttgtaaatttgtttgagttcattgtagattctggatattagccctttgtcagatgagtaggtt

SEQ ID NO: 56114 - DNA, 107 bp, Homo sapiens
ggtatatatctaacagtgggattgctggaacatatggtagttctatttttctttttttgaggaacttctaaactgttttcatagtggttgtactaatttacattacc

SEQ ID NO: 56115 - DNA, 122 bp, Homo sapiens
tgccttcttgattttttgtctaatttttctgtttgttataaaatgtatagaactatctatttctatcgattctgtcaaggtgaagggggaagaagatatattgtaagttatggcacacagga

SEQ ID NO: 56116 - DNA, 116 bp, Homo sapiens
gactggttgtcccgctttcctcaggttttcttctgccatctgtgacagcttcttgatctgtccttaggtgggtggctgtgttcgacaggtgttcctcctgacagttggggtcctcc

SEQ ID NO: 56117 - DNA, 270 bp, Homo sapiens
tgtgtatatatgtatatgtatacatatgtgtatatatgtatatgtatacatatgtgtatatatgtatatatatatacatatgtgtatatatgtatatgtatacatatgtgtatatatgtatatatatacatatgtgtatatatgtatatatatacatatgtgtatatatgtatatatatacatatgtgtatatatgtatatatatacatatgtgtatatatgtatatatatacatatatacacacacacacatatatatatatacacata

SEQ ID NO: 56118 - DNA, 215 bp, Homo sapiens
acatatatatgtatgtgtatatatatatatgtgtgtgtgtgtatatatgtatatatatacatatatacacatatgtatatatatacatatatacacatatgtatatatatacatatatacacatatgtatatatatacatatatacacatatgtatatatatacatatatacacatatgtatacatatacatatatacacatatgtatatatata

SEQ ID NO: 56119 - DNA, 69 bp, Homo sapiens
gtgctgaggcagtagtatctgagctcaaagtcatcaatgggcgagatggtgtggtcattgccaaagcac

SEQ ID NO: 56120 - DNA, 77 bp, Homo sapiens
cagggtggaagggctggaacataaaacataaagtctgtctctctgtgtgtgtgtgtatgggcatgttcctgtacctg

SEQ ID NO: 56121 - DNA, 86 bp, Homo sapiens
ctgctgctttgattccaggtgattttattttttttatttttttatgttttttgagatagagtcttgctctgttgcccaggcaggag

SEQ ID NO: 56122 - DNA, 133 bp, Homo sapiens
cctccagctttgttcttcttgcttaggattgtctgctatgtgggctcttttttggttccatatgaaatttaaagtagtatttttctaattgtgtgaagaaagtcaattgtagcttgatggggatagcattgaa

SEQ ID NO: 56123 - DNA, 86 bp, Homo sapiens
gggtgaaccaagtgtacagagcatgggtacagtggagagatgatgactcacactctgcctctgagacccaggtccacatgccaccc

SEQ ID NO: 56124 - DNA, 95 bp, Homo sapiens; identical to SEQ ID NO: 68

SEQ ID NO: 56125 - DNA, 93 bp, Homo sapiens; identical to SEQ ID NO: 69

SEQ ID NO: 56126 - DNA, 58 bp, Homo sapiens; identical to SEQ ID NO: 1673

SEQ ID NO: 56127 - DNA, 58 bp, Homo sapiens; identical to SEQ ID NO: 1673

SEQ ID NO: 56128 - DNA, 113 bp, Homo sapiens
caggagtagggtggtattgcattgtggttttaatttgcatttccctgatagtgatgttgaacattttttatatgtttttatatgtttgttggccatttgtatatcttcttttg

SEQ ID NO: 56129 - DNA, 80 bp, Homo sapiens
tgagttagagtctctctctgtcacccaggctggagtgcagtggcacgatcttggctcactgcaacatctgcctcctgggt

SEQ ID NO: 56130 - DNA, 120 bp, Homo sapiens
ggcctggcctcctgcagtgccacgctccgtgtatttgacaagctgagttggacactccatgtggtagagtgtcagtttgtcaaataccccaagtgcggcacatgcttaccagctctaggc

SEQ ID NO: 56131 - DNA, 117 bp, Homo sapiens
tatatatatatatatatatcacagtattccatgtatatatatatatatatatatatatatatatatatatatatacatggaatactgtgatttatatgtaatggaatactatatata

SEQ ID NO: 56132 - DNA, 109 bp, Homo sapiens
tatatatacacatatatatacatatatacacatatatacgcgtatatatgtatatatacatatgcgtatatatacgtatacgcatatatgcgtatatatacgtatacgc

SEQ ID NO: 56133 - DNA, 87 bp, Homo sapiens
gtatacgcatatatgcgtatatatacgtatacacatatgcacatatgtgtatatatgtatatatgcacatatgtgtatatatgtatg

SEQ ID NO: 56134 - DNA, 60 bp, Homo sapiens
atgtatatatgtatacatgtatatatacacatatatgtatatatgtatacatgtatatat

SEQ ID NO: 56135 - DNA, 115 bp, Homo sapiens
gtccacatcatctaatttagtccatgtacaagagttcttagacactcagaaacacacacagtttctagaactgaggacaattctacagcttacaaaaccatcatggatgatgggc

SEQ ID NO: 56136 - DNA, 95 bp, Homo sapiens; identical to SEQ ID NO: 68

SEQ ID NO: 56137 - DNA, 93 bp, Homo sapiens; identical to SEQ ID NO: 69

SEQ ID NO: 56138 - DNA, 95 bp, Homo sapiens; identical to SEQ ID NO: 68

SEQ ID NO: 56139 - DNA, 93 bp, Homo sapiens; identical to SEQ ID NO: 69

SEQ ID NO: 56140 - DNA, 120 bp, Homo sapiens
gtgtatatatatgtgtacacgtatatgtgtatacgtatgtgtgtatatatgtgtatacatatgtgtgtatatatgtgtatgcacatatatgtgtgtatgtatatacacatatatgtatat

SEQ ID NO: 56141 - DNA, 70 bp, Homo sapiens
acacacacatatatatacacacatatatatacatatatgtatatatatgtgtgtatatatatgtgtgtgt

SEQ ID NO: 56142 - DNA, 70 bp, Homo sapiens; identical to SEQ ID NO: 56141

SEQ ID NO: 56143 - DNA, 85 bp, Homo sapiens
gtgtatatatgtgtatatatgtgtatatgtgtatatgtgtatatataggtatatatgtgtgtatatatgtgtatatatatgtata

SEQ ID NO: 56144 - DNA, 120 bp, Homo sapiens
gtgagacagaatctcattgtggttttgatttgcatttctctaatgatcagtgatgttgagttttttttttttcatatgattgttggcagcatgtatgtcttttgagaagcgtctgttcat

SEQ ID NO: 56145 - DNA, 112 bp, Homo sapiens
ggattgtcttagctattccggctcttttttggttccatatgaaatttaaagtagttttttagaattctgtgaagaaagccaatggtagcttaatgggaatagcattgaatct

SEQ ID NO: 56146 - DNA, 85 bp, Homo sapiens
tgtgtgcatttttctgtatgtgtgtgcatgtttgtatatgcttatatatgtgtgtgtttatgtgtgttcacatgtgatgcatgta

SEQ ID NO: 56147 - DNA, 95 bp, Homo sapiens; identical to SEQ ID NO: 6311

SEQ ID NO: 56148 - DNA, 102 bp, Homo sapiens
ggcagaggtgagtgctggggaaagttttgcagaaaggtgaaaaccttaattatgactggaagagttgagaaattctgagctctcattttgaaattacaagcc

SEQ ID NO: 56149 - DNA, 80 bp, Homo sapiens
actctagtatttgatggtatatatatatatatatatatatatatatatatatatatatataccattgaatactagtcagt

SEQ ID NO: 56150 - DNA, 112 bp, Homo sapiens
ttggggatgttcttcttgtggagtatttcactggggcaatctgtatttttctaaatttaaatgttggcctttttagtgaggatagaaaactttccatggatgatattctcaa

SEQ ID NO: 56151 - DNA, 95 bp, Homo sapiens
cacttttcggatattataaataatgtttctatatttgtatacaagtattgtgtgtacatatgtttttaattatattgagtatatatctaggagtg

SEQ ID NO: 56152 - DNA, 70 bp, Homo sapiens
aatatatatgtgtatatatacatatacacacatgtgtgtgtatatgtatatatacacacaaacgtgtgtt

SEQ ID NO: 56153 - DNA, 95 bp, Homo sapiens; identical to SEQ ID NO: 68

SEQ ID NO: 56154 - DNA, 93 bp, Homo sapiens; identical to SEQ ID NO: 69

SEQ ID NO: 56155 - DNA, 146 bp, Homo sapiens
tatgtatagatatgtaaatgtaactatatatgttacacatagttttatatgttatagatatatatttatatatagttttacatatatgtatatataaatataactatatatagtcatatatagttttatatatgtaaaactgtata

SEQ ID NO: 56156 - DNA, 96 bp, Homo sapiens
atatatatatatgtatgtatgtgtgtgtgtatatatatatatatatatacacacacacatacatacatatatatatatatatttatacatacatac

SEQ ID NO: 56157 - DNA, 95 bp, Homo sapiens; identical to SEQ ID NO: 68

SEQ ID NO: 56158 - DNA, 93 bp, Homo sapiens; identical to SEQ ID NO: 69

SEQ ID NO: 56159 - DNA, 78 bp, Homo sapiens
ttgtaagtatatatgcatagtgtatatgtagtatatatgtatgtatatactatatataatagctatatactgtctcaa

SEQ ID NO: 56160 - DNA, 76 bp, Homo sapiens
tatactatacatgtaatatatatacactgcatatactatactatgcatatagtgtatatatgtatatgtatgtata

SEQ ID NO: 56161 - DNA, 110 bp, Homo sapiens
tatagtatacatacatatagtatgtattgtgtatagtgtacgtatattatactatatatgtatataatatgcatactatatacacatagtatatgtgtgtatatactata

SEQ ID NO: 56162 - DNA, 222 bp, Homo sapiens
acacacatagtatatactatatagtgtatatatattgtatatactatatagtatatactatatgtgtatatatattatatatactatatagtatatactatatgtgtatatatattgtatatacatatagtatatactatatgtgtatatatattatatatactatatagtatatactgtatgtgtatatatattgtatatactatatagtatatactgtat

SEQ ID NO: 56163 - DNA, 82 bp, Homo sapiens
ttggggcagaaagaaacagcttagcaccgggtcattccctgcccacccgcgtggtctgatcacactgagctctctgctccgg

SEQ ID NO: 56164 - DNA, 95 bp, Homo sapiens; identical to SEQ ID NO: 68

SEQ ID NO: 56165 - DNA, 93 bp, Homo sapiens; identical to SEQ ID NO: 69

SEQ ID NO: 56166 - DNA, 86 bp, Homo sapiens
atatagatatagatagatatagatacagatatagatatatagatatagatatatctgtatatgtatatgtatatatatacatatat

SEQ ID NO: 56167 - DNA, 63 bp, Homo sapiens
gaatcggtcagtatttttttttaacaaagcatggcagccatgtctttgtaaactgatcagttc

SEQ ID NO: 56168 - DNA, 148 bp, Homo sapiens
atatatacacacgtatatacacacatatatatatacacgtatatacatatatatgtatatatacgtgtgtatatatatgtgtgtatatgtgtgtgtgtgtgtgtatatatatatatatatatatatatatatatatatatatatatat

SEQ ID NO: 56169 - DNA, 140 bp, Homo sapiens
gtgtatatatatatatatatatatataagtatatatatacaagtctatgtatatgtctatatatgtgtatatatatctatatatatgtctatataagtgtgtatatatatgtatatatatgtgtgagtatatgtaagact

SEQ ID NO: 56170 - DNA, 97 bp, Homo sapiens
tcaatgcgggctcttttttgattccatatgaactgtaaagtagttttttccaatactttgaagaaagtcattggtggcttgatggggatggcattga

SEQ ID NO: 56171 - DNA, 112 bp, Homo sapiens
acgatggtatacttaggattatcttggctatatgggctattttatggttccatatgaaatttaaagtagttttttctagttctgtgaagaaagtcaatggtagcttcatggt

SEQ ID NO: 56172 - DNA, 84 bp, Homo sapiens
ggaatgtaaactagtatagtgtgtgtgtgtgtgcgcatatacgtgtatatatatgtgtgtatatatatagaatactactcatcc

SEQ ID NO: 56173 - DNA, 114 bp, Homo sapiens
taaagaaggggtccaatttcatacttttacatgtggatattcagtttttctaatacaatttatagaaaagactagaaatatttccttatttaatagttgtggtacccttgttta

SEQ ID NO: 56174 - DNA, 99 bp, Homo sapiens
tatttctctgtctcggtctctatatgaagacagagagaatatatatatatatatattctattttccaaataaagagatagaaaccaagacagagaaata

SEQ ID NO: 56175 - DNA, 128 bp, Homo sapiens
ggtatatgtatgtgtgtgtttatacatatatgtgtgtatatatatgtatatgtctatatgtttatgtgtatatgtgtctatatgtatatgtgtgtatatacatatatatgtgtgtgactgtatacata

SEQ ID NO: 56176 - DNA, 149 bp, Homo sapiens
atatgtctatatgtatatgtgtctatatttatatgtgtgtgtatacacatatgtctatatgtatatatgtctataggtacacacatatatgtgtatacacatgtgtctatatgtatatatgtctataggtacacatatatgtatagaca

SEQ ID NO: 56177 - DNA, 64 bp, Homo sapiens
tgtgtgtgtgtgtgtgtgtacacatatatgaatgtatatatgtgtctatatggatagacacata

SEQ ID NO: 56178 - DNA, 80 bp, Homo sapiens
ttgggtttgaaatgtgattttcttcattttatagataaggaaacttatgggaagggaggttaggttcatcttgtgcccaa

SEQ ID NO: 56179 - DNA, 81 bp, Homo sapiens
ctgtgggcactggctgagttctgctccatgttgctttctgctgtgacagggcaacattgagtttcaatgcaagtcccacag

SEQ ID NO: 56180 - DNA, 108 bp, Homo sapiens
tcatcatcccagggagatctgagtcattggtgggaaagtcgaggcgacagattatatctcactgatctcactgtcaccaattgctctgtgtgtccctccaccttttga

SEQ ID NO: 56181 - DNA, 90 bp, Homo sapiens
gtgtgtagtggcattgatggtatatccgtgcgttgaggcatttagagtgtattgagtgtgtacaagtgtatcatggtattgattgcatat

SEQ ID NO: 56182 - DNA, 66 bp, Homo sapiens
gtagatatagatagtatatctatatctatacagatagatagatatagatagtatatctatatctat

SEQ ID NO: 56183 - DNA, 104 bp, Homo sapiens
agtgcattgtggcatttaatatatattggtgcattgtagcattgagtgcattgtggcattgagtgtgtattgagtgtgtacaaatgcattgtggcattgagtgc

SEQ ID NO: 56184 - DNA, 106 bp, Homo sapiens
attctgacattctttcctcagcttggtctattatgctattaatacttgcaattgcattgtaaaattcttgtagtgtagttttcagcttgatcagatcagttagggt

SEQ ID NO: 56185 - DNA, 112 bp, Homo sapiens
cctggcactgggtaatttataaagaaaagaggtttatattggctcacagatttttttttaatttttaatttttgtgggtacatggtaggcttaaatatttatggggcacagg

SEQ ID NO: 56186 - DNA, 95 bp, Homo sapiens; identical to SEQ ID NO: 68

SEQ ID NO: 56187 - DNA, 93 bp, Homo sapiens; identical to SEQ ID NO: 69

SEQ ID NO: 56188 - DNA, 95 bp, Homo sapiens; identical to SEQ ID NO: 68

SEQ ID NO: 56189 - DNA, 93 bp, Homo sapiens; identical to SEQ ID NO: 69

SEQ ID NO: 56190 - DNA, 117 bp, Homo sapiens
tcaattttagatctttcctgctttctcttgtgggcatttagtgctataaatttccctctacacactgctctaactgtgtcccagagattctggtatgttttgtcttgttctcgttgg

SEQ ID NO: 56191 - DNA, 68 bp, Homo sapiens
ggggtctctctctgttactcaggcttcagtgcagtggtatgatcactgctcgctacagtctcgacctc

SEQ ID NO: 56192 - DNA, 96 bp, Homo sapiens
cctgttttagttatatttatgtatatatgtatgtatgttctagtctatggtgtaaaatgtatgtatgtatgtatgtatttactttgtagagacagg

SEQ ID NO: 56193 - DNA, 91 bp, Homo sapiens
acagggtctttctctgtggcccaggctggagtgcagtgacgtgatctcagctcattacagtctcagtctcctgggttcaagcgattcttgt

SEQ ID NO: 56194 - DNA, 133 bp, Homo sapiens
ttttctcttaaaaatgtctttgtctacatatatatatatatatatagagagagagagagagagagagagacatatatatatatgtctctatatatatgtctctatatatctatctttatgtatatctatgtgt

SEQ ID NO: 56195 - DNA, 68 bp, Homo sapiens
ggattacaggcatgacagtgcttggacatttttttttttttttttgagactgtcttgctctgtcaccc

SEQ ID NO: 56196 - DNA, 58 bp, Homo sapiens; identical to SEQ ID NO: 2626

SEQ ID NO: 56197 - DNA, 113 bp, Homo sapiens
gggcatggtgttgtgtacctgtagtcccagctactcaggaggctgaggtggaaggatcacttgagcccaaaaggccaaggctgcagtgagctatgatcacaccgctgcactcc

SEQ ID NO: 56198 - DNA, 86 bp, Homo sapiens
gtgggcagtgccagttcccaggtggagaaatcaagcagctgatcaggcgaggcttgatgtgctagcctccctgcttgcctgtgcac

SEQ ID NO: 56199 - DNA, 117 bp, Homo sapiens
atgcttttgtatgtctacaggctttttggagatgtgcctggctgtgtctctgtgtgtccctcatgcttgtgcataggagggtatgtatctgatgtgcctgtgtgcttacctctgtat

SEQ ID NO: 56200 - DNA, 72 bp, Homo sapiens
ggagcactcagcctagatgtggcagaggtggacgtaatatccaggtcagtctcactctgtgtccagtgctcc

SEQ ID NO: 56201 - DNA, 82 bp, Homo sapiens
gcccaagagcaggagcctgcagtcagggagaacattcctggggtctttctctccctctctgacaggctgtggtgaggtgggt

SEQ ID NO: 56202 - DNA, 140 bp, Homo sapiens
atatatgtgtgtgtctgtgcaaatgcgtgtgtgtatatatatgtatgtgtatatatatacacacatatatatgtgtgtgtatctctataaacacatatacacacacacacacacacacatatatatatatatatatatat

SEQ ID NO: 56203 - DNA, 111 bp, Homo sapiens
ctcatatatatatacacatatatatgtatatatatacatttttatacatacatatgtatatatatatatgtgtgtgtatatatatatgtgtgtgtgtatatatatatacat

SEQ ID NO: 56204 - DNA, 74 bp, Homo sapiens
gatctgagctctgtgtctgtctctgtatgtgctcctctgtccacacatgagcatgcatatatggtgcacatgtc

SEQ ID NO: 56205 - DNA, 81 bp, Homo sapiens
cctcccggttttccagcccctccaggcttccattggatgttgctgcaggaagaggccagagaagtcagagaagtcaggagg

SEQ ID NO: 56206 - DNA, 119 bp, Homo sapiens
gcctgggctcagctgatggatgagctccttgttggactgcctctggctctgtctctggctccacagatggatgctctcaggactgctggctgaaaggaaatccacatttgacctggagc

SEQ ID NO: 56207 - DNA, 86 bp, Homo sapiens
ccctcaagggatcccaatctaatggagaagacaagtaaacaattatagtacagtttagtcagagatctgtgggagctcagagaggg

SEQ ID NO: 56208 - DNA, 76 bp, Homo sapiens
acctctcttctctctgtggcatctacccgatactctctggtgacttaagggtggatgagtaggggctagagagtgt

SEQ ID NO: 56209 - DNA, 115 bp, Homo sapiens
ggaggtagcctgaggaggtttggggaatattgtggggtgatttgccacgggggttgtgcctctgtctgcctgtgtccccacctcttccccaaacagcggtggcaggtactgcccc

SEQ ID NO: 56210 - DNA, 58 bp, Homo sapiens; identical to SEQ ID NO: 5268

SEQ ID NO: 56211 - DNA, 114 bp, Homo sapiens
ccatttggaagctgcccatttcccgtccccctgccccctcatttcttttctttttttctttttctttttttttaaattttttgagacagggtctggctctgttgtccaggttgg

SEQ ID NO: 56212 - DNA, 99 bp, Homo sapiens
tatatatatgtaaatatatattatatatctgtatatatatgtatacatacacttatatgcacatatacatatatacacatatatacatacatatatata

SEQ ID NO: 56213 - DNA, 114 bp, Homo sapiens
agaagaaattgttcttacagttctagaagctagaggtctgagatcaaggtgtcagcagggatggtgcctcctgaggcctctctcctgggcttgtaggtggtgtcttctccctgc

SEQ ID NO: 56214 - DNA, 80 bp, Homo sapiens
ctgggattacaggtgtgagccacgatgttcagcccttttttttttttttttttgagatagggtctcactctgtcactcag

SEQ ID NO: 56215 - DNA, 112 bp, Homo sapiens
tcctctctgaggtattaagtggaagaaccaggacttaaatctggatctgtctcactccatgtctgttctttactgctggtcctggctttgccctgacctcagacctctaggg

SEQ ID NO: 56216 - DNA, 89 bp, Homo sapiens
ctagctgtgcaacctcaggcaggtttcttgtcttctctgagcctccatctggctactggggataattaccaagccttttgtgtggctgg

SEQ ID NO: 56217 - DNA, 73 bp, Homo sapiens
cctctgcctctctgagcctcagttgtctcatctatttcatgctggggtctgtaaggattgagagaagaaggag

SEQ ID NO: 56218 - DNA, 110 bp, Homo sapiens
gggaccttgggaaagtcatttcacttctctgagcctcagtgtctgcctctgtttcccttccctggaagtattctctgaggtttcaatgacatgatgcctggaaagcaccc

SEQ ID NO: 56219 - DNA, 94 bp, Homo sapiens
attgatttgcatatgttgaaccaggcttgtatcccagggatgaagcaaacttgatcgtggtggataagctttttgatgtgctgctggattcggt

SEQ ID NO: 56220 - DNA, 74 bp, Homo sapiens
gaggcttggggtgtgtgtgtgtgtatacacatatatatgtgtgtgtatatatatatatagcttgtacatgcctt

SEQ ID NO: 56221 - DNA, 75 bp, Homo sapiens
cctgactgctaacctgatgcctctttgtactgcatccatcagcacacagagaagtgtgtgaggaaccccctcggg

SEQ ID NO: 56222 - DNA, 86 bp, Homo sapiens
ccttagcagcccttcctaactcactggtaatctgtttatatgtttatttgcaagattggtttctgcttcagtgagggggggcttgg

SEQ ID NO: 56223 - DNA, 101 bp, Homo sapiens
gtgattctcaaggagcggggtgtggagcaggaaaaactgaaaaaaaagcatcaggaattcttttttttttttttttttgacacggagtctcgctctgtcac

SEQ ID NO: 56224 - DNA, 77 bp, Homo sapiens
ccatgggttgcatagatctgtgggagaaacgtggtttcctggggcagggtcacacaatcactcacagcttcccttgg

SEQ ID NO: 56225 - DNA, 96 bp, Homo sapiens
tagtttctgcatgtttattgtcagtatatagaaaagcaattgaatatttgtgtgttgatcttttatctgtgtacttggtgatatggttcgggtctg

SEQ ID NO: 56226 - DNA, 65 bp, Homo sapiens
ttgtatcaggaggagagataggttgtagtgagcttactccaactttttttttttttttgagacag

SEQ ID NO: 56227 - DNA, 95 bp, Homo sapiens; identical to SEQ ID NO: 580

SEQ ID NO: 56228 - DNA, 93 bp, Homo sapiens; identical to SEQ ID NO: 69

SEQ ID NO: 56229 - DNA, 95 bp, Homo sapiens; identical to SEQ ID NO: 68

SEQ ID NO: 56230 - DNA, 93 bp, Homo sapiens; identical to SEQ ID NO: 69

SEQ ID NO: 56231 - DNA, 137 bp, Homo sapiens
gtgtatatatatatatacatatatatgtatatatatgtgtgtgtatatatatatatacatatatgtatatatatgtgtgtatatatgtgtgtgtatatatacatatatgtatatatatgtgtgtatatatgtgtgta

SEQ ID NO: 56232 - DNA, 95 bp, Homo sapiens; identical to SEQ ID NO: 68

SEQ ID NO: 56233 - DNA, 93 bp, Homo sapiens; identical to SEQ ID NO: 69

SEQ ID NO: 56234 - DNA, 95 bp, Homo sapiens; identical to SEQ ID NO: 68

SEQ ID NO: 56235 - DNA, 93 bp, Homo sapiens; identical to SEQ ID NO: 69

SEQ ID NO: 56236 - DNA, 107 bp, Homo sapiens
tactgaaaaacttaggaggatgacaatgaattttatagtaaattacctacttgcttgtatggttttattctataagttactttgcagcttcatttttctagtaagtc

SEQ ID NO: 56237 - DNA, 90 bp, Homo sapiens
cagcctcgaccttttgggctcaagtgatcctcccacctcagcctcttttttttttttttgagatggagtctcgctctgtcacccaggctg

SEQ ID NO: 56238 - DNA, 103 bp, Homo sapiens
ggtggtggtgcacacctgtagtcccagccactcaggaggctgaggttggaggatggcttgagtctgagaggttgaggctgcagtgagctgtgatcacaccact

SEQ ID NO: 56239 - DNA, 70 bp, Homo sapiens
gtctcatagcaagtaagtgacagaactggtctgaagactatgttctatttttatttatttattttgagac

SEQ ID NO: 56240 - DNA, 58 bp, Homo sapiens; identical to SEQ ID NO: 605

SEQ ID NO: 56241 - DNA, 132 bp, Homo sapiens
tatatacacgtatatatgtatatatatacgtatatatatacacgtatatgtgtatatatatacgtatatatatacacgtatatatgtatatatatacgtatatatatacacgtatatatgtatatatatacg

SEQ ID NO: 56242 - DNA, 79 bp, Homo sapiens
taggctatagatagagtagatagagagatatagtgagatagagataaatgcctctctatatatacatatatatagtcta

SEQ ID NO: 56243 - DNA, 56 bp, Homo sapiens
gagtcagggtctcactgtgtcacccaggctggagcgcggtgatgtgatcttggctc

SEQ ID NO: 56244 - DNA, 87 bp, Homo sapiens
tagctgggatcacagatgtgtgccaccacatccagctaatttttatatttttagtagagatggggtttcaccatgctggccaggctg

SEQ ID NO: 56245 - DNA, 115 bp, Homo sapiens
agctttgtagtataatttgaaatcagaaagcgtgatgcctccaattttgtttttgtttttaaggttgctttggcacagagtcttttgtggttccatacaaattttaatattagct

SEQ ID NO: 56246 - DNA, 113 bp, Homo sapiens
gcgtactccccatttatgagtagattagctattgggcacaacatttaacatctcagtgtatttgtttttgtatatttatataataatataatctaactcataggcatgtaccc

SEQ ID NO: 56247 - DNA, 62 bp, Homo sapiens
tgtgtgtgtgtgtgtgtgtgtatatatatatgtgtgtgtgtgtgtatgtgtatgtgtatata

SEQ ID NO: 56248 - DNA, 104 bp, Homo sapiens
gtcatataccgagtagttttttattgaacaatatatatatatacatatatataaatatatgtgtatatatatttgttttttgagactgagtctccctctgtggc

SEQ ID NO: 56249 - DNA, 89 bp, Homo sapiens
tagctgggaccacaggtgtgcaccaccatgcccagctaattttttgtatttttagcagagatgggggtctcaccgtattgcccaggctg

SEQ ID NO: 56250 - DNA, 66 bp, Homo sapiens
ttgagcctatgtgtgtctctgtgtgtgagatggttctcctgaatacagcacactgatgggtcttga

SEQ ID NO: 56251 - DNA, 119 bp, Homo sapiens
tgttctttttgcttaggattgtcttggctacacgggctcttttttggttccatatgaaatttaaagtagttttttctagttctgtgaagaaagtcagtggtagcttgatgggaatagca

SEQ ID NO: 56252 - DNA, 117 bp, Homo sapiens
tatatatacatatatatacgtatatatacatatatacgtatatatatatattatatatgtatatatatacatatatatacgtatatatgtatatatacacgtatatatgtatacgta

SEQ ID NO: 56253 - DNA, 95 bp, Homo sapiens; identical to SEQ ID NO: 68

SEQ ID NO: 56254 - DNA, 93 bp, Homo sapiens; identical to SEQ ID NO: 69

SEQ ID NO: 56255 - DNA, 114 bp, Homo sapiens
tgggggctaaatctgagccagcaggaaaagggcatttctccagcattcattcagaaaaatagatttttcttttattggaaaagagaggctttgactgcttgttataagttctca

SEQ ID NO: 56256 - DNA, 58 bp, Homo sapiens
tgagacagaatctcactctgtctctcaggatggagtgcagtggtgtgatcttggctca

SEQ ID NO: 56257 - DNA, 64 bp, Homo sapiens
acagagtgagactctctctttctctctctctcttttttttttttgagacagattctcactctgt

SEQ ID NO: 56258 - DNA, 76 bp, Homo sapiens
ggtgggtagcgtgcttgttgactgagcagatataacatgagatgagtgactgctcacaccatccagctgcagggcc

SEQ ID NO: 56259 - DNA, 109 bp, Homo sapiens
gccgcttctgcccatcctccccacctgaggggacagttgaaagggaccagtcaagacagggaagataactagttgactaggggtggggagtggggtatggagagaaggc

SEQ ID NO: 56260 - DNA, 75 bp, Homo sapiens
agggatgcggggcttgggggagcatgagcagggccctgtgtgcttagtcaccctctctgaggcactcgtttacct

SEQ ID NO: 56261 - DNA, 82 bp, Homo sapiens
aggctgtattgccttgcctcccacagactcaattttttcttttgaaaaaggcgaagctggctgggcgtggtggctcacgcct

SEQ ID NO: 56262 - DNA, 99 bp, Homo sapiens
gctctgtcgctcaggctggagtgcagtgagacggagtctcgctctgtcgctcaggctggagtgcagtggcgcgatctcggctcactgcaagctctgcct

SEQ ID NO: 56263 - DNA, 58 bp, Homo sapiens; identical to SEQ ID NO: 5571

SEQ ID NO: 56264 - DNA, 62 bp, Homo sapiens
tgagacggagtctcactcactctgtcacccaggatggagtgcagtggtatggtctcggctca

SEQ ID NO: 56265 - DNA, 100 bp, Homo sapiens
gccacgttttggttgtagaaagtctgtattctttatttatttaattggttaattaattagagagagtctcactctgtcaactaggccagagtacagtggc

SEQ ID NO: 56266 - DNA, 130 bp, Homo sapiens
aggaactgaaggatgtcagcttgagacaaggttttgctctgttgcccaggctggggtgaggtggtaggatcttagctcactgcaaccttgaagtcctgggtttaagcgatcctcctgtctcagcctccca

SEQ ID NO: 56267 - DNA, 84 bp, Homo sapiens
tttgagaggctgaggtagaaggatcattagagaccaggagttcaagaccagcctggtcaaaatagtgagatcccatctcttaag

SEQ ID NO: 56268 - DNA, 88 bp, Homo sapiens
attccagcagtagtgtggagaatggtttggatggatctagttcaagtaagagagaatggagcccaaactggtgctatggcattgggat

SEQ ID NO: 56269 - DNA, 101 bp, Homo sapiens
tgcatgtgtctttatggtacctttttattttttaatcttagagacagggtctcactctgtcactcaggctaagtacagtggcatggtcacagctcactgca

SEQ ID NO: 56270 - DNA, 84 bp, Homo sapiens
ggcattcagactagcaggacatgttttgaaagagcagagttcaaagtgagcacactgtctttcaattcttgatccagcaatgcc

SEQ ID NO: 56271 - DNA, 123 bp, Homo sapiens
ctatatagtatagagacatattctatatctatataatatagacatattctatatctatataatatagacatattctatatccatataatatagagacatattctatatccatgtagtatagag

SEQ ID NO: 56272 - DNA, 123 bp, Homo sapiens; identical to SEQ ID NO: 56271

SEQ ID NO: 56273 - DNA, 120 bp, Homo sapiens
agtgggtgcaccatttcacatccccactagtgtacgggggttccagcttctgggttttttttttttttttcttaatagtggctatcccaacaggcatgaggtgatgttgttgttctcatt

SEQ ID NO: 56274 - DNA, 72 bp, Homo sapiens
gtgtatatacacatatgtatatatgtatatatgtgtatatatgtatatatatgtgtgtgtgtgtatatatac

SEQ ID NO: 56275 - DNA, 72 bp, Homo sapiens
atgtatatatgtatatatgtatgcatatatacctataggtatatatgcacatatgtatatacgtatacacat

SEQ ID NO: 56276 - DNA, 96 bp, Homo sapiens
tatacatatatacatatgtgtgtatatatgtatatgcatatgtgtatatatgtatacgtgtatatatgtatatgtgtatatatgtatgtatataca

SEQ ID NO: 56277 - DNA, 90 bp, Homo sapiens
ggataaatgatgtactctctggggccactctagtgagtctgctctcagccaggcacagctggatgtaggttaccagttgttactcattcc

SEQ ID NO: 56278 - DNA, 91 bp, Homo sapiens
tacaattgctgagtcatatggtaattgcatgtttagtttaaaaaacaaaaaacaaaaaactgacggccaggtgcggtggctcacacctgta

SEQ ID NO: 56279 - DNA, 64 bp, Homo sapiens
cagccctgtggctctgacagggtctctcatgatatccagcagagatcttgagtcagctgctctg

SEQ ID NO: 56280 - DNA, 87 bp, Homo sapiens
gatattgtgatataagaacatgagagatggaattgctgtcttaagatcagtatttttcgatttttttttttttttagagacaaggtc

SEQ ID NO: 56281 - DNA, 108 bp, Homo sapiens
gtctgctccagagccttcgctctgctgcctgggggcgggaccagaagagtggtcactgagcacagagaccttctgcacacagagcagcctgagcaaactgcagcaggc

SEQ ID NO: 56282 - DNA, 94 bp, Homo sapiens
tctccacctacttgccagcagtttgtgttatcacagttttttattttaatcattgagccaacaagattggtggcaaattggaagtgggtggtga

SEQ ID NO: 56283 - DNA, 70 bp, Homo sapiens
gacaggggggtcgacacccagattttggtttttttttttttttttttctgagacggagtctccctctgtc

SEQ ID NO: 56284 - DNA, 105 bp, Homo sapiens
attgcaccattgcactccagcctgggaaacgggagcgaaagtccatctcaaaaaattctgagacggtctcactctatcacccaggctggaacgcagtggcataat

SEQ ID NO: 56285 - DNA, 58 bp, Homo sapiens; identical to SEQ ID NO: 17852

SEQ ID NO: 56286 - DNA, 88 bp, Homo sapiens
tctacactgagacaaaggggaaaaggctacctcttttttttttttttttttttttgagatggcatctcactctgtcacccaggctgga

SEQ ID NO: 56287 - DNA, 122 bp, Homo sapiens
ctttgttctttttgcttaggattgtcttggctataagggctcttttttggttccatatgaaatttaaagtagttttttctaattctgtgaagaaagtcaatagtagcttgacagggatagca

SEQ ID NO: 56288 - DNA, 95 bp, Homo sapiens; identical to SEQ ID NO: 68

SEQ ID NO: 56289 - DNA, 93 bp, Homo sapiens; identical to SEQ ID NO: 69

SEQ ID NO: 56290 - DNA, 58 bp, Homo sapiens; identical to SEQ ID NO: 1911

SEQ ID NO: 56291 - DNA, 90 bp, Homo sapiens
gggaagtatctccatgagaaataagaagtatccgatggatgtgctaacatctcagaggatttttgtttggctgcagaggacaaggctccc

SEQ ID NO: 56292 - DNA, 106 bp, Homo sapiens
ttctatttttattgtactgtggtccaagagtacacttggtatgatttaaattttttttaatttattgagacttgctttatgactgaccatgtggttgatcttagaa

SEQ ID NO: 56293 - DNA, 77 bp, Homo sapiens
gcaggtgagagaagtgagtgctgagcagagggggaagccccttataaaaccatcagctctcatgaaaactcacttgt

SEQ ID NO: 56294 - DNA, 106 bp, Homo sapiens; identical to SEQ ID NO: 56292

SEQ ID NO: 56295 - DNA, 65 bp, Homo sapiens
gagcaaagtgtcagtacagagggagtctgatcctctgggttctctggcctgaactcgcttagctc

SEQ ID NO: 56296 - DNA, 74 bp, Homo sapiens
acctgataagctttccataaatattagatggtgaactgggaccaggcacttcattctagagagagagctcaggt

SEQ ID NO: 56297 - DNA, 106 bp, Homo sapiens
tgtatgtattgtacaatgctgtctctccatatatatatatatatatatatatatatatatatatatatatatatatatatgtaggtatgcatatgtatataatata

SEQ ID NO: 56298 - DNA, 95 bp, Homo sapiens; identical to SEQ ID NO: 68

SEQ ID NO: 56299 - DNA, 93 bp, Homo sapiens; identical to SEQ ID NO: 69

SEQ ID NO: 56300 - DNA, 95 bp, Homo sapiens; identical to SEQ ID NO: 580

SEQ ID NO: 56301 - DNA, 93 bp, Homo sapiens; identical to SEQ ID NO: 69

SEQ ID NO: 56302 - DNA, 95 bp, Homo sapiens; identical to SEQ ID NO: 68

SEQ ID NO: 56303 - DNA, 93 bp, Homo sapiens; identical to SEQ ID NO: 69

SEQ ID NO: 56304 - DNA, 72 bp, Homo sapiens
gaattcacgactaggtagaaggttagatatatgtgtgtacatatgtatctatgtctatatctctgtgtgttc

SEQ ID NO: 56305 - DNA, 74 bp, Homo sapiens; identical to SEQ ID NO: 56296

SEQ ID NO: 56306 - DNA, 65 bp, Homo sapiens; identical to SEQ ID NO: 56295

SEQ ID NO: 56307 - DNA, 95 bp, Homo sapiens; identical to SEQ ID NO: 68

SEQ ID NO: 56308 - DNA, 93 bp, Homo sapiens; identical to SEQ ID NO: 69

SEQ ID NO: 56309 - DNA, 58 bp, Homo sapiens; identical to SEQ ID NO: 10934

SEQ ID NO: 56310 - DNA, 121 bp, Homo sapiens
tatgcatatatatatgcatacctatatgcatatatatatgcatataggtatgcatatatatatgtatacatatatatgcatatatatatgtatacatatatatgcatatatatatatacat

SEQ ID NO: 56311 - DNA, 72 bp, Homo sapiens
gtgcttgtggcagttggaacatagtttattctttaattgtaagagttgcatgacttaactgttgcctggcat

SEQ ID NO: 56312 - DNA, 95 bp, Homo sapiens; identical to SEQ ID NO: 68

SEQ ID NO: 56313 - DNA, 93 bp, Homo sapiens; identical to SEQ ID NO: 69

SEQ ID NO: 56314 - DNA, 70 bp, Homo sapiens
gaagtttttttatttttattgtgttggtatcagggtgatgctgatagaatgagttactgaggaggccttc

SEQ ID NO: 56315 - DNA, 78 bp, Homo sapiens
ccaccatctgtgacagcttcttgatctgtccccaggtgggtgactgtgtttgacaggtgtagctcatgacagttgggg

SEQ ID NO: 56316 - DNA, 116 bp, Homo sapiens
agatcaaattttgtagcttccaagtgtgagagagactatgcagtatttatatttctgttcatgacttattttactgacctcgaggcttatgcatgttgccacaaattccaggattt

SEQ ID NO: 56317 - DNA, 66 bp, Homo sapiens
gggtgtgaaataccatatatatgtgtgcatgtgtatatatatgtatgtatgtatgtgtacatacct

SEQ ID NO: 56318 - DNA, 76 bp, Homo sapiens
catgtagctctctgtgtcagtctgaatgccctggtgtcatggactcacagggggattacttgacaccagggttgga

SEQ ID NO: 56319 - DNA, 95 bp, Homo sapiens; identical to SEQ ID NO: 68

SEQ ID NO: 56320 - DNA, 93 bp, Homo sapiens; identical to SEQ ID NO: 69

SEQ ID NO: 56321 - DNA, 123 bp, Homo sapiens
agcatatcttattgttttttttcttttgtatcctcttgctgtgtattttcaaatagcctgtctattttttatatactttaagttctggagtacatgtgcagaatgtgcagttttgttacatag

SEQ ID NO: 56322 - DNA, 111 bp, Homo sapiens
gttgtttatgtatgctgaataaaaggcttttttgacacgtgtgattttctttttttttttaatttatttattgttagtatacttttaagttttagggtacatgtgcacaat

SEQ ID NO: 56323 - DNA, 88 bp, Homo sapiens
ctggcagccactcccagagcccctggaactctggcccaaggctctctgactgactccttcccaggtcttcttggcttagtggctgaag

SEQ ID NO: 56324 - DNA, 225 bp, Homo sapiens
atacacaatattgtatatatatgtatatatatatacacaatattgtgtatatatgtatatatatatacacaatattgtgtatatatgtatatatatatacacaatattgtgtatatatgtatatatatacacacactatatatacacaatattgtatatatatgtacatatatatacacacccacaatattgtgtgtatatagtgtttgtatgtgtgtatatata

SEQ ID NO: 56325 - DNA, 80 bp, Homo sapiens
gtatatatatatatgtttgtgtgtatatatatgtgtgtatatatgcatatgtgtatatgtatatatgtatgtgtgtatat

SEQ ID NO: 56326 - DNA, 74 bp, Homo sapiens
gtatatatgtatacatatgtatgtatatgtgtatgtatacgtatatatgtatatatatgtgtatatatgtatat

SEQ ID NO: 56327 - DNA, 91 bp, Homo sapiens
atatatatatgtgtgtgtatatatatatgtgtatacacatatatgtgtatacgtgtatacatatatatgtgtatacatgtatacatacata

SEQ ID NO: 56328 - DNA, 129 bp, Homo sapiens
gtgtatatacgtatatatacacatatatacgtatatacacatatatacgtatatacgtgtatatatgtgtatatatacatacgtatatatgtatgtttacatatatgtatgtatacatgtatacacata

SEQ ID NO: 56329 - DNA, 65 bp, Homo sapiens
acagactgaaggtatctttggccagtaagtgggtctcttgtaggcagaagatagttaggtcttgt

SEQ ID NO: 56330 - DNA, 95 bp, Homo sapiens; identical to SEQ ID NO: 68

SEQ ID NO: 56331 - DNA, 93 bp, Homo sapiens; identical to SEQ ID NO: 69

SEQ ID NO: 56332 - DNA, 112 bp, Homo sapiens
ccacatcttttttttggagctattgcttactttctggtacaaggtagtataggcttatcttgtattctccctgcaccagccttacttttagccattttaataaggagcccgg

SEQ ID NO: 56333 - DNA, 104 bp, Homo sapiens
tgcttaaatattattgggacatgatagttgtatatatgtacatatatatgggacacatgatattgcaatacaaatgtgtcatgtgcaacaatcaaaacaaggta

SEQ ID NO: 56334 - DNA, 81 bp, Homo sapiens
tggtgggatatagaaatgctacaggtttttgtatggctgttttgtattatgcaattttactgaatttctttatcacttcca

SEQ ID NO: 56335 - DNA, 78 bp, Homo sapiens
acatgagggccagcctagaactgtgaggttaagttgtttggacaggaaggctacaggtcatgggcctggatcctgtgt

SEQ ID NO: 56336 - DNA, 83 bp, Homo sapiens
cttgagttcttattaactgtcagcctgactggctctttcctagctaggctagtcagctcggctgaggagtcaagggaggacag

SEQ ID NO: 56337 - DNA, 113 bp, Homo sapiens
ttgcatttctggaagaagattcgtacttttttgagacggagtcttctttttttttttttgagatgtagtctcgctctgtcgcccaggctggagtgtagtggtgcaatctcagg

SEQ ID NO: 56338 - DNA, 69 bp, Homo sapiens
agctgctgttccagatgtgattttgttgatgagcaaattaatatatctcctgttacctggtaggtagct

SEQ ID NO: 56339 - DNA, 96 bp, Homo sapiens
acaaaaaatatatatatgtgtgtatatatatatatatgtatacgtgtgtgtgtatacacgtctgtatatatacgtgtgtgtatatgtatatatatg

SEQ ID NO: 56340 - DNA, 95 bp, Homo sapiens; identical to SEQ ID NO: 68

SEQ ID NO: 56341 - DNA, 93 bp, Homo sapiens; identical to SEQ ID NO: 69

SEQ ID NO: 56342 - DNA, 72 bp, Homo sapiens
gaatatgtattcacgtatgtatatatgtgtatatatacacacacatatatgaatatatatggatatatattc

SEQ ID NO: 56343 - DNA, 72 bp, Homo sapiens
ttttttttgagacagagtctcactctgtcgcccaggctggagtgcagtggtgcgatcttggctcatagaaag

SEQ ID NO: 56344 - DNA, 58 bp, Homo sapiens; identical to SEQ ID NO: 2263

SEQ ID NO: 56345 - DNA, 69 bp, Homo sapiens
tttcaggagggagagtgaagtgactggggacattatattgatttcagtgctacactgtcacagtggaga

SEQ ID NO: 56346 - DNA, 87 bp, Homo sapiens
gcagtaaacctcctcaactcccctggcgagcctcatgaacacctaatacaggggggctagagaggagagactgaggagatttctagt

SEQ ID NO: 56347 - DNA, 95 bp, Homo sapiens; identical to SEQ ID NO: 580

SEQ ID NO: 56348 - DNA, 93 bp, Homo sapiens; identical to SEQ ID NO: 69

SEQ ID NO: 56349 - DNA, 78 bp, Homo sapiens
tgtggttccatgtgagttttaggattgtatttttctatttctgtgaaaaatgtcatcagaattttggtagggattgca

SEQ ID NO: 56350 - DNA, 67 bp, Homo sapiens
gcatgtatgtttatgtgtgtgtatatatatacatatatatgtatatatattacagttttatgtatgc

SEQ ID NO: 56351 - DNA, 95 bp, Homo sapiens; identical to SEQ ID NO: 68

SEQ ID NO: 56352 - DNA, 93 bp, Homo sapiens; identical to SEQ ID NO: 69

SEQ ID NO: 56353 - DNA, 105 bp, Homo sapiens
tgtgggttttgggcttctcagagttgaataccaccagagcaccctgtacagtgtgagctctctctgtcaagcacagacttacaggccttattcactgtgggaagt

SEQ ID NO: 56354 - DNA, 95 bp, Homo sapiens; identical to SEQ ID NO: 68

SEQ ID NO: 56355 - DNA, 93 bp, Homo sapiens; identical to SEQ ID NO: 69

SEQ ID NO: 56356 - DNA, 95 bp, Homo sapiens; identical to SEQ ID NO: 68

SEQ ID NO: 56357 - DNA, 93 bp, Homo sapiens; identical to SEQ ID NO: 69

SEQ ID NO: 56358 - DNA, 117 bp, Homo sapiens
ttcactcagctccatcaaaacaagtgctttgtatgctgtgtctgaaaggtctcatatctctgtctctctgagattagtcactgctgccttatttagtttgtttggtgaagttatgtg

SEQ ID NO: 56359 - DNA, 117 bp, Homo sapiens
actgccctgaagggagagacccaggctggcaccattcaccgcaacctgactgaagagtgcttggactttgagtgagcattggtggcagcctggcagtactccctgcaggcctggggt

SEQ ID NO: 56360 - DNA, 96 bp, Homo sapiens
atgataatgaaattaccattgttgttgagacttttgtatgtaatgtaaagatgttgctataaaatctaatgcagctgtggggcaatgtcattgaca

SEQ ID NO: 56361 - DNA, 118 bp, Homo sapiens
ggtactgtaaattagagcttcaggttaggatatgatctctaggcgtgatggaataatactattttattgtttgtctttagaaactatcctctttccttctcagtttttgtttggcact

SEQ ID NO: 56362 - DNA, 101 bp, Homo sapiens
gtagtcctagctactcgggaggctgaggtaggaggatcacttgagcccaggagtttgagctatgatcactgatcacaccactgcactccagctagggtgac

SEQ ID NO: 56363 - DNA, 115 bp, Homo sapiens
tgtaggggacaattaaaagccgtgttgaaatcaagatagactgtcactcactcatatgaataattggtttggtatgtcttgctcttttcaaaaccaagctggctgcttcctaaca

SEQ ID NO: 56364 - DNA, 91 bp, Homo sapiens
ctccagctcacatggacagagcagagtgtggagactcatatcatgaacttttgctccagaaatactgcaggaatatgtcagaaaagcggag

SEQ ID NO: 56365 - DNA, 109 bp, Homo sapiens
ggtaacaccagttgtaattcaggaattttgtagttattgccactaggtctaaaattgagagaagacagagagcaatgatctttggatacctaatcagacttggttaatc

SEQ ID NO: 56366 - DNA, 69 bp, Homo sapiens
ttgtgccttggtgaccatgtgcatgtgcttgtaggatttaaggatttatgctcacttggtttgggccag

SEQ ID NO: 56367 - DNA, 118 bp, Homo sapiens
tgggtaagtaccaaggagtaggatggctaagtcatatggtaggcatagaattttttttttaatgaaccatttttctatcctgtccctgtgtgtggtagatgctcactctctcattctt

SEQ ID NO: 56368 - DNA, 80 bp, Homo sapiens
actatgtcagaggaacgttctgtggctcaagggctgctgttcagattcttttcttccactgggtgatcccttgatgtggt

SEQ ID NO: 56369 - DNA, 59 bp, Homo sapiens
tgtgtgtgtgtgtgtgtgtgtgagtgtaaataaaactttaatacatgctcacacatata

SEQ ID NO: 56370 - DNA, 131 bp, Homo sapiens
gtattttaatcatatatatatatatatatatacacatacacatatatatacacatatgtgtatatatgtatatatgtatgtgtgtgtatatatatacatatatatatatatacacatacacacacatatac

SEQ ID NO: 56371 - DNA, 95 bp, Homo sapiens; identical to SEQ ID NO: 68

SEQ ID NO: 56372 - DNA, 93 bp, Homo sapiens; identical to SEQ ID NO: 69

SEQ ID NO: 56373 - DNA, 123 bp, Homo sapiens
gtattgtattgtggtattgtattgtgcatgagtattctcttttttctttttaatttattattattatactttgagttttagggtacatgtgcacattgtgcaggatagttacatatgtataca

SEQ ID NO: 56374 - DNA, 78 bp, Homo sapiens
tattcataagatagtatatccatgtaaatatatatcactgtgtgtgtatatatatgtgtgtgtgtatatgtgtgagtg

SEQ ID NO: 56375 - DNA, 95 bp, Homo sapiens; identical to SEQ ID NO: 68

SEQ ID NO: 56376 - DNA, 93 bp, Homo sapiens; identical to SEQ ID NO: 69

SEQ ID NO: 56377 - DNA, 100 bp, Homo sapiens
gcactatatttattgatttgtgcatgttgaaccagccttgtatcccaggaataaagcactgctggatttaatttgctaacattttgttgaggatttttgc

SEQ ID NO: 56378 - DNA, 82 bp, Homo sapiens
gtagatggatttgagtctggatttttcaatgggcagtaccaattactgagttcatcctgagtcctactcctaatctagtgac

SEQ ID NO: 56379 - DNA, 92 bp, Homo sapiens
catttaccacagtggcagaggctaggcagctgggggtggtggggagcagaaagcccctgctgaagattgtgtgcactgttgcagtggaggtg

SEQ ID NO: 56380 - DNA, 94 bp, Homo sapiens
ccttgatgtctggacattgaagagttgagtatttattgtagtctttatagtctgggattgtttgtacccattcttcttggaaagtctttcgagg

SEQ ID NO: 56381 - DNA, 95 bp, Homo sapiens; identical to SEQ ID NO: 68

SEQ ID NO: 56382 - DNA, 93 bp, Homo sapiens; identical to SEQ ID NO: 69

SEQ ID NO: 56383 - DNA, 64 bp, Homo sapiens
ggtatgtgtgtgtgtatatatatatatgtacgtatatacatatgtatacacacacacacatatt

SEQ ID NO: 56384 - DNA, 99 bp, Homo sapiens
tcctaggtattttattctctttgtagcaattgtgaatggcagttgactcatgatttggctctctgtttgtctgttactggtggataggaacgcttgtga

SEQ ID NO: 56385 - DNA, 95 bp, Homo sapiens; identical to SEQ ID NO: 68

SEQ ID NO: 56386 - DNA, 93 bp, Homo sapiens; identical to SEQ ID NO: 69

SEQ ID NO: 56387 - DNA, 62 bp, Homo sapiens
atatatatatatatatatatatatatggtgtatacatatatatatggtgtgtgtatatatat

SEQ ID NO: 56388 - DNA, 58 bp, Homo sapiens; identical to SEQ ID NO: 14767

SEQ ID NO: 56389 - DNA, 56 bp, Homo sapiens; identical to SEQ ID NO: 14768

SEQ ID NO: 56390 - DNA, 121 bp, Homo sapiens
atgggagtgatttgttttctagtgctttactctctagtggtctccttttcttaagctaaggactaaaaagaagtttgaacaagaagtcccatttcctctagtaataactgtgagaggaatc

SEQ ID NO: 56391 - DNA, 120 bp, Homo sapiens
agcagtggtttgtagttcttgaagaggtccttcacatcccttgtaagttggatttctaggtattttattctttttgaagcaattgtgaatgggagttcactcatgatttggctctctgtt

SEQ ID NO: 56392 - DNA, 95 bp, Homo sapiens; identical to SEQ ID NO: 68

SEQ ID NO: 56393 - DNA, 93 bp, Homo sapiens; identical to SEQ ID NO: 69

SEQ ID NO: 56394 - DNA, 94 bp, Homo sapiens
gcaattatgaatggcagttctttcatgatttggctctctgtctgtctattactggtggataggaatgcttgtgatttttgcacattgattttgt

SEQ ID NO: 56395 - DNA, 58 bp, Homo sapiens
tgagatggagtctcactctgtcacccaggctggagggcagtgatgtgatctcggctca

SEQ ID NO: 56396 - DNA, 98 bp, Homo sapiens; identical to SEQ ID NO: 1311

SEQ ID NO: 56397 - DNA, 64 bp, Homo sapiens
aaggaactcagcaggcttaagcagattctagctgagtggctgttgagagtctgcacagctcctt

SEQ ID NO: 56398 - DNA, 95 bp, Homo sapiens; identical to SEQ ID NO: 68

SEQ ID NO: 56399 - DNA, 93 bp, Homo sapiens; identical to SEQ ID NO: 69

SEQ ID NO: 56400 - DNA, 93 bp, Homo sapiens; identical to SEQ ID NO: 69

SEQ ID NO: 56401 - DNA, 112 bp, Homo sapiens
ttgcttaggattttcttggctctacgggctcttttttggttccatatgaaatttaaagtagttttatctaattcttttaagaaagtcagtggtagattgatgggaatagcag

SEQ ID NO: 56402 - DNA, 65 bp, Homo sapiens
tgggttacacagaaagacaatgggttttttttttttaaagagacacagtttctctctgttgccca

SEQ ID NO: 56403 - DNA, 70 bp, Homo sapiens
aagaagagattggttctcagttggagaaataggacattatctctctcactgtgaggcccaatctttcctt

SEQ ID NO: 56404 - DNA, 75 bp, Homo sapiens
tatagtgaaatctgctagaggctccttcttaccaggacactccctggagatgaggtagaatcttgaattcctatg

SEQ ID NO: 56405 - DNA, 79 bp, Homo sapiens
tgtgtatataaatatgtgcaagtatatatatatatatatatatatatatatgcacatacatataatggaatactacaca

SEQ ID NO: 56406 - DNA, 98 bp, Homo sapiens
gatctccattagttcagttgttttaatttttagctcccacaagtgagtgagaacatgtgaagtttatttttgcttttgctgcccgtgcttttggggtc

SEQ ID NO: 56407 - DNA, 83 bp, Homo sapiens
ggttatttttgaggagattgttttctggcaccgggggaggagtgttttcctgtgaggagttagttacccagttgaaagtgccc

SEQ ID NO: 56408 - DNA, 120 bp, Homo sapiens
cccgagtagctggggttacagatgcctgccatcacacgcagctaatttttgtatttttcatagagatggggtttcactatgttggccaggctggtctcaaactcctgacctcaggtgatc

SEQ ID NO: 56409 - DNA, 111 bp, Homo sapiens
ccatgttgaaatctttcacgtccttggctaagtgtatttctaaatgttttattttatttttttgcagttgtgataaaaggggttgagttcttgatttgatcttcagattgg

SEQ ID NO: 56410 - DNA, 81 bp, Homo sapiens
gtatttatggaaattgcccccacatgtgtcttttatattcatctatgtatattatagacatatgtatgtttttatatctac

SEQ ID NO: 56411 - DNA, 99 bp, Homo sapiens
agtgttctctttttaccacatccctgccaagatctataattatttttttttaattttttcattatggccattcttgcaggagtaaggtggtaacacact

SEQ ID NO: 56412 - DNA, 65 bp, Homo sapiens
atatatagatatatatgtgagatgtgtgtgtgtatatatatatatagatctctatatctatatat

SEQ ID NO: 56413 - DNA, 58 bp, Homo sapiens
tgagtcagaatctcactctgtcacttaggctggagtgcagtggtgctatctcggctca

SEQ ID NO: 56414 - DNA, 115 bp, Homo sapiens
gatatatatcaatatgtcgatatatatcgatatgtcgataaagatattatatatctatatagatatataatatatagacatatagatatatattacagatatatagatatatatt

SEQ ID NO: 56415 - DNA, 80 bp, Homo sapiens
tgttttttggataaaggccattttaactgggatgaggtgatatcttattgtagttctgatttgcatttatctgttgatca

SEQ ID NO: 56416 - DNA, 96 bp, Homo sapiens
tttatgatgaatggatattagattttatcgaaagcttttctgcatctattgagatgattatatagtttttgtttttaattctgtttatgtagtgaa

SEQ ID NO: 56417 - DNA, 96 bp, Homo sapiens
tggttggtcttttctgaattaatttatatttaattgaggagaagtagtttccatttctcatacataattataaaaggaagtttagttggctgaccg

SEQ ID NO: 56418 - DNA, 95 bp, Homo sapiens; identical to SEQ ID NO: 68

SEQ ID NO: 56419 - DNA, 93 bp, Homo sapiens; identical to SEQ ID NO: 69

SEQ ID NO: 56420 - DNA, 70 bp, Homo sapiens
gagcctcagattcttcatttgtgaaaataggaagaatagttttatttcagtcaagtagagtttgaggttc

SEQ ID NO: 56421 - DNA, 78 bp, Homo sapiens
ggccgtgctgtctgcctgagttcacatggagatgggaccaccggtctggaagctctagcaggcattgctcacctggct

SEQ ID NO: 56422 - DNA, 110 bp, Homo sapiens
tgcttaggattgtcttggctatttgtgctcttttttggttccatatgaaatttaaagtagttttttccatttctgtgacaaaagtcagtggtagcttgatggggatagca

SEQ ID NO: 56423 - DNA, 95 bp, Homo sapiens; identical to SEQ ID NO: 580

SEQ ID NO: 56424 - DNA, 93 bp, Homo sapiens; identical to SEQ ID NO: 69

SEQ ID NO: 56425 - DNA, 72 bp, Homo sapiens
acacaggtcttttctatgtatagtagaattttgtatagtagaatttatgatacatttagaaaagacctgtgt

SEQ ID NO: 56426 - DNA, 118 bp, Homo sapiens
ggtgactctggggtttttgtggttccatatcaattttagaattgttttttctattaatatttttatgaagaatgacctcggtattttgataggcattgtatgaaatctgtagattgct

SEQ ID NO: 56427 - DNA, 84 bp, Homo sapiens
atgcctgttattactttttcttacccaattgctctagctaagactacgggtactacgttgaatagaagtggcaagagtgggcat

SEQ ID NO: 56428 - DNA, 89 bp, Homo sapiens
atccttacaactttctgggatggttaatattgtcaacttggttgggttgaaggatgtaaagtattgttccctggtgtgtctgtgagggt

SEQ ID NO: 56429 - DNA, 88 bp, Homo sapiens
taggatcctgctctgtctcccaggctagagtgcagtggtgctatcgtggctcactgcagtctcagtcacccaggctcaagccattctg

SEQ ID NO: 56430 - DNA, 113 bp, Homo sapiens
actctgctttcacacttgacttatgtaaatgatctttctctctttttttaatttttatttttattttaagttctggggtacatatacatgatgtgcaggtttgttacacaggt

SEQ ID NO: 56431 - DNA, 111 bp, Homo sapiens
gtcttttctgcatctattgaggtgatcatgtgtttttttttgcgttttttttttttttttttttggacagagtgtcactttgtcacccaggctggaatgcagcggcgagac

SEQ ID NO: 56432 - DNA, 95 bp, Homo sapiens; identical to SEQ ID NO: 68

SEQ ID NO: 56433 - DNA, 93 bp, Homo sapiens; identical to SEQ ID NO: 69

SEQ ID NO: 56434 - DNA, 89 bp, Homo sapiens
tttatttcagaattcatctttggctcagctagaagcatgttgtttaatttccatgcgtttggaggttcccattatttttctgttgtgga

SEQ ID NO: 56435 - DNA, 77 bp, Homo sapiens
gccatgctttcttatgtttgtgtatgtgtatacgtatgcgtatgtgcatatgtttagatgtatgtatagtcatgtgc

SEQ ID NO: 56436 - DNA, 117 bp, Homo sapiens
gattaactcaaggtactgtttgctttaagcaataagatatatctatgtaattttataaaataatgacaggtttccatagtgtattgaaccatcttaagttaacagactcttttagtc

SEQ ID NO: 56437 - DNA, 58 bp, Homo sapiens
tgagacagagtctcactctgtcacccaggctggagtgcagaggcatgatctcggctca

SEQ ID NO: 56438 - DNA, 113 bp, Homo sapiens
accctaaaataattttagattcatgcaaaatcttgtctgtggcctacaggtaactttatatatatttagagttggatagagtgacgtacatctgcattagtattagttggggt

SEQ ID NO: 56439 - DNA, 104 bp, Homo sapiens
ctgagagcaatataattggatgatgagaatgacagggaacttggttcaaagagtcaaattttagattttttttctttgttaaataatatgttgtagtctcttgg

SEQ ID NO: 56440 - DNA, 116 bp, Homo sapiens
ataatatgtgttattgaagttaaaaatttggaatattcagttggttttgtaaagaatgaaatctatttttttctttcctttgagttttagacaaggggctttagtttccaaattat

SEQ ID NO: 56441 - DNA, 110 bp, Homo sapiens
gtgtgagccactgtgcccagcctatccccagtttatttatttatttttatttttatttttttgagatggagtctcgctgtgtcacacaggctggagtgcagtggcgccat

SEQ ID NO: 56442 - DNA, 103 bp, Homo sapiens
tgaatgacagagtgagacccccatctcttaaaataaaagagagattagcattgatacaataccatttttttttttttgagacagagtctcacactgtcgccca

SEQ ID NO: 56443 - DNA, 114 bp, Homo sapiens
gacagaatgagattccgtttcaaaaataaataaataaataaataaataaataaataaataaagaattattgtttttaatttttgtttttttctgagataggctgttactctgtc

SEQ ID NO: 56444 - DNA, 112 bp, Homo sapiens
caggagtttgagaccagcgtaggcaacacagtgagacaccttatttatttatttatttatttatttaagatagagtctcactctgtcgcccaggctggagtgcagtggtgtg

SEQ ID NO: 56445 - DNA, 139 bp, Homo sapiens
tatatatatgcatatatatacatatatgcatatatacacacatgtatatatatgcatatatatacatatatgcatatatatacacacatgtatatatatgcatatatatacatatatgcatatatatatatatggtgta

SEQ ID NO: 56446 - DNA, 171 bp, Homo sapiens
caccatatatatatatatgcatatatgtatatatatgcatatatatacatgtgtgtatatatatgcatatatgtatatatatgcatatatatacatgtgtgtatatatgcatatatgtatatatatgcatatatatatatacatgtgtgtatatatatgcatatatatata

SEQ ID NO: 56447 - DNA, 58 bp, Homo sapiens
tgagacagagtctcactctgtcgcccacgttggagcgcagtggcgtgatctcggctca

SEQ ID NO: 56448 - DNA, 117 bp, Homo sapiens
atcacaccactgcactccagtctgggtgacaaagtgacaccctgtctctctctttttttttttttttttgagatggagtctcgctgtgtcacccaggctgaagtgcagtggcatgat

SEQ ID NO: 56449 - DNA, 68 bp, Homo sapiens
ctgggtgacaaagtgacaccctgtctctcttttttttttttgagacagagtctcgctctgtcgcccag

SEQ ID NO: 56450 - DNA, 114 bp, Homo sapiens
ccaccctcttgcttactgtcagttccctcatctatctatctatctatctatctatctatctatctatctatctggggtgggtagagatgagtctggctatgttgttcaggctgg

SEQ ID NO: 56451 - DNA, 62 bp, Homo sapiens
agacagggtctcactctgtcactctctcatccagggtggagtgcagtggtgtgatctcagct

SEQ ID NO: 56452 - DNA, 96 bp, Homo sapiens
tttcatgtgcttttcataagttcctaaatatttttttaatttttttcaatggtgtaaaaatgtaaaaggcattcttagcttatgagccatatgaaa

SEQ ID NO: 56453 - DNA, 60 bp, Homo sapiens
ccatccagtgacaaagtgatttttttttttgagacagtgtcactctgtcacccaggctgg

SEQ ID NO: 56454 - DNA, 86 bp, Homo sapiens
cattgtgtttcctggttttataagttgtttttacaataagaatgtatgtatgtagctatgtatttatataatgggggaagccagtg

SEQ ID NO: 56455 - DNA, 95 bp, Homo sapiens
tgaactatctgaattgtcctaccacaaatatgtataacttctattttaattttttatgtcaacaggagttatctgtgtgataggattatagttca

SEQ ID NO: 56456 - DNA, 108 bp, Homo sapiens
tacgcttatctttcaagacccagcttatatctctctcttcagtgacaccctcattgactgacatatattgacagaggtatttgctcttcttcctgaatcataactgta

SEQ ID NO: 56457 - DNA, 95 bp, Homo sapiens; identical to SEQ ID NO: 68

SEQ ID NO: 56458 - DNA, 93 bp, Homo sapiens; identical to SEQ ID NO: 69

SEQ ID NO: 56459 - DNA, 95 bp, Homo sapiens; identical to SEQ ID NO: 68

SEQ ID NO: 56460 - DNA, 93 bp, Homo sapiens; identical to SEQ ID NO: 69

SEQ ID NO: 56461 - DNA, 75 bp, Homo sapiens
tggctggggcacccggccacattttcagcagcagcacccagtgcctctctctctgagtgtcctacgtttcagtca

SEQ ID NO: 56462 - DNA, 64 bp, Homo sapiens
ggtagtctggcattactctctgtagcctgtgatgacagtgactatgaggtgaggctcctctgcc

SEQ ID NO: 56463 - DNA, 77 bp, Homo sapiens
ccaaaatctcatgtcaaattgtaattctcaatgttgggggagagacctagtgggaggaaatttgatcatgggggtgg

SEQ ID NO: 56464 - DNA, 103 bp, Homo sapiens
tataaataagtatattttattaatataaacatatgatttttatatttttatataaataataaagttatatatagtgtatatgtaaaatacacttttatttgta

SEQ ID NO: 56465 - DNA, 80 bp, Homo sapiens
ctgggattacaggtgtgagccaccaccccgggctctttttttttttttttcttgagatggagtctcactctgtcacccag

SEQ ID NO: 56466 - DNA, 86 bp, Homo sapiens
gctggtaatgtttttatctttcaatatttagtacttccttcaggagctcttgcaaggcaggcctggtggtgatgaattccctcagc

SEQ ID NO: 56467 - DNA, 95 bp, Homo sapiens; identical to SEQ ID NO: 68

SEQ ID NO: 56468 - DNA, 93 bp, Homo sapiens; identical to SEQ ID NO: 69

SEQ ID NO: 56469 - DNA, 92 bp, Homo sapiens
tgcaggaataattaagggaaaggtaagatggggagtggatgagctcagatctctttcactgtcataattttctcattgatataatttttgta

SEQ ID NO: 56470 - DNA, 85 bp, Homo sapiens
gcaagtccagtctcactcacactgtgccccactaagagcacgaagtttatatccaggcagccagtgagcagtgctgagatcttgc

SEQ ID NO: 56471 - DNA, 75 bp, Homo sapiens
tatatatacacaccatatatatacacacatatatattcacacacatatatatgtgtgtgtatatatatatatgta

SEQ ID NO: 56472 - DNA, 78 bp, Homo sapiens
tggtgaacggggaacatttccacactgctgttgggaatgcaaactagtacagcagtgtggagattccttaaagaacta

SEQ ID NO: 56473 - DNA, 128 bp, Homo sapiens
catggtatgtgtatacatatatatatatatatatatatacgtatatagatatatgtatatatatatgtgtatagatatatgtatgtatatatatatgtgtatatatatatatgtatatatatatatac

SEQ ID NO: 56474 - DNA, 72 bp, Homo sapiens
tgtgcatatattgtgtatatatatacaatatgttgtgtatatattgtgtatatatctacaatatgttgtgta

SEQ ID NO: 56475 - DNA, 95 bp, Homo sapiens; identical to SEQ ID NO: 68

SEQ ID NO: 56476 - DNA, 93 bp, Homo sapiens; identical to SEQ ID NO: 69

SEQ ID NO: 56477 - DNA, 116 bp, Homo sapiens
aagtaaagtcattgggtgtaaactattgggaagacaggcttttgtcaaggaatgtagattaattttttaacatagatactttacagtggaataattttgaactagtgaacatgctt

SEQ ID NO: 56478 - DNA, 77 bp, Homo sapiens
gttagctttggactggccaagtagctttgattctcctggaaagctgattcaactcactgtccagtccagcacctgac

SEQ ID NO: 56479 - DNA, 117 bp, Homo sapiens
gcaagtattcagttaataagagcttgggtagtgagggacattttatatgtgctgtttatatatatctgttatacttactgcaatgtctccaaatgttttccattaaactttgcatgt

SEQ ID NO: 56480 - DNA, 110 bp, Homo sapiens
tgcatatatatatatatatatatatgcgtatatatacatatacgtttatatatatatacatatatatgtatatatatgtatatatatatagtttatgtccatgtaatgta

SEQ ID NO: 56481 - DNA, 111 bp, Homo sapiens
atcaaatccatgtggtttgaagtgtgcgtcattgagcccctgaacaaattattattattttacttcaatttcatggtaagtgaaacagcacgttttattcaaagatatgat

SEQ ID NO: 56482 - DNA, 84 bp, Homo sapiens
tgtgtgtgtgtatatatatacgtgtgtatatatatatgtgtgcttatatatacatatatatatgtgtgtgtgtatatatatata

SEQ ID NO: 56483 - DNA, 157 bp, Homo sapiens
tatacatatacacacatatatacgtatatatgtaaacgtatatatacacgtaaataaatatatttatatatacgtatatacgtatacacatatatacgtatatatgtatatatacgtatatatgtatgtatatatgtatgtatatatacgtatacac

SEQ ID NO: 56484 - DNA, 100 bp, Homo sapiens
ataatttcttgcaggagtgttttgcagtttttcttgtagagatatttcacctcattggttaagtattttatatttttgcagctgttgtaaaagggattgt

SEQ ID NO: 56485 - DNA, 122 bp, Homo sapiens
gttgaggagatatttttagtgtatttgcgatgcagatttagaattctaatgattttcttgtagaggtgtctttggaaaatattgctgtataggtggcataatcacactttgcccacaatctc

SEQ ID NO: 56486 - DNA, 108 bp, Homo sapiens
tcttttagaaatagaataacattagggttattacatctgcaaacataatttggaatcttttttttttttttgtagcaacttgcctgtatgttattctacactcaaaga

SEQ ID NO: 56487 - DNA, 87 bp, Homo sapiens
tctatctatctatctatctatctatctatctgttgtgggaagtcaaggaccccgaacagagagactgactgaacctgtggcagaaga

SEQ ID NO: 56488 - DNA, 163 bp, Homo sapiens
ctcttaaatctgtatatatacagatttatatatttaaacatttatatatatagactatatgtatatatacatatatgcagagtatatatatatatatacagactatatatgtgtgtgtgtgtatatatatatatagatatatatagtctgtatatacatatat

SEQ ID NO: 56489 - DNA, 89 bp, Homo sapiens
cctgtttcagttctccatagtgattcagagtggcagtactttataatgtttgatgcttttatatctctatagacttgacttcatacagg

SEQ ID NO: 56490 - DNA, 95 bp, Homo sapiens; identical to SEQ ID NO: 68

SEQ ID NO: 56491 - DNA, 93 bp, Homo sapiens; identical to SEQ ID NO: 69

SEQ ID NO: 56492 - DNA, 95 bp, Homo sapiens; identical to SEQ ID NO: 68

SEQ ID NO: 56493 - DNA, 93 bp, Homo sapiens; identical to SEQ ID NO: 69

SEQ ID NO: 56494 - DNA, 140 bp, Homo sapiens
gatgactccagctttgttctttttggttaggattatcttggctctgtgtgctctgttttggttccatatgaaatgtaaagtagttttttccaattctgtgaagaaagtcattggtagcttgatggggattgcattgaatc

SEQ ID NO: 56495 - DNA, 178 bp, Homo sapiens
tatatacatatatagcatgtatatacacatatatacatatatgtatatactatatatgtgtgtatatatacatatatatgtatgtgtatatatgtatatatatgtatgtatatatacacatatatatggatgtgtatatatatgtgtatatatatgtgtatatatatgtgtgtatata

SEQ ID NO: 56496 - DNA, 304 bp, Homo sapiens
atatacacatccatatatatgtgtatatatacatacatatatatacatatatacacatacatatatatgtatatatacacacatatatagtatatacatatatgtatatatgtgtatatacatgctatatatgtatatacatatatgtatatgtatatgtgtgtatatacatactatatatgtatatacatatatgtacatatgtgtatatacatactatatatgtatatacatatatgtatatatatggatgtatatatgtatgtatatatatgtgtggatttatatatacacatatatacat

SEQ ID NO: 56497 - DNA, 117 bp, Homo sapiens
gtgtggtctgagagaaaagtgtttgtttatgactttagcccactttttaatttttttcttgaaaatttgtttaagttttattatagaggctgtatattagaactttctcagatgcat

SEQ ID NO: 56498 - DNA, 115 bp, Homo sapiens
gcctccagctttgttctttttggttaggattatcttggctctgtgtgctctgttttggttccatatgaaatgtgaagtagttttttccagttctctgaagaaagtcaatggtagc

SEQ ID NO: 56499 - DNA, 105 bp, Homo sapiens
gcttcaagaaatttctgcagctccaaccacacaggagagagtgagcttgcacacaaatcagttcagacttcagaccagtggggtggttgtccacaagtatgaagc

SEQ ID NO: 56500 - DNA, 111 bp, Homo sapiens
agcttatattagtatgttttatttgccacaactgatgaactaataatgacaaattatttttaattaatgtccatagtttattcagttttttaaagtttatacctaatggct

SEQ ID NO: 56501 - DNA, 122 bp, Homo sapiens
agctttttttttttttttgcttaggattgtcttggctatgtgggctctttttttgttccatatgaaatttaaagtagttttttccaattctgtgaagaaagtcaatggaagcttgatgggga

SEQ ID NO: 56502 - DNA, 77 bp, Homo sapiens
tcagcattgtaaaagtctgtgatagaattgtggaacccccaggggactctcactcactcacccttttcccatgttga

SEQ ID NO: 56503 - DNA, 115 bp, Homo sapiens
gcagcaaagaagtgtcacccccagctgatcattccaatttgcagtggctctgtgtttctctgtcatatagctagctcccagagacaaatgacagcccgtctgccatcactgctgc

SEQ ID NO: 56504 - DNA, 58 bp, Homo sapiens; identical to SEQ ID NO: 30286

SEQ ID NO: 56505 - DNA, 122 bp, Homo sapiens
gtgccttagctgtcttatctgtgttttactgtctgctctttctggctgcttgtagttagaagagaagtgatttccttgaaatgcatgaggctagaatgggagctggaactgaaagtggcagt

SEQ ID NO: 56506 - DNA, 92 bp, Homo sapiens
gtgggcacatagctgtggagggacaaaggtgatgctgggcacacagactgaccacacagagctgggtctcttcaacaatgtcgtatgtctac

SEQ ID NO: 56507 - DNA, 116 bp, Homo sapiens
actgcatatgttttcatggcttggtgtttactttttaaatgtgtgaaacataaaatttctgaaatttttgtatatttagatccatctaaaactaaagctcccagaaatataggagt

SEQ ID NO: 56508 - DNA, 95 bp, Homo sapiens; identical to SEQ ID NO: 68

SEQ ID NO: 56509 - DNA, 93 bp, Homo sapiens; identical to SEQ ID NO: 69

SEQ ID NO: 56510 - DNA, 112 bp, Homo sapiens
ttttatgcatttagaggggctaattattttgctctgagctactaaaatgtatatctatatgatactatttttctaggacagggaggtttggtttatttgacgggccataaaa

SEQ ID NO: 56511 - DNA, 95 bp, Homo sapiens; identical to SEQ ID NO: 68

SEQ ID NO: 56512 - DNA, 93 bp, Homo sapiens; identical to SEQ ID NO: 69

SEQ ID NO: 56513 - DNA, 80 bp, Homo sapiens
cacaggcagaagagactgagctcctccctctatgtgattgtggcatgctgggagcatgtgtgaagtccttaggctctttg

SEQ ID NO: 56514 - DNA, 99 bp, Homo sapiens
gctaggctggggaagttctcctggatgatatcctgaaatgtgttttccaacttggttccattctctctgtctctttcaggtactccaaacagtcatagt

SEQ ID NO: 56515 - DNA, 129 bp, Homo sapiens
atacatacacgtatacatatatatgcatacgtgtatgtatacatatatatgcatacatgtatgtgtatatatgtatatatatgtatatgtatatatgtatatatgtatatatatacacacacatacata

SEQ ID NO: 56516 - DNA, 91 bp, Homo sapiens
agtagttatctctgagtctctgtttgagtgtgtgtattttaatacctattgtatattttagagtacagtgctcaatgggagagaaaacact

SEQ ID NO: 56517 - DNA, 58 bp, Homo sapiens; identical to SEQ ID NO: 1763

SEQ ID NO: 56518 - DNA, 117 bp, Homo sapiens
ttagctgtttggggtcttttctggtttcacttgaattttaggattttttttctatttatgtgaaaaatgtcattgaaattttcatagagattgcattagatctgtaaatgttgttgg

SEQ ID NO: 56519 - DNA, 111 bp, Homo sapiens
attcagtatgatattggctgtggatttgtcataagtagcttgtattgttttgaaatacgttcgatcagtacctagtttattgagagtttttagcatgaagcgttgttgaat

SEQ ID NO: 56520 - DNA, 58 bp, Homo sapiens; identical to SEQ ID NO: 1911

SEQ ID NO: 56521 - DNA, 88 bp, Homo sapiens
gcctcccactattattgtgtgggagtctcagtctctgtaggtctctaataacttgctttatgaatttgggtgctcctgtattgggtgc

SEQ ID NO: 56522 - DNA, 89 bp, Homo sapiens
ctcccatggtgtgtatttatttatttagatattcctcagtattttatttactgggttgaatagtttaagcttcaggccaatagtggaag

SEQ ID NO: 56523 - DNA, 113 bp, Homo sapiens
agcacagttgcttcttcctgcagctctttggatgtattggtctgtgtgactcgctcacagccttatttgacttagaaatctttgtgagtagctaaggagtgtggccatgtgct

SEQ ID NO: 56524 - DNA, 89 bp, Homo sapiens
gtgtgtgaagaatgtgtatgtgtgcatatatatatatatatatatatatatatatatatatgtacacatacacaaatatatatatatac

SEQ ID NO: 56525 - DNA, 95 bp, Homo sapiens; identical to SEQ ID NO: 580

SEQ ID NO: 56526 - DNA, 93 bp, Homo sapiens; identical to SEQ ID NO: 69

SEQ ID NO: 56527 - DNA, 63 bp, Homo sapiens
gacagactgagtctgtctttttttttttttttttttttttttgagacagagtctcgctctgtc

SEQ ID NO: 56528 - DNA, 118 bp, Homo sapiens
cacgtattgatagagatgagctgacagcatttgtgcagacttttctttttttaaatttttatttttatttgaagttctggggtacatgtgcaggatgtgcaggtttgttacataggtg

SEQ ID NO: 56529 - DNA, 86 bp, Homo sapiens
tatatctatatctatatatacatacagatatatatgtgtatatatatctatatctatatatctgtatgtgtatatatacagatata

SEQ ID NO: 56530 - DNA, 117 bp, Homo sapiens
gaggcataatgatatggttcagctctgcatccccacccaaatctcatgtcaaattgtaattctcattgttggaggaggggcctggtgagagctgattggatcatggggggtggtttc

SEQ ID NO: 56531 - DNA, 121 bp, Homo sapiens
gtatctatgtatattgatcaatgtctacatatcaacaaagatatatatttatgtagatatacatagatatgtatatatttctatctgtattaaatatatatgtctatgtatacatatatag

SEQ ID NO: 56532 - DNA, 153 bp, Homo sapiens
tatatacacacacgcacatatatatgtgtgtatatatatatatgtatgtatgtgtacatatagtatatatatgtgtgtatatatatagtatatacacatgagtatatatatatatatatatatatatatatatatatatatatataaagtgta

SEQ ID NO: 56533 - DNA, 128 bp, Homo sapiens
tatatatatgtgttctctctctctctcgatatatatatacatctgtgtatatatatataatctgtatatatatatatacatctgtgtatatatatacatctgtatatatatacatctgtatatatata

SEQ ID NO: 56534 - DNA, 98 bp, Homo sapiens
cagtggaattgctgggtctaatggtagttcacttttaagttctctgagaaatctatttttcacagtggctgaagtaatttatattcccgctagcactg

SEQ ID NO: 56535 - DNA, 83 bp, Homo sapiens
ttgacctgaattttttttcattatgactctgccagttttttggtgtcagaatgatgctggcctcatagaatgagtcagggaag

SEQ ID NO: 56536 - DNA, 63 bp, Homo sapiens
atatagattctccgtgtatatatacatatttagatgtgtgtgtgtatatatacgtatgtatgt

SEQ ID NO: 56537 - DNA, 57 bp, Homo sapiens
tgagacagagtctcactctgtcaccaggctggagtacagtggtgtgatcttgtctca

SEQ ID NO: 56538 - DNA, 94 bp, Homo sapiens
gcagaccaattatactgtgagaatttctatatgtttttaatgacaataaaatcatatttttcatgttatttttctcagtgctgatggtcacggc

SEQ ID NO: 56539 - DNA, 95 bp, Homo sapiens; identical to SEQ ID NO: 68

SEQ ID NO: 56540 - DNA, 93 bp, Homo sapiens; identical to SEQ ID NO: 69

SEQ ID NO: 56541 - DNA, 65 bp, Homo sapiens
ttgcctatatatatgtgtgtatatatatgtgtgtgtgtatacatatatatatgcacacactgcag

SEQ ID NO: 56542 - DNA, 60 bp, Homo sapiens
tatatatgtgtgtatatgtatgtgtgtgtgacacatacacacacacacacacacaatgta

SEQ ID NO: 56543 - DNA, 56 bp, Homo sapiens
ctcctaaaccagtcagaattgagtgagaaataactcactctgacttggttgagcag

SEQ ID NO: 56544 - DNA, 95 bp, Homo sapiens; identical to SEQ ID NO: 68

SEQ ID NO: 56545 - DNA, 93 bp, Homo sapiens; identical to SEQ ID NO: 69

SEQ ID NO: 56546 - DNA, 92 bp, Homo sapiens
ctcattcaagaatggtttatttattttattcttatttatattatttgcatgattcaatatttatgaaatgttcaaaacatttcatgagtgag

SEQ ID NO: 56547 - DNA, 72 bp, Homo sapiens
cacaataaaccatatgtatatatatttgtgtgtgtatatatacatatatatgtgtgtttgtgtgtgtgtgtg

SEQ ID NO: 56548 - DNA, 101 bp, Homo sapiens
atatatacacacacatatatacacacactcgtatatatattatatatacacacactcgtatatatgtatatatgtgtatatatatgtgtgtatttatatat

SEQ ID NO: 56549 - DNA, 147 bp, Homo sapiens
gcagcatgtgaacagagtaattatatatatatgtgtgtgtgtgtatatagatatatattatatatatgtgtatatatatatattgtatatatgtgtatatatatatattatatatagtgtatatatataacaattccatatatatat

SEQ ID NO: 56550 - DNA, 110 bp, Homo sapiens
ggctattctgggtcttttgcagttttatataaattttcatatttttttctatttctggaaagaatgtcattggtattttgaaagagactgcatttaatctgtaaattgct

SEQ ID NO: 56551 - DNA, 97 bp, Homo sapiens
gccattctgacccgtgtgacatggcagctcactgtggttttgatatatatttatctaatgatcagtgatactgagctttcttcatatgttctatggc

SEQ ID NO: 56552 - DNA, 94 bp, Homo sapiens
gaggctttcctgacaccagggttgcaaggattcgtggaagaaatgtaggcccttggggtttctcactcactgtttccctgggcaggaaagcctc

SEQ ID NO: 56553 - DNA, 108 bp, Homo sapiens
tttaaaatcaggaagtgtgatgcctagaactttatttttaattcttaagttccttaagatatgttaggaattctgtggttttacattcattttagaatttctgttttt

SEQ ID NO: 56554 - DNA, 85 bp, Homo sapiens
ttcattgctttaaactgtgaagtagtaggatcatttgttacatattaatagataactattgcagtcacactttatatggtaagaa

SEQ ID NO: 56555 - DNA, 106 bp, Homo sapiens
gttcaataccagctagtacaacttctaagaaagatcatttaatttgtaatatgtaagattcattttaaaaatagtgtttgaggggtggctggcaagatggctgaat

SEQ ID NO: 56556 - DNA, 73 bp, Homo sapiens
tgctcaccagcattacagagatacaatattctgcatttgtatgtatgtatgtgtgtgtgtgtgtgtgtgtgta

SEQ ID NO: 56557 - DNA, 58 bp, Homo sapiens; identical to SEQ ID NO: 23440

SEQ ID NO: 56558 - DNA, 95 bp, Homo sapiens; identical to SEQ ID NO: 68

SEQ ID NO: 56559 - DNA, 93 bp, Homo sapiens; identical to SEQ ID NO: 69

SEQ ID NO: 56560 - DNA, 95 bp, Homo sapiens; identical to SEQ ID NO: 580

SEQ ID NO: 56561 - DNA, 93 bp, Homo sapiens; identical to SEQ ID NO: 69

SEQ ID NO: 56562 - DNA, 89 bp, Homo sapiens
catatttattgtggtctagaacatactttattttttatttgatacagtctttcaaatgtgttaagatgtgttttatagcacaaaatgtg

SEQ ID NO: 56563 - DNA, 114 bp, Homo sapiens
cttttacgtttacatctttgatacactttagtttttgtgtatagtgtgagtccaaccttatttatttattttgcacatggatatacagttgtatcagtagtattttttgaaaag

SEQ ID NO: 56564 - DNA, 103 bp, Homo sapiens
tatgcattgaaacaccactatgtaccccatgaatatgtacaattattttcaattaaaaattaaatatatatatttatctaaaatatgtgcttttgaatgcata

SEQ ID NO: 56565 - DNA, 132 bp, Homo sapiens
gagtagtattccattgtgtgtgtgtatatatatatatataaatatacatatacatatatagtattccattgtgtatatgtatatatatacatacaatggaatatatatgtgtgtgtgtgtgtgtgtatctca

SEQ ID NO: 56566 - DNA, 66 bp, Homo sapiens
tcccagactatggaattgaaggaaaacgggtttccttcacagttctgccactcactcactctgggg

SEQ ID NO: 56567 - DNA, 114 bp, Homo sapiens
tctaaagaggtacttctaactgccattaggattgggacaatgaccgctcttaactgcttaatacagacagtgggtgttcttttggggaaaataggagtcatatcttctctcaga

SEQ ID NO: 56568 - DNA, 105 bp, Homo sapiens
ctgtagcactgagacctaaagatgtagtattttaatgtttcaatttaaatgattattttcccaggcatttagatataagtggtactataaggtaagtaaatacag

SEQ ID NO: 56569 - DNA, 58 bp, Homo sapiens; identical to SEQ ID NO: 1215

SEQ ID NO: 56570 - DNA, 95 bp, Homo sapiens; identical to SEQ ID NO: 68

SEQ ID NO: 56571 - DNA, 93 bp, Homo sapiens; identical to SEQ ID NO: 69

SEQ ID NO: 56572 - DNA, 144 bp, Homo sapiens
gtgtgtgtgtgcatgtatatatatgtgtgtatatatatatatgtatacgtatatatatacgtatatatacatatatatatacgtatacatatatatatatacgtatatatacatatatatatacgtatacatatatatatatac

SEQ ID NO: 56573 - DNA, 86 bp, Homo sapiens
atcattgagtttaatgttagcttttagctttttatactttattgaatgtataaatatttaatatggcttttattatgctaaatggt

SEQ ID NO: 56574 - DNA, 107 bp, Homo sapiens
gcaccaaggatacaccagtgaacaaaataattaaaaatctctgacttcataaatattatattttatgcttttttaaataacatggacactggagtctaattgtgtgt

SEQ ID NO: 56575 - DNA, 88 bp, Homo sapiens
ttccctggattacaaggcagagattcttcttttctttattttttcccaaacaaatagagtctctctgtctgtgctgagccacctggaa

SEQ ID NO: 56576 - DNA, 95 bp, Homo sapiens; identical to SEQ ID NO: 68

SEQ ID NO: 56577 - DNA, 93 bp, Homo sapiens; identical to SEQ ID NO: 69

SEQ ID NO: 56578 - DNA, 116 bp, Homo sapiens
gtggagtatttaggccattcatattcaaggtgaataatattaatatgtgagattttgatcttgtcatattgtcattacctagttgccttggggtttcaattgtgtaattgtttcat

SEQ ID NO: 56579 - DNA, 83 bp, Homo sapiens
acagagagaagcagagagttgagagagtgaccagaacttgggggatccctgagaagctgtccacctctactttttcagactgt

SEQ ID NO: 56580 - DNA, 108 bp, Homo sapiens
atgcacatcaaccaacaagcagattaagaatatgtgagatatgtatatatatttgtgtatatatatatatacatatatatgtgtatgtatatatgtgtgtatatatat

SEQ ID NO: 56581 - DNA, 88 bp, Homo sapiens
ggacagtcatgtgtattttacagccattggataaaatgttctataaatatttattagatccttttggtctgtagtgcagattaagtct

SEQ ID NO: 56582 - DNA, 95 bp, Homo sapiens; identical to SEQ ID NO: 580

SEQ ID NO: 56583 - DNA, 93 bp, Homo sapiens; identical to SEQ ID NO: 69

SEQ ID NO: 56584 - DNA, 93 bp, Homo sapiens
tatacgtatatgtatatatgtatatatgtttttatacgtatatgtatatatgtatatatgtttttatacgtatatgtatatacatgtatgtgt

SEQ ID NO: 56585 - DNA, 102 bp, Homo sapiens
tttcaaagtattcataacttttcttgtgatttctttgatatatgagcttttttaaaagttttattattttgtaattggcataaaattgtgcatattttgagg

SEQ ID NO: 56586 - DNA, 89 bp, Homo sapiens
gtgccaacatagatatatatacacacacatacacatataaatatatatgtttatatatgcatgtgtgtgtatatatgttgtatatgcat

SEQ ID NO: 56587 - DNA, 83 bp, Homo sapiens
agaagatatgggcaggatatctatacatctatatcatctacctctacaactataattgtatctatatctatgtctatatttct

SEQ ID NO: 56588 - DNA, 97 bp, Homo sapiens
atataaattttgtatcttgaaactttactgaaattgtttatcaattacaatatacttttggtgaaatctttagggttttctagatatagatttatat

SEQ ID NO: 56589 - DNA, 114 bp, Homo sapiens
gatttttgcatattgaatttgattttgtatcctgaaactgtactgaatttgttcattagttttaacagttttttgggtagactcttcagagttttccacatgtaagaccatgtc

SEQ ID NO: 56590 - DNA, 169 bp, Homo sapiens
catgtagttatatatatatatatatatatatatatatatatatatatatatgtatacatatgtgtgtatatatatatgtgtgtatatatacatgtatatatacatgtatatatacatatatatatacatatatatatacacacacacatatatatatacatatatatat

SEQ ID NO: 56591 - DNA, 172 bp, Homo sapiens
tatatatatatatgtatatatatatgtgtgtgtgtatatatatatgtatatatatatgtatatatacatgtatatatacatgtatatatacacacatatatatatacacacatatgtatacatatatatatatatatatatatatatatatatatatatatataactacatg

SEQ ID NO: 56592 - DNA, 117 bp, Homo sapiens
tgcttcagattgtcttggctatacagctcctttttggttccatatgaaatgtgaagtagttttctctagttctgtgaataaagtcaatggtagcttgatgggaatagcattgaatct

SEQ ID NO: 56593 - DNA, 89 bp, Homo sapiens
atgagtagtatcccatggtgtgtgtgtgtgtgtgtgtgtatgtgtgtgtgtatataatatgtatatatatatgatatctatctatctat

SEQ ID NO: 56594 - DNA, 105 bp, Homo sapiens
tcactggtctgtgtatttcaatgtgtttttgtagtagctattaacaatttttcttttctatatttcgtgcttcctccaggagctcttgcaaggcaggcctggtgg

SEQ ID NO: 56595 - DNA, 118 bp, Homo sapiens
aggtctccagctttgttctctttgcttgggactgtcttggctatatgggctctttttggttccatatgaaatgtaaagtagatttttctaattctgcaaagaaagtcactggtagctt

SEQ ID NO: 56596 - DNA, 110 bp, Homo sapiens
atataagttttctgggataaatctccgggagtgaaattgctgggtcacatggtagttgcatgtttagttgttttaagaaactgtcaaattgttcttaagagttcctatat

SEQ ID NO: 56597 - DNA, 76 bp, Homo sapiens
gatagtagccactctgattggagtgaggtgatgtctcattgcattttttttttttgatacggagtctcactctgtc

SEQ ID NO: 56598 - DNA, 139 bp, Homo sapiens
atgtatgtgtgtatatatatgtatatgtgtgtgtgtatatatatatatctatatatatcctatatatctatatctatatatatcctatatatctatatctctatatatcctatatagctatatatatatctatatatcc

SEQ ID NO: 56599 - DNA, 83 bp, Homo sapiens
accacctccaattccaaggatctgaaagggatttttttttttttaatttctcagttcagttttccttgatgagttgctttggt

SEQ ID NO: 56600 - DNA, 77 bp, Homo sapiens
gctattggagtgtggatataaaaacagtataaaactgttgttagttttaacttgttttttacattttctaattttgc

SEQ ID NO: 56601 - DNA, 87 bp, Homo sapiens
ggatgccctttatttatttctcttttctgattgctctggtaggacttccagtactaggttgaatagaagtggtgaaaatgggcatcc

SEQ ID NO: 56602 - DNA, 66 bp, Homo sapiens
tacatctatatgcttatgtatgtgtgtatatatatatatacacacacacatttatacatatatgta

SEQ ID NO: 56603 - DNA, 128 bp, Homo sapiens
tatatgtataaatgtgtgtgtgtatatatatatatacacacatacataagcatatagatgtatatatatgtgtatatatgtacatctatatgtttatgtgtgtgtgtatatatatatatatatatata

SEQ ID NO: 56604 - DNA, 95 bp, Homo sapiens; identical to SEQ ID NO: 68

SEQ ID NO: 56605 - DNA, 93 bp, Homo sapiens; identical to SEQ ID NO: 69

SEQ ID NO: 56606 - DNA, 108 bp, Homo sapiens
cttacagaacaggtctcgcgttaatgaaaccctcagattttgttcatctgggaatgtctttatttctttatgtttggagggaattttcgctggatatgctatgctagg

SEQ ID NO: 56607 - DNA, 114 bp, Homo sapiens
gagcagtgtggtgcggtggcccaccatatatatatagtatgtgtgtatgtatatatatatacacacacacacatatatatatataggccaatgacactatgaagaaactgcatc

SEQ ID NO: 56608 - DNA, 87 bp, Homo sapiens
gtgtcattggcctatatatatatatgtgtgtgtgtgtatatatatatacatacacacatactatatatatatggtgggccaccgcac

SEQ ID NO: 56609 - DNA, 115 bp, Homo sapiens
ttagcatagtccttgcatgatttcctcacctgtaaacagcatcagtagtgtctgtcattttctcagtgcttagggtgtgatttttagtggagactatgttgaagttttgctggga

SEQ ID NO: 56610 - DNA, 115 bp, Homo sapiens
gcttaggattgtcttggctatgcaggctcttttttggttccatatgaaatttaaagtagttttttctaattctgtggagaaagtggatagttgcttgatggggatagcattgagt

SEQ ID NO: 56611 - DNA, 73 bp, Homo sapiens
tcgtgtaccagtaatcaagacttgtgttagagctgtagcaactgacacagtgtggtaatgatgctggtataga

SEQ ID NO: 56612 - DNA, 119 bp, Homo sapiens
gctgagaaatccattaatgtatgtgtgtatatatatatgtgtgtgtgtgtatatatatacatatatatgtgtatatatgtgtgtgtgtgtatatatatataaacatttcatctgtcagc

SEQ ID NO: 56613 - DNA, 107 bp, Homo sapiens
ggggacgtagtagtagtaaagtggaaatgttttgaagaatgcttatgaatttttataattattatgagatattctttgccaaccaccatatgatgggtacagtctgc

SEQ ID NO: 56614 - DNA, 58 bp, Homo sapiens
tgagttggagtctcactctgtcacccaggctggagtgcagtggtgcgatcccggctca

SEQ ID NO: 56615 - DNA, 77 bp, Homo sapiens
agaaaagccctacttcaaaatagagaaaaaggaaagatttttttttttttttttttttttttttagagatggcgtct

SEQ ID NO: 56616 - DNA, 98 bp, Homo sapiens
cacttctgcagcacaagactatcacttagaaaatatttgaagtttttttttcttcaacttttaagttccggggtacatgtgcaggatgtgcaggtttg

SEQ ID NO: 56617 - DNA, 109 bp, Homo sapiens
cagcaatgtacaagacttgccaacatttgttgtgtttttattttttaataatagccattctaacagatgtgatgttacttcttactgtggttttgatatgcatttcctg

SEQ ID NO: 56618 - DNA, 112 bp, Homo sapiens
tgtcaagaggctacttacaaacctggccacaagagtaaggagtctttttttttttttttttttttttttgagactgagtctcattctgtcaccaggctggagtgcagtggca

SEQ ID NO: 56619 - DNA, 82 bp, Homo sapiens
aggttttatatagaatatgtagatatagacatatgaatatatatctattttcatatgttatctacatctctatatatgcact

SEQ ID NO: 56620 - DNA, 84 bp, Homo sapiens
ggcaccactattggcagaggttttgataagcggtttccacacgtgtgtcgtgtgtctgtctgcctgcctgactgcctgcttgcc

SEQ ID NO: 56621 - DNA, 81 bp, Homo sapiens
gcacaccagggtgactatagtcaataataactttttttttttctgaaacaagttcttactctgtcacccaggctagagtgc

SEQ ID NO: 56622 - DNA, 80 bp, Homo sapiens
ggagatgtctggctctgtgtgtgggaagttgaagggacacttggtggtgccttcctccctcaaagcgtcacagcaagtcc

SEQ ID NO: 56623 - DNA, 95 bp, Homo sapiens; identical to SEQ ID NO: 580

SEQ ID NO: 56624 - DNA, 93 bp, Homo sapiens; identical to SEQ ID NO: 69

SEQ ID NO: 56625 - DNA, 84 bp, Homo sapiens
gttttacattgaaatcatttgttatatcagatgtttttaaatataaacatatgaaggtgatataacaggatattaagatgaaac

SEQ ID NO: 56626 - DNA, 74 bp, Homo sapiens
ttgagtagggtcctagggatgaaatttctgaattatatggtaattctatgtttacatttttgaggagccaccaa

SEQ ID NO: 56627 - DNA, 101 bp, Homo sapiens
gggcatttggaaaaactctccagttctgtctgactgagtccttccttttccataaaggttgtagttggggcgagcagacactggtaaacctgccaagttcc

SEQ ID NO: 56628 - DNA, 78 bp, Homo sapiens
aggcctctgtctcccagtctctgtgagaggatagaatcctgacttccatcatagccagctagcagacacagctggcct

SEQ ID NO: 56629 - DNA, 109 bp, Homo sapiens
tgtttggctttcatatcagggcaatggtagtctttttatttatttatttattattattattatactttaagttttagggtacatgtgcacaatgtggaggttagttaca

SEQ ID NO: 56630 - DNA, 99 bp, Homo sapiens
gcattttgtggcatgctcccaatgaaatgaaaatttctattatgcttttggtataacaaaacataatatgtttttttacatttcaggctcattttgtgt

SEQ ID NO: 56631 - DNA, 116 bp, Homo sapiens
tgtatagtatttcatggtgtatatatattatataatatatatatatagtatatataatatatattatatataaaatatataaaatatatataaaatatatatataaaatacatata

SEQ ID NO: 56632 - DNA, 110 bp, Homo sapiens
gggatgggcaagcttgggggctgaaaacaaaatggaattggttgggtcgaatctctttcactttctcagtcacaattttgcaataatggtttcaaaagctgcttatcacc

SEQ ID NO: 56633 - DNA, 135 bp, Homo sapiens
cagtgatggggcagtagatctattgtgtttttaaatttatttttatttttcttagagacagggtctcactgtgtccctgaggctggagttcaatggcgcaatcatagctcactgcagccttgacatcttagcccc

SEQ ID NO: 56634 - DNA, 94 bp, Homo sapiens
atgctgcattgaacatgggagtggtggatcataggataattctatttttaatttttttgtggaacctccatactgttttccgtaatgtttgtat

SEQ ID NO: 56635 - DNA, 272 bp, Homo sapiens
tatgcagtatatcaaatatatatatctgtatatatatatatctgtatatatatatctgtatatatatatatctgtatatatatatctgtatatatatatatctgtatatatatatctgtatatatatatatctgtatatatatctgtatatatatatctgtatatatatatatctgtatatatatatctgtatatatatatctgtatatatgtatatctgtatatatatatctgtatatatatatctgtatatatatatatatctgtatata

SEQ ID NO: 56636 - DNA, 71 bp, Homo sapiens
tgtttcacactctgtctttgtgatccgcccgccttggccacacaaagtgctgcaattacaggtgtgagcca

SEQ ID NO: 56637 - DNA, 84 bp, Homo sapiens
ctgaatgcctttaacggcacgtgagtcaccttttttttaatttttattttttgagacaaaggctcactgtgtctcctaggccag

SEQ ID NO: 56638 - DNA, 117 bp, Homo sapiens
cagcactttgggaggctgaggtgggcggatcacttgaggtcaggaagtcagaagtttgagaccagcctggccaacatgatgaaactccatctctactaaaaatacaaaacttagctg

SEQ ID NO: 56639 - DNA, 90 bp, Homo sapiens
ggcctgagccactgcacctggccaatgaaacttttttttttttttgagacagtctcactctgtttctctgactagagtgcagtggtgcca

SEQ ID NO: 56640 - DNA, 95 bp, Homo sapiens; identical to SEQ ID NO: 68

SEQ ID NO: 56641 - DNA, 93 bp, Homo sapiens; identical to SEQ ID NO: 69

SEQ ID NO: 56642 - DNA, 95 bp, Homo sapiens; identical to SEQ ID NO: 68

SEQ ID NO: 56643 - DNA, 93 bp, Homo sapiens; identical to SEQ ID NO: 69

SEQ ID NO: 56644 - DNA, 86 bp, Homo sapiens
tgtgctgatgaatagaatgtatattctgtagatgtttggtagaacgttctataaatatctgttaagtccatttgttgtagggcata

SEQ ID NO: 56645 - DNA, 114 bp, Homo sapiens
ttcctgtgttccttttagagaaggtggtttcctctggtgatactgtttagtttcttgctttatatatatattttggaccccttgtatttttttgctttaaggttaacatgggaa

SEQ ID NO: 56646 - DNA, 114 bp, Homo sapiens
agtcatccaggtattctgcatccagctgctgctgctaccattggtcttctctgtgcctctgggtctctgcaaagtactggcagaggtcctgggtgacttccatattgcttaggt

SEQ ID NO: 56647 - DNA, 93 bp, Homo sapiens; identical to SEQ ID NO: 69

SEQ ID NO: 56648 - DNA, 118 bp, Homo sapiens
gggtgtgtatatatgcatgtgtgtgtataaatgtgtgtatatatatatgtgtgtgtctctgtgtgtatatatgtgtatatatgcatacacatgtatgcatacttatatatgtatatct

SEQ ID NO: 56649 - DNA, 83 bp, Homo sapiens
gctcttttttggttccatatgaaatttaaagtagttttttccatttctttgaagaaagtcagtggtagcttgattgggagagc

SEQ ID NO: 56650 - DNA, 92 bp, Homo sapiens; identical to SEQ ID NO: 56506

SEQ ID NO: 56651 - DNA, 101 bp, Homo sapiens
agctctaaatctatttcaatagtatatatgtcgatagttacatagatataatatctaaatgaatatctgacaatattatcaagaatagatcctaagggact

SEQ ID NO: 56652 - DNA, 109 bp, Homo sapiens
gatgtttcttgattaaaagttatgaatagctctatttgaaaagcattgtttaattttatgtttttttaggcagatggggtagaagtcataatttcatttttgcaatgtc

SEQ ID NO: 56653 - DNA, 95 bp, Homo sapiens; identical to SEQ ID NO: 68

SEQ ID NO: 56654 - DNA, 93 bp, Homo sapiens; identical to SEQ ID NO: 69

SEQ ID NO: 56655 - DNA, 75 bp, Homo sapiens
attccacttggtcatggtgtgtaattttttttttttttttttagatggagtcttactctgtcaccaggctggaat

SEQ ID NO: 56656 - DNA, 87 bp, Homo sapiens
catgacgctgcttcttttgtggaaggctgcattttacattgtttttaaataagcgtgtaccctgctagaatacaagtaaatgtcatg

SEQ ID NO: 56657 - DNA, 116 bp, Homo sapiens
cctcattgagacaatttattttgttctgtaaaattaagcaccatttaatatacaatataatataattatttattttattaaatattttattccagtacaattgaatctttttgagg

SEQ ID NO: 56658 - DNA, 142 bp, Homo sapiens
atatatacacatatatatatacatatatatacatatatatacatatatatacatatatatatacgtatatatgtatatacatgtatatatacgtatatatatatgtgtgtgtatatatatatatatatatatatatatatat

SEQ ID NO: 56659 - DNA, 113 bp, Homo sapiens
catggaatatatatatggaacatatacatacatggaatatatatatatatggaacatatacatacatggaacatatatatatggaacatatatatggatatatatatggaatg

SEQ ID NO: 56660 - DNA, 116 bp, Homo sapiens
gcgagtgatctgccagcctcggcctcccgaggtgccgggattgcagacagagtctcgctcactcattgtagatggtgctcaatgttgcccaggctggagtgcagtggcgtgatctc

SEQ ID NO: 56661 - DNA, 115 bp, Homo sapiens
gcactccagcctgggcagcacagtgagactctgattgcagtggaaaaataggaacactttttttttttttttttttttgagatggagtctcgctctgtcacccaggctggactgc

SEQ ID NO: 56662 - DNA, 95 bp, Homo sapiens; identical to SEQ ID NO: 68

SEQ ID NO: 56663 - DNA, 93 bp, Homo sapiens; identical to SEQ ID NO: 69

SEQ ID NO: 56664 - DNA, 87 bp, Homo sapiens
aagaagtaggaaatactcatgacaattacagtcctcgtttctgcagctggtcatgtggttgtagctggtattgatgactactttctt

SEQ ID NO: 56665 - DNA, 78 bp, Homo sapiens
tctaatattgacagtgggatgtcaaagtctcccactactattgtgtgggagtctaagtctctttgtcagtctctaaga

SEQ ID NO: 56666 - DNA, 83 bp, Homo sapiens
gtgttagtatgagttaaatgttaaatgagcatgggctctggaatcagagcatgttggttattttgtttccttatatataaaac

SEQ ID NO: 56667 - DNA, 117 bp, Homo sapiens
tgtatatggtttttttgttttgagatggagtctcattctgtttatcttttattttattatatttttatttatttatttacggacagagtctccctctgtcacccaggccagagtgca

SEQ ID NO: 56668 - DNA, 86 bp, Homo sapiens
aactttgttttcactatttgagggtcaatattgatgtagactgcaaggttcacagaaaattgattccagactaaattagcagagtt

SEQ ID NO: 56669 - DNA, 72 bp, Homo sapiens
tgtgtgtgtgtgtgtgtgtatgcgtatatatatgtgtgtgtgtatatatgcatatatatatatacacagaga

SEQ ID NO: 56670 - DNA, 97 bp, Homo sapiens
aagggggtattgcattgtggttttgatttgcatttccctgatcattagtggtgttgatcattttttatatgtttgttggccatttgtgtatcttctt

SEQ ID NO: 56671 - DNA, 118 bp, Homo sapiens
tttatatcaaagtaaaattgaggtttcagtgctcctttaatagccagcccttctaaatatgtatatttttggtaatggctttgggagtactcttgagactattagacttgaaaataaa

SEQ ID NO: 56672 - DNA, 95 bp, Homo sapiens; identical to SEQ ID NO: 68

SEQ ID NO: 56673 - DNA, 93 bp, Homo sapiens; identical to SEQ ID NO: 69

SEQ ID NO: 56674 - DNA, 165 bp, Homo sapiens
tatataaatatatgtgcatataaatacatgtgtgtatatatgtgtatatacatatacatgtgtatatgtatatacatatatacacatacgtgtgtatatatacacgtgcgtatatacacacgtgtgtatatatgtatatacatgtatacacacacatatacacac

SEQ ID NO: 56675 - DNA, 111 bp, Homo sapiens
actcccagcactatgttgaatagggatggtgagtgtgggcattcttgtcttgttccagttgctaggggagaatgcttacaaattttgtccattcaatatgatgttggctgt

SEQ ID NO: 56676 - DNA, 204 bp, Homo sapiens
gtttatatatatatatatgtatatgtatatatatatgtgtgtatatatatgtgtatatatatatgtgtatatatatacgtatacatatatatgtatatatatacgtatatatatgtatatatgtatatatatgtatatatatatgtgtatatatatatgtatatatatatatgtgtatatatatatatatatatatatactaca

SEQ ID NO: 56677 - DNA, 95 bp, Homo sapiens; identical to SEQ ID NO: 68

SEQ ID NO: 56678 - DNA, 93 bp, Homo sapiens; identical to SEQ ID NO: 69

SEQ ID NO: 56679 - DNA, 111 bp, Homo sapiens
ttaggattgtcttagctatacaggctcttttttggttccatatgaaatttaaagtagttttttctaattctgtgaagaaagtcaatggtagcttgatgaggatagtgttga

SEQ ID NO: 56680 - DNA, 99 bp, Homo sapiens
ggcgtgagccaccgtgcccagtctttttttttttttttttttttgagttggagtctcactgtcgctcaggccagagtgcagcggtgccatcttggctca

SEQ ID NO: 56681 - DNA, 95 bp, Homo sapiens
tatatgtatatatatgtatgcatgtgtgtgtatatatatgcacacacacacatatatcacatacacacacacacacacacacacacgtagatata

SEQ ID NO: 56682 - DNA, 87 bp, Homo sapiens
tttaaaccattttgaatgtgaaaaagaaggtaattatgaaggatatttctttattatcttcttttttttaatttattatactttaag

SEQ ID NO: 56683 - DNA, 107 bp, Homo sapiens
ccagctttcttctttttgctgagaattgtcttggctatatgggttcttttttggttccatatgaaatttaaagtagttttttccaattctgtgaagaaagtcaatgg

SEQ ID NO: 56684 - DNA, 99 bp, Homo sapiens
taaatttacctgataagattctgaatttcttctgtgtgacagagcacacatctctgtcactctgagattgttcatttggtgacttattttgttcatttg

SEQ ID NO: 56685 - DNA, 104 bp, Homo sapiens
atgtgtgtgtatatatatatacaccatggaatactgtatatacatatacacatatatgtgtgtatatatatgtgtgtgtatatatatgtatacaccatggagta

SEQ ID NO: 56686 - DNA, 92 bp, Homo sapiens
tttatatatatgtatatgtgtatgtgtgtgtatgtatatatatgtatatatgtatatatatacacacatatatgtaaatatatatacataaa

SEQ ID NO: 56687 - DNA, 93 bp, Homo sapiens
gtgtaatggaagaaacacttctcagtaagtgaatttctctctttgtcactcaaatctagggaaatgctctgagatttgtcaactacatggcac

SEQ ID NO: 56688 - DNA, 67 bp, Homo sapiens
gggtttagtggtgtgtgtctgtagccctagctactctggaggctgaggtaggacgatcacttgatcc

SEQ ID NO: 56689 - DNA, 105 bp, Homo sapiens
tgtgatcaaatatgtatgtttgttttctctgcaaatgttattttatcaatattaattggtgaagttaacatttagtgagagatatttgaacaacttttgaaaata

SEQ ID NO: 56690 - DNA, 102 bp, Homo sapiens
atatatatatgtgtgtatatatatgtatatatgtgtgtgtatatatatgtatatatatgtgtgtgtatatatatatgtgtatatatatgtactgaagcatat

SEQ ID NO: 56691 - DNA, 86 bp, Homo sapiens
gtgggcacatagctgtggagggacaaaggtgatgctgggcacacagactgaccacacagagctgggtctcttcaacaatgtcctat

SEQ ID NO: 56692 - DNA, 115 bp, Homo sapiens
gaggcctcacaatcatggtagaaggtgaaagagaagagtttctcttagcggcagacaagagaagagagtgtgcagggaaactccccttttaaaaccatcagatcttgtgagactt

SEQ ID NO: 56693 - DNA, 92 bp, Homo sapiens
tatgtgtatgtgagtatgtgtgttatctattttcggatgtataaattatttatttagaatttatatatatatacatataatctccacacatg

SEQ ID NO: 56694 - DNA, 117 bp, Homo sapiens
tccagcagtctggatgtgcatctcatttggtttgcagctcagtttttcaatataatttattgtcgctgccatctggcttgctcaccaaggagatactcagcctttggacatgaagga

SEQ ID NO: 56695 - DNA, 72 bp, Homo sapiens
tgcctgttctgacattttagtttggaaatgcataacttgtttgatttcacaggctcacttcaggacaggaca

SEQ ID NO: 56696 - DNA, 112 bp, Homo sapiens
tgaaaaacccagcaatctcatgtggtttaacttaatattatgctttttttaatactttttaaaattatactttaagttctggggtacatgtgcagaatgtgcaggtttgtta

SEQ ID NO: 56697 - DNA, 87 bp, Homo sapiens
atattctgtattgtatgtatatagatatacatatatacatgtgtatgcacacatgtacgtgtgtgtgtaaaatacattatatgatat

SEQ ID NO: 56698 - DNA, 139 bp, Homo sapiens
tggtaccatcctctactactcattttggtgatgaccttgcattcttggaagaaatttttagtactgattttctagtagtagagggaaaagtactatcccattctcaaagaattattgttgtttgtttttatctagccaa

SEQ ID NO: 56699 - DNA, 118 bp, Homo sapiens
ttcatgaatatcaagcaaaacaagagttaactaaatgaactgaactcagaaagctgaagaaacctttttgatttttggttggaatattgctgatccttgttttgtttttcatagtgaa

SEQ ID NO: 56700 - DNA, 95 bp, Homo sapiens; identical to SEQ ID NO: 68

SEQ ID NO: 56701 - DNA, 93 bp, Homo sapiens; identical to SEQ ID NO: 69

SEQ ID NO: 56702 - DNA, 107 bp, Homo sapiens
tattttgttggtattaaagattgaggcttttaatttttttgttgtaaaaaattgcaattacctttaaaaaaattacactgtctctgttcatcctgccaaacaatttg

SEQ ID NO: 56703 - DNA, 70 bp, Homo sapiens
tatatgtatatatattcatatatattcgtatatattcatatattcgtatatattcatatatgtatatata

SEQ ID NO: 56704 - DNA, 140 bp, Homo sapiens
gtatatatgtgtatatatgtgtgtatatatgtgtatgcatatatgtatatatgtgtatgcatatatgtgtatacgtgtatgcatatatgtgtatacatatatatgcatacacatatatgtatatatgtgtatatatatat

SEQ ID NO: 56705 - DNA, 98 bp, Homo sapiens
aatactatattgaataagagtggtgagagagggcattcttgtcttgtgccagttttcaaagggaatgcttccagtttttgcccattcagtatgctgtt

SEQ ID NO: 56706 - DNA, 110 bp, Homo sapiens
tggactcacaccagtgttttgccaggggctctcaggccttcggccacagactgaagactgactgcagtcggctgccctgcttttgaggcttttggtctctgactgagcca

SEQ ID NO: 56707 - DNA, 57 bp, Homo sapiens
tgagacggagtctcactctgtcacccaggctggagtgcaggagtgcatctctgctca

SEQ ID NO: 56708 - DNA, 110 bp, Homo sapiens
gcacagagtgtcatgcctgtaattccagctctttggtaggctgatttgggaagattacttgaggacagaagtttgagaccagcctgggaaacacagcaaaacctcatcgc

SEQ ID NO: 56709 - DNA, 105 bp, Homo sapiens
ctaacagttatgaagtccagaagtctgagatcaaggtgttagcaagtttgattccttctgaggcctctctccgtggcttgaatatggctgccttcttgctgtggg

SEQ ID NO: 56710 - DNA, 89 bp, Homo sapiens
gtgcgtttgtatatatatgtgtatatatataggtgtgtgtatatatatatatatatataggtgtgtgtatatatatatatatatatata

SEQ ID NO: 56711 - DNA, 172 bp, Homo sapiens
atgtggttaaatatatttatgtatgtatatatgtatatatgtatatattatatatgtttataggtatatatttatatgtactatatatgtttataggcatatatttatatatgcatataggtatatatttatatataatatatatccatatgtatatatgtatgtctacaaa

SEQ ID NO: 56712 - DNA, 71 bp, Homo sapiens
tatatatacctatatataccatatatatatacaccatatatgtatatatatggtgtatatatatatatgta

SEQ ID NO: 56713 - DNA, 101 bp, Homo sapiens
tatatatatgtgtgtgcgtgtatatatctatatgtgtatatatatgtgtgtatatatgtgtatgtgtgtatatatgtgtatatatatgtgtgtatatatgt

SEQ ID NO: 56714 - DNA, 58 bp, Homo sapiens
tgagacagagtctcactctgtcacccaggctggagtgcagtggccagatctcggctca

SEQ ID NO: 56715 - DNA, 85 bp, Homo sapiens
atctatgtaaatgaacaccaatttatatatttttttaacttgtattttaagttaaggggtatatgtacaggttggttacataggt

SEQ ID NO: 56716 - DNA, 125 bp, Homo sapiens
gctggaaaatgaaaggaaagttgtatagacagaattgtatattaggagacaatacagaagagattatctacttttgtgtgtatgttgagagactaattttgaactgttaaacacagcatcctttt

SEQ ID NO: 56717 - DNA, 58 bp, Homo sapiens
tgagacaaggtctcactctgtcactcgagctagagggcagaggtgtgatcacagctca

SEQ ID NO: 56718 - DNA, 363 bp, Homo sapiens
tatatatgtatatatgtgtatatatgtatatatatgtatatatatgtatatatatgtatatatatgtgtatatatgtgtatatatgtgtatatatatgtgtatatatgtatatatgtgtatatatatatgtatatatgtgtatatatgtatatatgtgtatatatgtatatatgtgtgtgtatatatgtgtatatatgtatatatatgtgcgtgtatgtatgtgtatatatgtatatatatgtgcgtgtatttatatgtgtgtatatatatgtgtgtgtgtgtgtatatttatatatatactatatgtatatatatactatatgtatatatatatactatatgtatatatatatactatatgt

SEQ ID NO: 56719 - DNA, 134 bp, Homo sapiens
atgtgtatatgtatatatacgtatatatgtgtatatgtatacatatacgtatatgtgtatatatacatatatacatgtatatgtgtgtatatacgtatatatacacatatatacgtatatatacatatgtacgt

SEQ ID NO: 56720 - DNA, 213 bp, Homo sapiens
ataaattttatatatatatgtatatatgtatatatacatatatatataaaatatatataaaaatatatacgcatgtatatatacatattatatattcagtatatatatgtgtgtgtgtgtatatatatataatatacatatatatatacatatatatatacatatatatatataatatacatatatatatatatacgtatatatatatatata

SEQ ID NO: 56721 - DNA, 102 bp, Homo sapiens
ggccaattatgagccccaagtacagcaccattctccagggtgatcagccagctacctggtggtaggttgattacattggaccactgccatcatggaagggcc

SEQ ID NO: 56722 - DNA, 99 bp, Homo sapiens
caggacagtgagtgagttcttcagagagctggttgtttaaaagtgtgtgacaccaccctactctctttctccctctctctctgtctcactcctgctctg

SEQ ID NO: 56723 - DNA, 71 bp, Homo sapiens
ttctctctctctctgtcaagtgatcataggaaactctccatgaggccattggtgcaggctgagggaaagaa

SEQ ID NO: 56724 - DNA, 79 bp, Homo sapiens
tattatttctttctcttatctaattgctctggctaggacttccagtaaaatgtttgagtggtgagagagagcattaatg

SEQ ID NO: 56725 - DNA, 86 bp, Homo sapiens
gagaaagagagggagggaggagggactacatgattttaaattaccagatcgtccaataagtcactcactcactcactcactcactc

SEQ ID NO: 56726 - DNA, 111 bp, Homo sapiens
gagaaatatcagtgtttaagttaacatagacatgaatatataaatacagaaataactatagatgtatgtatttatgtatgggttagcatacatgcacttatacatattctt

SEQ ID NO: 56727 - DNA, 64 bp, Homo sapiens
atatatatatatatatatatatgtatatatatgtatatatacgtatatatgtatacatacgtat

SEQ ID NO: 56728 - DNA, 94 bp, Homo sapiens
gtatatatacatatatacgtatatatacatatatatacgtatgtatacatatatacgtatatatacatatatatacatatatatatatatatat

SEQ ID NO: 56729 - DNA, 107 bp, Homo sapiens
gcattaagagatttgcagtccttccaggtatgaaaattcagtaagtaaatatttttattcatagaatttatgtgaatggaaatgattgttccctaaaaagtacttgc

SEQ ID NO: 56730 - DNA, 84 bp, Homo sapiens
agaggaaatactcatgacagttacagtcctcatttctgcagttggtcatgtggttgtagctggaattgatgactaccttcttct

SEQ ID NO: 56731 - DNA, 115 bp, Homo sapiens
gggatgctggattttgtcaaatgcttacactgcgtctattgagatgattatatattttttgtttttaattctgtttatgtggtgtataacattttttacttatacatgttaaacc

SEQ ID NO: 56732 - DNA, 104 bp, Homo sapiens
aggataatggcctccagctccatccatgttactgcaaaggccatgatttcattattttttatggccatgtagtattccatggtgtatatgaagcacattttctt

SEQ ID NO: 56733 - DNA, 118 bp, Homo sapiens
agtggattttgttgtgtgtttttcttcactgttgaagtgtttcctaattttattgttattatagcactaaaggtaacttttactttcagtgtatttgtaaaaacactgagccgtcatt

SEQ ID NO: 56734 - DNA, 105 bp, Homo sapiens
ggaactgagtttggtatttatttatggctgtgtagtattccactgtgtatacatatcacattttcttcatctaatccaccgttaatgagcaactagattgattcc

SEQ ID NO: 56735 - DNA, 90 bp, Homo sapiens
cttggtgcgcaggtggtcggacacgcagcaggactggcaaaacagagtatctgtgtgtcagtgtatgttttattcatctgtcatttgggt

SEQ ID NO: 56736 - DNA, 90 bp, Homo sapiens
gggtatggagtcacaggagttgagagaagataaaatatgtttcaaagttttataaatacatatgtttaactcttgttcttcttgatattc

SEQ ID NO: 56737 - DNA, 103 bp, Homo sapiens
tcacaatacaattgaatacgtagaggtgatgagaggcaacaggctattttctaaactattgattatcttgtaatgacttctattttgattcactgatttgtgg

SEQ ID NO: 56738 - DNA, 67 bp, Homo sapiens
catatatacatatatatacataaaatatatatgcttatatgcgtatgtgtgtgtatatgtatgtatg

SEQ ID NO: 56739 - DNA, 83 bp, Homo sapiens
ccgtgcctcctgactgacagaagcctctgagcagaggtcaacagacacctcatacagcagagctctggctggcatctggcagg

SEQ ID NO: 56740 - DNA, 95 bp, Homo sapiens; identical to SEQ ID NO: 68

SEQ ID NO: 56741 - DNA, 93 bp, Homo sapiens; identical to SEQ ID NO: 69

SEQ ID NO: 56742 - DNA, 116 bp, Homo sapiens
ttttgctgtgcaggagctctttagtgtaattagatctcatttataattttttgcttttgttgcagttgcttttggcatcttcatcattaaatctttgtgagttcctgtgtccagaa

SEQ ID NO: 56743 - DNA, 79 bp, Homo sapiens
gggtagtcttgcccatgagatggggccagtatgacctgagaacctccctgtctgccagcctctctcagggatcatgcct

SEQ ID NO: 56744 - DNA, 85 bp, Homo sapiens
ttctcacccacatctgtcactgtcagggtttggcaggaaccactagcagtgacctcatgccaccttgacccccagcagaggagaa

SEQ ID NO: 56745 - DNA, 95 bp, Homo sapiens; identical to SEQ ID NO: 68

SEQ ID NO: 56746 - DNA, 93 bp, Homo sapiens; identical to SEQ ID NO: 69

SEQ ID NO: 56747 - DNA, 135 bp, Homo sapiens
tctcgtgatactgagtgagttctcacaagatctgattaattttttttttctatttaggtggagtctcactctgtcaccaggctggagtgcagtggcacgatcttggctcactgcaacctccacctcctgggttca

SEQ ID NO: 56748 - DNA, 66 bp, Homo sapiens
tatatatgtgtatatatatacgtgtatatatacatgtatatatatgtgtgtgtatatatatatata

SEQ ID NO: 56749 - DNA, 98 bp, Homo sapiens
tctctttagttgaatggcaagtttattattttaaataatcttataacttttacttgtgtataaaactgtttagagtttagactgtaggctagatgaga

SEQ ID NO: 56750 - DNA, 93 bp, Homo sapiens
ggggagttggggacagtcagcagtgagagacctcacccagctcccatgcagttgttgaggtcagtctcacttctgcagtgccccactcagacc

SEQ ID NO: 56751 - DNA, 89 bp, Homo sapiens
tattgtgtattcaaacaatgtaagtagccttcattttatatttacttatttattgaaggtagtttaatgagttaattgaatatgcatta

SEQ ID NO: 56752 - DNA, 101 bp, Homo sapiens
tactgggttttttgtgtggttctatacaaatctgaggattttttttctatttctgtgaagaatatcattggaatttttattgggattgcattgaacctgta

SEQ ID NO: 56753 - DNA, 118 bp, Homo sapiens
tatctactgtgaccttggaaaatcaatcatcttctctgtctgagactcaatttcttcttgtgttaaatggggatgatggattgttcagaacctcaatgagatgacttttcaaaaagca

SEQ ID NO: 56754 - DNA, 115 bp, Homo sapiens
gcaaatatccatcaagtccatttgttctagactatggtttaatttcactgtttattttttgattttttgccttgatgacctgtctagtgccggcagtggagtattgaagtcctgc

SEQ ID NO: 56755 - DNA, 99 bp, Homo sapiens
ccagcctgagtaacatactgagactccccatctgaaatacatatatattaaaaaaaaatttttttttgagatggagtctcactctgtcacccaggctgg

SEQ ID NO: 56756 - DNA, 108 bp, Homo sapiens
gtcattcattgtgaatttcactgtgttggcttccagatatttttctatttttataaatatgatcaagattttatctgggatgaatataagttacttcaaaagtttgat

SEQ ID NO: 56757 - DNA, 95 bp, Homo sapiens; identical to SEQ ID NO: 68

SEQ ID NO: 56758 - DNA, 93 bp, Homo sapiens; identical to SEQ ID NO: 69

SEQ ID NO: 56759 - DNA, 119 bp, Homo sapiens
tgtgtgaggttgtacacagtgtatatattttatatatgtatatatatatatatatacactgaatatatatatatatatacactgaatatatatatatacactgaatatatatatatata

SEQ ID NO: 56760 - DNA, 94 bp, Homo sapiens
tggaggtcttgatctgattgtaggtgtttcatgatttggtatgcacacacatactctctcacacacgcctatatagaattgtcatgaatatcca

SEQ ID NO: 56761 - DNA, 105 bp, Homo sapiens
gcatggtggcacatgactatagtcccatctactcaagagactgaggagtgaggatcgcttgagcctaggagggggagttacgatgagctgtgattgtgcctctgc

SEQ ID NO: 56762 - DNA, 135 bp, Homo sapiens
gcagagagtgctggttggtcaggttgagggtgaaatcacaggggtttgaagtgagtccgtgctgtcttctgttcctgtgtgggatggctgatatctggttgagccacgttaccggtctgtgtggtgtcatcggct

SEQ ID NO: 56763 - DNA, 88 bp, Homo sapiens
tattatatagcctaatgttctttggttacaaatctgtacagcatgttaatgtatatatttgtaacctgtagacacatataatatgatg

SEQ ID NO: 56764 - DNA, 82 bp, Homo sapiens
gctgctctgtctgtctgagtgggagctgcaatttagttctgccttctatctaccatttttctcagtatccacccagaacagc

SEQ ID NO: 56765 - DNA, 87 bp, Homo sapiens
gaaatggagtggaatcattctttgaaaagagtcattgagaacagcgtctttttttttttttttttagatggagtctcgctctgtcgc

SEQ ID NO: 56766 - DNA, 58 bp, Homo sapiens; identical to SEQ ID NO: 1265

SEQ ID NO: 56767 - DNA, 58 bp, Homo sapiens
tgagactgagtctcactctgtcacccaggctggagtacaatggtgcgatctcggctca

SEQ ID NO: 56768 - DNA, 89 bp, Homo sapiens
gagttcggtaacacaatcactcactgcctctcttgggtggaggtgggagctccccttgccccgtgtggctcctgggtgggccattgctc

SEQ ID NO: 56769 - DNA, 129 bp, Homo sapiens
gccaccgtgcccagtgaggaaatctaatttctgtttttttttttttttttgagacagagtctcactctgtcacccaggctggagtgcagtggtgcgatctcggctcactgcaacctccatctcccaggt

SEQ ID NO: 56770 - DNA, 58 bp, Homo sapiens; identical to SEQ ID NO: 637

SEQ ID NO: 56771 - DNA, 107 bp, Homo sapiens
tgttctatattttttgcacaattatatttgagaaatagttgggaatatagttttatatatttcagataatattaaaccataattgcaggcatgaaaatacgtgaaca

SEQ ID NO: 56772 - DNA, 97 bp, Homo sapiens; identical to SEQ ID NO: 1307

SEQ ID NO: 56773 - DNA, 88 bp, Homo sapiens; identical to SEQ ID NO: 1308

SEQ ID NO: 56774 - DNA, 81 bp, Homo sapiens; identical to SEQ ID NO: 1309

SEQ ID NO: 56775 - DNA, 77 bp, Homo sapiens; identical to SEQ ID NO: 1310

SEQ ID NO: 56776 - DNA, 153 bp, Homo sapiens
ataaatgaataaataaatcagggtatatatatgtgtgtgtgtgtatatatatataaaatatatatacacatatgtatatgtgtatacatgtaatatatacatatatgtatatgtgtgtatatattacatatgtgtatgtgtctatatgttaca

SEQ ID NO: 56777 - DNA, 90 bp, Homo sapiens
tatgtggaatatgtgtggaagtatatacagatactatgttaatatggacaatacatatgtatatctatatacttatatggattccatata

SEQ ID NO: 56778 - DNA, 57 bp, Homo sapiens
tgagaccgagtctcgctctgtctccctgctggagtgcagtggcgcgatctcggctca

SEQ ID NO: 56779 - DNA, 111 bp, Homo sapiens
tggtgtaccatttgtttttaatataaggtagtttgtgtgcatatatatatatatatatatatatatatatgactccatatccccttttatttaatatatagtagcatacca

SEQ ID NO: 56780 - DNA, 113 bp, Homo sapiens
actttaggggcagaaagcaggagttttaaagggcagctttcactaaaaggcatgcagagaagagagtgagcaggtgtgggagttacatgactttgagttatctaccaggtggt

SEQ ID NO: 56781 - DNA, 101 bp, Homo sapiens
atgtatatacgtatatacatgtgcatatacatatatgtatatacgtatatacatgtgcatatgtatatatgtatatatatgtatgtgtatatatatataca

SEQ ID NO: 56782 - DNA, 151 bp, Homo sapiens
tgtatcatatatatatgtaagtgtatatatatgtatgtgtatatatatgtatatacatatatatgtgtgtgtatatatacgtatatatgtatatatatatgtatatacacatatatacgtatatacatatatacatatacacacatatata

SEQ ID NO: 56783 - DNA, 118 bp, Homo sapiens
tatgtgtgtatatgtatatatgtatatacgtatatatgtgtatatacatatatatatacatatatacgtatatatacacacacatatatatgtatatacatatatatacacatacata

SEQ ID NO: 56784 - DNA, 103 bp, Homo sapiens
acactgtcctagtagaggttctcgtgaaggttccacccttgcagcaggcttctttctggacatgcagggttttcaatacatcccctaaaatctaggtcaaggt

SEQ ID NO: 56785 - DNA, 116 bp, Homo sapiens
catttggaataggagcatttacacaatgcctgtaccctcattgtatcttggaagtaactaacttgttttttattttacatgctcataggcagaagggacttgtcttgtctcagatg

SEQ ID NO: 56786 - DNA, 112 bp, Homo sapiens
atttttgtatgttgattttgtatcctgaaactttagtgaatttgtttatcagttctaacagacttttggtggagtctttaagattttctatgatcatttcatctgcagagat

SEQ ID NO: 56787 - DNA, 122 bp, Homo sapiens
atggaaagccttatatctcagtggatgatgccaagcactgaatgaattttgagaagagagtgacctgattaagtttgtgtgttaaacgtatcattctgtggatattttaaagctatattggc

SEQ ID NO: 56788 - DNA, 95 bp, Homo sapiens; identical to SEQ ID NO: 68

SEQ ID NO: 56789 - DNA, 93 bp, Homo sapiens; identical to SEQ ID NO: 69

SEQ ID NO: 56790 - DNA, 92 bp, Homo sapiens
tgtgtaatactatgatggtggatacacgttattatacatataagtgtgtgtgtgtatatatatttgtcaaaattcacaaaatgtacaacaca

SEQ ID NO: 56791 - DNA, 76 bp, Homo sapiens
caaagggagtctttctgtcactctcttttctgagccacctggagctggagatgaagtgacacaagcatccctgctg

SEQ ID NO: 56792 - DNA, 105 bp, Homo sapiens
aggtctattttccataactgcttcccacagacaaaggggcagtagtggtcctgtgggtctcagtctctctagctgtcagggcaagagggtgactccatgcatagg

SEQ ID NO: 56793 - DNA, 114 bp, Homo sapiens
actcatgctcccttttttcttcttaatccagaaatcataaactgtcaggattagaaagtaccttagagatctgactccctcagtttatagaagaggaaaccaagagagcagggt

SEQ ID NO: 56794 - DNA, 97 bp, Homo sapiens
ggacagagtgattaaaagagtgtagagcttccagggatgtgttggaaacattctctcctcatggaatctatagaagtttagaaaatgtatcattccc

SEQ ID NO: 56795 - DNA, 106 bp, Homo sapiens
acaaacaatgtcaaacttgccttctctgttgagagtgagctcaaactccatgaaagagttacctgccattcatcatcatggaaggagaaaatcttgtcttccttgt

SEQ ID NO: 56796 - DNA, 109 bp, Homo sapiens
agtactttgcatgtaataacttatctaatccttacaacctcatgaagtaagtactattgttattctcatcgtcaaaataaggaagataaggcagagatatgttaagtct

SEQ ID NO: 56797 - DNA, 76 bp, Homo sapiens
atgcatatatatgtatgtatatatatgtatgtatgtatgtatatatatatgtatgtatgtatatgtatgtatgcat

SEQ ID NO: 56798 - DNA, 65 bp, Homo sapiens
tgtatgtatatatgtatgtatgcatatatatgtatgtatatatgtaaaatgcatatatatatgca

SEQ ID NO: 56799 - DNA, 75 bp, Homo sapiens
ctatggcactgataagaagcaggtggagggaaataaccagcggaatatctctctatcacactcccagtcacatag

SEQ ID NO: 56800 - DNA, 112 bp, Homo sapiens
ggattgtcttggctatacaggctcttttttggttccatatgaaatttaaagtagatttttctaattctatgaagaaagtcaatggtatcttgatgggaatagcattgaatct

SEQ ID NO: 56801 - DNA, 94 bp, Homo sapiens
atggacaatgtttacaatatatatagatatatcttatgtgcatatgatatatatgtatatatcttatatgatatcttagatatattctgtctat

SEQ ID NO: 56802 - DNA, 82 bp, Homo sapiens
cctccagcaggctctgcctccttggcttccttgattcagagagcagtgcagtggctttgttgaggagcagcccctgtggagg

SEQ ID NO: 56803 - DNA, 77 bp, Homo sapiens
cccatgttcacagtgactcttatgacgatggatgccaacaatagtatgttttgcacactcactctgagtgacatggg

SEQ ID NO: 56804 - DNA, 107 bp, Homo sapiens
caaaagttggctgggcgttgtgtcatgtgcctgtggtcccagctcctcaggaggctgaggtaggaggatcacttgagcccaggaggtcgaggctgcagtgagccgtg

SEQ ID NO: 56805 - DNA, 115 bp, Homo sapiens
gttcactgggctcactttgctgtcatttggttgaatttactcttttttaaattttttcctttttttttttgaaacagagtctcgctccatcaccaaggctggagtgcagtggtgc

SEQ ID NO: 56806 - DNA, 109 bp, Homo sapiens
tgcccatttgtaagatttgagaaaaaatattttttatatttcttatataaaatgtatagttcaattttgtataagaatttagggatgtagagaagtctgagaggtggca

SEQ ID NO: 56807 - DNA, 97 bp, Homo sapiens
tcctcatcattatttcattcagtgctttgatctctgaatctcatgttttggtttcagagtctcttcctcaatattttattggagagtaggacggggg

SEQ ID NO: 56808 - DNA, 95 bp, Homo sapiens; identical to SEQ ID NO: 68

SEQ ID NO: 56809 - DNA, 93 bp, Homo sapiens; identical to SEQ ID NO: 69

SEQ ID NO: 56810 - DNA, 75 bp, Homo sapiens
gtgttcttaacctttctgtgtgtgtgcgtggctctctgtagtcatcgagtgaagccgcagaggtctcagaatcac

SEQ ID NO: 56811 - DNA, 91 bp, Homo sapiens
ggatcaacctctctgagtggtcaaaaactgtgaatatatttgtatcctatgtgaatgctcaccaacgggtgacctcagaagaggaagattt

SEQ ID NO: 56812 - DNA, 72 bp, Homo sapiens
tggattagctttattattcattccacaatgtgtatatacatgtatatatatggaagaagaaaagcaaatcta

SEQ ID NO: 56813 - DNA, 106 bp, Homo sapiens
cacacgtaaaagggttttttttaaattcttgttagaagttttacttttttctgtattttttacagcttctaattttgtctttaaaatattctagccaggggcggtg

SEQ ID NO: 56814 - DNA, 103 bp, Homo sapiens
gatagataatccatagatcaagttctttttttttttttttgagacagagtttttgctcttgttgcccaggctggagtgcaaaggtgtgatcttggctcactgc

SEQ ID NO: 56815 - DNA, 100 bp, Homo sapiens
atgttgattttgtatcctgaaactttactgaatttgttcattagttctaagagtattttggtggagttgttagttttttcttagtataagatcatgtcat

SEQ ID NO: 56816 - DNA, 111 bp, Homo sapiens
tcagtccggatgccttttatttatttttcttacccaattgcacttggctatatctttcagtgcaatgttgaatagagttgttgagagcaaatatccttgtctggttactga

SEQ ID NO: 56817 - DNA, 97 bp, Homo sapiens
tttgcccaccttttgatgggtttgtttgtttttttcttgtaaatttgtttgagttcattgtagattctggatattagccctttgacagatgggtaga

SEQ ID NO: 56818 - DNA, 97 bp, Homo sapiens
tttgcccaccttttgatgaggttgtttgtttttttcttgtaaatttgtttgagttcattgtagattctggatattagccctttgacagatgggtaga

SEQ ID NO: 56819 - DNA, 88 bp, Homo sapiens
tctgtgcttttagacaagtgaatttatttctatatatttttgtttctttacaaaagtggaatatatttaatgtttaggttcttacaga

SEQ ID NO: 56820 - DNA, 84 bp, Homo sapiens
tatactatatatatatatttatcagatatatacatatatacatgtatatgtatatatgtgtgtgtctatgtatatgtgagtgtg

SEQ ID NO: 56821 - DNA, 110 bp, Homo sapiens
gtaaatgtctcttttcagaatttaagggtgtcagactctcatttactctctcctagacctgggaaaggcgtagaaaggaaagtcttcctgcattaatggagattctctac

SEQ ID NO: 56822 - DNA, 69 bp, Homo sapiens
ggcattttacaacatcaaaaagaagacttagcaaacaaatgataagtatttttgatgttgtaaaatgcc

SEQ ID NO: 56823 - DNA, 110 bp, Homo sapiens
atgtaatatacacatatatatgtgtatatatatgtgtgtatataatatacatatatgtgtgtatattttatatatatatatatatatatatatatatgtatatctcacat

SEQ ID NO: 56824 - DNA, 108 bp, Homo sapiens
tctgttggatcagaaaaaaaatgagaacttatttacttgtttatatatcaatgactggaaaaagtgaagcagtttgtagatgcttatttgaacatttggttcagttga

SEQ ID NO: 56825 - DNA, 82 bp, Homo sapiens
gcattgtactaatagatatgctctaacatatatatgtatatatttacacatatacatacatatctattaggattacttttgc

SEQ ID NO: 56826 - DNA, 66 bp, Homo sapiens
tatacatacaaaagcacacacataggcatacatatatatgtgtgtatatgtgtatatatatgtata

SEQ ID NO: 56827 - DNA, 95 bp, Homo sapiens; identical to SEQ ID NO: 68

SEQ ID NO: 56828 - DNA, 93 bp, Homo sapiens; identical to SEQ ID NO: 69

SEQ ID NO: 56829 - DNA, 81 bp, Homo sapiens
tctgaccttgaaaatcagagttccagattcttttttttttttttttttgagacggagtctcactctgtcgcccaggctgga

SEQ ID NO: 56830 - DNA, 95 bp, Homo sapiens
tggaacaacatgaatttgaaatgagtgggtcaatttatacacaatgtttttcaataaatatagttggccctctgtgttagcaggttctgcgtcta

SEQ ID NO: 56831 - DNA, 107 bp, Homo sapiens
agggtcttcaaagcattgggggtgtttggtgtacggtagtgattttcttgtgttcatttgacattttaaagtgatagacgtttaaccttgggctttctcaggactct

SEQ ID NO: 56832 - DNA, 108 bp, Homo sapiens
tgtagttggatgaggatcggctttgatgattgttctcaatatgttgttgtcagcttccaatggccagccactatgctcctcatcttcaaggctctcccctcctttgca

SEQ ID NO: 56833 - DNA, 73 bp, Homo sapiens
tgtgctttcttacagtcgaatgtactgtggcacctagctgctgacagtagtttttactcacacagaaagcaca

SEQ ID NO: 56834 - DNA, 73 bp, Homo sapiens
tgaggtacatggagctgtgagaagagagccaccagaatggtagatctactgacagcttgcaccgagtgcctgg

SEQ ID NO: 56835 - DNA, 92 bp, Homo sapiens
ccacttgttagctgcatgatattaggctactaagtttaagctctctgagactcagtctcttctgcatagtggattctgtaactgtcgaatgg

SEQ ID NO: 56836 - DNA, 277 bp, Homo sapiens
tatctatatgtaatatagataacagacattatatatctatatgtaatatagataacagacattatatatctatatgtaatatagataacagatattatatatctatatgtaatatagataacagatattatatatctatatgtaatatagatacagatattatatatctatatgtaatatagataacagatattatatatctatatgtaatatagataacagatattatctatatataatatagataacagatattatctatctatatataatatag

SEQ ID NO: 56837 - DNA, 86 bp, Homo sapiens
ccaagcagggcctggctcaggacctctcatcagccaatcccctcatggctgagcacacccactgactggctctgagtttccctggg

SEQ ID NO: 56838 - DNA, 189 bp, Homo sapiens
tatatatatgtatatatatgtgtatatatatgtgtgtatatatatacacatatatatgtgtgtgtatatatatatacatatatatgtgtatatatgtgtgtgtatatatatacatatatgtgtatatgtgtgtgtatatatgtgtgtatatatgtgtgtatatatatacatatatatacacacatatat

SEQ ID NO: 56839 - DNA, 68 bp, Homo sapiens
tatatatgtgtgtatatatatgtatatatatacacacatatatacacacatatatacacacacatata

SEQ ID NO: 56840 - DNA, 90 bp, Homo sapiens
atatgcatacatttgcatccgtgtgtgtatgtgtgttacaattacatatatatataaagtgtgtgtgtgtatgtctgtgtatgtatgtat

SEQ ID NO: 56841 - DNA, 81 bp, Homo sapiens
ctatctgtctctctatctgtctatctatagttgagggcagcattatgtccttaaaggactggaaaaatatctggcatatgg

SEQ ID NO: 56842 - DNA, 132 bp, Homo sapiens
tgtatatactgtgtgtgtatatacagtatatatatatactgtgtgtatatatatatatatacactgtgtgtgtgtgtgtgtatatatatatatatatatatatatatatattctaatatacttaattatata

SEQ ID NO: 56843 - DNA, 186 bp, Homo sapiens
tgtgtgtgtgtatactgtgtgtgtgtgtatatatatacgtactgtgtgtgtgtgtgtatatatatatatgtatactatgtgtgtgtatatatatatatatatactgtgtgtgtatatatatatatatactgtgtgtgtatatatagtgtgcgtatatatatatagtgtgtgtatatatatagtgtg

SEQ ID NO: 56844 - DNA, 93 bp, Homo sapiens; identical to SEQ ID NO: 69

SEQ ID NO: 56845 - DNA, 97 bp, Homo sapiens
tatttttattaatatataagaattgtatatatttatttatggggtacatatgctattttgatacatgtatataatgtgttatgatcaaataaagata

SEQ ID NO: 56846 - DNA, 72 bp, Homo sapiens
cctactgagttcctggtcaggaggtcatcccttcccacctggagtagatgaaagatgacagggaccagcagg

SEQ ID NO: 56847 - DNA, 107 bp, Homo sapiens
tagctagggagaagtgagtaagcgggagaatggtaagtaatgatgttagaaaatatgtagggtgcagctattgggcatttttgagcagagcaatcacagtctggcta

SEQ ID NO: 56848 - DNA, 95 bp, Homo sapiens; identical to SEQ ID NO: 68

SEQ ID NO: 56849 - DNA, 93 bp, Homo sapiens; identical to SEQ ID NO: 69

SEQ ID NO: 56850 - DNA, 113 bp, Homo sapiens
ttgcttatgaagcttagtttggctggatatgaaattccgggttgaaaattttttctttaagaatgttgaatattggccccaaatctcttctggcttgtagagtttctggtgag

SEQ ID NO: 56851 - DNA, 107 bp, Homo sapiens
ctttagagtctgcattgggtctaggtctcattgagagcagatagagagcacactgtgcaacctctagagtcggcattgggcctaggtctcattgaggacagatagag

SEQ ID NO: 56852 - DNA, 115 bp, Homo sapiens
ctttctatcccatgcttttcagatgtgttcaaatggcatttttaatagtgtaaattattgttttattaaaagtgtttacattgatagatattactgagtgcttgtgatatgaaag

SEQ ID NO: 56853 - DNA, 101 bp, Homo sapiens
tgattttacatgttgtatataataatgcatgactaagtattacttttattattttaaaaggtgactcagttttgctttgtgaaaaagcggactgaaaatta

SEQ ID NO: 56854 - DNA, 118 bp, Homo sapiens
aaccgacagtaataaagggggttttctgaatcaggttttgtgaaataagaatggaaatctattttattttaaatgcatatatcaaagtaagttctgaaaacaaaaacattatgtggtt

SEQ ID NO: 56855 - DNA, 95 bp, Homo sapiens; identical to SEQ ID NO: 68

SEQ ID NO: 56856 - DNA, 93 bp, Homo sapiens; identical to SEQ ID NO: 69

SEQ ID NO: 56857 - DNA, 95 bp, Homo sapiens; identical to SEQ ID NO: 68

SEQ ID NO: 56858 - DNA, 93 bp, Homo sapiens; identical to SEQ ID NO: 69

SEQ ID NO: 56859 - DNA, 99 bp, Homo sapiens
tggttgattttgtatcctaaaactttattgaatttgtttatcagttataaacgttttttggtggaatctttaggttttactaaatataagataatgcca

SEQ ID NO: 56860 - DNA, 77 bp, Homo sapiens
gcaaagtttaagagacatgagtgggagctgtgatattgggttaggcaacggtttcttttcttttttttttaaactgc

SEQ ID NO: 56861 - DNA, 86 bp, Homo sapiens
tgtgtatgtatgtgtgcatgtgtgtgtgtgtctatatttatgtatgtgtatgtgtctatatatatatatatacatatatatatgta

SEQ ID NO: 56862 - DNA, 90 bp, Homo sapiens
cagcttggaggttagaagcaagatggagttggttaggtcagatctctttcactgtctcagttataattttgcaatggcaggttcaagttg

SEQ ID NO: 56863 - DNA, 103 bp, Homo sapiens
ataaaccagtagcatagttgtttattatcattgtaaagtattatgtactttacataattgtacgtgctctacttatatatgaatggcagtgcattaggtttgt

SEQ ID NO: 56864 - DNA, 112 bp, Homo sapiens
ggaattcgagaccagcctgggcaacatagcaagacctcatttctacaacattttttttttaattagccagacatgatggtgtatgcctgtggtcccagctactcaggaggct

SEQ ID NO: 56865 - DNA, 104 bp, Homo sapiens
tatgtgtgtgcatgtatatgtttatatatatatgtatatatacacacatacacacatatatgtgtatgcatatgtatatacacaaatatgtatatacacacaca

SEQ ID NO: 56866 - DNA, 101 bp, Homo sapiens
ttcttaatagtatacttcgaagcacaagtgtttaatttttatgaagttcgatttatatatttttgttttgttgtctgtgcttttgatagtatatctaagaa

SEQ ID NO: 56867 - DNA, 117 bp, Homo sapiens
aagtagctaaaggtcaatattaaattctccttaatttcctatgtgttaatctatttttatgataaatattactgagggatgtggtaagcagaattctaaaatgacccaatgacgctt

SEQ ID NO: 56868 - DNA, 99 bp, Homo sapiens
tctctatatatctatatgtatttctctctctgtgtctcttgagagagatatatatatatatatcaagagagagagagagagagacagatatgagtgggg

SEQ ID NO: 56869 - DNA, 60 bp, Homo sapiens
gtgagacagggtctcactctgtcacccaggctggagtgcagtggtgtgatcatagtttac

SEQ ID NO: 56870 - DNA, 58 bp, Homo sapiens; identical to SEQ ID NO: 3701

SEQ ID NO: 56871 - DNA, 106 bp, Homo sapiens
gattatatatgtatgtgtatatatatgtgtgtgtatgtgtgtgtgtgtataaatatatatgtgtatgtatatggatgtatgcatgaatacatacatttttttaatc

SEQ ID NO: 56872 - DNA, 141 bp, Homo sapiens
atatatatacagatatatatatctatatatatctatatatatacacagatatatatatctatatatatattaccatgtatatacagatatatatatatctgtgtatatattagtatgtatatggcatttactacccctgtg

SEQ ID NO: 56873 - DNA, 91 bp, Homo sapiens
cagctggcttcgtattctgtgaattgctatagtcgttttctgagtataatcttatgactgattttgtaattctcacagtaggggaaagttg

SEQ ID NO: 56874 - DNA, 68 bp, Homo sapiens
actggggcagatatcagccgtgacgagccatcactgggagctccacttctgtgtgtatctgtctgggt

SEQ ID NO: 56875 - DNA, 110 bp, Homo sapiens
ggtgatcaatgtcactggtggttctgtgagttttttcatctacttaaaaattattatcttaataaataaaggtggaatacaattaacataatggcagtgcagtgaagacc

SEQ ID NO: 56876 - DNA, 89 bp, Homo sapiens
cactttaacctcagatttagcaagtctattatttcattattattattattattttgagacggagactcgctgtctcccaggctggagtg

SEQ ID NO: 56877 - DNA, 114 bp, Homo sapiens
ggaatgaacaaggacagcttggaggttaaaagcaagatgaagttggttaggtcagatgtctttcactgtctcagttacaattttgcaatgctagtttcaatgtcagtttgtacc

SEQ ID NO: 56878 - DNA, 58 bp, Homo sapiens
tgaggcagagtcacgctctgtcacccaggctggagtgcagtggcgtgatatcggctca

SEQ ID NO: 56879 - DNA, 58 bp, Homo sapiens; identical to SEQ ID NO: 10264

SEQ ID NO: 56880 - DNA, 112 bp, Homo sapiens
tggcctgttttctgaataattatctttcagcagcttgtttcagttttatcaacagacagaagtaagtctgctaagagcacaaatatattctagttaattgagaaagaatcca

SEQ ID NO: 56881 - DNA, 121 bp, Homo sapiens
tcaatgttgacttaactgaattcattcagataagtggaaatattgttagatttgttgactggaaggaagtctgagtttgattagtccaaaggtgatttgaggaaaggtggtaagctgaaca

SEQ ID NO: 56882 - DNA, 119 bp, Homo sapiens
agggcatcaactatgctatctttgttgttttcacattgcttatacattgtggagattgaatacatttttgatttttaacaaacgttcaatgtgctcttactaaagcttggcaatgacct

SEQ ID NO: 56883 - DNA, 62 bp, Homo sapiens
ggaagtccaggatcaaggtgctgtcagatttaatgtctgatgagtgtttgctctctgcttcc

SEQ ID NO: 56884 - DNA, 83 bp, Homo sapiens
agctgaggctcagaacttaccatgttacagatgaacaaatcttttttttttttgagacagagtcttgctctgttgcccaggct

SEQ ID NO: 56885 - DNA, 98 bp, Homo sapiens
tctgggttggactcagtggctcatgcctgaaatctcagcactttggaaggccagggcaggaggattgcttgaggccaggagtttaagacaagcccagg

SEQ ID NO: 56886 - DNA, 96 bp, Homo sapiens
gattgctttggctatttgggccctttttttggttacatgtgaaatttaattttttttttttttttttgccaggcacagtggctcatgcctgtaatc

SEQ ID NO: 56887 - DNA, 153 bp, Homo sapiens
gggcaacatggcaagacctggtctctacataaaaatttgtaaaaaataaatatttcattatacttttttttttttgagatggagtctcactctgtcacccaggcaaaagcgcagtggcaccatctcagctcactgcaacctccgcctcctggg

SEQ ID NO: 56888 - DNA, 82 bp, Homo sapiens
gcctgacttgttcaatttttcattttttgatcactctggctgcagattggagtggcatttggaagtaaacaagattggaggc

SEQ ID NO: 56889 - DNA, 93 bp, Homo sapiens
gggccatgagtccagggttaatgaaacaacagaatatggtttcttttttgttttttgttttgttgtgttttgttttgttttggagatggactc

SEQ ID NO: 56890 - DNA, 116 bp, Homo sapiens
atgtccaattgtatggtcaattttagagtatgtgccatgtgcagatgagaagaatgtatatttttatgtgtttgggtggagtattctgtaaatgtctattaggtccatttggtcat

SEQ ID NO: 56891 - DNA, 69 bp, Homo sapiens
ggagggtctctgtttcccacttcagcagttggggcactcacagttttgagggggtctcctgggtcctgc

SEQ ID NO: 56892 - DNA, 109 bp, Homo sapiens
ggtgacaaagcgagaccccaactctttaaaagagcctttgttggtcttaattttcataatacaatactgattttcaaggttttattaaagaattgatttgcagctcatc

SEQ ID NO: 56893 - DNA, 109 bp, Homo sapiens
gaatgcattcgatgttacagctggtacagctgtgctctgaatctggtcaatgtatatatttatttcagaaggttgtgaaccagtagaaaataggaattttgcaaatgtc

SEQ ID NO: 56894 - DNA, 95 bp, Homo sapiens
tgcactgtggtcaacagtgtggttggtatgatttctatttttttgaatttgctgaggattgttttatggccaattgtgtggttgatcatagagta

SEQ ID NO: 56895 - DNA, 84 bp, Homo sapiens
cactgcctatgtctggctggagaattcttttattttttatttttgagagagttttgctcttgttgcccaggctggagtgcagtg

SEQ ID NO: 56896 - DNA, 82 bp, Homo sapiens
catgtacatgtatcatttactataaacctcttttggttgataccaggtgaggtacttggtttatatgttcttgactaacatg

SEQ ID NO: 56897 - DNA, 93 bp, Homo sapiens
ttgtacttttctttgaatcagtttataaatatatatatatatatatatatatatatttatatttatactttaagttctgggatacatgtgcag

SEQ ID NO: 56898 - DNA, 79 bp, Homo sapiens
gactgatgtggcatcttatctcaaggttctggagtagaatctactaccaagattttgaggttgttggatgaatttagtt

SEQ ID NO: 56899 - DNA, 95 bp, Homo sapiens; identical to SEQ ID NO: 68

SEQ ID NO: 56900 - DNA, 93 bp, Homo sapiens; identical to SEQ ID NO: 69

SEQ ID NO: 56901 - DNA, 95 bp, Homo sapiens; identical to SEQ ID NO: 68

SEQ ID NO: 56902 - DNA, 93 bp, Homo sapiens; identical to SEQ ID NO: 69

SEQ ID NO: 56903 - DNA, 119 bp, Homo sapiens
acagtgtatgaaagttgcaattgctccatatcctttccagcacatagtatttttagttatttaaaagtattcattgtagtgaatgtgtagtaactcactgtggttttcatttgcattgt

SEQ ID NO: 56904 - DNA, 120 bp, Homo sapiens
atgtggcatatatatatatgtgtatatatatatgtatgtatatatataatatgtatatatatgtatgtatatatataatatgtatatatatgtatgtatatatataatatgtatatatgt

SEQ ID NO: 56905 - DNA, 114 bp, Homo sapiens
gagagagttctctagtgtaaaaccagaggaacctgtctttagtcattctctctttttttatatttgggaatggcctcaccagactaggatcactatgaagctagactttcactc

SEQ ID NO: 56906 - DNA, 80 bp, Homo sapiens
gcacattcactcatggctttccctggaatggggcgggttctcttgactctgtgtcacttctgggttggccatgattttgc

SEQ ID NO: 56907 - DNA, 95 bp, Homo sapiens; identical to SEQ ID NO: 68

SEQ ID NO: 56908 - DNA, 93 bp, Homo sapiens; identical to SEQ ID NO: 69

SEQ ID NO: 56909 - DNA, 58 bp, Homo sapiens; identical to SEQ ID NO: 1409

SEQ ID NO: 56910 - DNA, 98 bp, Homo sapiens
ggtgtcaggttcacatttatactacatccaagttctgggaatccctaaagagagacttcaatgtaaagtagtctgaaataataatgccccaagacacc

SEQ ID NO: 56911 - DNA, 67 bp, Homo sapiens
tacagagtctctcactctcttctgagccacataacgctggggatggagtgacccaagcaaccctgtg

SEQ ID NO: 56912 - DNA, 112 bp, Homo sapiens
ggatagtcttggctatttgggctctcttttggttccatatgaattctaaaatagtttcttctaactctgttaagaatgtcaatggtagctcaatgggaatagcattgaatct

SEQ ID NO: 56913 - DNA, 59 bp, Homo sapiens
atggggaatgtggtcagggacctggtttaaaaatgtggcagtctggccacattttctgt

SEQ ID NO: 56914 - DNA, 100 bp, Homo sapiens
tgaaggtctctaagaacttgctttatgaatcttggtgctcctgagttgggtgtatatatatttataacagttaaatcttcttgttgaattgagctcttta

SEQ ID NO: 56915 - DNA, 92 bp, Homo sapiens
gggatgatgtgtaacttccacttggacagacagaagagtgtgtggagacacactgttgacttttgctccgggaacccacacaggagtgtacc

SEQ ID NO: 56916 - DNA, 111 bp, Homo sapiens
atggaaatgaaataagtttgttgagtaaaataattctccctcatatttttttgttttattggttgagggaaattggcataaaaaaacccagcaaagtgattttttttctat

SEQ ID NO: 56917 - DNA, 87 bp, Homo sapiens
ctgtgcaacctttagagtctgcattgggcctatgtctcattgagagcagatagagagcatactgtgcaacctttagagtcggcattg

SEQ ID NO: 56918 - DNA, 97 bp, Homo sapiens
ctccactggaacaggtgctgttatccacagctgagagacccacatgtggttcgtatcacaagactctgtgcagacaacgcccagtaccagcctggag

SEQ ID NO: 56919 - DNA, 116 bp, Homo sapiens
tgatgcctccagctttttgcttaggattgtcttggctatatggactcttttttggttccatatgaaatttaaagtagttttttctaattttatgaagaaagtcaatggtagcttca

SEQ ID NO: 56920 - DNA, 106 bp, Homo sapiens
ggaatttatccatttcttctagattttccagattatttttaattttttgttgttgttgttttaaggagtggagagtttaataggcaagaaagaaggaagaagctcc

SEQ ID NO: 56921 - DNA, 67 bp, Homo sapiens
cacaacacttcttttcttttggagacagggtctcactctgtcacccaaaccagagcacagtggtgtg

SEQ ID NO: 56922 - DNA, 95 bp, Homo sapiens; identical to SEQ ID NO: 68

SEQ ID NO: 56923 - DNA, 93 bp, Homo sapiens; identical to SEQ ID NO: 69

SEQ ID NO: 56924 - DNA, 106 bp, Homo sapiens
gcctggaagtgttagtatgctacatgtagtcggtctatctctttcactctcacagagaagctgggagctgggggttccattctgaacatatgttactgtgccaggt

SEQ ID NO: 56925 - DNA, 82 bp, Homo sapiens
gtcattgctgccctcttatgtgtctcagtttctctctctggaggtctagcacctccagtagggcacagattgtagattgacg

SEQ ID NO: 56926 - DNA, 115 bp, Homo sapiens
ttatgagagttgacaagtccatagtttgataagaactagtttgagatgataaaccacgttattatttcattctttatagttccttgtggtctgccttgtatgacagctactgtag

SEQ ID NO: 56927 - DNA, 106 bp, Homo sapiens
tgagttgtactgagtgcatggagattctgttcaatatttgtttttaaatgacaagtcttgtaaataagagagaaactctatgtaggatatttatgtgtacaaatca

SEQ ID NO: 56928 - DNA, 118 bp, Homo sapiens
tgagcactctttggtctgctggcctctcccaaggccccagcctggccatgtctgcttacagggcagtcttgtgtgcctgggggtccacctcatagcttctgtaccagtggttcatgcc

SEQ ID NO: 56929 - DNA, 95 bp, Homo sapiens
aagatcactcacctaaggaaaagtgtgtatattatttctttaagaatatgtctttctttaatagacacagttttgtggggagcaagagagatctt

SEQ ID NO: 56930 - DNA, 108 bp, Homo sapiens
gaggtcaactctcctatgcttcttgttcaagttgaaagacaattgttcatatatttttgttcagattttctagttaattaacgcaggatagtaaactcagtagatctc

SEQ ID NO: 56931 - DNA, 90 bp, Homo sapiens
gcctattctagcttgtcttgttcttgatcttagaggaaaacctttcaggtttttttttttttaacattgagtatgatgttagctgtaggc

SEQ ID NO: 56932 - DNA, 97 bp, Homo sapiens
ggctagttgagacattggttcatggaagatagctactgcctgtcagaatggtgacagtggtcagtgagctttgctttttaccaaaagtctgaatccc

SEQ ID NO: 56933 - DNA, 115 bp, Homo sapiens
gttgctgtactggttgaactttgaatatttccttatgatatcttttgttaattgttttatttattgcaaaagttttagaatttcatttatttctaagtagctttgtgcaagcgat

SEQ ID NO: 56934 - DNA, 82 bp, Homo sapiens
gaaggtggtaggcttaggacaaatgaaaaggaagagactgaatttatctatttataatgatgactaagccagccctactttc

SEQ ID NO: 56935 - DNA, 95 bp, Homo sapiens; identical to SEQ ID NO: 68

SEQ ID NO: 56936 - DNA, 93 bp, Homo sapiens; identical to SEQ ID NO: 69

SEQ ID NO: 56937 - DNA, 95 bp, Homo sapiens; identical to SEQ ID NO: 68

SEQ ID NO: 56938 - DNA, 93 bp, Homo sapiens; identical to SEQ ID NO: 69

SEQ ID NO: 56939 - DNA, 119 bp, Homo sapiens
tatatatacatatattaaatatgttatatctgcatatgtgtgtatatgtgtatatacatatatgttatatacacatatacgcagatataacatatttaatatatacatatatacacaca

SEQ ID NO: 56940 - DNA, 95 bp, Homo sapiens
agaggtcctccacgtcccttgtaagttggattcctaggtattttattttctttgtagcaattgtgaatgggagttcactcatgatttggctctct

SEQ ID NO: 56941 - DNA, 112 bp, Homo sapiens
ggattgtcttggctatatggcctcttttttggttccatatgaaatttaaagtagtattttctaattctgtgatgaaagtcagtggtatcttgagggggatagcattgaatct

SEQ ID NO: 56942 - DNA, 99 bp, Homo sapiens
tggaagtggggtggactggaaattcacagagcattggagactgaagtttgtcacctcaccagattgctttctgagtatttccttgtctagcagctttga

SEQ ID NO: 56943 - DNA, 75 bp, Homo sapiens
tgaggcagaggttgcagtgagctgagattgtactactgcactccagcctgggtgacacagtgagactctgtctta

SEQ ID NO: 56944 - DNA, 116 bp, Homo sapiens
ttctgagagagtgtttcttacaaattggatgtattacatatatatgtgtgtgtgtatatatctatatatgtgtactgtgtagattggataataagacgagtattcttttttgtgaa

SEQ ID NO: 56945 - DNA, 58 bp, Homo sapiens
tgaaacggagtctcgctctgtcacccacgctggagtgcagtggcgcgatctcggctca

SEQ ID NO: 56946 - DNA, 106 bp, Homo sapiens
tcactgggatgctagagttgtttaccacctgtagaaaagtagctgccacactgtccgtctgtgactcagaggtctacattctggtgaaccctcgtcttctcacaga

SEQ ID NO: 56947 - DNA, 83 bp, Homo sapiens
gctgtctggctgtgcagtttcatttgggagaacaggcaatcagttctggaagcctgactgaagagagtggacagaatgatagc

SEQ ID NO: 56948 - DNA, 58 bp, Homo sapiens; identical to SEQ ID NO: 87

SEQ ID NO: 56949 - DNA, 56 bp, Homo sapiens; identical to SEQ ID NO: 88

SEQ ID NO: 56950 - DNA, 77 bp, Homo sapiens
atgcatatacatatgtacaatatgtacatatgtatatattttgatacatatacatatgtacaataattgtattgcat

SEQ ID NO: 56951 - DNA, 95 bp, Homo sapiens; identical to SEQ ID NO: 68

SEQ ID NO: 56952 - DNA, 93 bp, Homo sapiens; identical to SEQ ID NO: 69

SEQ ID NO: 56953 - DNA, 58 bp, Homo sapiens; identical to SEQ ID NO: 1101

SEQ ID NO: 56954 - DNA, 56 bp, Homo sapiens; identical to SEQ ID NO: 1102

SEQ ID NO: 56955 - DNA, 249 bp, Homo sapiens
gtattccatcatacatatgtgtgtgtatatatatgcgtatatatgtatatatgtgtatatatgtatatgtgtatatgtatgtatatattatatatgtatgtgtgtatatatatccgtgtatatatgtgtgtatacgtatgtgtgtctatatatgtgcatatatatatgtgtgtgtgtgtatgtgtgtgtgtgtgtgtgtatatatatatatatatatatatatatataaaaaacagtttctttatccac

SEQ ID NO: 56956 - DNA, 83 bp, Homo sapiens
gcatatactcttgcttgtgcatttgtatgaatatttctattaggtaaattcttagaagtcatattgcttggttaagtatatgc

SEQ ID NO: 56957 - DNA, 64 bp, Homo sapiens
gtgtgtgtgtgtgtgtgtgtgtatctagctgtctatctaaatatgtatatatacatacaaacat

SEQ ID NO: 56958 - DNA, 95 bp, Homo sapiens; identical to SEQ ID NO: 68

SEQ ID NO: 56959 - DNA, 93 bp, Homo sapiens; identical to SEQ ID NO: 69

SEQ ID NO: 56960 - DNA, 80 bp, Homo sapiens
gagtctcactctgtcacccaggctggaatgcagtggcgcgacctgggctcactgcgacctcctgggttcgagtgattctc

SEQ ID NO: 56961 - DNA, 79 bp, Homo sapiens
agactagggaactaagctgactccttttttttttttttttttttttttgaggcggagtctggctctgtcacccaggcct

SEQ ID NO: 56962 - DNA, 93 bp, Homo sapiens
tcctgactaatggtgcacacctgtagttccagctacaccagaggctgaggtaggaggatcacttgagcacaggaggttgaggctgcagtgagc

SEQ ID NO: 56963 - DNA, 106 bp, Homo sapiens
tggttcattttttcaattttttgtgcatctattttgttttattgtatatattcaaggtgtacaatgtgatgtttcgatgtatgtacacattgtgaaatgattacca

SEQ ID NO: 56964 - DNA, 113 bp, Homo sapiens
ccttgaggacatccttcacatccattgtaagttggattcctaggtattttattttctttgaagcaattgtgaatgggagttcactcatgatttggctgtttgtctgttattgg

SEQ ID NO: 56965 - DNA, 60 bp, Homo sapiens
caggcctgacaaattctgcagatccttttggatctgtagtgattttgtgcttcattcctg

SEQ ID NO: 56966 - DNA, 115 bp, Homo sapiens
acacagggtgatgcctgcttttttgatgtggtgtgctcctcttatttctttttttttttattatactttaagttttagggtacatgtgcacaatgtgcaggttagttacatgtgt

SEQ ID NO: 56967 - DNA, 90 bp, Homo sapiens
aatcactgactgtgtctgtgtctgtgtctgtatgtattgtgtgttatcatattttatccaaaggggctaaataacagtgctatagtggtt

SEQ ID NO: 56968 - DNA, 113 bp, Homo sapiens
atgttttgtggatttataaaacagctttcttaaattgttcattctgacaaaagaaaccttttttttttttttcaatttagtgatcttgatggctgctgtgaggtagagaacat

SEQ ID NO: 56969 - DNA, 85 bp, Homo sapiens
gatatgtatctgtatattttataattaatatatatgtattgcatgtatatgtaatttatgcattacatattgtaatacatgtata

SEQ ID NO: 56970 - DNA, 99 bp, Homo sapiens
gcacctggtctcaaatgatcctcgaaaatagtttctaaagaagtatttctactttagtgcttacctggacttcatctggattcatgtgacctccagggc

SEQ ID NO: 56971 - DNA, 116 bp, Homo sapiens
tgaactttgtgcaatatatgtatttaatacatgtatattgtgcattatatatattttaatatatgtatagtatatgtctatatataaatatgtatttcttttttgtatatacttta

SEQ ID NO: 56972 - DNA, 95 bp, Homo sapiens; identical to SEQ ID NO: 68

SEQ ID NO: 56973 - DNA, 93 bp, Homo sapiens; identical to SEQ ID NO: 69

SEQ ID NO: 56974 - DNA, 81 bp, Homo sapiens
ttggaaggaggactctcggtctctgtcttttgtctggggatgcctagaacaaaacagacacacctagcttccacttaccag

SEQ ID NO: 56975 - DNA, 72 bp, Homo sapiens
tttatttttgagttgaagactcactctgtcacccaggctagggtacatggtgcagtctcagctcactgtaga

SEQ ID NO: 56976 - DNA, 113 bp, Homo sapiens
ttaagtgctttctaattagtatctttaaagtatgttttgctaaagtggaaaaattattttttcatttgaagatagcattatgcccacaaatgaggtctgagttagctttttga

SEQ ID NO: 56977 - DNA, 84 bp, Homo sapiens
aggccttgagtgaacatagtcagttgtcagagagtgcacgcagcaggatttgagcaagacccatgctgtgctagctttaggtct

SEQ ID NO: 56978 - DNA, 116 bp, Homo sapiens
ctcaggacacagggccgccatccacctcactgctttcagaagagaatgctgagagtctcttacagactctctcttgacttgagttcttcatgggtgtgtggttaagatgtagtgag

SEQ ID NO: 56979 - DNA, 58 bp, Homo sapiens; identical to SEQ ID NO: 852

SEQ ID NO: 56980 - DNA, 95 bp, Homo sapiens; identical to SEQ ID NO: 2581

SEQ ID NO: 56981 - DNA, 77 bp, Homo sapiens; identical to SEQ ID NO: 2583

SEQ ID NO: 56982 - DNA, 58 bp, Homo sapiens
tgaggcagagtctcactctgtcgccgaggctggagtgcagtggtgagatcttggctca

SEQ ID NO: 56983 - DNA, 58 bp, Homo sapiens
tgagatggaatctcactctgtcactcaggctggagtacagtggtgtgatctcagctca

SEQ ID NO: 56984 - DNA, 70 bp, Homo sapiens
tttgaggcagggtcttgctctgtcaccctgtctggagtgcgctggtgcaatcttggctcactgtctcaag

SEQ ID NO: 56985 - DNA, 94 bp, Homo sapiens
attgtcatcactgccaggtttttgggagaatatattttattatcaaatgtacagtatattgaccctaaaattacagtaaagcagtcatggaaat

SEQ ID NO: 56986 - DNA, 95 bp, Homo sapiens; identical to SEQ ID NO: 580

SEQ ID NO: 56987 - DNA, 93 bp, Homo sapiens; identical to SEQ ID NO: 69

SEQ ID NO: 56988 - DNA, 171 bp, Homo sapiens
atacatctgtatgtgtgtatatataaagtacatgtgtgtatatgtttgtatatataaagatagtacatctgtgtgtatatatagtacctatatgtgtgtgtacatgcttgtgtgtattcatagtatatatatatgtgtatatattgatatgtgtgtgtgtgtgtgcatata

SEQ ID NO: 56989 - DNA, 70 bp, Homo sapiens
tgcgtacacatataggtatgtgtatatatatatgtgtatgtgtatatatatatatgtgtgtgtgtatgta

SEQ ID NO: 56990 - DNA, 108 bp, Homo sapiens
gattaaggggttttgttgttgttgttttgagatactgtctcactctgtcacccaggctagagtgcagtggtgctatctcagctcactgcagcctctgactcctgggtc

SEQ ID NO: 56991 - DNA, 77 bp, Homo sapiens
gtctctgtgcctgtgtctgtgtcctcatctcctctccttataagactgctatcacagaatgccatagacagggaggc

SEQ ID NO: 56992 - DNA, 74 bp, Homo sapiens
tgtatatatatatatgtgtgtgtatatattatgtgtgtatatatgtatatatacatatacatgtatacatatat

SEQ ID NO: 56993 - DNA, 79 bp, Homo sapiens
atatatgtatacatttatatgtatatatacctatatatgcacacatatatgtatacatgtatatgtatatatacatata

SEQ ID NO: 56994 - DNA, 95 bp, Homo sapiens; identical to SEQ ID NO: 68

SEQ ID NO: 56995 - DNA, 93 bp, Homo sapiens; identical to SEQ ID NO: 69

SEQ ID NO: 56996 - DNA, 94 bp, Homo sapiens
gataggtttggaatgtattgttgaaagaaattaaaataagttaattgtttatcttattatttttttttttttagagacagggtctcagtctgtc

SEQ ID NO: 56997 - DNA, 74 bp, Homo sapiens
atattttatgtatctatacatacacatacataaatgtatgtatgtgtacatatgtatagacacacatattatat

SEQ ID NO: 56998 - DNA, 89 bp, Homo sapiens
gcgaggtgtgtcggttctgtgcctgtaggttgcattctacttgcttgtatgaatctgcctgtcactctcacaaatgacgccacttctgc

SEQ ID NO: 56999 - DNA, 74 bp, Homo sapiens
ctattcttccaggtggaaggggagtctatcatatatataataatatatatgcagtcctccatgtggaaagggag

SEQ ID NO: 57000 - DNA, 75 bp, Homo sapiens
tctgggtgaggtgatgcatgcctgtagtctccactactcaggaggctgaggtggaaggatgatttgatccctgga

SEQ ID NO: 57001 - DNA, 201 bp, Homo sapiens
gcatgcatcacctcacccagatatatatatatatatgtatatatatatgtgtatatatgcatgtgtatatatgtatatatatgtgtgtatacatatgtatatatacacatatatatacatatatgtgtgtgtgtgtatatatgtatatatatacatatatatgtgtgtgtgtgtatatatatgtgtgtgtatatatatata

SEQ ID NO: 57002 - DNA, 83 bp, Homo sapiens
taacataaagcagaaagtattgagataccacagagaagctctgagggactcactgggtctctctttccctggattgtgttaca

SEQ ID NO: 57003 - DNA, 88 bp, Homo sapiens
agattgtatgttataggattatctctttggtaatgttggagtgccaaaatcaactctgagggggttgtattctttaatcatgacttct

SEQ ID NO: 57004 - DNA, 112 bp, Homo sapiens
aggatctttctatgagtgtgcatgcgtgtttagatgtgtttatgtgcatgcaaatatatgtgtacatatatatacataaatatatatatatatatttttgagatggagtctt

SEQ ID NO: 57005 - DNA, 76 bp, Homo sapiens
gggaggcttttgttcctctggggttgggggagactgggcctcactttcctctcagcctgactctgtggatgctcct

SEQ ID NO: 57006 - DNA, 135 bp, Homo sapiens
gcatgtacatatatgtatatatgcttatatgttatacatttatatttacatgtgcatttataacatgtatttatatgtatgtgtacatatatgtacacatttaggtatatgtacatatatgtttaaaagcatgtt

SEQ ID NO: 57007 - DNA, 95 bp, Homo sapiens
tatatatacatatatatgtttatgtatacgttcatgtatgttcatatatgtttaaatatatatataaatatatacgttcaaatatatatatatat

SEQ ID NO: 57008 - DNA, 227 bp, Homo sapiens
aatatatatatatatacacatacatatatatacacacacacacacacacgtgtgtatatatatatgtgtgtgtacatatatgtatgtattatatatttatatatgtgtatatatgtatatgtatatttatatgtgtgtatatatgtgtttatatatatttatatgtgtgtatatatgtgtgtgtatgtgtatatatgtatatatgcacatttaaaaataaatacata

SEQ ID NO: 57009 - DNA, 75 bp, Homo sapiens
ctgtagaggcctctgccatgggggaagggagagactgaatgtcacttgagtctctgtgaagagaccgccaaacag

SEQ ID NO: 57010 - DNA, 92 bp, Homo sapiens
gtcattgagcagggcacagtggagcacgcctctaatcccagcactttgggaggctgaggtaggaggatcacttgagtccaggagtttgagac

SEQ ID NO: 57011 - DNA, 67 bp, Homo sapiens
gagttaagaggggcatggcattgtggagactttctattcaaagacacaatctgtgtcacactgactc

SEQ ID NO: 57012 - DNA, 99 bp, Homo sapiens
gtaacagccaggtacagtttcctaaaaaaaaaagtatgttgtagtttattataaaagattcacagcttactgtagtagacaaaggtaccctggatttat

SEQ ID NO: 57013 - DNA, 57 bp, Homo sapiens
tgagacggactctcgctctgtcgcccaggctggagcgcagtggtgcgatctggctca

SEQ ID NO: 57014 - DNA, 95 bp, Homo sapiens
tcctaacaggtgtgaggtgtatctcattgtgatttttaaccttgcatttccctgatgattagtgatattgaggtttttttcttatacctttgggg

SEQ ID NO: 57015 - DNA, 69 bp, Homo sapiens
aagaaaggaaaagaaggaaagaaaataacagaccaatatttcttttttctttctttctttttttttttt

SEQ ID NO: 57016 - DNA, 56 bp, Homo sapiens
gaggcggagtctcgctctgtcacccaggctggagtgcagtggtgtgatctcggctc

SEQ ID NO: 57017 - DNA, 95 bp, Homo sapiens
tgaaaatggaagacttaaatatacaagggcagtgcaaataaatttttgtattttacatgttcattatactgctggttacagtctttcatttgtca

SEQ ID NO: 57018 - DNA, 66 bp, Homo sapiens
tgagatcacaggagtctcactcactctttcgcccaagctggagtgtagtggcacaatcttggctca

SEQ ID NO: 57019 - DNA, 58 bp, Homo sapiens
tgagacagagtctctctctgtcacccaggctggagtgcaagggcgcggtctctgctca

SEQ ID NO: 57020 - DNA, 75 bp, Homo sapiens
cttgtttttttgagacagagtctgtctctgtcgcccaggctggagtcactgcaacctttgtctcatgggttcaag

SEQ ID NO: 57021 - DNA, 96 bp, Homo sapiens
ttgaagtacaaaaaatgtctaaacagtaagaataatataaagatatatgtttttatcatatgtcaagtactgtttttagctgtttgtgtactttaa

SEQ ID NO: 57022 - DNA, 118 bp, Homo sapiens
gaagaatcacatctcatgtttcttgacagctggctggcttgtgagaacagatacaggacacatctatttttgaatgtgtggacaagcttcagccttctttcagttttgctgatgcttc

SEQ ID NO: 57023 - DNA, 94 bp, Homo sapiens
ggtgtcccctgcactgactcactgctactacttttgagagctaggaagcatctaaatgttccaagatctgagaatgatgttgtatgggggaccc

SEQ ID NO: 57024 - DNA, 74 bp, Homo sapiens
aaggaacacatttacactgttggtgggaatgtaaactagcacagccactacagaaaacagtgtggagattcctt

SEQ ID NO: 57025 - DNA, 95 bp, Homo sapiens; identical to SEQ ID NO: 68

SEQ ID NO: 57026 - DNA, 93 bp, Homo sapiens; identical to SEQ ID NO: 69

SEQ ID NO: 57027 - DNA, 101 bp, Homo sapiens
tactcattgtgactggttgtcctgctttcctcagattttcttctgccatctgtgacagcttcttgatctgtccccaggtaggtggctgtgttcgatgggtg

SEQ ID NO: 57028 - DNA, 95 bp, Homo sapiens; identical to SEQ ID NO: 68

SEQ ID NO: 57029 - DNA, 93 bp, Homo sapiens; identical to SEQ ID NO: 69

SEQ ID NO: 57030 - DNA, 105 bp, Homo sapiens
gcttatcaatcagtcaccccttgttcaaccctcagtggatgtgtagtgatattgtggtggacctttactgggcactctgctgaataactagagtggcacttgtgc

SEQ ID NO: 57031 - DNA, 87 bp, Homo sapiens
ttgaaacagggtctcactctgtcacttaggctggagtgcagtggtgcaacctcagcttactgcagccttgtcctcctgtgctcaagc

SEQ ID NO: 57032 - DNA, 78 bp, Homo sapiens
gctcggatgatttttgtgtttagtagagttgtgatatcaccatcacattttcttaatctgagtacagttattgctagc

SEQ ID NO: 57033 - DNA, 92 bp, Homo sapiens
gtattctacttgaaaaatacagattgacttaagaaactgtattttactttactttttcagacagtctcactctgtaatccaggctggaatgc

SEQ ID NO: 57034 - DNA, 95 bp, Homo sapiens; identical to SEQ ID NO: 68

SEQ ID NO: 57035 - DNA, 93 bp, Homo sapiens; identical to SEQ ID NO: 69

SEQ ID NO: 57036 - DNA, 240 bp, Homo sapiens
atgtgggtgtgtttgtgtgtgtgtgtgtgtgtgtgtatatatgtgtgtatatatatataatatacgtgtatatatatatacacgtatatatatataatatacgtgtatatatatatgtgtgtatatatatacgtgtatatatatatacgtgtatatatatatgtgtatatatatatacgtatatatatatatacgtgtatatatatatacgtgtgtgtgtgtgtgtgtatatatatatac

SEQ ID NO: 57037 - DNA, 106 bp, Homo sapiens
tgtaaatattcctgtaataaacatatatgtgcatgtgttttttaaagattattattatactttaagttttagggtacatgtgcacaatgtgcaggtttttgttaca

SEQ ID NO: 57038 - DNA, 111 bp, Homo sapiens
aattaatctttttgtaaatgggatagccactccattttctctaatgctttttcttatttctttataagtgttgaaaataatgggctcatgtacccaattacctggttgatt

SEQ ID NO: 57039 - DNA, 155 bp, Homo sapiens
gtattcatatatatatatatgagtatatatatatacacatatatacgtgtgtatatatgtatatatacatatgtgtatatatgtatatgtatattttgtatgtattatatatgtatatatttttatatgtgtgtgtgtgtatatatatatatcac

SEQ ID NO: 57040 - DNA, 58 bp, Homo sapiens; identical to SEQ ID NO: 10482

SEQ ID NO: 57041 - DNA, 58 bp, Homo sapiens
tgaggttgggtctcactctgtcacccaggctggagtgcagtggtggaataatggctca

SEQ ID NO: 57042 - DNA, 77 bp, Homo sapiens
atcttctgtctctctgtgtggccttttctattatgaaatgtagaaagaagcaggtatttcagagagaaaactgagat

SEQ ID NO: 57043 - DNA, 90 bp, Homo sapiens
tgggtttgtttataagatcttgcataattttatttaattaagcatggccacaatttaatttaatgaacattgcagaacttttgataccca

SEQ ID NO: 57044 - DNA, 88 bp, Homo sapiens
ggtgacaaagagaggaccttctccattttagaggccagatagatcagtaaacatttcctagtggtaggaggttctattattttccact

SEQ ID NO: 57045 - DNA, 119 bp, Homo sapiens
agaggagacatttttccagcctggattttggtctaaagggtacgtttttctatttttttcttgtattagctgtcagatatcttttctagtccaataccagactggcagaatactctttt

SEQ ID NO: 57046 - DNA, 58 bp, Homo sapiens
tgagactgggtctggctctgttctccaggttggagtacagtggctcaatctcagctta

SEQ ID NO: 57047 - DNA, 120 bp, Homo sapiens
ttgggaccttggaattgttgatgtacatatatatacatatatatatatatatatatacacatatatatatatatatatatatatacatacacagagagagagagagatttagaaataggt

SEQ ID NO: 57048 - DNA, 64 bp, Homo sapiens
tatatatatatatatatgtacatatatgtgtttatacatgtatgtacatatgtgtgtgtatata

SEQ ID NO: 57049 - DNA, 61 bp, Homo sapiens
ctgggatgatgatgatgatgatgatgatggcaattattattattatcattttaagttctgg

SEQ ID NO: 57050 - DNA, 102 bp, Homo sapiens
gaataagtatgatgtggtgctgagaagaatagacattttgttgatttggagtgtagagttctgtagatgtctattaggtctggtttttgcagagctgagttc

SEQ ID NO: 57051 - DNA, 88 bp, Homo sapiens
gcaataacactactctttgtgtgtgatattaaagagaaattaattctcattttcttgttgtctagacacacaaagtccaattgtatgc

SEQ ID NO: 57052 - DNA, 97 bp, Homo sapiens
gtgtgtgtgtgtgtgtgtgtggtgaagaaatatttgtatttcatttaagtgcaactaatttctatttaaatttaagctgccatatgtatctactggc

SEQ ID NO: 57053 - DNA, 115 bp, Homo sapiens
caccatcctcatcatcaccatcataatcatcattatgtagtagtagtgctgtataactgtgtatatttattcatcttttgattgattatgttctttggctgctgtgttgacagtg

SEQ ID NO: 57054 - DNA, 82 bp, Homo sapiens
acatatatatacatacacacatatgtgtatatatatacacacatatatacatatacacatatgtgtatatatatatacctgt

SEQ ID NO: 57055 - DNA, 91 bp, Homo sapiens
tagcagaaaccataacagagacaagtgagaggacagtggagaattttctctctacctctaatttcatcctcatttctgaaagggtatgctg

SEQ ID NO: 57056 - DNA, 81 bp, Homo sapiens
tacataagtatagaatacaaagctaaatctgcatataaaagtagataattattggcttgtgtgtgtgtctgtgtgtgtgtg

SEQ ID NO: 57057 - DNA, 95 bp, Homo sapiens; identical to SEQ ID NO: 68

SEQ ID NO: 57058 - DNA, 93 bp, Homo sapiens; identical to SEQ ID NO: 69

SEQ ID NO: 57059 - DNA, 95 bp, Homo sapiens; identical to SEQ ID NO: 580

SEQ ID NO: 57060 - DNA, 93 bp, Homo sapiens; identical to SEQ ID NO: 69

SEQ ID NO: 57061 - DNA, 95 bp, Homo sapiens; identical to SEQ ID NO: 580

SEQ ID NO: 57062 - DNA, 93 bp, Homo sapiens; identical to SEQ ID NO: 69

SEQ ID NO: 57063 - DNA, 251 bp, Homo sapiens
tatatatgtgtgtgtgtatatctatatatctatatagatatctatatatctatatatacacatatatacacacatatttgtatgtatatatacacacatatatgtatgtatatacacacacatatgtatgtatatacacatatgtatgtatgtatacacacatatgtatgtatatatacacacatatgtgtatatatgtgtatatatatgtgtgtgtatatatatacagacacacatatatacacatatat

SEQ ID NO: 57064 - DNA, 137 bp, Homo sapiens
tacatatatgtgtgtgtatatatatatatgtgtgtgcgtgtatagttccattatgtgtgtctgtgtgtatatatatatatacacatatatatgtacaaatatatacagatatatgtgtgtatatacacaaacacaga

SEQ ID NO: 57065 - DNA, 86 bp, Homo sapiens
ggaggctggaagtctgagatcaaggtgtaagcagagctggttcctcctcatgcttctctccttagcttgttgatgctgtcttctcc

SEQ ID NO: 57066 - DNA, 106 bp, Homo sapiens
agactttgcacctctggactcatatttttgccttatagccaactcatttttagatttattttgttttatttaagttcagggatacatgtgcagaatgtgcaggttt

SEQ ID NO: 57067 - DNA, 95 bp, Homo sapiens; identical to SEQ ID NO: 580

SEQ ID NO: 57068 - DNA, 93 bp, Homo sapiens; identical to SEQ ID NO: 69

SEQ ID NO: 57069 - DNA, 87 bp, Homo sapiens
ctttaatctgagttaaggataggcaatttttttttaatttatttgtttattttgagacattgtctggctctgtcactcaggctggag

SEQ ID NO: 57070 - DNA, 65 bp, Homo sapiens
tgtgtcccaggctggagtgcagtggtgtgatctcagctcactgcagtttcaatctctctgactca

SEQ ID NO: 57071 - DNA, 95 bp, Homo sapiens
ggcatccatgaatatgtgtgtgtgtgtgtgtgtgtgtttatgtgtgtatgtatatgtacacacacacatctattatctatctatctatctatgcc

SEQ ID NO: 57072 - DNA, 108 bp, Homo sapiens
gactgacttccaggaagcatgtgtgctgaatctatggccctgtattttctgagagagaacacacagagcctttacattggagcaatgcatcctgacaggagacaagtc

SEQ ID NO: 57073 - DNA, 73 bp, Homo sapiens
agtatatccacagtatattactatatgtatatataaacatatatgtatagtatagtacatatatgcatatact

SEQ ID NO: 57074 - DNA, 118 bp, Homo sapiens
gcatccaggtaccttccacagatggagcttagttgactgtgctgaaagagccctcctttttttattttttattttttttgacacagtgtttcactctgttactccggctggagtatgc

SEQ ID NO: 57075 - DNA, 105 bp, Homo sapiens
atatatattctctctctgtgtgtatatatatatatgtgtgtgtgtatatatatatatatatatatatatatatatatatatatattctacttaagacatatatgt

SEQ ID NO: 57076 - DNA, 70 bp, Homo sapiens
tttaagttacagggggatgagaatttggcccaacctgggtacatgtgcctttctctctctctgatttaaa

SEQ ID NO: 57077 - DNA, 118 bp, Homo sapiens
cttattgtcttaaattgtaagtgttaataattcaggtatgtatttaaatgattatttatagaattatttttctcacaggctgaatttaattaaagagtacaagtaataaaataataag

SEQ ID NO: 57078 - DNA, 91 bp, Homo sapiens
tgtcatggtgttttgttttgttttgtttttctgtggagagttgtcagggagcagggtttattatagtcagaataggagatgttactatgca

SEQ ID NO: 57079 - DNA, 93 bp, Homo sapiens; identical to SEQ ID NO: 69

SEQ ID NO: 57080 - DNA, 112 bp, Homo sapiens
ggccctacctttatttgcaaagtggtatatttctctttttttattattatactttaagttctagggtacaagtgcagaatgtgcagctttgttacctaggtatacatgtgcc

SEQ ID NO: 57081 - DNA, 90 bp, Homo sapiens
tctcttttctcaggctgtttcttctgacatcgttgatctatttatatttgtcttaagaaaagcatattatatggcccaaggaaattgagg

SEQ ID NO: 57082 - DNA, 95 bp, Homo sapiens; identical to SEQ ID NO: 68

SEQ ID NO: 57083 - DNA, 93 bp, Homo sapiens; identical to SEQ ID NO: 69

SEQ ID NO: 57084 - DNA, 132 bp, Homo sapiens
tgtgtatatatatgtacatatatatgtacatatatatatgtacatatatatgtacatatatatatgtacatatatatgtacatatatatatgtacatatatatatatgtatgtgcatatatatatatatgta

SEQ ID NO: 57085 - DNA, 102 bp, Homo sapiens
tatatatatatgtacatatatatatgtacatatatatgtacatatatatatgtacatatatatgtacatatatatatgtacatatatatgtacatatatata

SEQ ID NO: 57086 - DNA, 102 bp, Homo sapiens
tgtatatacatatgtatatatgcatatacatgtatatacatatgtatatatgcatatacatgtatatacatgtgtatatgtatacatatatgtacatataca

SEQ ID NO: 57087 - DNA, 117 bp, Homo sapiens
ggtttatttatatctctgtcgcttacatatttatctatattaaatatttttttaaatatatgtgcatatttgtatatagatatttatatgtaaatatattgataatataaatatatc

SEQ ID NO: 57088 - DNA, 61 bp, Homo sapiens
cagtgggcacaggtcagtgggtgcacacaccgtgtgcaagccaaagaagtgtgaggcattg

SEQ ID NO: 57089 - DNA, 95 bp, Homo sapiens; identical to SEQ ID NO: 68

SEQ ID NO: 57090 - DNA, 93 bp, Homo sapiens; identical to SEQ ID NO: 69

SEQ ID NO: 57091 - DNA, 82 bp, Homo sapiens
cctgtttaagagtagtcattttttttttcctactggaaatcctttaattggagagtaggtaaaattgtttttgttgagcagg

SEQ ID NO: 57092 - DNA, 83 bp, Homo sapiens
ggatctggcaatgtgcagaaaccaaggcagcttttctctgggtctctctcacaggagtcagcatccctttgcacatgggatcc

SEQ ID NO: 57093 - DNA, 99 bp, Homo sapiens
gtggctgtgtgtgacaccctataaacagtagcaacaacccctgagatctctgtatctctgtatcttgcttgtctttctagagagttatagcagaaacac

SEQ ID NO: 57094 - DNA, 118 bp, Homo sapiens
agattttagagaatttgagaggtgagtgtgttgaaaaattacatgtatatatcctaatatcaagaattagggcttggtgaagtggttcacacctgtaatcacaagactttagaaggct

SEQ ID NO: 57095 - DNA, 80 bp, Homo sapiens
acatataggtatgcttatatgtgtatatacataaagaaaaatgtcatatacatttatatatacatattatatcaatatgt

SEQ ID NO: 57096 - DNA, 73 bp, Homo sapiens
tgcccatattgacaaggatatagcttgatttttttttttttaagaaatgttgatgctatttctaggttaggca

SEQ ID NO: 57097 - DNA, 79 bp, Homo sapiens
gttttattgctctttctgcttgtagtttgaagagaagtgatttgcttggaatgcatgaagctagaaagggagctggaac

SEQ ID NO: 57098 - DNA, 79 bp, Homo sapiens; identical to SEQ ID NO: 57097

SEQ ID NO: 57099 - DNA, 80 bp, Homo sapiens; identical to SEQ ID NO: 57095

SEQ ID NO: 57100 - DNA, 118 bp, Homo sapiens; identical to SEQ ID NO: 57094

SEQ ID NO: 57101 - DNA, 74 bp, Homo sapiens
gagataaatggttgcattcttttgagtttccgattagcctctttaaaggagaaaatcagatatgcatttatctc

SEQ ID NO: 57102 - DNA, 99 bp, Homo sapiens; identical to SEQ ID NO: 57093

SEQ ID NO: 57103 - DNA, 83 bp, Homo sapiens; identical to SEQ ID NO: 57092

SEQ ID NO: 57104 - DNA, 72 bp, Homo sapiens
gtatacatatatatatacagtgtatgtgtatatatgtctgtttttatatataatgtgtgtatatgtgcatat

SEQ ID NO: 57105 - DNA, 73 bp, Homo sapiens
gaggttactgctgtctttttgttcatctgtgccctgcccccagaggtggagcctacagagacaggcaggcctc

SEQ ID NO: 57106 - DNA, 80 bp, Homo sapiens
gcctgtgtacttacctataagttcttattatatatatgagatggatttttatatatgttatttataagtaagtatattgc

SEQ ID NO: 57107 - DNA, 57 bp, Homo sapiens
catatatgtgtgttgtgtgtacatatacctttatatatatatacatacacatatatg

SEQ ID NO: 57108 - DNA, 84 bp, Homo sapiens
ggatatatacatatatatgtgcgtgtgtgtatatatgtatatgtatgtatttgtgtatatctatgtatgcatgtgtgtatatat

SEQ ID NO: 57109 - DNA, 105 bp, Homo sapiens
ttagtagtgtcgaaggaacttctagacatcttttcctctgaataaacactgacaaccctgaggaatgtaatgatgttagaaaaatatgttctgccgcattagtaa

SEQ ID NO: 57110 - DNA, 110 bp, Homo sapiens
ggatcatgggagtggctgtcccccttgctgttctcatgatagtgagtgaattgtcatgagatctggttttgtaaaagtgtgtggcacctcttctttttctctcttcttcc

SEQ ID NO: 57111 - DNA, 82 bp, Homo sapiens
actcaacacaaataaaaagagaaaactagatacctgatatttaaaatgttagtattttgcttttttctttttattctagagt

SEQ ID NO: 57112 - DNA, 81 bp, Homo sapiens
tcatattgatgttcatcagggatattggcctgacattttctttttttgttttgtctctgccaggctttggaatcaggatga

SEQ ID NO: 57113 - DNA, 136 bp, Homo sapiens
aggagccctatggtggccctggctgggcataacagaaggctcaccctgttatcttctggtcacttctcactatgtctcctcaactcctatctctgtatggcctggcttttcctgggttatgattatagagtgagga

SEQ ID NO: 57114 - DNA, 66 bp, Homo sapiens
caggcccagggagacaagagtgtgtgagatttcagccacactcactgcctggcaaacccatgcctg

SEQ ID NO: 57115 - DNA, 125 bp, Homo sapiens
gtatatatatgttccactatatacagtatatatatatattccactatatacagtatatatatatatattccactatatatagtatgtatatatatattccactatatatatatatatatatatag

SEQ ID NO: 57116 - DNA, 95 bp, Homo sapiens; identical to SEQ ID NO: 68

SEQ ID NO: 57117 - DNA, 93 bp, Homo sapiens; identical to SEQ ID NO: 69

SEQ ID NO: 57118 - DNA, 58 bp, Homo sapiens; identical to SEQ ID NO: 5571

SEQ ID NO: 57119 - DNA, 95 bp, Homo sapiens; identical to SEQ ID NO: 68

SEQ ID NO: 57120 - DNA, 93 bp, Homo sapiens; identical to SEQ ID NO: 69

SEQ ID NO: 57121 - DNA, 90 bp, Homo sapiens
tggctgctggagacttggtgagaggtgacagtgtgctggcagcccttgcttgctttgggcaccttctctgccttgggtccactctggcca

SEQ ID NO: 57122 - DNA, 115 bp, Homo sapiens
tttggaagaatgttattaaattcctaatacagagggtttatgtttttaattttttgtcttatgttgaaaatatataattttattgcattgtgattaatgattttttttttttaga

SEQ ID NO: 57123 - DNA, 58 bp, Homo sapiens; identical to SEQ ID NO: 7353

SEQ ID NO: 57124 - DNA, 83 bp, Homo sapiens
gtattgtgtatatgtgtatctatgtatgtgtgtatctatgtatgtgtgtatatatatgtatatacgtgtgtgtatacagatat

SEQ ID NO: 57125 - DNA, 85 bp, Homo sapiens
tgtatgtgtatgtatatatacgtatatatgtatattatatatgtatatatatgtatatatgtatgtgtgtatatatacatatata

SEQ ID NO: 57126 - DNA, 72 bp, Homo sapiens
aggctggttttgagatgtaggcctgtagtcctagctcttctggaggctgaggttggaggatcttttgagcct

SEQ ID NO: 57127 - DNA, 88 bp, Homo sapiens
ggtattgcattttggttttgatttgaatgtccctgatcattagtgatggtgggcatttttatttatgtttgttagccatttgtatatc

SEQ ID NO: 57128 - DNA, 68 bp, Homo sapiens
tatatatatatgtgtgtgtatatatatatatacacacatatatatgtatacacacacacatatatata

SEQ ID NO: 57129 - DNA, 59 bp, Homo sapiens
ctcagagcaggaaaaggggcctctgtgacagccctcctcagtggctctcactctctgag

SEQ ID NO: 57130 - DNA, 74 bp, Homo sapiens
gttggttttgagacaaagtctcactgtgtcacccaggctggagcacagtggtgcacttgtggctcactgcaaac

SEQ ID NO: 57131 - DNA, 102 bp, Homo sapiens
ggccccagagagatgaacccagtacctcagatggaaatgtagatattacctgtcttctgtgtcactctgggaactgtagactggacctgttcctattcggcc

SEQ ID NO: 57132 - DNA, 101 bp, Homo sapiens
cctgtgatactgctttgtgatgtgtggattcatctcacagagttaaatatttctttatattcagtaggttgaaaacactctttagaagaatcagtgaaagg

SEQ ID NO: 57133 - DNA, 103 bp, Homo sapiens
tacgcatacacacatatgtgtatatattacatacacatacatatatacacatatgtgtgtgtatatatgtgtgtatatgtgtgtatatgtgtgtatatgtgta

SEQ ID NO: 57134 - DNA, 95 bp, Homo sapiens; identical to SEQ ID NO: 68

SEQ ID NO: 57135 - DNA, 93 bp, Homo sapiens; identical to SEQ ID NO: 69

SEQ ID NO: 57136 - DNA, 89 bp, Homo sapiens
gagaggagagagagaggagagagagagaaaaaaaacctgtgagaattaaactcattagtatctgtgtgtctcttagtgtattacctctt

SEQ ID NO: 57137 - DNA, 149 bp, Homo sapiens
acttatatatgcatatataatgtatacctttatataatacatatgtgtatgtgtatatatatgcatatatgtgtgtgtatctatatatatttgtaaatatatatatatatatatatatatatatatatacatatatatatataaatgca

SEQ ID NO: 57138 - DNA, 74 bp, Homo sapiens
acttatatatgcatatataatgtatacctttatataatacatatgtgtatgtgtatatatatgcatatatgtgt

SEQ ID NO: 57139 - DNA, 82 bp, Homo sapiens
atacatatgtgtgtgcatgtgtatatgtatatatatacacacatatagagatatatacacacatatacatatacatatgtat

SEQ ID NO: 57140 - DNA, 64 bp, Homo sapiens
catatgtatatgtatatgtgtgtatatatctctatatgtgtgtatatatatacatatacacatg

SEQ ID NO: 57141 - DNA, 82 bp, Homo sapiens; identical to SEQ ID NO: 57139

SEQ ID NO: 57142 - DNA, 64 bp, Homo sapiens; identical to SEQ ID NO: 57140

SEQ ID NO: 57143 - DNA, 74 bp, Homo sapiens; identical to SEQ ID NO: 57138

SEQ ID NO: 57144 - DNA, 95 bp, Homo sapiens; identical to SEQ ID NO: 68

SEQ ID NO: 57145 - DNA, 93 bp, Homo sapiens; identical to SEQ ID NO: 69

SEQ ID NO: 57146 - DNA, 103 bp, Homo sapiens; identical to SEQ ID NO: 57133

SEQ ID NO: 57147 - DNA, 101 bp, Homo sapiens; identical to SEQ ID NO: 57132

SEQ ID NO: 57148 - DNA, 102 bp, Homo sapiens; identical to SEQ ID NO: 57131

SEQ ID NO: 57149 - DNA, 74 bp, Homo sapiens; identical to SEQ ID NO: 57130

SEQ ID NO: 57150 - DNA, 59 bp, Homo sapiens; identical to SEQ ID NO: 57129

SEQ ID NO: 57151 - DNA, 68 bp, Homo sapiens; identical to SEQ ID NO: 57128

SEQ ID NO: 57152 - DNA, 88 bp, Homo sapiens; identical to SEQ ID NO: 57127

SEQ ID NO: 57153 - DNA, 58 bp, Homo sapiens
tgagggtgggaagtgaaatagatttgtttaggtcaactctctttcactgtctccctca

SEQ ID NO: 57154 - DNA, 62 bp, Homo sapiens
tatatatatatatatatatatatacatattcgtatatgcatatatgtatatatgtatatata

SEQ ID NO: 57155 - DNA, 92 bp, Homo sapiens
gtcagtgttcctatattatatttatgtatacatatatacatatgtgtctgtgtgtacttatgtatgtatgcaatgtaaagaagaatacttac

SEQ ID NO: 57156 - DNA, 62 bp, Homo sapiens; identical to SEQ ID NO: 57154

SEQ ID NO: 57157 - DNA, 58 bp, Homo sapiens; identical to SEQ ID NO: 57153

SEQ ID NO: 57158 - DNA, 120 bp, Homo sapiens
tgccaaatgatgatagctagctctctagaggcggcaggaaaatgagacattgacattttttttttttttatacagagtctcactctgtcacccgggttggagttccatggcacagtctca

SEQ ID NO: 57159 - DNA, 73 bp, Homo sapiens
tatgtatatatatgtgtggtaagccaaaaataaacttctaagtttatttttgtgtatatataatgtgtatata

SEQ ID NO: 57160 - DNA, 58 bp, Homo sapiens
tgagactgagtctcattctgtcacccaggctggagtgcagtagtgcaatctcggctca

SEQ ID NO: 57161 - DNA, 111 bp, Homo sapiens
tataagttttctttctgttctgtcatttggaagaggttttatgggagttggggacaatttttattttaattatacattgtacagaattaccagatagtatgtaaacctatg

SEQ ID NO: 57162 - DNA, 76 bp, Homo sapiens
ctcccttcatacacttggagctctctgtgtttgtgtgacagtaaaggcatggggttccttgtgaatatccctcgag

SEQ ID NO: 57163 - DNA, 64 bp, Homo sapiens
catacatatatgtatgtatatatgtgtatatctgtatacatatatatgtgtatatatatgtgtg

SEQ ID NO: 57164 - DNA, 85 bp, Homo sapiens
gtctgcattgcctctctgtccatactcattgtttttctgctagtctttggaataaaggcaatgagagtgaagagagagtgtagac

SEQ ID NO: 57165 - DNA, 78 bp, Homo sapiens
tgtacacatacatacatatatgtacacatacatacatacatatatgtgtgtatatacatgtatatatgtatgtataca

SEQ ID NO: 57166 - DNA, 109 bp, Homo sapiens
ggataccagcactagcaccagtggaggtgaaagggaagtacaatgggctctgtgggggtacttagttgtatagttctttaatgcattagtgtagtgctggttgacatcc

SEQ ID NO: 57167 - DNA, 113 bp, Homo sapiens
tttatctgcatctattgggatgattatataattttgtttttaattatttttatgtggtgtatcacatttcttgacttacaaatgttaaatcgtccctgtatctcttgtgtgaa

SEQ ID NO: 57168 - DNA, 135 bp, Homo sapiens
gattggggtcacacttgaagcagtagtctggccatttttggtatagcagctgtgctgtgctggtgtgtctctctttctcactcagtttggactttcctaagcccacaggctggaatacctgagccatacaaacag

SEQ ID NO: 57169 - DNA, 95 bp, Homo sapiens
agaggtccttcatgtcccttgtaagttgtatgcctagttattttattgtctttatagtaattgtgaatgggagtttactcatgatttggctctct

SEQ ID NO: 57170 - DNA, 92 bp, Homo sapiens
aggttttcttctgccatctgtgacagcttcttgatctgtccccacataggtggctgtgttcaacgggtgttgcttgtgacagttggggtcct

SEQ ID NO: 57171 - DNA, 95 bp, Homo sapiens; identical to SEQ ID NO: 68

SEQ ID NO: 57172 - DNA, 93 bp, Homo sapiens; identical to SEQ ID NO: 69

SEQ ID NO: 57173 - DNA, 95 bp, Homo sapiens; identical to SEQ ID NO: 68

SEQ ID NO: 57174 - DNA, 93 bp, Homo sapiens; identical to SEQ ID NO: 69

SEQ ID NO: 57175 - DNA, 68 bp, Homo sapiens
gccagggcaccttcatgcctgagatgtctgcattgatgtgacagagaacagactgatctagcactggc

SEQ ID NO: 57176 - DNA, 101 bp, Homo sapiens
atatgcatgtgtgtatatgcgtgcatatgtatgtgtatatatgcatgtatatatgtatatatacacatataatttgtgtgtgtatgtttgtgtgtatatat

SEQ ID NO: 57177 - DNA, 77 bp, Homo sapiens
gcacagagactcactcagtggtagtacagcagtctgagatcaaactgaaggcagcagcaaggctgagggaggggtgc

SEQ ID NO: 57178 - DNA, 95 bp, Homo sapiens; identical to SEQ ID NO: 68

SEQ ID NO: 57179 - DNA, 93 bp, Homo sapiens; identical to SEQ ID NO: 69

SEQ ID NO: 57180 - DNA, 108 bp, Homo sapiens
ttgagtactgtacttggttcacagtcatcggtttctcactctgggtgtacatttttgtccccagctggaatctaaaatctgagacattcatgaccaggttcatgccaa

SEQ ID NO: 57181 - DNA, 101 bp, Homo sapiens
ctgggattacaaatgtgagacaccacactcagcctatttatttaatttttttttaacttttattttaggttcaaagagtagatgtgcagatttgttaccag

SEQ ID NO: 57182 - DNA, 113 bp, Homo sapiens
gaaagatatatgtgtgtgtgtatatgtgtgtatatatatgtgtatatgtatatatcctgtatatatatgtatatatgtgtatatacatatatacatatattatgtgtgtgttc

SEQ ID NO: 57183 - DNA, 77 bp, Homo sapiens
ctgtgtcagtttctctatctcactttctcaagtagctaaaattacagcctctgaaagtgttggaattacagacatag

SEQ ID NO: 57184 - DNA, 95 bp, Homo sapiens; identical to SEQ ID NO: 68

SEQ ID NO: 57185 - DNA, 93 bp, Homo sapiens; identical to SEQ ID NO: 69

SEQ ID NO: 57186 - DNA, 76 bp, Homo sapiens
atgtcttttttttttttttgaaagcagctcaagacctcaaagcagagtggtcatgggtcaggctttcataggacat

SEQ ID NO: 57187 - DNA, 120 bp, Homo sapiens
tatatttaatatatataaaatacatatatacatttatatatttatatattatatatttttatatataaatacatatgtattttaatgtgtgtgtgcatatgtgtatctgtatgtgtgtat

SEQ ID NO: 57188 - DNA, 76 bp, Homo sapiens
tggtttgttactcatctaaaagagagaggaaaagaaggtgtaccttagtttctttttcatttgaagtaattaccca

SEQ ID NO: 57189 - DNA, 77 bp, Homo sapiens
aggacttccagtgatatgttgaagaggacggtgagagtgggcattcttgtctggttctaggtctcagaggaaattct

SEQ ID NO: 57190 - DNA, 105 bp, Homo sapiens
tctcaggactatcaggatcaaagggagtatacatacaataggcctcacacagtctctcatagaattgtgctggactttcttcttttccctgaattacttcagaga

SEQ ID NO: 57191 - DNA, 162 bp, Homo sapiens
gtgttaaggagatattgagactgacaagggaatattgaggggttttagagtgttctattttttttttttttttttgagacagactctcgctctgtcacacaggctggagtgcagtggcatgatcttagctcacagcaacctctgcctcctggtttcagtgat

SEQ ID NO: 57192 - DNA, 103 bp, Homo sapiens
atgtgccttgtggtagtgtctggtacatacgcaaactttttttttaatactttaagttccggggtacatgtgcagaatgtgcaggtttgttacagaggtatat

SEQ ID NO: 57193 - DNA, 113 bp, Homo sapiens
tctctacaggtttatagaggagtagtatgtacaagtggagcaggttctctggatagaagttcagactcactgactgacttgccatgtactctctggcaatcacctaacaggga

SEQ ID NO: 57194 - DNA, 72 bp, Homo sapiens
gccgcacagtatgtctcactcagtgtacattggctgaatgtttaccgagcaaagatcatgcctgttctaggc

SEQ ID NO: 57195 - DNA, 74 bp, Homo sapiens
gtgcctgcctgcctgcctacctgcctgccttctcactctgtgtcatccaggctggagtgcagttgttcgatcac

SEQ ID NO: 57196 - DNA, 74 bp, Homo sapiens
agcaagcattgcctgcctccctgcctgcctggataccagtgtcaggaataggtggtactatccaggtgttttct

SEQ ID NO: 57197 - DNA, 100 bp, Homo sapiens
gatatgtgtgtgtgtgtatataaatacatatatatgtgtgtgtgtgtttaaatatatatatatatatatatatatatatatatatatatatatcccacat

SEQ ID NO: 57198 - DNA, 96 bp, Homo sapiens
cagaggaaggatcaggcagcaatatttgttgttcagtaatgtttgctgttcagcaatatttgctgttctgcaatatttgctgttctgcagcctctg

SEQ ID NO: 57199 - DNA, 72 bp, Homo sapiens
tgtgtatatatatgtatatgtgtgtatacacacacacacacacacacacacacacatacatatatataagca

SEQ ID NO: 57200 - DNA, 58 bp, Homo sapiens
tgacgcagagtctcactctgtcaccctggctggggtgcagtggtgtgatctcagctca

SEQ ID NO: 57201 - DNA, 108 bp, Homo sapiens
tggctggaatgacaaatgtgagacaccacactcagccaaaattaatattttaaaatatttagaaatatgtgtggtagggtgcagtggctcacacctgtaatcccatca

SEQ ID NO: 57202 - DNA, 101 bp, Homo sapiens
tacttgttgtgactggttgtcccgctttcctcaggttttcttctgccatcagtgacagcttcttgatctgtccccaggtggttgactgtgttcaatgggtg

SEQ ID NO: 57203 - DNA, 82 bp, Homo sapiens
taaaattataaatttatttttggattgccatactgcctccctggcacagatgaagccttctaaactgaaatttatattttta

SEQ ID NO: 57204 - DNA, 56 bp, Homo sapiens
gagtctgagtctcacactgtcacccaggctggagtgcagtggcatgatctcagctc

SEQ ID NO: 57205 - DNA, 93 bp, Homo sapiens
gatatagatacatagatagatagatagatagatagatagatagatagatagataaattgtgtgtgtgtatctgtgtgtatgtgtgtgtgtgtc

SEQ ID NO: 57206 - DNA, 61 bp, Homo sapiens
gccatctttgacaccttcttgatctgtccccaggtcagtggctgtgttcaacaggtgttgc

SEQ ID NO: 57207 - DNA, 85 bp, Homo sapiens
atagagctggtaaacaactcttccaggaagccaaatgcttgtaaactggcttggttggatagaattgattttatattggctttgt

SEQ ID NO: 57208 - DNA, 108 bp, Homo sapiens
tgtacggctgaataatactccattgtgtatgtgtaccacattttcttttgtttttattttattatactttaagttttagggtacatgtgcacattgtgcacattagtt

SEQ ID NO: 57209 - DNA, 87 bp, Homo sapiens
ctgttctcagcaattaatacctgcttactcagttactcactgtaactatgttatactgtgaagtgggtactacagttgttaaggaag

SEQ ID NO: 57210 - DNA, 119 bp, Homo sapiens
gtatggtggaatacagaaatgtctttggacacaaaggcaaagaaataaagtatgtttattgggtacctcatagcagagacaacaaatttcagccttttccatatcatctgtgcccatgc

SEQ ID NO: 57211 - DNA, 97 bp, Homo sapiens
aagtatcatatatcggtagagttttgggggtttttttattatttgggatttttttttttaattgagagaagctctcttctgtgcagaatggctattt

SEQ ID NO: 57212 - DNA, 81 bp, Homo sapiens
atgtgagtatgaagttacttggaagctgtgtgattgaaagtgagtcactcagtcactggatcctggcatttttctctacat

SEQ ID NO: 57213 - DNA, 105 bp, Homo sapiens
tcatttgtgttttactgcctgctcttttgagccacttgtagtcagaagagaagtgatttccttgaaatatatatggccagaaaaggagatggaatttaaaagtgg

SEQ ID NO: 57214 - DNA, 73 bp, Homo sapiens
aggcatgtgccaccacacatggctaatttttatatttttgctagagatgggatttcatgatgttggccagcct

SEQ ID NO: 57215 - DNA, 100 bp, Homo sapiens
gacacataaaattacaatgtgggtggatttatttatatatatatatctgtgtgtgtgtgtgtgtccctgaaattttatccttcttgagtatatatgtgtc

SEQ ID NO: 57216 - DNA, 84 bp, Homo sapiens
ggtgtcttatttgtgttttactatctgctctttttagctgcttgtagtcagaagagaagtgatttccttgaaatgcatgagacc

SEQ ID NO: 57217 - DNA, 81 bp, Homo sapiens; identical to SEQ ID NO: 57212

SEQ ID NO: 57218 - DNA, 119 bp, Homo sapiens; identical to SEQ ID NO: 57210

SEQ ID NO: 57219 - DNA, 87 bp, Homo sapiens; identical to SEQ ID NO: 57209

SEQ ID NO: 57220 - DNA, 108 bp, Homo sapiens; identical to SEQ ID NO: 57208

SEQ ID NO: 57221 - DNA, 85 bp, Homo sapiens; identical to SEQ ID NO: 57207

SEQ ID NO: 57222 - DNA, 58 bp, Homo sapiens
tgagacagagtctcactgcctcacccaggcaggagtgcagtggtgtgatcctgcctca

SEQ ID NO: 57223 - DNA, 124 bp, Homo sapiens
gggttaacacttacatggaatgtatttctcatcctgtcattttctgtctttttttaaattagatctgaagtgattctcttgaagacatgacatagttgatcttaatatacatcatgatatagtg

SEQ ID NO: 57224 - DNA, 96 bp, Homo sapiens
gcagagttcaagacaaagctcactggcagagtccaagacaaagaagagagtcacatcacctaggttttgcactcagtggtatgtcaaaatttcttc

SEQ ID NO: 57225 - DNA, 62 bp, Homo sapiens
ttgagatggactctcactctggcactccggagctaggttggagtccagtggcacaatctcag

SEQ ID NO: 57226 - DNA, 119 bp, Homo sapiens
aggcatgacatagttacatcctgatatagactacaacatagccacatttttttttttcatttggaaagataattttgcaggctatagtattctttattaggctatttatttcagtgttt

SEQ ID NO: 57227 - DNA, 112 bp, Homo sapiens
aggctacagagtaatatgtgtgatattcatagtatatagtttttatagttttatggtttataaaaaactatatatagtttgtatactatatatttacatacaatctggactt

SEQ ID NO: 57228 - DNA, 98 bp, Homo sapiens
aggcttcttttctcaggtgttcactgaggctgtgttttttttaaatcatctgaatgtatttcatagtttcagatgcccatacacatctgtgtgaacct

SEQ ID NO: 57229 - DNA, 58 bp, Homo sapiens; identical to SEQ ID NO: 57222

SEQ ID NO: 57230 - DNA, 85 bp, Homo sapiens; identical to SEQ ID NO: 57207

SEQ ID NO: 57231 - DNA, 108 bp, Homo sapiens; identical to SEQ ID NO: 57208

SEQ ID NO: 57232 - DNA, 87 bp, Homo sapiens; identical to SEQ ID NO: 57209

SEQ ID NO: 57233 - DNA, 119 bp, Homo sapiens; identical to SEQ ID NO: 57210

SEQ ID NO: 57234 - DNA, 81 bp, Homo sapiens; identical to SEQ ID NO: 57212

SEQ ID NO: 57235 - DNA, 122 bp, Homo sapiens
agagaagacttttatcattattattattattattattattattactatgatgatgtgtgtgtgtgagaaggagtctcactctctcactcaggctggagtgcaggagcagaatctcagctcac

SEQ ID NO: 57236 - DNA, 78 bp, Homo sapiens
tatatatatatactcctgtatatatatatatatatattcctgtatatatgtatatatatattcctgtgtgtgtgtgtg

SEQ ID NO: 57237 - DNA, 84 bp, Homo sapiens
tagaggggtttttatgagatggagtctcactctctcacccaggctagagtgtagtggcccgatctcagctccctgcagcctctg

SEQ ID NO: 57238 - DNA, 83 bp, Homo sapiens
ctgtttctagtggaatatatatatatgtataatatgtgtatatatacatatgtgtgtatgtatatatatatactgcatcacag

SEQ ID NO: 57239 - DNA, 105 bp, Homo sapiens
tagcttccttatcttactgcacctgaagggaaaggaatgtgcttactatttgtagttagaagacaagtgatttccttgaaatgcatgaggctaaaaagagagttg

SEQ ID NO: 57240 - DNA, 115 bp, Homo sapiens
ccacagctctctctgtcagataaccacaacaaagagacacagaagccgtccaagactctgacaaactctctgagactgaatcttgaaaatctcttagtctgttaagagaatgtgg

SEQ ID NO: 57241 - DNA, 95 bp, Homo sapiens
tggtggtcagtgtttgtagtcttggctactcagaaggctgaggtaggaggatcctttgattctgggatgcagaggttgcagttatccaaaaccac

SEQ ID NO: 57242 - DNA, 112 bp, Homo sapiens
tgtacatagatgtatgtatatatacacatatcatatatgtttatgtgtatatagatgtatgtatatatacacatatcatatatgtgtatgtgtatatagatgtgtatgtaca

SEQ ID NO: 57243 - DNA, 130 bp, Homo sapiens
gcgtatatattacacatgtgcatatatatacaaacattcacacacatatataagtgtgtgtatatataagtatatatgtatgctctgtctatatatgtgtgtatatatacacatacacacatatgtgtgt

SEQ ID NO: 57244 - DNA, 99 bp, Homo sapiens
tataaacatatatagacatacatatatacacatatatacatatacacacgtgtgtatatgtatatatgtgtgtaatatatatgtttgtatgtgtatata

SEQ ID NO: 57245 - DNA, 66 bp, Homo sapiens
tatgtgtgtatgtgtatatgtatatatatacacacatatagagatatatatacacatatacatata

SEQ ID NO: 57246 - DNA, 66 bp, Homo sapiens; identical to SEQ ID NO: 57245

SEQ ID NO: 57247 - DNA, 91 bp, Homo sapiens
acatatatagacatacatatatacacatatatacatatacacacacgtgtgtatatgtatatatgtgtgtaatatatatgtttgtatgtgt

SEQ ID NO: 57248 - DNA, 74 bp, Homo sapiens
tatattttcacatatatgtgtatatgtatatgtctgtgtgagcatgtatgtgcacatgtgtatgtgtatatgtg

SEQ ID NO: 57249 - DNA, 66 bp, Homo sapiens; identical to SEQ ID NO: 474

SEQ ID NO: 57250 - DNA, 86 bp, Homo sapiens; identical to SEQ ID NO: 2671

SEQ ID NO: 57251 - DNA, 99 bp, Homo sapiens; identical to SEQ ID NO: 3220

SEQ ID NO: 57252 - DNA, 68 bp, Homo sapiens
ttgttgagatggagtctcgctctgtcactcaggctggagtgcagtggtgtgatcttggctcactgcaa

SEQ ID NO: 57253 - DNA, 111 bp, Homo sapiens
tgtgcttggaaaagtctgactggatggcttcataaggacccttccctttttttttctttttttttgaggtggagtctcactctgtcacccaggctggagtgcagtggcgca

SEQ ID NO: 57254 - DNA, 82 bp, Homo sapiens
gttagggcaggaaactaacaaaggaagaaataaggtatgacccaaaccatattttttgtcttttttcttttcttgtcttttc

SEQ ID NO: 57255 - DNA, 124 bp, Homo sapiens; identical to SEQ ID NO: 57223

SEQ ID NO: 57256 - DNA, 96 bp, Homo sapiens; identical to SEQ ID NO: 57224

SEQ ID NO: 57257 - DNA, 62 bp, Homo sapiens; identical to SEQ ID NO: 57225

SEQ ID NO: 57258 - DNA, 119 bp, Homo sapiens; identical to SEQ ID NO: 57226

SEQ ID NO: 57259 - DNA, 116 bp, Homo sapiens
gcaacaatgctattggttaaaaatggaaagaaggctcgcatccttttgataaaatgcattcaaattttattttttgtttttgtttttattttttatttcgatagctttaggggtgc

SEQ ID NO: 57260 - DNA, 116 bp, Homo sapiens; identical to SEQ ID NO: 57259

SEQ ID NO: 57261 - DNA, 119 bp, Homo sapiens; identical to SEQ ID NO: 57226

SEQ ID NO: 57262 - DNA, 62 bp, Homo sapiens; identical to SEQ ID NO: 57225

SEQ ID NO: 57263 - DNA, 96 bp, Homo sapiens; identical to SEQ ID NO: 57224

SEQ ID NO: 57264 - DNA, 124 bp, Homo sapiens; identical to SEQ ID NO: 57223

SEQ ID NO: 57265 - DNA, 82 bp, Homo sapiens; identical to SEQ ID NO: 57254

SEQ ID NO: 57266 - DNA, 111 bp, Homo sapiens; identical to SEQ ID NO: 57253

SEQ ID NO: 57267 - DNA, 68 bp, Homo sapiens; identical to SEQ ID NO: 57252

SEQ ID NO: 57268 - DNA, 86 bp, Homo sapiens; identical to SEQ ID NO: 2671

SEQ ID NO: 57269 - DNA, 66 bp, Homo sapiens; identical to SEQ ID NO: 474

SEQ ID NO: 57270 - DNA, 74 bp, Homo sapiens; identical to SEQ ID NO: 57248

SEQ ID NO: 57271 - DNA, 91 bp, Homo sapiens; identical to SEQ ID NO: 57247

SEQ ID NO: 57272 - DNA, 66 bp, Homo sapiens; identical to SEQ ID NO: 57245

SEQ ID NO: 57273 - DNA, 66 bp, Homo sapiens; identical to SEQ ID NO: 57245

SEQ ID NO: 57274 - DNA, 91 bp, Homo sapiens; identical to SEQ ID NO: 57247

SEQ ID NO: 57275 - DNA, 130 bp, Homo sapiens; identical to SEQ ID NO: 57243

SEQ ID NO: 57276 - DNA, 112 bp, Homo sapiens; identical to SEQ ID NO: 57242

SEQ ID NO: 57277 - DNA, 95 bp, Homo sapiens; identical to SEQ ID NO: 57241

SEQ ID NO: 57278 - DNA, 115 bp, Homo sapiens; identical to SEQ ID NO: 57240

SEQ ID NO: 57279 - DNA, 105 bp, Homo sapiens; identical to SEQ ID NO: 57239

SEQ ID NO: 57280 - DNA, 83 bp, Homo sapiens; identical to SEQ ID NO: 57238

SEQ ID NO: 57281 - DNA, 84 bp, Homo sapiens; identical to SEQ ID NO: 57237

SEQ ID NO: 57282 - DNA, 78 bp, Homo sapiens; identical to SEQ ID NO: 57236

SEQ ID NO: 57283 - DNA, 122 bp, Homo sapiens; identical to SEQ ID NO: 57235

SEQ ID NO: 57284 - DNA, 81 bp, Homo sapiens; identical to SEQ ID NO: 57212

SEQ ID NO: 57285 - DNA, 119 bp, Homo sapiens; identical to SEQ ID NO: 57210

SEQ ID NO: 57286 - DNA, 87 bp, Homo sapiens; identical to SEQ ID NO: 57209

SEQ ID NO: 57287 - DNA, 108 bp, Homo sapiens; identical to SEQ ID NO: 57208

SEQ ID NO: 57288 - DNA, 85 bp, Homo sapiens; identical to SEQ ID NO: 57207

SEQ ID NO: 57289 - DNA, 58 bp, Homo sapiens; identical to SEQ ID NO: 57222

SEQ ID NO: 57290 - DNA, 98 bp, Homo sapiens; identical to SEQ ID NO: 57228

SEQ ID NO: 57291 - DNA, 112 bp, Homo sapiens; identical to SEQ ID NO: 57227

SEQ ID NO: 57292 - DNA, 58 bp, Homo sapiens; identical to SEQ ID NO: 2248

SEQ ID NO: 57293 - DNA, 113 bp, Homo sapiens
tgcttaaaaatatttgattttctttcttaacaattgattcttggtttaggtttttttttttagttaaactttggttggttagggcttaacagggaattaggaatttgatagca

SEQ ID NO: 57294 - DNA, 59 bp, Homo sapiens
gaatgtctgcttgtgatatttgtaggaatataaacatgtatcaacataagtaggcattt

SEQ ID NO: 57295 - DNA, 111 bp, Homo sapiens; identical to SEQ ID NO: 9033

SEQ ID NO: 57296 - DNA, 144 bp, Homo sapiens
cccaagtagctggaattacagatgtgagccactgtgcttggcctttttttttttttttttttttctgagacagagtctcactctggttgtccaggctggggtgcggtggcgcattcttagctcactgcaacctcgacctcccag

SEQ ID NO: 57297 - DNA, 77 bp, Homo sapiens
gtttctgtgtgtgtatgtgtatgcatgcatgtatcttatgtgtatatatgtatatatacacttacatgtatataaat

SEQ ID NO: 57298 - DNA, 62 bp, Homo sapiens; identical to SEQ ID NO: 39472

SEQ ID NO: 57299 - DNA, 96 bp, Homo sapiens
gcatgtttttggttttggttttggggtttttttgttttatttttatttttattttttttgagacagaatctcactctgccacccaggctggagtgc

SEQ ID NO: 57300 - DNA, 82 bp, Homo sapiens
ttttttaaatgaagatatatgtgtacctataagtgtgtgtatatacatatatgtatatatgtataacctttaaaatgaaaaa

SEQ ID NO: 57301 - DNA, 105 bp, Homo sapiens
ttctaatttgtctcactgtggtcagagtgtgtgcttggtatgatttcaaactttatgaatttattgaggcttgctttctggccaagcatgtggttgatcttagaa

SEQ ID NO: 57302 - DNA, 109 bp, Homo sapiens
tgagatggagtcttgccctatcatccaggctggagttcagtggtatgatcttagctcactgcaacctccacctcccaggttcaagtgattctcatgcctcagcttcctg

SEQ ID NO: 57303 - DNA, 113 bp, Homo sapiens
gtgactgatatatatatgtatgtttatatatatatatttatttatatatatgtatatatatatatatatttatttatatatatatatgtgtgtgtgtgtgtatcagtaaatat

SEQ ID NO: 57304 - DNA, 110 bp, Homo sapiens; identical to SEQ ID NO: 56706

SEQ ID NO: 57305 - DNA, 100 bp, Homo sapiens
agtagacagatagatagatacatacaggtagatagatacataaatggatactatgtatatatttatatatctacacctgtaaatatcctgttggttctct

SEQ ID NO: 57306 - DNA, 73 bp, Homo sapiens
ggatatttacaggtgtagatatataaatatatacatagtatccatttatgtatctatctacctgtatgtatct

SEQ ID NO: 57307 - DNA, 94 bp, Homo sapiens
cctaaggtattttcttatgacagccacctatcagcagatagagcaatgcggtgactgattgctgatactaccaagtctatgtaaggaacacagg

SEQ ID NO: 57308 - DNA, 110 bp, Homo sapiens; identical to SEQ ID NO: 56708

SEQ ID NO: 57309 - DNA, 104 bp, Homo sapiens
tgtgcgtttgtatatatatgtgtatatatataggtgtgtgtgtatatgtatatatatatatatatatacatatacacacacagacacacatgtatatatcacat

SEQ ID NO: 57310 - DNA, 95 bp, Homo sapiens; identical to SEQ ID NO: 68

SEQ ID NO: 57311 - DNA, 93 bp, Homo sapiens; identical to SEQ ID NO: 69

SEQ ID NO: 57312 - DNA, 110 bp, Homo sapiens
taggtatatatttatatgtactatatatatgtttataggcatatatttatatatgcatataggtatatatttatatataatatatatccacatgtatatatgtatatcta

SEQ ID NO: 57313 - DNA, 108 bp, Homo sapiens
tatatatatgtgtgtgtgtgtatatatctatatgtgtatatatatgtgtgtatatatgtgtatgtgtgtatatatgtgtatatatgtatatatgtgtatatatatgtg

SEQ ID NO: 57314 - DNA, 123 bp, Homo sapiens
gctggaaaatgaaaggaaagttgtatagacagaattgtatattaggagacaatacagaagagattatctacttttgtgtgtatgttgagagactgattttgaactgttaaacacagcatcctt

SEQ ID NO: 57315 - DNA, 74 bp, Homo sapiens
catggccatctttcgctgtctgtgtctctgtgtcccttattaagacatcagtcatattggattaagggctcatg

SEQ ID NO: 57316 - DNA, 69 bp, Homo sapiens
tgcagttttgagacggagtctcactgtctcccaggctggagggcagtggcatgatctcagctcactgca

SEQ ID NO: 57317 - DNA, 145 bp, Homo sapiens
atatatgtgtacatgtgtgtatatgtatatatatgtgtacatgtgtgtatatgtatatatatgtgtacatgtgtgtatatgtatatatatgtgagtgtatatatatatgtttatatatatgtgtgtgtgtatatatatatatata

SEQ ID NO: 57318 - DNA, 356 bp, Homo sapiens
atatatgtatatatgtatacatatgtacatatgtatacatatgtgtgtatatatgtatatgtgtgtacatatgtgtatatgtatatatgtgtacatatgtgtatatgtatatatgtgtacatgcgtgtatatgtatatatgtgtacatgcgtgtatatgtatatatgtgtacatgcgtgtatatgtatatatgtgtacatgtgtgtatatgtatatatgtgtacatgtgtgtatatgtatatatgtgtacatatgtgtatatgtatatatgtgtacatgtgtgtatatgtatatatgtgtacatgtgtgtatatgtatatatgtgtacatgtgtgtatatgtatatatgtgtacat

SEQ ID NO: 57319 - DNA, 171 bp, Homo sapiens
tgtatatatgcatatatatgtatatatgtatatatatgcatatatatgtatatatgtgtatatatatgcatgtatatgtatatatgtatatatgtatatatgtatatgtgtacatatgtgtatatatgtatatgtgtatatatgtatatatgtatatatgcatatatgtat

SEQ ID NO: 57320 - DNA, 78 bp, Homo sapiens
tatgtcatatatatatgtatatatatatgtctctatatatgtatatatgtctatatatgtatatatgcatatatatgt

SEQ ID NO: 57321 - DNA, 102 bp, Homo sapiens; identical to SEQ ID NO: 56721

SEQ ID NO: 57322 - DNA, 109 bp, Homo sapiens
acactataggttggagagaaggctgggagaaagaagtcagtgtacagtgtaacaggagtaggaatcacggacatttaagccacttctacatttaacttacttgtagcct

SEQ ID NO: 57323 - DNA, 99 bp, Homo sapiens; identical to SEQ ID NO: 56722

SEQ ID NO: 57324 - DNA, 83 bp, Homo sapiens
agatatatatatcgatatatatagatataggatctatcctatatatatagatataagatatatatatctatatatatgagata

SEQ ID NO: 57325 - DNA, 71 bp, Homo sapiens; identical to SEQ ID NO: 56723

SEQ ID NO: 57326 - DNA, 119 bp, Homo sapiens
gtattcttcggttggtgggtgaaatgttctgtacatatttgttaagtctatttgttctagagaatagtttaaatccattgttttttgttaactttctaccttgatgacctgtctaatgc

SEQ ID NO: 57327 - DNA, 79 bp, Homo sapiens
tattatttctttctcttatctaattgctctggctaggacttccagtaaaaagtttgagtggtgagagagagcattaatg

SEQ ID NO: 57328 - DNA, 120 bp, Homo sapiens
gctgagaaatatcagtgtttaagttaacatagacatgaatatataaatacagaaataactatagatgtatgtatttatgtatgggttagcatacatgcactcatacatattctttctggc

SEQ ID NO: 57329 - DNA, 88 bp, Homo sapiens
cttggtgcgcaggtggtcggacatgcagcaggactggcaaaacagagtatctgtgtgtcagtgtatgttttattcatctgtcatttgg

SEQ ID NO: 57330 - DNA, 111 bp, Homo sapiens
gattgtcttggctattcaggctctttttggttccatacacatttcaaaatagtttttttttctaattctatgaagaatgtcagtggcaatttagtggaatagcattgaatc

SEQ ID NO: 57331 - DNA, 113 bp, Homo sapiens
gaaatgcaatgtttataattttactttctcttacttatatgccttctctgttgtgagaagtgagtcagcttaaataagaggaaggtgaaagaagtaaagaaattggatacttc

SEQ ID NO: 57332 - DNA, 85 bp, Homo sapiens; identical to SEQ ID NO: 56744

SEQ ID NO: 57333 - DNA, 120 bp, Homo sapiens
atatatatatgcatgtatatatatacgtgtatatatatatacacgtatatatatgtgtatatatatacgtgtatatatacatgtatatatatgtgtatatatatacgtgtatatatatat

SEQ ID NO: 57334 - DNA, 98 bp, Homo sapiens
tctctttagttgaatggcaagtttattattttaaataatcttataacttttacttgtgtataagactgtttagagtttagactgtaggctagatgaga

SEQ ID NO: 57335 - DNA, 95 bp, Homo sapiens; identical to SEQ ID NO: 68

SEQ ID NO: 57336 - DNA, 93 bp, Homo sapiens; identical to SEQ ID NO: 69

SEQ ID NO: 57337 - DNA, 101 bp, Homo sapiens; identical to SEQ ID NO: 56752

SEQ ID NO: 57338 - DNA, 111 bp, Homo sapiens
atatacataatatacgtgtatatgtatataatatgtataatatataatacataacatatgtatatgtatatgtgtataatgtatgtaaagtgtattacatattatacatgt

SEQ ID NO: 57339 - DNA, 118 bp, Homo sapiens; identical to SEQ ID NO: 56753

SEQ ID NO: 57340 - DNA, 95 bp, Homo sapiens; identical to SEQ ID NO: 580

SEQ ID NO: 57341 - DNA, 93 bp, Homo sapiens; identical to SEQ ID NO: 69

SEQ ID NO: 57342 - DNA, 95 bp, Homo sapiens; identical to SEQ ID NO: 68

SEQ ID NO: 57343 - DNA, 93 bp, Homo sapiens; identical to SEQ ID NO: 69

SEQ ID NO: 57344 - DNA, 116 bp, Homo sapiens
ctatatttgagaagagccttgagtcaagatttttgtaaaagtttttgtatttctaatagtaatgaaggatatgttttgctaaaattgactataatgtggatcatctataaatatgg

SEQ ID NO: 57345 - DNA, 82 bp, Homo sapiens
gctgctctgtctgtctgactgggagctgcaatttagttctgccttctatctaccatttttctcagtatccacccagaacagc

SEQ ID NO: 57346 - DNA, 103 bp, Homo sapiens
tttctggttctagccactattgacaatggaacattgaagtctactatttttgtagtactgtctcctttcaattctgttaatgttggcttcatatatttagaag

SEQ ID NO: 57347 - DNA, 175 bp, Homo sapiens
tgtgtgtgtgtgtaagtgtatatatatgtatatatatgtgtatatatatgtatatatgtatatatacgtatgtatatatgtgtgtatatatatacgtatatatatgtgtgtatatatatacgtatatatatacatatatatgtgtgtgtatatatatatacgtatatatatatgc

SEQ ID NO: 57348 - DNA, 95 bp, Homo sapiens; identical to SEQ ID NO: 68

SEQ ID NO: 57349 - DNA, 93 bp, Homo sapiens; identical to SEQ ID NO: 69

SEQ ID NO: 57350 - DNA, 79 bp, Homo sapiens
gagaaaagcaacactaatacactgttggttgcaatgtaaattagctcaaccactgtggaaagtagtgtggtgattcctc

SEQ ID NO: 57351 - DNA, 58 bp, Homo sapiens; identical to SEQ ID NO: 56767

SEQ ID NO: 57352 - DNA, 89 bp, Homo sapiens
gagtttggtaacacaatcactcactgcctctcttgggtggaggtgggagctccccttgccccgtgtggctcctgggtgggccattgctc

SEQ ID NO: 57353 - DNA, 110 bp, Homo sapiens
tgttatagactgaacaaaatgatatataattgtgtatatataattatatatgtatatatcttatacaattgtttatatatagatgcatatgtcttgtcttgtcttataca

SEQ ID NO: 57354 - DNA, 107 bp, Homo sapiens
tgttctatattttttgcacaattatatttgagaaatagttgggaatatagttttatatatttcagataatattaaaccataattgcaggcatgaaaatacatgaaca

SEQ ID NO: 57355 - DNA, 115 bp, Homo sapiens
ggttttgacgtttcccaacctgtctgctggttacttttcagagttcttaggtcattgctatttatattttgtccagagtttcaaattgtgatcagtggaaatgacaggccatagc

SEQ ID NO: 57356 - DNA, 103 bp, Homo sapiens
ttctatttttattgcactgtggtcaagagtatgcttgatatgatttcaatattttaaatttttgagacttgctttataaccaaacaggtggttaatcttagaa

SEQ ID NO: 57357 - DNA, 88 bp, Homo sapiens
tatgtatatattacatatacacatatacatatgtatatattacatatatacacatatacatatgtgtatatatattttatatatatat

SEQ ID NO: 57358 - DNA, 194 bp, Homo sapiens
tatatatacacatatgtatatgtgtatatatgtaatatatacatatgtatatgtgtatatgtaatatatacatatatgtatatgtgtgtatatattacatatgtgtatgtgtatatatgttacatatgtgtatatatgtatataaatgtctgtatatatatatacaaacatatttacatgtatatatacacaca

SEQ ID NO: 57359 - DNA, 99 bp, Homo sapiens
tgctgtgtaatatattatgtataatttcaggtattttatatgaaattatttttatatgtattttatatgaaattatattttatatgtattttataagca

SEQ ID NO: 57360 - DNA, 96 bp, Homo sapiens
atatatgtggaatctgtgtggaagtatatacagatactatgttaatatggacaatacatatgtatatctatatacttatatggattccatatatat

SEQ ID NO: 57361 - DNA, 57 bp, Homo sapiens; identical to SEQ ID NO: 56778

SEQ ID NO: 57362 - DNA, 115 bp, Homo sapiens
gtgtaccatttgtttttaatataaggtagtttgtgtgcatatatatatatatatatatatatatatatatatatatatgactccatatccccttttatttaatatatagtagcat

SEQ ID NO: 57363 - DNA, 118 bp, Homo sapiens
aagctaaagcctaattcagagcaaggctcaaactctcttcaattctctgacggctgacagaagtgagggagctgcagacagaaaatttgaatctagctggggttggttcatgaggttt

SEQ ID NO: 57364 - DNA, 93 bp, Homo sapiens
gcatttgatgtttccatataaattgcatgatttttttttctatttccatgaagaatgtcattgatattttaatagggattgcattaaatctgc

SEQ ID NO: 57365 - DNA, 116 bp, Homo sapiens
catttggaataggagcatttacacaatgcctgtaccctcattgtatcttggaagtaactaacttgatttttattttacatgctcataggcagaagggacttgtcttgtctcagatg

SEQ ID NO: 57366 - DNA, 99 bp, Homo sapiens; identical to SEQ ID NO: 56970

SEQ ID NO: 57367 - DNA, 123 bp, Homo sapiens
cgtatatacatgtatataagtatatatgcacatttatatacatatatacatgtatatacgcacatttatatacatatatacatgtatatacgtatatatatacatgtacacatatgtatttat

SEQ ID NO: 57368 - DNA, 85 bp, Homo sapiens; identical to SEQ ID NO: 56969

SEQ ID NO: 57369 - DNA, 90 bp, Homo sapiens; identical to SEQ ID NO: 56967

SEQ ID NO: 57370 - DNA, 115 bp, Homo sapiens; identical to SEQ ID NO: 56966

SEQ ID NO: 57371 - DNA, 60 bp, Homo sapiens; identical to SEQ ID NO: 56965

SEQ ID NO: 57372 - DNA, 113 bp, Homo sapiens; identical to SEQ ID NO: 56964

SEQ ID NO: 57373 - DNA, 76 bp, Homo sapiens
taagtgatatgccagactcagtggctcacagctataatcacaacacattgtgaggccaaggaaggaggatcactta

SEQ ID NO: 57374 - DNA, 87 bp, Homo sapiens
atattctatattgtatgtatatagatatacatatatacatgtgtatgcacacatgtacgtgtgtgtgtaaaatacattatatgatat

SEQ ID NO: 57375 - DNA, 107 bp, Homo sapiens
tattttgttggtattaaagattgaggcttttaatttttttgttgtaaaaaattgcaattacctttaaaaaaattacactgtctctgttcatcctgccaaacagtttg

SEQ ID NO: 57376 - DNA, 86 bp, Homo sapiens
gaatacatatacatatatgaatatatatgaatacgtattcatatatgaatacgtattcatatatgtgtatatatgaatatgtattc

SEQ ID NO: 57377 - DNA, 72 bp, Homo sapiens
tatgtactcatatatattcatatatgtatatgtgctcatatatattcatatatgaatatgtactcatatata

SEQ ID NO: 57378 - DNA, 148 bp, Homo sapiens
gtgtgtatgtattatgtatataagtatgtgtatatacatatgtatgtgtatgtatgtgcatatataattgtatgtatatgtatgtgtatatatgtatgtgtgtgcatctctgtgtatatatacatgtatgtatacatacatatatatg

SEQ ID NO: 57379 - DNA, 79 bp, Homo sapiens
ggtacaatgaggatgtcaaatgaaatggccactaggatattttctagttctgatattcatttagggacagcataatgcc

SEQ ID NO: 57380 - DNA, 87 bp, Homo sapiens
agtggtgggggtgagaagctgtggctgtgagtggctatttcccttcctctcagatgctcactggcagcagggatcactggcattcct

SEQ ID NO: 57381 - DNA, 102 bp, Homo sapiens
tatgtgaaatcatacaatatatgtcctttagagtgtatttctttttaaaaaaaatgacttttattttagattcagggggttcatgtgtgggttttttacatg

SEQ ID NO: 57382 - DNA, 98 bp, Homo sapiens
aaatatatatgtatatatatttggttatatatatacatatatatatttggttatatatatatacacatatatatatttggttatatatacacttgttt

SEQ ID NO: 57383 - DNA, 95 bp, Homo sapiens; identical to SEQ ID NO: 68

SEQ ID NO: 57384 - DNA, 93 bp, Homo sapiens; identical to SEQ ID NO: 69

SEQ ID NO: 57385 - DNA, 106 bp, Homo sapiens
ttatattatatgccttttatttttgagacagagtctggctctgtcactcaggctggagtgcaatggtgtgaatttgactgcaacctctgtctcctaggtttgagtg

SEQ ID NO: 57386 - DNA, 111 bp, Homo sapiens
gatcagtacccctttctggtaacaacaggctccaggacagaatgtattctatgcctctctctgagcctctggtggttgctggagagccttggagttacttgtagctgtgtc

SEQ ID NO: 57387 - DNA, 111 bp, Homo sapiens
ttgcttaagataatggcctctacttccatccatgttgctgcaaaagatatttcattttttttgcagctgcctagtattccatgtggtgtgtgtgtgtgtgtgtgtgtgtaa

SEQ ID NO: 57388 - DNA, 76 bp, Homo sapiens
ctcagcgtcctaaagtgctgggattacaggcatgagcctccacacctggcttcccatgaatttttatttttttgag

SEQ ID NO: 57389 - DNA, 83 bp, Homo sapiens
tccagtctcaattacaagtaaggactctgctcttgcactttttttgggggtggggagagtctcactgtgtcgctcaggctgga

SEQ ID NO: 57390 - DNA, 116 bp, Homo sapiens
ggatgactgaagtagaattggaggctcgttatcgtgaggttctgagacagtctgtctgtgggttgtccacccgccttagacaacagcctcacccctccttgtcttcccactgcttt

SEQ ID NO: 57391 - DNA, 62 bp, Homo sapiens
gaggggtgaggctgttgtctaaggcgggtggacaacccacagacagactgtctcagaacctc

SEQ ID NO: 57392 - DNA, 107 bp, Homo sapiens
ccacggagcatgcagcctagatcccttacatgtgcagttgacagtagggtgtgtgcacctatgtgaatctaatatggctgatctgacaggaagtgcaactcaggtgg

SEQ ID NO: 57393 - DNA, 88 bp, Homo sapiens
ccaggctgggcaacatagtgagaccacattaaaaaacaatttttttttcttgttttgagatggagtttcactctgtcacccaggctgg

SEQ ID NO: 57394 - DNA, 101 bp, Homo sapiens
ataaagtttcttcgccattcatctcctgaaaatgtcctagatgtttctaattttattttattttaagttctgggatacatgtgcaggatgtgcaactttgt

SEQ ID NO: 57395 - DNA, 133 bp, Homo sapiens
atgtgtatttctaagtatataggtatatatacttgtatgtttatatgctatataagtgtatatacatatatttacaaatacatatatatttgcacatttagacatgagtatttgtaagtatatgtgtatatat

SEQ ID NO: 57396 - DNA, 116 bp, Homo sapiens
gttgagcaaatgttgagatcttgttttttaagactgagtaatatttcattgtatatatctactacatgtgtgtatccatccatctgtcagcaaacaggatgtttccatatctcagc

SEQ ID NO: 57397 - DNA, 169 bp, Homo sapiens
cgtgtgtgtatgtagatgtccatgtgtgtacccaactgtgtctgagtgtctgtgtgtttgtctgcctgtgtgtctctgtgtgcatgttagtgtctatttgtatatgtgtgtctgtatatgtaagtatacgtgtttctgtgtgtttatagatacctgtgtatgtgcccag

SEQ ID NO: 57398 - DNA, 58 bp, Homo sapiens; identical to SEQ ID NO: 57222

SEQ ID NO: 57399 - DNA, 58 bp, Homo sapiens
tgagatcgagtctcactctgtcacccaggttggtgtgcagtggtgtgatctcagctca

SEQ ID NO: 57400 - DNA, 118 bp, Homo sapiens
gcaaaggtttgggattttatctgtaaaaggggatgggttttctatgtgtgagtgtcgaattatgagaggagacagtggggagagaacacttaagtgctattaagaaactcatttttgt

SEQ ID NO: 57401 - DNA, 105 bp, Homo sapiens
gcctagattagaggaagaagtatggtgaagagaaagacaatttttttattattcaagagaggatactattctctttccaaatatgcttctcttccatcccagtgt

SEQ ID NO: 57402 - DNA, 111 bp, Homo sapiens
agggactggctggagttgtggcagaggaacataaattgtgaatatttcattttaatatggacatttatcagttctcaaataatacttttataatttctgatgcctgtcttt

SEQ ID NO: 57403 - DNA, 117 bp, Homo sapiens
tctgtagaaaagactgagaaaacactctgtgtactgctatgaaatggtgtctaagaaaagtatactgtttttgttgttgttgtttttgagacggagtttagctcttgttgcccaggc

SEQ ID NO: 57404 - DNA, 113 bp, Homo sapiens
aaatttcctttatcccaggagtgttaagaaatgtgtggttttgtggatttttttttctctattttcattcctttcttttccttttttttacctcttggaataatggtttattt

SEQ ID NO: 57405 - DNA, 116 bp, Homo sapiens
tagaaagaataccccttcttttagaaaataagttactctgggctttgggagcatcctgaaagaagagaggaagctcaaggagaatggtttatctttctgaatggtttgtctttcta

SEQ ID NO: 57406 - DNA, 116 bp, Homo sapiens
gggagcgtgtgacagggtactcttgaatagctccagttgcctttgtacagttattttttttatttgagacactgcccaagggagtctgcagtactgagtgttctgcctcagtgtct

SEQ ID NO: 57407 - DNA, 82 bp, Homo sapiens
agtttaagggtacatgtgcacaacgtgcaggtttgttatatatttatacatgtgccatgttggtgtgctgcccccattaact

SEQ ID NO: 57408 - DNA, 85 bp, Homo sapiens
ctaaactcagatatgacagtcaatatctctcttatatgatggtttcagggatgagaacattattagacctgtgagctgggtccag

SEQ ID NO: 57409 - DNA, 76 bp, Homo sapiens
taggctgagttccagagtgagacttttttttttttttttttttttaagagggagtctcactctgtcactcaggctg

SEQ ID NO: 57410 - DNA, 79 bp, Homo sapiens
tatacatatacaatgtatgtatatataatgtatacatatacacaatgtatatataatgtatacatatacaaaatgtatg

SEQ ID NO: 57411 - DNA, 118 bp, Homo sapiens
ttcatgcattattaagaagtctgtcttatataattctaatatagaggatttaaaaatatgtatatttttagacttgtttatattggaatcagataatgtgttcttgataatacatgaa

SEQ ID NO: 57412 - DNA, 95 bp, Homo sapiens; identical to SEQ ID NO: 580

SEQ ID NO: 57413 - DNA, 93 bp, Homo sapiens; identical to SEQ ID NO: 69

SEQ ID NO: 57414 - DNA, 115 bp, Homo sapiens
atgtgttgcattggtgtgtgtgtgtgtgtatatatatatatatatatatatatgcatctatgtataggtgtatgtgtatatatatgcatatatatttaggtgtgtgtataaatat

SEQ ID NO: 57415 - DNA, 94 bp, Homo sapiens
ggcctagacctcctcactgctgagaaaagagactctgcacctgggggaagagtgttgtttttacaccaagcagtcaggaatagtacaagatgcc

SEQ ID NO: 57416 - DNA, 96 bp, Homo sapiens
gagtcatatcacctaggtgcttccctagttatatgtcacaaactaacatgtgggcagaaactagacagaagagacacatcacttgggtacagcctc

SEQ ID NO: 57417 - DNA, 74 bp, Homo sapiens
tttaggctgagttcaggaatgagacttttttttttttttttgagacagagtctcactctgtcactcaggctgga

SEQ ID NO: 57418 - DNA, 117 bp, Homo sapiens
ggaaataagtctcacatcccacacaagtcctggttttgtacatgtgagtcaaatctttctatgagtttttgtatatgtgagtatatgagttttggtatatgtgagtcaactctttct

SEQ ID NO: 57419 - DNA, 77 bp, Homo sapiens
gcttgtgaaattaagggaatgtgggacagagttagaagcagtttctgtgtcattctgtctgtatgtcttttgcaggt

SEQ ID NO: 57420 - DNA, 85 bp, Homo sapiens
aaactacccttctgactccattcccaaaagaggctatgtacaagtatagggtcctttgtggattggaatgtagtctggtgtgttt

SEQ ID NO: 57421 - DNA, 71 bp, Homo sapiens
cgttgtgaatgtgcatgtgctagtctcagggcaccagaactcagctgtgagctctggcaagcatcacaatg

SEQ ID NO: 57422 - DNA, 77 bp, Homo sapiens
gctggttcaagtctgatgtctcctaggaccacgggaccatctcgaggatcccagagagaagacaggcaggagtctgc

SEQ ID NO: 57423 - DNA, 76 bp, Homo sapiens
caggtgtggcttcctgcagaaccaagcagcctcaggagctgtcaggctctgtgtttctgttggagtgttgcgagtg

SEQ ID NO: 57424 - DNA, 137 bp, Homo sapiens
tatatatacatgtatatatgtttatatatacatgtatatatacatgtgtatgtttatatatacatgtatatatacatgtgtatgtttatatatacatgtgtatgtttatatatacatgtatctatatatgtgtacat

SEQ ID NO: 57425 - DNA, 119 bp, Homo sapiens
caattagcagaatggaaggatgggtttggaagtagcttcagtgtcatctgtcttcatttttttaaattttattttttgaagttgaagttgtaggacctatccactcctcaccagattgt

SEQ ID NO: 57426 - DNA, 90 bp, Homo sapiens
gaagttggagtgtgtttctttgagtttatcttacttggagtttattgagcttcttggatgtttatttatttcctcacacttgtgacattc

SEQ ID NO: 57427 - DNA, 108 bp, Homo sapiens
ggatgtgcttcaaaaccatgaggtggtccctggaaactgcatttctcactctttctctgaaagaggctgtattccagaatcaggtcccgtgaagtttggaatatattc

SEQ ID NO: 57428 - DNA, 103 bp, Homo sapiens
gtgtacataggtattcttatataggtatatatatatatatatatatatatatatatatatatatatatatatatatatatgaaaatcccaatgaatgctgatg

SEQ ID NO: 57429 - DNA, 91 bp, Homo sapiens
gtgtacataggtattcttatataggtatatatatatatatatatatatatatatatatatatatatatgaaaatcccaatgaatgctgatg

SEQ ID NO: 57430 - DNA, 133 bp, Homo sapiens
atgtgcatatatacgtatatacatgtatatacatatatatgtgtgtacataggtattcttatatacatatatatatatatatatatatatatatatatatatatatatatgaaaatcccaatgaatgctgatg

SEQ ID NO: 57431 - DNA, 78 bp, Homo sapiens
tgtatatgtgtgtgtatatgtacatatacatgtatatgtacatatacatgtatatgtatacacacacacacacacaca

SEQ ID NO: 57432 - DNA, 63 bp, Mus musculus
tgtggttcttacaggattggcaaagctagttgctggttagttggtcagtgtagagagactgca

SEQ ID NO: 57433 - DNA, 127 bp, Mus musculus
tagtcttatggaaaacttattttgtgggtcatatatatacatatatatatatgtatatatatatatacacacatatatatgtatatatatatatgtgcatgggtctatatctatatctatatctata

SEQ ID NO: 57434 - DNA, 56 bp, Mus musculus
gcctgggcctgtgctgtgagacttagtctcacagtctcacagatattccaaatagc

SEQ ID NO: 57435 - DNA, 90 bp, Mus musculus
tttgctctctggttgtccttaaatgagcttctctgtcacactcactgtgattgacagaaactttgttggacagaaatagaaatttgtaga

SEQ ID NO: 57436 - DNA, 104 bp, Mus musculus
agaaaatgatgcctgtgaatgtcttattcttatgtttccaatgtctttcattctccttatactgacaggtatacatgcaatgagtaaattacagccattaatct

SEQ ID NO: 57437 - DNA, 66 bp, Mus musculus
aagaggctgtctagtaggacttggcaatgagcatagtgctgagactccaactggatgtgtgttctt

SEQ ID NO: 57438 - DNA, 85 bp, Mus musculus
tgcagattcacgcacatacacattaatatccatgtatgcatgtatgtatatacaacttactgtggttgttggctgagtttaggca

SEQ ID NO: 57439 - DNA, 85 bp, Mus musculus
ggccatggtggtctgataggatacatgggacaatttcaatatttttgtatctattgaggcctgttttgtgaccaattatatggtc

SEQ ID NO: 57440 - DNA, 96 bp, Mus musculus
ttgcctacagcagagcctggaggcagagggttccaagcacaactgggcagcctgtgtctctgcctctcttgagatcctgattaatcctgtgtgcaa

SEQ ID NO: 57441 - DNA, 81 bp, Mus musculus
tgctgacatttagcatgtatacatgcacaagtgagtatgcacactggcatatatatatgttatacatacaaattagtcaca

SEQ ID NO: 57442 - DNA, 104 bp, Mus musculus
atatgtaaatatgtatatatgtgtaaatacatatgcgtgtaaatatacataaatatatatatgtttatatatgagtgtataagtatatagaatgtatagacaca

SEQ ID NO: 57443 - DNA, 123 bp, Mus musculus
atatgtatatgtgtgcaggtatggaatatacatatatacatacatatatatgtatatatacatacatatgtgtgtatctctatgtatgtgtggattatgtgaatatgtaaagatgtgtgtata

SEQ ID NO: 57444 - DNA, 58 bp, Mus musculus
tatatatatatatatatatatatatatatgtatgtatgtatgtatgtatgtatgtata

SEQ ID NO: 57445 - DNA, 109 bp, Mus musculus
ggtgtgcagtggttggtgtaagcatccctttgtggttatggaaactggctcactcactgagccagctgtgagagccctcctatgctcctttctctgctgttgccacact

SEQ ID NO: 57446 - DNA, 66 bp, Mus musculus
tatctatgtgcctatgtgtgtacctatgtatgtgtgtatgtatgtatatatgtatgtatgtatgta

SEQ ID NO: 57447 - DNA, 109 bp, Mus musculus
ggttgtgagagccaaggaactatgtaatgcattgccagtgtagtttaaagtgaaaagacagagctcaatgagtatggctattatgtgtggtcccaaagatctgagaagc

SEQ ID NO: 57448 - DNA, 117 bp, Mus musculus
tctctgtatctatgaatctatttctttctatctatctatctatctatctatctatctatccatcatctatctaactatctattggggagagaggaatagagaaggtgcaaacagaga

SEQ ID NO: 57449 - DNA, 97 bp, Mus musculus
agggcttcttcctgtttatctgagttttattgtatttctttaagggagtttttgtctactccttatggtcctctatcttcatgattttaggagtcct

SEQ ID NO: 57450 - DNA, 69 bp, Mus musculus
gttttgtttggggcattatattcttagaaagactcccttgagtatttttattaatgtcttaaacataac

SEQ ID NO: 57451 - DNA, 85 bp, Mus musculus; identical to SEQ ID NO: 57439

SEQ ID NO: 57452 - DNA, 85 bp, Mus musculus; identical to SEQ ID NO: 57439

SEQ ID NO: 57453 - DNA, 71 bp, Mus musculus
acacagacaaaagttacatatatatatatatgcatatgcatgtgtatatgtatatgtgtatgtgtatgtgt

SEQ ID NO: 57454 - DNA, 58 bp, Mus musculus
tacacatacatacacacatatatacatacataagtatgtatgtatatatgtatgtgta

SEQ ID NO: 57455 - DNA, 114 bp, Mus musculus
ctaatatccacttatcagtgagtacatattgtttttatatgtaacatgtcaacatattttaacttgtttttattttaacaaaatagtatacataatcagtggatttttcattag

SEQ ID NO: 57456 - DNA, 76 bp, Mus musculus
agagtctcagtgtgtgtctgacaggttttcgggtttttccagtgtccatgtatgtgtctgtcacataaagggctct

SEQ ID NO: 57457 - DNA, 99 bp, Mus musculus
taatgtagagactcataactggtcaaagttcaggtgaatgcatatatatatattatatagctaaaaaggacactgggagaataaatatgagctacattg

SEQ ID NO: 57458 - DNA, 85 bp, Mus musculus; identical to SEQ ID NO: 57439

SEQ ID NO: 57459 - DNA, 68 bp, Mus musculus
gctggcgtctgcactgatgatggtgaggttagactcactgactgaccaataacgtgtggaaccgctgc

SEQ ID NO: 57460 - DNA, 119 bp, Mus musculus
tataacactgggattgtgcttttaggtttcagatacttaagccaggcctagtgtcactctctattactgattgctttagatctggatgttgaactcttacctatttctccaggattatg

SEQ ID NO: 57461 - DNA, 123 bp, Mus musculus
gtcttatatgttctaggtatctctggctggagcatgttccctctgtgagtctgttagtctctgtcagcactcctgggagaacagctctctcttgagttctgggtgtcagacagctctctggag

SEQ ID NO: 57462 - DNA, 188 bp, Mus musculus
tatgtatatgtgtatatatgtgatatataagtaatatacaaataatatatgcataatatgtatatatacatgtatatataatctgtgtgtgagcattttcatacagttattcacatgtatatatatatatgagtatgtgtttcatatatatatatatatatatatatatacacatgtatacatatata

SEQ ID NO: 57463 - DNA, 73 bp, Mus musculus
cctaactcctccaatgggatcacagtgttcagtctaatgttgattatgagcatctgcatctctattggttagg

SEQ ID NO: 57464 - DNA, 87 bp, Mus musculus
tatatatatgtatatgtatacgtgtatctataccaatgtaagaaatgtaccaatgtaagaaatcatatatatatatatatgtgtgtg

SEQ ID NO: 57465 - DNA, 117 bp, Mus musculus
aatgaaaaggaaaaagagaatgaaagtgatagctatcagagtccccatcacaatatgtatatttatttatcccatcccttggtctctgaggttacctaaaattttctgtctgttatt

SEQ ID NO: 57466 - DNA, 87 bp, Mus musculus
gggcggctcctcatatctcccccttttcttttatttaaaaggcaacaggccacccagtactgagagtggagatagaggtcaaatccc

SEQ ID NO: 57467 - DNA, 112 bp, Mus musculus
ccacctcagggctcaggtccctgggcccatgtggaaaccaggctgtctgattatcagtctctcagatagccaggtgctgctggatgttaaggaagagctgagaatggagtgg

SEQ ID NO: 57468 - DNA, 85 bp, Mus musculus; identical to SEQ ID NO: 57439

SEQ ID NO: 57469 - DNA, 85 bp, Mus musculus
ggccattttggtctgataggatacatgggacaatttcaatatttttgtatctattgaggcctgttttgtgaccaattatatggtc

SEQ ID NO: 57470 - DNA, 85 bp, Mus musculus
ggccatggtggtctgataggatacatgggacaatttcaatatttttgtatctgttgaggcctgttttgtgaccaattatatggtc

SEQ ID NO: 57471 - DNA, 75 bp, Mus musculus
gcacatctttcttataggtttatgtatgcatggtttatatatattaatacatgtacacatgggctcatggatggc

SEQ ID NO: 57472 - DNA, 58 bp, Mus musculus
gtgtgtgtgtgtgtgtgtgtatgaatgtataaatttatgcatgtatatatgtatgtgt

SEQ ID NO: 57473 - DNA, 85 bp, Mus musculus; identical to SEQ ID NO: 57439

SEQ ID NO: 57474 - DNA, 67 bp, Mus musculus
catatgtgcaatattcagagagtgatattaggcattctgctctgtcactctctgactttgtttcttg

SEQ ID NO: 57475 - DNA, 81 bp, Mus musculus
ctgtctctgcctccctgtctgtgtctgctgcagtgtggaagagcatgaaggagagaagagagagaccagagttcagagaca

SEQ ID NO: 57476 - DNA, 85 bp, Mus musculus; identical to SEQ ID NO: 57439

SEQ ID NO: 57477 - DNA, 85 bp, Mus musculus; identical to SEQ ID NO: 57470

SEQ ID NO: 57478 - DNA, 106 bp, Mus musculus
gccttaatctgtagtgatctgataggatgcatgggattgtttcaatatttttgtatctgttgaggcctgttttgtgaccaattatatgctcagttttggagaaggt

SEQ ID NO: 57479 - DNA, 93 bp, Mus musculus
atcccaaatcagaccaaaagccacaatatgtgctggaatgcttttagaatgaaaattagtagctgccacttgcacacttttgggggtggggat

SEQ ID NO: 57480 - DNA, 111 bp, Mus musculus
tatgcacacatacacacactttctctaacacatatgataaattataatattaataattaataaagtggagatcattaagttgatagggagttgggaagtatggggtgcatg

SEQ ID NO: 57481 - DNA, 115 bp, Mus musculus
aattatgagccaaatcagaaccttgttccctatgttcattttgttatttatttttgtcatagaaatgagaagcacatatgcttagtggtgatggagctggtgctggctagagatt

SEQ ID NO: 57482 - DNA, 85 bp, Mus musculus
ggccatggtggtctgataggatacatgggacaatatcaatatttttgtatctattgaggcctgttttgtgaccaattatatggtc

SEQ ID NO: 57483 - DNA, 85 bp, Mus musculus
tctcctcaatagtaaggattcaatcttgttttgtgagagtgtctctcactgaatctagattcatttatcagttataatgatgagg

SEQ ID NO: 57484 - DNA, 84 bp, Mus musculus
gcataaattcatcttgccttatgatacatggccacaggcatgtggggaacagggggtagaatgtggttgtgtaatgataatggt

SEQ ID NO: 57485 - DNA, 107 bp, Mus musculus
acatgtatatttccatagaaacttactggacagcaattccaaaatgaatttttttcttttggaattgagctttttatttgtaagtatttagtatctaatagtagtgt

SEQ ID NO: 57486 - DNA, 115 bp, Mus musculus
gccttgtagttcagcttgagttaaggattgtgattacatcagaatttcttttattgttgagaaaagttttcactatcctcgattttttgttataccagatgaatttgcaaattgc

SEQ ID NO: 57487 - DNA, 85 bp, Mus musculus; identical to SEQ ID NO: 57439

SEQ ID NO: 57488 - DNA, 87 bp, Mus musculus
tcttccttgatcaggtataattgactagagtgtcgttcagcttccatgtgaatgttgactttcaattatgtatgttgttattgaagg

SEQ ID NO: 57489 - DNA, 114 bp, Mus musculus
gtttcatgtggtctcatagaatctacagttaggtgaaatgcagagggacaggttcactgacatacactctgtcagtcactggtaataatgtgtaggtcaatagaaaaatgagac

SEQ ID NO: 57490 - DNA, 76 bp, Mus musculus
aggacacctgtatttatatacatgtatgtatatgcatatatgaatatatgtgcatgtatgtatacatgatgtacct

SEQ ID NO: 57491 - DNA, 66 bp, Mus musculus
ccagtcatgatcactgcagttggggatgtagccacacactcaccctcactgaagtgtctggcatgg

SEQ ID NO: 57492 - DNA, 98 bp, Mus musculus
tcatgacagtagagagatataaaacactgatttacttaaaggttgttaagtaaacaaatggaaaagtgatatgattggtgattttgctgttgttgtgg

SEQ ID NO: 57493 - DNA, 83 bp, Mus musculus
gtgtacatgtgtatatacattttgtgtgtgtgtctgtgtgtgggtgattttgtgtatatatgtgtgtgtgtgtgtgtgtgtgt

SEQ ID NO: 57494 - DNA, 116 bp, Mus musculus
acgcacagtttattttattttgtaaggacctatctatatatactttacgtctctagaaggatgtatagatatatttggattagaatcccaaggatataatcaaatagattttgggt

SEQ ID NO: 57495 - DNA, 85 bp, Mus musculus; identical to SEQ ID NO: 57439

SEQ ID NO: 57496 - DNA, 63 bp, Mus musculus
tgtgtgtgtttgcatgtgcatgtgcattaacatgcatgtgtgatgtttttgtgggcatgtaca

SEQ ID NO: 57497 - DNA, 70 bp, Mus musculus
gtatatatgtatgtacatatgtatgtatgtatgcatgtatgtgtgtgcatatgatgctgtgcatatgtac

SEQ ID NO: 57498 - DNA, 76 bp, Mus musculus
atctagtattacatcagttactttcctgagtttgggttgtataaacttaagagagtctctctctgtgatacaagat

SEQ ID NO: 57499 - DNA, 92 bp, Mus musculus
gtaggttgatagaaaagaattacaaggagtttgtagaaaatgtttaggcacatttctgaatcaaaatttgtttttcattttcaagcagctac

SEQ ID NO: 57500 - DNA, 76 bp, Mus musculus
cagtcttaggccatcgtggtctgataggatacatgggaaaatttcaatatttttgtatctattgtggcctgttttg

SEQ ID NO: 57501 - DNA, 93 bp, Mus musculus
ggcctgtggtctttgtagatactttgttcatctcagtcctcaaaaacagccgctgatattcatgtgatggtttctgtgtagaccactcttgtc

SEQ ID NO: 57502 - DNA, 75 bp, Mus musculus
ctgactctttatgtctgtctctgatgtgtgcatttgtgtttgcttgagcaccaagaggaaacttacaggagtcag

SEQ ID NO: 57503 - DNA, 138 bp, Mus musculus
acagacagacagacagacacacacacacacacacacacacacgcatgtgtatatatatatatacatatgtgtgtgtgtgtgcatgtatgtatgtatgtatgtatgtatgtatgtatgtatatgcatgtatgtatgtat

SEQ ID NO: 57504 - DNA, 83 bp, Mus musculus
catgggacaatttcaatatttttgtatctgttgaggcctgttttgtgaccaattatatgatcaattttggagaaggtcccgtg

SEQ ID NO: 57505 - DNA, 79 bp, Mus musculus
ttgtgagtatgtccatgtgcatgtgctgtttatattagttcatatacctgtgtaaatggacatgtccatgtacttgcaa

SEQ ID NO: 57506 - DNA, 114 bp, Mus musculus
ttgctggacctgaatattaggatacctaactttcccccacacaagttcttaaatataatttaatgagcgtgtggcaagttctcagagatgctaagttcagaattcatatagtag

SEQ ID NO: 57507 - DNA, 77 bp, Mus musculus
gtatatggtttatgtatgtatgcatgcatgtgtgtatgtatgtatgtatgtatgtatgtatgtatgtatctatctat

SEQ ID NO: 57508 - DNA, 104 bp, Mus musculus
ttgttgttccacctatagggttgcagaccctttcagctgttgggtaccttctcaacctcctacattgagggccctgtgttccatcctacagattaccgcgagca

SEQ ID NO: 57509 - DNA, 82 bp, Mus musculus
tctttcatctgtgtatttctgtgtgcaaatgtatatgtgagtacatatgcacatttgtatctctgaatgtagaggccaaaga

SEQ ID NO: 57510 - DNA, 118 bp, Mus musculus
gagtagcaactctatttcagagattgaatttaaattgtctccttgactattgatctgaggattgatgtgttgatgaataatgatagtcctggtcagtcccctagaatattgcatattt

SEQ ID NO: 57511 - DNA, 85 bp, Mus musculus
ggccatggtggtctgataggatacatggcacaatttcaatatttttgtatctgttgaggcctgttttgtgaccaattatatggtc

SEQ ID NO: 57512 - DNA, 90 bp, Mus musculus
caaatactgactttgactatttttttttcagcattaggaatcgaaggccccatgaatgctaggtaaagtgtcacaccagtgagctgtttg

SEQ ID NO: 57513 - DNA, 112 bp, Mus musculus
gatcagtcttaggccatggtggtctgataggatacatgggacaatttcaatatttttgtatctattgaggcctgttttgtgaccaattatattgtcaattttggagaaggtc

SEQ ID NO: 57514 - DNA, 118 bp, Mus musculus
agattgcagtccatcattgagggaagccaggacaagtgttaaaggtttaattcataatatgatttaatatttaccatgtgtgtttgaaatatatttgacttttctctgtctgcatgct

SEQ ID NO: 57515 - DNA, 84 bp, Mus musculus
tctaaggtctctctctctctgcataaggtctggctgtgagtctctgtacttgctctagtctgccgcaggaagaagcttcttgga

SEQ ID NO: 57516 - DNA, 81 bp, Mus musculus
agtctgtatatgtacgtgtgtctttcgggaatccagaacactggggcagtagccagaagcacagaaaatagagagcagatt

SEQ ID NO: 57517 - DNA, 66 bp, Mus musculus
aaccttcttttccactcaccatctgcagactgctgtaattcatggaatgtggaatgagtctaggtt

SEQ ID NO: 57518 - DNA, 101 bp, Mus musculus
tctatctatctatctatctatctatctaatctatctgcatatatatgtatatacatatatagtgcatgtataattaagatggcaagtgaatgaagtttagg

SEQ ID NO: 57519 - DNA, 85 bp, Mus musculus; identical to SEQ ID NO: 57470

SEQ ID NO: 57520 - DNA, 75 bp, Mus musculus
tggaaaacaatagcatatatatatatatatatatatatatatatatatatatatgtttgtgtgtctgtgtgtcta

SEQ ID NO: 57521 - DNA, 114 bp, Mus musculus
atccattatgtatagtgtgtgtgcatgtgtgtatgtatgtgtacatgtgtgtgtttgtgtgtgcatgtgcatgtgtgcctgtatgtgtttgagagtgtgtgtatatgtatgtgt

SEQ ID NO: 57522 - DNA, 85 bp, Mus musculus; identical to SEQ ID NO: 57470

SEQ ID NO: 57523 - DNA, 85 bp, Mus musculus; identical to SEQ ID NO: 57439

SEQ ID NO: 57524 - DNA, 85 bp, Mus musculus; identical to SEQ ID NO: 57470

SEQ ID NO: 57525 - DNA, 85 bp, Mus musculus; identical to SEQ ID NO: 57439

SEQ ID NO: 57526 - DNA, 85 bp, Mus musculus
gtccatggtggtctgataggatgtatgggacaatttcaatatttttgtatctgttgaggcctgttttgtgaccaattatatggtc

SEQ ID NO: 57527 - DNA, 103 bp, Mus musculus
tgtgtaagagtaagtccagagccttagactgaggcaggtcactttttgttttctttataaagaggtatttcccacagctgaggatttaggatagctcctcata

SEQ ID NO: 57528 - DNA, 92 bp, Mus musculus
gcatccctaacatccagttgtggttacctcctttaaacctagcactcagagagcaaagacaggggacaggtaactaagctggctaggctggc

SEQ ID NO: 57529 - DNA, 107 bp, Mus musculus
ggtttgagggttgaggcttctttgtggtgagcaagtaggttttaaagtatgcgaaagcagctcaaaggtttaattctgtttcatcttagaacacctcactagtgatc

SEQ ID NO: 57530 - DNA, 86 bp, Mus musculus
atctatgaatatgaatatgtgtttgtgtgaatatatattttcttttcttttagagaaatatttaggaacgtatagtaggcataggt

SEQ ID NO: 57531 - DNA, 94 bp, Mus musculus
agatggctggcctttggtctagctagaatatcaagacaaaagagtagcaagtttatttgattctttatgatactgttaggaaactacagccact

SEQ ID NO: 57532 - DNA, 64 bp, Mus musculus
ggcttgtggaggtggtggtggtggttgagatagggtctctctatgcctctgcctctggagtgct

SEQ ID NO: 57533 - DNA, 75 bp, Mus musculus
ccacatatggaagtatatattatttttagctaagagaaaatgaaattttgaaagtagttggtattttctgtgtgg

SEQ ID NO: 57534 - DNA, 62 bp, Mus musculus
tcccaagggctgcagcctgtgaggggctggaccggctctctcaggctctcacacctttgggg

SEQ ID NO: 57535 - DNA, 86 bp, Mus musculus
agccccactgctcagctggacacagttctcagagtactggatcagtcccagagacactctgtgaatcaccagcacgtcctggagct

SEQ ID NO: 57536 - DNA, 85 bp, Mus musculus; identical to SEQ ID NO: 57470

SEQ ID NO: 57537 - DNA, 105 bp, Mus musculus
aaccctggaactgttagtgtgaatcctggaagtgccatcctctgcgtcccctgtctctgtcacactggctcccaagccagagttgtgtaagcctgggagagctga

SEQ ID NO: 57538 - DNA, 82 bp, Mus musculus
ggaaaggaaaggggctggagaaatagctcagtgattaagagtactgactgctcttccagaggtcctgaattcaattcccagc

SEQ ID NO: 57539 - DNA, 104 bp, Mus musculus
agaagtgtgtttgggggctggagagatggctcagtgattaagagcactgactgctcttccagaggtcctgagttcaattccacagtaaccacatggtggcttct

SEQ ID NO: 57540 - DNA, 118 bp, Mus musculus
caggttttggtgtgtgtgcatgggatggatcgaaagttgggcgggtcactgggtggcctttctctcagtctctgttccatttttgttcctacatttcctttagaccatatgatatctg

SEQ ID NO: 57541 - DNA, 85 bp, Mus musculus; identical to SEQ ID NO: 57439

SEQ ID NO: 57542 - DNA, 70 bp, Mus musculus
aggtatgtcaccgggtactggctttgaggttacaaaagagccacatcactcccagtctgtgactgtgcct

SEQ ID NO: 57543 - DNA, 116 bp, Mus musculus
tggcagcgtgaggcatcagattcacatgttcaggttaggctacacagtgagctcagtgggcaggtgcgtccacattctcctcactgcatggccaattatctgtggtcttgttggca

SEQ ID NO: 57544 - DNA, 102 bp, Mus musculus
gtaaggcttctagtttttgtctgttaattttatatcctgctacattgcttaaaaatgtttctaatctatagaagtttccaggtggattttaagggtcttttc

SEQ ID NO: 57545 - DNA, 131 bp, Mus musculus
actggagcaggcctcctgagaggcagacagtactgtctctagttagggcaggtcttctgtgtccctgtgtccctagttatgcagacctcctgggagacaggtaggctgtgggaatgggagggaggcttgct

SEQ ID NO: 57546 - DNA, 104 bp, Mus musculus
ggatctgaggcaaggcttgaggcagggtttctgtctgacactgcctgagattaggaccgcaatcttcttggaccttggaccttgcttgaggcattctcttttcc

SEQ ID NO: 57547 - DNA, 78 bp, Mus musculus
gtgtgagtgaatatgtacatctgtgtgtgcacacttgtgtgtgagtgtgcatgtgcatgtgtgtatgtatgcttgtgt

SEQ ID NO: 57548 - DNA, 83 bp, Mus musculus
agagagcctgggcgggtactggggctctggagggcattgggctgctcttctcgatggctctctctgagtctctcagcccactt

SEQ ID NO: 57549 - DNA, 72 bp, Mus musculus
ggcacactggctggctctctgacaaacctcttccttcctcagatggtcttcccgaggccagaaaggacagcc

SEQ ID NO: 57550 - DNA, 78 bp, Mus musculus
aactcctgttcggccttctagggagctgctggaccctcactcacccactgtctctgtgtgaggctgaagagataggtt

SEQ ID NO: 57551 - DNA, 130 bp, Mus musculus
tatatatatatatatatatatatatatatatatatatatatatgtgtgtgtgtgtgtgtgtgtgtgtgtatgtatatatatatatacatatgtatatatacacacacacatatacacatatatgtatata

SEQ ID NO: 57552 - DNA, 71 bp, Mus musculus
ctgtctggcagttgtctgtccagtaagagaaggggcccttcctcactgtgactgacagactgatctactag

SEQ ID NO: 57553 - DNA, 81 bp, Mus musculus
acagtgattcacaggtatctgagtccctgtgttcagttgttctccatccatacccagcagtagatcttgtgggtcatatgt

SEQ ID NO: 57554 - DNA, 62 bp, Mus musculus
gtgtcattgagctttgacttggaggtttcaaaagcccaggtcacactctctctgcctgacac

SEQ ID NO: 57555 - DNA, 149 bp, Mus musculus
aggtgtacatacatgtatatatgtgtatatatctatacttatatatgtatatattgtagagggtgtgtctatgtgtgtacatatgtgcagagggctgtgtgtgtgtctgtatgtgtgtgtgttatagctttaactttactacttccttc

SEQ ID NO: 57556 - DNA, 112 bp, Mus musculus
gaaagttgtagttttggggctggtgagatggctcagcggttaagagcactgactgctcttccaaaggtcctgagttcaaatcccagcaaccacatggtggctcacaaccatc

SEQ ID NO: 57557 - DNA, 116 bp, Mus musculus
gtggcctattaataatgtgattatggagtgctggagagatgactcagcggttaagagcactgactgctcttcccaaggtcctgagttcaaatcccagcaaccacatgttggctcac

SEQ ID NO: 57558 - DNA, 76 bp, Mus musculus
cttctttttgtatgcatgtatgtttatatatgtgttcatgtgtttatgtgtacatatatgtctgtgcatgtggaag

SEQ ID NO: 57559 - DNA, 118 bp, Mus musculus
gcatatgcctgtgcatgtatgtgcaaatgtatgcatgtatgtgtgctcattcatgtatgtgtgcatgtccatgtgtgtgtgtgtgcatgtgtacctctgggtacatacatcatcttca

SEQ ID NO: 57560 - DNA, 74 bp, Mus musculus
gtcatattctacaaaaaagaaaaaacaactgggggggcagagaccctcagtgtcttacatgtggattcttgtac

SEQ ID NO: 57561 - DNA, 109 bp, Mus musculus
acatccttaccagcatctgctgtcacctgagtttttgatcttagccattctgactggagtaaggtagaatcttgttttgatttgcatttcctgatgactaaggatgttg

SEQ ID NO: 57562 - DNA, 80 bp, Mus musculus
gccagggagacaaattcaagctggtcaaaaacgaagcttagacctaccttctcaatttgtttttcagtgtttcctttggc

SEQ ID NO: 57563 - DNA, 100 bp, Mus musculus
gatgagtatagtattagctcttctttgaaggtctggtagttggtagtttaggatctctccaatttctttaccagggcacttagtgctatgaattctcctc

SEQ ID NO: 57564 - DNA, 85 bp, Mus musculus
ttgagagtcaagttcaaactggtcattaaaacgaagcttagacctaccttcttaatttgttgttcagtgtttgctttggctccaa

SEQ ID NO: 57565 - DNA, 113 bp, Mus musculus
agttctgcactctgtccatcctgtgacagctttccccacactctcagtctgacagctttcatcctttgaagtgatttcaaagctttcatttgattgttaacggatgaccgatt

SEQ ID NO: 57566 - DNA, 93 bp, Mus musculus
tccatgttggtctgataggatgcatgggacaatttcaatatttttgtatctgttgaggcctgttttatgatcaattatatggtcaattttgga

SEQ ID NO: 57567 - DNA, 84 bp, Mus musculus
tacaagaaatagattgtctcagatctgagtgatgagaattgaagtgttccctaagcactgagagaatgggcatctatttgtgtg

SEQ ID NO: 57568 - DNA, 120 bp, Mus musculus
tgacagagtgctagggagacaaattcaagctggtcaacaaaacaaagcttagacctaccttctcaatttgtatttcagtgtttcctttggctccaagcttgagcattcctagtgctgtta

SEQ ID NO: 57569 - DNA, 109 bp, Mus musculus
tgagttctgcattctgtccatcctctgacagctttcctcactctctcagtctgacagactttgaagtgatttcaaagctttcatttgatttttaacagatgacagctca

SEQ ID NO: 57570 - DNA, 85 bp, Mus musculus
agatttcttacaagattgagagcagtgtctatgaagcatatctgcattagacaacctgagtttaattacttgttcaagacaatct

SEQ ID NO: 57571 - DNA, 107 bp, Mus musculus
ttgtggttcctgggcttggcccgatagttggttatgagtatctgcatctgtatttgtcaggtgctggcagaacttttcagggatcagccataccaggctcctgtcaa

SEQ ID NO: 57572 - DNA, 105 bp, Mus musculus
aaagataacacagaacaataaccagatgacagatgtcactgtgcaatggttccagcatgtacaaaatgtgaaatgtaatgaggggtatatgttttgtgtcttttt

SEQ ID NO: 57573 - DNA, 114 bp, Mus musculus
aattagtgccctcttagtctttatatatatattgagtcctcttagttttgcttgtttttatattttttagtactgacaacttggagtttgataaccatttagggggctctaatt

SEQ ID NO: 57574 - DNA, 77 bp, Mus musculus
gcagctggttgggtgagtctggaagagttccctgcattactctgaaatataaagcctctgactcagacactccctgt

SEQ ID NO: 57575 - DNA, 111 bp, Mus musculus
ggatttggtatacctttctatatggtcattcaggttgtacaccaatgcaagacttgagaattagatattgtgatgatttgtatatccttggaccggagagtggcaccatct

SEQ ID NO: 57576 - DNA, 72 bp, Mus musculus
cagacatacacacacagacacacatgagagagagtgtgtgtgtgtgtatgtgtgtgtgtgtgtgtgtgtgtg

SEQ ID NO: 57577 - DNA, 108 bp, Mus musculus
taagaggtgtccttttcctttgatgacaatggtccctgttatttttgtttgtttgttttatttgtttattgatgctggtgaccatcagggcctggggcatgctgctta

SEQ ID NO: 57578 - DNA, 83 bp, Mus musculus
gactgtccgacaggttcccagtctctgtgtgtgtccagggccagaggaccaccactcaggagagactgcctttggattgagtt

SEQ ID NO: 57579 - DNA, 101 bp, Mus musculus
ttatactcctgattcaatggagatagagttggggaaagacaaagtatatttttttttaggccaacttgtaacagcattttcttctgaatgagagggtttga

SEQ ID NO: 57580 - DNA, 126 bp, Mus musculus
atatatatacatacacacacacacatatatatgtatatatatgtgtgtgtgtatatatatatatatattgatatatatatatatatatatgtgtgtgtgtgtgtgtgtgtgtgtgtgtgtgtgtgt

SEQ ID NO: 57581 - DNA, 68 bp, Mus musculus
tatatatatatatatacacacacacatatatatacatatatatgtgtgtgtgtgtatgtatatatata

SEQ ID NO: 57582 - DNA, 84 bp, Mus musculus
tctatgaaaatgtttgtatatacatatacatttctaagtatgaaatgcttagtctgtatagtgttgcatagatagatagataga

SEQ ID NO: 57583 - DNA, 85 bp, Mus musculus
atatttattatttatgagtgtcatgtatgtgtacatgcttgagtgtgtttgcatgtgtgtgcatgtgcttgtgtttgatatatat

SEQ ID NO: 57584 - DNA, 95 bp, Mus musculus
ggcttgtccttctcatgtgactttccttaaccctcagaaaataattgtctgatgtaatgaaaaaagttgactactgcatgagacttcagcatgcc

SEQ ID NO: 57585 - DNA, 116 bp, Mus musculus
ggaaggattacagtgccaataatttgagtagtggtctgattctgtgaccagagataagagagagatcacagagtgggcatgactaattgagactgtataaaaacagttatccaccc

SEQ ID NO: 57586 - DNA, 84 bp, Mus musculus
agtgatgaaaaggctcacactctgggattggtcaattgcctctggtgtggctgagagaacagactgtgatttttttcctttact

SEQ ID NO: 57587 - DNA, 88 bp, Mus musculus
ggctcacctttagattttctctctgtctgtcatagtaagctcaacatttacaattatatttggcagatttctgacaagattgagagcc

SEQ ID NO: 57588 - DNA, 85 bp, Mus musculus; identical to SEQ ID NO: 57439

SEQ ID NO: 57589 - DNA, 85 bp, Mus musculus
gcttttcctcaggatctgattcactctttgtctctgcatttcattttgacaggaggaattctagatcaatatctttgagataggt

SEQ ID NO: 57590 - DNA, 117 bp, Mus musculus
tacataaattagcctgctaaagttaattatggaactagtatgtttttttattaattttgtttaagagaatacacttactagtatctttatccttaaggtttggtctgttgctatgta

SEQ ID NO: 57591 - DNA, 69 bp, Mus musculus
atggtatatatgtatgtatgtatgtatgtatgtatgtatatatgtatgtatatatgtgtgtgagtacat

SEQ ID NO: 57592 - DNA, 85 bp, Mus musculus; identical to SEQ ID NO: 57439

SEQ ID NO: 57593 - DNA, 103 bp, Mus musculus
ttgattcacgtatttaaatataggtatacatttgcatgcatgtatgtatatgaatatatacatatgcagatttatcatacttcaggtagtttgtgttcctcaa

SEQ ID NO: 57594 - DNA, 64 bp, Mus musculus
catcgaaatacgcagacacacacacatacacacgtgtgtgtgtgtactgggtaagtgtttaatg

SEQ ID NO: 57595 - DNA, 109 bp, Mus musculus
gtactcaggggaggcagaatacagctacatagtagaggtcccactctgtgtttcactgagagaaccagcagagtctgaggtggatgctgtagttacaagtctcctgtat

SEQ ID NO: 57596 - DNA, 83 bp, Mus musculus
tctggattcttatgtttgaatgtctgtgcttgtctagtgttactgtgtagcatataaggacagaaatgataagctatcacaga

SEQ ID NO: 57597 - DNA, 84 bp, Mus musculus
tgtatgcatgtattttcatgtgttcatatatatatatgtatatgtgtgtgcatatatttatataaatacataaacacaaataca

SEQ ID NO: 57598 - DNA, 106 bp, Mus musculus
gccttagtccatggtgatctgataggatgcattggtcaatttcaatatttttgtatctgttgaggcttgttttgtgatcaattatgtggtcagttttggagaaggt

SEQ ID NO: 57599 - DNA, 85 bp, Mus musculus
ggccatggtggtctgataggatacctgggacaatttcaatatttttgtatctcttgaggcctgttttgtgaccaattatatggtc

SEQ ID NO: 57600 - DNA, 83 bp, Mus musculus
tctcctgtgtgtgtgtctgtctgtcattcatccacgctttgcccacccgcgtcgagagaccacattccacgcagacacaggga

SEQ ID NO: 57601 - DNA, 101 bp, Mus musculus
tatatgtatattatatgtgctatgatatattaaatatatttattgtatataatgaatacataatataataaatataatatgcaaatgtaatatataatata

SEQ ID NO: 57602 - DNA, 75 bp, Mus musculus
gtagcagatgtgagcttagtcttcatgtaggtcccctaattattggagctgagactgtctctgacactttgctgc

SEQ ID NO: 57603 - DNA, 106 bp, Mus musculus
ttgtgttgtaggctgttcctcttgagaatataaagtgatgtgttttgtaaatcattataaatttttgcatttcataattgttttctagagaaaaaaattaactcaa

SEQ ID NO: 57604 - DNA, 126 bp, Mus musculus
agacaagcctatcatggccagggagtggcatgtaatgatctgtatatgcttgacacaggaagtagcatgtttagaaggtatggccctgttagattaggcatgatcttgttggagtaggtgtgtcac

SEQ ID NO: 57605 - DNA, 67 bp, Mus musculus
tggacagggtcagttcgggccttcatcttcagccaggagacagagatgagacacagaccactggaca

SEQ ID NO: 57606 - DNA, 70 bp, Mus musculus
catgtacatatatatatatatgtgtgtgtgtatgtatatatacatatatgcataaatatacatgtacatg

SEQ ID NO: 57607 - DNA, 83 bp, Mus musculus
agtttgtattcatatatatgtatgtatgtatgtgtgtgtatgtatgtatgtatgtatgtatgtatgtatgtatgtatctatct

SEQ ID NO: 57608 - DNA, 85 bp, Mus musculus
gtccatggtggtctgataggatacatgggaaaatttcaatatttttgtatctgttgaggcctgttttgtgaccaattatatggtc

SEQ ID NO: 57609 - DNA, 118 bp, Mus musculus
gctttttcatgaaggcattctatttatggctgagtattcacttactgtcttcacattgtctgactctgggtctctatatttaataccacctactgaaaaatgtttacgtgatgagggc

SEQ ID NO: 57610 - DNA, 56 bp, Mus musculus
tgtatatgtgtatatatatatgcatacatatatatgcatatgcatacacatacaca

SEQ ID NO: 57611 - DNA, 106 bp, Mus musculus
gccttagtgcatggtgatctgataggatgcatgggacattttcaatatttttgtatctgttgaggcctgttttgtgacctattatgtggtcaattttggagaaggt

SEQ ID NO: 57612 - DNA, 58 bp, Mus musculus
tatgtatatgtatatgtgtatgtgtatgtgtatgtgtatgtgcatgtgcatgtgcatg

SEQ ID NO: 57613 - DNA, 74 bp, Mus musculus
tatgtatatgtatatgcatatgcatatgcatatgcatatgcatatgcatatgtatatgtatatatgtatgtata

SEQ ID NO: 57614 - DNA, 88 bp, Mus musculus
ggcctcaaactgatggttgactgtgaggatctgcatctgtattagtcaggtgctggcagattgtcctaggagacatctataccaggct

SEQ ID NO: 57615 - DNA, 136 bp, Mus musculus
acgtgtgcatgtatgtatatatatatacagatatatatatctgtatatatatatacatacatacacatgtatgtgtatatatatgtatatatatgtatgtgtgtatatatatatatatatatatataatgctgatg

SEQ ID NO: 57616 - DNA, 105 bp, Mus musculus
ttttaaacatatatctgtgctatttgtttggtttgggtactgattttatatttttgaaagggttagaaagaacataaacttgggatggtagggaggtgggtaaaa

SEQ ID NO: 57617 - DNA, 88 bp, Mus musculus
aatgctggtaatagtaaatggaaagtaaacaattaggcataattaatattcatatctatttcagtgtctgtgccagattactagcatt

SEQ ID NO: 57618 - DNA, 69 bp, Mus musculus
agcatactgattttctaattgtcttcccactgtgggagtaagaacagattgtagggagtctagtttgtt

SEQ ID NO: 57619 - DNA, 99 bp, Mus musculus
tactgaaataactcttggtagacaacgattcaagtagtaaatatctttttatggataattagttgattgaatgctgtgtgaattagaggctttttagta

SEQ ID NO: 57620 - DNA, 106 bp, Mus musculus
gccttagtgcatggtgatctgataggatacatggtacaatttcaatatttttgaatctgttgaggcctgttttgtgacctattatgtggtcaattttggagaaggt

SEQ ID NO: 57621 - DNA, 83 bp, Mus musculus
catgggacaatttcaatatttttgtatatgttgaggcttgttttatggcccatcatgtgctcaaatttcgagaaggtaccatg

SEQ ID NO: 57622 - DNA, 91 bp, Mus musculus
ttttggtctccctgctatcatggctccttggccaattcagttcataaaggcagagagaacagagtcaggaagcagtcatggtggacttaaa

SEQ ID NO: 57623 - DNA, 66 bp, Mus musculus
gaatatcactcatgtatacatatatgtatatttatatgcatgtatgcatatatatgggaattgttt

SEQ ID NO: 57624 - DNA, 85 bp, Mus musculus; identical to SEQ ID NO: 57439

SEQ ID NO: 57625 - DNA, 82 bp, Mus musculus
ctctgttgatctacctgtctgtcactgtatcacaattgctctattgtacagcttgaggtcaggcatggtgattctaccagag

SEQ ID NO: 57626 - DNA, 99 bp, Mus musculus
gtgtcagttagtgctgccataaagtgactgaagaactggggtcagatgaagtttttgtatttcaattattcattgcactgaatgtagtacttattgcac

SEQ ID NO: 57627 - DNA, 125 bp, Mus musculus
ggtgcctgttttcttgaacctatactaccttgattctgacttggattgtccactctgtcagtgtgacagggttctagcccaagtatgcagtacctgacctgacttgagagactttcctctgccag

SEQ ID NO: 57628 - DNA, 102 bp, Mus musculus
ctcaactccacctatgtctcttttgcccagctattggctgtctatatttttatttaccagtcagaaataattgtggggcaagatcacatagcatctcttggg

SEQ ID NO: 57629 - DNA, 81 bp, Mus musculus
ctttcagacagaaaagtcagagttgtgactgtggggtggcaaccccgcccctcacttcatatcctgtcttcctgctgaagg

SEQ ID NO: 57630 - DNA, 106 bp, Mus musculus
aatgttaaacattattaactttgtacagtgtcgagtttatttatatctttacatgattacttatagtagacgtctgtaacatgtcaagttttataatgagggcgtt

SEQ ID NO: 57631 - DNA, 85 bp, Mus musculus; identical to SEQ ID NO: 57470

SEQ ID NO: 57632 - DNA, 68 bp, Mus musculus
gagacaggtggatctctgagtctctgagtttctaggacagccagggctacacatagaaaccctgtctc

SEQ ID NO: 57633 - DNA, 96 bp, Mus musculus
cagtctcttttaaaagcgctttcatactaattatttttgtatatctgtatgccttggcatgcatttggcagttagatgggatcttttggaaatctg

SEQ ID NO: 57634 - DNA, 86 bp, Mus musculus
catctctttaaatgtttctgggagattcaagattcctctactgagaagtctctgtttatctctctgtaccccattatttaatggtg

SEQ ID NO: 57635 - DNA, 85 bp, Mus musculus; identical to SEQ ID NO: 57439

SEQ ID NO: 57636 - DNA, 85 bp, Mus musculus
gttggtggtccagtgtttgagagatcttaggggtcctggttgagactgctggtcctcctacattttttgttttacatagattact

SEQ ID NO: 57637 - DNA, 84 bp, Mus musculus
ggccatggtggtctgataggatacatggacaatttcaatatttttgtatctgttgaggcctgttttgtgaccaattatatggtc

SEQ ID NO: 57638 - DNA, 117 bp, Mus musculus
gatttgttaagatttttctgtgggctggagagatggctcagtggttaagagcactgactgctcttccaaagatcctgagttcaaatcccagcaaccacatggaggctaacaactatc

SEQ ID NO: 57639 - DNA, 114 bp, Mus musculus
taggtctgtataaatgtatatatatatatatatatatatatatgtgtgtgtgtgtgtgtgtgtgtatgcatgtatgtatatatgtatgtatgtctgcatttctatttgtatgta

SEQ ID NO: 57640 - DNA, 85 bp, Mus musculus; identical to SEQ ID NO: 57439

SEQ ID NO: 57641 - DNA, 92 bp, Mus musculus
ttggtcgcggcggcctcgaaggagctgtgtcaccagggaactgagaggctcctcacagaactgagtgacttggggtatcgagtttcggctaa

SEQ ID NO: 57642 - DNA, 81 bp, Mus musculus
ttgtaggaagtgtgtaatagcagtgggtcattgcagtgtcaaaacccattccacagtctgtctcactctcaattcctacga

SEQ ID NO: 57643 - DNA, 101 bp, Mus musculus
ttgccaaatatttgtgattggcctgtgtgggatggaatagcagagtatattaatgtatatacatgtatttttctcgctaaaatttttagtcataatagcaa

SEQ ID NO: 57644 - DNA, 116 bp, Mus musculus
agttatatggacatacaatttagcaaggacactgaggtcacacacatgaggatactacagaagactctatgcactgtggttgattcacacctataattcttgctggtgcccaagct

SEQ ID NO: 57645 - DNA, 104 bp, Mus musculus
atatgtatacatatttgtatatatacatatatatatttgtatatatgtgtatgtatatatatgcatatatatgtatgtgtatgtgtatatgtatatttacatgt

SEQ ID NO: 57646 - DNA, 84 bp, Mus musculus
acagtaccctagaaattttgttgttcattgaaaccaaaaagagattgttctctttcatgaatacatattttctagagtcaatgt

SEQ ID NO: 57647 - DNA, 105 bp, Mus musculus
gctgagcttgagttttcatgtatgtatgaatgtatgtatgtatatatgtatgtatggtaagtttgtacgtatgcatgtttatttaggttataatttaattacagc

SEQ ID NO: 57648 - DNA, 85 bp, Mus musculus; identical to SEQ ID NO: 57470

SEQ ID NO: 57649 - DNA, 106 bp, Mus musculus
gccttagtccatggtgatctgataggatgcatgggacaatttcaatatttttgtattagctgaggcttgttttgtgatcaattatgtggtcaattttggagaaggt

SEQ ID NO: 57650 - DNA, 106 bp, Mus musculus
acatttcttctttcctttttcagtgtctatgaggatatgtatgcatgctcttatatttgtgtatgtgtgcatgtccatgtgcaatccagaagacaatatggagtgt

SEQ ID NO: 57651 - DNA, 83 bp, Mus musculus
gtaacaagatctgtaaagtaacatgtccttttgtggatacaatctttctctaggtggatatgttatgaatagattaaagttat

SEQ ID NO: 57652 - DNA, 120 bp, Mus musculus
tctttgtcagtcttcacttgggaagtttgagatagggtctctctctctctctatgggactcactgatttgtcaattttggctgaacagagaaccctagataccttcctgtctctgcttcc

SEQ ID NO: 57653 - DNA, 90 bp, Mus musculus
atttttcttttgtgtgtggttgtcaattggagttagcttcttgcttatgggtggggaatcttgtctacttccacaacacaatgcttgaat

SEQ ID NO: 57654 - DNA, 106 bp, Mus musculus
ttccatattagaggtttatgaaaatctgtgtatgactgtgcatgtgcatgtgcacatgcttgtgttgtgtgcatatatagatgtgtgtattagcatgaatgtgggg

SEQ ID NO: 57655 - DNA, 107 bp, Mus musculus
ttagttcctccaattcttcccctacctctgtccaatgcttggctgtgcgtattcacatctgtcacagtcagctgcttttagagtcttgcagaagacagtcatgctag

SEQ ID NO: 57656 - DNA, 66 bp, Mus musculus
agttaagtgtttttctttataagaattgctgtgatcagggtgtttcttcacagaagaacactgact

SEQ ID NO: 57657 - DNA, 86 bp, Mus musculus
ggccatgtgtggtctgataggatacatgggacaatttcaatatttttgtatctgttgaggcctgttttgtgaccaattatatggtc

SEQ ID NO: 57658 - DNA, 85 bp, Mus musculus
ggctcctttgaggtctgtgtctgtctctctgggggaaggaaacctactctggctactagcttgcagaatacagccttttgggatc

SEQ ID NO: 57659 - DNA, 105 bp, Mus musculus
agatcagagttatggagaagaagcccaactcccagacactctaacacagttaggatcataggagtgcaggtgaggaggccacagcatcttcccaaactcctgtct

SEQ ID NO: 57660 - DNA, 115 bp, Mus musculus
gtgaccaaaactatactctgtcttctgtcttttggcttcctggtacaatgaaggatgcagtcacagcatcaggaactggatttagactaaggcagctgtgttagaaatgaggcac

SEQ ID NO: 57661 - DNA, 94 bp, Mus musculus
gtctgtatgatcttgatgtgagctgtgaccctaaaagctgtgaccctgtgtctctgcttgttcatagggtcttgtttgctgtcatttggaaggc

SEQ ID NO: 57662 - DNA, 119 bp, Mus musculus
tgcatgtatatatatatatgcatacatgtgtgtttgtgtgtatatatatatatatatatacatatatatatatatatatatacatgtatgcatatatacatgtatgcaattgtatgtac

SEQ ID NO: 57663 - DNA, 81 bp, Mus musculus
caagaagatttaaatattttttatatgtgtatgtgcatgtgtatgtgtgcgtatatgtgcgagtatatgtgtgtctttgtg

SEQ ID NO: 57664 - DNA, 96 bp, Mus musculus
aggatacatgggacaatttcaatatttttgtatctattgaggcctgttttgtgtccaattatatggtcaattttggagaaggtcccgtgaggtgct

SEQ ID NO: 57665 - DNA, 89 bp, Mus musculus
catacatgtgtatgcatgcatatggaagacagaggttagcttcaccagtggttgttcaccttatgtatgtatgtatgtatgtatgtatg

SEQ ID NO: 57666 - DNA, 81 bp, Mus musculus
gcctttgtacaataatgtaacatttcttgtatatgtatgtatgtatgtatgtatatgtgtgagagtatatttagtgtaggt

SEQ ID NO: 57667 - DNA, 121 bp, Mus musculus
ttttatgtacatttatgcatctgtttgtgtgcatgtgcttgcaaaaatacctgtctgtgtatatttatgtatatgtgggtccatgagcacaccaacaagtacatggatgtatagagaacag

SEQ ID NO: 57668 - DNA, 88 bp, Mus musculus
ggtcagcctaaggtgtctctctgtgtggctcttcgtgttattattcaaacaggttgtcttactgagtccagagatcatggttttggct

SEQ ID NO: 57669 - DNA, 62 bp, Mus musculus
gcacttctgtatatttgtatgtatgagggagcccccgagtatatgtatatatttagaagcgt

SEQ ID NO: 57670 - DNA, 94 bp, Mus musculus
ctcatcctgctgactctgttctgggggaatgtgggatgggactatgtcacactgtctcttccacagtggccatgaaggacttggcagataagag

SEQ ID NO: 57671 - DNA, 81 bp, Mus musculus
ggaagtcagtacaggctcaagacgatcaggtatagagtcttgaggaggagactggctgcctgatttcctgccttgacttct

SEQ ID NO: 57672 - DNA, 63 bp, Mus musculus
ctgtctgtcactctgtatcagtagcttttatcacaattgctctgtagtacagattgaggtcag

SEQ ID NO: 57673 - DNA, 85 bp, Mus musculus; identical to SEQ ID NO: 57470

SEQ ID NO: 57674 - DNA, 75 bp, Mus musculus
tcagtgggaattgacagacagactcagacatgagagtgtgctggtgctggatctgaatgcaatttgtcaaattga

SEQ ID NO: 57675 - DNA, 117 bp, Mus musculus
tgcaagggaagaaggaactgagtagaagttggtgattctcacattcttcttgctgagtgttaagtcaatgtgttcaactgtttcaagctccttccattgtgacatccctgttttgta

SEQ ID NO: 57676 - DNA, 116 bp, Mus musculus
tgccaactgtgttatctggaagttttcatatatatatatatatatatatatatatatatatatgtatgtatgtatgtatgtatgtatatatatatgaatgcatgtatttgtgggta

SEQ ID NO: 57677 - DNA, 93 bp, Mus musculus
atatacatttaaggtatatataattataaatatacatatatatatatatatatttatgacatacctatatctgtatatacattatatgtatat

SEQ ID NO: 57678 - DNA, 92 bp, Mus musculus
ggctcagatctcgctgccactgagaatgagaccacctggggtggaacattccctcctagatggttctattgttctgacatcagctctgttct

SEQ ID NO: 57679 - DNA, 104 bp, Mus musculus
gttcaggggatgctgatttgtgaagttactaaagcagaacctggtattgaattgatatgtaaataagactgggcatttggtttgcaagaaatcagcaattgagc

SEQ ID NO: 57680 - DNA, 98 bp, Mus musculus
tctttgtttatatacatatatgcatatatatatgaatgaatatatattcatatttatatatgtatttgtgtccatgtatgcatatatgaggagaaaga

SEQ ID NO: 57681 - DNA, 79 bp, Mus musculus
cagttcaggtgaagaaataaacctccaagaacacaagacaagagtcttgtgacattgttcttttctaaacatagaactg

SEQ ID NO: 57682 - DNA, 81 bp, Mus musculus
tcaccatgtgcattccttgtgtttttgtaggtctgagaaaggtgttagatccacaggcactggagttacagataattgtga

SEQ ID NO: 57683 - DNA, 79 bp, Mus musculus
gttttttaatatgtgcttgtgtctgtgtgtctatgtctgtgtgatgttatatgctcataagtgctggtgactaaaagac

SEQ ID NO: 57684 - DNA, 100 bp, Mus musculus
tgtattccacatgtgtgtgtgtgtatgtctgtgtgtgtgtatatatagtatatatatatatatatatatgtatgtacatatatatatacatatatatata

SEQ ID NO: 57685 - DNA, 116 bp, Mus musculus
ataaatttgtgagccttggattgcatagatgccataggacaacatttaaaatttatattttttatactgtatgtctctctgtgtgtatgcgtgtaacggtatatatacatttttat

SEQ ID NO: 57686 - DNA, 84 bp, Mus musculus
tatatataacttgcaagcacaatggtgtacgtgtgtgtgtgtgtatgtgtgtgtgtgtatctctgtgtatgcctttgtgtgtgt

SEQ ID NO: 57687 - DNA, 79 bp, Mus musculus
cacacacacacacagacacacacacacacacacacacacacacacacacaagtgcgtgtctgtgtgagtgtgtgtctgt

SEQ ID NO: 57688 - DNA, 92 bp, Mus musculus
gctctctaccaagtgtaacatgaggtcttgaatggtgatatttgaagagattattttattgtttaatctttttggctggtgtgtggatgagt

SEQ ID NO: 57689 - DNA, 87 bp, Mus musculus
gtatatatgtatataatgtatgtaaatatgtatgtgtatatatgtatatgtaaacataagtgtgtgcatatttattcatatatgtat

SEQ ID NO: 57690 - DNA, 99 bp, Mus musculus
ggaacatctattcatgtccctagaaatgcagctacagtcacagtgagtcagtctgtggcagttgtggagagcagtaggcactacttggataattgtttt

SEQ ID NO: 57691 - DNA, 107 bp, Mus musculus
tcagagttcacagtgttcaaatatcctgcaaactgagattgtgcaaatacatatttttaaaatatatttgttacttatttgacaggaggtggtttcgtggtcaatga

SEQ ID NO: 57692 - DNA, 106 bp, Mus musculus
aagccctcagtcttatacaacaagcatggtagtcattgagcccaggaaagttttttttttatagtgctatggagtttggtctgtattctgaggaatatttttgctt

SEQ ID NO: 57693 - DNA, 70 bp, Mus musculus
gtataggatatgatgtgagagagtctgattatgagtttaaagtctgtttctctcacttagtacattgtac

SEQ ID NO: 57694 - DNA, 103 bp, Mus musculus
gccatagtcctgactgggatgcagtctgtgtctgtgtgtgtttcagaggtctgtacctatatgtgcatatgtttacaatctatacatctgtctttctgtgtgc

SEQ ID NO: 57695 - DNA, 118 bp, Mus musculus
tcagcatcctcagagactggccgtgagaaaatgaatagtgtggtgtagacataacagagtcagcagtcttaacaccaatttgcagttttgcatgactccaaacataatgacaatagct

SEQ ID NO: 57696 - DNA, 112 bp, Mus musculus
gtgtatttttttgctttactatctagtaacttggagctggattgtttaccactgtttatctgagtggtaaagctcttgcctggtgttttaggtttgaggtgtgtgtgtgtgt

SEQ ID NO: 57697 - DNA, 112 bp, Mus musculus
gcttttagggacatacatacattttacagtgctggggataaagacataagtaggcactgaacaaactgagctctatccccaccccctctaatgtagtgttttccatatcagt

SEQ ID NO: 57698 - DNA, 78 bp, Mus musculus
tatatatattcctgttttgtgagggctgttgggcctagatccaactctcacaatctcagtgatacaggaacccatatg

SEQ ID NO: 57699 - DNA, 102 bp, Mus musculus
atctggacctataagatgactcaaggtatttttattttgaaaatgagccaaccaattttatttcttacacatgcccagagtttctgcaatgaggtctgagat

SEQ ID NO: 57700 - DNA, 97 bp, Mus musculus
tggttcttaatgtaaaacagtgaatttttatgaaaagattcatttcattttattttgaatgtatgagtatttttactgtatctatatttgtgcacca

SEQ ID NO: 57701 - DNA, 72 bp, Mus musculus
atatatatatacatatatatgtatatgtatatatatgtgtatatatatatatatgtgtgtgtatgtgtgtgt

SEQ ID NO: 57702 - DNA, 76 bp, Mus musculus
ctgtccttggaatctgtactacgacaagagaatgggctccacaattctgtctctgtcttccatatgttcaggacag

SEQ ID NO: 57703 - DNA, 107 bp, Mus musculus
attttaatgtttgcttgcttctttaagacaaggtctctctcactctgtatccctggctgccctggtactagctatatagagcagactgacctcaagcacatagaagt

SEQ ID NO: 57704 - DNA, 106 bp, Mus musculus
tatgcagagggcctaagtcagtcccatgcaagcttcctggttgtttacttcagtctctgtgagccccgatgagcccagcttagctgattctgtggttttttttgtg

SEQ ID NO: 57705 - DNA, 109 bp, Mus musculus
gtctatgtcaaccaatacagaacatagattttacagtctaaacaaaattgattttattcttttgtgattaggtataataattatgttttggggaacagaaactatggac

SEQ ID NO: 57706 - DNA, 81 bp, Mus musculus
gtgagggatgggactggttatgcacagcccctgcacatccatatggtccccaatggctgtctctgtcagtgacttctccat

SEQ ID NO: 57707 - DNA, 77 bp, Mus musculus
atggtgcctaggacactgactgcagattctgtgctcagaagaacacagttcgtctgcaatctagtttcagccatcat

SEQ ID NO: 57708 - DNA, 72 bp, Mus musculus
gctacagtacagctcactgtttctttgacatttgctcaggctcagcttagtcagtgactgtgtctcagtagc

SEQ ID NO: 57709 - DNA, 82 bp, Mus musculus
acagagtgatttgacacatgacagactgcagtagaccaccgtaggcgtctaactgctccttgtggttgtaggagttgttggt

SEQ ID NO: 57710 - DNA, 69 bp, Mus musculus
ggtatgtatgtattttgtatgtatgtatgtatgtatgtacgtacataggtaataaatgctgaaagtggc

SEQ ID NO: 57711 - DNA, 95 bp, Mus musculus
cacataaacttgctatgtgtgcatacttgtgtgtgtgtgttcatgcactggtatgtgtgtgttcatgcactggtgtgtatgcataagtgtagtgt

SEQ ID NO: 57712 - DNA, 85 bp, Mus musculus; identical to SEQ ID NO: 57470

SEQ ID NO: 57713 - DNA, 104 bp, Mus musculus
ttccaataacttcagcacctaatgtgatctctgtcactctcacagtttatgctcactgtttacagtatacactattcacaaggttaaagagctgcagcttggaa

SEQ ID NO: 57714 - DNA, 85 bp, Mus musculus
ggccatggtagtctgacaggatacatgagacaatttcaatatttttgtatctgtttaggcctgttttgtgaccaattatatggtc

SEQ ID NO: 57715 - DNA, 106 bp, Mus musculus
gccttagtgcatggtgatctgataggatacatgggataatttcaatatttttgaatctgttgaggcctgttttgtgacctattatgtggtcaattttggagaaggt

SEQ ID NO: 57716 - DNA, 106 bp, Mus musculus
catgagttgaattgttatggagcttaaagaatttcatgaagagtacagatttagttgtagctcttctcctgtggctctgttgctcactagctgttttacaaacatg

SEQ ID NO: 57717 - DNA, 105 bp, Mus musculus
ggtgtgtaacagtatctaacactgacttaataagtatataacatataagtcttttaaagatttatttacttatttgatgctgtcagggtaagttgcctatatgtc

SEQ ID NO: 57718 - DNA, 92 bp, Mus musculus; identical to SEQ ID NO: 57641

SEQ ID NO: 57719 - DNA, 71 bp, Mus musculus
atgtgtcactccctccctgattggctgcagcccattggccgagttgtcgtcacggggaaggcagagcacat

SEQ ID NO: 57720 - DNA, 115 bp, Mus musculus
tccttgaccaagttattattgagaagagtgttgttcagtttccacgtaaatgttggctttctattatttatttttttattgaagatcagccttagtccatggtgatctgatagga

SEQ ID NO: 57721 - DNA, 101 bp, Mus musculus
gatctagccgggggtcaaagggtaaaagagcggagagctctggctgggtctctgactgggtcacgaggggagaagagtccttggcttgtcggctgcttagc

SEQ ID NO: 57722 - DNA, 111 bp, Mus musculus
gcagttgtttagttggctggtgtgtgctgcagataaaaggacctgacagtcatctcagatctctctcttactctgtctgtcttactcctgccctctgtccttacttctgcc

SEQ ID NO: 57723 - DNA, 107 bp, Mus musculus
tgggttcccatctcccagctacagaaactagacagaactcacagagcagctactagctgctgtcctcaagactgtgtgtgtcttctcactgaggagatgcggatcca

SEQ ID NO: 57724 - DNA, 88 bp, Mus musculus
gtctgaacccatttagtctggctctcttctcaaggacaagggaaggaaacatgagcctcacggaaggagccaaggctgggagataggc

SEQ ID NO: 57725 - DNA, 94 bp, Mus musculus
tagactctggtggcatctgtactttgctctctcattggctctctctctctggggtgagtagatgtgtgtgttgcgtctgcccaggaagagtttg

SEQ ID NO: 57726 - DNA, 85 bp, Mus musculus; identical to SEQ ID NO: 57439

SEQ ID NO: 57727 - DNA, 88 bp, Mus musculus
ccgtgtgtgtgtgttcatgcttgtgtgtctgtgtgagtgtatgtcacacatgtgctcaaaggccagaaaagggtgccagatgccctgg

SEQ ID NO: 57728 - DNA, 100 bp, Mus musculus
gggaggaacgaccctcagttgaggaagtggctccattagactggcctgtgggcaagtctgtagacattttcttgatttgattgaagaggtggtgccaccc

SEQ ID NO: 57729 - DNA, 116 bp, Mus musculus
gcagggaaagcatggtgacaggagaatggggcagctggtcacactgcatctgctgtcagaaatcagacaggtgaatgctggtgtcacagggccccagggtcctaatctttcagggc

SEQ ID NO: 57730 - DNA, 86 bp, Mus musculus
gctccactcatttctgaagtgcttgttgactgcccgctggtgtcaggcatgagtgtcagcacagggactgcagctgagatgggagc

SEQ ID NO: 57731 - DNA, 71 bp, Mus musculus
cgtctgtctgtccatctgtgtctgtgtactgtgtgtgtcccccacagaaaggtggcccaaacagccagagg

SEQ ID NO: 57732 - DNA, 118 bp, Mus musculus
ggccaggctccatctctatactctttgcctaggtgacatctgtgactggctgagtgcctgccagccccaggggtttgacatggtaatgatgacacaacctgctggagcttgctaaggt

SEQ ID NO: 57733 - DNA, 141 bp, Mus musculus
tatatgtatgtgtatgtatatgtatatatgtgtatgcatatgtgtgtatatatgtgtgtatatatatgtgtgtatgtgtgtgtgtgtatgtgctatattgtgtatgtgtctatatgtatgtgtgtgtatctatgtgtatat

SEQ ID NO: 57734 - DNA, 109 bp, Mus musculus
tggcttccatgtgctgtcattatggtttgatttggtcatttgcatgcctttgcttctggtagaattcactgatgaccagccatatagatctgaagtcttacatctgcca

SEQ ID NO: 57735 - DNA, 56 bp, Mus musculus
cctctgagactctgaccacacagcctggaagctgccagatggtggggtggcagggg

SEQ ID NO: 57736 - DNA, 93 bp, Mus musculus
cacagccctacagccgtgtctggcttggctgtccctccgcctgatttggcctgggagccactgtgagtcactcaggccctagctgctgctgtg

SEQ ID NO: 57737 - DNA, 67 bp, Mus musculus
gtgcatctggacaggtaggggtgatttacctgttcacagattcagtcactcactgtttacaatgggc

SEQ ID NO: 57738 - DNA, 68 bp, Mus musculus
gtgtgtgtgcatgtacatgtgtatgggtgcatgtctgtggtacaatgtgtgtgtgcatgtacatgtgt

SEQ ID NO: 57739 - DNA, 76 bp, Mus musculus
atgtgtgtgtgcatgtacatgtgtgtgggtgcatgcctgtgcatggtataatgtgtgtgtgtgtgcatgtacatgt

SEQ ID NO: 57740 - DNA, 84 bp, Mus musculus
atgtgtgtatgtgcatgtacatgtgagtgcacgactgtgcatggtataatgtgtgtgtgcatgtatatgtgtgtgagtgcatgc

SEQ ID NO: 57741 - DNA, 88 bp, Mus musculus
gagacttatatgtatgtgcacacatatgatacatagacatacacacagagagagacacacgtgtgtgtgcacatagacacatagactc

SEQ ID NO: 57742 - DNA, 79 bp, Mus musculus
gtgtctgtgtctgtgtctgtctgtgtgtgtatgtgcacacacacacatacatgaatataggcaggccagaggttgatat

SEQ ID NO: 57743 - DNA, 56 bp, Mus musculus
ggcagagtctctctcactgagcctggagcttactggctggttgaggctggctggcc

SEQ ID NO: 57744 - DNA, 112 bp, Mus musculus
gtatctatatatctacatctgtatgtctgtatcactgtatctatgtatatatatgtatgactgtatctatgtatatgtatatatgtatgactgcatgtatgtatgtatgtac

SEQ ID NO: 57745 - DNA, 82 bp, Mus musculus
gtttctatgtctttctctgtctctgtgtctctgtttctcttaaattgagagaaatgactcagcagtgaagagcatttgctgc

SEQ ID NO: 57746 - DNA, 143 bp, Mus musculus
cagtcagaactgggctcttgagatgctcaaagtccttggatggattagcaacagaccccatcacagaggagagagagctgagggcatcagggttaggtgaagaagggacccccccccccctcagaggtccaaggtgaacagtc

SEQ ID NO: 57747 - DNA, 68 bp, Mus musculus
gacccaccctcaccctcactgtcactgccagaagctggcaaggcaagaagtggaggtgggggatgggc

SEQ ID NO: 57748 - DNA, 80 bp, Mus musculus
ctggctcactctctctgtgtcctctgtctttgtgtgcttttatgtgtgctcagaaggcgcaattcagagtgcccggccag

SEQ ID NO: 57749 - DNA, 119 bp, Mus musculus
tctgtgtgtatacatatgtacctgcatattcagtcagcttccatcatattttattctattagaattgacatgagaggggcaggcagtgtgcaattggttctcagttatattgcaaatga

SEQ ID NO: 57750 - DNA, 64 bp, Mus musculus
gggtctctcagtgtctcagactgtgccaattagactaagatggccagtgagtcctcagggactc

SEQ ID NO: 57751 - DNA, 78 bp, Mus musculus
tctgtgtgtgtatctgtgtctccgtgtccgtatttgtcagcgtatgggtatgtagatgtgactacaggtgccaatggg

SEQ ID NO: 57752 - DNA, 108 bp, Mus musculus
gccccctcctcagaatttttatttttgtgcgcaatgtgtatgtacacaccacacacacacacacacacacacacacacaaacacactacaatgttctaggagttggac

SEQ ID NO: 57753 - DNA, 71 bp, Mus musculus
agtttgcccaggggatctcttctctgcttccgaaggactggattgtagagagctatcatgcctgtctagct

SEQ ID NO: 57754 - DNA, 71 bp, Mus musculus
agatccaggggcctacaggctgtgtagcctaccctagtgggcaggttgtaggttggtaagtcttttcttct

SEQ ID NO: 57755 - DNA, 71 bp, Mus musculus
ggttttgttacaaatacggtttcctcccactggagcttccttctcctgagtgaggagactgagcaagtgcc

SEQ ID NO: 57756 - DNA, 102 bp, Mus musculus
ggggtcttttagaacttagagtatggggactggtgagatggctcagtgattaagagcactgactgctcttccagaggtcctgagttcaaatcccagcaacca

SEQ ID NO: 57757 - DNA, 95 bp, Mus musculus
agcaacagggggttggagagatggttcagtggctaagagcactgactgctcttccagaggtcctgagttcaattctcagcaaccacatggtagct

SEQ ID NO: 57758 - DNA, 99 bp, Mus musculus
gagaaagacatccaatgccctactgtgacctttgcatgtgtacacccaggcgtacatacccacacactcacacttactgggtttttctttttctttttc

SEQ ID NO: 57759 - DNA, 90 bp, Mus musculus
ttgtatttgttttctctgtgaggtacaagcatgaaaagattctgtccttctctgccccgtgctgtgtcgtcgttttgaggatcaatataa

SEQ ID NO: 57760 - DNA, 68 bp, Mus musculus
agctcctctctgtcactatgtgtgtccaacctcagcctgtggaccacatgtgacccagggctaaggag

SEQ ID NO: 57761 - DNA, 103 bp, Mus musculus
attgttcctcaggtccagacctgcccggttggcgtctgtcacactgactgtcctgcctggtccatgggggaaagtatttcagtaatgaagtccagatgcagcc

SEQ ID NO: 57762 - DNA, 74 bp, Mus musculus
tcacataagcaaatgtatgcaaaacacatggcacataacaagtgtcatgtatggacattgacattcttatgtgg

SEQ ID NO: 57763 - DNA, 101 bp, Mus musculus
acacgggtgtgcctagacatgggcgtgcacagatttgagtgtgcacaggtatgcatagaatgggtgtgcacaggcactggtgtgcataggcacaggtgtgt

SEQ ID NO: 57764 - DNA, 117 bp, Mus musculus
tatctttcttttcttttcatgtgtatatagtgcgcatgcacacatttctgtgtgttcacatgtgtgtgagagcacattcagtgtgtgcatgtggaggcctggggttgaggttaggtg

SEQ ID NO: 57765 - DNA, 78 bp, Mus musculus
ggggtatcagccaatccgaggagctcagttttgtatctttatttaaaacaagcttgtgagctggtggggctgcacttc

SEQ ID NO: 57766 - DNA, 72 bp, Mus musculus
ggatggagaaggacattttgaactttacttagggtatttcccccttaattttctgtctgcctctctctatct

SEQ ID NO: 57767 - DNA, 94 bp, Mus musculus
atatacataattttgtatgtatgtatgtatgtatgtatgcatgcatgtgtgtatatatgtatgtatgcatgtatgtgtgaggggtgcagtgatg

SEQ ID NO: 57768 - DNA, 71 bp, Mus musculus
cagagtgtctgtctgcctctgtagataccacaagggtgggatctgctgttcaatgtgtggcatttgctttg

SEQ ID NO: 57769 - DNA, 58 bp, Mus musculus
ggggcataaggctactgagggaggcagccagcatgtctctctgtaagtgtctggtccc

SEQ ID NO: 57770 - DNA, 82 bp, Mus musculus
agttactgccctggctgtctgtcactcagagcctggataggagacctgatggtccagagctgaaacagacaagagcagaatt

SEQ ID NO: 57771 - DNA, 97 bp, Mus musculus
gctctagctctatcacaaagcctgtatcacatatgtgtgtgtgcatgtgcatgtacacacacatacgggggaggtgttttgaagatatgtaaggagc

SEQ ID NO: 57772 - DNA, 96 bp, Mus musculus
gctaacactggggcctaacctttgagaacattgactgcattggttccaggaagaatctggccaaatgtcctcttggtgtcttccccaaccgtttgt

SEQ ID NO: 57773 - DNA, 125 bp, Mus musculus
ttcttagaacatcttctagatatatgcccaggagaggtattgcggtaccctctggtagtactatgtccaattttctaaggaaccgccagactgatttccagagtggttgtacaagcttgcaatcc

SEQ ID NO: 57774 - DNA, 97 bp, Mus musculus
cctgagtgaggtccagccttaaacaaagggcaagaggtgtgcatagctaaactgtcctgtgtgtctcactgtctgggctctgggctctcctgcaagg

SEQ ID NO: 57775 - DNA, 56 bp, Mus musculus
ctctctctctgtgtgtccacacatacgtgcactggtgtgtgtgcgcaggggttgag

SEQ ID NO: 57776 - DNA, 72 bp, Mus musculus
acacacacacacatacacagaaaagagaaagtgcatgcatgtgtgcacacgtgtgtgtgtgtgtgtgtgtgt

SEQ ID NO: 57777 - DNA, 80 bp, Mus musculus
gaggtctctgaagagagagatcagggcagggcagaaatgaaagtccataaagccattctttcttttttctcttctgagac

SEQ ID NO: 57778 - DNA, 103 bp, Mus musculus
acaaatgcctttaattgttaaatatcttggttgggattttaggtttcaatagaagtatcttggaaagctagattagccacttttggagcaatgggcactgtgt

SEQ ID NO: 57779 - DNA, 77 bp, Mus musculus
gtctccaggctctgggtctctgtcactctgtttccatatgctgccaactcatcagacagacccaggaactgtgaggc

SEQ ID NO: 57780 - DNA, 81 bp, Mus musculus
acatgcctgccagcatattgtttatgtatatatagatatcatgtgtatgtatgtagatgctgtgtgtgagtatatacatgt

SEQ ID NO: 57781 - DNA, 94 bp, Mus musculus
gggcttccagtgtctccctttctgcctacaagacctgagagaagagagttagccacatagatgcccaactctgttccttaggaggacacaaggg

SEQ ID NO: 57782 - DNA, 69 bp, Mus musculus
atatatatatatatatatatggagacaggagatgactatatgtgtttgcatgtatgtatgtgtgtatgt

SEQ ID NO: 57783 - DNA, 90 bp, Mus musculus
cctgtcattcaaaaggcatcggtgtctctcaatgtttattcctgctcctacatctcagagtgcctgtcttcagatgattgaactgaaagg

SEQ ID NO: 57784 - DNA, 94 bp, Mus musculus
atttctgctgtgtgactgtgtaagatatgtatgtttatatgcatatgtatgtatgtgcacaatgtctatgcacatgctcatggagaccagagat

SEQ ID NO: 57785 - DNA, 72 bp, Mus musculus
agctactattctgtgactctgtgtgtgtatgtgtatgtgcatatatgcatgagtgtttatgtgtatgtagct

SEQ ID NO: 57786 - DNA, 73 bp, Mus musculus
cagggtgtctctatgatttttagaccatagtcagtattgagatactgactccctctgtgtttctagaaccttg

SEQ ID NO: 57787 - DNA, 106 bp, Mus musculus
gccttagtccatggtgatctgataggatgcatgggacaatttcaatatttttgtatctgttgaggcctgttttgtgcctaattatatggtcagttttggagaaggt

SEQ ID NO: 57788 - DNA, 76 bp, Mus musculus
tgcactgatggactgtaacttgaaatcgtgatccaaaataaaccctttctcttcacagtttctttttgtcagtgca

SEQ ID NO: 57789 - DNA, 120 bp, Mus musculus
caaagccagtgccttgctgacacaggaaccccagtgcatggttcccagaagacagagaccactgtgggaatggcatcctgggatatcaaatttgtattagcagataaaaggttttggctt

SEQ ID NO: 57790 - DNA, 96 bp, Mus musculus
cgcaagacttcagttgatattcactcctgtgacaaataatcacccccaattttatttgaatatttaacaggaatgaaatgactttcagtctctgtg

SEQ ID NO: 57791 - DNA, 109 bp, Mus musculus
tctgtgtgtgttatgtgtatgtctgtgtgtatataaatgtgtatgtatgtatgtatctatgtatctatgtatctatgtgtgtatgtgtatatgtgtttgtgtccacaga

SEQ ID NO: 57792 - DNA, 82 bp, Mus musculus
gctttagttagagcccagggatctaaagtgggtggaaaaaagccttaagatttagatccctcactctctgtctaaattttgc

SEQ ID NO: 57793 - DNA, 115 bp, Mus musculus
ggtattgccagaaatttgacatctgctacatagtgagactttatcaaagaacatttaaaaatgtttatttattctttgagagtttcgtaatgtatacaatgtatttgattatgct

SEQ ID NO: 57794 - DNA, 79 bp, Mus musculus
catttcttgtttttctgagcctccacaatgcagggacgagagtctctgagtgtctgggaacctcgtgaaatttttaatg

SEQ ID NO: 57795 - DNA, 101 bp, Mus musculus
ggcacctgtagaaatcagagttcaacctcaggtctcagtcattatcttccacctattctaagacagggtcttcttttttctgatgtatacacaaagttgcc

SEQ ID NO: 57796 - DNA, 60 bp, Mus musculus
tatgtatgtatgtatgtatgtatgtatgtatgtatatatgcatgtgtatatgtatgtgtg

SEQ ID NO: 57797 - DNA, 94 bp, Mus musculus
acagttgcctggaggatgcatgcgggctttggggggaattgtgagggaagatcacaaaagctgagcctgtctgtctgtctgtctgtctgtctgt

SEQ ID NO: 57798 - DNA, 88 bp, Mus musculus
tgacctgttgtggtctttctgccagcaaagcatatttatcttctgtctccctgtgtgactggttagaagagggacttttctctggtta

SEQ ID NO: 57799 - DNA, 68 bp, Mus musculus
agatgtgggttgggggatgggataggccaattttctcaagtgtgtctctgtgcctctgacccaggcct

SEQ ID NO: 57800 - DNA, 95 bp, Mus musculus
gtgccttggaacatggcaagtaggccaggctggagatctagctagctcgaggctgctttctgtctctgcctctctggtgccaggattctaagcat

SEQ ID NO: 57801 - DNA, 103 bp, Mus musculus
ttgtgatttgtgagatttctttaaagagtagaggatttgagaggaattttctatggcaaaattccagtctctcttttgtcacaaactaagtctatactcacag

SEQ ID NO: 57802 - DNA, 98 bp, Mus musculus
ggggttatttgtttgggctcatggttacaggggtgtcagttcatcgagaaaggaagtacatgctagagagcagagtagctcccatcctggtagactgg

SEQ ID NO: 57803 - DNA, 61 bp, Mus musculus
ctcagtagttctccacctagttctctgagacagtctcttactgaacctggaggtcactgag

SEQ ID NO: 57804 - DNA, 81 bp, Mus musculus
aagttatcttttagtcctgttgagagactttttcttttaattttaggaaaaagtttcccagtctttgctcctgagatgctt

SEQ ID NO: 57805 - DNA, 66 bp, Mus musculus
tctgagagtgtgtatgtgcatgtgtactgatagttgtgtgtgtgtgtgtgtgtgtgtgtatgcaga

SEQ ID NO: 57806 - DNA, 94 bp, Mus musculus
ctctgccagggaggggtctagtgaatctggtcagtttcagggatttcctgatgttattttgatcttgtttacgttccagtccttgcttaaagag

SEQ ID NO: 57807 - DNA, 87 bp, Mus musculus
tgtatatgtatttatgtatgtgtgtgcattggtatttgtgtatatgtctgtgtgtatatatatttatgtgtatgcatgtgtctgtat

SEQ ID NO: 57808 - DNA, 73 bp, Mus musculus
tgaatcctcagaggctgaagagatagcttagtggttaagagcactgactgctgttccagaggttctgagttca

SEQ ID NO: 57809 - DNA, 85 bp, Mus musculus; identical to SEQ ID NO: 57470

SEQ ID NO: 57810 - DNA, 93 bp, Mus musculus
agaagcaatgttggcaggagacagaagagtgtctgggatgtaaagttggagatccaggcagtgactgatcttggttgctcagctcaagctttt

SEQ ID NO: 57811 - DNA, 84 bp, Mus musculus
tacacacaaatacacatgtatgtatgtatgtatgtatgtatgtatgtatatatgcatgtatgtatgtatgtaaaagtaactgtg

SEQ ID NO: 57812 - DNA, 58 bp, Mus musculus
gtgtgtgtgtgtgtgtgtgtgtgtgtgtgtgtcatatgtcacacacaaagctgtatgc

SEQ ID NO: 57813 - DNA, 85 bp, Mus musculus; identical to SEQ ID NO: 57439

SEQ ID NO: 57814 - DNA, 85 bp, Mus musculus; identical to SEQ ID NO: 57470

SEQ ID NO: 57815 - DNA, 70 bp, Mus musculus
tgtctctctgtgtgtctctgtgtgtatgcaccacacatgtgcagatacctgatgaatccacaagagggca

SEQ ID NO: 57816 - DNA, 60 bp, Mus musculus
gggccgtatgtgtgcatgtgcatgtgtgtacacttacacagatgtgcacatgtgtagtct

SEQ ID NO: 57817 - DNA, 83 bp, Mus musculus
gtcatatatgtatctgaatgtgtatgtataggtatgtatacatatatgtacctatacatatatgtataggataacatattaac

SEQ ID NO: 57818 - DNA, 64 bp, Mus musculus
gcgtgtgtgtatatatatatgtgtgcgttatgtcatatgcactgtgtgtatggtacatatctgt

SEQ ID NO: 57819 - DNA, 120 bp, Mus musculus
actggctaaacagtgtgtatgtgtgtgtgtgcatgaatctgtgtgtgcatgtgcatgtgtgcacatgtatgtacctgtgtatgtgcccgtgagtatatgtgcctgtgtgtctgtgtatgt

SEQ ID NO: 57820 - DNA, 102 bp, Mus musculus
gatttaatttgagtatcactagtataactattatttttttatttatgtgtatgttctcatgtgaatttgtaaatatgtgttactagacattcagaaggcatc

SEQ ID NO: 57821 - DNA, 98 bp, Mus musculus
gagttcttattatagtcatgtatggaagactactgtattagttagggttccctagagtcacagaacttatggatagtctctatacagtaaaggaattt

SEQ ID NO: 57822 - DNA, 115 bp, Mus musculus
gtccccagtcaggaagcagagagactagagagtaggtgctgagctccctccattcttacctggcagactcactcacagaatcttacttactcaactttcttgcagaggctaggac

SEQ ID NO: 57823 - DNA, 93 bp, Mus musculus
gagaagtaagtgtagaaagaaaagaatgatacagatgtgtgtgtgtgtgtgtgtgtgtgtgtgtgtgtgtctgcctgtctgtctgcctgtctc

SEQ ID NO: 57824 - DNA, 85 bp, Mus musculus; identical to SEQ ID NO: 57439

SEQ ID NO: 57825 - DNA, 83 bp, Mus musculus; identical to SEQ ID NO: 57504

SEQ ID NO: 57826 - DNA, 86 bp, Mus musculus
ggccatggtggtctgataggatacatgggacaatttcaatatttttgtattctgttgaggcctgttttgtgaccaattatatggtc

SEQ ID NO: 57827 - DNA, 81 bp, Mus musculus
tgatgatctgataggatgcatgggacaatttcaatatttttgtatctgttgaggcctgttttgtgaccaattatatggtca

SEQ ID NO: 57828 - DNA, 99 bp, Mus musculus
gtccattactctacctatgccgttgtctgtctttctgtctgtctgggtacaagggaactgactcctagtctctcagtgtgatctataattctaatggat

SEQ ID NO: 57829 - DNA, 85 bp, Mus musculus
acacatccattgaaggaaaggacaggagagtaaggaattctgttggagctctttagtgtgtgtgtctctctctctgtgtgtgtgt

SEQ ID NO: 57830 - DNA, 70 bp, Mus musculus
ttcctaatatgtgtgtggctgttgttatagatttatttctataacagtttaattatgtatgtatgagggg

SEQ ID NO: 57831 - DNA, 83 bp, Mus musculus
gccactatctgctatcacttgagattttgatcttcatcattctgattggtggaaggtggaatttcaggttctgtttgatttgc

SEQ ID NO: 57832 - DNA, 112 bp, Mus musculus
ggtgctttctctagcttctccattgagggccctgtgttccatcttatagatgactgtgagcatacacttctgtatttgctgggcactggcatagcctcatatgagacagcta

SEQ ID NO: 57833 - DNA, 80 bp, Mus musculus
ggggttttctgtatgtgtgtatgtatatacgtatatacgtatatacgtatatacgtatatatgtatatatgtaaagcttc

SEQ ID NO: 57834 - DNA, 68 bp, Mus musculus
ctctgaactatgtgcagaacaaatctctcctcctttgagctgtgtctgacacatactctgtctcagag

SEQ ID NO: 57835 - DNA, 85 bp, Mus musculus; identical to SEQ ID NO: 57470

SEQ ID NO: 57836 - DNA, 112 bp, Mus musculus
gagaaagctgaggctgtgacacaggaagaaaaaaatctgaatgagcaaaacatatcctgtttcattatttatttatgcctttcaaatgtaattgtcacgctccagtaaaatc

SEQ ID NO: 57837 - DNA, 72 bp, Mus musculus
ttctaagagaactgagattacagactggtcacaatactagtttggattttatctgggtgctctgtttctgaa

SEQ ID NO: 57838 - DNA, 64 bp, Mus musculus
tatttgtgtctgtatatgtacacaatatgtatatttttatatatgtacatgtatagcatatgtg

SEQ ID NO: 57839 - DNA, 112 bp, Mus musculus
tgacatatatacatgcacataggcagggatttagttgactaataccaatctatgtatttatatatgtagatggctgtcatagtaatgcctacatcaaatcatgtcgatgtta

SEQ ID NO: 57840 - DNA, 92 bp, Mus musculus
tgtctgtgtctctctgtctctgtttttctgtcaaacagcagacagacaaacatgtctatgtagacagccaaatacagacagacagacagaca

SEQ ID NO: 57841 - DNA, 79 bp, Mus musculus
tgcataagtgtgtatatatatttgtgtgtaaagatatttatgtttctaagtgtgtatatatacatatacatatgcattc

SEQ ID NO: 57842 - DNA, 84 bp, Mus musculus
gaatgtatgtccctaaatctcctccttatggtctttttatatttaactaaaaggaattaatatgactggagaatgggataattc

SEQ ID NO: 57843 - DNA, 93 bp, Mus musculus
tccatgatgatctgataggatgcatgggacaatttcaatatttttgtatctattgaagcttgttttgtatccaattatgtggtcaattttgga

SEQ ID NO: 57844 - DNA, 79 bp, Mus musculus
tagagagactttctgtggatgacatatgagactgaggagtccctctgacctccacatatacatgcatacaaactctctg

SEQ ID NO: 57845 - DNA, 74 bp, Mus musculus
ttgcatgaatattgagaagacaacatgtgaagtcatatttcttctgattctgttgttttctgagatgatcgcaa

SEQ ID NO: 57846 - DNA, 88 bp, Mus musculus
catatatatacatacatacacacatatatatgtatgtgtatataaatatatatatgtatatatatgtgtgtgtatgtgtatatatatg

SEQ ID NO: 57847 - DNA, 85 bp, Mus musculus; identical to SEQ ID NO: 57470

SEQ ID NO: 57848 - DNA, 85 bp, Mus musculus
gtccatggtggtctgataggatgcatgggacaatttcaatatttttgtatctggtgaggcctgttttgtgaccaattatatggtc

SEQ ID NO: 57849 - DNA, 90 bp, Mus musculus
tgtaggattagctttcctttgactacacatcctctgttggagataagtgctttcctttcagaacagtcacagcagagcacattccctata

SEQ ID NO: 57850 - DNA, 119 bp, Mus musculus
tctccgtctatgttaattgagagtttggttgggtatagtagcctgggctggcatttgtgttctctcagtgtctgtataacatctgaccaggctcttctgtctttcatagtatctggtga

SEQ ID NO: 57851 - DNA, 69 bp, Mus musculus
ctctctgtctgtctgtctgtttgtggatatgtgcatatgagtgcaggtcctatggaaatcagaagaggg

SEQ ID NO: 57852 - DNA, 83 bp, Mus musculus
cctgtctccatctcactctcagaaagctaggataacaggtgcatgctatatctgtccagttttgggtgtgatttaaggttcag

SEQ ID NO: 57853 - DNA, 99 bp, Mus musculus
tacatgtcttgtagatatgccttcatatatatgtatatatacacacttattcatatgtatgtcatatatatgtgccatatacatatatgtatacgtgtg

SEQ ID NO: 57854 - DNA, 97 bp, Mus musculus
cctgaaaccaagtctcagggtgattttcttgattaacaattgatgtgtgagggtgcagtctcctgtttcagtgtcactcctggatatgtgtccctgg

SEQ ID NO: 57855 - DNA, 87 bp, Mus musculus
ttttaattatctgtatgtgtgtgtctctgtttgtgagtaaatgcaggttgatgcagttctcccagaggctagaagacagcattgaaa

SEQ ID NO: 57856 - DNA, 109 bp, Mus musculus
atatatagatatatgcacttacatatataaatatatatgtatatatatttgtaagtccatatgtttatatatgactttatatatgcatttttacatctgtatatatatg

SEQ ID NO: 57857 - DNA, 85 bp, Mus musculus
gggaggaaatggtgactgatattgggatgtaaagttaacaaataactaagtatcattaataatgtcagtgattggttcttgtccc

SEQ ID NO: 57858 - DNA, 73 bp, Mus musculus
caggcactatccactctgtgtgtgtgtgtgtgtgcgctcgcgcgcgcgtgtgtgcactctgtctgtgtgtctg

SEQ ID NO: 57859 - DNA, 115 bp, Mus musculus
ctgcctgcctgcctgcctgtagccttgaatgcatgtagtgtctcttttttttttttttattctttgtctgtttgagacaagattttggccaagagcttgccagataggctctcag

SEQ ID NO: 57860 - DNA, 96 bp, Mus musculus
gctcaaattaaatatccaggataatgtactgttagctttgaaagtgaagaactttgtagtatcttttattgtcattgctgatcttcctgattgagt

SEQ ID NO: 57861 - DNA, 97 bp, Mus musculus
ctttcttctattttgagtgccctatgtgtggtagataaagcttgtttgcatttgagaaagtcgcataatatataccaagtagttcacaagaagagag

SEQ ID NO: 57862 - DNA, 68 bp, Mus musculus
ggaaatcagctctgaggaaataggttgtttacgtgtttgagttggcaagctcccttcagagctgttcc

SEQ ID NO: 57863 - DNA, 91 bp, Mus musculus
ctgtcccttacagaacattgcaaaagctaagctatccttagaatgctattagcttgttttctaaacagtgtttaaaacacagggtcctcag

SEQ ID NO: 57864 - DNA, 138 bp, Mus musculus
acatgtatgtatgtatatacatacatataatgtgtatatatgtatgtatagtgtgtttatatgtgtatatataatgcatgtatgcatgtatatacagcgtgtatatatgtatgtttatatagggtgtatgcatgtata

SEQ ID NO: 57865 - DNA, 94 bp, Mus musculus
tgcttgcagcggttgaaattctcctctgagttcagctttctgtcaggcagagactagagagtgtgcagaaggaggaataaacagaggctctgta

SEQ ID NO: 57866 - DNA, 80 bp, Mus musculus
gcctgaggcacatatcagtattcatttttgtttccaactttccaagttgagaggaatcatgtttggagtggactttaggc

SEQ ID NO: 57867 - DNA, 65 bp, Mus musculus
tatgtgtgtgtgtgtgtgtgtgtgtgtgtaagagagagacacagagagacatatgtgcacatgtg

SEQ ID NO: 57868 - DNA, 77 bp, Mus musculus
cagatggagagagagacagacagacagaattcctaaatacactaacctggcttttggcttctgtagttctcctgctg

SEQ ID NO: 57869 - DNA, 79 bp, Mus musculus
aggaacataatatatattgtatgtatatgtatgtatacatgtatatatatatatatgcatatatatatgattaaaacct

SEQ ID NO: 57870 - DNA, 85 bp, Mus musculus; identical to SEQ ID NO: 57470

SEQ ID NO: 57871 - DNA, 79 bp, Mus musculus
atatgtatatatgtgtgtacatgtatgtatgtgtgttcatatatgtatatatgtacatacatataatatacttacatat

SEQ ID NO: 57872 - DNA, 109 bp, Mus musculus
cctgtatcatcacttttcttcctacaggcagcagagggggaagttgtcagcctggagacactgacagtgtaaacctttctgaaacaaaataggagtgaaacctcacagg

SEQ ID NO: 57873 - DNA, 66 bp, Mus musculus
gagtgtagagactgagctgagaaaaagcaagcaggtggtcctctatgcatttctttctctgtgctt

SEQ ID NO: 57874 - DNA, 71 bp, Mus musculus
ttgtgtgtatgatggctctcttctgtaattgaacaattatgtcttaagatgagagacagacagacacacag

SEQ ID NO: 57875 - DNA, 69 bp, Mus musculus
tgtgtgtctgtctgtctctcatcttaagacataattgttcaattacagaagagagccatcatacacaca

SEQ ID NO: 57876 - DNA, 90 bp, Mus musculus
tgaagtcaggttaaatctgtgtgagtctgtctgtggaaatacttcctaggagaatttctgggctagtctattaggttaacagtgagttta

SEQ ID NO: 57877 - DNA, 85 bp, Mus musculus; identical to SEQ ID NO: 57439

SEQ ID NO: 57878 - DNA, 66 bp, Mus musculus
atacaaatttgtatatatgtatgtatgtgtgtatatgtgtgcatgtatatatgtgtgcatgtgtgt

SEQ ID NO: 57879 - DNA, 73 bp, Mus musculus
gctaagaggaacccacttttgtcctgatatatatatatatctttttggctcaaattgtggagatccaattggc

SEQ ID NO: 57880 - DNA, 74 bp, Mus musculus
tgtgtgtgtgttcatgtgtatatatgtatgtatatacatatacatacatatacggatatgtatacacacacaca

SEQ ID NO: 57881 - DNA, 90 bp, Mus musculus
catttaaaaaaagtttatttgtgtgtctctgtgtgtgactttcttcttaagaaaaatgtcagaggtacatgaaagtagactgatgtaatg

SEQ ID NO: 57882 - DNA, 83 bp, Mus musculus
ggtcttttgttgtgtattgtaatgctaagtgtgggcccccaagacctggttaccccagagacaagacagtcagcatgtggacc

SEQ ID NO: 57883 - DNA, 90 bp, Mus musculus
gggaaggcaactcaacacaactccagttttcactgatcagagtgacaaaacaggtcaagtattgctgagagtttggaagaacagcccctc

SEQ ID NO: 57884 - DNA, 86 bp, Mus musculus
agctccaaactgtgtctctgtatctctttccatgggtgttttgttcccaattctaagaaggggcaaagtgtacacattttggtgtt

SEQ ID NO: 57885 - DNA, 65 bp, Mus musculus
gggtcacagaaagaaaggggctgcctccctgagggttgacagcctgcctgtctgcctgcctgcct

SEQ ID NO: 57886 - DNA, 73 bp, Mus musculus
tgcctgcctgcctgcctgcctgcctgcctgcacctagcctcctgctcaaaggcaggacagcaccaaggtggta

SEQ ID NO: 57887 - DNA, 76 bp, Mus musculus
aggcctagatttacatacaggcatgtatacatacctatcttatatgtgtatatgtatatatgtatgcccttagcct

SEQ ID NO: 57888 - DNA, 70 bp, Mus musculus
acacacacacgtgtatgtgtgtgtattattttatagctgctcatacacacacacacacatttgtgtgtgt

SEQ ID NO: 57889 - DNA, 83 bp, Mus musculus
gtatatgtgtatatgtttttgagtatgtatatgttcttatttcggggggtattatacatgcttgtgtttgtgtgtgtgtgtgc

SEQ ID NO: 57890 - DNA, 81 bp, Mus musculus
gatggggttgatggataggtcagagagtctaaatgtatggattttatacattcatctctctctatctcagacccatcagcc

SEQ ID NO: 57891 - DNA, 116 bp, Mus musculus
atatataggtatatatgtatatgtgtgtatgtgtatgtatatatatatatatatatatatatatatatatatatatacacacacacacacacacatgcagtcatatataaatatat

SEQ ID NO: 57892 - DNA, 113 bp, Mus musculus
gaaactaacacctgggcatattgttgggtcctatggtgtttgggaaacacagcagacattccctgtgtctctctgcctcagagccacccaccatgtgcactttgatgagtttc

SEQ ID NO: 57893 - DNA, 68 bp, Mus musculus
tgtgtgaatgcatgtatatatgtatgtatataatgtgtgtatatgtgtatgtatgtatgcattatata

SEQ ID NO: 57894 - DNA, 112 bp, Mus musculus
gtcagtgtctctctgtgtgggtaccagcattcgtgtctgaatctctctctcatcaagaagaaaacgtacaagatttcaattctgccccccacgccattggactttcactgac

SEQ ID NO: 57895 - DNA, 81 bp, Mus musculus
atgtttgtgcaggtttcttaccagtcacctcactgggtgctggacagatggctcagtgggaagtagctgatgtacagatat

SEQ ID NO: 57896 - DNA, 67 bp, Mus musculus
cttgcttaatcttggtgtggagtcgctgacttcagttcaatgaattctaccttgagattaggacagg

SEQ ID NO: 57897 - DNA, 82 bp, Mus musculus
gcgcacacacacacatatatatgtatgtatatatatgtatgaatatatgtatgtattaatgtgtatatgtatgcatgcatgc

SEQ ID NO: 57898 - DNA, 79 bp, Mus musculus
tgactttgttaagagaaagtatgtcactggaggtcggctttgaactattcccagtctcattctctctgcttacaaatca

SEQ ID NO: 57899 - DNA, 71 bp, Mus musculus
gcaagagaaagggtgattcagaaaagccagagccaagctctctcctgctctgtctgtctgtctgtctctgt

SEQ ID NO: 57900 - DNA, 80 bp, Mus musculus
ctgacttgtaaagactactctgtccctctgtcccagccagcccagacagacagacaggctggagagaatttgcaggtcag

SEQ ID NO: 57901 - DNA, 69 bp, Mus musculus
tgtgtttatatacgtggcatatgtatgtatgattgtatgtatgtatgcatgtatgtatgtatatgcaca

SEQ ID NO: 57902 - DNA, 124 bp, Mus musculus
tatatatgtgtttgtatggattgcaaatgtgtatatatgcatccatattgtagcaggtatatatatgtatatatgttcatgtgtatatacttatgcatgtgaatttgtgtgcttgtgtatattt

SEQ ID NO: 57903 - DNA, 62 bp, Mus musculus
ttccctctcactgtgtctctgatggcttcctgagctatttctgaaggcacatgagtgttgaa

SEQ ID NO: 57904 - DNA, 56 bp, Mus musculus
gcatgtatagacatgtttacctggatatatacatatgtaaacatgtatgtgcatgt

SEQ ID NO: 57905 - DNA, 124 bp, Mus musculus
atgcatgttcctgtatgggtgtatgtgtatgtttacatccacatataagagcatatatgaatttgtatttctctgtatatgcacatgtgcatgtatgttgcacatgtgtgtatgtacatgtgag

SEQ ID NO: 57906 - DNA, 117 bp, Mus musculus
catacatgtatatatgtatatgtgtatatatgatgtgtatgtatatacatatatgtatatatgtatatgtgtatatatgtgtgcatacatatatatgacatatatattatttatata

SEQ ID NO: 57907 - DNA, 86 bp, Mus musculus
ggtcctagacacaggccagggaagagtccctgagagggctcaatccatgttgggtgcagacttttcactgtggctgctttggggtc

SEQ ID NO: 57908 - DNA, 98 bp, Mus musculus
attgtgttgtcttaataactcccaacaatctaggagctgtaaagtgtatagaagtatatgtcattttcttgttgtaagtttgtggtagactccagaat

SEQ ID NO: 57909 - DNA, 91 bp, Mus musculus
cagtgtgccccactatgtgcttctaatgttcttactgttcagggcctctgtctctgtctttgccaaaacattgacatgatttggtatgctg

SEQ ID NO: 57910 - DNA, 72 bp, Mus musculus
cacaatgtcttatatacagagagctgggagggacacttcttggagtcccttcagagtgtctgtgtgtgtgtg

SEQ ID NO: 57911 - DNA, 98 bp, Mus musculus
gcagcaggagagtgggaaggttggtcatgctgcatttcccagtcaggaaacagagaggtgagtgctggtgtcagctcactttctccttttcactctgt

SEQ ID NO: 57912 - DNA, 73 bp, Mus musculus
ggatgattgagggagagcaaggagtatcagactttcttgttgtgtgatgatttttctctaacttgaagcgtcc

SEQ ID NO: 57913 - DNA, 62 bp, Mus musculus
tgtgtgtgtgtgtgtgtgtgtgtgtgtgtgttcacacacacatgactgtgtgcacacactca

SEQ ID NO: 57914 - DNA, 93 bp, Mus musculus
tgtttgtgtatgtatgtatatgtatatatctatgcatatatattgtgtgtgcatgcatgtatgatgtgtgggagtgtgggtgtaccatggcat

SEQ ID NO: 57915 - DNA, 102 bp, Mus musculus
gtctccttagcccagaatttgcaatgtaagctagactgtgtgtcagtgagccccaggcttctgtctgtctcagtttccttagcacttaattctcttaaagat

SEQ ID NO: 57916 - DNA, 109 bp, Mus musculus
gttttttagatttatgtgtctgagtgttttgcctgcatgtgtgtatgcatatcatatgtatgcttggtgcctgcagaagtcagaagagggcattcaatctcctagagat

SEQ ID NO: 57917 - DNA, 69 bp, Mus musculus
tgtgtgttacctgtatgtatatatgtatgaatgtgtgtaaatgtgtagtatgtgcctacagtgaccaca

SEQ ID NO: 57918 - DNA, 86 bp, Mus musculus
acacctgtgtatgtgtgtgcatgtgcatgagcttgtatgaatgtgtgagtgtgtatatgtatctttgtgagtgtgtgtgtatgtgt

SEQ ID NO: 57919 - DNA, 96 bp, Mus musculus
gatcagccttagtccatggtgatctgataggatgcatgggataatttcaatatttttgtatctgttgaggcctgttttgtaaccaattgtatggtc

SEQ ID NO: 57920 - DNA, 64 bp, Mus musculus
tatacacacatatatatatacatatatacatatttgtatgtatgtatgtatgtatgtatgtatg

SEQ ID NO: 57921 - DNA, 83 bp, Mus musculus
actatatatacagtcttgtgtgcctgcatacactgggacatgtgtgtgcacacactgtggacaaatgtagttattcaaggctg

SEQ ID NO: 57922 - DNA, 65 bp, Mus musculus
tgtctttctgtgtctgtctgatgtgcatgtggggacacacacacacacacacacacacacacaca

SEQ ID NO: 57923 - DNA, 117 bp, Mus musculus
ggaaataactgtaaagcaggttatgagcgttcaataagatctcatgtgtgtatctctctgtgagtatagacaagaggaaaaccttggtcctgttcatgttttggttttggtttttct

SEQ ID NO: 57924 - DNA, 84 bp, Mus musculus
tagaatggctactctagcttctttcttgggaacatttttttttttttgaaaattgttttccaagcctctgaggtagtgtctgtc

SEQ ID NO: 57925 - DNA, 100 bp, Mus musculus
ccgcctgatagcaatcacatccctgatgatctatgaacatactctgcacaggagcatagttcttcacaatgtcacacaaaggatgatgccgacaagatgg

SEQ ID NO: 57926 - DNA, 97 bp, Mus musculus
ggaggtaacttttggtacagagctaagaatgtgttaacctggtagttgttatggttgacatgtgatttagaagaaatgcaaccaccggccactctcc

SEQ ID NO: 57927 - DNA, 112 bp, Mus musculus
atcagggtgagtcctctcatatcaatgagcccaatctaggagtccctcacagacgtgtgtgaggagggagtctagatgctttcagttgatgatcaatattaaccaccatgat

SEQ ID NO: 57928 - DNA, 90 bp, Mus musculus
ttttccttcgcctaggacgtgtcactccctgactggctgcagcccatcggccgagttgacgtcacggggaaggcagagcacatggagtga

SEQ ID NO: 57929 - DNA, 80 bp, Mus musculus
gggctgctgaaacacactcactctatcccgtgcaatgagactagcctcgtgggatataagagctgagtggccagcgacct

SEQ ID NO: 57930 - DNA, 90 bp, Mus musculus; identical to SEQ ID NO: 57928

SEQ ID NO: 57931 - DNA, 101 bp, Mus musculus
ttgtgtactggggctggagagatggctcagcaggtaagagctctgactgctctttcagaggtcctgagttcaattcccagccaccacatggtggctcacaa

SEQ ID NO: 57932 - DNA, 61 bp, Mus musculus
cttgacttcatgtttccattgcccaaagaattttcccaagcagtggaatcatgaaagaagg

SEQ ID NO: 57933 - DNA, 77 bp, Mus musculus
ggggagggagtagggtagaggttaaagttcaaaagcccatgccaggcccagcttctctctgtctctatttctatttc

SEQ ID NO: 57934 - DNA, 81 bp, Mus musculus
atatgcatatgtatatatgtgtatatatatgcatatgtatatatgcatatatatatatatatatatatatatatatacaca

SEQ ID NO: 57935 - DNA, 105 bp, Mus musculus
atggaaggaagatctctttctctcaaggcaataaaaggaagcatcttttttttttttaagttatgtttattttagtgttttgtgtgtgagagtctgtctgtctgt

SEQ ID NO: 57936 - DNA, 106 bp, Mus musculus
tcccttctctaatcagtatggtcattagcagtgattgcattagagaaagtttgcaaagagtctttgtatttgtgattaaaataatgattcaggctggaaagatgga

SEQ ID NO: 57937 - DNA, 112 bp, Mus musculus
taattggccttcttcctgagctgttggattcggggccgtagcactgtctgagaggtttacatttctcacagtgaaccggtctctttttcagctgcttcctgacttcttttta

SEQ ID NO: 57938 - DNA, 86 bp, Mus musculus
gggtagactgacagagacagagaagacattgagcacaaactaaatcaagtttgtcacttggtctctgtgtttgcaagtggaggcgc

SEQ ID NO: 57939 - DNA, 99 bp, Mus musculus
tggctatatcatttgggcaggttccctatgtagcatgtatgtatgtatgtatgtatgtatgtatgtatgatgtatagtgcttcctaaatgtttcttcta

SEQ ID NO: 57940 - DNA, 126 bp, Mus musculus
gtgtgtgtgtagtgttagacaggccctgagcatgctgtctcagcactccagcactctgtcacggtctctccctctgcagctttaactaaagggtgtggcatcagggaagagctgagatgcaattgc

SEQ ID NO: 57941 - DNA, 84 bp, Mus musculus
tcagaagaaacctatcaaatgcactttttgttattcataaaaactagtgtttctgtgattgtcagttgagtgtgggtattttgg

SEQ ID NO: 57942 - DNA, 117 bp, Mus musculus
cactggttggctgtcccctccatttctgctccatctttactccagcacatcttgttgacagaagaaagtgtgggtctaaggttttgtggctgggttggagtcccaatccctccattg

SEQ ID NO: 57943 - DNA, 70 bp, Mus musculus
tgaagacagggtaaccaatcagcatagcctaaatggatgagcctcagggtcagtgtgtggctctgtctca

SEQ ID NO: 57944 - DNA, 85 bp, Mus musculus; identical to SEQ ID NO: 57470

SEQ ID NO: 57945 - DNA, 90 bp, Mus musculus
gccttcatgattggagtcttctgtttttgttggaacagcatgtgagtttaagagttttgtgtcggggggggggggcaccagggagatggt

SEQ ID NO: 57946 - DNA, 118 bp, Mus musculus
tttctattttagtgagtcagtagaaatctgatttttaaagtacagagcttgcttttactactctgtgtgtaattctctgtccatttagaactgatatttaaaaaaaacaaggaagaaa

SEQ ID NO: 57947 - DNA, 76 bp, Mus musculus
ggtgactctgataccatttccggacactactgtgacactactgtgcacagtctctctgtggttctcatattgcatc

SEQ ID NO: 57948 - DNA, 108 bp, Mus musculus
gtgggaagtgtctagggggagtggggaggaaattggaatatatatatatatatatatatatatatatatatatgttttgatatattgctataattgtatattttacat

SEQ ID NO: 57949 - DNA, 85 bp, Mus musculus; identical to SEQ ID NO: 57439

SEQ ID NO: 57950 - DNA, 66 bp, Mus musculus
tgtcggtctgtctgtctgtttgtctgtccttctaaaacaaacagacagacagacagatgtgccaca

SEQ ID NO: 57951 - DNA, 95 bp, Mus musculus
gtccctgaaacagcaggggtctgtgtcaatgtctgtgtcccatgttaccaccataggctgtgcagacatccctgatctgggctgtctcctggggc

SEQ ID NO: 57952 - DNA, 81 bp, Mus musculus
ggtgttcaagcaggttccccaccaactggagcagagggcgtccttgagcctgttgcctccctgcctgcctgcctgcctgcc

SEQ ID NO: 57953 - DNA, 81 bp, Mus musculus
tccagccagtacccaagaactgagaatccctgtctcttagtcactgtgagagcagaatgtcagctttagtagctggctgga

SEQ ID NO: 57954 - DNA, 88 bp, Mus musculus
tatatatatatatatatatatatacacacacatacatatatacatatcaatatgtgtgtatgtgtatatgtatatatgtatatgtgta

SEQ ID NO: 57955 - DNA, 113 bp, Mus musculus
ttggctagggagacctcttggccataggtgtgcgtgtgtgcgtgcgtacgtgcgtgcgtgcgtgcgtgcgtgcatgcagatgacctgggacactgaggctccctgggtgccga

SEQ ID NO: 57956 - DNA, 68 bp, Mus musculus
gtcagctctgcaaagggaaacaaggggaggatgtctgcgacatgctcatctctctttgtatttctgat

SEQ ID NO: 57957 - DNA, 119 bp, Mus musculus
ccaccagcttaagggtgactcaggtgaaagctgttcacttctgcagataaatatctctaatgagaatttgtacatgtgagcccagtttccacagtgaaattaggtagtctgtttcgtgg

SEQ ID NO: 57958 - DNA, 70 bp, Mus musculus
cccagcaagagaagcagcttgtaggtagcatagtatcctccagtacttacttcagatgtattgtgttggg

SEQ ID NO: 57959 - DNA, 102 bp, Mus musculus
agtggaattagttccttccatatgttaaaatacattctactcatcactagtgaaattgctgatggatggaaaattttttctctattgtggtgaactatccct

SEQ ID NO: 57960 - DNA, 93 bp, Mus musculus
gtatgtatatatgtatgtatgtatgtatgtatgtgtatgtatgtatgtgtgtatgtatgtatgtatgtacgtatgtatgtatgtatgtttata

SEQ ID NO: 57961 - DNA, 69 bp, Mus musculus
ccctaattacgtcctacctggagtctttctatgctggtgtctaggggaactcagtgaggacagacaggg

SEQ ID NO: 57962 - DNA, 63 bp, Mus musculus
taggggtcagagatgtgactgtggaatggcaacaccatctctcacttgatgtctctctcccta

SEQ ID NO: 57963 - DNA, 90 bp, Mus musculus
caggtttacaaagtactagagatcgaatgcaggggttcctgatcatccctgcatttcctaatagtttctaattattttagtgtaaacttg

SEQ ID NO: 57964 - DNA, 84 bp, Mus musculus
ttgtctcatatatatgtgtgtgtgtatgtgtatatatatatatatatatatatatatatatataaaatcacactatacagacaa

SEQ ID NO: 57965 - DNA, 93 bp, Mus musculus
tcagagagctttatttttcaggtacatagattattttctttgtatatatcattggaagcattttgtctgcctataattcttaaggcttttagg

SEQ ID NO: 57966 - DNA, 93 bp, Mus musculus
attaatgcctttgctttgtctcagagtcacacagccagtgtcacaaccacacatggagggacagtcttagataagggtggagcccagcttgat

SEQ ID NO: 57967 - DNA, 99 bp, Mus musculus
acatgcacatgtggatatatgtatgtgtctttgtgcctgtgtgtgcatgtgcatgtattccataggcatgcatctgtgtgtatatctgtgtgtgtgtgt

SEQ ID NO: 57968 - DNA, 65 bp, Mus musculus
tctaggacatcagcacactctctgtcactgataaagtcatgccagtgtgtgtttagacttctaga

SEQ ID NO: 57969 - DNA, 79 bp, Mus musculus
ttcccacaagtctctctctctctcttagaaaagagaaaaaatattttaaaagcaagagagagtagatgtctgtagggaa

SEQ ID NO: 57970 - DNA, 85 bp, Mus musculus; identical to SEQ ID NO: 57439

SEQ ID NO: 57971 - DNA, 92 bp, Mus musculus
tgtactccagtttatctggaaaaaaatcacacaaaacattttttatatacttattttgtttgttgtgttttgtgctgggaattggtagtaca

SEQ ID NO: 57972 - DNA, 60 bp, Mus musculus
catgtatatacatgtgcacatgcatatatatatatgtgtgtatgtatatatgtatacatg

SEQ ID NO: 57973 - DNA, 109 bp, Mus musculus
tgaacacagtgaatcctgtgtctttgttttatgttggagcatcttctgaatatatatatatatatgcccaggagtggtagagctgggccctcaggtagtactatgtcca

SEQ ID NO: 57974 - DNA, 68 bp, Mus musculus
agtggacatcgttttaggttgtatacttaggccagcctctgacctgtgaccttgtaatggtatcctct

SEQ ID NO: 57975 - DNA, 60 bp, Mus musculus
gtgtgtgcatgagcatatgcatgcgcatctgtgtgtgtatgtgtgtgtgtgtgtgtgtgt

SEQ ID NO: 57976 - DNA, 79 bp, Mus musculus
gaagaagccagtgtgcatgatacagtgtgtgtgatacagtgtgtgtgattcagtgtgtgtgatacagtgtgtgtgattc

SEQ ID NO: 57977 - DNA, 115 bp, Mus musculus
ctgtttctagtgtgcttcttttagatcccaaagctaagtaagaacatgcactatttgtctttttgttctacatattttccagttttggtttttgagacaaggtcttactctacag

SEQ ID NO: 57978 - DNA, 70 bp, Mus musculus
tgtgtgtgtgtgtgtgcgagtgtggagagacagacagacagacacacagacagacacacagacagacaca

SEQ ID NO: 57979 - DNA, 73 bp, Mus musculus
tgtcacacttgccagcctattttgtgacctgttacatctcttataggtgctgagtctctgagtgtgtgtggca

SEQ ID NO: 57980 - DNA, 85 bp, Mus musculus; identical to SEQ ID NO: 57439

SEQ ID NO: 57981 - DNA, 110 bp, Mus musculus
tcgaagatcagccttagtctgtggtgatctaatagggtgcatgggataatttcaatatttttgtatctgtggaggcctgttttgtgacggattatgtggtcaattttgga

SEQ ID NO: 57982 - DNA, 76 bp, Mus musculus
cagcattcataggcagaagattcgaggtgctacattggttattgtgacagactttctgtctgtccttggaaggttg

SEQ ID NO: 57983 - DNA, 109 bp, Mus musculus
attatgtggcaggagtgtttcttttctggtctactctaatagatattctataagcttcttgtttgtttatagacatctctatttagttaggaatgtttacttgtatgat

SEQ ID NO: 57984 - DNA, 103 bp, Mus musculus
atccatattcataagggaaattggtctgaagttctctatctttcttggatctttctgtggtttagatatcagagtaattgtggcttcatagaatgaattggat

SEQ ID NO: 57985 - DNA, 87 bp, Mus musculus
ttcttttttaggggtgggaggtcacaagagtaggggacagacctgggaggactctgaagtgactgtgctcagggctcataattggaa

SEQ ID NO: 57986 - DNA, 81 bp, Mus musculus
ttggctttgggcatggaatgtagggttttggtggcaggagctggaaactggccatctgcatctgcatctgcaagaaggcag

SEQ ID NO: 57987 - DNA, 80 bp, Mus musculus
gctacacaactgtaacatgtacacaaggccttagtcactcccatgcaggctcccttgttgacagttcagtctctgtgagc

SEQ ID NO: 57988 - DNA, 107 bp, Mus musculus
cataacaaaaagctggagcaaatgcacacagcataggatacaggtagaaaactgattttttttttccagaggattctggctggaatatctgctttactttttctgtg

SEQ ID NO: 57989 - DNA, 86 bp, Mus musculus
ggtcttatatattcaggaaagtgatgcagactaaatatatgatttgagaattcatagtatttgatgtcatatgaatgtataagact

SEQ ID NO: 57990 - DNA, 99 bp, Mus musculus
gctatagtctcttggcaaccctcatgcctctcttcagtttgaagtattgctgccagtattctcagtagagatggtctgatagccatgaacttgtttagc

SEQ ID NO: 57991 - DNA, 81 bp, Mus musculus
tctcctgtgtgtatctgtgtgtcgctcatccacgctttgcccacccgcatcgagagaccccgttccacgcagacacaggga

SEQ ID NO: 57992 - DNA, 116 bp, Mus musculus
attgaaactgaacggttataggtacaaaattgtcaaaagataacagatgaaacagtgcactaaaattgtctttatcttggttaccggggatttttactttccttccttgttttgat

SEQ ID NO: 57993 - DNA, 58 bp, Mus musculus
ggggctctgggagtagggagactgacactctaacagtctactcactttctgtagtctc

SEQ ID NO: 57994 - DNA, 84 bp, Mus musculus
gaatttcatacagtgtgagtagggatctagtttgttcttctgtaaatgggcagtcaatttctctagtgattttgttgaagattc

SEQ ID NO: 57995 - DNA, 79 bp, Mus musculus
acatcattatatatatgtgtgtgtatgtgtatatcattatatatgtacacacacatatttgtcaatatactttgcatgt

SEQ ID NO: 57996 - DNA, 66 bp, Mus musculus
tttacctaatgtatgtatttatgtatgcatgtatgcatgcatgcatgtatgcattatgtaggtagg

SEQ ID NO: 57997 - DNA, 91 bp, Mus musculus
tctgttctctttttcctcccagcagggagctgttcagaacttcctccagtggacaatagtgtatttgttgataaggaaacagaaggacaga

SEQ ID NO: 57998 - DNA, 98 bp, Mus musculus
agatcagccttagtccatggtgatctgataggatgcatgggacaatttcaatatttttgtatctgttgaggcctgttttgtgaccaattatatgatct

SEQ ID NO: 57999 - DNA, 75 bp, Mus musculus
caggggtggtagctctgagtttagaaaggctttggaactaagataagtgtgtctatctctgagtcctggcttctg

SEQ ID NO: 58000 - DNA, 86 bp, Mus musculus
cctggcgtgtggtaggtcctccagagttgtgtgaggcatcagagagatgacttgtgtcagagccagaggacctgcagagtctcagg

SEQ ID NO: 58001 - DNA, 85 bp, Mus musculus
ttcatgtcatctctttctgcttgatcttgtcccttggaagtccccttcgttcttgattggtgcagagagaaatgagagtgagcag

SEQ ID NO: 58002 - DNA, 118 bp, Mus musculus
cagagacagatgagcaagagacccgacaccggacaggcgtctctctagatttacctagtctcctgtctagtctgtgtgtgtctctggatgcatgtggcctgactgggctgtaggagac

SEQ ID NO: 58003 - DNA, 62 bp, Mus musculus
gccagaggttgggggaagagttagccagctcgactcgcagtctcactccctgatttctcggc

SEQ ID NO: 58004 - DNA, 71 bp, Mus musculus
cagacagaatttacacatcattcacatcacagtagtctatttttactttatgtatatgagtgttttgtctg

SEQ ID NO: 58005 - DNA, 85 bp, Mus musculus
gagttgggccactggggtgttgctttcagaggagagagtgagctgcttgtctctctttctctttccttcttcagtgtgtgagctc

SEQ ID NO: 58006 - DNA, 101 bp, Mus musculus
cttccattcacaaagtgctgagtgtggcctctcgtgagtggctcagtggtaatctatgggagaacagagtgcgcacagttaatggcgctagaaacaggagg

SEQ ID NO: 58007 - DNA, 107 bp, Mus musculus
cagagactgccattaaatctggggctagtctgtctgtctgtctctgtcccccatagccctgggactacaggcacatggaccgctttttacataggtactaagatctg

SEQ ID NO: 58008 - DNA, 76 bp, Mus musculus
ctatgagcctgcctgcctgtctgtctatctttctgccatttggatagtttcagctctgagcccctcaggcttctgg

SEQ ID NO: 58009 - DNA, 108 bp, Mus musculus
atacaactttagtgtgggttttttccttgacattactttattggcctctgtctcttacagtctgcctcttgggtcttgctcattgaaaacggcttgtaaacattgtgt

SEQ ID NO: 58010 - DNA, 88 bp, Mus musculus
aggacggcctggagatggggtgaggaggcaggctctcaggacccaagtctctgtggctgttcttataattctgaactaatccagtgcc

SEQ ID NO: 58011 - DNA, 107 bp, Mus musculus
gccttagcccatgttgatctgataggatgcatgggacgatttcaatatttttatatctgttggaggcctgttttgtgaccaattatatggtcaattttggagaaggt

SEQ ID NO: 58012 - DNA, 81 bp, Mus musculus
tctctctgtctctgtctctcatacttgatccctagttggtgaaactatttgggaaagtttaggaggaaagttgttggagga

SEQ ID NO: 58013 - DNA, 103 bp, Mus musculus
atcatgaaaatggtggtaattgaactggtgagatggctcagtggttaagagcactgactgctcttccagaggtcctgagttcaaatcccagcaaccacatgat

SEQ ID NO: 58014 - DNA, 93 bp, Mus musculus
gtgtaatttgtcttattcactatcaccctgttaaattgctctacagctgctgtggcagtaatcacagtgatcagtgattcagacttattgagc

SEQ ID NO: 58015 - DNA, 82 bp, Mus musculus
gagatgagattttctttttttgtagctcaaacaggacttgaccttgctgtgtagctcaagatggttttgaacttctgatctt

SEQ ID NO: 58016 - DNA, 90 bp, Mus musculus
tgtgtctgtatatacacacatttgtatatgaatatatcttaactatatgtatatggttgtatgtatgaatgtgtgtacacaacattcaca

SEQ ID NO: 58017 - DNA, 69 bp, Mus musculus
atggaagtgtattagagacatcttatctagggcagttaggctagtggtgtgtgtctgtcactctttcgt

SEQ ID NO: 58018 - DNA, 108 bp, Mus musculus
tagaagaaaggaaaatgacagttttaatgaagggactgaaggtggcactgtcactgtgtcacctcaaagtcaggatgtctaaaatagtgttcattttcttagcaactg

SEQ ID NO: 58019 - DNA, 96 bp, Mus musculus
tttctttaaccctcttgcccctcactgagacactggctgttctcttcctggcatgtggaaggtgcacccacacagtttataagtaagacaaagaag

SEQ ID NO: 58020 - DNA, 108 bp, Mus musculus
ggcctttttacccgcgtcagtgaattctaggactaggggattgcatcgacccccctgtgtggcaccctggatgccactggagaccgctgaggaatcataacaggggcc

SEQ ID NO: 58021 - DNA, 84 bp, Mus musculus
cacagatggagaattgatgaggagagagtctgcagaaggtatgaggagggtttgactctctctctctctctttctctctctgtg

SEQ ID NO: 58022 - DNA, 100 bp, Mus musculus
caagtgtatatgtatatatgtgtatatatgtatgtgtatatgtatgtgtatatgtatgtgtatatgtgtatataaatgtatgtgtatatatgtatatgtg

SEQ ID NO: 58023 - DNA, 95 bp, Mus musculus
agcggctggctgggaataggtgagagtggacagagacctgactgacacagtggccattcactactctacaactccttctccaccctctttctgct

SEQ ID NO: 58024 - DNA, 79 bp, Mus musculus
aactcaagattcaggaaggtatagagatggtcaacagttaagagcactgactgctcttccagaggtcctgagctcagtt

SEQ ID NO: 58025 - DNA, 70 bp, Mus musculus
gtatgtatgtatgtatgtatgtatgtatgtatgttatgtatgtgtatatgtatgtatgtatatatgtaca

SEQ ID NO: 58026 - DNA, 115 bp, Mus musculus
atctaagccagaccctcctacggccaggcaccatttctctctggagtggctctgtggtctgtgactcacagagtcccattgggaatggagctgcaccctgatgtgtggcagagat

SEQ ID NO: 58027 - DNA, 115 bp, Mus musculus
gccactggacccctccgctctgctgtggcctatggcttttcattcctatgtgattgctgctccgaactcatgtagggctaaaagccatgggctacagtgaggggcaagctcctgc

SEQ ID NO: 58028 - DNA, 83 bp, Mus musculus
aggctcagatccacggggagctgacaagggaggccctggttctgctcacaccactgtctccctctctctgtgaacttcgtcct

SEQ ID NO: 58029 - DNA, 81 bp, Mus musculus
gcctggaactggagttagagacagttgtgagccaccacgtaggtgctgggaactgaacctgtgtctgatgtaagaacaagc

SEQ ID NO: 58030 - DNA, 79 bp, Mus musculus
ctagccactgtatctctttgctcttctgtattgccaattgaagtgggggcaatgagagtaaagagttagcagaggtgag

SEQ ID NO: 58031 - DNA, 70 bp, Mus musculus
tatatgtatatgcatatgtatgtgtccatgtatatgaatatatgtatatagacatgtgtatagacaggta

SEQ ID NO: 58032 - DNA, 87 bp, Mus musculus
gacccctccctttcccagcaggctctgggtgtgagagtatgcatgtatatggatgtgtctctctgagtctcctgtgccacctctgtc

SEQ ID NO: 58033 - DNA, 86 bp, Mus musculus
gcactgatgaagagggcaagcagtgggtgactttaccaacacccttcccaccccgtctgcctgtctgtctgtctgtctctccctgc

SEQ ID NO: 58034 - DNA, 87 bp, Mus musculus
caaatatacacgatgtatgtatgtatgtatatatgtagtatgtatgtatgtatgatgcatgtatgtgtatatatgtatgtagtatgt

SEQ ID NO: 58035 - DNA, 189 bp, Mus musculus
ttttcagtgttattcttatgcctgatgatgttgcaaaccattcaaattattttttaaaacatttatttatttatttatttatttattcatggtgaggcatggggctggagagatggctcagtggttaagagcactgactgctcttccgaaggtcatgagttcaaatcccagcaaccacatagtggctca

SEQ ID NO: 58036 - DNA, 84 bp, Mus musculus
gggaaagcaaggtgaaggcgctggttcacggagggaggctgtcctccgtatgtgcacacaggcactcactgactgtggcatccc

SEQ ID NO: 58037 - DNA, 99 bp, Mus musculus
ggagatttctctctgtctgtctctgcctctatctctgtctcacctagaaaagaaaacttagaagaagaaaagtaggaggaagaagagaaggaaatcttc

SEQ ID NO: 58038 - DNA, 75 bp, Mus musculus
gctacccactctcagtctctatctctgggcttttgtggcagtgaaggtttagctgaggaggccaagaacaggagc

SEQ ID NO: 58039 - DNA, 94 bp, Mus musculus
tccttttaacaaaaggcttctttttatttttacatgtgtgtctgtatgtgtgtgtgccacgtgtgtgcaggtgccagcagaggccagagagggg

SEQ ID NO: 58040 - DNA, 97 bp, Mus musculus
gtctgccaggacgtccgtcctcagctttggtggtggtcattgtctctctctgtctatctgtcatcaccacctatttgagtgacctcggctggcatcc

SEQ ID NO: 58041 - DNA, 82 bp, Mus musculus
tacatgtatatgtatgtatatgtatgcatatatatgtatgtatgcatctgtgtgtatacatatatatgtatatatgcatgtg

SEQ ID NO: 58042 - DNA, 82 bp, Mus musculus
atggaaagattggggatgaagatagaggggaagggaggaatctgtctgtctgtctgtctatcatctatctttatctatccat

SEQ ID NO: 58043 - DNA, 85 bp, Mus musculus
gctgaaaacttccagggctggagagatggtgcagcgggtaatagcactgactgctcttccagaggtcctgagttcgattcacagc

SEQ ID NO: 58044 - DNA, 71 bp, Mus musculus
cttagcgtcgtgctagcagctgaagacaagtcgtccttggactgacagactgactggcactttggcagaag

SEQ ID NO: 58045 - DNA, 77 bp, Mus musculus
ccttgcagcctctctgtgtttctcaaactccatgtggtgactcaccagtgggtgtgaaatcaagagaagggtcaagg

SEQ ID NO: 58046 - DNA, 68 bp, Mus musculus
gtctgtctgtctgtctgtctgagggtgtgggcatatgagtgtaggtgtccaagaatccagaagaaggc

SEQ ID NO: 58047 - DNA, 93 bp, Mus musculus
ggctcttataatgctgactctcggtctgaatctgtagtcgctacatccagggcacacatacagtgttcagttctcttgggttcagaagcagcc

SEQ ID NO: 58048 - DNA, 63 bp, Mus musculus
ggagagacctggatggcagagctgggcgcactctgtctggctctgaccatttctagactcttc

SEQ ID NO: 58049 - DNA, 118 bp, Mus musculus
cagggaatgcagaggaacaagaggtagaggccagggacaaggtagatctctctcaggcacactctcaatgatctatttcctctaagtaggactcagcttctaatttccatcctgttcc

SEQ ID NO: 58050 - DNA, 77 bp, Mus musculus
tactcatctgtttgtctgtctggtaaaggattttgggttggactcactagtccttattggaaacattaggctgagtg

SEQ ID NO: 58051 - DNA, 117 bp, Mus musculus
tgttatcccaatcgttcaacatctgcatcatattttgtaaacattcttctctgtcacctgattggtgtaataaagagcggatggcttacacctgaggcaggagaggaaggggagaca

SEQ ID NO: 58052 - DNA, 73 bp, Mus musculus
ggtctctcatcaaagatagagcctacagttgcagccagactgtctgtctgtcctggaactcactctgtagacc

SEQ ID NO: 58053 - DNA, 77 bp, Mus musculus
gactgagcaagccgcggagagcagaccagtaagcaccatgcctcaggtgctctcttcagttcctgccttgcttcctc

SEQ ID NO: 58054 - DNA, 118 bp, Mus musculus
tgacttggagccgagctccaggcactgtgaaaaggaggagcagctgtgtccctgtctctgctctcatgctgtcactctcttcttcctcacaggccccccaagccaatggttcccttca

SEQ ID NO: 58055 - DNA, 95 bp, Mus musculus
gatggccctattttagcttctggaccaggactgaagccagcctaggaactgaatgggttggactgtctgtctatctgtctgtctctctctccatc

SEQ ID NO: 58056 - DNA, 85 bp, Mus musculus
gtgtccgaagctggcctaggcaatggaatcagagactatttatctcttggtctgtctgcctgtctgtctatgtctctctctgcac

SEQ ID NO: 58057 - DNA, 65 bp, Mus musculus
aagatggaggaaggaggctaggaatctgggagccctttctgggactcaaagtctctctctatctt

SEQ ID NO: 58058 - DNA, 74 bp, Mus musculus
cctgcagctcctccaggtctctcgatctctgactgaattagacccaggccccagaaacctgaggaagctgtggg

SEQ ID NO: 58059 - DNA, 109 bp, Mus musculus
ctctgagtctgtccagctgtctcccctccctctcctttccagtctacccaatgactgatgactgacaggaggtcctggagttgacactctggtatggcctactgcagag

SEQ ID NO: 58060 - DNA, 78 bp, Mus musculus
ggtcatctggaaggtcagagggcagggttaagatttaatacctcaaccctagctctgactgcctctcttcaggtcttc

SEQ ID NO: 58061 - DNA, 73 bp, Mus musculus
gcccactgccactgcctgtgtctgtatctgtctcctagccaggaggcaggcagacagatgcaagtggcctggc

SEQ ID NO: 58062 - DNA, 88 bp, Mus musculus
tgtgtgtgtgtgtgtgtgtttgttcttacctctctcagtatttctgtctataacagatttaaagaacaaagccactcaagccaacaca

SEQ ID NO: 58063 - DNA, 68 bp, Mus musculus
ccttcagagatcagggtagagttgaggggatgtggcttctgactcctcactctgtcaggtgtctgtgg

SEQ ID NO: 58064 - DNA, 102 bp, Mus musculus
ataggattgttgatttctaggtcatcatttgtatatagaaatgctagaacattatttgtatataaaagtgtacagacttttgttgttgacattgcatcctat

SEQ ID NO: 58065 - DNA, 78 bp, Mus musculus
tgtctagaaggcgctatgggggatgggggaggcacttgaagatccgcatgagtcagatctgtgtgagctgtttagata

SEQ ID NO: 58066 - DNA, 78 bp, Mus musculus
cagccagatctctcaatcattctctcagtgtgttcctgctctatctgagaagcgatgagagtgggaggggcttgggag

SEQ ID NO: 58067 - DNA, 115 bp, Mus musculus
cgtttaagcacgtttcacttttcccagcctcttttcgtgtcacacgctccctcgctccctgtgtccagtgtgggaggcggggcaggaactggaagagaggaagcaggctcaaggg

SEQ ID NO: 58068 - DNA, 75 bp, Mus musculus
gcttctgagggtctctgttcagcctaggaaaagtagtcttagtgacccaggggtgacaggtgacagtgggcaggc

SEQ ID NO: 58069 - DNA, 95 bp, Mus musculus
ggaaggaaggaaggaaggaggaaggaagaagcagggttgggggctgagtcagaacactgactgctcttccagaggtcctgagttcaaaccccagc

SEQ ID NO: 58070 - DNA, 90 bp, Mus musculus
tctctttcctctccaggtctgagagtgtagactgctgggcaggagctgtggtctcactctggccctcactcctatgcagagaaaaaggga

SEQ ID NO: 58071 - DNA, 78 bp, Mus musculus
gtctgcaggccagccttcccagcactgagactctgtgtcaaataaacagaggagtgggatggagagggaaccttatac

SEQ ID NO: 58072 - DNA, 61 bp, Mus musculus
ggggatggctcagaggttaagagtgctggctgctcttccagaggtcctgagttcaattccc

SEQ ID NO: 58073 - DNA, 87 bp, Mus musculus
gtaccatgtgtatgtggtgtctgtagactgtcagatctcctgggggtggaattacagacagttgtgagccaccatgttagtgctatg

SEQ ID NO: 58074 - DNA, 69 bp, Mus musculus
gcagaagcagacagatctctgtgagttcaaggccagcctggtctacagagcacgtgtgtgtgtgtgtgt

SEQ ID NO: 58075 - DNA, 71 bp, Mus musculus
atatgtgtatatatatcatattcatatgcatagttatataatatatatgttatatgtatatatacatatat

SEQ ID NO: 58076 - DNA, 67 bp, Mus musculus
gccagtgtctgtgtgtgtgacagagaaaagccgtgggtctttatgtgccacagtgcagggatggggt

SEQ ID NO: 58077 - DNA, 112 bp, Mus musculus
tgtatgtatgtatgtatgtgtgtatatatatatacacacatatataaatgtgtatacacacatatatatgtatatatatgtatatatatatatcatttaaatagtactcaca

SEQ ID NO: 58078 - DNA, 98 bp, Mus musculus
gcagcgaagagctttagaattgagtaaggtgtctttctctgagtctctgagagaagataggccatggaactgtgtcttagtcagtgttctattgctgt

SEQ ID NO: 58079 - DNA, 78 bp, Mus musculus
ctaactcctccattgggtccctgtgctcagtccaatggttggctgtgagcatctggatctgtattggtcaggatctgg

SEQ ID NO: 58080 - DNA, 59 bp, Mus musculus
gaccttctctgccagcacagttctgagtctttcacacaggactgacagcagctggagtc

SEQ ID NO: 58081 - DNA, 135 bp, Mus musculus
tttgtgtttgtatgtttatgcacatttgtgtgagtgtggaggtcagaggacagtttgtggtagttggttctttccttctattctgtcaagtttggtggtaagcatcttacctacagagtcatcttgcagcctcat

SEQ ID NO: 58082 - DNA, 75 bp, Mus musculus
gggtctctgctacatgggcaacaggctctgctatatgagcttacagagcctctgtgtgtgtgtgcagaaggattc

SEQ ID NO: 58083 - DNA, 77 bp, Mus musculus
tgccatgtggatcctgagaatgaagtcaggctcgggggtaagggcctttacccgctgagctgtctcactatacagta

SEQ ID NO: 58084 - DNA, 61 bp, Mus musculus
tctgtctgtctctctgtgttgtgtgcctgtatgtaggtgacctcagaggtcagaagaagga

SEQ ID NO: 58085 - DNA, 68 bp, Mus musculus
gcatgagtctgtctctgagtccgagtccgtctctttgatggggctttttttactatcagattcggagc

SEQ ID NO: 58086 - DNA, 93 bp, Mus musculus
cttacctgggggtctctcacccactgtgagattgaggattagaatttatgtacccctcatcacaacggaagtgcagaggctggaccaggcagg

SEQ ID NO: 58087 - DNA, 82 bp, Mus musculus
ggtacacaaccataactgtatacagagggcctagctcagacccatgcaggctccctgattgtcagttcagtctctgtgagcc

SEQ ID NO: 58088 - DNA, 105 bp, Mus musculus
gcttcctacatgtgtgaatgagtctgtgtgtatgtggtacatgtatatatgtatgtatgtatgtatgtatatatgcgtttatgagtgagtgtgtatgtggtatgt

SEQ ID NO: 58089 - DNA, 60 bp, Mus musculus
gtgtgtatgtgtgcatgttcacatgtgtatgaacatatgtatgtgtgcatgtgtactcat

SEQ ID NO: 58090 - DNA, 144 bp, Mus musculus
tacatatatataatatacatgtatatattatatacatatatatacatatatacatacatgcacacatatatgtacgtatatatatgtctatatatacatgtatgtatatgtgtatatgtatgtgtgtgtgtgtatatagtttgt

SEQ ID NO: 58091 - DNA, 69 bp, Mus musculus
gaatcgggggctggagaagtggctcagcagttaaaaagcactgactgctcttccagaggtcccgagttc

SEQ ID NO: 58092 - DNA, 62 bp, Mus musculus
gaaccaagactgtagaccaagctggcctcaaatgcctgactctgtgtctcagtgctgggttc

SEQ ID NO: 58093 - DNA, 91 bp, Mus musculus
gcctttctagttgtgtgtctgtactacagtgtaattatagaaactttatgcaatgtttacatgtctgtagagcttgtccctcctgggaggc

SEQ ID NO: 58094 - DNA, 82 bp, Mus musculus
ggttttttgggattgttgggtgatttgcttgtctgaagttgggtgcatttagaggtcaaatgactcccagctatcttgagcc

SEQ ID NO: 58095 - DNA, 92 bp, Mus musculus
tttatttatggatattagaatatgaatttcaattttttgttatggaggggtgaccgggaagggaaatatcatttgaaatgtaaatgaataaa

SEQ ID NO: 58096 - DNA, 75 bp, Mus musculus
gctgtcctctctgacagtctgcagggctgtgggttgaatatcgccccgcaggactgcttctgctgtcaagtcggc

SEQ ID NO: 58097 - DNA, 82 bp, Mus musculus
cggcccacgttctgagagaggtgtgagtgctcatgggagtgttggtggatgctcagataaggatctcagagcatctgggctg

SEQ ID NO: 58098 - DNA, 77 bp, Mus musculus
gaaacaaacgagggctgaagagatggcttagtggttaagagcactgactgctcttccagaggtcctgagttcaattc

SEQ ID NO: 58099 - DNA, 78 bp, Mus musculus
gggaagcttggggctgacgagatggctctgcagttaagggcactgactgctcttccagaggtcctgagttcaattccc

SEQ ID NO: 58100 - DNA, 110 bp, Mus musculus
gcacaatgtatatatggaagtcagaggacaacttgtaggaattgattctctctctctatcacttggatcctgaggattgaatccaggtagtcaggtttgcaggcaagtgc

SEQ ID NO: 58101 - DNA, 93 bp, Mus musculus
acccaggaggcaggggcaggcagatctctgtgagctcagggctagcctgatctacatagcctgttccagccacgcccctgcccccaaaaaggt

SEQ ID NO: 58102 - DNA, 98 bp, Mus musculus
ctcattctatattgctcatatacagatgaatatttatatgtgaatattatatacatagatctcatatatatgtttatatatgagagcaagggagagag

SEQ ID NO: 58103 - DNA, 117 bp, Mus musculus
ctaagatgaagtgatggctcagggcattgtgatacagcttggctgcctggctctctgactgccaggctggaggcagggaagggcagcaggatgtgtggccaccaatactcgctttgg

SEQ ID NO: 58104 - DNA, 83 bp, Mus musculus
tgacaacaggatggggagaggggaggtgggatgcatcgtgctaagagaagggccagagacactcacactttctggttgtcatt

SEQ ID NO: 58105 - DNA, 95 bp, Mus musculus
accttatgcttctaacatgctactactgtctctctgtgagtcagcctttaagaaattttacagtggcaggagatatagcttagttggtagggggt

SEQ ID NO: 58106 - DNA, 111 bp, Mus musculus
aagtaagtaagggattatttgtaacagtcttgtttggaaccactctaagtcactgtgtgagtaaccagttcaggactgttcctgcctcgctgatggttccctgccctgctt

SEQ ID NO: 58107 - DNA, 60 bp, Mus musculus
catacacacacatacacatgtatgtatgcatgcatgcatgtatgtatgtatgtatgtatg

SEQ ID NO: 58108 - DNA, 89 bp, Mus musculus
cctgctgtcaatcacggaaggcaggagacacatggtgtacattctcactggctgtctcagttccttgtgtgtaaaacagctaattcagg

SEQ ID NO: 58109 - DNA, 87 bp, Mus musculus
tgtcacccagagagctgcctgcacctgctcctgtctgtctgtctatctcttggccacagagcaagcttgtaggggctgtgggccaca

SEQ ID NO: 58110 - DNA, 116 bp, Mus musculus
cctgggtgggggtgggctctgctttctttgcagcagtggtctccttatcaaagaaatcaaaatttttttttgttcagtcactcagagataaggagctcccagaccttctcctgagg

SEQ ID NO: 58111 - DNA, 97 bp, Mus musculus
ctctcctgttctatgccatgttctctgtcactgcctccctctggtgggtgggtggggggtggcctttgagccctataacatgtggcgcaagggagag

SEQ ID NO: 58112 - DNA, 70 bp, Mus musculus
caggcgcagctgctctgactcctgggtaagaagacacacattcaggaagacacagacacctctatgcctg

SEQ ID NO: 58113 - DNA, 79 bp, Mus musculus
gccacttggctctgtcactggttctgaggcctggtgccctggacattcagatgccagtcagaacagactgccttggggt

SEQ ID NO: 58114 - DNA, 84 bp, Mus musculus
gaaagtatgtgtgtatatatgtatatagaatgtgctgtcatcctaaggtgtgtatgtgtatatatgtatatagaatgtgctatc

SEQ ID NO: 58115 - DNA, 72 bp, Mus musculus
ggacctgagctcccgtcttcagcacccacagaagttggctatggctgcctctgtgcctgtgacctcagcacc

SEQ ID NO: 58116 - DNA, 68 bp, Mus musculus
ccaggtaaatctctcactctggctcacatggggcaaccatggggttgagaaatgatatatttacttgg

SEQ ID NO: 58117 - DNA, 73 bp, Mus musculus
gacctgcacactcagcctctgtgtgccccgaagctgtcctctgacctgcacactcagcctctgtgtgtctgtc

SEQ ID NO: 58118 - DNA, 92 bp, Mus musculus
gaacttgaagataatcccaaatcctgaacgtgtgatgtcacagcagtgacactgtctctcgctatggtgtgcttgagggtggttttcctttc

SEQ ID NO: 58119 - DNA, 99 bp, Mus musculus
gtgaattgtggatatctaggagttcgggtcaagaaagtaaagcagatctcaggctggattgatgtggctatgaatggtattttatgatgtaaagtttac

SEQ ID NO: 58120 - DNA, 68 bp, Mus musculus
cacaatcagtgtgtgtgcgtgagtgcatgcctctctctgtatgcacgcaatgcatgtgtgtgtttgtg

SEQ ID NO: 58121 - DNA, 69 bp, Mus musculus
ctgggttcaattcccagcaaccacagggcagctcacaactgtctgtgactcttgttccaggggacccag

SEQ ID NO: 58122 - DNA, 74 bp, Mus musculus
tacatatgtatgtatgtatgtatgtattaattacatatgtatgtatgtatgtatgtatgtatgtatgtatgtat

SEQ ID NO: 58123 - DNA, 63 bp, Mus musculus
gatcttatgggggctagagagatggctcggcggttaagagcactgtctgctcttccagaggtc

SEQ ID NO: 58124 - DNA, 92 bp, Mus musculus
gtacatgtgtgtctgtctgtctgtctgtctgtgatggtgtgcatataaatataggcaccctggaggccagaggcaggcagcagatgtgttgc

SEQ ID NO: 58125 - DNA, 88 bp, Mus musculus
gtccaaagctcggcagctttcagacacttgctctctgtttcccagtctggagaatggacttgccagtttgatcactgcaaagtcagac

SEQ ID NO: 58126 - DNA, 74 bp, Mus musculus
tccctctctctctctctctccatgagtccactgcaccctttatggacaatggcccaggagaagatttagaagga

SEQ ID NO: 58127 - DNA, 58 bp, Mus musculus
gtgtgtctgtcagtctctctgcatggtgtgggtgcatgcatactgaggagagatacac

SEQ ID NO: 58128 - DNA, 83 bp, Mus musculus
tagatctctctggggaaagattggagaaacgctaagagtacatttttagatattttatcaaggtccttcttcaggggaatctg

SEQ ID NO: 58129 - DNA, 119 bp, Mus musculus
tagattaaaagagctttgtgggggctggagagatggctcagcggttaagagcactgactgctcttccagaggtcctgagttcaattctcagcaaccacatggtggctcacaaccatctg

SEQ ID NO: 58130 - DNA, 115 bp, Mus musculus
agcttgtaagttttgtgtgtacttggataggcttatctgtctgtcagtctgtctttgggctggaatttgacctatgggctttgtgtatgttaggcaagcactctaccattgggct

SEQ ID NO: 58131 - DNA, 82 bp, Mus musculus
ttgactgtgagtctctgtatctgtattagtcaggtgctgcagagcctctcagaggacaggtatacgaggctcctgacagcaa

SEQ ID NO: 58132 - DNA, 85 bp, Mus musculus
gggcagagaacttctgctgtagggcccagagagaataaagcagggagtccctgattctctctgtctctgggagagttttcctccc

SEQ ID NO: 58133 - DNA, 74 bp, Mus musculus
tttctcctctctttgattacctgggtgccagagttcaggtgtccatgagatggcagtgagtagagatggaggaa

SEQ ID NO: 58134 - DNA, 96 bp, Mus musculus
gtctggcttcagcatatttatataaagtagtatgtattagtctgatagattaaccaagtacaagtttagttaattaagtatgtaacagaagccagc

SEQ ID NO: 58135 - DNA, 73 bp, Mus musculus
gtatatgtatgtatgtacacatgtattatgtatgtatgtgtgtgtatgcgtgtatgtatatatgtatatatgc

SEQ ID NO: 58136 - DNA, 85 bp, Mus musculus; identical to SEQ ID NO: 57470

SEQ ID NO: 58137 - DNA, 93 bp, Mus musculus
tatatatgaatatgcatatatatatgtgtgtgtgtatatatgtatatatgtatatacatatacatatatatatatatatatatgcatgcatat

SEQ ID NO: 58138 - DNA, 95 bp, Mus musculus
agcttttccctgtggccttattagcatctagctctagggcatctcatgattctctgactctctgtgttttgtgcagatcaccagtgtggaaagct

SEQ ID NO: 58139 - DNA, 85 bp, Mus musculus; identical to SEQ ID NO: 57439

SEQ ID NO: 58140 - DNA, 70 bp, Mus musculus
atatacatgtaaatatatatcatatatattaatgtatgtacataatatatatgtatatgtgtatgtatat

SEQ ID NO: 58141 - DNA, 101 bp, Mus musculus
agcatggctccaaggtcattctctgaaatatagagtggagaaagacaatggctggctctgcctgtctgtctgcatgcaatctgggaatgcctttttatgct

SEQ ID NO: 58142 - DNA, 117 bp, Mus musculus
tgttcttaataactgagtagtactccactatgtaaacaaaccagattttctgtatttgttcatctgtcgtgggaaatctgggttgtttccagcttctggctatcacaaataaggcca

SEQ ID NO: 58143 - DNA, 100 bp, Mus musculus
attgatggagttaatattctcttttaaaaatggggagggcagtgtgttcttataaactctctttctgtcagagtctttgttgttcagaatcttcatcagt

SEQ ID NO: 58144 - DNA, 115 bp, Mus musculus
cctattgtcattgctgtcctgtcattttgacagtaagttgctgtgtttatttatctttctaagatgagctacatgggcgacagcgacaatgtttcaggagagggcagggagaagg

SEQ ID NO: 58145 - DNA, 135 bp, Mus musculus
tccagactcccacagatactgtttaaatcagcacatctctgcctcacaggttgcttcagtgaacattcaacgctgtcggtgagtttggaattcaaataaaaaccatcgaccgttgattgtaccctatagctaacc

SEQ ID NO: 58146 - DNA, 79 bp, Mus musculus
ggtcacaatcaacattcattgctgtcggtgggttgaactgtgtagaaaagctcactgaacaatgaatgcaactgtggcc

SEQ ID NO: 58147 - DNA, 85 bp, Mus musculus; identical to SEQ ID NO: 57439

SEQ ID NO: 58148 - DNA, 76 bp, Mus musculus
ttgcttgtttttgtgtgtgttatgatgaagatgtgacatgcaacattgacacacacacacacagaaatacatgcaa

SEQ ID NO: 58149 - DNA, 137 bp, Mus musculus
gtatatacgtgtatatgtatacatatatgtgtgtgtatatatatatatatacatgtatatatacatgtatatatacatgtatatatatacatatatacaaagtgtgtgtgtgtgtgtgtgtgtgtgtgtgtgtgtgt

SEQ ID NO: 58150 - DNA, 101 bp, Mus musculus
atgttttttgaactgttagtttggccgtttcagtctaaggctgcatgtccctgtgacactgggtctctgataggaacatcagataacagttgtaaggtcgt

SEQ ID NO: 58151 - DNA, 90 bp, Mus musculus
gtccctgtcttccccacattgcgattaaaggtgactgaatgccactatattcagcttatttgattatttgtttaacgtggctgctgggac

SEQ ID NO: 58152 - DNA, 105 bp, Mus musculus
atcttgtccttgtaaggctgacatgctggtgagaccttatgaatgtagcttcaattgataaaatacagcattgtatttcagtctcttagccttctctctagagat

SEQ ID NO: 58153 - DNA, 79 bp, Mus musculus
cttgatttctgtctcccacactctgagaagtcatcaaaactgatgactcctgtttgtgagactcagaaaagccctcagg

SEQ ID NO: 58154 - DNA, 100 bp, Mus musculus
catacggtaagagtactttaaactttcagttgtttatttgatgatgtgaacacaagtgctcacgatacatcagatagcaaccgagtggctttaacacatg

SEQ ID NO: 58155 - DNA, 62 bp, Mus musculus
gtctctgtgtgtgtctgtgtatgtctatatctatgtacgtacatatgtaaatatgctggggc

SEQ ID NO: 58156 - DNA, 87 bp, Mus musculus
cacaacagccaaccttatctgtcactctatccaggtctcttgtgttcataaagagatgcttggagacagaaggatctgagctgtgtg

SEQ ID NO: 58157 - DNA, 85 bp, Mus musculus; identical to SEQ ID NO: 57470

SEQ ID NO: 58158 - DNA, 67 bp, Mus musculus
ctgagtcaagtcactctgcacagagacacagtcagcactctgtattcacagagctacgttggttcag

SEQ ID NO: 58159 - DNA, 74 bp, Mus musculus
gttgagggagaaggcaggagctgagacagagcagagactccatcaagtcagatgtctggccattctctctgaac

SEQ ID NO: 58160 - DNA, 72 bp, Mus musculus
gtgtgtgtatgtatgtatgtatgtatgtatatcattcatatgatatatatgtgtgtgtgtatatgtgtatat

SEQ ID NO: 58161 - DNA, 90 bp, Mus musculus
atgtgtgtgtatgcatgtatgtatgtatgtatgtatgtatgtatatatacacacacacacacacacacacacacacacacacacacacat

SEQ ID NO: 58162 - DNA, 70 bp, Mus musculus
tgtgtatatatatgtatatatgtatgtgtatatacatatatatgtatatatatatttatatatatatttg

SEQ ID NO: 58163 - DNA, 72 bp, Mus musculus
gccttgcattccagttctttttatccggtatagagaactgtgactgaaaagctgctgggaatttagtgaggt

SEQ ID NO: 58164 - DNA, 77 bp, Mus musculus
cagggaagtagagagtgggtgttctatttatgatcccgaagtcatttttaataactcacctatgttcgcattcgttg

SEQ ID NO: 58165 - DNA, 111 bp, Mus musculus
aagctatatatgtatatgtatatacacacacatacatgtgtatatgtgtgtatgtatgtatgtatgtatgtctatatatgtgtgtatgtatatatatatattctacagttt

SEQ ID NO: 58166 - DNA, 81 bp, Mus musculus
ccttgcaagtctgactgccagtctgactgccaatgcttgtgtttctgtgcccatcagttccgtaatcaggctttctctagg

SEQ ID NO: 58167 - DNA, 75 bp, Mus musculus
ggctctaatcccagggaagagagtgaggacaggcaggcaaagagtaaacgtttctttcttccttggcctttagct

SEQ ID NO: 58168 - DNA, 90 bp, Mus musculus
aggtggcatcatagtcactctgtgactcatttggctcctatctccttggttgagttgaagtgcgggttatatggagtatgagcctgaact

SEQ ID NO: 58169 - DNA, 89 bp, Mus musculus
catagacacacagacagacagacagacaggcaggcaggcaggcaggcatgtgtgatgtgtgtgtgtgtgtgtgtgtgtgtgtgtgtgta

SEQ ID NO: 58170 - DNA, 83 bp, Mus musculus
agcttgcctacagcctgatctcatgggtgcattttcttacttcgggctccctcctccctgctgacttcagtttgtgtcaagct

SEQ ID NO: 58171 - DNA, 71 bp, Mus musculus
tggcttatgcctttggtagagttgtctatacactgtagatacttgtttccttatttctaggctgtgagtca

SEQ ID NO: 58172 - DNA, 108 bp, Mus musculus
gagtgctgtagaaatcagtatacatacacatattatatatattatataatctaatatgtatgtatgtatgtatgtatgtatgtatgtatatattagatgatcttactc

SEQ ID NO: 58173 - DNA, 70 bp, Mus musculus
tatacacacacacatatgtgtgtgtatatatatatatatgtgtgtgtgtgtgtgtgtgtgtgtgtgtgta

SEQ ID NO: 58174 - DNA, 85 bp, Mus musculus
ggccatggtggtctaataggatacatgggacaatttcaatatttttgtatctattgaggcctgttttgtgaccaattatatggtc

SEQ ID NO: 58175 - DNA, 84 bp, Mus musculus
ggccttgttggaggaagtgtgtcattaggggtgagctttggggtttcaaaagcccaagctagtgtcagtgtctctctctctgcc

SEQ ID NO: 58176 - DNA, 85 bp, Mus musculus
ggccatggtggtctgataggatacatgggacaatttcaatatttttgtatctgttgaggcctgttttgtgaccaagtatatggtc

SEQ ID NO: 58177 - DNA, 67 bp, Mus musculus
gtccgctcactcaccctcacagtttgcaagctgatctgcgcagactgatctcagagggacccaggac

SEQ ID NO: 58178 - DNA, 118 bp, Mus musculus
tctataggatgtttctctatttagagcatatgtacgaaaagattcagaaaaaaaacccattctcaatttctatatctgatactgaacatgtctctgaaagggtaaaaagtgagggaaa

SEQ ID NO: 58179 - DNA, 116 bp, Mus musculus
caattcctttagagaggaaccactctaggttaaaatttttgagatgggtgggtggctctatccctcaactggggccatgtctatctattggaggttgttctctctccactttgttg

SEQ ID NO: 58180 - DNA, 145 bp, Mus musculus
tatactgatagccactatatttgtgtgtgtatatatatgtatatacatatatatacacacacacgtagatgtatatgtatgtttgtgtgtgtgtgtgtgtgtgtgtgtgtgtgtatagatatatatatatagatatatatagata

SEQ ID NO: 58181 - DNA, 135 bp, Mus musculus
atatctatatatatatatctatacacacacacacacacacacacacacacacaaacatacatatacatctacgtgtgtgtgtatatatatgtatatacatatatatacacacacaaatatagtggctatcagtat

SEQ ID NO: 58182 - DNA, 115 bp, Mus musculus
ggacaaatagtgagccagactgtctcccagctatgccagacgaaaatctgtctctctgtctgtctcatgcatgcatgcatgcatgcaaacatatatacacacagacacaaagata

SEQ ID NO: 58183 - DNA, 94 bp, Mus musculus
tcattacattcatttatttatcctgtgtgtatacatgcatatatgtgtatgtttatgtaggtgtgtatactgcattatacatgaaggtgtcgga

SEQ ID NO: 58184 - DNA, 135 bp, Mus musculus
ggttcctgactgtacttcatccttccagcctggtgtgcagtggtgtctggacacactaagtgaagaaactgaggacaggaaccattgtttccctagttggggtgtgtaaacacttgtgtatcatctccactggaa

SEQ ID NO: 58185 - DNA, 94 bp, Mus musculus; identical to SEQ ID NO: 58183

SEQ ID NO: 58186 - DNA, 94 bp, Mus musculus; identical to SEQ ID NO: 58183

SEQ ID NO: 58187 - DNA, 97 bp, Mus musculus
gatacccatatacttaggatatgtgagagctaaatattgaatttaaacccattcaaatagatttattttacattattcacaccgtaggtgggttatt

SEQ ID NO: 58188 - DNA, 71 bp, Mus musculus
tcctgatgaccctgtggtgattccagcaaccacttgacagctcacaactgtctgtgactacagttacagga

SEQ ID NO: 58189 - DNA, 98 bp, Mus musculus
ggggcatgactatgtaattagctgttggaaaaaataacctctcaatgtcaggaactctcagtcagtaacagcccatttacaatgctagtttaggctcc

SEQ ID NO: 58190 - DNA, 105 bp, Mus musculus
gtggaggttgctggatgccttctgctgtattgaaagttttcagtgggtcttctttattttggatgtttctatgtgcttctttaaatgtgaaggtttcctcctcac

SEQ ID NO: 58191 - DNA, 66 bp, Mus musculus
ttttatgtgcatgagttttgcctgcatgtttgtatgtatatatgtatgtgtctggtgcatgtagaa

SEQ ID NO: 58192 - DNA, 85 bp, Mus musculus
gtgtagctgtctgtgctctctcggatctgcctggctgtccttctccctgttcttgccatggctgtcagaacatagtcagctgtgt

SEQ ID NO: 58193 - DNA, 82 bp, Mus musculus
tatgcatgtttataatataaatgtataaatgtatacctgtataaatatatatgtatacatgtatatatgtatatatatcata

SEQ ID NO: 58194 - DNA, 66 bp, Mus musculus
cacacacacacactcacacgttgcatatatatatatatatatgcaacgtgtgagtgtgtgtatgtg

SEQ ID NO: 58195 - DNA, 60 bp, Mus musculus
atacacacactcacacgttgcatatatatatatatatatgcaacgtgtgagtgtgtgtgt

SEQ ID NO: 58196 - DNA, 85 bp, Mus musculus; identical to SEQ ID NO: 57439

SEQ ID NO: 58197 - DNA, 84 bp, Mus musculus
taaggcagaaattgatgtgaagtgattttgatggagtgtgtgcacaattttaggtaatttatcactttacctttcttctccttg

SEQ ID NO: 58198 - DNA, 72 bp, Mus musculus
cacacatatatatatatatatatatatatatatatatatatatatatatatatatgtatatgtatatgtatg

SEQ ID NO: 58199 - DNA, 116 bp, Mus musculus
ttgaagatcagccttagtgcatggtgatctgataggatgcatgggaaaatttcaatatttttgaatctgttgaggcctgtcttgtgacctattatgtggtcagttttggagaaggt

SEQ ID NO: 58200 - DNA, 81 bp, Mus musculus
ggtgtcagcatttggaggctgattaggggattgatgcctgggtgctgcagtctctagatggtccatcctttcgtctcagct

SEQ ID NO: 58201 - DNA, 96 bp, Mus musculus
tcagaggtgttaataatggatagttgacaggaggaaagtcatggtagagtctttctccctgtctcactgtcaaaggtgaataacattggtgtctga

SEQ ID NO: 58202 - DNA, 106 bp, Mus musculus
ttctgatctggcaggcagagaaaataatccatgccctaaaacaaaatcaaagattatttatgtttgttacatgcttagagtttcattgtatgccagccataaagaa

SEQ ID NO: 58203 - DNA, 81 bp, Mus musculus
tctgccattaagagaagcttgtggttgaaggatgaagaaatgcacaattctccaattaaaagctactctagatggtctaga

SEQ ID NO: 58204 - DNA, 78 bp, Mus musculus
aaacaatgtaagtagagaagatctacagttgtagtgattttttttcattcaatagattcagctgcttgcaatatgttt

SEQ ID NO: 58205 - DNA, 99 bp, Mus musculus
tgtgtttaaattctatcttatcttattttattttgaaggaaagcttgcaaagggcagagggcaaatatgaaatatggagaagagtgggactggggtgca

SEQ ID NO: 58206 - DNA, 90 bp, Mus musculus
tgttgatctatatgtcattgacttattttgtgaagagtgtgagatctgtattaacattcatatttcaaagattcattggctatttcagca

SEQ ID NO: 58207 - DNA, 99 bp, Mus musculus
agaactggctgtaaagaattttcttagttagtgatgcatatggggtgggcccaactcactgcacttagtgtcattcctgggatgttgcttcttggtttt

SEQ ID NO: 58208 - DNA, 106 bp, Mus musculus
ggcgtttttgatgcagcagtagacacactaactaagaaggcctgtagatctgtcgattgatctgtctgtctgtctgtctatctgtctgcctgcctgcctgcttgcc

SEQ ID NO: 58209 - DNA, 67 bp, Mus musculus
gcttctacattatagtgatactcttgccttgctgcaggctgaggtagaagtgtcttgtaagtcaagt

SEQ ID NO: 58210 - DNA, 101 bp, Mus musculus
aagtggaaaaactcttttgattctcccttgtaaaataagagagtggaagactaatgttttactggtggggtaatgaaaattggaatgagcatggtctgttt

SEQ ID NO: 58211 - DNA, 96 bp, Mus musculus
tatatatatgtatatgcatatgtgtgtgtgtataatatatatatgtatgtatatatagtacacatatatacatatgtatgtatttatgtatacaca

SEQ ID NO: 58212 - DNA, 96 bp, Mus musculus
atatatgtataagtgaacatacatcattgaagactttatttatatatatatatataaatatatatcaatgatgcttatgtaaatataaatatatat

SEQ ID NO: 58213 - DNA, 81 bp, Mus musculus
aacttctgttagtttcactgtgtctctgtttagtttctgtttccaggatctgtccattgatgagagtggggtgttgaagtt

SEQ ID NO: 58214 - DNA, 85 bp, Mus musculus; identical to SEQ ID NO: 57439

SEQ ID NO: 58215 - DNA, 85 bp, Mus musculus; identical to SEQ ID NO: 57439

SEQ ID NO: 58216 - DNA, 125 bp, Mus musculus
tatatatgtgtatatatatatatatgaactatatatatacatgtgtgtatgtgtatatgtatataaatgtatatatgtatatgtatataagtgtacatgtatatatatatatgtgtgtgtgtgta

SEQ ID NO: 58217 - DNA, 116 bp, Mus musculus
gccttagtgcatggtgatctgataggatacatgggacaatttcaatatttttgtatctgttgaggcctgttttgtgacctattatgtggtcaattttaaagaaggtaccatgaggt

SEQ ID NO: 58218 - DNA, 94 bp, Mus musculus
atatatgtgtgcatgtgtacatatatatatatatgtatatgtgtgtgtgcatgtatatatatatatgtgtgtgtgtatgtatgtatatgtgtgt

SEQ ID NO: 58219 - DNA, 72 bp, Mus musculus
tttcagtgtttagtctgctcaccaaggtcctgaggtaccaaggtgtctctgtctggcactgccacactgaaa

SEQ ID NO: 58220 - DNA, 80 bp, Mus musculus
ggaaattgaggttgtatgtaggatgaggcctgcttctatttttattaattcagaccctacccacagtcacagccttttcc

SEQ ID NO: 58221 - DNA, 73 bp, Mus musculus
gagtcaggtgaggacgcattcccccaggtcttaccctcctgggtcacttcagaatgactcagtctctctctcc

SEQ ID NO: 58222 - DNA, 85 bp, Mus musculus; identical to SEQ ID NO: 57439

SEQ ID NO: 58223 - DNA, 99 bp, Mus musculus
cacccgtcctgaggactgtgagaaatgaggagccactctgtccagtgggtagtgggcagactggctggctctttcccagcacgggtgcttcttccgggc

SEQ ID NO: 58224 - DNA, 85 bp, Mus musculus; identical to SEQ ID NO: 57439

SEQ ID NO: 58225 - DNA, 68 bp, Mus musculus
tatatatatgtgtgtgtgtgtgtatatatatgtatgtatgtatacatatatatatacatacatacata

SEQ ID NO: 58226 - DNA, 85 bp, Mus musculus; identical to SEQ ID NO: 57439

SEQ ID NO: 58227 - DNA, 88 bp, Mus musculus
cagtctctatagatgtgtttatgttgtccagtattaggcattttgtttcagcagatacaaataatgtttagtgacataaacaagactg

SEQ ID NO: 58228 - DNA, 108 bp, Mus musculus
ggatatatcagaagacttggagctagaagcctcaaatgagagagaacacaaagatcacactgagtgaggtaacctagacccagaaaggtgtctcttctaatagattcc

SEQ ID NO: 58229 - DNA, 99 bp, Mus musculus
gtgtgtgtgcctcttactagtctggaactggcaaagtaggctaggctgggttgtccacaggctctctcactctacctgtctctgccttacctaacctgg

SEQ ID NO: 58230 - DNA, 118 bp, Mus musculus
gaacttattttcccagttgtgttttatgaagtagaaaatttctagaagtgtttactgtaatactctctggaaaagcagttcttttaaactttccttgtgtaactgaaatcatttgttt

SEQ ID NO: 58231 - DNA, 68 bp, Mus musculus
atcagtatttataagtatatacatgtatatacatacatatatatacatgtatacacatatatattggt

SEQ ID NO: 58232 - DNA, 112 bp, Mus musculus
gggatgactagaatgccactgtatcaggcctatagttttctcttaaataagtatttttatttccttaagagaacatactgggattctgtacattttactaaatactcatttc

SEQ ID NO: 58233 - DNA, 137 bp, Mus musculus
tatatgtacatatacatatatttgtacatatatgtatatatatgcatgtatatgtacatatacttatacacacacacatatatatacatatatatatatgtatgtatgtatatgtatataatgtgagtgttttagtg

SEQ ID NO: 58234 - DNA, 99 bp, Mus musculus
aatgagttttatcttctgaaattagcattgggaatagggactgacaggagacagacagcattctctttccttttagagtgtaataagaagcagaccatt

SEQ ID NO: 58235 - DNA, 80 bp, Mus musculus
acacttcagtcagtgtaaagtgtgtgtgtgttgtgtgttaagtacacaacacagagtgtagagaaatgaggccaaagtgt

SEQ ID NO: 58236 - DNA, 80 bp, Mus musculus
atacatatatatatacatatacacacatacatacatacatatatgtatgtatgtatgtatgtatgtatgtatgtatgtat

SEQ ID NO: 58237 - DNA, 70 bp, Mus musculus
ttatctgtctgcctgaatgtctgtctgtctatttttctctgaagataagcacaagttcacagacagttaa

SEQ ID NO: 58238 - DNA, 85 bp, Mus musculus; identical to SEQ ID NO: 57470

SEQ ID NO: 58239 - DNA, 85 bp, Mus musculus; identical to SEQ ID NO: 57439

SEQ ID NO: 58240 - DNA, 86 bp, Mus musculus
cttattactgctctgtgaaaacatgaaatgctcaagcatactttcctttcaccatgttttcagtatgtatgcagaatagtgatcag

SEQ ID NO: 58241 - DNA, 91 bp, Mus musculus
agagaaagatagagacagagacacagagagagacagagacacacagagatttgcctgtctctccctctgactttgtctctccttctctttt

SEQ ID NO: 58242 - DNA, 62 bp, Mus musculus
acaaagtcagagggagagacaggcaaatctctgtgtgtctctgtctctctctgtgtctctgt

SEQ ID NO: 58243 - DNA, 71 bp, Mus musculus
tgcccatggggctctgacttacatgagagacttaagtcttgtcagttgagacacagcactcaaaatggaca

SEQ ID NO: 58244 - DNA, 111 bp, Mus musculus
tgttgttttggttggtggcttaacattcctgtgtgaacctctgtgtctctgattcttttgccttttggaggatcttttccttttgtgagcttttcttgtccaatgctgata

SEQ ID NO: 58245 - DNA, 117 bp, Mus musculus
ggctacagcagatcatacacattagcatcttacatgggtttgctgtgaaacactctcactgagaagtgattagcatgcaggttgtttggattttaagtgcagactctttctttagct

SEQ ID NO: 58246 - DNA, 86 bp, Mus musculus
acacacacacacacacacacacacacgagagagagaagtatataaaatctattttttctcatgtgtgtatatatatatgtgtgtgt

SEQ ID NO: 58247 - DNA, 99 bp, Mus musculus
ctcatgggaggcactatatcacaaccagtgtggttttgaaggatttatctcatatttggactgtccatctgtctctctgtgtgtatgtgcttccaaggg

SEQ ID NO: 58248 - DNA, 96 bp, Mus musculus
atgttggagtatctaataaaatcaatatcaaggtcaagctaaccttactaggttgttccttgaattgttaatttcccacagtcagccagccaacgt

SEQ ID NO: 58249 - DNA, 66 bp, Mus musculus
tgggggccgagttgggataggggctcctcagcaaccgagggtctctctcttgctctcattgtcctt

SEQ ID NO: 58250 - DNA, 96 bp, Mus musculus
gatcagctttagtccatggtggtctgataggatgcatgggacaatttcaatatttttgtatctgttgaggcctcttttgtgaccaattatatggtc

SEQ ID NO: 58251 - DNA, 91 bp, Mus musculus
atttcttcactgacagagttatcactgagcagaaagttgttcagtttttgtaattgtgtgggctttctgtagtttctattggtattgaagt

SEQ ID NO: 58252 - DNA, 106 bp, Mus musculus
gccttagtgcatggtgatctgataggatgcatgggacaatttcaatatttttgtatctgttgaggcctgttttgtgacctattatgtggtcaattttggagaaggt

SEQ ID NO: 58253 - DNA, 113 bp, Mus musculus
agagaaattggtctgaagttctctatctttgttgggtctttatgtggtttagatatcagagtaatagtggcttcataaaatggaagactattaatgactgcttctatttcttt

SEQ ID NO: 58254 - DNA, 108 bp, Mus musculus
tatatatatatggggaattattggttattggtttatgctttcttgattaagttttgaaattttataattttggatttatgttctgaaatcaagttcttgtattatata

SEQ ID NO: 58255 - DNA, 118 bp, Mus musculus
agagatattaaggaaaagtaattgttgcttcctattatttttgttgctagagttgacattctgttcttgtggctgtcttctaataggtttattgaaggattactttcttgctttttct

SEQ ID NO: 58256 - DNA, 105 bp, Mus musculus
tggggaccatctgtgtttctgcatcttttaattcctatctcatggtttctggaatgataaagttgagtctggaacaggtgagatctgcaggggcggggtctgtct

SEQ ID NO: 58257 - DNA, 79 bp, Mus musculus
gttgtatatatgagtatttatatgtgtatgtagaaatacccatgtatgtgtatatgcatatgtggctctatatttaagc

SEQ ID NO: 58258 - DNA, 84 bp, Mus musculus
atatatgccctcatatatatatgtatacatatatgcaaactcatgtctatatgttgttatgtgtgtctgtgtgtgagtatatat

SEQ ID NO: 58259 - DNA, 79 bp, Mus musculus
gagagagagagagaaacacattgttgggtctgtgctaaaacattgagtatacaagcccattcatctctctcactctctc

SEQ ID NO: 58260 - DNA, 107 bp, Mus musculus
ggacagaaagatttagttgcatcttcattggggagatttcagtacactattttaatattttgaaactatctgaattcttataaccaagaggaaaagcatctatagcc

SEQ ID NO: 58261 - DNA, 169 bp, Mus musculus
ctttttttttttttttttgattgggttgtttggattgctggaggttaacttcttgagttctttatatattttgaatgtcagccctctatcagatgttgaattggtgaagggtttttttttttcttaatctgtaggtgccatacactctggtagagtcagcttgacagtc

SEQ ID NO: 58262 - DNA, 88 bp, Mus musculus
gcaaagtgtcagtgacaggtgtgggtgtgcactgagtttgatgttttgattggcacagtgtgttatctgcctgattactgtgcggggc

SEQ ID NO: 58263 - DNA, 85 bp, Mus musculus; identical to SEQ ID NO: 57470

SEQ ID NO: 58264 - DNA, 63 bp, Mus musculus
cagatatctgggcaccttccctgcaagaggagagcttgactgcagagagtgctcagaccactg

SEQ ID NO: 58265 - DNA, 66 bp, Mus musculus
ggctgtgcatctctctctctctcgtggcctaaaatggacttgatgcaagtgaatgatgcagaagcc

SEQ ID NO: 58266 - DNA, 101 bp, Mus musculus
gtagtgtttgaagtgatttctaagtagctcatctcagttatacagatcttttttctctctgtcactgagaatcggcaggtttcatcacctttaatggctat

SEQ ID NO: 58267 - DNA, 66 bp, Mus musculus
gtgtgtgtgtgtgtgtgtgtgtatctatctatctctctctctctatatatatatatatatatatat

SEQ ID NO: 58268 - DNA, 68 bp, Mus musculus
gctgtgggtctctgtttctatctcgattggctgcagggtggagccactcagaagacagttattctagc

SEQ ID NO: 58269 - DNA, 70 bp, Mus musculus
gaaaaagaataaaactgcatatatatgtatatatatgcatatacatatatatgcagttttattctttttt

SEQ ID NO: 58270 - DNA, 101 bp, Mus musculus
taacatctccattggggtcccagcattcagtctgatgtttggatgcttgcatatgcatctgcactggtcaggctctgacagggcctctcaggggacagtta

SEQ ID NO: 58271 - DNA, 115 bp, Mus musculus
catctacctcaaaatctagctagaccacttgggcatatctccaagagacactttatctgacaggtaatcactttctcaaccatgttcattgctattctaggaagtgacctagatg

SEQ ID NO: 58272 - DNA, 117 bp, Mus musculus
tgtttgtttgttttgttttgttgctccccatcatctctggctctcacactttctgtttcccctctgcagacttcgctgagcctggaaggaaaataattaatagaagcatttcattta

SEQ ID NO: 58273 - DNA, 120 bp, Mus musculus
tatatatatatatatatatatatacacattacatattatgtgtgtgtgtatgtatatatatatatacatacacacacacataatgtgagtgagtgtgtgtgtgtgtgtgtgtgtgtgtgt

SEQ ID NO: 58274 - DNA, 94 bp, Mus musculus
acactcactcacattatgtgtgtgtgtatgtatatatatatatacatacacacacacataatatgtaatgtgtatatatatatatatatatata

SEQ ID NO: 58275 - DNA, 88 bp, Mus musculus
tgtatgtatgtatgtatgcatgtatgtatatatgtatgtatgtatgtatgtatgtatgtatgtatgtataagccttttacctatttac

SEQ ID NO: 58276 - DNA, 114 bp, Mus musculus
cactgtgtaattgctgggaattgaactcaggacctctgagagagcagtcagtgctcttaactactgagccatctctcaagccccctgatgtttctctttttggctttaaacatg

SEQ ID NO: 58277 - DNA, 64 bp, Mus musculus
gtatgtatatatgtatgtatgtatgtacgtaaatatgtatatatgtatgtatgtgagtatgtat

SEQ ID NO: 58278 - DNA, 85 bp, Mus musculus; identical to SEQ ID NO: 57439

SEQ ID NO: 58279 - DNA, 85 bp, Mus musculus
tcccattaatctgaaatacatgaagtaactttttctttaatttcactgttacttcaagtattttactaatttcaaaaagatggga

SEQ ID NO: 58280 - DNA, 72 bp, Mus musculus
gtgctgtgtgtcagtctcagtgtcttgtccatattaggcaagcactctttaatgcacctacactcccagcat

SEQ ID NO: 58281 - DNA, 106 bp, Mus musculus
tatacttctgtatatacacacacgtgcacacacacatatgtatacaaatatgtacttgtatgtgtgcatgtgtgtgtgtgcacgcgtgtgtatatgtgtgtgtgtg

SEQ ID NO: 58282 - DNA, 85 bp, Mus musculus; identical to SEQ ID NO: 57439

SEQ ID NO: 58283 - DNA, 102 bp, Mus musculus
tgtccttcctgtgatcctgattgtatcagaaatcctcagagtccagctgtctctgtttctgtgattctgggatcctgtgatcctgagatcctgggtgtgtca

SEQ ID NO: 58284 - DNA, 81 bp, Mus musculus
tggttatgtgataggatgcatgggacaatttcaatatttttgtatctgttgaggcctgttttgtgaccaattatatggtca

SEQ ID NO: 58285 - DNA, 78 bp, Mus musculus
tgatctgataggatgcaagggcaaatttcaatatatttgtatctgttgaggcctgttttgtgtccaattatttggtca

SEQ ID NO: 58286 - DNA, 109 bp, Mus musculus
ttgtttctagggaacaaatgccaaagatgcaacactagtgactatgtagttctgcctcaaattacaatccttgctgacttttgtgtattggcacttggctcctttgcaa

SEQ ID NO: 58287 - DNA, 109 bp, Mus musculus
tgtacatatacacacagtgataacttgtatatatatatatatatatatatatatatatatatatatatgtatatgtatatatgtgtgtgtatatatattcaataattca

SEQ ID NO: 58288 - DNA, 113 bp, Mus musculus
ccttcttcttgagtttcatctgttttgcaaattgtatcttgggtattctaaatttcttggttaatattcatttattaatgagtgcatatcatgggtgttcttttgtgattggg

SEQ ID NO: 58289 - DNA, 85 bp, Mus musculus; identical to SEQ ID NO: 57439

SEQ ID NO: 58290 - DNA, 56 bp, Mus musculus
cgcacatagatatttgtatatatatgtgaatacatatatgtacttatttttgtgtg

SEQ ID NO: 58291 - DNA, 85 bp, Mus musculus; identical to SEQ ID NO: 57439

SEQ ID NO: 58292 - DNA, 90 bp, Mus musculus
ggtcctgtagagatatatttcattttattagatcaagtctgtcactaggctggctttgaggattaaatggactctttaattgctgtggcc

SEQ ID NO: 58293 - DNA, 79 bp, Mus musculus
gttccagccagtggtcctaagtgggatccagtaccaggggaggcctcaaggtctgacactatcactcaggctatggaac

SEQ ID NO: 58294 - DNA, 79 bp, Mus musculus
ggtcctttttcctgtgcaggcttgataccccagtgtaggagagttccagggcagggaggtgggagtgggtggatgggtc

SEQ ID NO: 58295 - DNA, 118 bp, Mus musculus
ggatttaaaagttatcatgaggggctggagagatggctcagcggttaagagcactgactgctcttccgaaggtcctgagttcaaatcccagcaaccacatggtggctcatagccatcc

SEQ ID NO: 58296 - DNA, 76 bp, Mus musculus
atcctggagttatggatctgtagaataggctgcttcaagtactatagcagcttagcaatggagtagatgtcagggt

SEQ ID NO: 58297 - DNA, 85 bp, Mus musculus
gagatgacatatgttgaagccttattctatccatttctgtatatgtatatatgtacatatatgtattttctacatatgtgttctt

SEQ ID NO: 58298 - DNA, 89 bp, Mus musculus
tgtgtcacttcagctgccttcagtatctgtttttcaatatttcaagaaatgaagtgcatggagaacatctgggggggggggtggatata

SEQ ID NO: 58299 - DNA, 93 bp, Mus musculus
tccatggtggccggataggatgcatgggacaatttcaatatttttgtatctgttgaggcctgttttgtaaccaattatatggtcaattttgga

SEQ ID NO: 58300 - DNA, 71 bp, Mus musculus
gcaactgtgtttgtacatgtgtgaattcattagatttatattttcattcacacatgtgatgctgcatgtgc

SEQ ID NO: 58301 - DNA, 76 bp, Mus musculus
tacagtgaaactatttttaagttttcatatacttgtatttaaggtgtatgaaatttttgtgtgaatgtttactgtg

SEQ ID NO: 58302 - DNA, 115 bp, Mus musculus
tgccaggcttatacatagaatatatacatatacatatatatatatatatatatatatatatatatatatacacacatcatatatgtatacatacatacatgtatatacacatgca

SEQ ID NO: 58303 - DNA, 81 bp, Mus musculus
ttttacattaaggatgtatgtatgaatgtatgtatgtatgtatgtatgtatgtatgtatgtatgtatgtatgtatgtagag

SEQ ID NO: 58304 - DNA, 105 bp, Mus musculus
tacacatgcgtatatgtcatgtatgtatatgtacatacacacacaagtatatatgtatgtatatccttgtgtgagcatgtgcaagtgagcatttatgtgtgtgtg

SEQ ID NO: 58305 - DNA, 85 bp, Mus musculus; identical to SEQ ID NO: 57439

SEQ ID NO: 58306 - DNA, 74 bp, Mus musculus
atatatatatatatacacacacaggcatatatatgtgtatatatacatatatatgtgtgcatatatatacatat

SEQ ID NO: 58307 - DNA, 98 bp, Mus musculus
cacagagagtctggtagtgacccatgtaggcacagtgctactgacttcagtctctgtgagcccatagggacctagttgagttgattctgtgggacatg

SEQ ID NO: 58308 - DNA, 111 bp, Mus musculus
agactccatgtataagaatccattctcctctaaagtggccttggatgtcagtcagtttctgacactctaaggaaatgaggtgattcatatgtgggtacttggcagacgtct

SEQ ID NO: 58309 - DNA, 109 bp, Mus musculus
tgatgattgcatcggcatcggcttctggagatgtcaggttttagttaggaaatggaatgaataatttcagtaaaacgcacgtcatgctcagtaatgctgcagtcaatca

SEQ ID NO: 58310 - DNA, 83 bp, Mus musculus
ttcataacctctcttagtttcactgtgtctctgtttagtttctgtttcagagacctgtactttggtgagagtggggtgttgaa

SEQ ID NO: 58311 - DNA, 99 bp, Mus musculus
ctagtagagatagatgatgagcagcgatttgtctaaatgggtcaggaggggccttctctgtgactctgcattagcatctgcttccagtgaactaactag

SEQ ID NO: 58312 - DNA, 85 bp, Mus musculus; identical to SEQ ID NO: 57439

SEQ ID NO: 58313 - DNA, 93 bp, Mus musculus
taattgggattactacatcacgtattgattggatgtatgaaaatgacgttttttttaaatcacagtgggagatgtgtgttgtctagaaagtta

SEQ ID NO: 58314 - DNA, 134 bp, Mus musculus
gtgtatgtatgtatgtatatatatatatatatatatatatatatatatatatacacatacatatatataactatatataatatataaaactacatatatataatatatgctatatataactatatgtatatatg

SEQ ID NO: 58315 - DNA, 95 bp, Mus musculus
tcagtcggagaagatgcacctaaccatcaagagactggaggccacagagaatttagagagctcatggggtaaggggcaggggctggtggggtggg

SEQ ID NO: 58316 - DNA, 101 bp, Mus musculus
gttttgtcactctgggccaaagttcacatttcccaaaagatattttcaattttttcattgcagtgtctctttgtgaggctctggcctttactgtactccac

SEQ ID NO: 58317 - DNA, 101 bp, Mus musculus
ctgccttctaatcaacactgttcatgcccatagagaagtgagactttcagctttggtctgagttgtttctttgtgcagtggtcagtgatgactgactgcag

SEQ ID NO: 58318 - DNA, 112 bp, Mus musculus
gtggctagaaggtgcatccatgttgaagtagacattaaacttgtaagaatattttctttttataaaagcattctatttaagaaccatacatcgatacatccttttgatccat

SEQ ID NO: 58319 - DNA, 106 bp, Mus musculus
ttggtactaaattataatgttgtattagagagttggatatatgatatgatatgatacgatatgatatgatatgatatgagtgccatgttctaagcaattgaaccaa

SEQ ID NO: 58320 - DNA, 84 bp, Mus musculus
tattattattattattattattattattattattattactatgaatagtagtagtagtagtagtaatatgtatgtgtgtatgta

SEQ ID NO: 58321 - DNA, 109 bp, Mus musculus
accatgctctccctttgttacatcatcttctgcagagagacagaagtgacaaagcacttcagggcagacttttggtttttattcacttcttctgagaagcctgtgttgc

SEQ ID NO: 58322 - DNA, 162 bp, Mus musculus
tatgtatgtatgtatgtatgtatgcatgtatatgtatacaaatatatgtatatatatgtgtatatatatatgtatatatatgtgtgtatgtgtatatatatatacatatacatatacatatacatatacatatacatatacatatacatatatatatatata

SEQ ID NO: 58323 - DNA, 78 bp, Mus musculus
gaatagaaaaggagctggagagatggctcagtgggttaagagcactgactgctcttccagaggtcctgagttcaattc

SEQ ID NO: 58324 - DNA, 87 bp, Mus musculus
tgtggttggttgaagtcctgaatacagagaccacagatgaagagtgttgtctatttcttgatttattataaggagttcaaagccata

SEQ ID NO: 58325 - DNA, 241 bp, Mus musculus
tatatgtgtgtgtatatatgtgtgtgtatgtgtgcattagtatgtgtatgtgtgtatatgtgtgtatatgtatatatatatgtatatatatgtatatgtacgtatatgtgtgtatgtgtgtatatgtatatatatatgtgtgtgtgtatgtgcaagtatatgtgtgtatgtgtatatatgtgtgtatatatatatatatatacacatacatatatatacacacacatgtgtgtgtatgtat

SEQ ID NO: 58326 - DNA, 70 bp, Mus musculus
atgtgtgtgtatatatatgtatgtgtatatatatatatatatacacacatatatacacatacacacatat

SEQ ID NO: 58327 - DNA, 89 bp, Mus musculus
ctcctttgtgctaagaacttggagtctggatgtgttctgtatcaactcgagacacccctcccaagataccaagtgttcaaacgtccgag

SEQ ID NO: 58328 - DNA, 96 bp, Mus musculus
gaattaccctggtttagcatggtgttggtagtaggttcttttctaaaatctatgactttactagctccatgttgttggctaggcttccagtagttc

SEQ ID NO: 58329 - DNA, 114 bp, Mus musculus
agattaggagatgaggccttgttggaggaggtatgtcactggggatggactttgaggtctctcactctctgttatagaggctatttcaaacacttaagctctcagcactgctct

SEQ ID NO: 58330 - DNA, 85 bp, Mus musculus; identical to SEQ ID NO: 57439

SEQ ID NO: 58331 - DNA, 75 bp, Mus musculus
tatgggtgacactatctctgactgggtactcattcagcaaatttgaatgcctaacctagcagggaaatccccatg

SEQ ID NO: 58332 - DNA, 74 bp, Mus musculus
acttgtttttcctgtgagtctgtaagtctgtgtcagcactcctggcagaccggctctctcctggcaagaccagt

SEQ ID NO: 58333 - DNA, 112 bp, Mus musculus
ggaccccttgagcacagagttactcagcaggctggtcactgagggtcacttgacattttgaaaatgtgttttagataccctagcaagtctgctggtacattgttcagtgtcc

SEQ ID NO: 58334 - DNA, 122 bp, Mus musculus
cttatttaattgtttgttttaggaaagctgtgcctaatagatcttgagagatgaattgttatcaagtttataattttaagtcatcttttaagcacagtgttacatggtaagatgggaggttg

SEQ ID NO: 58335 - DNA, 77 bp, Mus musculus
aggagaagaagcttttagtgcttattgtgtgattatttttcaaattgcccatttatagtcctaattctttttttcct

SEQ ID NO: 58336 - DNA, 74 bp, Mus musculus
tgtgcacacactcactgttacacacacatgaagtcaggagtcagcacattcattgtaactagtctgtgtgcaca

SEQ ID NO: 58337 - DNA, 114 bp, Mus musculus
gcctgtttgtactgaaatgcaattatttctttgaatttctaatgttttaatagaacattttaaatattttgaaacttaatatttgcttagaatctgttcagtttgggatagtgt

SEQ ID NO: 58338 - DNA, 90 bp, Mus musculus
ctcagtccctcaaactgcacttcgggcaccttgttctgattgcctcctttagttatcacagggatgttcattagttgtttaggggctttg

SEQ ID NO: 58339 - DNA, 90 bp, Mus musculus
ttcttttcccatctctgtctgtctgtctgcctctctttgtgtgtgtgtgtgagagagagtcagagacagagaaagacagagacagaagaa

SEQ ID NO: 58340 - DNA, 61 bp, Mus musculus
tctctgtctctgactctctctcacacacacacacaaagagaggcagacagacagacagaga

SEQ ID NO: 58341 - DNA, 115 bp, Mus musculus
gtttttctctctttctgtttcacctgttcatccatacacacacacacacacacacacacacacacacagaaagatagacagacagacagacagacagacagacagagagaatgtc

SEQ ID NO: 58342 - DNA, 113 bp, Mus musculus
ctctctctctctctctctatatatatatatatatatatatatatatatatatatatatatatgcatgcttgggtgtctgagtaggtgtgaatgtgtctgtatatgtgtgtgtg

SEQ ID NO: 58343 - DNA, 67 bp, Mus musculus
ggtcagaaaatcgtcagggtctgtctgtctctgccttccaatgttgtgatcacaggtccctgtggcc

SEQ ID NO: 58344 - DNA, 92 bp, Mus musculus
gctttatttagagcttccaacttaaagctgccccatcaaaccaacacaggtataaaggaagcaggcttcattgcgggctcctacaatacagc

SEQ ID NO: 58345 - DNA, 109 bp, Mus musculus
gcatgcactgggagaaagcaggggtttgatgtctgtacagcagttaaacgtaaaagaattttttttcttgattagtggctacatatcaccaaatgcaagccatgtatgc

SEQ ID NO: 58346 - DNA, 114 bp, Mus musculus
ttagttttggatctattctgtttttatatgctcttctgctgctgtggcaaattctcagagtcactctctctccaccatatgtctcagagattgaactcaggtggtcaggcctag

SEQ ID NO: 58347 - DNA, 100 bp, Mus musculus
ctcagactctcagaggcagaggcaggcagaggcaggtggatctctctgtgagtctgagcccagcctggtttacatagggagttcccagacagcctgtttc

SEQ ID NO: 58348 - DNA, 73 bp, Mus musculus
gctgggctcagactcacagagagatccacctgcctctgcctgcctctgcctctgagagtctgagattaaaagc

SEQ ID NO: 58349 - DNA, 85 bp, Mus musculus; identical to SEQ ID NO: 57439

SEQ ID NO: 58350 - DNA, 114 bp, Mus musculus
ctggcccagagctcactgtgtagcccaggctgatcttggactcccggctgttttccctgactcaaactctgagtgccagagttacaggcctggtcatgtactgtgggaggccag

SEQ ID NO: 58351 - DNA, 112 bp, Mus musculus
ggcagaattggaaactgagggcagtgaggatcagtctggtgtgagtagccagtgatgccacctggggccatggtgaggtcctgacctgtgctgtcactggaggctatggacc

SEQ ID NO: 58352 - DNA, 104 bp, Mus musculus
gtggggtttagggcatgtatatttatgtgtatgcatatgcagacacttgtgtatgtgtgtatgtatgtatgtatgtatgtatacacatgtgtcttttaccttgc

SEQ ID NO: 58353 - DNA, 67 bp, Mus musculus
gtactgggcacatcctgagcagaattgctaacagtgtgtctgtgtgtctgtctgtgtgtctgtgtat

SEQ ID NO: 58354 - DNA, 79 bp, Mus musculus
cagggaatgttaggctgctaatcattcagatgttcataaatcagaatactgagtgtagacatggcttctctcttctttg

SEQ ID NO: 58355 - DNA, 116 bp, Mus musculus
cagcattgaaagcctgggagctcgctgcagtcagtaccactgagttcatgttgaaaggctgaagaactttggggtctgatggtgcaggcctggaatcccagctattcaggaggctg

SEQ ID NO: 58356 - DNA, 85 bp, Mus musculus; identical to SEQ ID NO: 57439

SEQ ID NO: 58357 - DNA, 73 bp, Mus musculus
aggtaacacagggagctatcatctgcagggtgctgaacctcccaatgttttagtaactttcccacagttgcct

SEQ ID NO: 58358 - DNA, 105 bp, Mus musculus
cttttagaagttgtaggtcccaggtagcaaagacaataaaacaggtgtatatctttatatagataacagaagagacacatgtctgtgtggacaaatgtccaagag

SEQ ID NO: 58359 - DNA, 97 bp, Mus musculus
tagcattgcacagggtcacctagctggtaggctgcaaagtcatatttgaatagagtctctttgaccttgacatgcgaactgattctctgctatgcta

SEQ ID NO: 58360 - DNA, 93 bp, Mus musculus
tatatatatatgtgtgtatgtatatgtatgtatatatgtgtatatatgtatatatatacacacatacatattatttccccatatacacacata

SEQ ID NO: 58361 - DNA, 79 bp, Mus musculus
tgaccaggcgctggtggcacacacctttaatcccagcacttgggaggcagaggtagatggatctttcagttcaaggtca

SEQ ID NO: 58362 - DNA, 89 bp, Mus musculus
cggcctgtgtgtgcgtgcgtgcgtgcgtgtgtgtgctgtagggaaaagaggagcgagcttagtgtgtgcatgcacacgcgtgctgcagg

SEQ ID NO: 58363 - DNA, 121 bp, Mus musculus
atatacacacacatatatgtatgtgtgtttatatatttatatatgtgtgtatttatgtatatgtatacattcatacatatttgtatatgtatatatggtatgggtgtatatgtatatatgg

SEQ ID NO: 58364 - DNA, 69 bp, Mus musculus
agggaggggggcgagggggtgctgcttatttcaggaggggagagagcacagactgcgaattctgtccct

SEQ ID NO: 58365 - DNA, 67 bp, Mus musculus
tatacatatgcacataaatacatatatgctgcataagcatatgcatatatatatgtatgtatgtatg

SEQ ID NO: 58366 - DNA, 82 bp, Mus musculus
cagcactcaggaggcagagacaggcagatctcagtgaacacagcatcttctgaggcagcctgggctgtagattgagatgctg

SEQ ID NO: 58367 - DNA, 74 bp, Mus musculus
gcatatgtatacatgtatgtatatatgcatgcatgtatgtgtgtgtgtgtgtgtgtgtgtgtgtgtgtgtgtgt

SEQ ID NO: 58368 - DNA, 109 bp, Mus musculus
caaaggatagagcaagggtgtatcctttctgctttgcatacatttttttttaaaagaagccccatattcattgagcaagagagactctatcctgggctatttccctttg

SEQ ID NO: 58369 - DNA, 89 bp, Mus musculus
gtgtctgtctatctgtctgtctgtctgtttgcatgtatgaccatatgtcttatgcacttgtgcttgcatggaggccagaagaaggtcgc

SEQ ID NO: 58370 - DNA, 90 bp, Mus musculus
aggctagcctcagcctcctgtttgcttctctaagaaagacctctgctttgagcttgtatagataagttatggctgcttgttcatctgcct

SEQ ID NO: 58371 - DNA, 122 bp, Mus musculus
actcagtagtcacaactgtcattattggagattcatatgctgtcactctgatttctgtatgtatatatttcaatttaggactttaggcagtcagtattgagtaattcaatttatagtgagat

SEQ ID NO: 58372 - DNA, 68 bp, Mus musculus
gtgtatgtatgtgtgtatatatgtgtgtatatatgtgtgtacaaatgtgtgtgcatgcatgtgtgtgc

SEQ ID NO: 58373 - DNA, 120 bp, Mus musculus
gggaagactatgagatagtgaaaccttgcttgatctctgtgcagcagattggtttaccaaactgtctgtttgtctgtctgtctgcctgcctgatctctctgtagattcctatttcttcct

SEQ ID NO: 58374 - DNA, 89 bp, Mus musculus
tttctgagcttcgggtctggaggtgggttcccaggaaggggtgggctattcatttcactccctctgtcactgagattctagctttgaaa

SEQ ID NO: 58375 - DNA, 107 bp, Mus musculus
tgaatcccagtgctaagtctttgtagccttctcaagtttcctatgaagtatttctttttatatttggagaaatcccaagttgctatggaaaaagcctgaatgattta

SEQ ID NO: 58376 - DNA, 159 bp, Mus musculus
ctccaactgaaggcactgggatgtcaatcagggtggcacagaagtggttttttttttttttgtcccctttagactagttgtcacacttgagagtctggagtgctcaaaggtagcacacaattggagactctcactggatttctagttctggggcccaga

SEQ ID NO: 58377 - DNA, 115 bp, Mus musculus
ggtatggataagaatgaggtagatggggctggagagatggcttacaggttaagagcactgactgctcttccaaagactgctcttccaaaggtcctgagttcaattcccagcaacc

SEQ ID NO: 58378 - DNA, 64 bp, Mus musculus
gctctcatatacatgtgtgtatgtatgtatgtatgtatgtatgcatgtatgtatgtgtgtatgt

SEQ ID NO: 58379 - DNA, 89 bp, Mus musculus
ggtggtgtagactgaatggaccggtaagatgtagcacgtgacagaggtagagtgtcagtcagtgcttgtccttttgtgtctgcaacagc

SEQ ID NO: 58380 - DNA, 74 bp, Mus musculus
tggagacaaacaggttccctgtctggctgccaatgagaagcagcagccaatcagaggacagttgtcagcatcca

SEQ ID NO: 58381 - DNA, 71 bp, Mus musculus
gctgagcatgttactcaacactccactcgggaaatgagtctgagtgttcagagtgtgcagatgctttttgc

SEQ ID NO: 58382 - DNA, 59 bp, Mus musculus
gcactccgatgctggtctccggagtccatgggagtctccggagtctctgtgtctcaggc

SEQ ID NO: 58383 - DNA, 106 bp, Mus musculus
gcgtccatagggctgtttggcaggacctggtgaaagtgttcccttccagctttctctctgactcacagacggctttaaacggctgcgttagatgggagtcttctgg

SEQ ID NO: 58384 - DNA, 69 bp, Mus musculus
ttgtgtgtgtgtgagtgtgtctgtataggtatatgatatgtatgcacagacacactcatacacacacaa

SEQ ID NO: 58385 - DNA, 94 bp, Mus musculus
gtggaaatagctttaagaagacaagcatcggtgctggagagatggctcaacggttaagagcactgactgctcttccacaggtcctgagttccat

SEQ ID NO: 58386 - DNA, 117 bp, Mus musculus
tacttgagtaacttgtgtaaagccagtggtctggagacggtatttaattactggatttctttttgtgattgccccatgaatctggctgtactttttgagagagttggaaactatgtg

SEQ ID NO: 58387 - DNA, 79 bp, Mus musculus
cagtactggagaactgtcagtaggctgtgtgtacaggaagaatggtaccaagagcttgccgtggaagccagagaaactg

SEQ ID NO: 58388 - DNA, 115 bp, Mus musculus
tgtagagttcatgtgccaagtctgctctcaggtggcagaggggcaggggcgtgactgaagcttgtgagcccaggatcccaccgacacccacctgtgtgaccacagggaagtcaca

SEQ ID NO: 58389 - DNA, 76 bp, Mus musculus
ttcactgtctgtctgcctctgtctgggagcagcctcttactaatctttgtatcctagcatctggcaaactcaggaa

SEQ ID NO: 58390 - DNA, 58 bp, Mus musculus
atacatacatatatacatatacatatatatgtatgtgtgtatgtatatatgtatgtat

SEQ ID NO: 58391 - DNA, 85 bp, Mus musculus
ggccatggtggtctgataggatgcatgggacaatttcaatatttttgtatctgttgaggcctgttttgtgaccaattatatggtc

SEQ ID NO: 58392 - DNA, 85 bp, Mus musculus
aagctgtcctctgaccttcacacacactctctcttttttaaatttatttttatttgtgggaggggtggtggtttcaagacaggtt

SEQ ID NO: 58393 - DNA, 84 bp, Mus musculus
gtgtatgtatatatgtatgtatgtatgtatgtatctatctatctatctatctgcattctaatacacacacatgtatatacatgc

SEQ ID NO: 58394 - DNA, 85 bp, Mus musculus
tctcttcagagctgattgctgcttcagaagggggtcttgtcgaagagaccccaggagcagttgtgtctttgtagatgttaagagg

SEQ ID NO: 58395 - DNA, 114 bp, Mus musculus
gggaagaagagtttacattctgggctggagagatggctcagcggttaagagcactgactgctcttccagaggtcctgagttcaattcccagcaaccacatggtggctcacaacc

SEQ ID NO: 58396 - DNA, 87 bp, Mus musculus
gtgtatgttatatacacacatatataatatgtatgtatatatattatatgtgtatgtgtgtgagtatgtctgtgtgtgttcctactc

SEQ ID NO: 58397 - DNA, 88 bp, Mus musculus
gtgtggggcaggatacccgggatgagaggtggacatagaaggatgctttgtatctatctgctcactgtctctctggatctgtccccac

SEQ ID NO: 58398 - DNA, 83 bp, Mus musculus
gtctgtctgtctgtctgtctgtctaggtatcatgatcccctgattgccctgcacagtcttaacatcagcaaaggtggagagcc

SEQ ID NO: 58399 - DNA, 109 bp, Mus musculus
gtcgtgtttgagggcattaggatccacacacagaacagcaactgtcattgttaatgtgactctgtttgaacacaagtcagctctgtcacggacaggacacaaatgacag

SEQ ID NO: 58400 - DNA, 127 bp, Mus musculus
cgtctctgtatgtgtacattgtggtgatctagtgtataagacctgtgtgcagtgtttatctgtgtgtctctgtgggatatgtatatgacgcatccaacatatatgcattatatgtttctatctatgt

SEQ ID NO: 58401 - DNA, 99 bp, Mus musculus
aagcagagtatggggctgcagagatggctcatcagttaagagcactgactgctcttccagaggtcatgagtttagttctcagaaaccacattgtggctt

SEQ ID NO: 58402 - DNA, 66 bp, Mus musculus
cacgcctttgtggtcgtcacactgtgtggctttatgactgtcacactgtgtgcctttgaggttctg

SEQ ID NO: 58403 - DNA, 115 bp, Mus musculus
ttgccgaagagcttcacaagtgcccaaagtacatctccacactgtttttgttgttgttacaatcatttatgcagccatgagacgcatgaattgggatgctgctagaatttggtgg

SEQ ID NO: 58404 - DNA, 110 bp, Mus musculus
aggctaggtaattgtcttctgtgttagtttctggttactcactctctgacttaagtgtccacaaagagaagatggtagtaggaagtttgttggaggaattcatcttttct

SEQ ID NO: 58405 - DNA, 82 bp, Mus musculus
gcttactatcacaggcaagatttttttatatttgcttcaaaatttggtaaatgaaaagggtttgacctgaagaaatgtaagt

SEQ ID NO: 58406 - DNA, 72 bp, Mus musculus
agttgaacagttgtgagcacatggatgcgcatatatgggcatatgcatattgatgtgtgcacatgtacaact

SEQ ID NO: 58407 - DNA, 73 bp, Mus musculus
tttggagaccagactggtctacatagtgggtttcagaacagacagagctatgtaatgagaccctgtctccaaa

SEQ ID NO: 58408 - DNA, 112 bp, Mus musculus
gctctggggtgttgcaagagctaggaaacggtgaaagacaagagctacagagcagaattcagctctctcactctgtgtaattacccaccagcctgtgccacctcagtttggc

SEQ ID NO: 58409 - DNA, 113 bp, Mus musculus
gttgataattatgagtgcataagtatatatagtccaactatttttgtatatttacaaaggatgtttgtatttttgtatatattacacgggatatcagcatcctgtgatcttgc

SEQ ID NO: 58410 - DNA, 88 bp, Mus musculus
aaatcactgcagatccaggagactaattattcactatatactttaaggatatataatgaataattttcttcacccaatgtaatggctt

SEQ ID NO: 58411 - DNA, 126 bp, Mus musculus
tagagattcaagactctgataatcttatatgtatgtggatgtacatatatgaatatgtatgtatatacatatatatgcatacatctacacacattcatacattcatgtgttgtctctaatatatat

SEQ ID NO: 58412 - DNA, 83 bp, Mus musculus
catgtatatctgtctgccattgtgttgctggtgcccacagaagtcaaggaaggtgtcagaatattgtgagctgtcatgtcatg

SEQ ID NO: 58413 - DNA, 96 bp, Mus musculus
gcacatctctactttcactgcccctcactccatcactcacatattcatgcccaggaagtgaatggcacagggctgggagtggtcttcagagaatgc

SEQ ID NO: 58414 - DNA, 69 bp, Mus musculus
gtcactgtcactgtcactgtgctcctgtgaagaactcagggaagccgttcaagtgctctgtatggtgat

SEQ ID NO: 58415 - DNA, 80 bp, Mus musculus
gagtgcttgcacgggcatgtgtgtgtgcatttatgtctgtatgttgtctatgtgcatatgtctctctgtgtgtgtgtctc

SEQ ID NO: 58416 - DNA, 75 bp, Mus musculus
agagtctgctaatgaaatgtgtcactcagtctgtgcgcgatatcgagaagattgtgtgtcacttggcagatcttt

SEQ ID NO: 58417 - DNA, 76 bp, Mus musculus
gtgtgtgtgtgtgtgtgtgtgtgtgtccccgtactatgtctggatggagtgcatatgtatgcatgcttcagtgtat

SEQ ID NO: 58418 - DNA, 118 bp, Mus musculus
atagagtagccaggatttggggggaccacagatagatgttctatctatctatctatctatctatctatctatctatctatctatctatctatgtgtgtctgtctgtctgtctgtctgt

SEQ ID NO: 58419 - DNA, 132 bp, Mus musculus
ctacaacagtcagtgcggaaaggttggtgtctctgtgtagcccctggatccagtctctgtccctctgtgatttgtctaggctttcccactgtaactctagtgcttctctgcccctggattccagctggacag

SEQ ID NO: 58420 - DNA, 81 bp, Mus musculus
tggagtttcattacctgagggcatgtgtggaccctcttaaccaatccaagttcactcacagtctgacagcctgtgactcca

SEQ ID NO: 58421 - DNA, 112 bp, Mus musculus
gctagggaatgccagtagtcagtaccagcatgcactgtgatttataaagttattagagaatttgtaaatttgacaattaatttggtgcaagatgctatgtggctccttttgc

SEQ ID NO: 58422 - DNA, 100 bp, Mus musculus
ccccaggacacatctgcagtttggacacttgaagtacctctcaacagtgagagaacacagggaaggtgagtgacaggcatcgtagggatcagcaaggagg

SEQ ID NO: 58423 - DNA, 105 bp, Mus musculus
caaagatgaaaaaaggagttggagagatctgaagactgctttgacatcagacatggagatgcaaagtttagaagtttgccccagctggttttctgtcttgctttg

SEQ ID NO: 58424 - DNA, 87 bp, Mus musculus
tgttgctgttttaaaggtagataaggagtgactgtgatatttgcttacaaagaatttgtagtctcctagataacagagagggcaaca

SEQ ID NO: 58425 - DNA, 92 bp, Mus musculus
gggagttatagaagaatgtcaaggagctggagaagacggttcagtggttaagagcacagactgctcttctgaaggtcctgagttcaaatccc

SEQ ID NO: 58426 - DNA, 92 bp, Mus musculus
gccggtagttccagaagtctgacactcacactgagtttatattgttgacctttggtcctgctttggtttgattgtgagtgtgtcctggttct

SEQ ID NO: 58427 - DNA, 165 bp, Mus musculus
ttcttctctctctgtctgggtcctattttctggagctcccaggtggccgggttgggggtgggaggaactgaattatgtgaattactttgagtctggctcagttcttatgaaaaattctgaattatgtctggcaggaactcttgaatagtttcatgcagtgccttt

SEQ ID NO: 58428 - DNA, 77 bp, Mus musculus
gtgaggcccacccacaggaaccaggtgagtccagggcctgctcactgcactctgcctcaaatctgtctgtctgtcac

SEQ ID NO: 58429 - DNA, 109 bp, Mus musculus
caaaggctggtccacggtgtgagaggtgtagcagtgagctgaagtctgtcctccctgtacagagtgagcacagcagctgtcacatgctgagcagaccaccctgcctctg

SEQ ID NO: 58430 - DNA, 108 bp, Mus musculus
gagttccaattcctagctatcctcaagggtcatattcagcaaatagcttttggccatgaaagactagagacagtttgagagcttgtcaccttgagtttcaggagactc

SEQ ID NO: 58431 - DNA, 65 bp, Mus musculus
caggctagaaagctataggagctctgaaagggtctcagtgtctcctgtgtctgtgtctgtgcctg

SEQ ID NO: 58432 - DNA, 103 bp, Mus musculus
tctggatctacttgtcagtttcccttttaaaatatcataccttaaagtacctataactttaatttattatgtatatactatagatactgacagtcatttcagg

SEQ ID NO: 58433 - DNA, 120 bp, Mus musculus
gtctatcatgtgtgcagaaaccacgagttgttggttcccctggtgctggagtaacaggcagttgtgagacagcacacgggtgctgggactcaggtcacctgtaagagcagtgagcaactt

SEQ ID NO: 58434 - DNA, 84 bp, Mus musculus
tttgatttacatgcgtgtgtgtgtgtgtgtgtgtgtttgctcgcgagcacgcacgcacgcactctcacacataagggtgtcagg

SEQ ID NO: 58435 - DNA, 87 bp, Mus musculus
ccatctcagaggtgaaagggagacattctggggtgcctctgtggggtgcagaaaacgtgtctgtctgtctgtctgtctctgtgctgg

SEQ ID NO: 58436 - DNA, 101 bp, Mus musculus
tgcagatgtttccctttccccaactctatttgtttatttcatgtaagtcatcctggcaggttatcatttggacttagggttcagaggcaaagccatctgca

SEQ ID NO: 58437 - DNA, 83 bp, Mus musculus
atacactttatgtatgtatgtatgtatatgtgtaaatatgtgtgtttaaatatgtgtgtatgtgtatgtatgtatatgtgtgt

SEQ ID NO: 58438 - DNA, 64 bp, Mus musculus
agaccggaggagagtgaagtgagtgtgtgaatgaatgcaatcccatttcactttctatttgttt

SEQ ID NO: 58439 - DNA, 74 bp, Mus musculus
cagttcccttcaaagaagtcacactggagaggtaccgcacctgtgttttcagtgtgagaaagtttgaaggattg

SEQ ID NO: 58440 - DNA, 97 bp, Mus musculus
cagatagccgtgtttctctgtggttttattttccccttgagaggacacacacaaagagagagagagtcagagacagagagagacacagcgagaactg

SEQ ID NO: 58441 - DNA, 96 bp, Mus musculus
agctgctgggtttttctttcagacttatttacttttattttatgtgtattttatgtgtatgggtattttatctgcatgtaagtaagtccagtggtt

SEQ ID NO: 58442 - DNA, 57 bp, Mus musculus
ctgcctgtctgtctgtgggactctgctcctgagtgcagtgcttacagaagccagaag

SEQ ID NO: 58443 - DNA, 71 bp, Mus musculus
ggggcacaacttaggatgagactgtgcagagtgggctgcgctggcggtttcatttccgggtgtgatggccc

SEQ ID NO: 58444 - DNA, 70 bp, Mus musculus
gcactcctggaccgtaggtgttgtctgcgcctgagcagaggcagaatgtcagacagcacacaaagggggc

SEQ ID NO: 58445 - DNA, 87 bp, Mus musculus
gttttctggttgtttctggtagatttcaggtgagtctgacactgtcttagatgcctgtgaactcagtgggccaggggggcagagggt

SEQ ID NO: 58446 - DNA, 75 bp, Mus musculus
gagttccagtggtcagagcactctctgcaggcaagctcttctcttgcagggcacatgtacagaagtctggagttc

SEQ ID NO: 58447 - DNA, 85 bp, Mus musculus
gggagcaatggcggctcagagtaaacattgattcatttttctacctgaggatttgaacttctctgtctctgtctcacccactctc

SEQ ID NO: 58448 - DNA, 110 bp, Mus musculus
tctgaactcctgcgcactgtttgctcttttatttcatagtattcaccaggccatattttttaatttattattctgtgcaaaaaagtcagaagacagcctgcaggagcagg

SEQ ID NO: 58449 - DNA, 61 bp, Mus musculus
gggttctctagaggaacaaaactgatagagtgaatctatcagtctgtctgtctatccatcc

SEQ ID NO: 58450 - DNA, 77 bp, Mus musculus
gaaagaccagcaggatgtttgagctccagattagtggtttatctgactcaatgtctcagacatgctgattatcattc

SEQ ID NO: 58451 - DNA, 91 bp, Mus musculus
atctgaggttggagctggagatggctcagcggttaagagcactgactgctcttccagaggtcctgagttcaattcccagcaaccacatggt

SEQ ID NO: 58452 - DNA, 97 bp, Mus musculus
gtgtgctttgagcttcagtaaagtttctttttataaatgtgggtatccttgcatttggagcatagatgtttagaattgagagttcatcttggtagat

SEQ ID NO: 58453 - DNA, 103 bp, Mus musculus
tttgtctggcatgtttgaggttctaggttcaattctgtggggtctcagagagagagaaagagacagagagacagacagacagagagacagacagacagacaga

SEQ ID NO: 58454 - DNA, 117 bp, Mus musculus
gcttctagttttaattccattatgatgacatagacaaaattatttcaatatttgtgtattgatgctgttctatttgagtcttttgtatgatctgttttggaaaaaagttctatgggc

SEQ ID NO: 58455 - DNA, 145 bp, Mus musculus
catatatgtatgtatgtatgtatgtatgtatatatgtatgtatatatgtatgtatgtatgcatatgtatgtgtatatgtgtgtgtgtgtgtgtgtgtgtgtgtgtgtgtgtatatatatatatatatatatatatatatatatat

SEQ ID NO: 58456 - DNA, 69 bp, Mus musculus
tgagtggtgaattctatgattttatatatagcagatgattatatatataaaacaggtatttatcactta

SEQ ID NO: 58457 - DNA, 90 bp, Mus musculus
atccaatccaaactcatgctagctgggggacatttgggctagcccctttgtctctctgtgcctcagcttccctgttagagcatggacgat

SEQ ID NO: 58458 - DNA, 72 bp, Mus musculus
ggcagaggtctggttcatttcagctccttcattgccaaacctgggggtagagactgtctcagtttctctgcc

SEQ ID NO: 58459 - DNA, 80 bp, Mus musculus
gtgtgtgcctcaataagtgtgcatggatgtgtatgtatgtgtgtactgggctcaatgagtgtatacttgtatgtatatat

SEQ ID NO: 58460 - DNA, 118 bp, Mus musculus
taggttagtggcccacagacccagcctgcagcatggagccaccactcgctcaccctgctgtgagaagagtgtggccacagtgttgccagcaggcttataaacaccgtggtcacccctg

SEQ ID NO: 58461 - DNA, 68 bp, Mus musculus
tatatatgtatgtgtgtatatatatatatgtacacatatacatgcatacatatatacatacatatata

SEQ ID NO: 58462 - DNA, 103 bp, Mus musculus
agtgtcttaatttggcttattcgtagagcttttaaagtgaaagactgtgcatgtgcttgtgtttatgcacgtgcatcttttagctcctgccaaattattcact

SEQ ID NO: 58463 - DNA, 127 bp, Mus musculus
gcctgcaacttataaatcagagtgagctctcagctactgctctagtgccgtgcctgcctgcctgcctgcctgctggccaccatacttccttcgatgctagccatgggctaaccttctgaaattgtga

SEQ ID NO: 58464 - DNA, 111 bp, Mus musculus
atgatgatgccggctggcattagaaatgtacctgaagagatggctcagcaagttaagagcactgactgctcttccagaggtcctgagttcaattcccagcaaccagatcat

SEQ ID NO: 58465 - DNA, 117 bp, Mus musculus
ttaagtgcagatgataggctattcctggaagtgcaattcaagactgtgagctgacaccccataatgccatgactatcttgaatgcatgtttatttgggaaataaagtccgtagttaa

SEQ ID NO: 58466 - DNA, 77 bp, Mus musculus
tacttatatattatgtacatatgtatatgtatatgtatatgtatatgtatatgtatatgtgtgcatgtgtgtgtgta

SEQ ID NO: 58467 - DNA, 106 bp, Mus musculus
gaatgtcaaatcagatgtggaaaacataaggagagtttgtagcttccttggattgtaaactgatgggatatgattctctatgttcccaatgtgtgaatgtatattt

SEQ ID NO: 58468 - DNA, 124 bp, Mus musculus
gtgtgtgtgtgtgtgtttgtgtgtacgctcgcatgggagtgtgtgttcatatatatgtatatatatatatgtatatgtatatgtatatgcacatatgtgtgtgcatgtatgtatgtatgtatgt

SEQ ID NO: 58469 - DNA, 108 bp, Mus musculus
gaaaaaagatcctctgtttaaaattggccagcagggtatcaggatggcattggaagaattctgcttgtacatcgtttctaagctatctttatcctgcttgttctgttc

SEQ ID NO: 58470 - DNA, 82 bp, Mus musculus
gtttgtgcctggagagatgaagcactactgttggtaagggaaagtcccatatatttaatgacagtaggctgtgagcagaaac

SEQ ID NO: 58471 - DNA, 104 bp, Mus musculus
actctgaaggtgaggaatgtgaagctcagtcacttaagtgatcagtgtgaggatcatgtggttagtaagtgacaaagtgggattcagactcacactgcatgagt

SEQ ID NO: 58472 - DNA, 72 bp, Mus musculus
cagagccactctgtccctctctcccttaggaacactcctgcaatatgatatgaggcatggcagtaggcaatg

SEQ ID NO: 58473 - DNA, 74 bp, Mus musculus
ctgtgttctctctctgactgtggacatcagaagcaacttttctgagagtcaatagtttcacatagagagtgtgg

SEQ ID NO: 58474 - DNA, 84 bp, Mus musculus
gctatctgaacagcaagtgaacggccagtaaatgtgaccctgaaaactttcaaaccttctgaagtcactttgttgtacagtagt

SEQ ID NO: 58475 - DNA, 93 bp, Mus musculus
acctaatttctctctcaatttgtcctagtactattataaaaataaatgggcattgtggtaagatatggacgcttagtgtgggttccattaggt

SEQ ID NO: 58476 - DNA, 61 bp, Mus musculus
tgcatgtgcatgtgcacgtgcgtgtacacacatacacacacacacacacacacacactgca

SEQ ID NO: 58477 - DNA, 109 bp, Mus musculus
cagcattgtctctaccacatttaagggtggcaggtacttacagagtctcttcctagactctgtatctccaagtccatctgtccattccttgctgagggagacagaggtg

SEQ ID NO: 58478 - DNA, 98 bp, Mus musculus
taggctttactgggcttttaggaaatgctagatctgtgaggtaatcatgcccctggaaatgcctaagataacctacagctctcaaaaggccaagctta

SEQ ID NO: 58479 - DNA, 85 bp, Mus musculus; identical to SEQ ID NO: 57439

SEQ ID NO: 58480 - DNA, 76 bp, Mus musculus
gtgggagcatggagcatggacttctacatggtttctggtgacagcaaacactgtggacatccatgtcatctcccat

SEQ ID NO: 58481 - DNA, 89 bp, Mus musculus
gcacagtttaaaagtgccaattattagttgtcatatatatatgtatatagtacatatatatatgtattaatacacagttgaaaaagtgt

SEQ ID NO: 58482 - DNA, 114 bp, Mus musculus
gtcctgtattgattcatcaatgacattttgcagcccatgactatatttataaattatacgcagtctgtggtagtttgagtggaaaaatgttgttccccccccccccatacaggc

SEQ ID NO: 58483 - DNA, 104 bp, Mus musculus
gtcataaggtagccccatctctccttaggacactcaacagagagaagtgtgtgcccagaggctctgtgaagagtgtcgtgaccaatgaccacagaccatatgcc

SEQ ID NO: 58484 - DNA, 84 bp, Mus musculus
tctgaaaccatactctcttacactctctgcaagatgtgtctgatatcactaggagatgctatctgatgggaggtgtgtgtcagg

SEQ ID NO: 58485 - DNA, 91 bp, Mus musculus
gaagagtctatactgtgtggcaaggaaaagggcatgccaatcctctgttctaattttcttgttcatatactatttcttgcctggattcttt

SEQ ID NO: 58486 - DNA, 113 bp, Mus musculus
acatatatatgcatacacatacatatacatatataatatatatacacatatatatgaatgtatatatgtatgtatgtaaatatatgtcaactttaactaaaataactatgcat

SEQ ID NO: 58487 - DNA, 83 bp, Mus musculus
agggggtgagatgtagcaagaaacttgagtccgggctgggaatggcaatcctctgagctcatgctgtctgtgtattgcctcct

SEQ ID NO: 58488 - DNA, 75 bp, Mus musculus
aagaggaattgaaatgtgtggtatgtgcttgtacagttttaagtacttacaggttggacacacagggatgctctt

SEQ ID NO: 58489 - DNA, 129 bp, Mus musculus
caggtccctcccaggagctcactggccagcccttccagccaaactggtgagctcttcagtgagagactctgtctcaaacaataagatggaaaagtaatcaaggaagatacccggtgttgacttctggcc

SEQ ID NO: 58490 - DNA, 79 bp, Mus musculus
tagatgacagatcatgagacttcttagcttctatggtcacataggtcaattgctgtctgtctgtctgtctgtctgtctg

SEQ ID NO: 58491 - DNA, 116 bp, Mus musculus
gctcaacaaatttttttttattgctttattatgcaggacacttggggggtctctttatctcacactgtctcttctgggttttacctgcaaaaggcattaaaggtccatttatgggc

SEQ ID NO: 58492 - DNA, 74 bp, Mus musculus
gcaggaagaggaagaggatagactgacaaagctggtcacctgccagattctagtctctctcagtctctctctgt

SEQ ID NO: 58493 - DNA, 87 bp, Mus musculus
gctgaggtttcaccgcacccagctctgctactgaggtcaggaacgcaacttcctgaatctgactggctggctctgtctctcctcagc

SEQ ID NO: 58494 - DNA, 71 bp, Mus musculus
gatgcagtatagggtagaagacagatgttcaaatggaaggtgaaggtctccctgtctctgtgagtgccatc

SEQ ID NO: 58495 - DNA, 89 bp, Mus musculus
ctcaaagttcccagggccaatcgtttcctgagggtggcagatctgcccagcacatctctcagcctctgactttgtccaggaactttaag

SEQ ID NO: 58496 - DNA, 111 bp, Mus musculus
ggtgtcttgaattaggtttgttttgggtgagcctggctcttctgtctttcactcattctcttaatgtggtgatccagcaagaagttcctcacacagggctggagagatgcc

SEQ ID NO: 58497 - DNA, 82 bp, Mus musculus
gaagtgtgaacactgaattgacagacctctgggagctcacacactggccgctagatctctgtaatgcattgttgcactcttc

SEQ ID NO: 58498 - DNA, 95 bp, Mus musculus
tcctggtccaccctcttttaaacatgtaactagatagagagcactttaacagcaaagtgctctattgtccttactttaaaagtcttcaaccatga

SEQ ID NO: 58499 - DNA, 111 bp, Mus musculus
tggtacacgtgtatattaatagatgtgtgtatagtgcttgaagcttgtaaacatattttctaaggttggagtaggtcatggcatatatttttagtaaaatttaaaagacca

SEQ ID NO: 58500 - DNA, 115 bp, Mus musculus
ttgtgtctccttatgagcatgtttatactgtgagaaataatgaacagattttgttttacacaactaattagactagtttatttttttcattaaaaaacatgtaaaacattcacaa

SEQ ID NO: 58501 - DNA, 85 bp, Mus musculus
cttgcaggtgggggaaggagaaatttcaaactttacttattgatattcaattttgaaatttcagttctaattctttacttatgag

SEQ ID NO: 58502 - DNA, 85 bp, Mus musculus; identical to SEQ ID NO: 57470

SEQ ID NO: 58503 - DNA, 114 bp, Mus musculus
tggaaggatcttctcttctgctaggtgagctttttctgacctgtgctttatctgtgcctgcctccctgcctgagcatcacagctaggatagttcccacagcaggaggaccccca

SEQ ID NO: 58504 - DNA, 104 bp, Mus musculus
gcccatgcccacacacgtgcacacacatgcacacacatgaattttcttaaatcctatgtatgaaagtatgtatgcatgcatgcatgtctgtgtatgcatggagt

SEQ ID NO: 58505 - DNA, 125 bp, Mus musculus
gacttttataatttttaagtttcatatttcaagtatatatatatgtgtgtgtgtatatatatatgtgacttataattttaagtttcaaatttcaagtatatatatacatacatatgaatatctat

SEQ ID NO: 58506 - DNA, 88 bp, Mus musculus
gagggaggagagatggagagatggctcaggggttaagagcactggctgctcttccagaggtcctgagttcaagtcccagcaaccactt

SEQ ID NO: 58507 - DNA, 86 bp, Mus musculus
ggcagacagcaggagagtctcttttgcccagggtggagcttaaacatagcccaccctcacagtgactcacttcctccaataaggcc

SEQ ID NO: 58508 - DNA, 92 bp, Mus musculus
tgctgtagaaggacatctgaaggctggagagatgggtcagcggttaagagcactgactgctcttccagaggtcctgagttcaattcccagca

SEQ ID NO: 58509 - DNA, 116 bp, Mus musculus
ggccagagtgtctgaggagtttttccatctgtctgtttgtctgtctgtctgtcagatggcatgcatgtgccatggcatatatgtggatgccagaggacaactttatggagttggtt

SEQ ID NO: 58510 - DNA, 102 bp, Mus musculus
tatagacatgtgttaccatgcctacctttgatgcctttaaaacaaaatacattttgttttaaattatatatgtgtgtgtgtgtgtgtgcacctgcatctgta

SEQ ID NO: 58511 - DNA, 70 bp, Mus musculus
tgtatatatgtgtgtgtgtgtgtgcatatgcatgtatatgtatacacacacacacacacacacacacaca

SEQ ID NO: 58512 - DNA, 79 bp, Mus musculus
ttggttgacacattctgtctgtctgtataaggcacatatgagaactatctttaagcagacatcaggaatgtgctgccag

SEQ ID NO: 58513 - DNA, 128 bp, Mus musculus
gtatatatgtatatgtatacacatacatatatacatatatatgtatgtgtatacacatatatatgtgtatatatatatatgtatatatatatatatacatatatatatatatacatgcatgtatcatg

SEQ ID NO: 58514 - DNA, 74 bp, Mus musculus
tggatgcagggagaaatgacaagattcctgattccactaagctgcctttctgttcacacttctctctgtgtcca

SEQ ID NO: 58515 - DNA, 82 bp, Mus musculus
gtgtctaataaagtatgaaatgatacataatcaatgagcctaaaggaatttgtttgaaaatgtatgatttatactgagacat

SEQ ID NO: 58516 - DNA, 84 bp, Mus musculus
ggggtaagacttagtcttagatatttagggttgttgtataataataaaacatttacctattttaagtctaagtcactttgcctc

SEQ ID NO: 58517 - DNA, 77 bp, Mus musculus
gcctggtgtttggctggatttttctgtggatagtgctccgtgtaatggtcttcagtccccctgactcacacacaggc

SEQ ID NO: 58518 - DNA, 113 bp, Mus musculus
tgactagcccccttccctggactcagcactctggagatagtctgcctctcattgtctgtcctattcaagactccagaccagctctgaggctgtgccttgtagagaatgtgtca

SEQ ID NO: 58519 - DNA, 84 bp, Mus musculus
acacagagagagagagagagagagagagagagagagagagagagagagagagaatgtgtgtttgctgtctgtctcactttgtgt

SEQ ID NO: 58520 - DNA, 104 bp, Mus musculus
gcgcgcgtacacatgtgtgtgtgcacatatttttttacagagagagagagaggtggcagacagagagagagagtgtgtgtgttttatatagcagtgtggcgtgc

SEQ ID NO: 58521 - DNA, 98 bp, Mus musculus
agtgagggctcagaggtgtgaggcttgggatgggagcccgggacttttattttggagagtgtcactctcagtaagtcaatcaacatttcagctcagct

SEQ ID NO: 58522 - DNA, 123 bp, Mus musculus
gtgcatgtgtgtgagtgtgtatgtgtgtctgattatatatgcatgtttgcatgtgtgactgtgtgtgtgcatgtccatttgaatatgtgtgcacatgtgtctgagtgagtatgcatgtgtgtc

SEQ ID NO: 58523 - DNA, 87 bp, Mus musculus
atgtatgtatgtatgtatgtatgtaatatatatggatattaatactcaaacctcaagtatagtttatatatatatatatacatatat

SEQ ID NO: 58524 - DNA, 76 bp, Mus musculus
tacttttacttttatatactagcatatgtgtatatgtttatttatatgtacatgtgtgcatctatatatgtatgta

SEQ ID NO: 58525 - DNA, 108 bp, Mus musculus
caggttttacttccatgatttgaagtagtctaggcgggttttagaattatctttaaatatttgtaaatggctctggcatctggacactttctcaggaggctaactctg

SEQ ID NO: 58526 - DNA, 111 bp, Mus musculus
ggctcagcttacaggtttagaggttcagtccgttatcatcatgacaagacacatgacagtgtccagatgctggaggagctgagaattctacatcttcattgaaaggaagcc

SEQ ID NO: 58527 - DNA, 119 bp, Mus musculus
tgctacctgcagctgctgcaaggcccctccagggcacttgaggaatgctactgtggaatttgacagttcagactgtgcccttaggctgttgatggtgaaaaagagctagccaggtgtca

SEQ ID NO: 58528 - DNA, 81 bp, Mus musculus
cacacagcccttaggatacagaaatatgtgatcatttctttaaatttttgtaaaaacagtctgtttcttaaatactgtgtg

SEQ ID NO: 58529 - DNA, 69 bp, Mus musculus
ctcgaacaggtgtggtagaggagggtggcagtgggtatctctgtgagtctctctcaccatatcagtgag

SEQ ID NO: 58530 - DNA, 110 bp, Mus musculus
agataatcagctcaagcaaggcagaagtgaatcgaccaggtaaagaataattgtatatgtgaatatgttgctatgtgtcagagtcaaagctgtgtttttttgcagtatct

SEQ ID NO: 58531 - DNA, 104 bp, Mus musculus
ggctggacagagttgtcatgtgtctgcctgtctacacttgctgtgcagaacatccgctcacctgtacagcaggcacagacaggcagtcacatgacaacccagcc

SEQ ID NO: 58532 - DNA, 56 bp, Mus musculus
ttcactctttcttctttcttttttaatggatgagagagagagagagagagagagag

SEQ ID NO: 58533 - DNA, 85 bp, Mus musculus; identical to SEQ ID NO: 57439

SEQ ID NO: 58534 - DNA, 98 bp, Mus musculus
tgcatttttcatatatatgtgtatgtgtgtatatatatatatatacatatacatatatatacacatgtatatgtatatgtatatgtacacacacacat

SEQ ID NO: 58535 - DNA, 72 bp, Mus musculus
gctggtctgagcatctcttcatgctgatggatatcatgatgataatgggagaagagactgaacagagttagc

SEQ ID NO: 58536 - DNA, 79 bp, Mus musculus
ctgtctgtctgtctgtctgtgctctcatctctggaacaaccaggtattggagggtttcacttagcattacaatagatag

SEQ ID NO: 58537 - DNA, 113 bp, Mus musculus
acatatatatttttaaatatgcatatacatatataaaaatttgtatatatgtatatgtgtgtatacatgtatgtataaatgtatgtatatgtatatatgtatatgtgtatatg

SEQ ID NO: 58538 - DNA, 101 bp, Mus musculus
gactgtgcatgtgtgtctctatgtgtgtgtatggtatatacatgtgtgtgtctctgtatctgtgtatgtatctatatgtatgtgtgcatgtgtttgtggtc

SEQ ID NO: 58539 - DNA, 81 bp, Mus musculus
aggaagcctcaggggcctctcacacactgtctgggtactttgtctgtctcctggacacctggaattctctctgtgcttctt

SEQ ID NO: 58540 - DNA, 99 bp, Mus musculus
gctcattggtgcaccaagttgaacttttggtggtatctgtattttggtctgttacagcttctctatctggggtaagtagatgtgtgtgtgtgtgtgtgt

SEQ ID NO: 58541 - DNA, 80 bp, Mus musculus
tacatatacacacatttgaatatgtgtatacgtatatgtagtgagatatatatgtatatatgtgtgtgtgcatatatgta

SEQ ID NO: 58542 - DNA, 107 bp, Mus musculus
tgacttcaatcaaaccaaagctctagttgtggtgtggtcactttgggacacagatatgagtgtgcagaagccttcacgcctagctaggggtttggcttgtgttctca

SEQ ID NO: 58543 - DNA, 114 bp, Mus musculus
tttagaaaaccccacacttttagaacttttactagatgtggcaaattctcagagaactgagagttgtcattaaactataaaagtaagcagcgttcttccatttctgggtctgaa

SEQ ID NO: 58544 - DNA, 69 bp, Mus musculus
cagtgtcagtcagtagccgactgtcaggagcatagatgtcttcacatactcactcagtgactgatgctg

SEQ ID NO: 58545 - DNA, 79 bp, Mus musculus
tatatgtatacatatgtgtgtgtatgtatatatatatatatatatatatatatatatatatatgaatgatagaggtgca

SEQ ID NO: 58546 - DNA, 74 bp, Mus musculus
tctctgtgtgtgtgtgtctgtatgtgtgtatgtattacattctctcaggaaaagtctctcacacaacaccagga

SEQ ID NO: 58547 - DNA, 85 bp, Mus musculus; identical to SEQ ID NO: 57470

SEQ ID NO: 58548 - DNA, 68 bp, Mus musculus
acacacatacatacacacacacacacatatatatatatatatgtgtgtgtgtatgtatatatgtatgt

SEQ ID NO: 58549 - DNA, 84 bp, Mus musculus
acaggactgtgactccagtgagcatttttgtctggcgcctcgagaagctaagtacagtttttgatctttggactcactttttgt

SEQ ID NO: 58550 - DNA, 99 bp, Mus musculus
tgaaacacagcttccaaggaaatgcattacccggaagtggccgagtgagtctggctcacactgggtcacagtggcagactggtggagggaggtgttcca

SEQ ID NO: 58551 - DNA, 104 bp, Mus musculus
acagtactcacccctccatattatatgtctcttactctgtctcctcttctgggatgctttttgagccttggtgatggtggtgatggcggtagcggtagtgggta

SEQ ID NO: 58552 - DNA, 86 bp, Mus musculus
agaaaaatagcttcagatatggtgataaggaggcccgagactgctgctctatttacttatctatctatctgtctgtctgtctgtct

SEQ ID NO: 58553 - DNA, 114 bp, Mus musculus
gctttatccaagtgtcaggcagctttggatgctgacacctatgtctgtctgtagacagagaggttgaccagtggaaataaaagctcaatgatcgtcctgaacactgggtacagc

SEQ ID NO: 58554 - DNA, 66 bp, Mus musculus
gtcatcctgtgactgcgtcagttctgtgggctctcatgacatgcatactccttagtcatgggtggc

SEQ ID NO: 58555 - DNA, 85 bp, Mus musculus; identical to SEQ ID NO: 57470

SEQ ID NO: 58556 - DNA, 75 bp, Mus musculus
cactgtctccataagcacgtcaatgatggcccagtaccatttgctaaccacaacctgctttgatgagggatagtg

SEQ ID NO: 58557 - DNA, 70 bp, Mus musculus
gatacagaggaacaggcagaagggttaagtggatcccttcactcactccctgtgactgttctttgcaggc

SEQ ID NO: 58558 - DNA, 108 bp, Mus musculus
cagagacataggaagaggcagtgtagaaatgcttctcactccctccttaaactcattctctctgtctctccacctttgtctgcctctctgcctctgtctgtctctctg

SEQ ID NO: 58559 - DNA, 87 bp, Mus musculus
cttgcagtgttgctgagtgtttgggaggcagtgtggcctggtgccttgggtttggcttcgctcactcgctcactggctaagagctgt

SEQ ID NO: 58560 - DNA, 119 bp, Mus musculus
gatgtttagaaaagagaaattttaaagagaagatgtttagagagagagaatcttgttttactttgtctctgtctccctgacatcataatgcattttactttctcagatggtataagctc

SEQ ID NO: 58561 - DNA, 85 bp, Mus musculus; identical to SEQ ID NO: 57470

SEQ ID NO: 58562 - DNA, 104 bp, Mus musculus
gctacttgacctttttcccttactgcttttaatattcagtcggtcttaatttactgcatttgttgttctgattattatgtgtcgggaggaatgtcttttctggt

SEQ ID NO: 58563 - DNA, 120 bp, Mus musculus
gctgtaattctctgtaagaatggcatctgagctgaagaccgtactgcgcccctcctctcagtctctgcctgtgtttgcacagcagtgagcggaaatcagtgccgatttcgttcacgttgc

SEQ ID NO: 58564 - DNA, 94 bp, Mus musculus
cctatatatttcaatgagaaatttttctttatatgtacaggaaaaatactgcagtattagtgtgtgtatgagtgtgagtgtatgagtgtgtggg

SEQ ID NO: 58565 - DNA, 76 bp, Mus musculus
tctagtctgcccaggtgagagtgcggtctacagaagcgacacaacttctgtgacagactctgtttcagactccaga

SEQ ID NO: 58566 - DNA, 61 bp, Mus musculus
ccacacggtagctgccaatttcctcagactctgagtgtgtggtaaggcttaattgtgttgg

SEQ ID NO: 58567 - DNA, 69 bp, Mus musculus
ctgatgcttctgtccccagcgatggaaggtaaatccctatggctgaagacactgtgcacttcagaagca

SEQ ID NO: 58568 - DNA, 86 bp, Mus musculus
tgatgctctgtgtctgttatcctagcatttgaaaggctgcagcgaggttatttgtgctcagaagtttgagaccagactgagcaaca

SEQ ID NO: 58569 - DNA, 113 bp, Mus musculus
tggaggacttaggatctgaagaatcactagtatgtgtgaccctctgtgaggctgacatagtaacaggaccaggagcacattccggagaagtacttcacaactgatcatctcca

SEQ ID NO: 58570 - DNA, 62 bp, Mus musculus
gtatgtatgtatgtatgtatgtgtatatatatctatatatacatacatacatacatatatat

SEQ ID NO: 58571 - DNA, 106 bp, Mus musculus
aggaaacagctctttgacagtggagcaagtctgtaaactctcagtgtctctctccagtggtgtactttatccaagaaggcttcatgtcctaaaagtgccataacct

SEQ ID NO: 58572 - DNA, 113 bp, Mus musculus
tctaaagtcttatcatgtatttaatatttgcttccttccttatagtctgtgtgtcccattggaagaactcagtgtgctatactcacttttgagcaatcaacatggagactaga

SEQ ID NO: 58573 - DNA, 81 bp, Mus musculus
tgtgtgtgtgtgtgtgtgtgcatgcgctcatgtgcaagtatgtatgaatgtttgtatgtgtgtgcatattcatgtagagat

SEQ ID NO: 58574 - DNA, 103 bp, Mus musculus
agagatagttagttcccaatccctgaagtcactgtgcttacacacacacacccacgctctggtccctagctctaagcccaggactccaactctaaccatcact

SEQ ID NO: 58575 - DNA, 72 bp, Mus musculus
gtgtcatctctaacccctcttccggctcaataactggctatgtgacagaggacagaggggctgatctgaggc

SEQ ID NO: 58576 - DNA, 78 bp, Mus musculus
tctgtctgtctgtctgtctgttgtctgtcgtgtatatgtcaagggctacatgtggacatatggaggcaattggctaga

SEQ ID NO: 58577 - DNA, 83 bp, Mus musculus
ctctgtgaatgatagtagtgtgtgacgtgaggcgtgccatgggacaccgtgcattgacacatcttcaacacttattagcagtg

SEQ ID NO: 58578 - DNA, 92 bp, Mus musculus
tatatatgggtgtgtatacacttgtatatattatatatgtgtatgcatacatatgtgtatatatacatatataatgtatgtgtgttaatatt

SEQ ID NO: 58579 - DNA, 144 bp, Mus musculus
atatgtatatatgtgtgtgtatatatagtgtatatcatatatacacatgtataaaatgtatatataatatataaatatataatacatatattatacacacatatatatatgtgtgtatatatgtgtacatatatgtatatatat

SEQ ID NO: 58580 - DNA, 68 bp, Mus musculus
gatgtatgtatcatgtatatatacatatatacgtatatgtaaagtatacatgatactaggagagcatc

SEQ ID NO: 58581 - DNA, 81 bp, Mus musculus
tgtctgtgcatatgcatgtggaagctggaggacaaccttcatggtagttcctcagttaattcgaatttgttttgtgaggca

SEQ ID NO: 58582 - DNA, 102 bp, Mus musculus
tgtgtctatgtgtctgtaagtatgattctgtgtatgtctgtctgtgtattttctatatacctgatgattcccatagtttcaacataatgataaaaaggcaca

SEQ ID NO: 58583 - DNA, 117 bp, Mus musculus
agaggttaagatgcagtcccagtctctactccctaataagtctcacactttctgactcagattgatgtttttcttccttgggatgtatcgatgcacacatttcatttcaactagtct

SEQ ID NO: 58584 - DNA, 85 bp, Mus musculus
ggccatggtggtctgataggattcatgggacaatttcaatatttttgtatctgttgaggcctgttttgtgaccaattatatggtc

SEQ ID NO: 58585 - DNA, 85 bp, Mus musculus; identical to SEQ ID NO: 58584

SEQ ID NO: 58586 - DNA, 81 bp, Mus musculus
gcagttgcggttggttataggaacacttacctaagagggaagccaggtatagtggtatttgcttgtaatcttagcagttgc

SEQ ID NO: 58587 - DNA, 161 bp, Mus musculus
gtgtgtgtgtgtatgtatatatatacatatatatgtgtgtgtgtatgtatatatatatacatatgtgtgtgtgtgtatatatatatatatatatatatatatatatatatatacatatatatgtgtgtgtgtgtgtgtgtgtgtgtgtgtatggcaagcac

SEQ ID NO: 58588 - DNA, 85 bp, Mus musculus; identical to SEQ ID NO: 57439

SEQ ID NO: 58589 - DNA, 68 bp, Mus musculus
tctctgtgcccatcactgtactctgaaaggacataagtcaacggcaaatacagtcatggcctgggaga

SEQ ID NO: 58590 - DNA, 99 bp, Mus musculus
gctaagcttacaagagttgattacactgagattataagctgtgataagattgattacatagtttttgttaaagggcagttgattctgatcaggctaagt

SEQ ID NO: 58591 - DNA, 66 bp, Mus musculus
tgtgtatgtatatgtatacatatatatacatgtctatctatatgtatgtgcatatatacatatgta

SEQ ID NO: 58592 - DNA, 72 bp, Mus musculus
gttcctggcttataggcaggataagacatgagtctctttgagaggatgtctttggttttctagtcagtgaac

SEQ ID NO: 58593 - DNA, 78 bp, Mus musculus
gtcaagtgagaagagtgtgtccacaaagggtggagacagctagtgtgtcgacggttctgatacactcctgaaaaggac

SEQ ID NO: 58594 - DNA, 82 bp, Mus musculus
ggaaatttggaacaaggaactcgagcagggactggaacagaaaccatggcttcttgctggctggctctctgtttccctttcc

SEQ ID NO: 58595 - DNA, 110 bp, Mus musculus
tatgtatatatacatatatatacacatatatgtgtacatatatgtgtatatatacatatatatatacacatatatgtgtacatatatgtgtatatatatacaaatacata

SEQ ID NO: 58596 - DNA, 107 bp, Mus musculus
gtaacatgacaacagccaggccggcatgctgtgtctgtctgtccttctgtcctgtaacatgacaacagccaggccggcatgctgtgtctgtctgtccggcatgctgc

SEQ ID NO: 58597 - DNA, 72 bp, Mus musculus
ctttctctgtgtctctcggtgtcaaggagccattttgtgctcttcaaagtgacaagagtgtttctgaggaag

SEQ ID NO: 58598 - DNA, 76 bp, Mus musculus
atataatggaggatatatatacatatatatatatatggatacatatgtgtatatatgtatatatatatatatatat

SEQ ID NO: 58599 - DNA, 60 bp, Mus musculus
gagctctctttctcagtctttgaatgtctagtttataggccaaatgcttgaaggggagcc

SEQ ID NO: 58600 - DNA, 88 bp, Mus musculus
ggacaggaatgagcagatgtgtgtaatgcagatgtgtgtaatgcagatgtgtgtaatacagatgtgtgtgtgcagatgtgtgtgtgca

SEQ ID NO: 58601 - DNA, 92 bp, Mus musculus
agagttgctgtggtcatggtgtctgtttacagaagtaaaaccctaactaaggcacctggctcactgtttctctctccacagacaactagacc

SEQ ID NO: 58602 - DNA, 79 bp, Mus musculus
tgttaaaaagacacagctaggttttcgtcagccagccacactcgtgtgccaggctccgtgaaagccgtgtatttaaaca

SEQ ID NO: 58603 - DNA, 77 bp, Mus musculus
ctgggatctgcagtggggagcaatggaacaggcttcagctaaagagccccgtctagtctctctctcagtgctcccag

SEQ ID NO: 58604 - DNA, 74 bp, Mus musculus
atgtgcatgtgtgtatatgcatgcatacgcgtatgtatgtatgtatgtatgtatgtatatatgtatatgtgtgt

SEQ ID NO: 58605 - DNA, 85 bp, Mus musculus; identical to SEQ ID NO: 57470

SEQ ID NO: 58606 - DNA, 69 bp, Mus musculus
gctcctctcccactctctgtgagtccccagagtactcctcttgggcaaacccagtattgggagagggac

SEQ ID NO: 58607 - DNA, 84 bp, Mus musculus
ggtcttaagcagtggacagttgtgccctccctactctagagcgtttagcagtatacggagacaactattttagttgttgtgacc

SEQ ID NO: 58608 - DNA, 83 bp, Mus musculus
gagtttagtccttctaatagctactattgcaaactgctatatgtggttgagaaatgaaagctaatggtcagatcatcaaactc

SEQ ID NO: 58609 - DNA, 102 bp, Mus musculus
gcatgctattctttcttaaatgtcccagggcacagtagaggtttatagatctttgtgtgcatgtgcatgtgcatgtgcgtgtgtgttttacaggcaattact

SEQ ID NO: 58610 - DNA, 108 bp, Mus musculus
acacatgtcatgctgtgtgcacatccatgtgtgtaaacacacagtctataaataaatattattaaaaaatttatacttattgtgttacatactgccacagacctgtgt

SEQ ID NO: 58611 - DNA, 97 bp, Mus musculus
gatagtctcagagacaaaataaatatcctctctgattggatatttaattgatatccaatctaaagatgagaatatttcagtcttcataggtactaac

SEQ ID NO: 58612 - DNA, 106 bp, Mus musculus
tctctcatatatatatgcgtatatatgtatatatgtgcatatatgtgtatatatgtatatacatgtatatatatatatacacatgtgtgtgtgtttgatcttcatg

SEQ ID NO: 58613 - DNA, 130 bp, Mus musculus
atatgtgtatgcatgtgtgtgtctacgtgtagctgtgtgactctgcatgtgggcatatgtgtatgtgcatatgcatgtgtgtctctttgtatatatgtatacacgtgactctttgcatgtgtgcatgtgc

SEQ ID NO: 58614 - DNA, 72 bp, Mus musculus
tacaaagagcggatattaagagcttttgcatttgcctcaggcccggtgctgctttcagtctctgtttctgtg

SEQ ID NO: 58615 - DNA, 84 bp, Mus musculus
cttttaaactgcattatcaccggagtcctcaaggaaaaacgaaaagcccgtgtgagactcactgtgtcaatgccaatgagaaag

SEQ ID NO: 58616 - DNA, 70 bp, Mus musculus
gcgaggaaggcagagagcactctgggagctctgcaggcgagaatccctctggctctctgaccctctcagc

SEQ ID NO: 58617 - DNA, 84 bp, Mus musculus
cggagaaccagcacatttcttagcatccttcacaggtttggtttgctttttggaggggtgtttgtctgtctgtctgtctgtctg

SEQ ID NO: 58618 - DNA, 77 bp, Mus musculus
cataagcaacatgtgcatatgtaaacctgtctatttaaatatgtatgtatgtatgcatgtgtgtatgtatgtatgtg

SEQ ID NO: 58619 - DNA, 104 bp, Mus musculus
ttctgatcattacacattttatatgtactgaagtgtctgtcacactccctgtgctccatggcctgtaacagtatgtcacttacagatttaaagtgttgtcaggg

SEQ ID NO: 58620 - DNA, 76 bp, Mus musculus
taaaagtctcactcactcaattatgtgctccctgttaagggagatcttaaggggatgtgttgtgttgtgactcttg

SEQ ID NO: 58621 - DNA, 76 bp, Mus musculus
gcaaaatatgcactatgtatatatgtgtatatatgtacatatattattagtataattacatatgtgtgtgtgttgt

SEQ ID NO: 58622 - DNA, 60 bp, Mus musculus
ctagaaaaaaaggcagagagtgacaaagggaaacacagtatctctgtctctattatctgg

SEQ ID NO: 58623 - DNA, 80 bp, Mus musculus
tctgacagtccaagtaaacgaggtcactgaggaatcccagctgcaaagctggtaaactagtgattttgttattgttcagg

SEQ ID NO: 58624 - DNA, 85 bp, Mus musculus; identical to SEQ ID NO: 57470

SEQ ID NO: 58625 - DNA, 63 bp, Mus musculus
cttcagatgcagcttcctctgtcagcctgtgtgaatctgtgagcaggagcagtgaatctgagg

SEQ ID NO: 58626 - DNA, 80 bp, Mus musculus
gagacagagacagagacagagtggggggtgtgctgagggaaacataaactgtgtatttcccactgtctctccatctgctt

SEQ ID NO: 58627 - DNA, 103 bp, Mus musculus
ctcaggtcataaatggaactgtctgcatttatttgagattgaaggtgaaaaaactctcaaactctcaggcattgaaggaagagagcacacaaactgcactgag

SEQ ID NO: 58628 - DNA, 110 bp, Mus musculus
tcatcgtaacgtgtgatgtcatattcgtgtgaaggggagtgcatgttctgagtcagtctttgtgttcccgttcatgatcagtcaccctgttgccttcaaccctctgatga

SEQ ID NO: 58629 - DNA, 100 bp, Mus musculus
cccagatgcttgtgctcatgtgtaattggtcttcaccagaacactgctgcgacatgtcttctgtctggctgattacagatcttagagcccaagtcttggg

SEQ ID NO: 58630 - DNA, 117 bp, Mus musculus
tactgttgctatctgctaattctatgaggaaccattgagttgtgacaatattattttattctttcttctttttttgatgcacagcacaatagaaatcatgagtgacaagtgacagtg

SEQ ID NO: 58631 - DNA, 133 bp, Mus musculus
agtacacacacacacacacacacacacacacgcaagcatagaaaacatcttgttgtggaaactgtagtgtgtcacagtgtgtctcacgatatattcctctgaccacacatcttcacttgcaaatgttgattgc

SEQ ID NO: 58632 - DNA, 69 bp, Mus musculus
atagatgagaaaaggaaggctcaaagagagctgagatcctagcttctgtctgtctgtctgtctgtctgt

SEQ ID NO: 58633 - DNA, 86 bp, Mus musculus
ggtggtttgcctgcatgtctgtctgtctgtctgtgtgagggtgatggatcccccataactggagctacagacagtggtaagctacc

SEQ ID NO: 58634 - DNA, 118 bp, Mus musculus
catcaggcgcagacgagtcatttttaataacacctcatcctgggctatgaaaatttttatttgtcatcatctaattgatttgtgtccgtttcaattatttgtttgctttggcttggtg

SEQ ID NO: 58635 - DNA, 64 bp, Mus musculus
atgtatatatgtatgtatgtgagcatgtgtaatatatatgtttgtgtgtgtatgtagtatgtgt

SEQ ID NO: 58636 - DNA, 73 bp, Mus musculus
gtgcatgtatgtatgtatgtatgtgtatgagtgcaatgtgtgtgtatgcatgtgtgtgtgtgtgtgtgtgtgt

SEQ ID NO: 58637 - DNA, 107 bp, Mus musculus
agtacttggctgaatacaaagatgtagatgggttttcttactctagcgtatatcaatttatattttagtagggaaatcaaatgcctttcgtgtatagatcgtatgct

SEQ ID NO: 58638 - DNA, 84 bp, Mus musculus
gaaatggaggctccattctctatctctgtgtcttaacagactagcctgttatctaagggtagggaaagtagtattcttttgttc

SEQ ID NO: 58639 - DNA, 62 bp, Mus musculus
gtgcagtttgtgtatgtgctggtgtgggatgcgcatgttggtatgtatacaagtatctgtgt

SEQ ID NO: 58640 - DNA, 90 bp, Mus musculus
gaggtggcgcagtgggtagagttattgtttatgtgtgcttgagcacctaagatccccagcacgcacatagaacctggacacagtggcttc

SEQ ID NO: 58641 - DNA, 70 bp, Mus musculus
ggcggcggcggcgggggaggggggagtccagtttgaataagcgtttctctctctggctctgttggcagct

SEQ ID NO: 58642 - DNA, 106 bp, Mus musculus
aagctttttctgattatcctagcttgtagttaacaaattgacagctgtggcctctggtcacagttcagtttgtggactcaagagctaagctagggaagtaaagctt

SEQ ID NO: 58643 - DNA, 107 bp, Mus musculus
gccttagtccatggtgatctgataggatgcatgggacaatttcaatatttttgtatctgttgaggccagttttgtgactaattatatggtcagtttttggagaaggt

SEQ ID NO: 58644 - DNA, 73 bp, Mus musculus
ggaatgactgcatgtagcatcttttcttttcactaaaagaagctgatgcatagaatagacatgtggttaatct

SEQ ID NO: 58645 - DNA, 85 bp, Mus musculus
ggccatggtggtctgataggatacatgggacattttcaatatttttgtatctattgaggcctgttttgtgaccaattatatggtc

SEQ ID NO: 58646 - DNA, 85 bp, Mus musculus; identical to SEQ ID NO: 57439

SEQ ID NO: 58647 - DNA, 111 bp, Mus musculus
attttaaacaaattctccaggcaattcttagttccactcaggtatataaggtgctgtatttatataattctttggtaggcaggggatgtaagagagagttctgcctaaaat

SEQ ID NO: 58648 - DNA, 64 bp, Mus musculus
tctcctttgttcagtgacaagcttattctggaactttctagtgcttttgttctggtgaaggaga

SEQ ID NO: 58649 - DNA, 68 bp, Mus musculus
gcagatgatcctgaagcacaaatccatggggagtgtctctgtgtgaatctgtgtgtgggagtgtaggt

SEQ ID NO: 58650 - DNA, 108 bp, Mus musculus
catgcagttcctaatttcagattaatgcattgtgtatagaaaaatttaacagtagatagtctgcagtgatattgcttaatgatgcatagttcctttgtgagctaaatg

SEQ ID NO: 58651 - DNA, 115 bp, Mus musculus
aggaaattaggacaatgggagagatgtgtgggtgtctcttctcctggggtctgtctcactctctgcctctgccagccaccaggtaagcagcctttctcacccagtgagccttcct

SEQ ID NO: 58652 - DNA, 82 bp, Mus musculus
tctttgttataggctgttcagctctctattgaccaataaaatggtgatggagactatgattacagaactctgagacaagtga

SEQ ID NO: 58653 - DNA, 91 bp, Mus musculus
tgattgtcttccataatattcagagaaaagtcagagcccagtttgactttgttcatttctacttcatctgcttttttctggctgatattca

SEQ ID NO: 58654 - DNA, 121 bp, Mus musculus
ggggttactttaaaaaattaatgttacttattatatatatgtatgcatatgtatacatatatgtacatatatatgtatacatatatgtacatatacatagtttctaaagaaatttctgatt

SEQ ID NO: 58655 - DNA, 86 bp, Mus musculus
ctaatgtcacagtgagcaggcaggcaaacagtatgtatatatgggtataggtatatgtatgtgtgcatgtacatgtggatagatag

SEQ ID NO: 58656 - DNA, 86 bp, Mus musculus
cagtgtgcgtgtttccagggcgactcagttcaatggggtttgttttggaaacctagactgagactgactcagtggctgagttcagc

SEQ ID NO: 58657 - DNA, 95 bp, Mus musculus
ccgagtttcatggtcagtttggacctcagaaacaacaccttcgttcacagaacagagagtggattgaagagaatgactggaagctatgagcacgg

SEQ ID NO: 58658 - DNA, 110 bp, Mus musculus
gctctgttggtgctgagattcaagaactttgaatgatatttttacttttaatgaaacaggaacaaaggttattgaatgtctgaggcattcttgggattatggacgtgagt

SEQ ID NO: 58659 - DNA, 75 bp, Mus musculus
gtgtgtgtacatcatatatatacacatgtatatatgtatatgtatgtatgtatatatatgtatatgtatacacac

SEQ ID NO: 58660 - DNA, 82 bp, Mus musculus
gtgttcatgcagctcagatcatatatacatatatatatatatatatatatatatatatatgtgtgtgtgtgtgtgtgtatac

SEQ ID NO: 58661 - DNA, 81 bp, Mus musculus
atgtatctgtcacagcaaaatagagtctgaggaacagcagtgtcttcctgactctgtcacagtttggtgtacttgttgcat

SEQ ID NO: 58662 - DNA, 93 bp, Mus musculus
atgtatgtgtatatgtatgtgtatgtatatatatatatatatatatatgtatatgtatacacacacatacatatatacatatgtatatatatg

SEQ ID NO: 58663 - DNA, 138 bp, Mus musculus
tatgctcatatatatatatatacatatatatatatatatgtatatatatatgtgtgtgtgtgtacatgtgtgtgtatatatatatatacacacatacatatatgtgtatatacatagacatatgtatacacacacaca

SEQ ID NO: 58664 - DNA, 107 bp, Mus musculus
tctgtgcatcgtttgactgtcaggatctcaagcatttagacaccctcaatcactcagtagttgaggctggcctagaattccagattccctcatgtaggcattataga

SEQ ID NO: 58665 - DNA, 85 bp, Mus musculus; identical to SEQ ID NO: 57470

SEQ ID NO: 58666 - DNA, 80 bp, Mus musculus
ggcctttttggaagacgtatgtctctgggctggaaaggtggctttagcagttaagagcactgactgctcttccagaggtc

SEQ ID NO: 58667 - DNA, 98 bp, Mus musculus
gtagcccatcctttctgttttctgtctgatattacccaggctcagccatgcttagttctgagatgagactgtacacatatagggtgctatgggcttac

SEQ ID NO: 58668 - DNA, 109 bp, Mus musculus
gcacaccaagctggttatggaataccaaagggtcagccctgaacacaatttttaaaattgaatatacacctgtacagtggttgtggtggttcatgcctgtgattctagc

SEQ ID NO: 58669 - DNA, 96 bp, Mus musculus
catgacatgactctcaggcctctgtctctcaggttctcatttcatatgtacaggagctgaaccagagaggagctgggtgctaagagatcctccatg

SEQ ID NO: 58670 - DNA, 92 bp, Mus musculus
tgcaggcaaaatactctgagataatggacagatggttcagtggttaagagcactgactgctcttccagaggtcctgagttcaattcctagca

SEQ ID NO: 58671 - DNA, 112 bp, Mus musculus
gcccaggaagatcaaagtgcagttcagggtttggtttgtttgtttgttgtttttttgttttttaagttgactcactgatatttcactgacactcactcactgtgtcttcagc

SEQ ID NO: 58672 - DNA, 68 bp, Mus musculus
gactttggggctggagagatggttcaatgattaagatcactgactgctcttccagaggtcctgggttc

SEQ ID NO: 58673 - DNA, 88 bp, Mus musculus
taggaaaaaattatatttgtatatatatgtatatatacatgtattatatatatgtgtatatatgtgtgtgtgtgactgtgtgtgactg

SEQ ID NO: 58674 - DNA, 121 bp, Mus musculus
ttggagtgggtgtggccttgttggagggggtgtgtcactgtgggggtgggctttgagttcttatatatctatatatgctcaagtctagccagatcgagtctcttctggttgcctttggatc

SEQ ID NO: 58675 - DNA, 98 bp, Mus musculus
gtgagtcccctaacaattggcactggggctgtctctgactctgttgtggggtctttggatttcctgccccatagctgggctgcactgtctggcctcag

SEQ ID NO: 58676 - DNA, 73 bp, Mus musculus
tgaggcagggtctcactgtgtgtctcttgtgggctcagaacttcctatatagaccaatttgtccttgaactca

SEQ ID NO: 58677 - DNA, 81 bp, Mus musculus
gtttaccagacactctctctcagcccagacagagcatttaaaaaaaaaatcttcttgggactgggggtccatctggtagac

SEQ ID NO: 58678 - DNA, 70 bp, Mus musculus
aggacagaatgggtagatagcaggattctatgattctgtttggacagatgactctctgctctctgagcct

SEQ ID NO: 58679 - DNA, 108 bp, Mus musculus
catgcatgtgtatgtgcatgtgtgtgtgcatgtacatgtgcatgtgtgtgtgcatgtatgtgtgcatgtgtgtgtgcatatgcatgtgtgtttatgcacctgtccgtg

SEQ ID NO: 58680 - DNA, 107 bp, Mus musculus
cctgggtcctgagttcacagcgtgcacattttgtgttgtacgttagcatcacactacacaacactgaatgctgtctgcgacactgctgcttggatttgagtctgtgg

SEQ ID NO: 58681 - DNA, 66 bp, Mus musculus
ggtcagctgtgattattctttgctgggttgaattctgttgacttagaaggtttcatagttagggcc

SEQ ID NO: 58682 - DNA, 71 bp, Mus musculus
ctctctgtctctgtctgtgtgtgtgtgtgctctcgcgtgcgcgcacacacgcttgggcacacacttgagag

SEQ ID NO: 58683 - DNA, 89 bp, Mus musculus
aggatcccacaacgtagctcagggtgctctggaagtgtctatactctgactttctctgactcccgaagaatgttgcctgaggctgtcct

SEQ ID NO: 58684 - DNA, 68 bp, Mus musculus
gacttggagagccggagagaaggttcagtggttaagagcactgactgctcttccagaggtcctgagtt

SEQ ID NO: 58685 - DNA, 132 bp, Mus musculus
tgggatagggggtaagtgaggtgcctgcaactgagtggaacaacagggtgagtgtcagaggaaagtgagcacagcctgtccagggcactctaagtgtctgagcgtctgttgccaagtgtgatgtactcagtc

SEQ ID NO: 58686 - DNA, 92 bp, Mus musculus
tgctttctctgcccgccgctgtgcctgtctggctcgccgcaatgccagggcttctgctgacagtatcactgtgtcaggcaagagagatgaca

SEQ ID NO: 58687 - DNA, 128 bp, Mus musculus
ctcggaaagaacagatttagatcttgttttatgaccaggtcatctggtcttctttttttgtttttggtttttcgagtcagggtttctctgtatagccctggctgtcctggaactcactctgtagacca

SEQ ID NO: 58688 - DNA, 83 bp, Mus musculus
agggggggggagggggagctggagagctggctcagcggttaaaagcactgactgctcttccagaggtcctgtgttcaattcct

SEQ ID NO: 58689 - DNA, 85 bp, Mus musculus; identical to SEQ ID NO: 57470

SEQ ID NO: 58690 - DNA, 114 bp, Mus musculus
ggaagggacacagccaggccagttttgacagacagagacaatcagcttgcctgcagacagaagaggctgtggtcagtcaggacagagctaatgaggaagtgggctgtggcttct

SEQ ID NO: 58691 - DNA, 107 bp, Mus musculus
tgtaggaatctttgaaatatcatacctgagagaactgtgtgtgtttagcaaagacttgcaccagttagccagtataatgatttggttcaagggctttggaacacata

SEQ ID NO: 58692 - DNA, 96 bp, Mus musculus
ggtaacaaacatatatgtgatatatatttgtatatacatatatgcctatacatatgcctatatatgtataagtatatattcacatacatgcatact

SEQ ID NO: 58693 - DNA, 90 bp, Mus musculus
tatatacaaggttatgtatctatatgtatatatatgtatgtaggtatatatatatatatatatatatgtgtgtgtgtgtgtgtgtgtgtg

SEQ ID NO: 58694 - DNA, 78 bp, Mus musculus
tggccggtcgtgagaacgcgttattaacagaagacgtgtcctgtatgagagtagcgagtgttcttacctgctgagcca

SEQ ID NO: 58695 - DNA, 89 bp, Mus musculus
gacacagggagaaggtatctgaagaggtctgtgaaactgctcagtgaagcaccaacagaattcagcacattggtatataagctcctgtc

SEQ ID NO: 58696 - DNA, 85 bp, Mus musculus
gattgacaggttgatgagggtccattggcagaggaggagagtctgagttcttccccaatccagtctgtctgtctgcctgtctgtc

SEQ ID NO: 58697 - DNA, 68 bp, Mus musculus
gatgtcttcccagagtcagtcctgactcagctcactgcctggtccagaaccaccctctagaagacctc

SEQ ID NO: 58698 - DNA, 89 bp, Mus musculus
gccatagtgattctgtctgtctcagagtgtgggcgtgggcaaacagccctcttctgctggcttcacctgggatgcagatcaaattaggt

SEQ ID NO: 58699 - DNA, 85 bp, Mus musculus
ggcgagctcctcctctcccaagcccctgactcactcactgccagaagcagtgtggactaagtggagacaggctccagggctcccc

SEQ ID NO: 58700 - DNA, 90 bp, Mus musculus
gttggctatagttccttctccagagccagacctttatccctgtgcctaaaccctttccagtctgtctcactcaggggctgtgggctctgc

SEQ ID NO: 58701 - DNA, 135 bp, Mus musculus
gtgtttcttgcttgtagtaggcactccttaaaggcatgccgccgggagaacgaatattgaagatagacagcacagttggctggagatgttgtgccaacttcaaattcatatccttctgttgggtatctttggggg

SEQ ID NO: 58702 - DNA, 79 bp, Mus musculus
ttgtaagtgatactgttttgtatttgccgctaaaaaggaaaagaatgtggcacgtgacataattagtttttatttacaa

SEQ ID NO: 58703 - DNA, 100 bp, Mus musculus
gatcagccttagtccatggtgatctgataggatgcatcggataatttcaatatttttgtatctgttgaggcctgttttgtgaccaattaattatatggtc

SEQ ID NO: 58704 - DNA, 115 bp, Mus musculus
gtgtgtatatgtgtatgtgtatatgtgtgcatatgtgcatatgtgtatgtacatgtacatgtatatgtatatatgcaaacacatatgcagccactacatatacatttatggacac

SEQ ID NO: 58705 - DNA, 115 bp, Mus musculus
tccttgaccaagatatcattgagaagagtgttgttcagtttccacgtgaatgttggctttctattatttattttgttattgaagatcagccttagtccatggtgatctgatagga

SEQ ID NO: 58706 - DNA, 85 bp, Mus musculus; identical to SEQ ID NO: 57439

SEQ ID NO: 58707 - DNA, 85 bp, Mus musculus; identical to SEQ ID NO: 57439

SEQ ID NO: 58708 - DNA, 92 bp, Mus musculus
gagagcctactgatgttgattttgtaaatggccatgttttcaaactctcttctaaatatttatgtttatattcatagatccgtgttgctctc

SEQ ID NO: 58709 - DNA, 85 bp, Mus musculus; identical to SEQ ID NO: 57439

SEQ ID NO: 58710 - DNA, 85 bp, Mus musculus
ggccatggtggtctgataggatacatgagacaatttcaatatttttgtatctgttgaggcctgttttgtgaccaattatatggtc

SEQ ID NO: 58711 - DNA, 89 bp, Mus musculus
gactgaactgtgatatttgacagattttagatatatgcttttggaattgcactaaattcattgtctgtctgtctgtctgtctgtctgtc

SEQ ID NO: 58712 - DNA, 85 bp, Mus musculus
gtccatagtggtctgataggatgcatgggacaatttcaatatttttgtatctgttgaggcctgttttgtgaccaattatatggtc

SEQ ID NO: 58713 - DNA, 74 bp, Mus musculus
cttgacagtacagactatggtcactaatgtcacttcagagagacattagtgagaccttctgtatttctgttcag

SEQ ID NO: 58714 - DNA, 84 bp, Mus musculus
tggtctggcactgtgacacactcactcaatcctggaggccaacagagatgctgagaattgagtccactggaacgcttgccacca

SEQ ID NO: 58715 - DNA, 85 bp, Mus musculus; identical to SEQ ID NO: 57439

SEQ ID NO: 58716 - DNA, 83 bp, Mus musculus
ggaacttagagcatgagattgcttagtgagaataatgcctgaaggggactcactgagagcctcagtccaatgttctcccttcc

SEQ ID NO: 58717 - DNA, 85 bp, Mus musculus; identical to SEQ ID NO: 57439

SEQ ID NO: 58718 - DNA, 79 bp, Mus musculus
gctctgccttctgtctccctcacaggctgctggtgccgaatgctagatgcttgtgaaggggctaagttgaacgaggagc

SEQ ID NO: 58719 - DNA, 80 bp, Mus musculus
ttcaaaactcagaggatttgaggcaagagctagatgctagtaatgtactgcatttcagcagagccaccacactgagggag

SEQ ID NO: 58720 - DNA, 71 bp, Mus musculus
gtctctgcgtctcagtgtctgtgtgtacatgtatattcacatgcagcagggaaagtgactaatgctcagat

SEQ ID NO: 58721 - DNA, 102 bp, Mus musculus
cttgaagatgctgtctttttatccagtgtgtatttctgtctgctttattaagaaagaaataaagaaaggtagagagtgagagagagagagagagagagagag

SEQ ID NO: 58722 - DNA, 85 bp, Mus musculus
ggccatggtggtctgataggatacatgggaaaatttcaatatttttgtatctattgaggcctgttttgtgaccaattatatggtc

SEQ ID NO: 58723 - DNA, 82 bp, Mus musculus
tgtatatgtatatgtataatgtatatgtataatgtatatgtataatgtataatgtatatgtatatgtatatgtatatgtata

SEQ ID NO: 58724 - DNA, 130 bp, Mus musculus
ccagcaccaaaacttgaagatgctgtctttttatccagtgtgtatttctgtctgctttattaagaaacagagagagagagagagagagagagagagagggagagggagagggagagggagagggagaggg

SEQ ID NO: 58725 - DNA, 80 bp, Mus musculus
tagtcagagttccctagagggacagaacagataaaatgattctatctatcaccatgtctgtctgtctgtctgtctgtcta

SEQ ID NO: 58726 - DNA, 83 bp, Mus musculus
cattttggagagagaggacacgattatatctggtttcagggacttcctgaagtctttaagttgttcacttcttaatcttaatg

SEQ ID NO: 58727 - DNA, 115 bp, Mus musculus
tgcaggctgtgaagggtactccaggtttctagctgttgtgagctgtcactcattttgtggtagactagtgacattgctgactttggctcatttctgcttcataattaatgcctca

SEQ ID NO: 58728 - DNA, 85 bp, Mus musculus
ggctatggtggtctgataggatacatgggacaatttcaatatttttgtatctgttgaggcctgttttgtgaccaattatatggtc

SEQ ID NO: 58729 - DNA, 96 bp, Mus musculus
tggtaagaacagtgatgataatggctactgcgtggatcacgtcctcaatgacaatcacagaagtgtctgtgcaggctaggctcagcacagggacca

SEQ ID NO: 58730 - DNA, 96 bp, Mus musculus
atatatgtatatgtatgtgtatgtatatgtatacgtatacgtatacgtatacgtatacgtatatgtatatgtatatgtatatgtatatgtatatat

SEQ ID NO: 58731 - DNA, 85 bp, Mus musculus
ggccatggtggtctgataggatacatgggacaatttcaatatttttgtatctgttgagtcctgttttgtgaccaattatatggtc

SEQ ID NO: 58732 - DNA, 116 bp, Mus musculus
tcaaccctggtgttcggtgagccacagctgctagggatgtatcctttaggcccgggctctctctgtctgtggatatctgcattctgtccagttgtggtctgtgtgacaagctctga

SEQ ID NO: 58733 - DNA, 90 bp, Mus musculus
atcatgaggggctggagagatggcttagcggttaagagcactgactgctcttccaaatgtactgagttcaaattccagcaaccacatgat

SEQ ID NO: 58734 - DNA, 84 bp, Mus musculus
tttttgtttttatttatgtgtacatgcatatctctggttttgtgaatgccactgtgtgtcagtgtctatggatgatagcgaaag

SEQ ID NO: 58735 - DNA, 85 bp, Mus musculus; identical to SEQ ID NO: 57439

SEQ ID NO: 58736 - DNA, 84 bp, Mus musculus
atgtatgtataccagtgtatgtatacatgtgtgtatatctgtatgtatgtatgtgtatgtatatatgcatgtgtatatgtatgt

SEQ ID NO: 58737 - DNA, 62 bp, Mus musculus
ggtgatagagggagtataccgatgtcttcgtggggagacagttgtaagtcaccactttcact

SEQ ID NO: 58738 - DNA, 85 bp, Mus musculus; identical to SEQ ID NO: 57439

SEQ ID NO: 58739 - DNA, 132 bp, Mus musculus
tgtacatatagataagtattcatatacacatatatgtatacacacatatagatgtatatatatgtatatacttataaatatatgtatacacacatagatatatatgtgcacattatatatatatgtatatat

SEQ ID NO: 58740 - DNA, 123 bp, Mus musculus
atatatataatgtgcacatatatatctatgtgtgtatacatatatttataagtatatacatatatatacatctatatgtgtgtatacatatatgtgtatatgaatacttatctatatgtacat

SEQ ID NO: 58741 - DNA, 105 bp, Mus musculus
caggcatgagccagagtgtggagagcagagtctctgtcagtgttttatcccttgatgcagcttgttttaaactgaccaaagagagcaacacagtgggcatggctg

SEQ ID NO: 58742 - DNA, 105 bp, Mus musculus
ttccaataccagggtctgcttgggtgccccttcagtgttcagtcttgctcttgtccagtgttcagacttcctgatcatggccttcccttgaccctgctttaggag

SEQ ID NO: 58743 - DNA, 85 bp, Mus musculus; identical to SEQ ID NO: 57439

SEQ ID NO: 58744 - DNA, 117 bp, Mus musculus
tgcaaagttttctggccctgtagaaacgtgaaggaactcaaaggcttttaatattttctcagtgccagttcttatcacgtgagtatcaaattagtttggcattgggatgcagctgca

SEQ ID NO: 58745 - DNA, 88 bp, Mus musculus
ctgcatagaggaatggagagacagctccgttaagagcacatagtgctcttgcagaggacttaagtttagctcctagccctcatgtcag

SEQ ID NO: 58746 - DNA, 73 bp, Mus musculus
tccagaagaggacataggatgtctcagagctggcattacgggtgtttgtgagctgtcttgtgtggctgctgga

SEQ ID NO: 58747 - DNA, 108 bp, Mus musculus
catatgggatcacttaatctttatgtctaacataatggctatgctgttgataggcatctccattactagtgattttcatatggatgtggccggtgcctatggcatggt

SEQ ID NO: 58748 - DNA, 111 bp, Mus musculus
agacataaagattaagtgatcccatatgtgtctggcaataatgtttatttgtgtgcaagtatgttcttttatattgttagtcctgtatcctcagtttctcctaagatgtct

SEQ ID NO: 58749 - DNA, 70 bp, Mus musculus
ggctggcttagaattcatggtgtagaccaggctagcctcaagctctgtctgcctctgactcctgagtgct

SEQ ID NO: 58750 - DNA, 95 bp, Mus musculus
gagaaaatgggctggagagatggctcagtggttaagagcactgagtgctcttccagaagttctgagttcaattcccagcaatcacatggtagctt

SEQ ID NO: 58751 - DNA, 93 bp, Mus musculus
gattggagagatggctcagcggttaagagcactgactgctcttccagaagaaagcaaaacgtgttattagagcagagaccatgagatcccttc

SEQ ID NO: 58752 - DNA, 78 bp, Mus musculus
tgactatgcctggaatcaaggcaatatttgaatccctacaaagaggtgagagaagacagcctgatttgaggcccatca

SEQ ID NO: 58753 - DNA, 93 bp, Mus musculus
tgtaaggaccattctgtctctgtgtctctctgtttttctctctctctcgacagggacagacagacagacagacacattcagagaaccctggca

SEQ ID NO: 58754 - DNA, 70 bp, Mus musculus
tctgaatgtgtctgtctgtctgtctgtccctgtcgagagagagagaaaaacagagagacacagagacaga

SEQ ID NO: 58755 - DNA, 70 bp, Mus musculus
atcctgcatgggtgtgtctctgtcactcttgttactccagatgacaaagacttcaggctccaggcatgat

SEQ ID NO: 58756 - DNA, 80 bp, Mus musculus
tagtctctctctctcaggccatggagacagattataggattagggctgcatcctggcagagtatgccgtttgagggacta

SEQ ID NO: 58757 - DNA, 72 bp, Mus musculus
ctagactcatatgacttgagagtctatttgaaggcaaccatcctgcctgtatgataactctctagtcactgg

SEQ ID NO: 58758 - DNA, 85 bp, Mus musculus; identical to SEQ ID NO: 57439

SEQ ID NO: 58759 - DNA, 67 bp, Mus musculus
gatgagggggctggagagatggttcagcagttaagagcactgactcctcttccagaggtcctgagtt

SEQ ID NO: 58760 - DNA, 65 bp, Mus musculus
catctctgtgagtgtgtgtgtttgtgtatatccatgctgatgcacatgcatagcgtacagaagtg

SEQ ID NO: 58761 - DNA, 62 bp, Mus musculus
gtcctctgtgagagcagtatgtgcttttaccactgagccatctctctgtctctcattgggat

SEQ ID NO: 58762 - DNA, 120 bp, Mus musculus
ctgctcaggggagggatgaggctgtggcaagggcagcaggctgcagacatagaactttgccttactctgtctcagtctgttttcaccaggacaagctaagaggttctttctcatggccag

SEQ ID NO: 58763 - DNA, 89 bp, Mus musculus
aaaagagggttgactctcagaggagagagaagagagtctgacaggtttaatctccatttccaaatattctaccaggtgaaccctctttt

SEQ ID NO: 58764 - DNA, 85 bp, Mus musculus
ggccatggtggtctgataggatacatgggacaatgtcaatatttttgtatctattgaggcctgttttgtgaccaattatatggtc

SEQ ID NO: 58765 - DNA, 97 bp, Mus musculus
gagcatgggcggcctggagagatggctcagcggttaagagcactgactgctcttccagaggtcctgagttcaatcactagcaaccacatggtggctc

SEQ ID NO: 58766 - DNA, 68 bp, Mus musculus
tgtctgactctgtgtgtgcatgtgtgtgtgtgcgcgcacacacacacacgcacacacacacacacaca

SEQ ID NO: 58767 - DNA, 74 bp, Mus musculus
ataacctcatttgtgaggggcagagccccatgagatctctgtctctgtctgtctgtctgtctgagtgtctgtgt

SEQ ID NO: 58768 - DNA, 112 bp, Mus musculus
agatagatgccttgctcctacaagagtaaagtgcatgcgctttgggacagtgaggaaaataatgttcacaaagcccatacactttcaccctttaggagagttgcagcttgct

SEQ ID NO: 58769 - DNA, 85 bp, Mus musculus
gtagatgtgtagcttggtcttcatgagggtcccccaacaactggagcaggggctgtctctgactctgttgcctgcctttggatcc

SEQ ID NO: 58770 - DNA, 97 bp, Mus musculus
gttttataggcttcttgtacctttatgatcatcttctttaggttagggaagatttcttctgtgattttgttgaagacattttcaggtcctttgagat

SEQ ID NO: 58771 - DNA, 79 bp, Mus musculus
ttcctgggccatgtctctgtctgagtcccctggaggcctgctgccaccctggagaaccagatctgccacattcctggag

SEQ ID NO: 58772 - DNA, 89 bp, Mus musculus
gtctgtctgtctgtctgtctgcctgtctgtctatagataacctaaagaaataggcagtggttttagactaaaaatacaaagagaaagac

SEQ ID NO: 58773 - DNA, 112 bp, Mus musculus
gtagcagagttcatatctggaaccttcagtctggtgattttatttaaggtttaacctctgacccccacactcactgttcttccaattatgcagctttcccctggtaggctgc

SEQ ID NO: 58774 - DNA, 117 bp, Mus musculus
gggtataaaaaatgtataacatatatgtatgtatgtatatgtgtatatatgtatatatatgtgtatacatgtatgtatatgtgtatatatgtgtacatgtgtttatatgtgtataca

SEQ ID NO: 58775 - DNA, 110 bp, Mus musculus
ggtgaactatctattgattataattaaaattacctgtcattactgtttctgaacttgtctgtcatgttagttttgtctagtagtgtttgttttatgcagtagggtgtacc

SEQ ID NO: 58776 - DNA, 82 bp, Mus musculus
ctatttgtacagttatgagaggattgggttactggcagtgctctctgtttgtcactgttttctctgtattattgacaagtag

SEQ ID NO: 58777 - DNA, 84 bp, Mus musculus
tctatctatctatctatctatctttgtgtgtgtgtcgggggtattctatgccacatatatgaaggtcggaggacagtttgtagg

SEQ ID NO: 58778 - DNA, 86 bp, Mus musculus
catggtaaccacactgacttggcctgagaactacctagaaatgggtactcatctcttctcagagaagtgagtctgaaaaggccatg

SEQ ID NO: 58779 - DNA, 121 bp, Mus musculus
catatggaatggcctttgaaaagttgcttttaggggtctggagagatggtttagtggttaagagcactgactgctcttccagaggtcctgagttcaagtcccagcaaccacatggtgactc

SEQ ID NO: 58780 - DNA, 112 bp, Mus musculus
gacattttgactatctggggctcattgactccctcacttcacagatattcttaagtcagaatctttaattatttatgaaggtgttgggacaacaaatcagattgggagtgtc

SEQ ID NO: 58781 - DNA, 101 bp, Mus musculus
gctaagatcacaagaggctgtgtgcgggcagtttcagtgaccggagtcagtctgtgtgtccccggagcgctgaaagctgtcctgcacacactcagtggagc

SEQ ID NO: 58782 - DNA, 107 bp, Mus musculus
gtgtaggttaaacctaaaggcttgagggaacactatgttgtgaattttataaaatgtttcaattttgatagaccaagaatttgtttctaagacctttaaatctccac

SEQ ID NO: 58783 - DNA, 95 bp, Mus musculus
tgtgcacctgcgtttgcatgcctgtgtgcctgtgtgtcagttcgtgcgtatgtatactctagcactcacataccaaggcatgtgtggaggtcaga

SEQ ID NO: 58784 - DNA, 88 bp, Mus musculus
gtgtatgttcatgcacgggtgcacgtataaatctgtgtgggcgtatatgtcagtatgtgtgtgtgcttgtgcatgtgtttcagtatat

SEQ ID NO: 58785 - DNA, 67 bp, Mus musculus
gtacatgtgtgtgcactcatatgctgtatgaatacatgtatatgtgaaagtgcatgtgcaggtgtat

SEQ ID NO: 58786 - DNA, 70 bp, Mus musculus
ctgggctctgactgtctctgtcatgtcccaaagagatgccttgagtcaatccatggagacttctgcctag

SEQ ID NO: 58787 - DNA, 73 bp, Mus musculus
aacaaaaggtttaggtctggagagatggctcagctgttaggaacactgactgctcttccagagctcctgagtt

SEQ ID NO: 58788 - DNA, 76 bp, Mus musculus
gtcagctgaccctcagactgtctgtgtgttgcccgacatgactcgggcatgtcagggaggccgtggaggtagctac

SEQ ID NO: 58789 - DNA, 75 bp, Mus musculus
ggaggtgtgttagaagggataggctttgaggtgtcaaaagcccacatcaggtctagtctctctctctctgcctgc

SEQ ID NO: 58790 - DNA, 123 bp, Mus musculus
gtgtgtgtgtatgtatatgtatatatatgtgtgtgtgtgtacatatatatacacacacacatatgtatatatatatatacatacatatatgtgtgtgtgtgtgtgtatgtactgcatgtgtgt

SEQ ID NO: 58791 - DNA, 68 bp, Mus musculus
tgttgtgtgtctgtctgtctgtctgaaggccagcagagggcctcagatccctgggagtcagagcaaca

SEQ ID NO: 58792 - DNA, 79 bp, Mus musculus
cttaacacacagagcatgtcagtacttgcctttcattccagcacttgagaggcagacacagactgtctgtgagtttgag

SEQ ID NO: 58793 - DNA, 72 bp, Mus musculus
aactcacagacagtctgtgtctgcctctcaagtgctggaatgaaaggcaagtactgacatgctctgtgtgtt

SEQ ID NO: 58794 - DNA, 86 bp, Mus musculus
tgtatgtatgtatgtatgtgtgtatgtatgtatacaaatatatatatatatatatatatatatatatatatatatgcacatatatg

SEQ ID NO: 58795 - DNA, 116 bp, Mus musculus
cacatgctctgacagaaagcagcttagggtagaacaggtttagggggtcacagtctatcactgaaggaagtcaggacagggaacgaacttaaagcaagcaccttggaagagcagtg

SEQ ID NO: 58796 - DNA, 78 bp, Mus musculus
ggagtctgagaagagactctggacttttaagcagcattgcaactaaaagagtaaggggacttttgaatcttgggatcc

SEQ ID NO: 58797 - DNA, 115 bp, Mus musculus
gagttacagtgcatccaggacacactggattgatgctcgactctttatttttggaatgaaaagttgtatctccacatcctccagaggtgaccaagggatctttttctgaatgctt

SEQ ID NO: 58798 - DNA, 66 bp, Mus musculus
agctctgcctgcctgcctgcctctgcctctctagggctgagattaaaggtatgcagcatcacggct

SEQ ID NO: 58799 - DNA, 85 bp, Mus musculus; identical to SEQ ID NO: 57439

SEQ ID NO: 58800 - DNA, 81 bp, Mus musculus
gagaaggctaggaatgacccaggctctaagggaaggaagtaattagatctctttctctcaggctgtctcttctgcttactc

SEQ ID NO: 58801 - DNA, 68 bp, Mus musculus
gtgcacatgcgcctgtgtatgtatgtatatgtgtgtgcctgtgtgtgtcagtgtgtatctgtgtgtat

SEQ ID NO: 58802 - DNA, 66 bp, Mus musculus
gcttgctcacagtttcagtgagtctgtggccatcctggcagggaccataggggcaggaaggcaggc

SEQ ID NO: 58803 - DNA, 71 bp, Mus musculus
cagtcacagtgacgctctgacactgctttggggaatgggggagaggtttggttcagagccacagtgacatg

SEQ ID NO: 58804 - DNA, 57 bp, Mus musculus
tccctgtcattttgtagttctgtgcaaaaggcattgaattgtggattaaaacggggg

SEQ ID NO: 58805 - DNA, 134 bp, Mus musculus
ccctgtggggctgggacactgctggctgcaggcttgtcagcattgtagcggttgagcgctgactctgtcagtccctcgcggccggtctctgtcatcagctgggagatctgacaaagaaaatgacatgaagctca

SEQ ID NO: 58806 - DNA, 66 bp, Mus musculus
tgaggacactccatccatactacagcacaggaggaacacatgccctctgagtgtctgtgtgtccca

SEQ ID NO: 58807 - DNA, 70 bp, Mus musculus
cagagcatcataataatggcaaagagcaattgtgccacagcagctctctgccactgtgacaaaaactctg

SEQ ID NO: 58808 - DNA, 85 bp, Mus musculus; identical to SEQ ID NO: 57470

SEQ ID NO: 58809 - DNA, 76 bp, Mus musculus
tatatatttatatacatctatatacatacatacatatttgtgtatgtatatatgtatatacacacacatatatata

SEQ ID NO: 58810 - DNA, 68 bp, Mus musculus
ttttctgtgacagtctctcactggcctggaactcaacaagcaggctgacagactgaactctcaggaag

SEQ ID NO: 58811 - DNA, 191 bp, Mus musculus
acataaaaaatacatatatgtatatatgtgtatatatgtatgtatatgtatatatacatatgtgtgtatatatgtatatatgtatgtacatatatttgtatatatacacatatgaatatgtgtatatgtttatatgtatatatgtgctttatatgtttatatttgtatttatatgtacatatatatgtaca

SEQ ID NO: 58812 - DNA, 60 bp, Mus musculus
gtatgtatgtatgtatgtatgtatgtatgtatgtatgtatgtatatatgtatatgtgtat

SEQ ID NO: 58813 - DNA, 71 bp, Mus musculus
gccttcaaacactgtcactgtgtcagagagccaactgccttgggaagcagtgtgagcatgtgtgtgtgggc

SEQ ID NO: 58814 - DNA, 63 bp, Mus musculus
gcacgtgtgtgcctgtgcatagtatatgcatgtgtgtgtatctgtgtgtgtgtgtgtgtgtgt

SEQ ID NO: 58815 - DNA, 83 bp, Mus musculus
agaaactgggatttttgggcccatgtagaagtcctggtcacatgactcactggctgtgtgaatggccacatactaaagtttct

SEQ ID NO: 58816 - DNA, 149 bp, Mus musculus
tatatgtatatatatattcataaatattattttagggggatttattaattttatgtgtgagtgttctgtctgtctgtctgtctgtctgtatgtatgtatgtatgttatgtgcaccatgtgcatgcttggcggccatggaggtcagcaga

SEQ ID NO: 58817 - DNA, 101 bp, Mus musculus
atattgagcttcaaggttcactggctataatgtgtgtttgtctgtgtgtctgtgtctatgcatgcctatgtgtgcccgtgtgtgaatctgcatgtctgtgt

SEQ ID NO: 58818 - DNA, 84 bp, Mus musculus
tgatcctgttggctttgtttgggttcggttatccaactcatagggtttaatggaggaaattgtgtctcactgagtctcagggca

SEQ ID NO: 58819 - DNA, 100 bp, Mus musculus
cgcaataatagatctggtgacactgtctgtctgtctatctgcatcacagcacacgtggggaggtcagaggacagtttgcaggcgttggctgctgctccta

SEQ ID NO: 58820 - DNA, 112 bp, Mus musculus
tctcccttaatgtagccaataaaatcccataggtatctagggcaaggtttttttttttatagagcctgtaatttcttcaggatttgatcatggtttaagcatcctttggtga

SEQ ID NO: 58821 - DNA, 90 bp, Mus musculus
gtgacactgtcttctacacagcccaggttagcttcagactcacagtctctctgcctcagcttccagagtgctaggattacaagtgtgcac

SEQ ID NO: 58822 - DNA, 98 bp, Mus musculus
tgacccaccggagctggagagatggctcagtggttaggagcactgactgctcttccagaggtcctgagttcaattcccagtaaccacatggtggctca

SEQ ID NO: 58823 - DNA, 80 bp, Mus musculus
agtgaaaaagagactgtgtggggtccataggaccaactggccaagtcagttctctctcccccatgtctctctctgtctct

SEQ ID NO: 58824 - DNA, 64 bp, Mus musculus
tcactaagagtggccatacttgtgtggcaccagtcctacactaagtgtggctgtacttgggtgg

SEQ ID NO: 58825 - DNA, 102 bp, Mus musculus
gaaacacggaacatggggctggtgagatggctcagcggttaagagcactgactgctcttccaaaggtcctgagttcaaatctcagcaaccacatggtggctc

SEQ ID NO: 58826 - DNA, 83 bp, Mus musculus
gtgtctgtgactatataagtgcatgtgcaagcggatgaatgagtgtgactctgtgtgtgtgtgtgtgtatgtgtgtgtgacac

SEQ ID NO: 58827 - DNA, 102 bp, Mus musculus
cttttcattcttatcggattctttttaagatgatgatgttgttgctgtgtatgtgagctcacaggccagaggaggacatcagatcatggtagcatgggagag

SEQ ID NO: 58828 - DNA, 92 bp, Mus musculus
taatttaggagagtagtttattttgggaaaagctatgtaggttaaatcctttatatatgtttttaaacatttacatagctacttctaagtta

SEQ ID NO: 58829 - DNA, 93 bp, Mus musculus
gacccacacaggctccctgagtgtcagttcagtctctgtgagcccatatgagccctggttagttgattctgtgagccaatttcttgtggtgtc

SEQ ID NO: 58830 - DNA, 114 bp, Mus musculus
cattggggttcccaggctcagtccgatggttgcctgtgagtatctgcatctgtattggttcttgctggtagatcctctcaaggaacagctatatcaggctcctgtcagcaaatg

SEQ ID NO: 58831 - DNA, 96 bp, Mus musculus
atggtgtgtgcagagcagagggtgccactgagcatggggggggggggggggctcctctcatctcacactgacagcaaacgcccttgcacactctat

SEQ ID NO: 58832 - DNA, 75 bp, Mus musculus
tatgaggatgttggaagttggactaaatgtattttttattatgctatggctaggtctggcccccacagactcatg

SEQ ID NO: 58833 - DNA, 97 bp, Mus musculus
ggattttgtcaaatgcttttccagcatctaatgaaatgatcatgtaatttttttacattgagtttgtttatagagtggataacattgatggatttcc

SEQ ID NO: 58834 - DNA, 106 bp, Mus musculus
ccttcatgtgctgagttatcctgctcacccccctctgttactaagtcaggctctctctctgggatctgggtttggaaggttagggtggctggccagtgctaagagg

SEQ ID NO: 58835 - DNA, 70 bp, Mus musculus
cgtgactcaggctgtgactgagtggctcttccctcttggaatggctcctcctgtgccggtttgaagcatg

SEQ ID NO: 58836 - DNA, 99 bp, Mus musculus
ggagcagagctcacctagatgggggggggaggggggaagaagcatcatgcccctgcctccctgtctcccagctcaccctgtcacacagagcctgcctcc

SEQ ID NO: 58837 - DNA, 79 bp, Mus musculus
gatgggggggcccacctgtctgtctgtctgtctgtctctcttggacacaggggattctagatctaggggccctggagtc

SEQ ID NO: 58838 - DNA, 76 bp, Mus musculus
tgtgtgtgtgtatatatgtacattatgtatacatgtatatatgtatacatgtgtatatatatatatgcatacacac

SEQ ID NO: 58839 - DNA, 78 bp, Mus musculus
ggagtatccacagtggccccgaggctatgctgggaccctctttctctgtgggtgtttagggagccacggtggcactcc

SEQ ID NO: 58840 - DNA, 69 bp, Mus musculus
gacgagagacccacagcattgcacacctagctgtatcagcaagccaagctctgtctctgtctctctgtc

SEQ ID NO: 58841 - DNA, 78 bp, Mus musculus
tgtgcctatggaagctgagaaattctgttatgtgcagctgacaagctggggactcagaagagtctgagctgaaggcca

SEQ ID NO: 58842 - DNA, 94 bp, Mus musculus
cagctcctgatgttctcagtggagactgagcactgggaccacgtgtctgctagtgtccggtctttggattctcataccggggagatcagaactg

SEQ ID NO: 58843 - DNA, 85 bp, Mus musculus
gaccttggctctcctgcctctgtctctgattgcctccacatccagttctagcagtcccagggatgaacgcaggacacccaaggtc

SEQ ID NO: 58844 - DNA, 84 bp, Mus musculus
tcaggggtcacacaagtggacagacagacagacagacagggatcccactttacctctgatgcattgtgtctgtgtcccccttga

SEQ ID NO: 58845 - DNA, 78 bp, Mus musculus
gtgtgtgcatgtgtgtgtacatgtatgtgtgcatgtgtgtgagcatgtatgtgtacatgtgcatgtatgtgtgtatgc

SEQ ID NO: 58846 - DNA, 105 bp, Mus musculus
acatttcatatacttgaaaattgctaatagattatatcatcacagaacaaagaaaggtgagtgatgtcatgcatgtgttaagcagtttgatttgggtatgtatgt

SEQ ID NO: 58847 - DNA, 95 bp, Mus musculus
gacacgctttctgtctctagtgccttaaaggtgccctggcctcactcagtccctgggtccctggagttttgcattcatgcagatggtggtgggtt

SEQ ID NO: 58848 - DNA, 76 bp, Mus musculus
gagctggacctggtctggaggtctggtattgggatctttctcaccctctcagtgactcaagactctgggacagttc

SEQ ID NO: 58849 - DNA, 97 bp, Mus musculus
agcacgaggatggggctgacgagatggctcagtggttaagagcactgactgctctttcaaaggtcctgagttcaaatctcagcaaccacaggtggct

SEQ ID NO: 58850 - DNA, 86 bp, Mus musculus
gaggcatgagcctgtgagcctgagtctgtggctctgtgcctacccacatcttccacacagctcaggcaccagggcagactgcactc

SEQ ID NO: 58851 - DNA, 83 bp, Mus musculus
ggcatgtctgtatatctgtctgtctgtctgtatgtatgtatgtatgcctgcaagcacacatgtatattcttatttgacttgtc

SEQ ID NO: 58852 - DNA, 92 bp, Mus musculus
gctggcctcaaactcagaaattgactggagagacggctcagcagttaagaacactgactgctcttccagaggtcctgagttcaattcccagc

SEQ ID NO: 58853 - DNA, 82 bp, Mus musculus
tgcctgcagctgtggactggacatgtttccaggcagatttggcctctggatggtttctgtctctaagtctgtggtatgagca

SEQ ID NO: 58854 - DNA, 70 bp, Mus musculus
tgtatgcaacagtcatgcatcatcattgtttatttatttactctgtgtatgatgcgtgtgtatgtgtgca

SEQ ID NO: 58855 - DNA, 70 bp, Mus musculus
gtgggagtgcacagcagtggacttgtggctttgctccgcagcagggtcacactcactgtgaatctccttc

SEQ ID NO: 58856 - DNA, 88 bp, Mus musculus
ggaggatggaggcctggagaggtgaggccccaccttttctgtcagaactcatccccaggctctgcctctctcggcctgacattctacc

SEQ ID NO: 58857 - DNA, 64 bp, Mus musculus
gcatgtacgtatgtatgtatgtatgtatgtatgcatgcatgtatgcatgcatgtatgtatgtgt

SEQ ID NO: 58858 - DNA, 109 bp, Mus musculus
tagccagtgttcttaactgctgaaccatctcctagccacaattttttattctttaagatactcttagaggggctggtgagatggctcagtgggtaagagcacccgactg

SEQ ID NO: 58859 - DNA, 95 bp, Mus musculus
cactagtgctgggggctggagagatggctcagtggttaagagcactgactgctcttccaaaggtcctgagttcaaatctcagcaaccacatggtg

SEQ ID NO: 58860 - DNA, 144 bp, Mus musculus
gtgtgtcagctgtcccttgtacacactgtgtctctgtgtgtcagccattccttgtacgttgtgtcattgtgtgtcagctgtcccttgtacacattgtgtcattgtgtgtcagccgtcccatgtacacactgtgtcactgtgtgt

SEQ ID NO: 58861 - DNA, 74 bp, Mus musculus
ggctgacacacagtgacacagtgtgtacatgggacggctgacacacaatgacacaatgtgtacaagggacagct

SEQ ID NO: 58862 - DNA, 65 bp, Mus musculus
agcttcagggaacactctgtctctgtctccccagtgccaggatcacagagtacacccctggacct

SEQ ID NO: 58863 - DNA, 64 bp, Mus musculus
gcatcgtgggctgctctctgctcattttgtgaagaaagggatcattgaggtttcccaggatagc

SEQ ID NO: 58864 - DNA, 84 bp, Mus musculus
tgggcagaaatgccactgcaaggtttcactggggaatcttcttggtgagcatgatttggaagtttcaggcttgattcatgccca

SEQ ID NO: 58865 - DNA, 88 bp, Mus musculus
gggctcacaaggatagagtgggagaaaaggctgtgaacaattttttctgtctgcctgtctgtctgcctgcctgcctgcttgcttgcct

SEQ ID NO: 58866 - DNA, 79 bp, Mus musculus
tctctgtgtctgtgcatgtgcatgtgtgtatgcatgcacgtgtgtgcgtgcatttgtgggtgtgtgtctagactagaga

SEQ ID NO: 58867 - DNA, 68 bp, Mus musculus
tgcatgcatgtgtgcgtgcatatgtgtgcacatgtgtgtgggtgtatgtgcatgtggatatgaatgta

SEQ ID NO: 58868 - DNA, 88 bp, Mus musculus
gcagcagctgggtttaggggtgtgagaaggcactgagcactccaaggtggtgtgggaagtgatctaacacatgggatcatgttgttgc

SEQ ID NO: 58869 - DNA, 85 bp, Mus musculus; identical to SEQ ID NO: 57470

SEQ ID NO: 58870 - DNA, 60 bp, Mus musculus
ggatcttccactgaaacggaaggaagaagagtttctctctggctcagtctcagaagattc

SEQ ID NO: 58871 - DNA, 119 bp, Mus musculus
ttctggggtaaaactttgtcttacgagaaatttaaggtggctgtataataaaaagtttgcttatctaagtctaagttactatgctgttgtagctgacctgccttctgtgttcctctgag

SEQ ID NO: 58872 - DNA, 103 bp, Mus musculus
tactctccacaaagtaacatcagaatcagagccccattgctaaagacaatatatatatatgtctcgccaacattctagttctagtgcctttggtgcagaagtg

SEQ ID NO: 58873 - DNA, 116 bp, Mus musculus
ggaagaggaaaatcattgtggttcagaaagctgcgagggggcgctgggacagcaacaggaagtgctcagccccaggaattcgaagggtttctttggtaaggggacttcctcggttc

SEQ ID NO: 58874 - DNA, 94 bp, Mus musculus
ggggaagcaaagagaaggctgacctttcccatagctgcaatgcttgactccacaagtgttttagatgtagggtaccctggcttagcaaatccct

SEQ ID NO: 58875 - DNA, 78 bp, Mus musculus
gaatgaagcaaggagagaagtctggatctctgccttcctgcagagtctgtctgtctgtcttctttttttttttttttt

SEQ ID NO: 58876 - DNA, 87 bp, Mus musculus
accaggggctggcgagatggctcagtggttaggagcactgactgctcttccagaggtcctgagttcaattcccagcaaccacatggt

SEQ ID NO: 58877 - DNA, 113 bp, Mus musculus
tgtcagcccaagtaaggactatatgatactcatgaagtaaagatagctttgtgacattagtgatcaaatgggcctttttagctttagtacagttttaaatttgggaattgaca

SEQ ID NO: 58878 - DNA, 76 bp, Mus musculus
tcatgagaccctttccaaagtgggtgcacatgggtaccagttagatctggcccacagttactcactctgtctctga

SEQ ID NO: 58879 - DNA, 59 bp, Mus musculus
gtgtctgtctgtctctgtctgggcacatgagcatgggtacccacagagagcagagacat

SEQ ID NO: 58880 - DNA, 98 bp, Mus musculus
ggtatggtcctggagaaggagctgagagttctccgtcttgatatgtaggcagcaggagactgtgtcactcactgggagtagcttgagcttaggacacc

SEQ ID NO: 58881 - DNA, 79 bp, Mus musculus
ggagaaagtgtgacactgtgtgtcacaggctttgaggtgtcctaagctcaagctactcccagtgagtgacacagtctcc

SEQ ID NO: 58882 - DNA, 87 bp, Mus musculus
tgtctataaattgtcttctgaccttcacatactggctatggcatacatgctatgacagatagacagacagacagagacacacagaca

SEQ ID NO: 58883 - DNA, 75 bp, Mus musculus
aagctgtcctgtgtcacactctgcctgagggaaagactcaaatttcgtatcctagcagatgccacagtgtagctt

SEQ ID NO: 58884 - DNA, 75 bp, Mus musculus
gatttggggattgggagcgtgtatcctggttgacctaggtgaggtgacagaacacagaaagcagatccacgaatc

SEQ ID NO: 58885 - DNA, 88 bp, Mus musculus
gagcttgtttccctgggctgaaagtatctctctctctattctgatgtttgtcgaagaaagaggtagaagagactgtggacaggctcag

SEQ ID NO: 58886 - DNA, 119 bp, Mus musculus
gtccttcccctaactcctccattgggatccctgtgctcagtctgatggttggctatgagcatctgcatctgtattggtcaggatctggcagagcctctcaggagacagttgtatcaggc

SEQ ID NO: 58887 - DNA, 70 bp, Mus musculus
ttatttcccatacacatgtaatttaaattaaaaaaaaaagatttttcattatttgtgtgtgtgggggtga

SEQ ID NO: 58888 - DNA, 84 bp, Mus musculus
cagcgaagtgaagatgagcgaaggctcagacctacaagtggctctaaaagcaagcctagctcagcctctgtcactgtgtcactg

SEQ ID NO: 58889 - DNA, 61 bp, Mus musculus
tacagttttctcccactggtggtagagcaagtctcaaacactcagtgtgaagaggaccgtg

SEQ ID NO: 58890 - DNA, 120 bp, Mus musculus
gacctcaaccccttcctgaaacagccctaaaatgcttcccgttctgatgatagtcagcagtcatctaactatgatacagcatttgaaaaggaaggaaggctacatcatgaggttaagttg

SEQ ID NO: 58891 - DNA, 68 bp, Mus musculus
gcactgtccgggaagaaaggcagaagagcgtaccccactctgcctgtctctctcctgccccactctgc

SEQ ID NO: 58892 - DNA, 117 bp, Mus musculus
gttttaaaaaagattttatgtgtatgagtgctttgtcagcatgtatgtatgtatgtatgtatgccatgtatgtgcagtgagcaggcattaggtcccctaaaattggagtttctagac

SEQ ID NO: 58893 - DNA, 97 bp, Mus musculus
gcttccagttgagaacccgtgctttaaaccattcatagcacaagcccgcccagttctgtgtgtgtgagtggcagcgaaaactttcattggacagagc

SEQ ID NO: 58894 - DNA, 108 bp, Mus musculus
tgtgtccttgagttgtttgcaaatccctgcaaggtgacagtggagggtgagcactgcactgggcttgctcagctatgatctgggggcattcgcagtcacaggagcaca

SEQ ID NO: 58895 - DNA, 70 bp, Mus musculus
gactgactctttctctccctgaaactatcaaagagcgattgctcctcagtttacgggagggagttatgtc

SEQ ID NO: 58896 - DNA, 114 bp, Mus musculus
tccatgatcctttcgattgcctggggttctgtggtgaggcagatggcatgaataagactgtgtggtaaacaaggcctgatcacctcatgacttcaaggaggagaaaaagaggga

SEQ ID NO: 58897 - DNA, 89 bp, Mus musculus
aggaagtaaggagcacagagaccacacaggggccagatcatgccgagccctgatcatgtgtggagaatttgaaaattctggttattcct

SEQ ID NO: 58898 - DNA, 83 bp, Mus musculus
ggcctttgtcaagggctgtgcttggagctgtgactctctttgcctctctgtgttcccccattgccacatgactgtgaagtgcc

SEQ ID NO: 58899 - DNA, 58 bp, Mus musculus
ggcatcagctagatctgactgaattaaactggttctgtccctcactggctgtgtgacc

SEQ ID NO: 58900 - DNA, 78 bp, Mus musculus
ccttgctcactgcagggtcttaggtgggcaggtgtggcatagcctctctgtctcactctccttgtctgtggagctggg

SEQ ID NO: 58901 - DNA, 105 bp, Mus musculus
gagttgggaagaaggagctcagctggtctttatcagtgcgtgggctgcggatacggctctgtgtttgccacacaagtatgaggtcccaagctcaattcccagtcc

SEQ ID NO: 58902 - DNA, 168 bp, Mus musculus
gcatatatatatatgtgtgtgtgtgtttatgtgcatatatacacatatacatatttgtgtatatatgtgtatatatgtatacacacattcacatatatgtatgtatgtatatatgatatatgtacattcatatatgtacatatatcatatatacattcatatatgtat

SEQ ID NO: 58903 - DNA, 125 bp, Mus musculus
atatatatgtatatgtgtatatgtgtgtatgcatatatatgtatgtatatatgtacatatgtatatgtgtgtacacgtgtatatatatgtatatatgtatatgtgtgtatgtgtatatgtcatat

SEQ ID NO: 58904 - DNA, 126 bp, Mus musculus
tatgtatatatatgtatatgcatatgtatatatatatatatatatatatatatatatatatatatatatattctgtgtgtgtgtatgcatatatgtacatatatgtatatatatcatgcatagaat

SEQ ID NO: 58905 - DNA, 136 bp, Mus musculus
atgtatgtgtatatatttatatgtgtatatatatatacacacatatatatacacacatagtgtatgtatatgtatatatatatatgtatatgtatagtatatgtatgtatacatgtatggtatatgtatgtatata

SEQ ID NO: 58906 - DNA, 78 bp, Mus musculus
tgcatgtgtatatagttacatgagtacacagatatgtgcagatgtgtgtatgtgtgtatatgtatatgtatgtatgta

SEQ ID NO: 58907 - DNA, 91 bp, Mus musculus
ggcaggaggatgaggaaaaggccaggaaccttagaagttcatctttattatctagccacattccctctgtctgtttgtctatctgtctgcc

SEQ ID NO: 58908 - DNA, 115 bp, Mus musculus
tagtgctttaactgacagagaaaccgaaccggattgagacctccagactgcaccactaacacactctgtcacctactctctctggtatgtttttctgtgataggaagctgagctg

SEQ ID NO: 58909 - DNA, 83 bp, Mus musculus
cttaattatatatgtgtgtatacacatatatgtgtatttgtatatatacatatacacatatatgcatatatatagatagtaag

SEQ ID NO: 58910 - DNA, 64 bp, Mus musculus
acacaggcaatgaggtgttcccttcaggaaaacccctgctttcacactgtgtcactgtctgtgt

SEQ ID NO: 58911 - DNA, 114 bp, Mus musculus
ctccatgagaacttggcaatctggccataggagatgaagagctgtaggctgtcagagaggagagtgatgaaactagagttgtcgtctatgggtcactctctgagtaacatgagg

SEQ ID NO: 58912 - DNA, 92 bp, Mus musculus
gtgaatgtgtttatgtgtctgtacatgtatgtatgtatgtatgtatgcatgcatgcatgcatatttgtgtatgtccatgtgtatgcattcat

SEQ ID NO: 58913 - DNA, 118 bp, Mus musculus
agaagaaatatcacacaggtttataaatgtctctgaaatatattgtcttgacactctttgagtaaatactcaggagtggtatagttgtttcatatgataaacctattgttagactttt

SEQ ID NO: 58914 - DNA, 85 bp, Mus musculus
agctttgaggttaaagagttgatggagacatcctatttagagttgtatattccaaggtctctctgtctctatgtaatgtctggct

SEQ ID NO: 58915 - DNA, 71 bp, Mus musculus
ggggaagaggcagagatggcagagactgtggcgagtgctcacatgtctctctcatttctagcagttaccct

SEQ ID NO: 58916 - DNA, 78 bp, Mus musculus
tgatgctcagtggtccgccagcatgtgcacacggtatgggtaaagtgcttagactgctgcaggcatcattccgctgag

SEQ ID NO: 58917 - DNA, 92 bp, Mus musculus
gataaacttcaggggcagtcacaccccgttgggcacagactcagtgtgtgtgccaagatggggcacacacttgctctgacagaaggtaaatc

SEQ ID NO: 58918 - DNA, 65 bp, Mus musculus
ggaacttgccaagtaggctaggctgggtggactctgcctgtctctgcctccttgatccaaggatc

SEQ ID NO: 58919 - DNA, 75 bp, Mus musculus
atagatagatgggtgatagattttctctctctatatatatatatatagagagagataaatgattgatggatagat

SEQ ID NO: 58920 - DNA, 121 bp, Mus musculus
ctgaaggggcatccttgagctaaggttggtctctgccctccatctttgagagtgtagactctgaggccagtctgacagccccctgctcagacccctctggatattatgaattattagagat

SEQ ID NO: 58921 - DNA, 111 bp, Mus musculus
gagatcagtctacctcatgacccagctatgccactcatgaatgagatggatcaggggttaagagcactgactgctcttccaaaggtcctaagttcaaatcccagcagcagc

SEQ ID NO: 58922 - DNA, 73 bp, Mus musculus
cctgctgctgagaaaacacacagacgaaagcagctttaggagaggaggtttaggttgtggtccgtggtgcagg

SEQ ID NO: 58923 - DNA, 89 bp, Mus musculus
gacaggaactcaagataggaatgcctaggcaggaagcatagaagaagcctttttgctaactttctgtctggctcactcatgttcatgtt

SEQ ID NO: 58924 - DNA, 88 bp, Mus musculus
tggtctggtggcctgtgactcacagtgaggcacagaggaccaagatctctggctctctgagccagacactgggcatgggcaaggagca

SEQ ID NO: 58925 - DNA, 117 bp, Mus musculus
cattttggagttggcatcttagggaagctggcatgcacaaccatgaagctggagtatagtcactcagtttgtgtgtctggtatggtagactagatgatagccatggagccaggaatg

SEQ ID NO: 58926 - DNA, 102 bp, Mus musculus
gaacaagacatcgtgaggttcagtctcctgtttaaggccctgtgaatgctaagttgtcaaaacagaagtcagatagcagaagactttcttaccctctagttt

SEQ ID NO: 58927 - DNA, 67 bp, Mus musculus
ttctctctgtatctgtctccattgagaaactgtccagacagtctcctggaagatatacatctgggaa

SEQ ID NO: 58928 - DNA, 71 bp, Mus musculus
ttgtgagactgaagactgcctggacttttgacatcacttaaaacaggcagacaatttacagtggttcacga

SEQ ID NO: 58929 - DNA, 78 bp, Mus musculus
ggagaatgctccacagctgctactttaaaatcagggtatccaaatttaagactgagtaaagacagtgtggaagacttc

SEQ ID NO: 58930 - DNA, 116 bp, Mus musculus
cagataccctggagcaggagttgcctgacataggagctaagaaccaaactcagttcttctgaaagaacagagtgtgctcttaactgctgagtcatcgctccagcccagtcatgttg

SEQ ID NO: 58931 - DNA, 106 bp, Mus musculus; identical to SEQ ID NO: 57620

SEQ ID NO: 58932 - DNA, 82 bp, Mus musculus
tgggaatgttcactcaagtcacaagtgtctatgatttatttttttcaaagacatcctttgtggaattttatctattttccca

SEQ ID NO: 58933 - DNA, 93 bp, Mus musculus
ggagaaaaccagccagttgtcgctcgtgtgctggctcaatcagacagaagtaactgagtccattgccacactgcataatgagcccttttctgc

SEQ ID NO: 58934 - DNA, 74 bp, Mus musculus
tactcactcactgactcagtcattcattgtgtgtgcacacatacactcgaatgtctgctatatgtgtttgagtg

SEQ ID NO: 58935 - DNA, 132 bp, Mus musculus
agaaggatggatagatggacagatggatggatggatggatggacagatggatggatggatggatcaatctatcaatcgatggatggataaagctgctaatctgggctatctcagcttgcatagagtgtttcc

SEQ ID NO: 58936 - DNA, 83 bp, Mus musculus
gcactggcaacctgggggcagggggagggaggggagaggctgtctgtctatctgtctgtgtgtcttctgagcactgccttggc

SEQ ID NO: 58937 - DNA, 79 bp, Mus musculus
tgggagctggagaaatggtgcagtggttaagagcactgactgctcttccaaaggtcctgagttcaattcccagcaacta

SEQ ID NO: 58938 - DNA, 68 bp, Mus musculus
gttctcacacggtgcctctgagcctccctgaaccccaattctggcctctctaggcaccaggcatgaat

SEQ ID NO: 58939 - DNA, 76 bp, Mus musculus
cacagacattcctcaaatcgctgcttgcagagccttgccagtctctgtcagtgtcagcaggtttggggcccctgtg

SEQ ID NO: 58940 - DNA, 67 bp, Mus musculus
tgtgcgtgtgcgtgtgtgtgtgtgtgtgtgcgtgtgcgcatgcatgtgtgtactgtgtccatgtcca

SEQ ID NO: 58941 - DNA, 107 bp, Mus musculus
ctattttctggcatgagatgtgttgctatctgtctgtctgtctttcttatggagttagggtaaccctgtgggagtaagaacaggcagtgcgggacaacagcctatag

SEQ ID NO: 58942 - DNA, 120 bp, Mus musculus
gaattcatagtgtgtgtgtgtgtatgtgtacaaatgtctgtgtgtatctgtgcatgtgcatgtgtgagtgcacatgcctgtgtgtctatgcatgtgtatatgtgtgtgtgcatatgtgtg

SEQ ID NO: 58943 - DNA, 90 bp, Mus musculus
tatatatatatgtgtgtgtgtgtgtcatttgtgcatatacacacatacatatatacacacacacgcacacacacacacattatgtatgta

SEQ ID NO: 58944 - DNA, 73 bp, Mus musculus
agcccaatgaagaccagcaaagagtggcaaggcgaaccaacgccgcacagtgtcattcactgtctgttgggtt

SEQ ID NO: 58945 - DNA, 58 bp, Mus musculus
cacagtagttagaaagcagacacctatttcagacatgagatctggctttcctactgtg

SEQ ID NO: 58946 - DNA, 78 bp, Mus musculus
gctaaaggagtgtgaggtggcaggcacctaggagttttactattgtctctctgactgacaccaccgcactgtttcggt

SEQ ID NO: 58947 - DNA, 107 bp, Mus musculus
gtgaccagtaatgggtaatgggggttctcttagggtaattaaatattattaacttcgatggtgacagtagttagagaactttgagaatactaagaaaactgagttgt

SEQ ID NO: 58948 - DNA, 116 bp, Mus musculus
ccatccggcaaactgatggagtcatcgggtgtaacagcaactccatgtggactgtgctcggattccagtggagctgctgttacttctgatggcctccaaccggctacaaacatgga

SEQ ID NO: 58949 - DNA, 81 bp, Mus musculus
gccttctcatttccgtgtgtgtgtgtgtgcatatttgcatgtgtgggcatgcatctatgtgtgcatgtggaagtcctaggt

SEQ ID NO: 58950 - DNA, 98 bp, Mus musculus
gtccagggttgttctatctccatatatgtatgtatatacatatacacacacacatatatatattcggcatatttatatgagtttttggaattgaggat

SEQ ID NO: 58951 - DNA, 66 bp, Mus musculus
gaggcaggatctccctacatagcctggaacttgttatgtagaccaggctgtctctgtctctgcctc

SEQ ID NO: 58952 - DNA, 90 bp, Mus musculus
gcatcagttcaagagcaaagttgtctggaaccttggttaccttggtggcatgcttttccaggcttcctctccttagcttctcagcgctgc

SEQ ID NO: 58953 - DNA, 86 bp, Mus musculus
gtctgtctgtctgtctgtctgtctgtgcaccacatgtgaacctgatgcatgcggaggccagaagaggacatcagatcctctatagc

SEQ ID NO: 58954 - DNA, 60 bp, Mus musculus
gtgtgtgtgcatgtgtatgtgcatgcatgggaatgtgtgtgtacatgcttgtacatgtgt

SEQ ID NO: 58955 - DNA, 107 bp, Mus musculus
tggccactcagctatacttaactttataccatctgtaattatatatgtatctatacgtccacttatatagatccatatctatggatggaaagatagggctttggtta

SEQ ID NO: 58956 - DNA, 92 bp, Mus musculus
tctgagctttaatctctaaatacaagggtatttaatctctaaatacaggctcatgagaaaagacactctgcagagagaaatcagagctgggg

SEQ ID NO: 58957 - DNA, 82 bp, Mus musculus
tggtgtgtattcagcctaggcaagagagtcagctgagggccaggctgtcaatgctcagatttgtgggtggctgaatacttca

SEQ ID NO: 58958 - DNA, 89 bp, Mus musculus
cagttatatgatgtattcatatacatatttgtgtgtatatagttatatagttactatacaaatatgtatatgaatatatcatataactg

SEQ ID NO: 58959 - DNA, 86 bp, Mus musculus
tactatgaactaagagagggtggaaggactcagaagtctctctcgactttttctgcctctctctcatcctgtctccaaaattagta

SEQ ID NO: 58960 - DNA, 96 bp, Mus musculus
gcatgcatgcatgtgtgtgtatgactgcatgcatgcatgcatgtatgtatgactgcatgcatgcatgtacagatgaatacatacatgtgtgtatgc

SEQ ID NO: 58961 - DNA, 84 bp, Mus musculus
gcatatttgtgtgtgtacatatatgtatgcatgcatgtgtatatatgtgtgcatatttatatatgtgtatacacatatgtatgt

SEQ ID NO: 58962 - DNA, 69 bp, Mus musculus
gctagagagatggctcagtggttaggagcactcactgctcttccagaggtcctgagttcaattcccagc

SEQ ID NO: 58963 - DNA, 82 bp, Mus musculus
gagactggctctctcactgagtttgggattactgttttgtctagactgaatggccagcaagctcttgagattcccttgtttc

SEQ ID NO: 58964 - DNA, 76 bp, Mus musculus
ctgtctgtctgtctgcctgtgcacttccttccacatgtgtatactaaatgccatggtgccctcagagggcagaagg

SEQ ID NO: 58965 - DNA, 73 bp, Mus musculus
tgtttttgcagtggtagtgaggacgtacagaacaccccagctgtctctgtctccctctgtcaactcaggaaca

SEQ ID NO: 58966 - DNA, 121 bp, Mus musculus
gggatttaaaatgttcctttcaggggttggagagatagcacagcagtgtagaatgctgattgctcttccagaggtcctgagttcaattcccggcaatcacatggtggctcacaaccatctg

SEQ ID NO: 58967 - DNA, 103 bp, Mus musculus
atacatgtatatgtatatatgtgcatatgtgtatacatgtgtgtatatatgtatgtatgtgcatgtgtgtagacatgtgtgtaagcacatatgtgtacatgta

SEQ ID NO: 58968 - DNA, 160 bp, Mus musculus
atatatatatatatatatatatatatatatatatatatatatatacatatacatatatatatacatatatatacatatatatatacatatatatacatatatatcacatatatgtatgtatatatatgtacatatatatcacatatatgtatgtatatat

SEQ ID NO: 58969 - DNA, 116 bp, Mus musculus
gcttctgctctccactctttctttaaatggacagtgtgactctggcagaaatgactgagcagttgagtgcaaaggagtgcctggggctccatgaggtgaggactgggaagtagggt

SEQ ID NO: 58970 - DNA, 108 bp, Mus musculus
ctcaaaaatgggtatatagctcttctcagtaagtctcacttctagatgggagcttgcttccatttgaaatgtaaaccagtttgataggggagtagattgtgccctgag

SEQ ID NO: 58971 - DNA, 92 bp, Mus musculus
gtgagtggatgatctaagcaaggatttgagcgatgaagccatcatgggaatgcggctgtctgtcactctgtccgcatgctttcgttcctcac

SEQ ID NO: 58972 - DNA, 94 bp, Mus musculus
gtaaggaccagtgtgcacaggatggtttgtcatattgatatcagtcagtgactctctccaacttaacctgtccttgtacttgggactctagtac

SEQ ID NO: 58973 - DNA, 59 bp, Mus musculus
gagggacccctgtttagtcatctgtctagacagatgagtgtctgtaatgggactccctt

SEQ ID NO: 58974 - DNA, 72 bp, Mus musculus
tagtagagagacagctgagagctgagtcccctgtgtgcgtgggtggccttgcagctgttgatcaggctacta

SEQ ID NO: 58975 - DNA, 73 bp, Mus musculus
gctgtattactgagtcggtgtgtgctggctagaccctctgcagcaccacatttctgactctctgagtgcctgc

SEQ ID NO: 58976 - DNA, 96 bp, Mus musculus
gtacttgtgtgtgcatgtgtatgtccatgtgcatgtgtgcatgtgtttgtatgcttgtatatgtatgtgtgtgcatgtgcgtgcatgtgcatgtgt

SEQ ID NO: 58977 - DNA, 75 bp, Mus musculus
tttgtgctccagtgttatgatgtcttgagaattttttgtgctccagcaaaaatgactgaaacacttcagcacaga

SEQ ID NO: 58978 - DNA, 78 bp, Mus musculus
cactgatagggctggagaggtggttcagtggttaagagcactcactgctcttccagtgactggagttcaagttccagc

SEQ ID NO: 58979 - DNA, 118 bp, Mus musculus
atggctgaaaatatgactgtagggggctggagagatggctcggtggttaagagcactgactgctcttccagaggtcctgagttcaattcccagcaaccacatggtggctcacaaccat

SEQ ID NO: 58980 - DNA, 118 bp, Mus musculus
atggctgaaaatatgactgtagggggctggagagatggctcggtggttaagagcactgactgctcttccagaggtcctgagttcaattcccagcaaccacatggtagttcacaatcat

SEQ ID NO: 58981 - DNA, 71 bp, Mus musculus
gctcaggccaggtctacatagttagttccaggccagccagtcctgcctactcagtgagactctgtctcagc

SEQ ID NO: 58982 - DNA, 102 bp, Mus musculus
ttgctgatgcgaggctgcactgtgcctgtcactctgtctgtgtgcattactcctagcattaggggacggacatggtcgctagtgcaccactcaatcaagcag

SEQ ID NO: 58983 - DNA, 107 bp, Mus musculus
actgcaggtctctagtgtcttagcgggacctgatttaatgatggtgtggagactaacccagacagaagtcactcaggagtgataggaacaaagaagctactgcaagt

SEQ ID NO: 58984 - DNA, 94 bp, Mus musculus
tgtgacagagtcagccacagagtgtggaggggaacatgacgctgcagaagcagggcacctgatgtgacattacgtgtgcagacttggagtgata

SEQ ID NO: 58985 - DNA, 109 bp, Mus musculus
gtaactacactatttttcaaagcacacataggacgaggatgaagctagtttggaaatgatttaatgactctttccccatcagttcacagctttagaagtaggtagctac

SEQ ID NO: 58986 - DNA, 85 bp, Mus musculus
ttgaatgcttggcccatgggaagtggcactagtagcaggtgtggccttgttggagaaagtgtgtcactgtgtgggtggctttcag

SEQ ID NO: 58987 - DNA, 106 bp, Mus musculus
gaaggccactcaggtgaaagaaagagcggacatgtgtgtatcgctgcgtgcgtgcgtgcgtgcgtgcccacacttgtctgtgtctctgcatgtgagtgtatatttc

SEQ ID NO: 58988 - DNA, 87 bp, Mus musculus
gatgctgtttctgcttcttctgattctttggtggtgctgtttatagtgctttttatttgactcacggagactctcactctcagcatt

SEQ ID NO: 58989 - DNA, 76 bp, Mus musculus
gagggttgtatcacaggaatcttctgtgtctaggaaaccccaacaccttccaagccggagccaagtgtgcagcccc

SEQ ID NO: 58990 - DNA, 110 bp, Mus musculus
atgaatcttagctcatcagagggaccactgagtcaccttctcatcagtatccttttaactgagaacatggtggaaggtactggagtgtcagcggaggctaggacacgcat

SEQ ID NO: 58991 - DNA, 73 bp, Mus musculus
tcactcccgggtaggtggctctgggctgtacaagaaagtgagtgagtctgtgagtgggtgagtctgtgagtgg

SEQ ID NO: 58992 - DNA, 74 bp, Mus musculus
ggcagatctaagctccagacctctgtgcaccttccctgaaacaggagagcttgtctgcagagagtgatctgacc

SEQ ID NO: 58993 - DNA, 71 bp, Mus musculus
caggactgacacttggcattagatagccaatgtatgtgtaatatatctatctctgtctgtctgtcggcctg

SEQ ID NO: 58994 - DNA, 65 bp, Mus musculus
ggcaatcacacagggagatgaaatagatcctgagatgtgtgggctctgctctctgtgtgactgtt

SEQ ID NO: 58995 - DNA, 82 bp, Mus musculus
cactgagccttgagggaggagtttggtaaaggcatcccatttagcgctgggtgctccaaagtctctcactctctgcacactg

SEQ ID NO: 58996 - DNA, 63 bp, Mus musculus
tatctttctttgtatctgtattacatatttatatgtttatacacacagacacagagagagata

SEQ ID NO: 58997 - DNA, 89 bp, Mus musculus
atgtaccaagattttatcctgtagatgtgattgtcactaattgtgacaatttgtaattctgagacttgatagagccccgggttgagcat

SEQ ID NO: 58998 - DNA, 92 bp, Mus musculus
tatatgtgtgtctgcatgtgtgtatgtgtatatatatatgtgtgtgtgtgtatatatgtgtgtgtgtatgtatgtacgtgtgtgtttatgta

SEQ ID NO: 58999 - DNA, 93 bp, Mus musculus
ttaaatgggtgttctcttggagcttttcaaatctgatgatttgagaaaacgtaagtggttcctcagtagagttgggacaagacatctatctaa

SEQ ID NO: 59000 - DNA, 79 bp, Mus musculus
gctagctaaactcagaggaaacatcacaggctcgaggagctaatggagatttgttggtgttgtagggagaggggtagac

SEQ ID NO: 59001 - DNA, 80 bp, Mus musculus
ctgtgtgtgtctgtgtatgtgtgtgtgtacgcacgtgcgtgcgtgcgtgtgtgcatgcgtgcgtgcgcacgctcacggag

SEQ ID NO: 59002 - DNA, 94 bp, Mus musculus
ggcagggtcagacctggtagggatgccagtggaaaaccactcaaaattacctttttttcacactctgtctctgacctcccttctcatccctgtt

SEQ ID NO: 59003 - DNA, 87 bp, Mus musculus
catgagcatgcacacacaacacacacagctggatatcaaatatcctacaggaaataggctatatgtgtgttgagaaggatagttatg

SEQ ID NO: 59004 - DNA, 110 bp, Mus musculus
gatagatatgtacatacatgtatacatatatatgtatatatatatgacacacacacacacatatatatatatatatatgacatacacaaccctctgtacccatggatatc

SEQ ID NO: 59005 - DNA, 102 bp, Mus musculus
agatcagccttagtttttggtcatctgataggatgcatgggataatttcaatatttttgtatctgttgaggcctgttttgtgaccaattatatggtcaattt

SEQ ID NO: 59006 - DNA, 60 bp, Mus musculus
gtgaagacagaacacagtggctaggattaggctagtgccatgtcggtctgtctgtctcac

SEQ ID NO: 59007 - DNA, 120 bp, Mus musculus
atatatatatatatatatacacatacacatatatacacacacacatatatgtatatatatacatgcacatacatatatgtgtgtatatatacatatatgtgtatatatgtatatatgtgt

SEQ ID NO: 59008 - DNA, 96 bp, Mus musculus
attgtgtgacgtcaggggttgtctggctcactgtctccatctgataatctgttgatgatagcctgtgatgcctgataactactctctttacatgat

SEQ ID NO: 59009 - DNA, 123 bp, Mus musculus
attgctataatctatatttataataatttactatatagtatatgtaattttatgttatatattaatgatatatattataggtaacatgttattatatcatgtatataattatatcaatataga

SEQ ID NO: 59010 - DNA, 80 bp, Mus musculus
gcataaaacacactggacagctggatcctattttcagatagcatcaggaccagtgcagctgtgtgagtgtgtgtgtgtgt

SEQ ID NO: 59011 - DNA, 158 bp, Mus musculus
ctacaaagccctgtgagtaagcaactttgattgaattttttatttaaaatttagcagaggggctggagaggtggttcagtggttaagagctctgactgctcttccagaggtcctgagttcaaatcccagcaactacatggttgctcacagccatctgt

SEQ ID NO: 59012 - DNA, 104 bp, Mus musculus
tggtttgcatttctctgatgactaaggactttgaacatttctttgggtgcttcacagccactcgagattcctgtttagaattctctgtttagctctgtatccca

SEQ ID NO: 59013 - DNA, 104 bp, Mus musculus
cacatgcatgcacgtgtatatacatacatatagatgtgtatatacttttacacacatatatatttatgtatgtctatatatgaagaaagcaagcatatcctgtg

SEQ ID NO: 59014 - DNA, 106 bp, Mus musculus
tgtatatttgttatctgggtactaatagatatcagttataaatatacgattattttatttttgttaagtgatatctcatagcaaaattttccagggcaaaattata

SEQ ID NO: 59015 - DNA, 127 bp, Mus musculus
atatatagtgattgtgtgtgtgtataatatatgtgtgtatgtatatatatatatatatatgtatgtatgtagtatgtgcatgtgtgtatgtatgtgtgcatgtgcttgtatcatctccacagcataa

SEQ ID NO: 59016 - DNA, 72 bp, Mus musculus
gtctcccacatcagtcagtgtgatcaagacaatccctcacagactttcacagtgggtgatgttagtatggac

SEQ ID NO: 59017 - DNA, 57 bp, Mus musculus
ggtgcacatttttcatagacccgggcttccccgtgactctgtgagtcagtggctgcc

SEQ ID NO: 59018 - DNA, 97 bp, Mus musculus
tctccctgttgttgacaaatctctccaggacttagaaaaacgcatgtatagttgtatgtcgttttatgagttcaggaaaagatatactcaggtatga

SEQ ID NO: 59019 - DNA, 119 bp, Mus musculus
cactgacatccacccagttgccctttcagcatggtcccacttacttgttttcacagggaggtaagaagagattccctgggaagaccatttgaatggcttaatgaccccctgtagtgtgt

SEQ ID NO: 59020 - DNA, 74 bp, Mus musculus
taaatatagcactatgcactatgcatgcatgtatatatgtgcatgcatgtatgtatgtatgaatatatcattta

SEQ ID NO: 59021 - DNA, 64 bp, Mus musculus
atatacacacacagcatactatatatacatgtatatatgtatatgtgtatgtgtatgtgtatat

SEQ ID NO: 59022 - DNA, 67 bp, Mus musculus
tgtggagggagtttgatgaagatagctgatgtcagaccaatgtttcagagtttctcactctctcaca

SEQ ID NO: 59023 - DNA, 110 bp, Mus musculus
agttgttaagaggtaaaaacgagggaataggagagagggttcaccagttaggagcacacactgctcttacagaggacctgagttctatcccagcaccacgtctgataact

SEQ ID NO: 59024 - DNA, 113 bp, Mus musculus
tatctgtatatttctatatctgtctgtctgtctgtctatctctatatttatatctgtatgtttgtacatcaagtggtcacaggacctgcagaggctagaagaggatgccagat

SEQ ID NO: 59025 - DNA, 74 bp, Mus musculus
ggggagatagtcagaatgatatggagaatttattcattctctttttctctatgtctgtctgtctctgtctctgt

SEQ ID NO: 59026 - DNA, 80 bp, Mus musculus
gtgtatgtatgtatgtatgtatctgtgtgtatgtatgtatgtatgtatgtatgtatatggtatatgcatgcatggtatat

SEQ ID NO: 59027 - DNA, 78 bp, Mus musculus
tgtttatcaagcactttccattttcctcttggtgatgtttccatgttggaagcaagctcagagtagtgacagagaaca

SEQ ID NO: 59028 - DNA, 92 bp, Mus musculus
gtgtatatacacccatatgtgtgtatttgtgcatgtgcatgtgcgtgtgtgtatgtgtatgtattcatgcacatgtgtgtgtgtgtgtatat

SEQ ID NO: 59029 - DNA, 81 bp, Mus musculus
tgtagcacacactgttaattggacacctggggttcaaagaggggaaatgccgagttgctgtctgaacactgtgtgctgaca

SEQ ID NO: 59030 - DNA, 111 bp, Mus musculus
gtctctgtgtgtatatgtgtgcatgaatatgtatgtgtatgtatgtatgtatgtgtgcatgtgtatgaatgtgtatgtgtgttatacgtgtgtgtgtgtgtatttggaagc

SEQ ID NO: 59031 - DNA, 105 bp, Mus musculus
tgccttcttaattatgcttttgatttcctctgtgactctgtgattgttagtgtgaactgtcagctcacaggatctagaagcacccgagtgaagagcctctgggca

SEQ ID NO: 59032 - DNA, 102 bp, Mus musculus
gtgagtgtgttagtgtgcatgcctgcatgtgtgcatgcgaatgtgtacaaatgtgcacatgtatgtgtgcatgtgcttgtgtgtgcgtgagcacatgtgtac

SEQ ID NO: 59033 - DNA, 67 bp, Mus musculus
gcatatatgtgcatatgtgtgtgtgtgtactgtgtgtatatgtgtctatatatatgtgtgtgtgtgt

SEQ ID NO: 59034 - DNA, 105 bp, Mus musculus
ttagttgtgtttctgcaattgtgctggtgtgtaggtatgtctatgtgcatgtgcatatggaggccagaagaggatgccaggtcccgaatgacaggaaccgaatga

SEQ ID NO: 59035 - DNA, 114 bp, Mus musculus
ctgaacttgtcatccatggggacagctgtgatgtctctgtttctgtgtcactgtttaggctgtgcaaacacaaatacagtaaacactgaaatctcatctgcccctcagcttcag

SEQ ID NO: 59036 - DNA, 74 bp, Mus musculus
tgtgtgtgtgtgcatgtgtgtacatgtgtatgtgtgtgtgcgcacatgtgtgtgtgtgtaatagctacataaca

SEQ ID NO: 59037 - DNA, 69 bp, Mus musculus
taggctatatgtggctgtatatgtatatatatgtgtgtatgtgtatacatatatggctgtatatgtctg

SEQ ID NO: 59038 - DNA, 80 bp, Mus musculus
aggctaggctatagagaaagaccttagctcctgttctataatgctgcagtatgctgctgcttctctctgtctgtctgtct

SEQ ID NO: 59039 - DNA, 109 bp, Mus musculus
gagcataatcatattctcaggcattttgaagtctttgcagctattccctatttaactttttaaattgtattttatgaggattatttgcctgcgtgtatgtttgtgcatc

SEQ ID NO: 59040 - DNA, 110 bp, Mus musculus
tagttgctcgactgaaattaacaggaagtctaagacatgggtctcagactctcaccgtgtgagaggccattagtcagccttggatgagctgtggtgcagagagccagctg

SEQ ID NO: 59041 - DNA, 119 bp, Mus musculus
atgtgcgtgtatatgtgtatatgtatatatgtgtgtgtatatacatgtatgtgtatatatatatatatatgtatatatatatatatatacacacacatacaaagatagatagatagata

SEQ ID NO: 59042 - DNA, 56 bp, Mus musculus
tcacaggctcacaggtaagtttggttagactctgactctcacactggggtctgtgg

SEQ ID NO: 59043 - DNA, 96 bp, Mus musculus
gatcagccttaatccatggtgatctgataggatgcatgggataatttcaatatttttgtatctgttgaggcctgttttgtgaccagttatatgatc

SEQ ID NO: 59044 - DNA, 112 bp, Mus musculus
gctgcaagctctgacttttgatgcctacaaatcactcactttctgactgtgaccacaaagggagggacatgagtgaactttagaatccttcgtctcttgtcagggcttctgt

SEQ ID NO: 59045 - DNA, 110 bp, Mus musculus
tgatagtattaacagccacaccgactgagcagtgattctttttcattgttttaacagacactaaaaggacagctcaaaactcggtgtagctctcttggtttgtagtttca

SEQ ID NO: 59046 - DNA, 121 bp, Mus musculus
gcttgcagagctttctggctgactcccacacctcggtttctgagacagtctctccctctgcctaagcctcagcggctcagctcagatgcccggagtgggctagcacagccctgggctcagc

SEQ ID NO: 59047 - DNA, 112 bp, Mus musculus
ccacggtggaagatctggaatgtgtgtgggacctgcatgagagaaatgtgtgtcaacaggccgctgctttgtgctgcttggtcccgggtctcctcgaggcgttcttccttgg

SEQ ID NO: 59048 - DNA, 82 bp, Mus musculus
ttgagagactgaagcaggaggctcagaagttcggggtcattctccattgtgaatgacatgagtccctgtgtccctccctcaa

SEQ ID NO: 59049 - DNA, 77 bp, Mus musculus
gtggcatgtgcagtgcacatggaggccagaagacaatctcaggtgtcgactgtccgtccgtccgtctgtccgtccac

SEQ ID NO: 59050 - DNA, 80 bp, Mus musculus
tcaggagtgcggtccacatcctttgagtcagtctctcactaagtccggggctcactgaattgtctactctctgctcctga

SEQ ID NO: 59051 - DNA, 103 bp, Mus musculus
tcatctatgctgcatggctggtggtgtgcgtgcatgtgtgtgggtgtgcgtctgtctgcctgtctgcctgcctgcctccctgtctgtctgtatgcctgtctga

SEQ ID NO: 59052 - DNA, 72 bp, Mus musculus
tgtctgaggttgatgtctggtttccatgagagcacagacaggcagagacacagacagacagacaggcagata

SEQ ID NO: 59053 - DNA, 72 bp, Mus musculus
gcaaaacctgggaaggaccagacctcagtctctgcctcacagggaccccgtcagtccatccaagttctttgc

SEQ ID NO: 59054 - DNA, 128 bp, Mus musculus
gcatcagcatggtaagtacacacgcacatctgtgtgtgctcaggtgtgtgtgtgtctgtgtgtgtgtctgtgtgtgtgtctgtgtgtatgtatcagcatggtaggtacacactcacactctctgtctc

SEQ ID NO: 59055 - DNA, 90 bp, Mus musculus
gctgctgtattcacactagcaagatactgtatccagcactcaccggaagaaaactgagctgtagcagcatctccaagtgtgggaggaggt

SEQ ID NO: 59056 - DNA, 76 bp, Mus musculus
ggtgctcttacccatagaagaagctattcacgtaggattgtctgtgtgtctgtctgtggaaggggggatagaagcc

SEQ ID NO: 59057 - DNA, 59 bp, Mus musculus
tctctatctctctgtgtgtgcatatgtctttgtgccagtgcacaggcagaagctggaga

SEQ ID NO: 59058 - DNA, 73 bp, Mus musculus
ccctcctccatctttgtatgtgcatgtaagcacacatatgtgtgtgtattcatgtgtgtacatgtagtgaggg

SEQ ID NO: 59059 - DNA, 97 bp, Mus musculus
gtataaaaagtttgatgctcgatttgacaaattacattcagatccagcacactctctcgtgtctgtgtctgtctgtcaattcccgccaactctatgc

SEQ ID NO: 59060 - DNA, 71 bp, Mus musculus
aggagttggcagggaagagtcaggcatgagggtcccgggaatctcgcagtctgactgactggcagccttct

SEQ ID NO: 59061 - DNA, 123 bp, Mus musculus
aagataagtgtgtgtgtgtgtgtgtgtgtctgcatgtatgtatgtgtgtgtgcatgtgcatgtatgtgtgtgtgcacgtgtacgtgtcttcatgtgtgcatgcatgcacatgtacacacatgc

SEQ ID NO: 59062 - DNA, 94 bp, Mus musculus
gtgggtgccacaggccaacctcagccatcatccctcaagagcagaacactgtctgactgattggttatgcagctctggctggcctggaactcac

SEQ ID NO: 59063 - DNA, 135 bp, Mus musculus
tatttgaatgtgcatatgtatgtgtaagcacatatgtgtctgtgtgtatatgtatgtatgtgtgtatataagtatgtttatgtgtaactgtgtatatgtaaatgtgtgaatgtatgtgtatctttgtgtgtagat

SEQ ID NO: 59064 - DNA, 121 bp, Mus musculus
tctttggtgtgagggagtagacatatgtatgcatgtccatgtgtatgcatgtatgaatgtatgtgcacatagaagatatatggaagacacactatgtcttcctcccatgaatagaacacac

SEQ ID NO: 59065 - DNA, 108 bp, Mus musculus
gcccctgccagtaatgagctacgaaatccatgtctctttctgtgtcacatccatttccaaagacgaacactcaggagacaggcatcctccaagctactttgcaggggt

SEQ ID NO: 59066 - DNA, 86 bp, Mus musculus
gaagcaaacccagcatgtcatactgcagtgacaccccggcttgaagaaatagctctgtctctctatgtcactttgggtttgtcctc

SEQ ID NO: 59067 - DNA, 83 bp, Mus musculus
cagaattctagtctctctgtgtcacatactggaccagcttaaacaagctatggaccagggttggattataagagatgagactg

SEQ ID NO: 59068 - DNA, 158 bp, Mus musculus
catgagtgtgcacatgagtgtgaatgttatgggtatgtgagcatgagcatgtgtacatgcatgagaacacacgtgtgtgcatgtgagtgtgtggatgtgcttgtgagtgtgcgtatatgtgtaccagtgcattcctgtgcatgagtgtgtgtaagtca

SEQ ID NO: 59069 - DNA, 79 bp, Mus musculus
aagattctcggcgtctgtcagtgtctgtctggggcatggggtgcagggggctgaaggtactgacaggcactgggatctt

SEQ ID NO: 59070 - DNA, 74 bp, Mus musculus
ggtgtggcttctctctcttactgactgcactgtggggactcagtccaagtcagtggggacagtggagccacagc

SEQ ID NO: 59071 - DNA, 83 bp, Mus musculus
tagtgggaggaagtgggtcacagggcaagtttgtaggctatctcgttcctggctccttcctgtctctcactctctttccagtg

SEQ ID NO: 59072 - DNA, 65 bp, Mus musculus
caaatgtgcatgctcactctatgtgtgtatgtgtgtgaatatatatatgtgtgtgtgtgaatttg

SEQ ID NO: 59073 - DNA, 80 bp, Mus musculus
tagagatgacagagaggagagagctataatgagcctttctcgggagaatggctcctagctcagcttcctcttcaactcta

SEQ ID NO: 59074 - DNA, 83 bp, Mus musculus
tacatgtgtatgtgcatgtacatgtacacgcgtgtgcgtgtgtgtttgtgtgtgtgtgtgtgtgtgtgtgtgtgtgtgcgtgt

SEQ ID NO: 59075 - DNA, 82 bp, Mus musculus
gttggaagaagtatgtcactggtggtggcctttgaggttttcaaaagcccaagccaggcccagtgtctctctctctcccagc

SEQ ID NO: 59076 - DNA, 121 bp, Mus musculus
gcattgtgtatgtgtttgtgtgtgtatatgtgcatgtttgtatatatgtatgtatgtatatatatgtggggttatatgtgtatttatgtgtctgtatatgtgtctgcatgtgtatgtgtgt

SEQ ID NO: 59077 - DNA, 101 bp, Mus musculus
tggtctgaagttctctttctttgttggatctttgtgtggtttagatatcagagtaattgtggcttcgttgaatgaattgggtagagggaagttccagaaca

SEQ ID NO: 59078 - DNA, 87 bp, Mus musculus
gagtgggtttccgtctcatccaggtcccggtgtcctgagactaagatgagctgagagacaggactgtgagaccagagcctcatgctc

SEQ ID NO: 59079 - DNA, 81 bp, Mus musculus
caggtagaaagtggactccaaggaagctcacaggcttgtcagtgtctcatctctccttggtctccctcagactctgtcttg

SEQ ID NO: 59080 - DNA, 74 bp, Mus musculus
ctcgctcctttagtggggtttctgggcataagctagcatggtctgtctgtgtcacacacactcttggagatgag

SEQ ID NO: 59081 - DNA, 127 bp, Mus musculus
gtatgtatacacacatatatgtatatatgtattgtatatacatatatatacacatatgtgtgtatatgtatatatatttatatgtatatatcttatatatgtatatatatatatgtatatatatatg

SEQ ID NO: 59082 - DNA, 109 bp, Mus musculus
gagtgttcatgtatgtgcatctgtgtgtatacatgtgtgcatagtgtatgtctctatgtacacaagtatgtatttgtatatacctgctgcatgtgtgcctatatgtttc

SEQ ID NO: 59083 - DNA, 84 bp, Mus musculus
gagtcaactgagcccgtcagagaggagacagagtgcaggataatccagcaagtgaggtcagtccgctctgtggctggctgtctc

SEQ ID NO: 59084 - DNA, 104 bp, Mus musculus
tgccgtatgttgtgtagtcagtagagtactaggttgaatagatttgaacaggagtcatggacactgttcacaagtcacttacaatgtgattatggaacaaggca

SEQ ID NO: 59085 - DNA, 82 bp, Mus musculus
gtgagtctggttcatttttgagtcacggtctctctatttagcccctggctgttctggaacttttaatgtaaaccaggctggc

SEQ ID NO: 59086 - DNA, 100 bp, Mus musculus
ttggagtccctgctagaggaatgagcctgtctctgtctctgccttgaatcacccagaaggttggatgagacagtgctcctggccttgagctggagaccga

SEQ ID NO: 59087 - DNA, 111 bp, Mus musculus
aggtctctgtgtgtatttatatgtatgtgtatatatatacatatgtgtatatatatgtgtgtgtatatatatgtatatattcctctcaaacctaagtaaataaagggatgt

SEQ ID NO: 59088 - DNA, 64 bp, Mus musculus
gcacaatgttaatgtctgacagaaagcagtgatgagagagcatgctattctgtcatctttgtgc

SEQ ID NO: 59089 - DNA, 239 bp, Mus musculus
tgtgtaagtgctgacacagcacagtataggatgtgtaagtgtacacacagagcacagtgtaggatgtgtgtgcacacacagagcacagtgtaggatgtgtaagtgcacacagagcacagtgtaggatgtgtaagtgcacacacagagcacagtgtaggatgtgtaagtactgacacagcacagtgtaggatgtgtaagtgcacacacagagcactgtgtaggatgtgtgtgcacacaga

SEQ ID NO: 59090 - DNA, 95 bp, Mus musculus
cttacacatcctacactgtgatgtgtgtgtgcacacacatcctacactgtgctctgtgtgtgcacttacacatcctacactgtgctctgtgtcag

SEQ ID NO: 59091 - DNA, 78 bp, Mus musculus
tggtgtatgggttacaatgtgggtgattgtttgtggaggagagtcctctgactcacttgctgtctgcccatcctgcca

SEQ ID NO: 59092 - DNA, 84 bp, Mus musculus
ggcctctcagagcttactgtctcacttgtgaccgtgttctccagaagccccacttacacctgtctgtcactaactctgttggcc

SEQ ID NO: 59093 - DNA, 124 bp, Mus musculus
tgtatttgttaatcatatatatatatatatatatatatatatatatatatatatatatatacacacacacatatacatatatatacaaatatgtgtgtgtgtatatatatatgtatgtatgtat

SEQ ID NO: 59094 - DNA, 66 bp, Mus musculus
ccagcacatgtgtgggtgtgagagggacaagctgtggaagtcccttcccaccttccacgatgtagg

SEQ ID NO: 59095 - DNA, 78 bp, Mus musculus
catctctctctctgtcacagggtgctcggtcagcactgagggcttggggctggatggcgtccatggttcatggggaga

SEQ ID NO: 59096 - DNA, 129 bp, Mus musculus
gtgtgtgtgtgtgtgtctgtatgtgtgtctatgtgcatatatgtgtgtgtatgtatgtgtatatgtatatgtgtgtatgtgcatgcatgcacgtgtgtatgtgtgtatatgcatgtatatgtgtgtgca

SEQ ID NO: 59097 - DNA, 72 bp, Mus musculus
gtcagggaaaagtgacaaacagacactgacacagagagagtgctgtgtctgagtgtgatttctccaagcgac

SEQ ID NO: 59098 - DNA, 66 bp, Mus musculus
ctgtgtgcctggctccctgacaggacttccccacgagtgtcctgccctggagtttcccgagcacag

SEQ ID NO: 59099 - DNA, 92 bp, Mus musculus
cttatggacctgtgggtcaaaagcagcagttcttgggctgcagagatagctcagcagtttagagcactgactgctcttccagaggtcatgag

SEQ ID NO: 59100 - DNA, 121 bp, Mus musculus
catagtgtagcttttggtggtgagaaaaggatgtgtgtggtttcctgggacctggctgacacagatgatacagaggaggaaattataaacactgtatgtcactggctctaaaatgaatctc

SEQ ID NO: 59101 - DNA, 97 bp, Mus musculus
cctgcctcacactgtgcctgcctcacactgtgcctctgccattgagggtcaaagcagcaacagggatgccaggtcactgagtgacacaggctggggg

SEQ ID NO: 59102 - DNA, 66 bp, Mus musculus
gctacccagagaacggcctcggacattatcagtgctgatgaaactcagaggctcactctgagtgac

SEQ ID NO: 59103 - DNA, 67 bp, Mus musculus
cacagaggaatgttgagaggacccgtggctggaatggctctcagaatgggcttcctgcaggcatgtg

SEQ ID NO: 59104 - DNA, 117 bp, Mus musculus
tgctgcagtagatgtgtgcctgggcttgggatatgaggtttcaaaagtcaagctaggctcagcgtctctgtctgacacctatggatcaggatcacactcgcaggtacttctccagca

SEQ ID NO: 59105 - DNA, 58 bp, Mus musculus
gagcttgtgagtgagcagacactgtgcagtctgtagcagtcgtcctcactgcaggctc

SEQ ID NO: 59106 - DNA, 82 bp, Mus musculus
taattttacttatttgcatatctgtgtgtctgtgtgaatgtatgccacatgtgcatgggtgcctgtggattccagaagattg

SEQ ID NO: 59107 - DNA, 116 bp, Mus musculus
ctggtcaaattcctagtggccagtcccccctcaaggaagctgagtctctctctgcctgcactcatgctgtcagaagccgtcagctgaggagggatggggccagctctaccacacag

SEQ ID NO: 59108 - DNA, 118 bp, Mus musculus
gagagtctgctaccattaccacattacaagcaatctctaaaagatggttatgatttgagattttaaagatctagttcatgtttgccttcttcaaggagtatgtggattttcaagtgga

SEQ ID NO: 59109 - DNA, 60 bp, Mus musculus
ctgtctgtctgtctgtctgtctgtgtgccctctgacagagagagagagagagagagagag

SEQ ID NO: 59110 - DNA, 123 bp, Mus musculus
gagctaggatttgcaggaagcccatagcctccagagcagttcctgtcagtctgtccgtccatctgtctgtctgtctggggctatttaagttgcccatagtggctcagatcaaagcaggtgttc

SEQ ID NO: 59111 - DNA, 120 bp, Mus musculus
gtgtgctctgcaaaagagaacatcccagaagttggggatatctatctgtctgtctgtctgtcatctacctatctagggtggcatacatctttagccccagagtttgggaggcagaggcat

SEQ ID NO: 59112 - DNA, 74 bp, Mus musculus
caagtgagggtgactctgtctgggtcactgtgccccttattttgatagtgcctttcttctcactgctgcacttg

SEQ ID NO: 59113 - DNA, 88 bp, Mus musculus
cacagccctgtcagatgagtgtgacctcaaaagcccccgtgtgctcgggatccagcaggccatattagtcatttggcagaagcatgtg

SEQ ID NO: 59114 - DNA, 103 bp, Mus musculus
ggaaagggttcatttcagctcatagccccacatcactgtctgtctctgagggagtcactgagcctggctgaggctcttccaaagcttctttcaatggcagtga

SEQ ID NO: 59115 - DNA, 117 bp, Mus musculus
cacacacacacacacacacacacacacacacacatatatatatatatatatatatatatatatatatatatatagtttagcagtgacttacagaatgtgtgtgtgcatatgcatgtg

SEQ ID NO: 59116 - DNA, 91 bp, Mus musculus
cctgcttggtggaagctgcacaggctagggagcaaggcaggtggtttgtctgtctgtctgtctgtctgtctgtctttatgggctgaggagg

SEQ ID NO: 59117 - DNA, 120 bp, Mus musculus
gatgcagacattcaaatagtacatgctttctgtcaaacattgactctatattcaagcggtaagtgtgtttgtatatgtgtgtctgtgtctgtgtatgtatgtctgtgtatatgtgaatgt

SEQ ID NO: 59118 - DNA, 123 bp, Mus musculus
agtgtgctcacgtaggtttacatgtgcatgtgttcatgtgtgttcacacgtgtttgtgaatatatgtgtgttcatgcatgtgtgtgtattcacatgtttatgtgtgttcattgctggctgtgg

SEQ ID NO: 59119 - DNA, 107 bp, Mus musculus
ggtagctttaaacaccagcgcctcacgtatgtttatttttacttagtcttagggcagccattcctatttaaaactgagtaattgatgttgaaaggagctaagttgcc

SEQ ID NO: 59120 - DNA, 91 bp, Mus musculus
gacgtacctgttttgatcctcacactttggcgtgtgtgaaggcagatgagagacagccctgtgttcagacttgcttgagattacaggcgtc

SEQ ID NO: 59121 - DNA, 113 bp, Mus musculus
gtgtgtgcgtgcacacatctgtgtgtgtagtatgtatatgtattcatgtgtgtgtgtgtgtgtgtgtgtgtgtgtggcttgtatatgcatgtgtgcacatgtgtggatatatg

SEQ ID NO: 59122 - DNA, 92 bp, Mus musculus
aagattccttaagtcactgtctcagtcagggtttctattgctgcaatgaaacaccatgaccagaaagcaagacgggcatgaaagggtttctt

SEQ ID NO: 59123 - DNA, 66 bp, Mus musculus
tgctcatgtatgtatgcatgtatgtggattcacatgtgttggcatgtgtgtgggtatacatgtgca

SEQ ID NO: 59124 - DNA, 73 bp, Mus musculus
gtgttgactgagagcagacaccatgcagtttctgttgttttacatttgccaaggtgtctctggtagtcaggac

SEQ ID NO: 59125 - DNA, 87 bp, Mus musculus
tcctgtggtactttctgtgtgagtctgtctctcttatgaaattcaagtactgaggatggcagacgctaacagagcattctattgtga

SEQ ID NO: 59126 - DNA, 93 bp, Mus musculus
gcactgtctgcaagtcttgctcctgggtagcttgttgatctgatgtagacaagactgacagatacctaaaaggagcacaccaggatacagagc

SEQ ID NO: 59127 - DNA, 121 bp, Mus musculus
tgtgtgtatatatgtatgtctgtgtatgtgtatatgtgtatatatatatgtatgtgtatatatatatatatatatatacacatacatacacacacacacacacacacagcacatatatatg

SEQ ID NO: 59128 - DNA, 90 bp, Mus musculus
caatgtgcacagggggctcactctgtccctctcttgaagcaagcaggcagataaatgctcacagagaaggcagagccttctgagagcttg

SEQ ID NO: 59129 - DNA, 73 bp, Mus musculus
tctgcctgggccaagcttgaaggacagggtcaccatggccagtgagtctgttacactctctgtcaaaagcaga

SEQ ID NO: 59130 - DNA, 64 bp, Mus musculus
tggatgaggttcagatggcacagtgcccactaatggtcactgacactgtgtctgtcctctttca

SEQ ID NO: 59131 - DNA, 61 bp, Mus musculus
atgtgtaaatgcatgtgtatgcatacattgtgtgtgtgtgtgtgtgtgtgtgtgtgtgtgt

SEQ ID NO: 59132 - DNA, 102 bp, Mus musculus
cagccaaaccctgctgagattcaccctccggactggtctctgcctgtgtgactcacccaggctgctgccatggagtctgaaatcacagcacagctgaagctg

SEQ ID NO: 59133 - DNA, 94 bp, Mus musculus
ccagccccatgggcatctgggagctggctactttcgcatgtgtggttcaatcagcccatggctgagttctgagttcctctgtgcccttgggtgg

SEQ ID NO: 59134 - DNA, 116 bp, Mus musculus
ggattctacactcagagagacacacacacacatgtacaaaattctctttttttattactaaagattggtttatttatttcatgtatgtgggtacactgtcgctgtcttcagatacc

SEQ ID NO: 59135 - DNA, 62 bp, Mus musculus
gcttcacagtatgtgtcactgtgtgtccgtgtcccgagggcagactctgtggctgatggagc

SEQ ID NO: 59136 - DNA, 114 bp, Mus musculus
tctcacagcaatgaaaatgctaagacaatctcctcaaatcttgaaatgtgtttatgatgttagcaaataagaactgatggatccgtggtagagtatttatcagcattaatgagg

SEQ ID NO: 59137 - DNA, 91 bp, Mus musculus
agagcacacctgtgagatttttgcttgttttgaagtggatgaatccacttctattctggacttttgaggtaggaaggcacagctttgatct

SEQ ID NO: 59138 - DNA, 58 bp, Mus musculus
cagtgaaggtgaataagtcacacctgtgctaaggcacactcactgacaccttcatctg

SEQ ID NO: 59139 - DNA, 68 bp, Mus musculus
tcacactggctctgactctatccagctgtctccagaggcagattctggaagaagtctgtactctgtga

SEQ ID NO: 59140 - DNA, 78 bp, Mus musculus
gctaatgttgggtggattttggcggccacagaagctaatggttactctcaggctgtcactccatatttccagtaaagt

SEQ ID NO: 59141 - DNA, 57 bp, Mus musculus
cccagtgtctctgccagtctctcagaggttgccctggggactgcatgatgtcttggg

SEQ ID NO: 59142 - DNA, 62 bp, Mus musculus
tgtatgcaggacaccacgcgtgcattgacgtctcacaggcacacactgagtgttcacataca

SEQ ID NO: 59143 - DNA, 114 bp, Mus musculus
cattgtcctccatgtttgcaatgaagggctgtgtctaagtctgtgtgctattgctgtaaagagacaccaagaccaagacaactcttattttaaaaaaggcatctggtggtagtg

SEQ ID NO: 59144 - DNA, 112 bp, Mus musculus
gatgtctagaaaggagcacccactcctggggctaagggaggggctgaaagccctgcagtcagtcactcagtgcttcccttttcaggagacattcctggctcttctctgcctc

SEQ ID NO: 59145 - DNA, 68 bp, Mus musculus
atcatggtgctctctagtgccagaggctgggttacaaccctgtctctctcactcactgactctgtgat

SEQ ID NO: 59146 - DNA, 65 bp, Mus musculus
cctgtctgtctctcagtctctgtgttagagcttccgagatagcaagaggcccgaggaaggatggg

SEQ ID NO: 59147 - DNA, 85 bp, Mus musculus; identical to SEQ ID NO: 57439

SEQ ID NO: 59148 - DNA, 107 bp, Mus musculus
cccagcacattaatgaactcagtaccaagaatgctgacatattatttatttttcaagagtctcccctggggtttaattatgtagacatcactgagtcactggctggg

SEQ ID NO: 59149 - DNA, 110 bp, Mus musculus
gttgtaagcttaagagatggactggagagatggctcagaggttaggagcactgtctgctcttccagaggtcctgagttcaattcctagcaaccacatggtggctcacaac

SEQ ID NO: 59150 - DNA, 91 bp, Mus musculus
ttggactggctgttcagctgttcagagtgctgaagagtgagagctgacagctttcctctcctctggacctgtcaagagcttgccaacatcc

SEQ ID NO: 59151 - DNA, 116 bp, Mus musculus
gttgtggggcatatgtactgtgtgtgtttacagacttaaaaagtgacagatatttgcaaatgtattcatatttttaaatcacgagattggcatattacatgttttagggaatcagc

SEQ ID NO: 59152 - DNA, 81 bp, Mus musculus
gaaacttctgtgcctctgactgcctggagccacacaggcatccaccaaaccaggtcagagcgccttaggcacatcgtgttc

SEQ ID NO: 59153 - DNA, 105 bp, Mus musculus
tcacttagccacaagacaactcaaagcaggataaggcccggcattcctcccttcttcactgtgtgtgcctgtgtgcctgtcttactttggttgaaggcacagtga

SEQ ID NO: 59154 - DNA, 85 bp, Mus musculus; identical to SEQ ID NO: 57470

SEQ ID NO: 59155 - DNA, 135 bp, Mus musculus
tgtgtgtgcatatctgtatgtatatgtgtgtttgtgcatgtttgtatgtatgtatgtatatatatgtatgtgtatctatatgtgtatttttgtatttatctgtgtgtatgtgtgcatatgtatatatatgtatat

SEQ ID NO: 59156 - DNA, 94 bp, Mus musculus
agtctgaagtcctatttatgcaaagacattatttctttaaagtactgtattatcttgtgagtttttatctttatatagaaagtgactgcagatt

SEQ ID NO: 59157 - DNA, 76 bp, Mus musculus
ggccttgttggaggaactgagggtgggctttgaggtttcagaagctcaagccaggctcagtctcactccctctgcc

SEQ ID NO: 59158 - DNA, 83 bp, Mus musculus
catgggacaatttcaatatttttgtatctgttaaggcctgctttgtggctaattatatggtcaattttggagaaggtcccgtg

SEQ ID NO: 59159 - DNA, 85 bp, Mus musculus; identical to SEQ ID NO: 57439

SEQ ID NO: 59160 - DNA, 93 bp, Mus musculus
gtcttggtcatctactgctgggtatggagtctattttttttttttaagtttttcgagactgtaaaaggaggatttactcggtagtttccaagc

SEQ ID NO: 59161 - DNA, 69 bp, Mus musculus
ggagaagatgccctgtccctcagtgtgtcacaaccacaggacacatctgaaaggcagtgactggactcc

SEQ ID NO: 59162 - DNA, 103 bp, Mus musculus
gtatgtatgttgtatgtatgtgtatatgtgagtgtatgtgatataatagttatctgtgtatatgtatatgaatatataggaagttatatatgcaagtatatat

SEQ ID NO: 59163 - DNA, 58 bp, Mus musculus
ctgggtgtgagttgagtgacagcaggaccttgttggaatggctccactctgctcccag

SEQ ID NO: 59164 - DNA, 111 bp, Mus musculus
ttcagcctaaaggcaacattgtaagattctacaggcagagaggttacctgtttgttctttgagcaaactagtgtttcttgggctgtagagtgtttttccttgaggcatgag

SEQ ID NO: 59165 - DNA, 108 bp, Mus musculus
atgcaacatatatatatatatatatatatatatatatatatatatatatatatacatatatatgtacatatgtatatatgtacatatatatagtgtgtgtatgtatgt

SEQ ID NO: 59166 - DNA, 104 bp, Mus musculus
ctctccaatctagagtaagtatgcatatatatactcattgcatagatacatcacaattctataaatgtatgtaaatgcacacaaaaacatctgcatagggacag

SEQ ID NO: 59167 - DNA, 115 bp, Mus musculus
catgagtgagtgttgtttttggaagggctggtcctggggagagaggtgacactagtctaagaactcactctggaaaggagcctatagcctccccagaggcaagctgtattctgaa

SEQ ID NO: 59168 - DNA, 86 bp, Mus musculus
tgcccaagggaacagagcagacagagcactggggacagagtctgaattgggtgttgctggtgctacatgcttggtgaacatgggta

SEQ ID NO: 59169 - DNA, 80 bp, Mus musculus
tcctaaaatcctcatttaataacttgcccatagcttgtttcctgtcttgttccaagtttgttaagtgaagattgacagga

SEQ ID NO: 59170 - DNA, 109 bp, Mus musculus
gtgagatcctcttcttctggaagctggtttcacatggtggcttagatttttccatctttgtatctagcaccatttgaaatcagtgttttaggagtaagaattgcagcac

SEQ ID NO: 59171 - DNA, 98 bp, Mus musculus
ggtccatctcttacacaggctgaccgatttctcctggtgttcagagtctgtttttgtctagcaccatttgaaatcggttatgatgtagggggaagagc

SEQ ID NO: 59172 - DNA, 85 bp, Mus musculus; identical to SEQ ID NO: 57439

SEQ ID NO: 59173 - DNA, 85 bp, Mus musculus; identical to SEQ ID NO: 57470

SEQ ID NO: 59174 - DNA, 115 bp, Mus musculus
cccgtcagaagtaaggctggttgtacaagtccaggggcagtcgagtgtgcttagatatactggtgtcttctgtctctgttactattttgtttttgtttgtggttttcgttatggg

SEQ ID NO: 59175 - DNA, 117 bp, Mus musculus
aggttggagttcaaagccatagctgggcattggtgttatacctctgtcaggcactgtgtctggtatattttgtgtttcctttcatactaatctcagcttcacactttgcacgtgcct

SEQ ID NO: 59176 - DNA, 85 bp, Mus musculus
tatatatgtgtgtatctatatgtgtacatgtatgtatgtgttatgtatatatatatatgcgtatgtatgggtatatgcatgtata

SEQ ID NO: 59177 - DNA, 77 bp, Mus musculus
cttttggcccttccagtctgcgacaacaccaggtcacctgggcacagagtcagcagacaccctgaagatccttagag

SEQ ID NO: 59178 - DNA, 105 bp, Mus musculus
gcaatattcagatattatgtcagtatattcttatcattgaggttctaagatttttttctgtagaatgttgtttggtttggtctatgtagatggtagtagaagtgc

SEQ ID NO: 59179 - DNA, 85 bp, Mus musculus
tttcatacgttctgttagtttcactgtgtctctctttagtttctgtttgcaggaactgttcattagtgagagtggggtgttgaag

SEQ ID NO: 59180 - DNA, 74 bp, Mus musculus
ggcgctcttgtggaactcctaacagtggaagcaggggctctctctgactctgttgcgggttttgcgggcctgtc

SEQ ID NO: 59181 - DNA, 106 bp, Mus musculus; identical to SEQ ID NO: 58252

SEQ ID NO: 59182 - DNA, 83 bp, Mus musculus
gggtttaatctgctcactggtgtgagatgaacattgtcttcctgaggtacaggcgatcacattctcactcagtcaaaagaccc

SEQ ID NO: 59183 - DNA, 77 bp, Mus musculus
tatgtacagacatttgtttctctgaagcttcagcttcaaacctgctccttcaaagaaagagaagatgtttgtacatg

SEQ ID NO: 59184 - DNA, 89 bp, Mus musculus
tgtgtacgtgtgtgtgtgtgattaagtaggatacaaattatatattttatgatactcaaatctctcttgataacacatgaactgacata

SEQ ID NO: 59185 - DNA, 67 bp, Mus musculus
atgtgtacaccatacatatatgcatgcatgcatgtatgtatgtatgcatgtgtgtgtgtatgcacat

SEQ ID NO: 59186 - DNA, 99 bp, Mus musculus
ggagctagtggccacaatgactgaattcctaagtgtaatctgtacagtactgacagagctcaggagagcagaagatacatatgtgatagccaaaagacc

SEQ ID NO: 59187 - DNA, 137 bp, Mus musculus
gccccctgatacccaaactgcattgtgtggagatgagtactgtgtgctgttccaagtgttgtgctttctgtctctcagtgaatcagtgggagctctgaacatttccttagactcagtaaattaattttctcttcaat

SEQ ID NO: 59188 - DNA, 111 bp, Mus musculus
tgtgtatgtatgtgtatatatatgtatatatgtgtgtatatatctgtatgtatatgtaaatatatatgtatatgtgtacatatgtatatatgtgtatatgtatatgtatat

SEQ ID NO: 59189 - DNA, 78 bp, Mus musculus
tggtttaataggtgatcagataggatacatgggataatttcaatatatttgtatctgcagagacctgttttgtgacca

SEQ ID NO: 59190 - DNA, 85 bp, Mus musculus; identical to SEQ ID NO: 57439

SEQ ID NO: 59191 - DNA, 119 bp, Mus musculus
atatacttatgtatgaatgtatatatatgtgtgtgtatgtatgtatgtatgtatgtatgtatgtatgtatatatatatatatgtgtgtgtgtgtgtgtgtgtgtgtgtgtgtgtgcgtg

SEQ ID NO: 59192 - DNA, 118 bp, Mus musculus
attgagagtatgtgaattagtggctatggggagtaatatctatgtatgtatgtatgtatgtatgtatgcatgtatgtgtcttagtgactatggggagtatgtatgtatgtagagcagt

SEQ ID NO: 59193 - DNA, 82 bp, Mus musculus
atgtatgaatatatacatgtgtgtatgtgtctttgtggctatggggagtagtatctatgcatatatgtatgtatatatgtgt

SEQ ID NO: 59194 - DNA, 107 bp, Mus musculus
gttgtgattacttatatttacctatagagagttctgttttggttgtactttaataccattggattatacatatgctagaatgggctccttataagtaccatcccaat

SEQ ID NO: 59195 - DNA, 114 bp, Mus musculus
taggaaatgctttaaaacaggctccacaatcacagaccacaaagcagggctggggttggctccctctgtgtgtgcatcgtgtttgtactcagatggctggaaaagcaaaggcta

SEQ ID NO: 59196 - DNA, 101 bp, Mus musculus
ctctgggagaacagctagtgccctctctccagcaacacacattttattttttaaatgccaagtggttatgtctgagaatgaggcaggaaattagtctagag

SEQ ID NO: 59197 - DNA, 110 bp, Mus musculus
cacacacacacacacacacacacacacacacacacacacacacacatatatatatatatatacatgcatgtggcatgtgtatgcatttggtgtgattgtctgtgaatgtg

SEQ ID NO: 59198 - DNA, 115 bp, Mus musculus
gtgcctcggaggacacagcttccccaggccacatgcttctttatatcctcatagatatctcagcactatggaatgtaaggaagtgtgtggttttggcaagtgcttcttcaaggcc

SEQ ID NO: 59199 - DNA, 69 bp, Mus musculus
ggtcagtttgaagaaagacagcatagctgattgacccacaactgttgtgtaagcatttcttatctggcc

SEQ ID NO: 59200 - DNA, 70 bp, Mus musculus
gctcccttcttgagaggtttgtagactgtggtagactcacttggctgcctgtcttcagccagaggggagt

SEQ ID NO: 59201 - DNA, 93 bp, Mus musculus
gtttctgattttctccattgagtttggtttctgattttatatatatgagaggctcatcaaagaattcagtgaaaagctaggggaaagcggggc

SEQ ID NO: 59202 - DNA, 71 bp, Mus musculus
cagacagggatgtaaattagagcggctttttagttgaaagctagaaaccactgtgactgtgactctgtttg

SEQ ID NO: 59203 - DNA, 83 bp, Mus musculus
gcaaagagagtaaacagaacagcgcaccagaggccatagatttctgtctctgtgtctatctctctgtatctgactctctctgt

SEQ ID NO: 59204 - DNA, 57 bp, Mus musculus
ggacgccgagggaggtggaagagcagctcactgttctgactcactgcctgtcggtcc

SEQ ID NO: 59205 - DNA, 106 bp, Mus musculus
gagggcctctgtgtctacagcacattcttctctctggctctgttctggtgcggcatggaccgacaggcagtgagtcagaacagtgagctgctcttccacctccctc

SEQ ID NO: 59206 - DNA, 60 bp, Mus musculus
tgtatgtatgtatgtatgtatatgtgtgtgtgtatgtatgtatgtatgtatgtatgtata

SEQ ID NO: 59207 - DNA, 68 bp, Mus musculus
ggatttatttgtatatttacatgtatgagtgtttcctggcatgtaaatatgtacacaggtgtatatcc

SEQ ID NO: 59208 - DNA, 120 bp, Mus musculus
actcaggcaagcacctgggaggaagaagttgatgcaggccatggagagatgttgctctctgtctctctatggcttgcttggcctgcttccttaggcacccagaaccactagcccaggagt

SEQ ID NO: 59209 - DNA, 112 bp, Mus musculus
cttgtccttgcaaagtccctttggcacctggaacatttttagctagggactcacagacagtgtctcagtggaaagcctgcctgtgcccatgaaagggaaaacctgtagcaag

SEQ ID NO: 59210 - DNA, 116 bp, Mus musculus
gcctgcatcgtcagaagtgtatgtgcacacatcatcagaagggtgtgtgcacacatcgtcagaagggtaagtgcacacatcatcagaagggtatgtgcacacatcatcagaagggt

SEQ ID NO: 59211 - DNA, 71 bp, Mus musculus
tagggggcctagagggcagcttacctatgaggggtcacatccttaagggaaactgactctcagtctccctg

SEQ ID NO: 59212 - DNA, 61 bp, Mus musculus
tgtcacatcattcagtctctctggttctcatcctctgttgactctgtgaggctgtgtgaca

SEQ ID NO: 59213 - DNA, 76 bp, Mus musculus
tgtgggccactatcccagtctttgaagagttatttacatttcagaggaaagatcactggtttcttatcagcctaca

SEQ ID NO: 59214 - DNA, 90 bp, Mus musculus
gccttagcctgtggtgatcagataggatgcatggaataatttcaatatttttgtatctgtgtaggcctgttttgtgaccaattatatggt

SEQ ID NO: 59215 - DNA, 75 bp, Mus musculus
gggtgcatgtgtgtgtgcatgtgtgtatatatatatatatatatgcatgatatctgaatatgtacatatgcattc

SEQ ID NO: 59216 - DNA, 80 bp, Mus musculus
ggatgtgtatgtatgtctatatgtatgtgtgtgcttacacacacatacatatatatatgtgtgtatatatatatatatcc

SEQ ID NO: 59217 - DNA, 85 bp, Mus musculus; identical to SEQ ID NO: 57470

SEQ ID NO: 59218 - DNA, 107 bp, Mus musculus
gtgggtgtggggcaaagtttgagtagagcaatgaagacagtctgcacataggctgggtggaatctctgtggacttactgtcttgcttactggatgtttaatgaccat

SEQ ID NO: 59219 - DNA, 64 bp, Mus musculus
actgtgactccagtgtgtgtgtgtgtgtgtgcaaatactgtgtatgcatgactgtgactccagt

SEQ ID NO: 59220 - DNA, 105 bp, Mus musculus
cctatatctatatctatcatctatatctatatgtatatctatatttacatcttagcctgcttgcatataggttgtatatgattagccttcttgtatatagattgg

SEQ ID NO: 59221 - DNA, 102 bp, Mus musculus
tgtacatgtatgtatgtacatgtgtgtattatgtacatgtgtgtatatgtgtatatgtatacatatatgtatatatgtgtacatatgtatgcatatgtgcat

SEQ ID NO: 59222 - DNA, 116 bp, Mus musculus
tatatatgcagatatgtatatctgtatttgtatatatctgattatgtgcatatatatgtatgtatataggtatataaaatatgtaatattggtagatatgtatatctgtatttgta

SEQ ID NO: 59223 - DNA, 120 bp, Mus musculus
gagactagagaagtagttagtgcctagagaaaaaggtctgtagataatacaaacaattattattttataataaatggaggggcagtcacagaaaagtgtcaggtgtgatgacatggtgtc

SEQ ID NO: 59224 - DNA, 94 bp, Mus musculus
cagagggttttcatagtcatatattaatttttagatgtcttacagtgacttggtagtcagatgattaagctttagtttttatgaaaggactttg

SEQ ID NO: 59225 - DNA, 135 bp, Mus musculus
aatggagacatcactaggacaacacattctcaggggactgaagtctgtggattctgtcagtgtctctgtttgctttagctcactttatcttttattataggtaataagatacaaattgctgggtaaattggatac

SEQ ID NO: 59226 - DNA, 85 bp, Mus musculus; identical to SEQ ID NO: 57439

SEQ ID NO: 59227 - DNA, 95 bp, Mus musculus
ctccatggtgttcccattatggtggttatgctggctaggtttatgtcaacttgacacaagctagagtcctctgaccagagggaaccccaactgag

SEQ ID NO: 59228 - DNA, 96 bp, Mus musculus
gttgacagtgagcgactgtaaacatcctcgactggaagctgtgaagccacaaatgggctttcagtcggatgtttgcagctgcctactgcctccaac

SEQ ID NO: 59229 - DNA, 98 bp, Mus musculus
gagcactgagtgacagatattgtaaacatcctacactctcagctgtgaaaagtaagaaagctgggagaaggctgtttactctctctgccttggaaatc

SEQ ID NO: 59230 - DNA, 78 bp, Mus musculus
catttaggaacatgcatatatgcatatatgcatatacatatagggatatgtatgtatgtatgtatacaacaatgaatg

SEQ ID NO: 59231 - DNA, 80 bp, Mus musculus
ttcttctgtccttgtgtgtctgtgtgtgtgtgcgtgcacatgtgcatgtgtgtgtgtgtgtgagagagagagacagagag

SEQ ID NO: 59232 - DNA, 74 bp, Mus musculus
gctgacctcaggcatggttctgtaatggaggagagggccctaagggttcagacagatgtgtgtgtgtgttcagc

SEQ ID NO: 59233 - DNA, 65 bp, Mus musculus
cactgtcttcctctgtctctatctcatccaagggtgtgatcataataaaggataaattggcagtg

SEQ ID NO: 59234 - DNA, 108 bp, Mus musculus
tggtggcttttgcaatcatggcttactaagaacctttcaaactatgcgtgctgagtgattatgttcttgtgaatctgtcatgtgtttacacctttgtaaaaggcagca

SEQ ID NO: 59235 - DNA, 111 bp, Mus musculus
cagagacagagacatagagagacagagacacagagagacagagagacagagagagatagtgtgtgtgttgtctctttttatcaactgtgtagatcctagagattgaatttg

SEQ ID NO: 59236 - DNA, 115 bp, Mus musculus
cagcaaaatgagtgtgagggacagctcatcattttgtgtcactctttcagtctgtctgagacttgtttccccttctgaagcagtggcaatgctgatcatgtcttttatgttcctg

SEQ ID NO: 59237 - DNA, 85 bp, Mus musculus
gtagacagtaggtcactagaaatgtgaatttgaagatatttattgaccttggatatttcttctatttctcttgctctctgtctcc

SEQ ID NO: 59238 - DNA, 102 bp, Mus musculus
agtgctagagcaaaaatttaagtccagaattggcatctgagcttgggctcgtcactgtcgtttgcctggctgcctgattgccatctgaatgtgctctggcct

SEQ ID NO: 59239 - DNA, 85 bp, Mus musculus; identical to SEQ ID NO: 57470

SEQ ID NO: 59240 - DNA, 85 bp, Mus musculus; identical to SEQ ID NO: 57470

SEQ ID NO: 59241 - DNA, 62 bp, Mus musculus
gcaagctatacacatacatgtatacacatatatgtatgtatgtatgtatgtatgtattttgt

SEQ ID NO: 59242 - DNA, 113 bp, Mus musculus
catgagtgaaacagatggcttgagagaattgcagtcttatatggagccttaaatagaaactttttatttagattgttctaatttgcttttctgttgctatgataaataccatg

SEQ ID NO: 59243 - DNA, 85 bp, Mus musculus; identical to SEQ ID NO: 57439

SEQ ID NO: 59244 - DNA, 97 bp, Mus musculus
aggtaaagttgcctgtggctcagggctttgatgtctcccacgacacagctgtgagaaggggatttacagagaacctaacagtcagggcacttggctt

SEQ ID NO: 59245 - DNA, 87 bp, Mus musculus
gcagagggcatgcgacttacctggtatataaatatatatagtaggtatatgtaagcgtacctattgtgagtcgaaaagcttaaatgt

SEQ ID NO: 59246 - DNA, 77 bp, Mus musculus
tttttggtagaattttcttatgtagagaagatctgtcctccattaagatctgctttgcttttagaatctaaagaaag

SEQ ID NO: 59247 - DNA, 94 bp, Mus musculus
atgcaatatacatatatatatatatatatatgcatatatatgtgtgtgtgtgtatatatgtatatatacatatatgtgtgtgtgtatatatata

SEQ ID NO: 59248 - DNA, 61 bp, Mus musculus
tatgtgtgtgtgtatatatatacatacatatacatgtatgttatgtttacatatatacatg

SEQ ID NO: 59249 - DNA, 112 bp, Mus musculus
atatgagagttggatgacctctccttcctgctcccatccttctggtctgtatgtcatgtcagaagaaagacaggtgtaggaggcacaagactgctattccattcattcatat

SEQ ID NO: 59250 - DNA, 73 bp, Mus musculus
ggaggaggtgtatcactgagggggaggggagatttcaaaagattcccagtgtgtctctcactgactcctacct

SEQ ID NO: 59251 - DNA, 97 bp, Mus musculus
ttgaaacgtaagggttatttcattcatagaagagagagagcaggttctgggcagtgcatcttgctcctgtatgtgatattaatttacagcgatgcag

SEQ ID NO: 59252 - DNA, 85 bp, Mus musculus; identical to SEQ ID NO: 57439

SEQ ID NO: 59253 - DNA, 116 bp, Mus musculus
acattaacagggtatagagggactggagagatggctcagaggttaagagcactgactgctcttccaaaggtcctgagttcaaatcccagcaaccccatggtagctcaaccatatgt

SEQ ID NO: 59254 - DNA, 85 bp, Mus musculus
gtccatggtggtctgataggatgcatgggacaatttcaatatttttgtatctgttgaagcctgttttgtgaccaattatatggtc

SEQ ID NO: 59255 - DNA, 81 bp, Mus musculus
tatatatacatgcatacatatatgtatgtatatatgtgcgcatacatataatatgtatatgtgtatatgtatatatatcat

SEQ ID NO: 59256 - DNA, 97 bp, Mus musculus
atatacacatatacatattatatgtatgcgcacatatatacatacatatatgtatgcatgtatatatatgtgtatattaagaatgggtggatgagta

SEQ ID NO: 59257 - DNA, 61 bp, Mus musculus
ttctatcaagtatagagttggtagagattctctcccactctctgagcttgctcatgtagaa

SEQ ID NO: 59258 - DNA, 167 bp, Mus musculus
tatatatatataatgtttgtgtgtatatataatacacatataagtgtttgtatatatatatgtgtgtatatacatatatatagtgtacatatgtatatgtatatatatatgtatgtatgtataatacatattcagtaagctaatgtatatatacacatacacatatg

SEQ ID NO: 59259 - DNA, 73 bp, Mus musculus
ctattggtgaaagttgggtattgaagactcacactatcagtgtatgagggtcaatatgtggcttaagctatag

SEQ ID NO: 59260 - DNA, 62 bp, Mus musculus
atatatgcataagtatatctttctatatttatagatagatatacatatatgtgtgcatatat

SEQ ID NO: 59261 - DNA, 72 bp, Mus musculus
gcacaccagctttcatcatagaatttatttattcatcattagaatttatctatgatgaaagctgaaaacagc

SEQ ID NO: 59262 - DNA, 76 bp, Mus musculus
atatatatgcatataggcatgtattgtatatatataaaggtatatatgctatataaaggaatatatgtatatatat

SEQ ID NO: 59263 - DNA, 89 bp, Mus musculus
ttcatcaaggaattgtgtgtgtgtgtgcagtggcctctatgtagagtaaaaggtcactgacccactgtcagaaaaacatgctctgtgaa

SEQ ID NO: 59264 - DNA, 120 bp, Mus musculus
caggggattagggatgcactcacagcagcttgaagtaagaacacaacttatagccatttgtaaatggttctatagttttgtctttggataaggaaatgagcgttttaacctgacatcttg

SEQ ID NO: 59265 - DNA, 118 bp, Mus musculus
atggtttgagaattttatgcatcagaactttgtaattcagatttttatgtctataaatgactgtagtaatgaattggaaaatatctaaagatctaaatgtatagaatagatatactgt

SEQ ID NO: 59266 - DNA, 118 bp, Mus musculus
acacacagacacacacacacacacacacacagagagagagagagagagagagagagagagagagagtgagtcttgctcagggctaggatgagaggtgtgtgacctgactctgttttgt

SEQ ID NO: 59267 - DNA, 165 bp, Mus musculus
atgtatgtatgtatgtatgtatgtgtatatatatatacatacatatatatgtgtgtgtacatatgtctttatatatttatatttatttatatactatataattaaatatctaagttatagtcattcatttaaatatatgtatttaaatatattttatacatgggt

SEQ ID NO: 59268 - DNA, 68 bp, Mus musculus
caaagaccagacagagaaggcatgaaaactcttaacagtctctatgtctgtctgtctgtctgtctctg

SEQ ID NO: 59269 - DNA, 105 bp, Mus musculus
ggcagcttctcatcttcccataacagcatgttaatctatattcttaaatgtgtcagttaagttataaaggtctgcacgtgttatattttattggaaggttttgct

SEQ ID NO: 59270 - DNA, 85 bp, Mus musculus; identical to SEQ ID NO: 57470

SEQ ID NO: 59271 - DNA, 71 bp, Mus musculus
gtgtgtgtgtgtgtgtgtgtacacgtgcaggtgtgtgcagatgagcatgcacacacacacacacacacata

SEQ ID NO: 59272 - DNA, 86 bp, Mus musculus
atatatatgtgtatatgtgtgtgtatatatgtgtgtatatatgcatatatgtatgtatatatgtgtgtgtgtatgtatatatgtat

SEQ ID NO: 59273 - DNA, 146 bp, Mus musculus
atgtgtatatgtgcatatgagtatgtgtgtatatgtgcatattatgttatatgtatatatgtatttgtgtgtataggcatgttatatgtatatatgtatatgtgtatatgtgtatatgtgtatatgtgtatgtgtatatgtgtata

SEQ ID NO: 59274 - DNA, 113 bp, Mus musculus
tatctgatcctgatttaacattggtatctggtatttgactagaaaattgtccaattcatccagattttctagttgtgttgatttggcctatgcttttgtagcagcatctaatg

SEQ ID NO: 59275 - DNA, 78 bp, Mus musculus
attttaactgtttgtcattttgttcattttgttgaaaaacttttttttttgatgaaggggatgacaaatatttttaat

SEQ ID NO: 59276 - DNA, 108 bp, Mus musculus
tcataagggaaattggtctgaagttctcgttctttgttggtctttatgtggattagatatcagagtaattgtggcttcatagaatgaattgcgtagagtaccttctgg

SEQ ID NO: 59277 - DNA, 94 bp, Mus musculus
ttggcatctttagcaacaggatcttacttccatattttgattggcaattaaggattgtggtaatatgttgtaatgttttgtgaacctctgccaa

SEQ ID NO: 59278 - DNA, 111 bp, Mus musculus
ctcactgcaaggtgagcatttatggaagtgattggatagatagaattcttacataataagtatttctatctatttatgaactcaaaataagatgccattattttgggtggg

SEQ ID NO: 59279 - DNA, 85 bp, Mus musculus; identical to SEQ ID NO: 57439

SEQ ID NO: 59280 - DNA, 76 bp, Mus musculus
gctggagacttacataaggacaatggaagaaggaagtttctgtctgtctgtctgtctgtctgtctctctcctttgc

SEQ ID NO: 59281 - DNA, 85 bp, Mus musculus
ggccatggtggtctgataggatacgtgggagaatttcaatatttttgtatctgttgaggcctgttttgtgaccaattatatggtc

SEQ ID NO: 59282 - DNA, 76 bp, Mus musculus
tctgttagtttcactctgtctctgtttagtttctgtttccaggatctgtccattgatgagagtgggctattaaaga

SEQ ID NO: 59283 - DNA, 90 bp, Mus musculus
taccaactcattgtatttatgtatgtatgcatgcatgcatgtatgtatgtatgtatgtatgtatgtatgtatgtgcatgaccatctggtg

SEQ ID NO: 59284 - DNA, 68 bp, Mus musculus
tggggagagtaggtattcttgtcttgtcccaaatttcagtgggattgattcaagtatgtctccactca

SEQ ID NO: 59285 - DNA, 95 bp, Mus musculus
atatgtatgtatatatgtatgattgcatgtatatatatatgtatatgcatatatatacatatatatacatatatatatatatatatgcatacaca

SEQ ID NO: 59286 - DNA, 90 bp, Mus musculus
gtgtgtgtatgtatgtatgtatgtatgtatatatatatatatatatatatatatatatatatatatatacacacatatatatatatatat

SEQ ID NO: 59287 - DNA, 71 bp, Mus musculus
tatagagtagtgttcactgtcatttttatatgttttagaacatataaaagagacacactcctgtctttata

SEQ ID NO: 59288 - DNA, 111 bp, Mus musculus
tataagtcttgccttggtcatggtgtcttttcacagcagtaaaaccctaactaagagagtttcactgtctctgttaattttctgttgcaaatagccctggggctagttata

SEQ ID NO: 59289 - DNA, 123 bp, Mus musculus
atatatatatatatacatatatatatatatgtgtgtgtatatatatatgtgtgtgtttcatatatatatatatatatatatatatatatacacatacatacatatatatatgtttcatatata

SEQ ID NO: 59290 - DNA, 161 bp, Mus musculus
atatatagtaatttctttgtttatacatacatacacacacatatatataagagattactacatactttatatatatgtaattatatatgtgtgtgtgtatatatatatatatatatatatatatatgtgtgtgtgtgtgtgtgtgtgtgtgtgtgtgtata

SEQ ID NO: 59291 - DNA, 84 bp, Mus musculus
cttcagtctcagaattgactgaggtcactctgcagcatcgtctaattgtcacctttcttttcagtccttgttcctgcgctggag

SEQ ID NO: 59292 - DNA, 70 bp, Mus musculus
caggctcagtctgtgagtatctccatctgtattagtcaggtgctggtagaacctcttaggaaacagcctg

SEQ ID NO: 59293 - DNA, 86 bp, Mus musculus
ggcatccatgtatgactcactacagaaggttctcaagctaggatcaatacaatagtaagagatcagtctgtgctcaggtggatgcc

SEQ ID NO: 59294 - DNA, 112 bp, Mus musculus
ttggttttattttatttagtgggtgtggcctttttggagtaggtgtgtcactgtgagtgtgtgctttaagaccctcatcctaactacctgtaagtcagtaccctgctaccag

SEQ ID NO: 59295 - DNA, 106 bp, Mus musculus
gctttagtccatggttatctgatagtatgcatgggacaatttcaatatttttgtatatgttgaggcttgttttgtgaccaattatgtggtcaattttggagaaggt

SEQ ID NO: 59296 - DNA, 120 bp, Mus musculus
ggagggatatatatatatatatatatatatatatatatatatatatatatgtatgtatatacacacacacatatctatctatctatatctatatctatatctatatctatatctacatct

SEQ ID NO: 59297 - DNA, 59 bp, Mus musculus
gcatctgtctttgtatttgtcaggctctggaagagcctctcaggaaaaagtcagcaagc

SEQ ID NO: 59298 - DNA, 115 bp, Mus musculus
ttgctctctctctcttgagtaggtgtacgtgtgcatgtgtgtgtgcttgtgcatgtgtgcaggtatatgttcatgcacacacaccagcaagctcatgggtatacatagagtgtag

SEQ ID NO: 59299 - DNA, 72 bp, Mus musculus
agccgcttatgtgacagaggatgatctttttggacatcagtaagaggaacagcccttggtcctgtggtggct

SEQ ID NO: 59300 - DNA, 80 bp, Mus musculus
tccttcacctggatgtgttttcctgtgatgctttaagggatttttgtgtttcctctttaagtgcatctccatgttaaggg

SEQ ID NO: 59301 - DNA, 69 bp, Mus musculus
tgttaacttgagaggtcaagggacctgtagggggtcttacatgtgtcttctgatattgttcttgtgaca

SEQ ID NO: 59302 - DNA, 178 bp, Mus musculus
tctttgccattattaaactatatgtatatatgtatatgtgtgaatgtatttatgcatgcatgtatgtatgtatgtatgtatgtatgtatgtatgtattgaccccattgaccaaagcagtactcatttccagcaaatgtgtcttgaaataagtctctgtttctctgtggttcatgggtc

SEQ ID NO: 59303 - DNA, 68 bp, Mus musculus
acatacattctgcgtgtgtgtgcacattctgtggtagctgagctttgtgtgtgtatgtgtctgtgtgt

SEQ ID NO: 59304 - DNA, 83 bp, Mus musculus
tatttggtgattatgtagttgaaataactctaaaagcattgtcttcttggagttaagttatgccaagtaatatggaccaagta

SEQ ID NO: 59305 - DNA, 129 bp, Mus musculus
tgtctttcaaactgcaccaggcatgctggtccctgttacacaaagtatattggccacagtagtgattttgttcctcacctgtgccctgctgtagtctgtcttcaattctccattgcattagccatttgc

SEQ ID NO: 59306 - DNA, 114 bp, Mus musculus
gttttcaattttgtaagttgatttcttatcctacaatactagtgaaattgttgaagctttcagcaagatttttgttagaatttttggagtctcttacatatatcatttgaaaat

SEQ ID NO: 59307 - DNA, 70 bp, Mus musculus
gccttagagtgtcactagatagaaaagggtgatctcacctgagtcccactgtcagacacttcctggaggc

SEQ ID NO: 59308 - DNA, 86 bp, Mus musculus
agatatacacagacacacaaaaacacagacatagacacacacatctatctatctatctacctgtctgtctgtctgtctgtctatct

SEQ ID NO: 59309 - DNA, 69 bp, Mus musculus
tatttcctgacatagattttacacattcatctcggtatgcgtatgtgagtgtgtgtgtgtcagtgagtg

SEQ ID NO: 59310 - DNA, 84 bp, Mus musculus
tatatatatatatatatatacacacacatatacatatatatatacatatacatatatgtgtgtgtatatatatatatatatata

SEQ ID NO: 59311 - DNA, 99 bp, Mus musculus
gaaaatgtgaatcaaatttgaactcactggaaaagctgtgaaattagggtgtatcacatctgtttttcttgctgccttggaattgttctgaatcacttc

SEQ ID NO: 59312 - DNA, 102 bp, Mus musculus
gaaatattcttgagggagctggagagatagctcaatggttaagagcactgactgctcttccagaggtcctgagttcaattcccagcaaccacatggtggctc

SEQ ID NO: 59313 - DNA, 172 bp, Mus musculus
tatatgtatgtatgtatgtatatatgtgtgtgtagggtatatatatatatatatatatatatatatatatatatatacatacatacataaatatacatacagacacacacacacacatatatatatatggacacatatgtgtgtgtgtgtgtgtgtgtgtgtgtgtgtgtgt

SEQ ID NO: 59314 - DNA, 101 bp, Mus musculus
ggctgatgacttgatagatgatagctaattaagggactcatttcatgagaagactcattctctctctaactgtagctgctaattacctatggagatcagtt

SEQ ID NO: 59315 - DNA, 63 bp, Mus musculus
tagtatcagtggatgctgagtgagtgtgtcacacactctttcatgcactcctcctcggtattg

SEQ ID NO: 59316 - DNA, 85 bp, Mus musculus; identical to SEQ ID NO: 57470

SEQ ID NO: 59317 - DNA, 85 bp, Mus musculus; identical to SEQ ID NO: 57470

SEQ ID NO: 59318 - DNA, 85 bp, Mus musculus; identical to SEQ ID NO: 57439

SEQ ID NO: 59319 - DNA, 110 bp, Mus musculus
gccttagtccatggtgatctgataggatgcatgggacaatttcaatatttttgtatatgttgaggcttgttttgcggtcagttttggagaaggtaccatgaggtgctaag

SEQ ID NO: 59320 - DNA, 85 bp, Mus musculus; identical to SEQ ID NO: 57439

SEQ ID NO: 59321 - DNA, 119 bp, Mus musculus
ggattgctggagaaaagggacactcctaccagccaagtaggtttcaggattttttatatatttcatgcatctaaaatttctgctctgagcttcaggaatgcagctttttttgggtctcc

SEQ ID NO: 59322 - DNA, 92 bp, Mus musculus
tatatatatatatatatatatatatatatacatacatacatacatatatatatgtatgtatgtatatgtatatattcatattcatatacatg

SEQ ID NO: 59323 - DNA, 75 bp, Mus musculus
tatgtgtatgcatcttctgtgagtcccttatgtgtgtgtgtgtatatatatatatatgacacttgtatggacatg

SEQ ID NO: 59324 - DNA, 101 bp, Mus musculus
tatctatatctatctctgttgttatttatagctatattatctgtatctatatataaatatagaaagttagagagagatgtgtgtggatgtggatgtagatg

SEQ ID NO: 59325 - DNA, 96 bp, Mus musculus
gatcagccatagtccatggtgatctgataggatgcatgggacaatttcaatatttttgtttctgttgaggcctgttttgtgaccaattatatgatc

SEQ ID NO: 59326 - DNA, 85 bp, Mus musculus; identical to SEQ ID NO: 57439

SEQ ID NO: 59327 - DNA, 79 bp, Mus musculus
gagcttggtcagttgaattagagggcttggttttcctgctgtcctccatcccctctggctctcacactgtttctagctc

SEQ ID NO: 59328 - DNA, 74 bp, Mus musculus
gcaaggttgttgattgtagtgtctctgccttctgcctaaggacagacaagccagtgagctcattcacatgttgc

SEQ ID NO: 59329 - DNA, 85 bp, Mus musculus; identical to SEQ ID NO: 57439

SEQ ID NO: 59330 - DNA, 112 bp, Mus musculus
gatcagtcttaggccatggtggtctgataggatacatgggacaatttcaatatttttgtatctgttgaggcctgttttgtgaccaattatattgtcaattttggagaaggtc

SEQ ID NO: 59331 - DNA, 82 bp, Mus musculus
gggcatcctgagctctccagtatagttaccttgttgcctagacaggcagactctgacactctggggtaactgccattgctca

SEQ ID NO: 59332 - DNA, 87 bp, Mus musculus
tatgtatgcatatgcatatatgtgtatactatgtatatatatgtgtatactatgtatactatgtatatgcatacataaagtgtatac

SEQ ID NO: 59333 - DNA, 77 bp, Mus musculus
tatgtatgcatatacatagtatacatagtatacacatatatatacatagtatacacatatatgcatatgcatacata

SEQ ID NO: 59334 - DNA, 78 bp, Mus musculus
tcatgcagaaaatgtatatatatatcattttgtaacacttatgtaaataaattgcatatgtatattcattttacatga

SEQ ID NO: 59335 - DNA, 96 bp, Mus musculus
gatcagccttagtccatggtgatctgataggatgtatgggataatttcaatatttttgtatctcttgaggcctgttttatgaccaattatatgatc

SEQ ID NO: 59336 - DNA, 85 bp, Mus musculus
gtagtgactctctttcacactgatattggagattgggtctcacaatgtgtctatactctccaaatctgaaacttgaggaagctac

SEQ ID NO: 59337 - DNA, 95 bp, Mus musculus
atcttctccatgtattgtctttttggtctgaattttaaatgacagtgataactgtttgaatttatttttgaagagaatggcctggactccagggt

SEQ ID NO: 59338 - DNA, 114 bp, Mus musculus
agctcttaaagatgataggaccaagttggttgtgattctgggacaagggagagagaactgacagtgcaactccgtctcaggtcgtgaaggacctaaagtcctacagatgaggct

SEQ ID NO: 59339 - DNA, 96 bp, Mus musculus
ctgatgtctcttagatccttcaacagttctctttttgttcttatcacaggaaatggcaaagtgaaagaactggataatctaagtatcttgagttag

SEQ ID NO: 59340 - DNA, 92 bp, Mus musculus
gctttgctctctctgcaacagaatctcttattataccagtgaccgtatccaagacttatttgagagaccacactgtgaacaggttgccaagc

SEQ ID NO: 59341 - DNA, 116 bp, Mus musculus
tagtttgcctgtactcttatgtaagcaccagccagctctggggctcactctcagactctgtatcaaaggccttaagctagattggggtttccaaaatgtcttttcaggaaatacta

SEQ ID NO: 59342 - DNA, 116 bp, Mus musculus
gccttagtgcatggtgatctgataggatgcatgggacaatttcaatatttttgtatctgttgaggcctgttttgtgacctattatgtggtcaattttagagaaggtaccatgaggt

SEQ ID NO: 59343 - DNA, 97 bp, Mus musculus
aacagggctttctccacacttggtactgggttgttttgtttgggaacctatgtttcctgagaggaacattatccctccatgtaggaaaaccctagtt

SEQ ID NO: 59344 - DNA, 65 bp, Mus musculus
aaggccaggagctcactgggcccaatgagttgtctatctcagtcacagtgtggttacatgggttt

SEQ ID NO: 59345 - DNA, 116 bp, Mus musculus
gtacattttaaccagaaatatatatgtatgtgtgtgtgtgtatatatatatatatatatgtatatatatatatatgtgtgtgtgtgtgtgtgtgtgtatgcatacccacacataca

SEQ ID NO: 59346 - DNA, 106 bp, Mus musculus
gccttagtgcatggtgatctgataggatgtataggacaatttcaatatttttgaatctattgaggcctgttttgtgacctattatgtggtcaattttggagaaggt

SEQ ID NO: 59347 - DNA, 93 bp, Mus musculus
tccatggtggtatgataggatgcacgggacaatttcaatatttttgtatctgttgaggcctgttttgtgacccattatatggtcaattttgga

SEQ ID NO: 59348 - DNA, 97 bp, Mus musculus
gtctgtctttgactttctctctctttctctgtatttctatctctctgttgagcattgggctatacacagatgggctggtttccagtcaaggctagat

SEQ ID NO: 59349 - DNA, 111 bp, Mus musculus
cacttctattgttgattgatattgaatagggctggagagatggctcagtggttaagagcactgactgctcttccaggggtcctgaattcaattcccagcagccacatggtg

SEQ ID NO: 59350 - DNA, 94 bp, Mus musculus
tgtatccaaatcttcaaaaagctactacatgcatatatgtatgtatatatgcatgcatgtatttagggtgtgttggcgatggggaccatatgca

SEQ ID NO: 59351 - DNA, 85 bp, Mus musculus
gtccatagtggtctgataggatgcatgggacaatttcaatatttttgtatatgttgaggcctgttttgtgaccaattatatggtc

SEQ ID NO: 59352 - DNA, 111 bp, Mus musculus
tctatgatgagatgtatttttgtttgttatttcattttcatttttcattttcttttgggggaaggtagcagggatggagggttgatatgaaggaatggggagatgagtgga

SEQ ID NO: 59353 - DNA, 76 bp, Mus musculus
ccctgaccttcctgcactttgaggacatttctagagtcaagaatctgagcagtgagcagccagggagaggttgggg

SEQ ID NO: 59354 - DNA, 73 bp, Mus musculus
tcactctgtctctctttctgcatatgcaaattgggtgctcaaaggtcatgctgtgcatgtagagatcagagga

SEQ ID NO: 59355 - DNA, 72 bp, Mus musculus
ttataaacaatgtttctgtgtgtctctctgctttcctaaagagcagagagaccagagttgctttgtttctaa

SEQ ID NO: 59356 - DNA, 63 bp, Mus musculus
atcacaggaacgaagggaagtggtgcagcatggctaacacacttgtctctgtcactctgtggt

SEQ ID NO: 59357 - DNA, 64 bp, Mus musculus
gtatgtgtgtgtatgtatgtatgtatatgtgtatatatatgtatatacatatacctacacatat

SEQ ID NO: 59358 - DNA, 102 bp, Mus musculus
agacagagacacagagagacagagagagagggagaaagagagagagagagagaggttgggggcttgggctcccgctatgtgtgtctctcagtgactcagtct

SEQ ID NO: 59359 - DNA, 91 bp, Mus musculus
gtatatatatatacatatacatatatatgcatatatatatatacacatatatatatgcatatatatatatgcatatgtatgtatatatatg

SEQ ID NO: 59360 - DNA, 102 bp, Mus musculus
cattttatatgtgtatgtgaatgtgtgtgtgtatgtgtatatgtatatatacatacatatgtgtgtgtgtgtatacatgcatatgtgtgtgtgtgtgtgtgt

SEQ ID NO: 59361 - DNA, 76 bp, Mus musculus
ttgaaggattgagctgtctgaaatgacaggcagcagtgtgacaagtgctgccctggtcacaggaagcttacttgaa

SEQ ID NO: 59362 - DNA, 110 bp, Mus musculus
ttatctgatcctgtttagctttggtatttggtatctgtctggaaaattatccattttattcagattttcaagttgtgttgagtagaggcttttgtagaaggatctgatga

SEQ ID NO: 59363 - DNA, 116 bp, Mus musculus
ctttcttaagtgattactatggggctaataatttagacttaattatgtgtactgcattttaattgtatatgtttcatttagagtttgggctatgggtgttgtcagtggatagaaag

SEQ ID NO: 59364 - DNA, 83 bp, Mus musculus
tatatgtatatacatatgatatgtgtatatatatacatatatgtgtgtatatatacatatatatatgtatattgagtatacat

SEQ ID NO: 59365 - DNA, 65 bp, Mus musculus
acataaacacatgacagtgtgcagaccattcaccctggtctgtccacaagtgacaagtgctgtgt

SEQ ID NO: 59366 - DNA, 85 bp, Mus musculus; identical to SEQ ID NO: 57470

SEQ ID NO: 59367 - DNA, 105 bp, Mus musculus
cagtgccaaagcaccttttaggatgtgcaagttttgatattatcattttcaatatctatctgaagattgcttaaattccaaagaatgcattggcttatgaaactg

SEQ ID NO: 59368 - DNA, 85 bp, Mus musculus; identical to SEQ ID NO: 57470

SEQ ID NO: 59369 - DNA, 77 bp, Mus musculus
cttctgtgagtttcactgtgtctctgtttagtttctgtttccaggatctgtccactggtgagagtgggatgttgaag

SEQ ID NO: 59370 - DNA, 75 bp, Mus musculus
acacactctctttctatatatatatacatacatatatacatatatgtacatatgtatatatatatgagtgtgtgt

SEQ ID NO: 59371 - DNA, 113 bp, Mus musculus
agaaatgactgactgactgactaactgactgactgactgactgactgactgactgagagacaaacagacagacagacagacaggcatagatgtggtcgggtatattggtttct

SEQ ID NO: 59372 - DNA, 94 bp, Mus musculus
gagatgagaccttatagaagttactgactaaattacatgtgttataatcaatgcaaactattcatgtttgtagctatatacatggacttttctc

SEQ ID NO: 59373 - DNA, 112 bp, Mus musculus
gatcagtcttaggccatggtggtctgataggatacatgggacaatttcaatatttttgtatctattgaggcctgttttgtgaccaattgtatggtcaattttggagaaggtc

SEQ ID NO: 59374 - DNA, 107 bp, Mus musculus
tgctaaagattataaacaaacataacagatgtgagagaccaaactgtgggatcccacagtttctctcacacagttacttgtatattcatatatttgtctttattgca

SEQ ID NO: 59375 - DNA, 76 bp, Mus musculus
tgttccttggagtggccctctagatttaagagtcagtgtcttagagtctctgtctgaaagtcactcctcctgtgca

SEQ ID NO: 59376 - DNA, 85 bp, Mus musculus
ggccatggtggtctgataggatacatgtgacaatttcaatatttttgtatctgttgaggcctgttttgtgaccaattatatggtc

SEQ ID NO: 59377 - DNA, 100 bp, Mus musculus
ctctggagaaccaaagtcagatcacacagtgcagagagggataatttaaaagtctgtttaaagcttaccagcacagtgtaaagacttggtttgaatagag

SEQ ID NO: 59378 - DNA, 123 bp, Mus musculus
atatgtttatatgtaaatatttatatatctagatatctgtatctatccatatatatcattttgtatatgtgtatatgcttatatgctcatatgtaaatctttatatatctagatatctatatc

SEQ ID NO: 59379 - DNA, 75 bp, Mus musculus
cttacagatgacagatcagagagaagtgggctgtactcaggtcattccactcagaaactgctctctttctgtgag

SEQ ID NO: 59380 - DNA, 123 bp, Mus musculus
actttgagagattttacccatgctaatgtaaaatatgtctgctatgcttctagtatttttaaattttcaagctcttatagtaagacttagaaatcattagaggtgacgtttgtacatgtaaga

SEQ ID NO: 59381 - DNA, 67 bp, Mus musculus
ctggaatcagactctggctctcagtcaccacaaatgctgctgggtacctcagaagagctggttctgg

SEQ ID NO: 59382 - DNA, 71 bp, Mus musculus
ggatagagagatgactcagtggttaagagcactcactgactgctcttccagaggtcctgagttcattatcc

SEQ ID NO: 59383 - DNA, 69 bp, Mus musculus
ccagtgacaacatagggagcaacatatagagggcagtacctcttatctgtctctgtaacttgtcagtgg

SEQ ID NO: 59384 - DNA, 109 bp, Mus musculus
ttgaagatcagccttagtccatggtggtctgaaaggatgcatgggacaatttcaatatttttgtatctcttgaggcctgttttttttaccgtatatggttgattttgga

SEQ ID NO: 59385 - DNA, 79 bp, Mus musculus
atttctgttagtttcactgtgtctctgtttagtttctgtttccaggatctgtccattgatgagagtgggatgttgaagt

SEQ ID NO: 59386 - DNA, 65 bp, Mus musculus
gctggctcagtgtgatgaatagttggctgtgagtatctgtcagcctgtgtgtatctcctgtcagc

SEQ ID NO: 59387 - DNA, 85 bp, Mus musculus; identical to SEQ ID NO: 57439

SEQ ID NO: 59388 - DNA, 85 bp, Mus musculus; identical to SEQ ID NO: 57470

SEQ ID NO: 59389 - DNA, 76 bp, Mus musculus
gcagaagaagagactgatttgtgtgaaggcagtgagctgagaaattcatttcttgtctgcatgtcacttcatctgc

SEQ ID NO: 59390 - DNA, 106 bp, Mus musculus
gccttagtccatggtgatctgataggatacatgggacaatttcaatatttttgtatctgctgaggtctcttttgtgaccaatcatattgtaaattttggagaaggt

SEQ ID NO: 59391 - DNA, 101 bp, Mus musculus
atatatatgtgtgtgtatatgtatatataaatacacatgtatatgtatatatacatacacatatatatgtatatatatacatacatatatatgcacacata

SEQ ID NO: 59392 - DNA, 119 bp, Mus musculus
gaagagttagaggactgatagatattgaaacatccctgacttccccacagtctctctctccatggttcccaccatcttgacactttaggaagcaggagatggagcagccactaatcatc

SEQ ID NO: 59393 - DNA, 117 bp, Mus musculus
gttaaaaggggaaggagtctatttaaacatgctgcggcagtggtgcgagaagtcacagagctcaaattctgactcgctgttttgcaagaagtctatatacattttttattttttaat

SEQ ID NO: 59394 - DNA, 117 bp, Mus musculus
atgtgaaagcattttgctgttttaaatgctattgtggatggtattctttatttcttattcagatctccctgttattatgtataaatagcattgatatttataagttgatttttatat

SEQ ID NO: 59395 - DNA, 86 bp, Mus musculus
gactagtccatcataaaacctgatagccactgtcacacacaacagtgttagcagatcttagtgggggcaatactcaacgcatagtc

SEQ ID NO: 59396 - DNA, 85 bp, Mus musculus; identical to SEQ ID NO: 57470

SEQ ID NO: 59397 - DNA, 74 bp, Mus musculus
tgtgtatatttatatgtctatttgcatacatgcctatgcatgtgtggatgtgtgtgtgtgtttgtgtgtgcgca

SEQ ID NO: 59398 - DNA, 78 bp, Mus musculus
aacccttggtcagagatactatattagcaatgcccaggtctgacttcagtccatagcaatgtactctgtttcctggtt

SEQ ID NO: 59399 - DNA, 115 bp, Mus musculus
tccctgacctcagtccatttgttgtctgtaagtatctgcatctgtctcagccactaattttttttttaaagctaaacaacaagcagaatagggaaagaaagaactgagtgtggga

SEQ ID NO: 59400 - DNA, 103 bp, Mus musculus
gttttaggatgaaatgttttgtatatacatatatatatatatatatatatatatatatatatatatatatatatatatatatatattccatttggtccttaac

SEQ ID NO: 59401 - DNA, 117 bp, Mus musculus
gacagtgaagtaactcctgtaatagttctgagcgggatcattgcatagtcgttactgacagcctctgatcagcagcttgcaaggttccaagcactgtttgagtctatgcctattgtt

SEQ ID NO: 59402 - DNA, 103 bp, Mus musculus
gaggtatatttaggcagttctctgtagttggcagtgacaaatgagcatagcttagggttattttcatatttattgatccattctaaaaagaccaatatagttc

SEQ ID NO: 59403 - DNA, 90 bp, Mus musculus
gccttagactgtggtgatcagataggatgtgtgggataatttcaatatttttgtatctgtggaggcctgttttgtaaccaattatatggc

SEQ ID NO: 59404 - DNA, 85 bp, Mus musculus; identical to SEQ ID NO: 57439

SEQ ID NO: 59405 - DNA, 85 bp, Mus musculus; identical to SEQ ID NO: 57439

SEQ ID NO: 59406 - DNA, 91 bp, Mus musculus
tggtaggagaggtagttctttaggtcaggaatgaaagagtgggtcatatggtagctcaatttttaatttttcaaggattttttttctatca

SEQ ID NO: 59407 - DNA, 92 bp, Mus musculus
gtaggcgctttgggagtagttaaagctcgtttggtaggtttactctgcctgtttgtctgcctgcctgcctgcctgcctgcctgcctgcctac

SEQ ID NO: 59408 - DNA, 111 bp, Mus musculus
taagtagtgcctttgttttactctagaatgttttctgaacatccttctctctgtgccaagtgatgtgaaaagggtaggaaagaactaacagagaatgcaggcttggactta

SEQ ID NO: 59409 - DNA, 83 bp, Mus musculus
tcagatgggccgggtgcacagtagtgactgtgcagagagcgtgcctgctcttcactgcccccttggcacctgacttgctttga

SEQ ID NO: 59410 - DNA, 92 bp, Mus musculus
agcacacatcagccagagacaggactaggacaggattcctgccctctgcagaagtgtccctctcttcctctgtcactcaggctgctcctgct

SEQ ID NO: 59411 - DNA, 85 bp, Mus musculus
gctcgctcgctcgctctctcgctcattcagcccgtgggtaaagaacgctcccctttgtgatgagaggtgcacacagcggaggagc

SEQ ID NO: 59412 - DNA, 77 bp, Mus musculus
gtctgtctgtctgtctgtctgtcctccttggctgcatttagtagagcagccacggcagagatggccctccggcagtc

SEQ ID NO: 59413 - DNA, 100 bp, Mus musculus
ggagagcttatggtacagcctactgtgcttgaatgctgtgttgatgggagaggctctttaagacacatgtgagagagcacacggggctctgcagtcatcc

SEQ ID NO: 59414 - DNA, 61 bp, Mus musculus
cagaccttctcctacagagtgtcagcctttagctccctcagacactcagtgggaaccgctg

SEQ ID NO: 59415 - DNA, 103 bp, Mus musculus
tggttacttgagcaactattctagcacagaggaatgagagagctcagaggataaattctctcgtcaccaagccctgtgatctgaggttgattccccagagcca

SEQ ID NO: 59416 - DNA, 118 bp, Mus musculus
ttgttgaagatgctgtctcttctctagggtgggttttttttttttttggttttggtttttttttttttttttttttttttgactctttgtgagaactcagacagcagtatttccatgg

SEQ ID NO: 59417 - DNA, 81 bp, Mus musculus
ggtctgtctgtctgtctccttgctgtcctgtcttctgtctgttatattcattagccgagggagcgagactttttgaagacc

SEQ ID NO: 59418 - DNA, 75 bp, Mus musculus
acagcgaaagaaaggcatgtgtgacaggcagctcttgctgcagagctgccactctgcctgtctcttaggagctgt

SEQ ID NO: 59419 - DNA, 63 bp, Mus musculus
ggttatgggagcagagggaagagaatctggcgaaccgtagtctctgtctctgtgtccgtcgtc

SEQ ID NO: 59420 - DNA, 129 bp, Mus musculus
ttcgttagcccttttcttcagggtagggttgtgttctgaaaaacctactcatcagacagaaggcagtgagtacaccgtccctgacactgtaagagtggaagacgaatgaatcacagttgacttaataga

SEQ ID NO: 59421 - DNA, 76 bp, Mus musculus
tgtcacagaaaggttttgtagagaaacgtgtagatatctgtgtccctctctcacatgtagtgataattctgtgaca

SEQ ID NO: 59422 - DNA, 80 bp, Mus musculus
ccatacacctggctgccactctgtcacactttgctctgcttagcatagcaacagtggcaaggtataagaccagcatctgg

SEQ ID NO: 59423 - DNA, 76 bp, Mus musculus
gattacagtgacctggggctagagagatggctcagcggctaagaacactgactgctcttccagaggtcctgagttc

SEQ ID NO: 59424 - DNA, 66 bp, Mus musculus
tcggggcacaggtctgtgtgtctgtgggacggtctccacgtctgagcacacagactggatttctga

SEQ ID NO: 59425 - DNA, 96 bp, Mus musculus
tcgccagcatgtgctatcacttgagtttttgatcttaacatcttactagtgtaaaatggaatcttggagttgttttgatttgcatttgcctgatga

SEQ ID NO: 59426 - DNA, 102 bp, Mus musculus
acttgcttgttagatgataacaaatcaaggtaagaaagggttccaggctttttctgtgacctggcttctttcatgtgttaatcttcattctgcttcttaagt

SEQ ID NO: 59427 - DNA, 65 bp, Mus musculus
agtgtgtgcatgcctgcatgcatgcaggcttgtgtgtgtctgtctgcctgtctgtctgcctgtct

SEQ ID NO: 59428 - DNA, 61 bp, Mus musculus
gggaggcaagtgtggctcatccatactcctgggtgcttggctgaggcactctctgcctgtc

SEQ ID NO: 59429 - DNA, 129 bp, Mus musculus
catgtatgtgtatatggtgtatatatgtctgtatatgtatatatatgatgtataagtgcatgtgcatatgtatatgatgtatctgtgtctgtatatgtatatgaaacacatgtatttgtgtatgtgtat

SEQ ID NO: 59430 - DNA, 95 bp, Mus musculus
gtctttgctagaggtcaggggctggagagatggctcagcagttaagagcgctgactgctcttccagaggtcctgagttcaaatcccagcaaccac

SEQ ID NO: 59431 - DNA, 61 bp, Mus musculus; identical to SEQ ID NO: 59428

SEQ ID NO: 59432 - DNA, 192 bp, Mus musculus
atgtgcgtgtatgtatgtgtatgtgctatatgtacatatatatacatatactgtgtgtgtatatgtatgtgctgtatgtatgtatgcatgcatatatatatatacacacacatatatatgtgtatgtgtgtgtatatctctgtgtgcatgcatatatgtatgtatgtgtgtatgtatatgtatatatatatg

SEQ ID NO: 59433 - DNA, 105 bp, Mus musculus
ttgtgtgtgtgtgcatgctcatgcatgtatgtttgtgtgcatgtgcatgcctgtgtgtgtgtgtgtgtgtgtgtgtgtgtgtgtgtgtgtgtgtgttaattgcag

SEQ ID NO: 59434 - DNA, 104 bp, Mus musculus
gtgtgtgtgtgtgtgtgtgtgcattctgtgtgtatgctgtatgtctgtgtttctgtgtcagtatatgtgtgtgtgtgtttgtgtatgtgtgtgtgtgtgtacac

SEQ ID NO: 59435 - DNA, 74 bp, Mus musculus
cctgcctgcctgcctgcttcactgaacaaaggcctcctgccattcctaaagctagaagtgggaacaggggaagg

SEQ ID NO: 59436 - DNA, 66 bp, Mus musculus
acttgtctgtctgtctgtgtgggagtatgtatacacggtgcaggttcccatggaggccagagatgt

SEQ ID NO: 59437 - DNA, 93 bp, Mus musculus
tgactttatcaaacatgtttggtcatagataaaagttgtgctctggtctaccactgttctgtttctgtgacatatgcacatcacatgagttca

SEQ ID NO: 59438 - DNA, 110 bp, Mus musculus
ttgaagatcagccttagtgcatggtgatctgataggatgcatgggacaatttcaatatttttgtatatgttgcggcttgttttgtcaccaattttgtggtcaattttgga

SEQ ID NO: 59439 - DNA, 113 bp, Mus musculus
tgttgaatgtaggcacacagttccttccattcctgcacttgtaactttttgagagaaaatagtttgaaaacagtcaatgcaaaggaaagaagggacgtgagttagaatggata

SEQ ID NO: 59440 - DNA, 86 bp, Mus musculus
cctgcatatcatatatttatattgtaattcatagcagtatcaaaattacagttatgaagtagctgcaaaataattttatggttggg

SEQ ID NO: 59441 - DNA, 117 bp, Mus musculus
gtttggttgtgttttcctgtttttctttaaggacttgtaactctttagcagtgttctgtatttctttaagtgagttattaaagtccttcttgaggtactctaccatcatcatgagat

SEQ ID NO: 59442 - DNA, 90 bp, Mus musculus
gctccactgtcacttccactggagagcaaaggcacttctaccatatctcagccttatggccttttttctctgtgtgtgagcacacctggc

SEQ ID NO: 59443 - DNA, 103 bp, Mus musculus
caggacgtggtgctatactgaaaagatcggaaggatttagagctctctctctctcttcctctccttctctctctctctgtatgtctgtctgtctatctgcctg

SEQ ID NO: 59444 - DNA, 111 bp, Mus musculus
gtgtacagtcaagagtatgtgtgtatatatatatgtgtgtgtattatatatatagacacatatatatacatatatacatatacatatatacacacatatacacacacacac

SEQ ID NO: 59445 - DNA, 76 bp, Mus musculus
gtgtgaaaatgtttgtgtgcatgtgtatgtagttatgcatgtgattatatatggttgtgtatgtgcatgtgtacat

SEQ ID NO: 59446 - DNA, 115 bp, Mus musculus
tctgcatgcatacatacctgcacttgataatgcacattaatgcgcacgcacacacacacacatattcttcatgcaccttaatgtgtacatgcatgcacttatacatgcatataga

SEQ ID NO: 59447 - DNA, 107 bp, Mus musculus
tggaggtagtctcattttgtagcccaggctagcctaaaacccactctttctgtgtctgtctcctgagttccagggttgcggctatgtgctaccatgacaggctttca

SEQ ID NO: 59448 - DNA, 78 bp, Mus musculus
acactggacttgccaaggatagcaaacacctgcattctgggccctgaacaggtaggtgttctatctgtctctctgtgt

SEQ ID NO: 59449 - DNA, 75 bp, Mus musculus
ggaggttgacctgagctcaggactgtgttattgagaacttgatagtgacacagcctctgcctcagtgtctgccct

SEQ ID NO: 59450 - DNA, 77 bp, Mus musculus
gacacagtcacatgctatgtaatgccatggctctgctcatttgcagtctctgtgagtcactgcaggcattttgtgtt

SEQ ID NO: 59451 - DNA, 116 bp, Mus musculus
aaccacagctggacccccaaatgcatacttcgtatgttctaacagtgtgttacatgcttgtatccttacccctgttcagagcatttaagaaatatttatttttctttatgtgtgtt

SEQ ID NO: 59452 - DNA, 103 bp, Mus musculus
atgtgtgtgatttaccccataagtgcatatattactgatatatatatatataaaactgtcagctgaatatatgtatttgttggagggggtaacctgtacagat

SEQ ID NO: 59453 - DNA, 66 bp, Mus musculus
cctgagtccaaacacagaggagttaagatctcaaactgagactcactcactctgagaaaactcagg

SEQ ID NO: 59454 - DNA, 71 bp, Mus musculus
cctttaatctagatcttgaggtgggaagacacactgtgtcacaccttctgctggaaggacatggaagaagg

SEQ ID NO: 59455 - DNA, 98 bp, Mus musculus
agtctccttcaagaagggcgctctgattctgtgtctctcaggaacacactctaggcagagggaggagctagtgtggcattctatgtagggagttgact

SEQ ID NO: 59456 - DNA, 69 bp, Mus musculus
cagcaaagtggaacaatgtctgctgtttgtctcagacactctcagatgttgttctcggcacttgggttg

SEQ ID NO: 59457 - DNA, 94 bp, Mus musculus
agggaagggagcttgtgtgcctaaggaggcaggccaggcctatgactgcatagtagcctcgtctctctgtctccctcactgtctccctgtctct

SEQ ID NO: 59458 - DNA, 73 bp, Mus musculus
ggtgtttttgcctctgtgtatgtcagtgaatcatgtggatgcctggtatctgtgcaggccagaaaaagacact

SEQ ID NO: 59459 - DNA, 67 bp, Mus musculus
cacacaaactcacaattagagaacagtgtgtgcacacgcgtgtgcacatgtgcttgtgtattgtgtg

SEQ ID NO: 59460 - DNA, 64 bp, Mus musculus
catgcatttatgtatatgtatatgtgtaatgtattatgcacatatgcatatatgcatgcttgca

SEQ ID NO: 59461 - DNA, 89 bp, Mus musculus
gccccgaggtggaacagtcagagagctcagagggaagtgttggggtcctggccctgtattccttttgggctggggcaggtttagggggt

SEQ ID NO: 59462 - DNA, 67 bp, Mus musculus
tgtgtgtgtgtgtgtgtgtgtacatatacatgtatttgaatatatgtacatactatggaggcccaca

SEQ ID NO: 59463 - DNA, 75 bp, Mus musculus
acttcatgggtaagacaggacacagggaccttgggcatctgtcctctgaggttgtagtttgttctgtccagaagt

SEQ ID NO: 59464 - DNA, 67 bp, Mus musculus
gtgtgtctgtgtgtctgtccattaggtccatccccggagccctgttggatgtggcacatctccatgc

SEQ ID NO: 59465 - DNA, 111 bp, Mus musculus
gggtgtcattcttcatggacccttatactcgaaggctcctggctctgcagaagctctgtgtggctgtgagtatcaggtcctgtaactcctggggtgagagagaaagcgtcc

SEQ ID NO: 59466 - DNA, 72 bp, Mus musculus
ccagcggtcagtgacaggatcttcattgctctccaccttattttctgaggcagagtctctcactgaccctgg

SEQ ID NO: 59467 - DNA, 89 bp, Mus musculus
tttatacttcatattgtatgcagtacatgtatgtgtacatatgtagtttacatgtttgcaaatgcatgcatatgtgggtgaagaataga

SEQ ID NO: 59468 - DNA, 87 bp, Mus musculus
tgaggaggaagagaaagggagagaggatctagatatagagacacaaattaaatgtctgtctctctgtctgactgtttgtctatatca

SEQ ID NO: 59469 - DNA, 85 bp, Mus musculus
caggagccacagaagtgtgagtggccacagggcatgaggcgggtgttggcagtgttgtggaagcagatgacacactcctctcctg

SEQ ID NO: 59470 - DNA, 111 bp, Mus musculus
gaacttggtgtccattcatttctggccacgctatcactctctctgtccctggcaggactttctgggctccgacttctgcagctttagatgaggggacagggtatccttagt

SEQ ID NO: 59471 - DNA, 76 bp, Mus musculus
atagaggaaagaatagagggtggctgctgggccaaggtgacccaaagtgtctgtgcccatctgtctgtctgtctgt

SEQ ID NO: 59472 - DNA, 104 bp, Mus musculus
ctgggaccatcttgtactgtgtatcagggactgacttcctggggaagaaatggaggctcagagatgacagactgcagacagagtaatcagagatgaagtaacag

SEQ ID NO: 59473 - DNA, 107 bp, Mus musculus
gcctctgtctctctccccccagcccccgtgagtgcgtgtgtgcgtgcctgtgtatgcatgtgtatgtatgcgtgccaccatgtgaggtctgggcctagaacttaagc

SEQ ID NO: 59474 - DNA, 70 bp, Mus musculus
gggcctctgtcagtcacgctctgagtacttacttgtcttcagagcagtctctactttagttccctggcct

SEQ ID NO: 59475 - DNA, 66 bp, Mus musculus
acaagtgtatatatacatgtgtatgtatgtatatatgtatatacacatgtagatatacatacttgt

SEQ ID NO: 59476 - DNA, 66 bp, Mus musculus
tgggggtggggagacaggtgggcatcaggtagcagtgccagtggctggctcagtctctcatttcca

SEQ ID NO: 59477 - DNA, 58 bp, Mus musculus
ttgttacagcaagaggaagtgaaagaatctatcagtctattttctgttgctgtaacag

SEQ ID NO: 59478 - DNA, 90 bp, Mus musculus
tccgtgttgtcacactttctactccctaacactctgtctgattcaaaggaaagacaaacattaaaagggattgtggtggtttgaatagga

SEQ ID NO: 59479 - DNA, 85 bp, Mus musculus
agggagctgaggcaggtatgaatttgaggccagccagtgctgtatatgaagacgtctgtctgtctgtctgtctgtctctctctct

SEQ ID NO: 59480 - DNA, 127 bp, Mus musculus
gaagctggaggtgagggcgtggtcagagggggcgtgggtggggcatggaggctgatgctgtgtctgtgtgtctgagccatggcaggggtcattcatgagtttcttacagtcagagtctgaagctctt

SEQ ID NO: 59481 - DNA, 74 bp, Mus musculus
atctagctctcagcttgcagcttgtaggtaagcactgagcacacatgcctgcctgcctgcctgcctgcctggat

SEQ ID NO: 59482 - DNA, 116 bp, Mus musculus
cagtttcctcagcctgtcctgactctaatggctttgaagggcgcctcaggcagctcacagaacagtgtgaccctgacaacacagccctccattatggtgtctctgcggtgtgactg

SEQ ID NO: 59483 - DNA, 68 bp, Mus musculus
tgctagtcctgtttgtttccattattggctgctccaaacagaggagtcagagacaacagtgggaggta

SEQ ID NO: 59484 - DNA, 118 bp, Mus musculus
ggtactaatttcagcacactggtggtaactcattcattcattcattcattcactcactcattcactcgttttgaatagtgaccattgtagaaagtgtgtgatgataggctattgtgtt

SEQ ID NO: 59485 - DNA, 59 bp, Mus musculus
caggtggtcaggcccaaccagcatgtgtgtatgtgtctgtctgtctgtctgtctgtctg

SEQ ID NO: 59486 - DNA, 83 bp, Mus musculus
ccctatttctatgtttttaaaagatttattttcacatgtgcactgtgtgtgtgtgtgtaagtatatgtgagaatttaggggta

SEQ ID NO: 59487 - DNA, 93 bp, Mus musculus
tatatatatatatatatatatatatatctctacatatgtgtgtgtgtatatatatatatacacacacgcatacatacatatatagtatatata

SEQ ID NO: 59488 - DNA, 56 bp, Mus musculus
ctatatatgtatgtatgcgtgtgtgtatatatatatatacacacacacatatgtag

SEQ ID NO: 59489 - DNA, 97 bp, Mus musculus
gcaatccatgtgtccattgctggtgggtggatgagcaaaatgtcacacacacacactttattccttcaattaaaactacaagctgggcagtgcgggc

SEQ ID NO: 59490 - DNA, 65 bp, Mus musculus
tatgtgtatatgtgcatgtgcatgggtatgttattcatgcctgtgtctatgtggatgtgaacgtg

SEQ ID NO: 59491 - DNA, 127 bp, Mus musculus
gggcttttgtggctctgtgagagacatgaccctcaaacattagtcacattgcagcctgaggaagaaggttgaagctgggtggcaggatccctgggacagtcttaatgcctcgatcagagcaggcagc

SEQ ID NO: 59492 - DNA, 59 bp, Mus musculus
cctgccactgcctgatgtcagcgctgcaatgctctgtcaatagggcaagccatggcagg

SEQ ID NO: 59493 - DNA, 101 bp, Mus musculus
ccgtggagaggcgggtgtgggtgtctgaggggagaacatttgcacaggctatttggagcttacacactgtgtctctttcaacctgttacctgcctacttgg

SEQ ID NO: 59494 - DNA, 117 bp, Mus musculus
gtccagcagagctgttccagttgtcctgcacccttgccagctctcggagctctctctttatcactgaggctgtttaagtggtggttttaggcctcatagcttcagttcatattgtgc

SEQ ID NO: 59495 - DNA, 108 bp, Mus musculus
gggtggggaggtgcagtgggaatgtgtctgaagggaaagagtaccaagcgtcaaaggcggctcagccactctctcagtatgcagacatgtttatgtaatttttaagtc

SEQ ID NO: 59496 - DNA, 78 bp, Mus musculus
tactgttactactactatgctgtggggcgtgcgtgcgtgcgtgcgtgcgtgcgtgctggagcatgagtttctgcagtg

SEQ ID NO: 59497 - DNA, 99 bp, Mus musculus
gtgtgtgctgtgtatgtgtgtgtgctgtgtatgtgtgtatgcatgtatgtatgtatgtgtgcatgtgtgtgtggtatatatagtacacgtccatgctac

SEQ ID NO: 59498 - DNA, 215 bp, Mus musculus
gacaagtctctttctgggggtgccatgatcttcttgggaggtgccacatctccttcgggaggtgacatgtctctctctgggggtgccatgatcttcttgggaggtgccacatctccctcggaaggtgacatgtctctctctgggggtgccatgatcttcttgggaggtgccacatctccctcgggaggtgacatgtctctctctgggggtgccat

SEQ ID NO: 59499 - DNA, 119 bp, Mus musculus
ggtgccatgatcttcttgggaggtgccacatctccctcgggaggtgacatgtctctctctgggggtgccatgatcctcttgggaggtgccacatctccctcagaaggtaacatgtctct

SEQ ID NO: 59500 - DNA, 82 bp, Mus musculus
ggtgggagctgggatttgaactctggtcttcaggattgtgcagcaagcactgtcagtctctgtgccatgttaaagccccatt

SEQ ID NO: 59501 - DNA, 75 bp, Mus musculus
ggcaggcatctgttagaggcaggctggagtgacatccgttgtcaatgtcactgcctctgttcagtgggtacagcc

SEQ ID NO: 59502 - DNA, 80 bp, Mus musculus
catagcatcaaagccagacagggcagtctgttgtctccctggccgcttctccgtactgactgttctctctgtgcgctgtg

SEQ ID NO: 59503 - DNA, 104 bp, Mus musculus
gcccccatgctgtaccactgaagacacacacaacactgacacaccttgagcctttctctcagactgtctcgctctgtggtcattcttcgtaggtcagtgaaggc

SEQ ID NO: 59504 - DNA, 120 bp, Mus musculus
gtgtgtgtgtatgtgtgtgtgtgtgtgcgcgaggaggtcaaaggacaacttgtatgtatatttatgtgtatgtgtgcttgtacacttgcttgccagggtatatgcttgccacagtgcaca

SEQ ID NO: 59505 - DNA, 80 bp, Mus musculus
attgaatggtgattagccaaccctgggtttatttatctatttagatggaaacttccaggatatgttaatcaattgacaat

SEQ ID NO: 59506 - DNA, 85 bp, Mus musculus
tgctcagtaggtaggtaatgtgtttgcagaatatgaagatctttatttatatatctcaaaaccataaaatgccagatctgcagca

SEQ ID NO: 59507 - DNA, 113 bp, Mus musculus
gttttgtcttggtctcttgcagccaggagaaaataatgtgtcaaggcaggatagctttatcactctgttactgtctcctagctttgttttatggcaacatggccaagaagaac

SEQ ID NO: 59508 - DNA, 78 bp, Mus musculus
tccaggctcacgctctgtctgagttcctgcctgacttcccttcatggcgagctgtgatggagacatgtaagccgtgga

SEQ ID NO: 59509 - DNA, 74 bp, Mus musculus
gacgacagtgtccagagtgtgccgtccctagatctggcagttgctttgcagactcagacacactcactgttgtc

SEQ ID NO: 59510 - DNA, 105 bp, Mus musculus
acttgtgctcaccaagtgcttgctgttttagtcttgccccggttagttctgctgtcagtctgtctgtgggcatttcattcagccagtgctcctggtccaccaagt

SEQ ID NO: 59511 - DNA, 78 bp, Mus musculus
aagactttagtgtcagtctgtctgtcttctctgatggttgatttggagaaattctgtttaagactagacaatcgtctt

SEQ ID NO: 59512 - DNA, 116 bp, Mus musculus
aaaagatattaaggaaaagtaattgttgcttcctgctatttttgttgtaagagttgtcattctgttcttgtggctgtcttattttaggtttgttgagggattactttcttgctttt

SEQ ID NO: 59513 - DNA, 91 bp, Mus musculus
tcctgagagagcctgaatgtgcacgcttaagctggaaggaaaaataacctggggaatgtctttctgactctgtgtgaggctccacacagga

SEQ ID NO: 59514 - DNA, 82 bp, Mus musculus
ttctgtcacgattatttctggcattcttcctgtgctgtgctactacatagggcacaggggtgagagatctcagtggtcagag

SEQ ID NO: 59515 - DNA, 91 bp, Mus musculus
tgcccctttagatggagagaagacagacaccagggaggtaagattagcagtgcctggagctaagcctttgttgccattttgaagttgggta

SEQ ID NO: 59516 - DNA, 78 bp, Mus musculus
ctgagtgttttgcctgtgtgtctgtctgtgtgccacatgtgtggctgttgcctgtggaggctggaggagggcattgag

SEQ ID NO: 59517 - DNA, 78 bp, Mus musculus
ggggagagtaaatagttcaactggctatcacagagcagggaaggctgctctggaaatccatgctaaagtgcttttcct

SEQ ID NO: 59518 - DNA, 69 bp, Mus musculus
ggagggtggattgatactgggcaggcaattggcatagtatgccatatctgtctgtctctgtctttcaac

SEQ ID NO: 59519 - DNA, 122 bp, Mus musculus
gtgtgtgtggtgtatgtgtgtatatatgcatgtgtgtttaagtgtgtgtatatagtgtatatgtatatgtgagtgagcatatgtgtttgtgtgtgtgagtgtgtatgtgtgtgtgtaataga

SEQ ID NO: 59520 - DNA, 115 bp, Mus musculus
gcagaggcctgggaacctgggcatccttctgagttgtgcaagtgcagagcccaacactctgactctgcgaatgacccagctgcgcgtgctccagtggttgcctccagtgccgtgc

SEQ ID NO: 59521 - DNA, 115 bp, Mus musculus
agttgtagatggttttattgtccagccttgttatttcaggtagatggtttttaagtagtaatttacagaggttgtactggaaaaaatgtggaggttggagagagtatctggaact

SEQ ID NO: 59522 - DNA, 111 bp, Mus musculus
tctgtgagcgttcagatgccccccttgtatgtatgtatgtatgtatgtatgtatgtatgtatgtatgcatgcatgcatgcatgtaggtgtatgtgtgtgtgaatgtgcagg

SEQ ID NO: 59523 - DNA, 61 bp, Mus musculus
ttcagtgagctcctggggtccccacactgtggaggtgtgggcctctctgactctcactggg

SEQ ID NO: 59524 - DNA, 98 bp, Mus musculus
gtatatatttgcgtgtatgtgtgtatgtacatgtatgtgagtatatgtgtatatatttgtatgtgtgtgtgcatgtgtctatgtatgtaagtatgtat

SEQ ID NO: 59525 - DNA, 79 bp, Mus musculus
ggaaggtctccacctgcagtgggggaaatagctctctgacatggtgtggtcagtctgtctcagcctgcagggatcttcc

SEQ ID NO: 59526 - DNA, 70 bp, Mus musculus
gtgtacgtctgtgtgcatgtgtttgtgtgtgtgaatctgtctgtgtatacctgcatatgtgtatgtgcac

SEQ ID NO: 59527 - DNA, 75 bp, Mus musculus
gaaaaatgccctaggactggagagatggttaagcggttaagagcactgtctgctcttccagaggtcctgtgttca

SEQ ID NO: 59528 - DNA, 117 bp, Mus musculus
actgggacaaaggtggtaaggcttggcacttaacctatatacttacatatgtttgtttgcctgggtgagtgtatgcaagtcacatgggtgcaggggccattggctcctcaaaccagt

SEQ ID NO: 59529 - DNA, 97 bp, Mus musculus
tcacatttaaacttttggttcctagttattgtcattatgtagatgtgtacaattctctagtgatattggggaaaaaaaccacagagtaaagaagtgg

SEQ ID NO: 59530 - DNA, 127 bp, Mus musculus
caccaaaatctgcttccctagttaatgtgcaccagacttggctgtccctgcgtggatctgtggaatgatggctggtgatagactgctgcatttgaaaccgctcaagaaatcttgccttccggtgcgc

SEQ ID NO: 59531 - DNA, 84 bp, Mus musculus
gggcacaaaaagttttcatctctgtctctgtctcacccatggtatcccaggacagtcatgaaataacagtagccatttgtctcc

SEQ ID NO: 59532 - DNA, 71 bp, Mus musculus
gcccgctgacagaacacagactgggtgggaagagtatccctccaggcagtgctcactctgtcttcaatggc

SEQ ID NO: 59533 - DNA, 99 bp, Mus musculus
gtgtgtcatgtttgagatgaatacaaggcatttagtgcaaagagaaggactgcctgcctgcctgtgtggaagataaaagtctctaagctcactttatac

SEQ ID NO: 59534 - DNA, 104 bp, Mus musculus
ctcttcagcttcctggtccttgtgcttgtcaaaagatgagacacacaagacagtgtggagtttattgcatctctcaacgagacagagtggactatggctgtgag

SEQ ID NO: 59535 - DNA, 107 bp, Mus musculus
ggtccagcgtacatctcttttggggaaatgtccatttgggtccttcactcatttgaagtgaattagttgttctttattccttaactgtaagagttcttttatgttcc

SEQ ID NO: 59536 - DNA, 85 bp, Mus musculus
cagttgatctaacagggtaggaacatccagtgaagtctaaactacaccaggcttggctgtgagcctctgtgtgtgtgtcctgctg

SEQ ID NO: 59537 - DNA, 93 bp, Mus musculus
tatggtatagtctatgatgcttgcagagacagaaatcaccatataattcatttctgggagtctgtttctgtcagtaagtggcacccggccatg

SEQ ID NO: 59538 - DNA, 76 bp, Mus musculus
gcaatatgtatgtatgtatgtatgtatgtatgtatatatgtgcatacacatacacatatgcatatacatatataca

SEQ ID NO: 59539 - DNA, 135 bp, Mus musculus
atatgtatttgtatgtgtatgtatatatgcatatatgcctatatatgtatgtatatgtgtatgtgtgtatatgtatatatgtatattatgtatatgtgtgtatgcttatatatgtatgtatatgtatatatgtat

SEQ ID NO: 59540 - DNA, 67 bp, Mus musculus
gaggcgtctgtgtgaacacagtgcacagttcataacaggaacatgtcaccaagtacagaggcagctc

SEQ ID NO: 59541 - DNA, 80 bp, Mus musculus
ggctagagatcttgagtgcagaggtgaggaaggctggcctagccgtcactcagcctgtcactcagtttgagcttgtggcc

SEQ ID NO: 59542 - DNA, 118 bp, Mus musculus
ggcagtcggtgtgcacagggtcctggagcatcgcagtgaagccactgagcagagagtgcaccctgcgctcaggaagctcaccatagatgctcaggactggccccctggagctggcgtc

SEQ ID NO: 59543 - DNA, 78 bp, Mus musculus
tcctgtttggaggaccgtgtgtggcaagatgacagcagaaagtgacatctctgcaaactcagtctgggccaagcagga

SEQ ID NO: 59544 - DNA, 141 bp, Mus musculus
acacatgctcctgtgcatgtgtacatgtgtgtgcgtatatgtgtgcctatacatgttcctctgtgtgtgcatgtgcatgtgtgtatgtgtgtgttatatgtgtgtactcatgttcctgtgtgtatgaatgtgtgcatgcat

SEQ ID NO: 59545 - DNA, 107 bp, Mus musculus
gagttaagagggtagtagaggggctggtgagatggctcagtggttaagagcactgactgctcttccaaaggtcctgagttcacatcccagcaactacatggtggctt

SEQ ID NO: 59546 - DNA, 89 bp, Mus musculus
ccagtctactggactgtctctctcagttagttttgaacaagctgatataaaaccaaactaagtgcaaaggacagtgtctaaggggctgg

SEQ ID NO: 59547 - DNA, 115 bp, Mus musculus
gggtgggggtggggtgtctgcaaagaaatactgtcaagctgcaacactgaggtctcatctctctgtgtgcttgcccctcaaacatgctctggcactgacatcctatctgacactc

SEQ ID NO: 59548 - DNA, 67 bp, Mus musculus
ccctctgtctgtatctcagtgggtttgtgagtaacaatccgcctgcctcagacacagaaatactggg

SEQ ID NO: 59549 - DNA, 119 bp, Mus musculus
ggagacctagcagaggagagatggctctgggcttctttttcatatggtcatttcatttgacagtcattttgatgaagaagcaaacaaaaatctcatgtttttctcagatcttggcctct

SEQ ID NO: 59550 - DNA, 174 bp, Mus musculus
atatatgtatatgtatacatacatatatgtgtatatacatgtatgttgcatatatgtatatatgtatgcatatatgtatgtgtatacatatatatgtgtatatgtttatgtatatacatatgtgtatatgtgtatatatatgtgtatatgtatatatatatatatatatatata

SEQ ID NO: 59551 - DNA, 88 bp, Mus musculus
gtgtgtgtgtcttcgagaggtcaacatcaggtactattcctcaggtgctgacttgtttttgagacagtctcacactgggtctggtact

SEQ ID NO: 59552 - DNA, 63 bp, Mus musculus
agccttctcaaggacacaggactgttcctggtatgtcacagtagcctgtgtgctcaaagtgct

SEQ ID NO: 59553 - DNA, 66 bp, Mus musculus
gcatatgtgtatgtgtgcacactcacgtgtgaatttgtacatgagtgtgtatatggatgtatgtgc

SEQ ID NO: 59554 - DNA, 56 bp, Mus musculus
atactgacacacatacatatatgtgtgtatatatatatgtatgtgtgtatatgtgt

SEQ ID NO: 59555 - DNA, 110 bp, Mus musculus
ctgcccatagctgccaggatgggctttgctatttgcatagaggggtggcctagggttttggctctggtagttgtttgtctgtcattaaagcagtccacagtagtgggagg

SEQ ID NO: 59556 - DNA, 100 bp, Mus musculus
gtgtgtgcatgtgtgtgtatgtatgtatacatatgtgtgtatgtgtatatatatatgtgtgtgtacatatatgtgtgtatacatacatacacacacacac

SEQ ID NO: 59557 - DNA, 77 bp, Mus musculus
gtgtatgtgcatgtgtaggtgtgtatgtgcatgtatatgtgtgtattccttatatatgtctgtgcatgtgtatgtgt

SEQ ID NO: 59558 - DNA, 113 bp, Mus musculus
tctttgcatttgaagaatactgactgaaaggggtccctcatctttgaaattctatttattttgagtttacaaatggagatgctgccttttatttacggggttttctgtgaaga

SEQ ID NO: 59559 - DNA, 82 bp, Mus musculus
cacccacattgctgttcctctgcatgcccttggcagcctccatccaagcaccatgctgagtctcacagtctgtgttggagtg

SEQ ID NO: 59560 - DNA, 58 bp, Mus musculus
cgctcgctcgctcgctcgctcggagacggcctcctggagctgcagggaaggcgcagcg

SEQ ID NO: 59561 - DNA, 77 bp, Mus musculus
ggtcccaagtgttgtgagagaggacacagaatctgtggcagcataatgcatgtgttgtctgttaaagcagggtggcc

SEQ ID NO: 59562 - DNA, 92 bp, Mus musculus
gttgagacctctcctgaactcaacctggattcactctctgtgtctttctgtcaccttccaggaccccgatagtgcgaggagaggtgctcagc

SEQ ID NO: 59563 - DNA, 266 bp, Mus musculus
gtataatgtatatgtaatatgatatgtaataatatattatatatggtatgtgatatataatacattatatatgttatatgtatatatagatgtgtgtttatatatgtatatatatgtatatgtgtacatgtgtgtatatgtatatatacatgtatatatatgtatatgtgtgtatgtatatatgtacatgtatatatatgtatatatgtacaagtgtataatatataatatatgtgtgtatatatatgtgtgtatgtatatatata

SEQ ID NO: 59564 - DNA, 85 bp, Mus musculus
agtggcccagccattgagctgattaaggcatatcagaatataaagactgtgtgtgtctttcactcaggaacttactggggccagt

SEQ ID NO: 59565 - DNA, 110 bp, Mus musculus
ggaagaaggagtctgaacactcagagggcttacccagtgtgcctctctcagagacatagctatattgtgggaaagcctttggggtcttcagagaatcttgaattgaagcc

SEQ ID NO: 59566 - DNA, 90 bp, Mus musculus
ggtgaagggttaatttgtgatctgtctgtgtgtgtctgtgcatacagcagtgacatggacatgcaaagtcacaagttggtttctctttcc

SEQ ID NO: 59567 - DNA, 62 bp, Mus musculus
gtgtgtgtgtatacatatacatatatatgtttaaatatatgtttgtttgtaaatgcacagac

SEQ ID NO: 59568 - DNA, 78 bp, Mus musculus
acacacacacacacacacacacacacacacaaacacacaggcgtgcgtgcgtgcatgcgtgcgtgcgtgtgtgtgtgt

SEQ ID NO: 59569 - DNA, 88 bp, Mus musculus
tgtatgtgtgtgtatgtgtatatgatgtgtatatgtgtatacgatgtgtatacgtgtatacatgtatatatgtatatatgtatacaga

SEQ ID NO: 59570 - DNA, 84 bp, Mus musculus
ctgtctgggttgcagctgacaggcattgcctagtatgaaccctgtataaaagtagactgtgtgctcagctgccaggtagactta

SEQ ID NO: 59571 - DNA, 115 bp, Mus musculus
ggctggtggggatctgggtcaggctttcttctgggaaatgtaaaattttatatctatgttaagatgaagagaacatgctatattaggtgcctttctcaagacacctcagccaggc

SEQ ID NO: 59572 - DNA, 64 bp, Mus musculus
gcgtagaggagtgaatctgttgatgtcacagcagaagttgctgtgtaggcaggcttcttggtgc

SEQ ID NO: 59573 - DNA, 75 bp, Mus musculus
ggcatgtttagaagccagaggtggatgtgatgtgtcttcctctatcactctctgctttagtttttgagacatgcc

SEQ ID NO: 59574 - DNA, 102 bp, Mus musculus
gtgtgtttaagtgtgcaggtatacttgtgtctgtgtgtgtatctgtgtatgtgtatatatgtgtgtaagagtgcaggtgtatctgtgtgcaatagagctcac

SEQ ID NO: 59575 - DNA, 101 bp, Mus musculus
ttcaaaggacatcggttttgactctcacactcacagtgatttctaggtgtgtgcccaacactgcaaccctgtgtgtgagagagccgcacagtctctgtgga

SEQ ID NO: 59576 - DNA, 90 bp, Mus musculus
cagcactgatcagaaggaacctgagatgctggtcaagcagggctcctgtatccctgctcctgctgtcacaggcccatcatgattggtttg

SEQ ID NO: 59577 - DNA, 92 bp, Mus musculus
tgtttaaaatcctaccctaggggctggggagacggctcagcagttaagagcactgactgctcttccagaggtcctgagttcaattccaaaca

SEQ ID NO: 59578 - DNA, 103 bp, Mus musculus
aataaggataatatagattaattattttcatatatatacacacatatgtgtatatatgtgtgtatatatgtgtgtgtatatatatatgtgtgtgcttattctg

SEQ ID NO: 59579 - DNA, 115 bp, Mus musculus
tccttgaccaagttatcattgagaagagtgttgttcagtttccacgtgaatgttggctttctattatttattttgttattgaagatcagccttagtccatggtgatctgatagga

SEQ ID NO: 59580 - DNA, 131 bp, Mus musculus
tatatgtatgtatgtatgtatgtatgtagtgtatatatatatacatatatatatgtatacatatatatatatacatacacatatatatgtatatatacacatgtatatatatatatgtatacatatatgta

SEQ ID NO: 59581 - DNA, 85 bp, Mus musculus; identical to SEQ ID NO: 57439

SEQ ID NO: 59582 - DNA, 74 bp, Mus musculus
tgtttgtgtgcatgtacatgtgtgtatgagtgcatttatgtgtacatgcacacacacacaaacgcacacacaca

SEQ ID NO: 59583 - DNA, 79 bp, Mus musculus
tggggattctgagtctctgtgactgtgggaagtgtttaaaaagactcacgaggcctacccaccccaactctggaccccg

SEQ ID NO: 59584 - DNA, 68 bp, Mus musculus
ccatcagtccaatcactgtctctctgaggctcatctccgtgacattcagatgctgtgtgaggacatgg

SEQ ID NO: 59585 - DNA, 115 bp, Mus musculus
gctggctagagtccccgtgggtgagttctgaccccaaaggattgggttctcagtgtatgtctctgtgtgaacctgagcctgctgggcaatgcctcttcaacgggtgctcacccgc

SEQ ID NO: 59586 - DNA, 69 bp, Mus musculus
tatacatatatgtatacatacatatacatatatacatgtttaatgtgtgtgtatatatatatgtataca

SEQ ID NO: 59587 - DNA, 86 bp, Mus musculus
gagtgcagcaagatggaaggctgttcattatgtctggtgatcctaacatgtacaataccacaaacagcaacaggagctgcatcctc

SEQ ID NO: 59588 - DNA, 82 bp, Mus musculus
gtatgccgaaccacctcttcacttgtatgtatacctcaaagattagagactgatacaggtttagatgtgattgtaggcatac

SEQ ID NO: 59589 - DNA, 111 bp, Mus musculus
catatcaccttgatgagaccttgagcccagccattgacatgacagaagccagtgaacagtgacatttgagagcagctttgggggcatactcatcagatgtggctgctactg

SEQ ID NO: 59590 - DNA, 65 bp, Mus musculus
ggtggactgaggagaaggcagctagcggggctctcaggttctcagttactctctcacagtcggac

SEQ ID NO: 59591 - DNA, 69 bp, Mus musculus
gggatggatccccaggtggggcagtctctggatggcctttccttcagtctctgtcccactgtttgtccc

SEQ ID NO: 59592 - DNA, 101 bp, Mus musculus
tatatctaaacatataagtttatatatgtgtatatactttatatatgattatatctaagcacatatatgtttagatatacatttttatactatatataaac

SEQ ID NO: 59593 - DNA, 121 bp, Mus musculus
catatatatgcatatatacctatatgcatatatataagtatctctaaatatatatttgcatatatgtatatgtgcacatatatgattatatgttatatatatgtatatatgcacatatgta

SEQ ID NO: 59594 - DNA, 74 bp, Mus musculus
ctaccccagaaatgcctttttatatatatgtcataatctgcagcgtgtatatatatatataaagggggaggtgg

SEQ ID NO: 59595 - DNA, 82 bp, Mus musculus
tatgtgtgtacatgttcgagtgtgcacacatgtgtgtgtccatacatgtgcatgtgtgcatgcttgtgcatgtgcatgggtg

SEQ ID NO: 59596 - DNA, 86 bp, Mus musculus
atgtatatgtatatgtatatgtatatatcatgtatgtgtgtatacagatttcatatatgtatatatatgtacatatatatatgtgt

SEQ ID NO: 59597 - DNA, 105 bp, Mus musculus
gcatagaaatttatcagcgaagtctgaagggtagagagaagaccaactctagtgtctatgttcatttctttgaagattatggccataaatttttactaaacctgc

SEQ ID NO: 59598 - DNA, 79 bp, Mus musculus
gccggtgatgcgggtcagtggagtgaagcctgcctgcctgagggtcagactcagtctctctccctggacgtagccgagc

SEQ ID NO: 59599 - DNA, 87 bp, Mus musculus
tgacactcaggtgacgacatgtgaggttgggatcagcctaaagcggatttaagttctcactcctctcactctgtgacctgggcttcg

SEQ ID NO: 59600 - DNA, 76 bp, Mus musculus
ggcctctccctctgtctcagtgagttgacccaaacttgagtaattcggtcaaatagggtgagtgagaatcgaggcc

SEQ ID NO: 59601 - DNA, 120 bp, Mus musculus
tatgtatgtatgtatgtatctgtgcacacatatgtgtatatatatatatacatatatatgtgtatatatatatatatatatatatatatatatatccatcacattcttttcatcacttgc

SEQ ID NO: 59602 - DNA, 115 bp, Mus musculus
cacttgctacatccagacactgaatgagttaattgtgttttttttaattaaataattattttattttgttattaaaatcctatagtcatcactcatatggatctgtgtatcggtg

SEQ ID NO: 59603 - DNA, 91 bp, Mus musculus
aggaggaaggcgctgaatgacaggctgaggaagatggttctgttgcttacgttaaacagaacatattttaaagcagtgttttaaaactttt

SEQ ID NO: 59604 - DNA, 66 bp, Mus musculus
atgtgtgctattatgttttgtcatatatatatatatgcatatatatgacatatataatacatatat

SEQ ID NO: 59605 - DNA, 69 bp, Mus musculus
gtgtgtgtgtgtgtgtgtgtgcatgtgtgtactgtgtgtgtgcctttgtgtgcatgtgcatgtgtgtgt

SEQ ID NO: 59606 - DNA, 114 bp, Mus musculus
gtgtacccaatggtatgtgatgtgggggtagggtgtcgggtgagggttgggagttcgtaggtctgtctgtctgtctgcctgcctatctctgtttgcaagactgtgtgtgtgtgt

SEQ ID NO: 59607 - DNA, 95 bp, Mus musculus
gtggtccccatgctcagtctgattgttggctgtgagtatctgcatctgcattggtcaggtgcatggctccagctacatatgtagcagagaattac

SEQ ID NO: 59608 - DNA, 96 bp, Mus musculus
tcagcactgggactattctggtttgaacctgtgttggccttgtgtactgtcacagtcactatgagttcacaagtgtaccagttttcttgggtctgg

SEQ ID NO: 59609 - DNA, 114 bp, Mus musculus
ggttctctcaatgaaaatagatggcaaatataaaatgaagatgaaaattatacagcatagcttgtatagaacaatctagttataattcataggtgtcacatattttctaaagcc

SEQ ID NO: 59610 - DNA, 71 bp, Mus musculus
ttgaacacaaggggctggaatggctcagcgattaagggcactgactgctcttccagaggtcatgagttcaa

SEQ ID NO: 59611 - DNA, 120 bp, Mus musculus
acacacatataactgcatgtacacacatatataatagtcacatttatgtatacacacatatgtgtatatatgtatatatatgtgtgtgtatatatacatatatatacttatacaaacaca

SEQ ID NO: 59612 - DNA, 70 bp, Mus musculus
catgtatatgtatatgtgtaaatatgcatatatgtgtatatatgtatatgtacatatgtgaatatatgtg

SEQ ID NO: 59613 - DNA, 92 bp, Mus musculus
cctgagcataattgcactgagatcatcctgtttccattttgaaagccactggcaattactggaatacaatgtatcatgcgtttgctcactgg

SEQ ID NO: 59614 - DNA, 119 bp, Mus musculus
ctttactgaattcaaatttcaagtcctaaattgtctttatcattttgtttagccttatatttgtatttatttgactattactctgatgtttattgttaggttcttgtagttcagtgaag

SEQ ID NO: 59615 - DNA, 90 bp, Mus musculus
tgtatatgatgtatgtatatatgtatgtgtatgtgtatatgtatatgtacatatatatcacacacatatatgtgtgtataaatgtataca

SEQ ID NO: 59616 - DNA, 91 bp, Mus musculus
acgcatatgacgtatatgatgtatatgatgtatatgatgcatatgcatatctatatctatatctatgtctatatctatatctcatgagtgt

SEQ ID NO: 59617 - DNA, 106 bp, Mus musculus
atatctatgcatgtttgtatatatacaaacaaatgtgtatatatatgtatgtatatgtatgtatgtatatatatatatatatatatatatatatatatatatatat

SEQ ID NO: 59618 - DNA, 99 bp, Mus musculus
atggagtcttagatgaccaattgtaatggagtcccatcaagggcattgtattgtctctgtgttacactctcactaacagaccattatctactacttcat

SEQ ID NO: 59619 - DNA, 105 bp, Mus musculus
ctgacaagaggcagccttggtagctggaattgtctgaagaaacacagcaggttctttcgtcatcataatgctggttctccagtcagtttctagtctgtctgtctc

SEQ ID NO: 59620 - DNA, 121 bp, Mus musculus
gtgtatatatgtatgtatatgtgtatgtatatgtatatatgtgaatatgtatatgtatgtgtacatatatatatatatgtatatgatgtatatggctatgtgtatacgtatatggtattca

SEQ ID NO: 59621 - DNA, 85 bp, Mus musculus; identical to SEQ ID NO: 57439

SEQ ID NO: 59622 - DNA, 64 bp, Mus musculus
aggcgtagggttggaggcagtggagagccatagtggcttagcttagttgtctctctctctccct

SEQ ID NO: 59623 - DNA, 94 bp, Mus musculus
ccattgtgggatccgtgggcatctgtttgttatgcatgcacacttgctgtgtgtgtgcacactgtgtctaacgaagggtcaccgcctgccttgg

SEQ ID NO: 59624 - DNA, 89 bp, Mus musculus
gaaatctacataatcaaaaaaatctgtgctctctgtgtgtgtgacaaaaaaacactggactacaatgatttcgctgctgtgtaggcttc

SEQ ID NO: 59625 - DNA, 107 bp, Mus musculus
tcaaagttacatttatttgttcacatgtgtgagtgtgaacatgtgtgtatgtgcatgtgcatgtgtgcatgtgtgtgtgcatgtgtgtgagtgtgtgtgtactatgg

SEQ ID NO: 59626 - DNA, 59 bp, Mus musculus
ctgcaaactgaggccagcttgggctgtacagccagaccctgtctgtctcagtttaaaag

SEQ ID NO: 59627 - DNA, 90 bp, Mus musculus
ccttaccactgtctgtctggcactgtctcatttgtagatgctttttctgaggacgtaaatgaagggagtgttgcacagggtggtcatagg

SEQ ID NO: 59628 - DNA, 85 bp, Mus musculus; identical to SEQ ID NO: 57470

SEQ ID NO: 59629 - DNA, 71 bp, Mus musculus
tgtgtgcatgcatgcatttgtgcatgtgtgttgtgaatgcacacttatgcatgtatgtatgtatgtacaca

SEQ ID NO: 59630 - DNA, 83 bp, Mus musculus
tgaagacagtctgacaagtttgaaaagtaagcacaatagctatttattactttttaaatgcatggtttgttgcgatgtcttta

SEQ ID NO: 59631 - DNA, 62 bp, Mus musculus
tgcatatgtgtgtgcatgtgcatgtgtgcatacacacacatacacagatagacacacatgca

SEQ ID NO: 59632 - DNA, 102 bp, Mus musculus
tccaagtccaaggttgaaacagtctgaatatctgcatcaaacgtatgttatttatttatttgcagaaataaagttggttcagcattttgggtaaatattgga

SEQ ID NO: 59633 - DNA, 101 bp, Mus musculus
atgtatatatgaatgtaagtgtatgtatgtaagcatgtatgtaggtacgtgtgtatgtatgtaaatacacacatatgtgtgtatataagtaactatgttta

SEQ ID NO: 59634 - DNA, 81 bp, Mus musculus
ggtgggaaagcatttctacaagaaggacaggtgccaggagcatggtcagtatctcactcagaatctgtgttttcacccact

SEQ ID NO: 59635 - DNA, 72 bp, Mus musculus
tatatgtgtgtgtgtgtgtgtatatgtatatatatatgtatatatatatgtatatacatatacatatacatg

SEQ ID NO: 59636 - DNA, 96 bp, Mus musculus
gctcagcactaggattttatctggtttgaactcagtgtgggtcttgaacacgctgtcacagtctctgagttcatgcccatatcagccctgttgtgc

SEQ ID NO: 59637 - DNA, 78 bp, Mus musculus
tattgtttcctttgcaagtatgtatgtatgtatgtttgtacatatgtacatatatcatgcacatgcctggtgtcaatg

SEQ ID NO: 59638 - DNA, 81 bp, Mus musculus
gctatgctgaaggcaaagggcagtcacagcagcactcaaccgcagtgggagagactgactctgtgcctctcagggtgaagc

SEQ ID NO: 59639 - DNA, 72 bp, Mus musculus
atctggttgggaagcctagtgctgctgctcttagtgggaagggacacgcagacgctctgactgacttaagat

SEQ ID NO: 59640 - DNA, 94 bp, Mus musculus
ctaggttctttcactttgagctatggtggctagaacacatggtgagaaaagattgtgtgctcagtgctagcaagaggcagagagggaggctgag

SEQ ID NO: 59641 - DNA, 59 bp, Mus musculus
cggctctcagtgactctgtgacaaggcgagtgagcagtcaccagcgtactgctgtgctg

SEQ ID NO: 59642 - DNA, 85 bp, Mus musculus; identical to SEQ ID NO: 57439

SEQ ID NO: 59643 - DNA, 117 bp, Mus musculus
gctagttgggaacaaacttaagctgtgagggccaagcattcataaataaatataagtctctctgtgtgtcattgttcggaagccaggctgttgcagtaaatctccacccaaatatgc

SEQ ID NO: 59644 - DNA, 64 bp, Mus musculus
tgtctgtctctctctgagtctcagtttccccaacaggggatgcattcaatgaggggttcagtca

SEQ ID NO: 59645 - DNA, 116 bp, Mus musculus
cctctccacttctttccaaagctccatgtcccaccaaatccaagcttgaaagaacagacaagttttattctattttattcgaacatggaggccccaggaagcaaagcaagggctgg

SEQ ID NO: 59646 - DNA, 82 bp, Mus musculus
gggaatagcttagtctggaaatggtgtgaagtagggtgagcacatttagctctctatctgtctcacattagcttctgtctcc

SEQ ID NO: 59647 - DNA, 81 bp, Mus musculus
gaagctgtgtctcttggatgttatgttttctgttttccaagctgagggaacaaagggaacaatgaccatccacaacccttc

SEQ ID NO: 59648 - DNA, 84 bp, Mus musculus
gtgtctgtgtctgtgtctctggctatggctatggctatggctatggctatggctatggctatggctatggctgtctatgtccat

SEQ ID NO: 59649 - DNA, 90 bp, Mus musculus
ttatacagaatcagtgagaggagtctgaggccacttttcaaagcaaaagcttaaaaactgtgtccatatcgtcttacttatttagcataa

SEQ ID NO: 59650 - DNA, 119 bp, Mus musculus
gtctcaggttctgaggcaatatttttgtcactgtcctatgcatttcctctacactgatgactgtatgctaagccaagagtgacatgcaagccctgatccagtactgcccagtgcactgg

SEQ ID NO: 59651 - DNA, 67 bp, Mus musculus
agcttaacatctcacagcctgttttgtattattgcaacaaaactccagaggctgggagaaggaagct

SEQ ID NO: 59652 - DNA, 82 bp, Mus musculus
attaggtcaactcactctctcagtgaaatgctgcttagcttggctatgattgcattttacagagagaagagcattgcttgat

SEQ ID NO: 59653 - DNA, 94 bp, Mus musculus
atgtattggtagaagagatgttgagcgactgctgtgcacactgtcagtttctcatacagcctatgttcatatttttaaaatctatctgtaacat

SEQ ID NO: 59654 - DNA, 80 bp, Mus musculus
atttattgtatgcagtgtgtgtgtgtctgtatctgtgtgcacacatgtgcatgtatatgcctgctggaatgcacatgaat

SEQ ID NO: 59655 - DNA, 86 bp, Mus musculus
ttgataggtgagagtgcacagagtgtagaattgtggggacttccagtgttcttcataactatttactcaagtgtttcccctgacaa

SEQ ID NO: 59656 - DNA, 99 bp, Mus musculus
tggctcaagatttcatcagataagtgtacaattaatatgcattgtttatttctggaagttttctgataatgattttgcatcttggctgatgatgagtga

SEQ ID NO: 59657 - DNA, 65 bp, Mus musculus
cgcagagctgacatctctgtgtgtcagcagagctgacaactcatgtgacataagttggttctgtg

SEQ ID NO: 59658 - DNA, 78 bp, Mus musculus
catccatccatctccagctcaggttatggtagcgccaggctgggaaccgtggcctctcggtctgtgagtgagatgatg

SEQ ID NO: 59659 - DNA, 85 bp, Mus musculus
gaaaggataggaaagaagcctgtgtggacactctgggactctcagggaatcctgcttccaagtgtttgttacttcttcccctttc

SEQ ID NO: 59660 - DNA, 93 bp, Mus musculus
ggtgaaacatgtacagtccatgtatggaagtatgttggtcactatttacttagcaaggccttgcccctatatggcctgtgctggcctgacacc

SEQ ID NO: 59661 - DNA, 80 bp, Mus musculus
ggttcctctccatttccatccctataattctttcagacaggaacaattgtgggtcagagatgtgactgtggaatgggccc

SEQ ID NO: 59662 - DNA, 67 bp, Mus musculus
aggtacttctgagtgggtttatttcttcttgagagatgagagtaatgacactacacatgaagtactt

SEQ ID NO: 59663 - DNA, 85 bp, Mus musculus
gaccatggtggtctgataggatgcatgggacaatttcaatatttttgtatctgttgaggcctgttttgtgaccaattatatggtc

SEQ ID NO: 59664 - DNA, 85 bp, Mus musculus; identical to SEQ ID NO: 57439

SEQ ID NO: 59665 - DNA, 85 bp, Mus musculus; identical to SEQ ID NO: 57470

SEQ ID NO: 59666 - DNA, 85 bp, Mus musculus; identical to SEQ ID NO: 57439

SEQ ID NO: 59667 - DNA, 57 bp, Mus musculus
agtgtgagaactgagtcaagagtcctggagactcatctgagtcaggacactaacact

SEQ ID NO: 59668 - DNA, 85 bp, Mus musculus; identical to SEQ ID NO: 57439

SEQ ID NO: 59669 - DNA, 108 bp, Mus musculus
ttagtttctagtgagcgctttgagggtgtaaaaaataaaaccacactttaaatataatgtctatggtattcttgttgtatatcaagtgagctgtttgcaagaaagtga

SEQ ID NO: 59670 - DNA, 85 bp, Mus musculus; identical to SEQ ID NO: 57439

SEQ ID NO: 59671 - DNA, 116 bp, Mus musculus
tatttttatgttatttcagttgctctttaagatgattttgcaatgaatgaagaacaatgttaatattcttttatagaaaagtcagataaagacctaggctgattaattttctaata

SEQ ID NO: 59672 - DNA, 114 bp, Mus musculus
tcatgtggcttttgtatttcagtatttttatgcagtgggttacatttatatatttatgtatgtcaaaccatctttgcatgaggcctgcttgattatagtaaaagggctgtttga

SEQ ID NO: 59673 - DNA, 104 bp, Mus musculus
ggtggattttcctcttgatgcatataaagtgtctttcttcataatgcttgataacttttggttgaaagtctattttattggatattaggatggcaattcctgct

SEQ ID NO: 59674 - DNA, 85 bp, Mus musculus
gtccatggtggtctgataggatgcatgggaaaatttcaatatttttgtatctgttgaggcctgttttgtgaccaattatatggtc

SEQ ID NO: 59675 - DNA, 85 bp, Mus musculus; identical to SEQ ID NO: 57439

SEQ ID NO: 59676 - DNA, 86 bp, Mus musculus
agtcttctacaagatggaagaacacatcgctggcactttgatcacagtacactgtgactgtgcttcttgtctctctatattagact

SEQ ID NO: 59677 - DNA, 129 bp, Mus musculus
tctgataaagcaacttaagtggggagctctctgtaagacttatttttatttatgtgtacctgtgtctgtgtgagtctatgcctagagtgggatctgcagaggtcaagaggtcagatctcctgaaactgg

SEQ ID NO: 59678 - DNA, 84 bp, Mus musculus
cattctctagtgacacctgaagagctaaaagcttttaaactattaattctgtgaagtagttcagtgggacagcaatggagaatg

SEQ ID NO: 59679 - DNA, 69 bp, Mus musculus
ttttatgtgtagcctcagttgttatggtttgcgttaatgtatgtaactatgtatgaggttaacatggaa

SEQ ID NO: 59680 - DNA, 83 bp, Mus musculus
tttcagagttacagagaagcaaggtgagatcagccctctcttcctttcctggatgagcatctgcttgtctgagagctctgaga

SEQ ID NO: 59681 - DNA, 102 bp, Mus musculus
ttggggtacatgggctggagagatgactcagcagttaagagcactgactgctcttccagagttcctgagttcaatttccaacaaccacatggtgactcacaa

SEQ ID NO: 59682 - DNA, 118 bp, Mus musculus
agtcctggcctgattataagctagaggataaagagtggcctttatagaaaaatcaactgtactgttattgttctacaactggatctctttgtttactaaagttttcagcttgtctgtc

SEQ ID NO: 59683 - DNA, 85 bp, Mus musculus
agaaactttggcttagtctcccaaattgccagtttgcagcctgtcatggggtgagcctggctctggctgactgactcagtcctct

SEQ ID NO: 59684 - DNA, 85 bp, Mus musculus; identical to SEQ ID NO: 57470

SEQ ID NO: 59685 - DNA, 114 bp, Mus musculus
cacttcaaaatagcttaagaattgtatattcaggctggagagatggcccagtggttaagagcactgactgctcttccagaggtcctgagttcaattcccagcaaccacatggtg

SEQ ID NO: 59686 - DNA, 115 bp, Mus musculus
ctttggtacagaacaaggcagctttgagacccacatttctgagtatgacagaagagcctgtggtctgtgaccttcaagatgtgcttggtccaaagctatagcaattgtaccctag

SEQ ID NO: 59687 - DNA, 97 bp, Mus musculus
tgtcagttcaggctgagctgggttcttttgcatgtagaatagaacatgtgtctttctttttctgtactggtaatggacacagcttagaaaattgtca

SEQ ID NO: 59688 - DNA, 85 bp, Mus musculus; identical to SEQ ID NO: 57439

SEQ ID NO: 59689 - DNA, 70 bp, Mus musculus
tctcctgtactcattctttctctgcctctgtggctctctgcccacacccagtctgtgtgtgtgtgggggg

SEQ ID NO: 59690 - DNA, 90 bp, Mus musculus
tgtgtgtatatgtatatgtgtgtgtgtgtgtgtatgtgcaggagtctgcatgtgcatgtatatgtacacatgtgtgttcatatgcccaca

SEQ ID NO: 59691 - DNA, 90 bp, Mus musculus
caaagaaccctgacatgtgaggaactgtataactttgattgtttaattttttttccaacagagtgcagcctcacctcaagaaatgctttg

SEQ ID NO: 59692 - DNA, 84 bp, Mus musculus
gtgattgaaaactagcatcgtcagtagatgaataatttgaaattatgtactactgatgggatgcaatgagaaaaagagtgtcac

SEQ ID NO: 59693 - DNA, 100 bp, Mus musculus
taccagtttatgcccaagtgagagacacaacagagtctgatcattgccttaccttattgtggcaattatcaactgggtgtcacatacctgaagactggtg

SEQ ID NO: 59694 - DNA, 87 bp, Mus musculus
gtatttattgctccaagatcaagatctcctgccgacatgctttttatgtctcacagtgactctggctttcttgaacacaatgcatac

SEQ ID NO: 59695 - DNA, 91 bp, Mus musculus
caaagaaccctgacatgtgaggaactgtattactttgattgtttaatttttttttccaacagagtgcagcctcacctcaagaaatgctttg

SEQ ID NO: 59696 - DNA, 74 bp, Mus musculus
gacagtatgctgtggatatagtgacactcactgctgctgtactgtgtgtctcactcaatagtgatcttactgtc

SEQ ID NO: 59697 - DNA, 85 bp, Mus musculus; identical to SEQ ID NO: 57470

SEQ ID NO: 59698 - DNA, 73 bp, Mus musculus
gcaacatcttaggctgttgcttcttctaccaggttatgcccaagtgagagacacaacagagtctgatcattgc

SEQ ID NO: 59699 - DNA, 104 bp, Mus musculus
agtatatatgtgtatatatgtgtgtatgtgtatatatatttgtgtgtgtatacccccactcacatatcacatacaattaatgatgctacatactttatatatac

SEQ ID NO: 59700 - DNA, 69 bp, Mus musculus
tgttttgtttttcaaatgtggaagacttgagaacttgagtctagaaaaacagttgagtattgcaaggca

SEQ ID NO: 59701 - DNA, 106 bp, Mus musculus
aggagagagatgaacttcagtagtagatggtgatacaagctgcatggcttagggtctctccctctggcagtctcaggccatcattgtacccttatataaaactgga

SEQ ID NO: 59702 - DNA, 106 bp, Mus musculus
gccttagtccatggtgatctgataggatgcatgggacaatttcaatatttttgtatctgttgaggcctgttttttgacgaattatgtggtccattttggagaaggt

SEQ ID NO: 59703 - DNA, 85 bp, Mus musculus
ggccatggtggtctgataggatacatgggagaatttcaatatttttgtatctgttgaggcctgttttgtgaccaattatatggtc

SEQ ID NO: 59704 - DNA, 63 bp, Mus musculus
tagactagccatggaaccttctccagtttgaaaactaaggaagagactctgtggctctctctg

SEQ ID NO: 59705 - DNA, 97 bp, Mus musculus
ccaggctcctgtgaacctgagattctcagtgtgtcagagttcttggcagtcaagcttcctctgagaccctgagatcctggtttgaccaagcttctgg

SEQ ID NO: 59706 - DNA, 82 bp, Mus musculus
tgtgtgtctatgtctgtgtgtgtataatatatatatatatatatatatatatatatataatacacacacacacacacacaca

SEQ ID NO: 59707 - DNA, 109 bp, Mus musculus
tcatagttaattgtctaagctttagaaatgtatgtatatatgtatgtacgtatgtatgcatgcatgcatgtttatttgctctgaaattatacataaaaagtatctaaga

SEQ ID NO: 59708 - DNA, 76 bp, Mus musculus
atcagcctggaactgagctagaagcttctttcctgctgggaagcttttgccatgctgggagatgttactcaggctg

SEQ ID NO: 59709 - DNA, 74 bp, Mus musculus
tgttgtccctgtgaatgagaacacctagggtggagccttccgacctagatggttctattgttctgtcatcagca

SEQ ID NO: 59710 - DNA, 68 bp, Mus musculus
catgtggagtttctgacactcactttctttattaaactgtgaagatggtactgttaggagcagacatg

SEQ ID NO: 59711 - DNA, 114 bp, Mus musculus
taagttaggaatgatggaaaagaactttatctaattgacaaatatgatgcactggatattatttgtatatcatactttgtaattcagataattgttgtggttttgttcaattta

SEQ ID NO: 59712 - DNA, 85 bp, Mus musculus; identical to SEQ ID NO: 57439

SEQ ID NO: 59713 - DNA, 116 bp, Mus musculus
gccttagtgcatggtgatctgataggatacatgggacaatttcaatatttttgtatctgttgaggcctgttttgtgacctattatgtggtcaattttggaaaaggtaccatgaggt

SEQ ID NO: 59714 - DNA, 97 bp, Mus musculus
tgtagtacaatttacacacaggattagagatgtttcctgctgttctttttattatttaagattgttttatctatccgtgtgtgtgtgtgtacatgca

SEQ ID NO: 59715 - DNA, 83 bp, Mus musculus
ctctcctgcgtgtgtgtctgtctctcattcatccacgctttgcccacccgcgtcgagagaccccgttccacgcagacacaggg

SEQ ID NO: 59716 - DNA, 85 bp, Mus musculus
ggccatggtggtctgatagaatacatgggacaatttcaatatttttgtatctgttgaggcctgttttgtgaccaattatatggtc

SEQ ID NO: 59717 - DNA, 80 bp, Mus musculus
gaggcagtttttgcatcatcaaattatagaagtttagtatcctttagattctaaatttcttgatgtaattgaattagctc

SEQ ID NO: 59718 - DNA, 87 bp, Mus musculus
attctacttacaatagatatgaaatatttattttattttaaattctagaaataaactgaatattttattttcattgtaacaatgagt

SEQ ID NO: 59719 - DNA, 110 bp, Mus musculus
ttgaagatcagccttagtccatggtgatctgataggatgcatgggataatttcaatatttttgtatctgttgaggcctgtttggtgacctattatgtggtcaattttgga

SEQ ID NO: 59720 - DNA, 68 bp, Mus musculus
agggtgctgcctcagtggctctgtggctctgcctgtcccagaagctgtccggttctgtagtgcaccct

SEQ ID NO: 59721 - DNA, 103 bp, Mus musculus
gctcactcctcagctgcagaaaaactaaagaaatttgtaaatttcaatattaaaatgtaatgaagcttaatgtctttaatttcagcactagggaggtagaagc

SEQ ID NO: 59722 - DNA, 125 bp, Mus musculus
atgcatgtccacatatatgtatatatatatgcatgtatatatatatatacatatatatacatatatatgcatatatatacatatatatataaacaacttcacatgcatatatatatagtatatat

SEQ ID NO: 59723 - DNA, 95 bp, Mus musculus
gtgtatatccatatggtttttgctaatttcattcagttcatagtttattttgtaataaaccttgagtgagatactcagccgtttggaccacatgg

SEQ ID NO: 59724 - DNA, 85 bp, Mus musculus; identical to SEQ ID NO: 57439

SEQ ID NO: 59725 - DNA, 85 bp, Mus musculus; identical to SEQ ID NO: 57439

SEQ ID NO: 59726 - DNA, 68 bp, Mus musculus
agggcgctgcctcagtgcctctgtgcttccgcctgttccagaagctgtcaggttctctggcgcaccct

SEQ ID NO: 59727 - DNA, 88 bp, Mus musculus
ggagtataacaggcaggttttgtgccctgaaagcaggtctcttctcactggctgactacaggaggtacaatattttatgctatgtacc

SEQ ID NO: 59728 - DNA, 94 bp, Mus musculus
agagagagagagataaagatagacatagctatagatataactatatagatatatatatctatttttgcttagtttaataatcattctactttct

SEQ ID NO: 59729 - DNA, 81 bp, Mus musculus
ggatgtgctgggaacttaactcaggtcagtgctctctctgtaagagcaacatcatgtgtttatatcttctgagctatgtct

SEQ ID NO: 59730 - DNA, 81 bp, Mus musculus
tcagataagacacagtggctgatgtattacctgtgtggaaccagaagggcaaacagggaaattgcaactttgtgtggctga

SEQ ID NO: 59731 - DNA, 85 bp, Mus musculus; identical to SEQ ID NO: 57470

SEQ ID NO: 59732 - DNA, 85 bp, Mus musculus; identical to SEQ ID NO: 57470

SEQ ID NO: 59733 - DNA, 99 bp, Mus musculus
ggtaactcaattttaaaagcttctatatatgtgtatattttagaaggattctataggaatagatcttcatatctggaaggccttcaggattgatcatcc

SEQ ID NO: 59734 - DNA, 58 bp, Mus musculus
tatgtttgtgtatgcatgtatatatatatatatgtgtgtgtgtgtatacatatacata

SEQ ID NO: 59735 - DNA, 91 bp, Mus musculus
tatatatatagtgtatgtatatatgtatacatatatgtatacatatatgtatatatatgtgtatgtatatatacatacacacatatgtata

SEQ ID NO: 59736 - DNA, 84 bp, Mus musculus
atatatttgtatatgtatgtatgtatgtatgtatgcataaatatgactgtatatacgtatgtatgtatgcatgtatgtatgtat

SEQ ID NO: 59737 - DNA, 90 bp, Mus musculus
tagtccctgtagatttgataggctgcatgggataatttcaatatttttgtatctgctgcggcctgatctatttctttcctagggtttcta

SEQ ID NO: 59738 - DNA, 80 bp, Mus musculus
ttgaggtgcacatgtgatataaagctggagggagttgcttactgctgtttctgcctgtctgtcgcactgtctgctgtcaa

SEQ ID NO: 59739 - DNA, 98 bp, Mus musculus
ttgtctgacatcaatgggaggagagttcctgggtcttgtgaagaaatgtctttcaaagacacagatgatactgtgctttcacattgctttgttgataa

SEQ ID NO: 59740 - DNA, 101 bp, Mus musculus
atgagccaccatgtggttgctaggaattgaactcaggacctctgaaagagcagacagtgctcttaacctctgagttacctctccagtccattacagctcat

SEQ ID NO: 59741 - DNA, 84 bp, Mus musculus
atatgtatgtaggtatgtaggtatgtatgtatgtaggtatgtaggtatgtatgtatgtatgcatttatgtatgtaggtaggtat

SEQ ID NO: 59742 - DNA, 85 bp, Mus musculus; identical to SEQ ID NO: 57470

SEQ ID NO: 59743 - DNA, 111 bp, Mus musculus
gaatccactgatattgatagttcctgtttttctgttagaggtagtaatatgtattcatgtgactctctgttttgggcgtttgttgtgaactcattaatttcttgtgttttc

SEQ ID NO: 59744 - DNA, 85 bp, Mus musculus
ggccatggtggtctgataggatacatgggataatttcaatatttttgtatctattgaggcctgttttgtgaccaattatatggtc

SEQ ID NO: 59745 - DNA, 75 bp, Mus musculus
tgtgtgtttatgtgtgcgtgtgtgtgcacgtgagtttgtgcttacatgtatatatttcttagttttgaacatcca

SEQ ID NO: 59746 - DNA, 93 bp, Mus musculus
ctatatgtatatatgcataggtacatatgtatatttgtgtatacatgtatatgtatgcataatatatatacatacatatgcacttatatatag

SEQ ID NO: 59747 - DNA, 82 bp, Mus musculus
tgtatatatatatatatatatatatatatatatatatatatatatatatatatatatttgtgtgtgtgtgtctatgtctata

SEQ ID NO: 59748 - DNA, 103 bp, Mus musculus
ggaaaggacttcaagcaagaacataaggcagcaaccatggagtaagactgccggatgactctctctctgacttgctcctaggctcatgcttgactagctttct

SEQ ID NO: 59749 - DNA, 88 bp, Mus musculus
agttctgatgtgggtctctctgtgtgtgggttctcagctgagggtacaccttagctggttctgcccacattggggtcctgcatctact

SEQ ID NO: 59750 - DNA, 85 bp, Mus musculus; identical to SEQ ID NO: 58712

SEQ ID NO: 59751 - DNA, 78 bp, Mus musculus
gactttgaccttgctgccactaagaaggagattacctgggatggatgcttctgacttagatggttgtattgttctgtc

SEQ ID NO: 59752 - DNA, 93 bp, Mus musculus
tataatatccatacattttattctccttcttagcattcttctcagaggactctgagtgtgtctcagtggcagaatatttgcttggcacatatg

SEQ ID NO: 59753 - DNA, 68 bp, Mus musculus
gtgtgtatgtttacatgtttgtatatgtacatgtttgtacgtatgtatatttgtgtgaacatgtgtat

SEQ ID NO: 59754 - DNA, 85 bp, Mus musculus
tacagatcaggtacaatgtcttagcagttaaaagaaaacttactcaattcttttgctgaggatctaggttcaattctagtctgta

SEQ ID NO: 59755 - DNA, 71 bp, Mus musculus
ggtgttagatgttcttgctgtctctggctggagcttttcctcctgtgagtctctaagtctgtgtcagcact

SEQ ID NO: 59756 - DNA, 74 bp, Mus musculus
catatatgtgtgtatgtgtatgtatatatatatatgtgtgtatgtatgtatatatatacatatgtacatatatg

SEQ ID NO: 59757 - DNA, 64 bp, Mus musculus
tccagtttgagcaagaccatttgctgaagatttcagtgaatatttttgtcttgtttcttttggg

SEQ ID NO: 59758 - DNA, 118 bp, Mus musculus
gggggttctaggtccagcccatgcatgatctttgtttgggggtcagtctctgtgagtcttcatgggcctcacagagctaggtggctctttaggtcttcttgtgctgtctttgacctct

SEQ ID NO: 59759 - DNA, 111 bp, Mus musculus
actggatggttttagctcccttgtcaaagatcaagtgaccatagatgtgtggattcatctctgggtcttcaatcctgttccattggtcttactgtctgtcactataccagt

SEQ ID NO: 59760 - DNA, 71 bp, Mus musculus
atgcattatgtatgtatgtatgtatgtatgtatgtatgtatgcatgtatgcatatatatatgtttgtgtat

SEQ ID NO: 59761 - DNA, 85 bp, Mus musculus
ggccatggtggtctgataggatacatgggacaatttcaatatttttgtatcagttgaggcctgttttgtgaccaattatatggtc

SEQ ID NO: 59762 - DNA, 74 bp, Mus musculus
gtgaggatacagaaagaaaagaggctggatatctgttaatattcactgtctgtgtgtctgtctgtctatcttat

SEQ ID NO: 59763 - DNA, 72 bp, Mus musculus
gtgtgtgtgcatatatatatgtatgtatatatacatatatatgtatatatacatacatataatgtacaccat

SEQ ID NO: 59764 - DNA, 78 bp, Mus musculus
agaaggacgtgtctttgccattcatgaattagatgaatgtattatttatatttagtcagagctgtaaagtgtctttct

SEQ ID NO: 59765 - DNA, 57 bp, Mus musculus
gtctgtgaattctgttgcttctggggcatttcctagaaggttggaaagtttacagat

SEQ ID NO: 59766 - DNA, 83 bp, Mus musculus
acagacacacacactcattcttctctgtgtgtgtagtgtgtgtatggtgtgtgtgttgtatgtgagtgtctctgtgtgtctgt

SEQ ID NO: 59767 - DNA, 85 bp, Mus musculus; identical to SEQ ID NO: 57439

SEQ ID NO: 59768 - DNA, 99 bp, Mus musculus
tcagcctgtctgtctgtctgtctatctatctatctatctatctatctatctagtgtctattggtagtaagattgtcatatataggcttgattatgttga

SEQ ID NO: 59769 - DNA, 105 bp, Mus musculus
catatgtaaatatatatatgtgtatgaatctcatatatatattatatatacgtatgtgtatatatgggtatatatgtataaataaatatacacatacatatatat

SEQ ID NO: 59770 - DNA, 68 bp, Mus musculus
gctgattcctgtgtctttttcactgtctgctctaacacagaagtacatggacagacacaggaagctgc

SEQ ID NO: 59771 - DNA, 69 bp, Mus musculus
gaagcctcttctgttaatgtctgtcacagtctctcattaccagagaacagaactcacagtgagagcttc

SEQ ID NO: 59772 - DNA, 117 bp, Mus musculus
gtgataggtattcaagctgtatgtatactagaactgttttgttgaggaatagctgaaagatttttttttttccaagacatgcaatggtattagaatttacagggaatgcagacttgc

SEQ ID NO: 59773 - DNA, 141 bp, Mus musculus
acacatattcatacactcatacatgcacacacagatgcatacacgcacacagatgcacacatatgtgtatatgtttatgtgagcatttatgtgcatgtatgtttgtgcatatatatgtgtattatgtattgtgtttgtgtg

SEQ ID NO: 59774 - DNA, 74 bp, Mus musculus
gggactgactgtggttgtggttgtaggttctaaatgaactgacactaagaactatataccaaaaaatcagtgtc

SEQ ID NO: 59775 - DNA, 109 bp, Mus musculus
gtgcatctatgggccaaatgctgttattcctgtttgaagtaatttttcattatttgttgctcaaataatatagaaacaaagctaaatccagccctggaaccacctgcat

SEQ ID NO: 59776 - DNA, 61 bp, Mus musculus
ctgtgggtcactctctggctgggatcctggacggtgtgagtgggaaatgtgtgaccggcag

SEQ ID NO: 59777 - DNA, 112 bp, Mus musculus
tgtcactgtgttgaaatggttaacactgcctgtgtaggagttctatatttttattttgcaatgagcttctcaaatcccgtagccagccttgactatactgcatttcgtgaca

SEQ ID NO: 59778 - DNA, 75 bp, Mus musculus
ccagctgaaaacgtgaagggagcagcaaatgcagctgtttagctcagagttgtgacttcctgttcaactttatgg

SEQ ID NO: 59779 - DNA, 61 bp, Mus musculus
gctgggagaggtagttgattttcttagggacgctgtccctgcgaggttgccatggtccagt

SEQ ID NO: 59780 - DNA, 87 bp, Mus musculus
agcctcagcagctggaaaggcatgacgtcgttggctgtccatttccagaggtcagcgtctcacactctatcttctggctctgacgtt

SEQ ID NO: 59781 - DNA, 88 bp, Mus musculus
tcttacatgtagatgttagcttttagccttaagtatgtatgtttttttcagaatattgacaaaggttaggtagctagcaaggcgaaga

SEQ ID NO: 59782 - DNA, 74 bp, Mus musculus
tttctggctatgggcagggttgggatgggggctggagtacaggatctggttccaggcttgattcaagccagaag

SEQ ID NO: 59783 - DNA, 85 bp, Mus musculus
ggccatggtggtctgataggatacatgggaaaatttcaatatttttgtatctgttgaggcctgttttgtgaccaattatatggtc

SEQ ID NO: 59784 - DNA, 83 bp, Mus musculus
gggaagatatttcagcttaaatgtatacttaaccatgtaactatatgtttatatatttatgcatttaagtacatatctattcc

SEQ ID NO: 59785 - DNA, 91 bp, Mus musculus
cccagcaggatagagagcctaggaatctgtctgtctgtctccccactcctggaatacaagcatgtgcctggttgtttacctgggttctggg

SEQ ID NO: 59786 - DNA, 78 bp, Mus musculus
gtatgtatgtatgtatgcatgtagtatgtatatacgagatctatctactatcacctgcctgtatatgtatgtatgtat

SEQ ID NO: 59787 - DNA, 85 bp, Mus musculus; identical to SEQ ID NO: 57439

SEQ ID NO: 59788 - DNA, 97 bp, Mus musculus
cccttagctgcaggctttactctgggtgacatgggactttaccttatcactcaccctgagtctgtgatgggaataaaatatgtccttggactgcctg

SEQ ID NO: 59789 - DNA, 63 bp, Mus musculus
acacacacacacacatatatgtgtatatatatatcacacacacatatatatgtgtgtgtgtgt

SEQ ID NO: 59790 - DNA, 69 bp, Mus musculus
atgaagcttttctgagacaagttagagtaagaattgtttattttgcctcacagtctcagtgtgtttcgt

SEQ ID NO: 59791 - DNA, 115 bp, Mus musculus
tccttgaccaaggtatcattgagaagagtgttgttcagtttccacgtgaatgttggctttctattatttattttgttattgaagatcagccttagtccatggtgatctgatagga

SEQ ID NO: 59792 - DNA, 100 bp, Mus musculus
ggacacccctctacatgcgacttgctctttgtgtgctcacgggacctgacatcattcacagagaacacagattgcactttactgtcagccctggaagtct

SEQ ID NO: 59793 - DNA, 115 bp, Mus musculus
tcattgtcaaattataaaataaaaaagtagctgttattgagataccatatttgtatttctttagatacatgttggtatgtttagtaatgcttgtaatttttaaaatggtggggca

SEQ ID NO: 59794 - DNA, 89 bp, Mus musculus
cttccttaatataaggctcttttgggaagggtcccttgatcagccaccccagtctgactcactctttcctcaccttaatgaagcagaag

SEQ ID NO: 59795 - DNA, 69 bp, Mus musculus
tcttacagtctcagtgagtcaaacaaggcagggtattcagtctgctttctaggctcatagtgatgaaga

SEQ ID NO: 59796 - DNA, 96 bp, Mus musculus
ttggctggggatgtactcagtggcagagtatatgctgaaacacacagacacacacatgcatgcatgctctagactctgggttaatccctagcacaa

SEQ ID NO: 59797 - DNA, 79 bp, Mus musculus
agtgcttgctgacaggcgcctgataaagctgtttcctgagaggctctgtcagtgcctgacaaatatagaggtggatgct

SEQ ID NO: 59798 - DNA, 86 bp, Mus musculus
ccattgttccaagtccctattggaggacagagtcaagtgaacatgtttcttgttcctactctctctctttctgactggcttgatgg

SEQ ID NO: 59799 - DNA, 59 bp, Mus musculus
actgagaatgagaccacctagggtggagccttccgacctagatggttctattcttctgt

SEQ ID NO: 59800 - DNA, 97 bp, Mus musculus
gggtgccctctgctgtgtgagctgtgttaactgtgagttgtgtgtgagctgtgagctttgtattgcagacaggaaaagctgcatgtgggataagctt

SEQ ID NO: 59801 - DNA, 74 bp, Mus musculus
gcaacaagcttctaggatagagcactagagagagtgctatccattgctggtggtctgtctgtctgtctgtctgt

SEQ ID NO: 59802 - DNA, 85 bp, Mus musculus; identical to SEQ ID NO: 57470

SEQ ID NO: 59803 - DNA, 107 bp, Mus musculus
ctgtgtctcggtgtccctgtcgccttgtgtcacccatggataacccccttttgtttttaattttaatatcattgttacatcatggtctctgggacacgtctccacag

SEQ ID NO: 59804 - DNA, 70 bp, Mus musculus
tctgggggagctgccgctggtctgcttggtgtatttgttgtaaggagaacattctgaaagcttcttcaga

SEQ ID NO: 59805 - DNA, 85 bp, Mus musculus; identical to SEQ ID NO: 57439

SEQ ID NO: 59806 - DNA, 86 bp, Mus musculus
ctgcatctgtaatttcatgtttcttgagattgtgttcttgtgtgaatgtactttatgcgaaagggttgagattactggaagagcag

SEQ ID NO: 59807 - DNA, 75 bp, Mus musculus
tgcatgtgtgcctctgtgtgtgtgtcttccatagcttgcgtatatggaagtcagaggacaacttgcagtagccat

SEQ ID NO: 59808 - DNA, 63 bp, Mus musculus
aggcacgtctttgcttgcatgcatgtatctatgtattatgtatgtatgtatgtatgactgtct

SEQ ID NO: 59809 - DNA, 91 bp, Mus musculus
cttactagatcaccagacttgagggagcagggttcatttgcttctgaccagtgcttctgtgttccttcctgtcttaaatatcttgagtaag

SEQ ID NO: 59810 - DNA, 68 bp, Mus musculus
tgtgtgtgtgtgtatatatatatgtacatttctatatcggtgtgcatatatatgtatgtatacatata

SEQ ID NO: 59811 - DNA, 79 bp, Mus musculus
acttctgttagtttcactgtgtctctgtttagtttctgtttccaggatctgtccattgatgagagtggggagttgaagt

SEQ ID NO: 59812 - DNA, 77 bp, Mus musculus
tgatattgaccagctgcagataaaatggaactgtctcataattctaatgggactgtccctctctgtgtcccttatca

SEQ ID NO: 59813 - DNA, 67 bp, Mus musculus
gctgactgattctctcagtgtgttgccagggctgctgggtaactgaacagtgagaatgaatgtgagc

SEQ ID NO: 59814 - DNA, 60 bp, Mus musculus
ctgaccattggctcggtgatgcctgggctggcctcacacctcagactctgagtctgtcag

SEQ ID NO: 59815 - DNA, 71 bp, Mus musculus
atgctagaagtgagtcaggtgagtgagttctcagtgaatcgctgctcctggttctacacgttgttcagcat

SEQ ID NO: 59816 - DNA, 101 bp, Mus musculus
ggcaagcgagctgctgaacactgtcccctcatcttgttgcttctagggttagccaaggaacttataggttgattagcacagtggaatggaggtttcatgct

SEQ ID NO: 59817 - DNA, 123 bp, Mus musculus
ccacatgtacataccaccccacagtcccacccacatacatgcaataaaaaataatgagctaagttaagatgtttcttgttttttacttcatggactggagagatggttcagtggttaagagca

SEQ ID NO: 59818 - DNA, 115 bp, Mus musculus
ttcttccttttgttatcaagctgtatccacaggttgcttccaacatttatatatttgttgtagaaggttgtttgcaacatacatatacattactctgggtcagaagcatgaagag

SEQ ID NO: 59819 - DNA, 57 bp, Mus musculus
agttagggtagaatttatgggtaggtcttacagcctacagacagattctccttcact

SEQ ID NO: 59820 - DNA, 65 bp, Mus musculus
tctgactgtgtgtctctggctgtcctggaactccctctgtagaccaggctagcctcagactcaga

SEQ ID NO: 59821 - DNA, 108 bp, Mus musculus
gggctgctctgttagtatttagtatgagcttgcggtcatttgtttacatagttttctgattatgtttttctgaactcaaactgtaagactccgaccttcagtcagtcc

SEQ ID NO: 59822 - DNA, 80 bp, Mus musculus
atattagcgcaggccacagggccctcaggctttgctttgagaacctatctaaacgtgtctggcactgtgtctggcagtat

SEQ ID NO: 59823 - DNA, 112 bp, Mus musculus
atgaagcacagtacttcactctacagaattgcttactattaaatgtactactcaaatgtacttacattaattatgcgataggctatttgttaaggaagaatactaaattcat

SEQ ID NO: 59824 - DNA, 109 bp, Mus musculus
gaaagccataacatccacactggagccttaaaaacagggactgaagtgatttggttgttttaaaatcattttctcagtgtttgaggtctcttcacttgggactgatttc

SEQ ID NO: 59825 - DNA, 87 bp, Mus musculus
cacaaaggcaaacatgacttctgaccctgtaagtgagctacatggatgtaaactttactgcacgtgtcagaattcttttgcattgtg

SEQ ID NO: 59826 - DNA, 94 bp, Mus musculus
ttttcagtctaaagactttttgcttcaggcaatattgttcctaatgcattgtgagtaatattgttgttcagaaagctaaattctgttctgagaa

SEQ ID NO: 59827 - DNA, 66 bp, Mus musculus
gtacatgtatatgtgcatgttcatgtgtatacaccagtgcatatgtgtaggtacacatgtatgtac

SEQ ID NO: 59828 - DNA, 67 bp, Mus musculus
gcacgcatgtgtgtctgtgtctctatgtgtctgtatgtgcatatatgtgcatgcatgtcgtgtgtgt

SEQ ID NO: 59829 - DNA, 95 bp, Mus musculus
gctgtcactctcattcacactctgggtttaagttgcagacatggaaggaaatgttactgtttcttattttttagatacacgaagatgaagaccgc

SEQ ID NO: 59830 - DNA, 85 bp, Mus musculus; identical to SEQ ID NO: 57439

SEQ ID NO: 59831 - DNA, 72 bp, Mus musculus
gagaatttggaaatgtcctgatggctgctagtgtgtgcacctgccacactctgtcactggatatcagtgctt

SEQ ID NO: 59832 - DNA, 86 bp, Mus musculus
caagaaggaaacccagtctctctgtctcttgaagggcatgacccacccagtcaggtgattgcaataggagcgtctgtttctttttg

SEQ ID NO: 59833 - DNA, 80 bp, Mus musculus
ggcataaaaatatatgctatgactatcagtaattttttacataataatgtaaatgatacatggatatgtatttctgtgct

SEQ ID NO: 59834 - DNA, 107 bp, Mus musculus
gactgatactctttaaggtttctctcttccattcagtatttattattataattcatgaaggtagacaaagattggtttggggagggacctgggtttaaaagatagtt

SEQ ID NO: 59835 - DNA, 85 bp, Mus musculus; identical to SEQ ID NO: 57439

SEQ ID NO: 59836 - DNA, 91 bp, Mus musculus
cataccaagcgctgttagagtgtatatatgtatactgtacacattatatatgcatgtatatatatataacatgtaatatatgtttggttcg

SEQ ID NO: 59837 - DNA, 95 bp, Mus musculus
tccttgggagctcataactatatatgtatgtaaatttaggccgcattctgaattttcaaatattaattagtgcttcatgctaaactatacgagga

SEQ ID NO: 59838 - DNA, 113 bp, Mus musculus
caacatgagagacatctgaactgcagtttaaaggtacatttctcttaattaaaattttaaattatgtaatacagatttgtgccctaacttgtgtgggtggaggttcacagttg

SEQ ID NO: 59839 - DNA, 86 bp, Mus musculus
acttctctgtctgtcatttttgtaatgtcctagaaaagagcctctcactgagtctcacaggtgatgtaatagtgagcagcagaagt

SEQ ID NO: 59840 - DNA, 94 bp, Mus musculus
tatgtatatgtatatgtatatgtatatgtatatgtatatacttttatatatacttatatatactttaatatatactcatatatatgcatatata

SEQ ID NO: 59841 - DNA, 71 bp, Mus musculus
tcagcagatgtgattttgtagagctatgtaaattactctggcctccagaagtgactcagaatgtctgctgg

SEQ ID NO: 59842 - DNA, 108 bp, Mus musculus
tgaactgcttccagtgtgcaggcagacttcgcagacacaaactctcagtctcaggtaaacatgtgactcattggtttgtttgtgcttgcttgtaattcagtcaattca

SEQ ID NO: 59843 - DNA, 119 bp, Mus musculus
gacattgagtgtctcccttcatggctctcaccttgttttctgagacagcatctctcactgagtctggagctcactgatcagctaagatgaagggccacacgctgaggcctctgcctgtc

SEQ ID NO: 59844 - DNA, 91 bp, Mus musculus
ggtatcgaaaacatctactaggctgaactgtagggtgcagactgctgtagctgcagtgtgtcagctcactggtctaggaggaggagatgcc

SEQ ID NO: 59845 - DNA, 64 bp, Mus musculus
gttttgacactagtgcaagtgataatgggctgtgactcagtgtgtcaaagcgctcactcaaggc

SEQ ID NO: 59846 - DNA, 92 bp, Mus musculus
gttctgaaaagccctggggtggcaggcagtcggccctggagtcaaacaatcctgcttcggtcactctgcctgagtcactgactgttcataat

SEQ ID NO: 59847 - DNA, 92 bp, Mus musculus
taatcatctccctctcagtgtctttctctctgcggcttgtcagtgagtccggctctggcttctggcagaggcagccgcgaggggagaggttg

SEQ ID NO: 59848 - DNA, 84 bp, Mus musculus
cagcatttacccccagcctctctggctctcagaggcacttccaaaagtgcgctgcctcttttagagcgctgaaagtttgtgctg

SEQ ID NO: 59849 - DNA, 79 bp, Mus musculus
ctttaagggctatgtgaatagtcattttcttgtttagggagtagtaataaggaaaagagttatcacgtggtaggtatag

SEQ ID NO: 59850 - DNA, 73 bp, Mus musculus
tgctctctgtgagaactcagtgtgcccatcactgttactgtagatgggtactctaggaggctccttaattgca

SEQ ID NO: 59851 - DNA, 122 bp, Mus musculus
tcccattcttcttaatgtctacagattttgtagttctgatatagtttttatttcattatatatatataatgaaagagtggggtggaatctacaattctggctctgatgaggctgaggaagaa

SEQ ID NO: 59852 - DNA, 75 bp, Mus musculus
gcttagagaagaggcagaggtcagagcacagactgggtagagtcaatgtcaagttcactgctttttctgatacgc

SEQ ID NO: 59853 - DNA, 110 bp, Mus musculus
ttgaagatcagccttaatttatcatgatctgataggatgcatgcactaatttcaatatttttgtatctgttgaggcctgttttgtgatcaattatatggtcaatttttga

SEQ ID NO: 59854 - DNA, 108 bp, Mus musculus
gtatgtgtttatatatgtatgtgtgtatgtgtgcatatatgtatgtatatatgtgtgtatgtgtgtatgtatgtgtgtacgtatgtatgtacgtatgtatgtgtgtat

SEQ ID NO: 59855 - DNA, 77 bp, Mus musculus
tccagttgtctgtcagtgtctgtcagtgtcaagtatggacttgtgttgaggtatatggaccagaaatgatagctgga

SEQ ID NO: 59856 - DNA, 82 bp, Mus musculus
tcctgtgtgtgtctgtttgtcactcattcatccacgctttgcccacccgtgactagagacccgttccacacagacacaggga

SEQ ID NO: 59857 - DNA, 105 bp, Mus musculus
tgccagctatatctgtgtatatctctgtgtgtgtgtatatatatatatatatatatatatatatatatatatacattcagaatatatattcagaatcaacaggta

SEQ ID NO: 59858 - DNA, 100 bp, Mus musculus
gagtagagacaaagaaggaattagcactggttatatgtatatgtatgtgcatatatatatatgttatatgaatctatgctagctcctgtgttgtatgctt

SEQ ID NO: 59859 - DNA, 103 bp, Mus musculus
catagttattgtaaagggttctcttttctgaatttctttctcaaaccattttattgtttatataaaggagggggaagtttctgatgactttgaggtaactttg

SEQ ID NO: 59860 - DNA, 107 bp, Mus musculus
tctgggaggctggccccatccatttctactctgcctctctctcactctgaataatccttaagagtctgattggtgcattgtggcctttcaagccagcggcttcctga

SEQ ID NO: 59861 - DNA, 71 bp, Mus musculus
gcttctgttgtaagaagacagttgtctgcgtccagccatctccaggacaactccatcttactagcagagtc

SEQ ID NO: 59862 - DNA, 96 bp, Mus musculus
tctgttttattgatttcaaccagcagtttgaatatttcttgatcacttcttttggtctagagctttcagctgtattgttaagttggtagtttgtga

SEQ ID NO: 59863 - DNA, 101 bp, Mus musculus
ctgaacttgagctaaaactgtaatctgtaaactctggcagaggaagagtacagttttagctcaagttcagcgatgtggttaaaagcactgactgctcttcc

SEQ ID NO: 59864 - DNA, 96 bp, Mus musculus
tctggatattccccccttctccatcctctctcctctctctctctcactgggtttaactagagttataggagcatgagtgaggggctgtattacaga

SEQ ID NO: 59865 - DNA, 61 bp, Mus musculus
ctctgtctgcctctccgtctctgtctatgtgtgtgtggggggagggtgggggagctaagag

SEQ ID NO: 59866 - DNA, 72 bp, Mus musculus
ccagtagctggtgagtgttgcaactgtcatggattccacagtgccctagactgtctcactcactgcctatgg

SEQ ID NO: 59867 - DNA, 85 bp, Mus musculus
ttagctgccttgtcaaagatcaagtgtgtgattcataggtgtgtggattcatctctgggtcttcaattctgttccaaaaagctga

SEQ ID NO: 59868 - DNA, 78 bp, Mus musculus
gcccattaaaactaaacaaggaagttgtatttcctggaaactggaattacatttgtgagctgccatgtgggtgctggg

SEQ ID NO: 59869 - DNA, 121 bp, Mus musculus
gtgaacagaaagctagacttgtgggctggagacatctcttagcggttaagagcactgactgctcttccagaggccctgagttcaaatcccagcaaccacatggtggctcacaaccatctgt

SEQ ID NO: 59870 - DNA, 89 bp, Mus musculus
ctggtgacagtgagcagtctgctacaggttttcttatgtaaaggacaatgattacagtgaggaacagagcagtagtacctggttatcag

SEQ ID NO: 59871 - DNA, 90 bp, Mus musculus
gataatagtgcaatgcacttggaagagttttaaataaaaagatcttagaggtcagttggctctctctgtggaaaacaatgtactgtgatc

SEQ ID NO: 59872 - DNA, 105 bp, Mus musculus
atgatatgggcagaaacctcaaccaagttgtactgtcaacaaaaataatattttgttgttcttttaatgccagaacagattgtgtgtgtgtgtgtgtgtgtgcgt

SEQ ID NO: 59873 - DNA, 79 bp, Mus musculus
ggatttctcctgtaggggcagagagaattaacaagacgtctctcaatttctctctgtccctggtcgagttccaaaatcc

SEQ ID NO: 59874 - DNA, 78 bp, Mus musculus
gtgcgtgtgcacatgtgtgctcacacgcttatatatgtatgtatgtatgtatgtatgtatgtatgtgcatgtatgcat

SEQ ID NO: 59875 - DNA, 149 bp, Mus musculus
tgttcaaatcgctttgttttgctttggcggctgagaggtcccagtccctctgtgaagacagacagacagacagacagacagacagacagacagagagaacacttgcaagttttttagaggaagtattttctcctctgctgccgcttctg

SEQ ID NO: 59876 - DNA, 75 bp, Mus musculus
cagaagcggcagcagaggagaaaatacttcctctaaaaaacttgcaagtgttctctctgtctgtctgtctgtctg

SEQ ID NO: 59877 - DNA, 88 bp, Mus musculus
tactggttcctcaagacctggttgccccagagacaagagagtctgcatgtagacctatgttatcttgcccccaagtttctgattggtg

SEQ ID NO: 59878 - DNA, 75 bp, Mus musculus
tgcttccaaagcaaacaggggcatgtctatgtctgtctctctggatgtatgtgtgcctgtctgtctctttgtgta

SEQ ID NO: 59879 - DNA, 70 bp, Mus musculus
ggatcaggtggcgtgggaagagctctgtcctcattggtcagctctgctcctctgtcagactgtctcatcc

SEQ ID NO: 59880 - DNA, 66 bp, Mus musculus
gaaacactctctctctcagtgagctttggagaatttcccaccttatggagagagaggccgtctttc

SEQ ID NO: 59881 - DNA, 69 bp, Mus musculus
atactgataatatatatatatgtgtgtgtatatatatacacatatgagtgtgtgtgtatatgtctgtgt

SEQ ID NO: 59882 - DNA, 102 bp, Mus musculus
atgagacttgatgtatattcatgcacacacgtgtgtgtttgcacacactcacacactcacttacacatactcatatgcatatgtatactcaaacacactcat

SEQ ID NO: 59883 - DNA, 71 bp, Mus musculus
gcacatcacattttaaaaaatatatatgtatgtatgtgtgtttatataaacgtatatatatgtgtgtgtgt

SEQ ID NO: 59884 - DNA, 62 bp, Mus musculus
ggagagagagtacacagcctgctgtctgaggagccaggccttacgttttgggttttctctcc

SEQ ID NO: 59885 - DNA, 108 bp, Mus musculus
ctgaatccaccattacccacgctgtattcctctgagccactctgtctaagtaaaagacaccagtagttaaaaagacaacactcagagcacaaatgggtaggaaaacag

SEQ ID NO: 59886 - DNA, 64 bp, Mus musculus
tacatacacaaatatatatgtatatgtgtatatatgcatatatgtatgtatgtgtgtgtgtgta

SEQ ID NO: 59887 - DNA, 87 bp, Mus musculus
atgataacatgacatacaatgtaacatgatatatgtattatacactatattacatatttgtactacagatatgttatgcactattat

SEQ ID NO: 59888 - DNA, 101 bp, Mus musculus
gtgatgtcgaatgggctggtgagatggctcagcggttaagagcactgactgctcttccaaaggtcctgagttcaaatctcagcaaccacatggtggctcac

SEQ ID NO: 59889 - DNA, 91 bp, Mus musculus
tgtataatatatatctacatataaactcgtattatatacatatatgacatatgtatgtatgtatgtatgtatgtatgtatgtatgtataca

SEQ ID NO: 59890 - DNA, 85 bp, Mus musculus
gaaaagagatatatgagtgtgtattcatgaatttgtatatgaatttatgtgagtttatgcatatttgcttgtgtaaaagtttttc

SEQ ID NO: 59891 - DNA, 74 bp, Mus musculus
cactcagtagagacagagaacatggaaggttagagaagccctagtctataccctgaccattgctgaactgagtg

SEQ ID NO: 59892 - DNA, 86 bp, Mus musculus
gcctacatccatctctcactggatcagagatccatgacaaagtataaaactttgtgtctcattctgtctgatctgtgatgtacggt

SEQ ID NO: 59893 - DNA, 84 bp, Mus musculus
tgggtctgtcctgagttctctgactgcacagtgctggcagaactcagtcagcacatcgcagatcaccccagaatgatggtctca

SEQ ID NO: 59894 - DNA, 85 bp, Mus musculus
agctggaagttagttgtattctaatgagatcatttcagaagcgagttactgaaagaattagaatataactgaagcacttttggtt

SEQ ID NO: 59895 - DNA, 99 bp, Mus musculus
gaattacttctggagctggagagatggctcagcggttaagagcactgactgctcttacagaggtcctgagcttaattcccaggaaccacatagtggctc

SEQ ID NO: 59896 - DNA, 94 bp, Mus musculus
ccatttctgtttaatttacttctctacagttctctgtgacagacatgtgagtgtggacacatgtatagagagtccagaggttgacatctggtgg

SEQ ID NO: 59897 - DNA, 101 bp, Mus musculus
acacacacacacacacacacacacacacacacacaaaagttctgttttttttttttaacaacttatgtgtatgtatctgagcatgtgcttgtggactgtgt

SEQ ID NO: 59898 - DNA, 106 bp, Mus musculus
gggagggagagtccaatgggaagtgttagttcatgaggattctttgtgcgtattttaatgacacaacagaaagagctgatgctggccagagtgggctcactctctt

SEQ ID NO: 59899 - DNA, 116 bp, Mus musculus
gaccataccatatatgcagaggacctagctcaggcccatgcaggcttggtgattgtcacttcagtctctgtgaacccctatgagccctgcttagttggttctgtggctatgttttc

SEQ ID NO: 59900 - DNA, 85 bp, Mus musculus; identical to SEQ ID NO: 57439

SEQ ID NO: 59901 - DNA, 65 bp, Mus musculus
actgactgtcagtcagtccagcgctggtgctttgctccacccatgcgcactgactgtcagtcagt

SEQ ID NO: 59902 - DNA, 119 bp, Mus musculus
tgggacaagcaggggagctgagaggagaggaagcactgaggaagcagacagacagacagacagacagacagacagacagacgcattcggtgctcagcatgtttttaccttcacattcca

SEQ ID NO: 59903 - DNA, 77 bp, Mus musculus
caggcactgtatctggctgcctcagtctgactctgctccaaagtcgctgctcttgtaggcaggtagatgagagtttg

SEQ ID NO: 59904 - DNA, 107 bp, Mus musculus
cactcagaccttggggagagggatcagtatccagcagaacagatggtccctctgacacattttgtttttctgatttcccagtgaccttcaacacaaggtaatgattg

SEQ ID NO: 59905 - DNA, 64 bp, Mus musculus
ggatccctgagggtagagatggcaaaacccatggatgtctgactctctttctctgggtacatcc

SEQ ID NO: 59906 - DNA, 108 bp, Mus musculus
tgattcatctctcagaggtttagagcaaaatatggtggaaatgcttggagaatcacacccactctcacccagtcccatcaccatcatctgctcccaattctgtaatca

SEQ ID NO: 59907 - DNA, 106 bp, Mus musculus
gcttattattattgatagtatcttcatcttcatcatcatcatcatcatctggtggcttcctacaccgactggtgtgaggtgggatctcagggttgttttgatttgc

SEQ ID NO: 59908 - DNA, 115 bp, Mus musculus
tgatcttagaagaccatgcatataacctgggagggagagagattcagacttactctctatgtctcctgattttgtctcccattgaaacccaactggtatctggtcaagggagtca

SEQ ID NO: 59909 - DNA, 87 bp, Mus musculus
gttctttctataaagaaatttcttcagatgtataaacaggcaatcacattgtaagttttatctgattatttttctctgtgggagaat

SEQ ID NO: 59910 - DNA, 132 bp, Mus musculus
ttagttaatgtctcttgagacatgatcgttctgtgtcctgtaagttctagccttctcctctctctctgtggcactggggatagtgcattaaactcaaggccgaccacatgctaggtgagctttctgctacag

SEQ ID NO: 59911 - DNA, 106 bp, Mus musculus
ttgttgccagtagcttaaacacagcgttaggcacatagtaaggcattttttttttttaaagcaaggtttacttgtacttgagcaagtgaagaagaatggaaaacaa

SEQ ID NO: 59912 - DNA, 85 bp, Mus musculus; identical to SEQ ID NO: 57439

SEQ ID NO: 59913 - DNA, 85 bp, Mus musculus; identical to SEQ ID NO: 57470

SEQ ID NO: 59914 - DNA, 80 bp, Mus musculus
agtccagggacactcagttggggctctcatcctttatgccttctcagtggctgagtctctcgggctccctgtagtttcct

SEQ ID NO: 59915 - DNA, 73 bp, Mus musculus
tagatggataatggtgggttcaaggtgtgtgtgtgtgtatctgtgtacgtgtgcctgtgtctgtgtctctctg

SEQ ID NO: 59916 - DNA, 100 bp, Mus musculus
tggaaagagcaagtttattgaataactacttatttaatatttcctttttgggggcaagtatttctatatttgtttagcattaataaactcattttatcca

SEQ ID NO: 59917 - DNA, 66 bp, Mus musculus
ctgtgctgtgcattataccagccactgactctctcacagttcctttgttagttttgcatagcacag

SEQ ID NO: 59918 - DNA, 85 bp, Mus musculus; identical to SEQ ID NO: 57439

SEQ ID NO: 59919 - DNA, 98 bp, Mus musculus
gacaagcaaactgagagtaacctgagtctactcctgagtctgttagccagggctgactggcagactgactgcatgaagtgtgggtgcttcagtgtgtc

SEQ ID NO: 59920 - DNA, 95 bp, Mus musculus
ggagctttggctgtactgtaatgactttgcatttctttctgtaactacacttccattgggatgcatagttaaccttattaaagtatacttgtttc

SEQ ID NO: 59921 - DNA, 88 bp, Mus musculus
gcagactgccccctgacagctattctctgagaatcactctatgtcttttgaagcagaggaatgtccttcagctgcagatgtactttgc

SEQ ID NO: 59922 - DNA, 85 bp, Mus musculus; identical to SEQ ID NO: 57470

SEQ ID NO: 59923 - DNA, 87 bp, Mus musculus
gaaactgcacaacactgtgtgcttcaagttctttttataattataagtctcagagctttccaagacatattgtttgtgctcagttgc

SEQ ID NO: 59924 - DNA, 67 bp, Mus musculus
agttaatagagtgacagagttacatctccagacagtagtcacatgtgtgtctgtcattcaattaatt

SEQ ID NO: 59925 - DNA, 85 bp, Mus musculus; identical to SEQ ID NO: 57439

SEQ ID NO: 59926 - DNA, 78 bp, Mus musculus
ggggtagagagggagcagtctggggtctctgggcctcacaaaggccagagatgacagggtctcagtctcagacattcc

SEQ ID NO: 59927 - DNA, 110 bp, Mus musculus
tgtatgtatgtatgcatgtatatgtataggtgtatgtgtatatatgtatgtatgtgaatatatatatgtgtatatatatgtgtatatatatatatatatatatatatata

SEQ ID NO: 59928 - DNA, 102 bp, Mus musculus
atgtatatgtatatgtatatgatgtatatgatgtatatgtatctatatatgcatatatatgtatacatatacatatatatatatatatgcacacatatacat

SEQ ID NO: 59929 - DNA, 111 bp, Mus musculus
gctttaatttccttggactgtggtgatgcttttgacacttattttttcaaatcatatgaaatattatatatgtctctgtaagtatccatccaggcctatgtgaatatatgt

SEQ ID NO: 59930 - DNA, 84 bp, Mus musculus
gttgtgaggtgcatcccagctcccacttgtgtcaactccttgagggggttgccagaagagagagagcacatgtgttccagcagc

SEQ ID NO: 59931 - DNA, 86 bp, Mus musculus
ggcatatggaaagcattctgtgcctctgtgtgtgtgcacgcacgcatgtgtgtgcacacgcaagtgtgcatgtgtgtttgtatgcc

SEQ ID NO: 59932 - DNA, 94 bp, Mus musculus
tcttcctggatcatgccctcactgacagagtcacactttctgttgtctcaacagaattggcttgtgggcccgtgattttatctcacaatgaaga

SEQ ID NO: 59933 - DNA, 85 bp, Mus musculus; identical to SEQ ID NO: 57470

SEQ ID NO: 59934 - DNA, 74 bp, Mus musculus
atatatatatatatacatatgtatatatgtatatatgtgtgtatgtatatatgtgtgtgtatgtatatatgtgt

SEQ ID NO: 59935 - DNA, 106 bp, Mus musculus
gtgtatgtatgtatgtatgtatgtatgtatcatgtgtgtgtttgtatgatgtatatatgcatgagtctgtgtatatatgtgtgtacatgtatatgtgtgtgtgtcc

SEQ ID NO: 59936 - DNA, 77 bp, Mus musculus
ggtttttgagacagtctcactgtgtgttgcaggcttgcctcaaactcatggtaattcttcagtctgtcttgagcact

SEQ ID NO: 59937 - DNA, 65 bp, Mus musculus
aggaaagaatggtaacagaagagactgagtcctttcaagtttgcttttgtatcatttacttttct

SEQ ID NO: 59938 - DNA, 112 bp, Mus musculus
gccttacctttgggacatggtgaagtttcaggtctggacagcaagtgtctgacattctcactggttttcatttgctccaaggcctaccactatggtgtctacaagaccctgc

SEQ ID NO: 59939 - DNA, 89 bp, Mus musculus
agactgtaatgtattcttttctgaggtacatttatggagtcacatgactaagcaaatggtatgtattccagtaaaggttattattttct

SEQ ID NO: 59940 - DNA, 87 bp, Mus musculus
taattggcagaataagcctgcccattgtgtacagtctggagatttgccgaatgcagacgttgtaggttgcttatatctagctaatta

SEQ ID NO: 59941 - DNA, 80 bp, Mus musculus
ggcatttgcctctctttgtttgttttgaaacatgctagttctcacactctcagtttatcagactcccagggaggctggct

SEQ ID NO: 59942 - DNA, 72 bp, Mus musculus
gtgtatatatatgtgtatgtatgtatatatatgtgcacatatatgtttatatatgtgtgtatgtatgtatcc

SEQ ID NO: 59943 - DNA, 71 bp, Mus musculus
gcagagaacagagaattcacaagtagctcgagtgcgcatttgttgtgcaactcagactctctctctctagc

SEQ ID NO: 59944 - DNA, 85 bp, Mus musculus
ggaagctgccaccttcccatgtcactgtcactctctgtttatggacagttcactagaatagcagtggatgggaatgaagagctcc

SEQ ID NO: 59945 - DNA, 71 bp, Mus musculus
gtctgttgaactgaggctcacaattagctcaggacatgggttgacacacagtcagtcctcagtgagcagat

SEQ ID NO: 59946 - DNA, 77 bp, Mus musculus
ctcttcctagccttgtctcttcactccctgtctgcagtcacagtaggggcagcagagggatcaagcctgggcaagag

SEQ ID NO: 59947 - DNA, 59 bp, Mus musculus
gtgaagtgaacagagagaagagtgacagccctgttatcttagcacctctgttcttttgc

SEQ ID NO: 59948 - DNA, 72 bp, Mus musculus
tccatccatctatctatctatctatctatctatctatctgcctagatagatagatagtacatgtgtttgtga

SEQ ID NO: 59949 - DNA, 81 bp, Mus musculus
catgtacagcagcaacgtctgcctgtcttctgatgaaaggcaccttcgtgagaagatcgcatagtggagggcgagtaagtg

SEQ ID NO: 59950 - DNA, 63 bp, Mus musculus
gttgaatatatgtatatatgtatgtatgtatatatatacatatatatacatatgtatacatac

SEQ ID NO: 59951 - DNA, 85 bp, Mus musculus; identical to SEQ ID NO: 57470

SEQ ID NO: 59952 - DNA, 65 bp, Mus musculus
ctcggggcaatcccagggacagagatgactggcaccaccttactctgactgggactgtcactgag

SEQ ID NO: 59953 - DNA, 63 bp, Mus musculus
gcagcttggtcttcatgagggtcccctaacaattggaacaggggctgtctctgactctgttgc

SEQ ID NO: 59954 - DNA, 77 bp, Mus musculus
actagggctttaatagtgattaaccaggacagctgtcctgcaagctccaggaatctgtctgtctctgcctccctagt

SEQ ID NO: 59955 - DNA, 85 bp, Mus musculus
ttcagggacaatggactttttgtgttttcaagacagggtctctctttgtcacaggctgtcagagggctccagagatcctcctgaa

SEQ ID NO: 59956 - DNA, 103 bp, Mus musculus
gtgaatggtgatgggctggagagatgactcagtgtggttaagagcactgactgctcttccagaggtcctgagttcaattcccagcaaccacatggtggctcac

SEQ ID NO: 59957 - DNA, 56 bp, Mus musculus
gtcctagctagcagtgatttgggggtgcagacttctgtcactgtatctggctggac

SEQ ID NO: 59958 - DNA, 139 bp, Mus musculus
gctccaattttatatatatatatgtgtatatatatatacacatatatatatatatgtgtgtgtgtgtgttgtgtgtgtatatacacacacatatacatatgtgtatatatatatacatgtgtgtatatatatatatata

SEQ ID NO: 59959 - DNA, 59 bp, Mus musculus
ccagaatgctgtgattttgtttttctctcttgagatcaagtggaatcagagcctaatgg

SEQ ID NO: 59960 - DNA, 154 bp, Mus musculus
gtgtgtgtgtgtcattatgtatgtatatatgtatatgtgtgtgtatctgggtgtatgtatatatgtgtgtatatatatatatatatatatatatatatacacacacacacacacacacataaacacacgcacatatatacatacatatatacat

SEQ ID NO: 59961 - DNA, 90 bp, Mus musculus
gtttacttaacatatgtgggtgtctttcatgtatgtatgtatgtatgtatgtatgtatgtatgggcaccacttatgtacctggtacctgc

SEQ ID NO: 59962 - DNA, 83 bp, Mus musculus
tagaaatcattcatatatgtatgtatatatgtgtgtgtgtatatacatatatatatacacacacacacatatatatatttcta

SEQ ID NO: 59963 - DNA, 107 bp, Mus musculus
agacactgcatattcatgctggtaggcgttgtctcatagactctctcacattcatgagcatgttcagtaggagtcgttgaataagctttctcatgaatcacatgttt

SEQ ID NO: 59964 - DNA, 109 bp, Mus musculus
caccccctacaaacaaaggttgctgcgtgggaagctgtaggctgctggcacacacagtctgtctagtagctacactctgtcaaataatctgtgtgggaattctcaggtg

SEQ ID NO: 59965 - DNA, 82 bp, Mus musculus
tatgtatatatacatgtatgtatttatgtatacacatacatattttacatagtatatataaatacacatgtatgtatatata

SEQ ID NO: 59966 - DNA, 119 bp, Mus musculus
taagacaaagcttcctccactgagtggctggatgaaagcgaagtggggggctctggtgtgactgcaggcttcatttcccacttaaattcatccccattaatctggatgaaacttactta

SEQ ID NO: 59967 - DNA, 68 bp, Mus musculus
atatataaaaactcactcatatacatatgtgtatatatatacatatatgtatatatgcatttatgtat

SEQ ID NO: 59968 - DNA, 85 bp, Mus musculus
gtcagaggggtgtcagttgacaggtcttgtctcacaccctcagtgtctgtgaagctgggatggccatctgattccttatcttgat

SEQ ID NO: 59969 - DNA, 61 bp, Mus musculus
gggtttgctgagtctctgtctctgcttgatgcaatggagagaaatcagggcatagaaacct

SEQ ID NO: 59970 - DNA, 93 bp, Mus musculus
gcagcccagtaatccgtgaatgcgcactctagcaacgatgccgatttcttatctctgcgtgcttatgcaatctatgaaaaagttgctgcctgc

SEQ ID NO: 59971 - DNA, 80 bp, Mus musculus
tggcctccaggtgtcagtcaggctttaggggttggcaggtctggaagctactgttgcacttgtgccggccactatgagcc

SEQ ID NO: 59972 - DNA, 85 bp, Mus musculus; identical to SEQ ID NO: 57439

SEQ ID NO: 59973 - DNA, 72 bp, Mus musculus
tggagtaccacatgccctggattgactagacaaataaatgtattttttatctatgcatgttgtggtgcttca

SEQ ID NO: 59974 - DNA, 85 bp, Mus musculus; identical to SEQ ID NO: 57439

SEQ ID NO: 59975 - DNA, 101 bp, Mus musculus
gtggctggttgtctggagctgaagatggtgccgccccagaatctctgtgactctctcacccgtcccagaaacggctggcactctgtattccacacggtcac

SEQ ID NO: 59976 - DNA, 66 bp, Mus musculus
gttacggttctctgtagtagtttctatctgctgaaaagagaagctgctttgaacagggagagtaat

SEQ ID NO: 59977 - DNA, 77 bp, Mus musculus
cctaagagacagtctcctgggagttatatttgagcatggagttgttccaaatgcaacagtctctctttctcattagg

SEQ ID NO: 59978 - DNA, 73 bp, Mus musculus
ggtagactcacattctgctaggtggatgtcgagactgtggtgtgtcccataggccagcagaaaaccagctatc

SEQ ID NO: 59979 - DNA, 118 bp, Mus musculus
ctctgcaacatattaccatataattatataactatatgtatatatgtatgtatatatgtgtatatatacatatatacacacattcacacacatatttatataaatatgaactctagag

SEQ ID NO: 59980 - DNA, 74 bp, Mus musculus
aacatgcatgctgttggagtcagagctaccgctgtaactgtagctgcagctgtaactccaacagcaagtgagtt

SEQ ID NO: 59981 - DNA, 119 bp, Mus musculus
catatataataatatgtctatatattatatatgtatgtaagccatatatgtatacaatgtatatatgtgtgtaatatatatgtatataagccatatatatatgcatatatatgtgtatg

SEQ ID NO: 59982 - DNA, 84 bp, Mus musculus
tgctggctagattgaagactgctttgtccatacctagagaggttatgcaatttctgggcctgtcagtcattcagtccgtgggta

SEQ ID NO: 59983 - DNA, 112 bp, Mus musculus
tgatgacaaacttgactttgggggatacacgtgtgtatgtatgtatgtatgtatgcatgcatgtatgaattatatacatagatgtgtgcacgtcaaggcgccttttcactca

SEQ ID NO: 59984 - DNA, 96 bp, Mus musculus
tcctggagacccacatgtggtagtaaggaccagtgtgctagatatatatatattgttcaattcatagccacctccaggaccacaaatgaaccccca

SEQ ID NO: 59985 - DNA, 79 bp, Mus musculus
ctcgtgaaaagatgctggatatgctgacctgaaacagtctcagagtcacttatgtataaggggttccagggttctcggg

SEQ ID NO: 59986 - DNA, 113 bp, Mus musculus
aagattgacttctatgtgcataacacctacaccctcatccatgagtgtgcgtgcactcacacacagacacacacacatatggctggatcataaaagagcgttatcatattctt

SEQ ID NO: 59987 - DNA, 67 bp, Mus musculus
agcctgactgtgtcactgtgtcttacaggacttcctgaaacctcaaagcacaggtacacccgtggct

SEQ ID NO: 59988 - DNA, 98 bp, Mus musculus
tatatgtgtgtatatgtgtatgcatatatgtatatgtgtgtatgtatacatttatatacacacagtatatatatatatatatgcatattatatatata

SEQ ID NO: 59989 - DNA, 69 bp, Mus musculus
tatgcatatatatatatatatactgtgtgtatataaatgtatacatacacacatatacatatatgcata

SEQ ID NO: 59990 - DNA, 84 bp, Mus musculus
cagaggtcagtgtggttatattgactatgtcttataaatcacacttcattttatttttaagacaaagtttctttactgagcctg

SEQ ID NO: 59991 - DNA, 114 bp, Mus musculus
tctgtgtttctaaatatctcctttgcttctggggggtctttacacatacccaatggaagagttcacagaacttagtcagggaggtctgtggagttctacagagaagacaatggg

SEQ ID NO: 59992 - DNA, 146 bp, Mus musculus
tacctgtgtctgtgtatatgtacatatatacatatatatgtatgtatgtgtatatgtacatatatacatatatatgtatgtgtatatgtttatatatatgtgtgtgtatgaccatatatatatatatatatacacacacatatata

SEQ ID NO: 59993 - DNA, 59 bp, Mus musculus
atagatgtgtggattgatgtctgggtcattgattcaaatctgtcaatcagcgtgtctgt

SEQ ID NO: 59994 - DNA, 108 bp, Mus musculus
agcatattcaaatcactacaatatatgtgcatgtatatatatatatatatatatatatatatatatatatatatggtttaaattatatgttacttgaagtagtgtggc

SEQ ID NO: 59995 - DNA, 128 bp, Mus musculus
gctcactgagagtgcatgaggcctgctcactgagagcacctcagaagatggcagttaccctctgaagtgagtgaggtgagtgtctgttgggttaaccctaaacccagcactctctctcctagtgcact

SEQ ID NO: 59996 - DNA, 73 bp, Mus musculus
tcactggtggcgggccttgaggtttcaaaagcccacaccaggccctgtgtctctctctgcctgctgcctgtgg

SEQ ID NO: 59997 - DNA, 78 bp, Mus musculus
gcagctgtacgattcatgcttcgtgctcactcacaaggcctgctatagtgagcagatgaaaggaatgatgtatgctgt

SEQ ID NO: 59998 - DNA, 73 bp, Mus musculus
gggaggcacattgagggtaggctaagcataggaatctgggctcaggatctgacgctgtcactcacagctaacc

SEQ ID NO: 59999 - DNA, 90 bp, Mus musculus
tctcctcacgctttccagactctgtgtgtgtgtgcgcacaagcatggtacacacgtgtgtgcacgcacacccaactgtatgtgtgtatga

SEQ ID NO: 60000 - DNA, 220 bp, Mus musculus
gtgcacatgtgtatttatatggtatgtcagtatgtatatgtgtgtatgtgaccatatgtgtgtgtatatatatatgtgtgtgtgtgtatgcatatgcatgtaaataaatatgtgcatgtgtatgcatgtgtatgtgtgactgtatgtatttatatatgtgtgtgtgtgcgtgcatgtgcatgtaaatgtgtgcatgtgtgcatatgcatgtgtgtgcatg

SEQ ID NO: 60001 - DNA, 68 bp, Mus musculus
gcactgactgctcttccagaggtcctgtgaagtggaaacttagggtttttttggcgagtcagttgtgt

SEQ ID NO: 60002 - DNA, 106 bp, Mus musculus
gtgtatgtatatgtatatgtgtgtgtatgatatgtgatatatatatgtatatgtgtgtgggtgtatatatatgtgtgcgtatatatatgtgtgtgtgtgtgtgtat

SEQ ID NO: 60003 - DNA, 106 bp, Mus musculus
cgggtcttgccagggtgattcatggacagacaaatcaggaaacagagacaactgagtcatgtcatgcttgcttgttgtttgtttaaatccatctggttatgaagtg

SEQ ID NO: 60004 - DNA, 81 bp, Mus musculus
ggggggcctggattctgtatctatctctcagtgattccaaatttgggcaaagagaaaatagattttatttttgagtccttc

SEQ ID NO: 60005 - DNA, 68 bp, Mus musculus
ggcagagtcttgtggtagcaggatctttagatgaccaaccaagtttcttgccctctgcgatgaatgcc

SEQ ID NO: 60006 - DNA, 89 bp, Mus musculus
tatatacatatatgcatatgtttacatagattttacttatacaaatatatttatacatacatgtgcatatgtatgcatatatgtatgtg

SEQ ID NO: 60007 - DNA, 83 bp, Mus musculus
tgtatatatttgtgtgtatgtatatatgtgtgtatgtatgtttatatatacatacatacttacatgcctgctcagtctgtata

SEQ ID NO: 60008 - DNA, 86 bp, Mus musculus
ggaccttcttttcctcaggttcctctccatgattctttcagcagagcaattatgggtgagagatgtgactgtggaatggcaacccc

SEQ ID NO: 60009 - DNA, 97 bp, Mus musculus
cttgggtgaactttaagagaacaaagctaatgggagtggtatgtcactgtttgtgtgctgtggctcctgagtagttatgatggctttatcacaaaag

SEQ ID NO: 60010 - DNA, 84 bp, Mus musculus
agggttagaggcttgaacttcaacaactcaccgagctttcatgtccttagaaatcaaaacttggtggtgttggccttcagttct

SEQ ID NO: 60011 - DNA, 82 bp, Mus musculus
agtattaaatgaacacatgtacatgcatgtgtgtatccaagtattaaatgaacacatgtatgtacatgatttatgaaaaact

SEQ ID NO: 60012 - DNA, 60 bp, Mus musculus
gtgtattagcatgtgttaatatatatatgttagtgtatatgttagtctgtgttaatgtgt

SEQ ID NO: 60013 - DNA, 102 bp, Mus musculus
gcatgctccctggttggtggcccagtctttgtaagccccaattgtcccaggttaattgacactgtggttcttcttctggtgtcctcaaccccactgtcttgc

SEQ ID NO: 60014 - DNA, 71 bp, Mus musculus
tgagtttagggcactcttcttaaaaggcggggactcttgtctgtttctctgactggtaggccttacactca

SEQ ID NO: 60015 - DNA, 85 bp, Mus musculus; identical to SEQ ID NO: 58731

SEQ ID NO: 60016 - DNA, 85 bp, Mus musculus; identical to SEQ ID NO: 57470

SEQ ID NO: 60017 - DNA, 94 bp, Mus musculus
gtgtttgtatctgtctgcctgtctgcctgtctgtatgtaatatgatgtgtttgtgttaaaatgcatatggaagtcagaggacactatcaagtgt

SEQ ID NO: 60018 - DNA, 83 bp, Mus musculus
gtctctgtggtacagctgggtcttgaggtagtagattgattcccatcttcctgaggaactgccacgctgatttccctagtggc

SEQ ID NO: 60019 - DNA, 85 bp, Mus musculus
catgtatggaattatgtagcattttgtatatttgtgtacatatgtgtgtatgtatatgtgtataatatcttgcaggtttatcatg

SEQ ID NO: 60020 - DNA, 77 bp, Mus musculus
gtctatatatatgtatgtatgtatatctgtgtatatgtgaatatatacatatatgtttatatatatttaacttagac

SEQ ID NO: 60021 - DNA, 116 bp, Mus musculus
cctaaagatggctagtgaatgacagggttaatggggattcaggccaggtcactctgactgacagcttgtcttctaaaacaatttttagttttgtgttttaaaaattattctacagg

SEQ ID NO: 60022 - DNA, 78 bp, Mus musculus
aagaaaaaaatttttttcaattagatgttcttatttgtttaaggggataagggcatcctgagatacatcatttttctt

SEQ ID NO: 60023 - DNA, 102 bp, Mus musculus
gtcttttcaacattgtagtttcaaatctttgcttttcaagctgaaaatagtcaatagtcaatttttaaaggaaggtgacaagtttgggcactcaaaggagac

SEQ ID NO: 60024 - DNA, 73 bp, Mus musculus
tctgtgtgtctttatctctgtcagctggccttcacaacacctagtctacagatgactgctgttgatacacagg

SEQ ID NO: 60025 - DNA, 85 bp, Mus musculus; identical to SEQ ID NO: 57439

SEQ ID NO: 60026 - DNA, 71 bp, Mus musculus
gagcacttctagaatcctaataggaaatctagttaaaactattttttttaaagagggagctagaattgctt

SEQ ID NO: 60027 - DNA, 89 bp, Mus musculus
atcattgagtagagtgttgttcagcttccatgtgtatgtgggctttctattatttatattgatattgaagatcagctttagttcatggt

SEQ ID NO: 60028 - DNA, 94 bp, Mus musculus
ccagcatcttgttcctgagtcttcattggtaaaattgaacaattgagattttgtttttaaaaaaagtgggaactggtatcagcaagtattctgg

SEQ ID NO: 60029 - DNA, 72 bp, Mus musculus
aggggctagctctcccactctgcctcagttgcccatccagtgccactgccagaaagggccagagccaactct

SEQ ID NO: 60030 - DNA, 89 bp, Mus musculus
cccagcaacagccatcacatgtaatgtgtccacctgcactgagctcgtgtgtgcactgtgtgcactgtgtgtatctgtgttggggcagg

SEQ ID NO: 60031 - DNA, 84 bp, Mus musculus
tccgtgtctgtgtctgtgtcacggctgagaaacagaagcagagcaaggcttgagttcttaggtgacacaaccagcaggtgggga

SEQ ID NO: 60032 - DNA, 88 bp, Mus musculus
ccctatggctatgattcagtgtatttctctcacgtagaggactgtttctctgtggtgagaaattaacagagttatatcaactactggg

SEQ ID NO: 60033 - DNA, 91 bp, Mus musculus
atatatgcatatatacatgtatatatgtatatattccttataagcagatatatgtatgttcttgtatttatatatgtatatgtgtatatat

SEQ ID NO: 60034 - DNA, 108 bp, Mus musculus
aagtgctggcttcaagtggggctcagagtgaagagagagtgctcaggttccaaagtttcccgagtggctgctcaccactcttcaaaagcaccactttttattgctctt

SEQ ID NO: 60035 - DNA, 110 bp, Mus musculus
gtttacttggagatatgtgcgtttgcgctgagagagtgctcagtggggtcacaattcagaattcagtgggtaactttagagtgttggagcattaatgttactttttaaac

SEQ ID NO: 60036 - DNA, 86 bp, Mus musculus
ggtctaggacaaggcatgcagacagaacacattttcaggggaactagaagagtgtatctctgtttgttattgtgaaagtggaggtc

SEQ ID NO: 60037 - DNA, 110 bp, Mus musculus
tgagactttaaactgacatgcagacagattaaattgttggtttggtgacagaagtatcagagcactgtccctctcccatgagctctgtgacatgtggtaaaacatctgca

SEQ ID NO: 60038 - DNA, 79 bp, Mus musculus
cctagattcacactgtatctcactgtaacccaatgctttttagaacagaggtagcagtgatgtcatcttcttatctagg

SEQ ID NO: 60039 - DNA, 60 bp, Mus musculus
aggaggttagctagtgtttgtgcacatttgtgcacacagatctcagtgtgctaccttcct

SEQ ID NO: 60040 - DNA, 85 bp, Mus musculus; identical to SEQ ID NO: 57439

SEQ ID NO: 60041 - DNA, 118 bp, Mus musculus
ggagaacaaagaatgttagtagtactgaactgttagggtctaagtatttttatataaaggtgtgaatatagttagctctgccaattcattatcactttccatatattctgattacttt

SEQ ID NO: 60042 - DNA, 85 bp, Mus musculus; identical to SEQ ID NO: 57470

SEQ ID NO: 60043 - DNA, 112 bp, Mus musculus
gatcagtcttaagccatggtggtctgataggatacatgggacaatttcaatatttttgtatctattgcggcctgttttgtgaccaattatatgttcaattttggagaaggtc

SEQ ID NO: 60044 - DNA, 93 bp, Mus musculus
ctttacttgtcttgtcttgtatgtatgcatgtatgtatatatgtatatatgtatgtatgtatgtatgtatgtatgtatgtcagttcactaaag

SEQ ID NO: 60045 - DNA, 62 bp, Mus musculus
ttgtaatgtgacactgaagagtaagtgggaagacttgaagcttcagtgtctctcagtcacaa

SEQ ID NO: 60046 - DNA, 78 bp, Mus musculus
cacacatatatatatatatgtatatatacacacacacataccacattatgtatgtatatatgtatgtatgtgtgcata

SEQ ID NO: 60047 - DNA, 67 bp, Mus musculus
taatgtatgtatgtgtgtatgtgcatatgcatatgacatatatgtaaacacacacatatacacatta

SEQ ID NO: 60048 - DNA, 104 bp, Mus musculus
gaagtgtccacgtgttttctcagtggatctgggaggaggcatccttcagggtacctcactcttgtcatagatgggcttaggtgtggctgccttctggtaatgcc

SEQ ID NO: 60049 - DNA, 107 bp, Mus musculus
aatgaaccaaggagacagacagaaaaaaagttatatgtggatcacactgagttcattgtgatagcaacagaagacagatttttttcaagtcgatctgagtttttatt

SEQ ID NO: 60050 - DNA, 100 bp, Mus musculus
ggaaaatgggaatgatgaaggaataggaatgttttgaagaatgctataaataaaactaacatttttccagacaagattaagtctttcaggttctgtttcc

SEQ ID NO: 60051 - DNA, 76 bp, Mus musculus
tgtatatatatatatacacatacatatatatatatatgcctgtatgtctgtgtgtatgtatatatatatgtatata

SEQ ID NO: 60052 - DNA, 100 bp, Mus musculus
ctagacagcataatttaagtctgacatggatgccagcggtgacacactcacacacgctattttctgccagggttatagagagagcaagttatgttcctgg

SEQ ID NO: 60053 - DNA, 101 bp, Mus musculus
gtaggtacaactttcatgtgtatgtcactgtcactctcagttgtaaatgtatgtcttctaattgcagaatctcttagggcaggtggctgagcacggcttac

SEQ ID NO: 60054 - DNA, 83 bp, Mus musculus
gcacaaggagatcctgcaaatagttggcataacataaatatacatccatgatggcactactgaatttgtggatctgtttatgc

SEQ ID NO: 60055 - DNA, 108 bp, Mus musculus
gtaacttattctcagcacataaaggacaagacattagaaatatcatatccagagaatttttatttctctgtcatgatattgattaatacttgtttgtttgcagttgct

SEQ ID NO: 60056 - DNA, 113 bp, Mus musculus
ttcagtataactgatttagatgaattgttatggtcctctttgtgtctgtgtcacactttgtgtaaatttagaggactataccttctaatatcccaaggtcaggaaatcatgaa

SEQ ID NO: 60057 - DNA, 102 bp, Mus musculus
gtcgacaattgcagacaggttgtcctggaagaagtgcaaacatggcagctcactctgtctcactgtcattctgcagcctggagctgttgagggcatatttct

SEQ ID NO: 60058 - DNA, 117 bp, Mus musculus
gcggttgtgagtaaaaatgggaaaggcatttagtcatgcattttttatctatagaaattattttctgaattttatgatgaataccaatggatggctgacaattttatgtgattctgt

SEQ ID NO: 60059 - DNA, 85 bp, Mus musculus; identical to SEQ ID NO: 57439

SEQ ID NO: 60060 - DNA, 94 bp, Mus musculus
caggtctcaattcaatggttgactgtgagcatctgcatctgtcttagtccagtgttggcagaacctctcagaggacagccatactaggctcctg

SEQ ID NO: 60061 - DNA, 166 bp, Mus musculus
tatacattgtttatatcaaatatatactatatgcacacatatatatgtatatatgtgtatgaatgtgtatatatatatgtatatatatatctgtgtgtatatatatatatatatgtatatatatctgtgtgtgtatatatatgtgtgtatatatgacaatgaaata

SEQ ID NO: 60062 - DNA, 85 bp, Mus musculus
tgaagtgaagaccttttgttagtcagtggcattgtgcctgccatagttgaagggcgcagagaagactgtgagctgtcattcctca

SEQ ID NO: 60063 - DNA, 116 bp, Mus musculus
gttatatttgggaatatatatgtttgtgtatatgcatttatattatgtatatacatatatatttatgcatgtaactacaattaataaaattaatatatacacatttctgcatataa

SEQ ID NO: 60064 - DNA, 118 bp, Mus musculus
ggaaaaatgtcagcggtgtcttcctccatggattttaacttgataatcttaagatgtatgttaatttcttagataagtcagatggaagttggggtggggaggagatttgaattattct

SEQ ID NO: 60065 - DNA, 85 bp, Mus musculus; identical to SEQ ID NO: 57439

SEQ ID NO: 60066 - DNA, 106 bp, Mus musculus
tggatgtggaagtttagagaagggaccgagctgacagaggagagtgagcgacatagcagcagcctcatctctcccccatctctttccccaagtaacaccccattca

SEQ ID NO: 60067 - DNA, 90 bp, Mus musculus
gtgtgaatagagtgcctctctcaatttctcagtcactagtgctactgtatctagacagattaagagagatgaaagctgtcttttttatac

SEQ ID NO: 60068 - DNA, 87 bp, Mus musculus
caagactcaggttcctcacactacttgtctgcctctgacactggcactccacaggagtagaagtggatgtagaagggaagacatttg

SEQ ID NO: 60069 - DNA, 86 bp, Mus musculus
tagtgcctctgcttctagagctgtcaaatttacccaccaattaggagggagatgacagaagatagaaaggcagccatggaaaacta

SEQ ID NO: 60070 - DNA, 117 bp, Mus musculus
gtagtcagtagaagggtttggctttggtgggtttttttttattatttttccctaaaatgttttattatatcaagaagtaaaggaaaagactttgatatcaacaccttcaatgataac

SEQ ID NO: 60071 - DNA, 117 bp, Mus musculus
tgtctttgcatgtatgcagatgtgcgtagtatatgcatgtgtgtatatatatatgtgtatgtgtgttcaggtgttcacatatgtaaccatatgtgtgggtgagtgtacatatatgtg

SEQ ID NO: 60072 - DNA, 110 bp, Mus musculus
atacagagtgcacttatgagaagaaattgattacaaatggacagaaagccaaatttcttttatttataatttatgaataaagtttttatttgtgtgtgtatgcattgtat

SEQ ID NO: 60073 - DNA, 120 bp, Mus musculus
gctaggccccggcatagtctcaaattcttataaggcccttcaggatccaagtgttttctatgattatatatttttatcttgagttaatcttctaatttggttctctgtctctcttagcct

SEQ ID NO: 60074 - DNA, 85 bp, Mus musculus
tctcagccatttgtacataactctgtcttagctgcatggttttgggaagcattagagtatagagagagtagatggttaactgaga

SEQ ID NO: 60075 - DNA, 90 bp, Mus musculus
gcatcaacttcctatgcccacttttgtgaacagcccaaatgacactccaggtgacagtcagactgtatcagagaagaggcaaggctgagc

SEQ ID NO: 60076 - DNA, 84 bp, Mus musculus
gccacaggaaagtactgcttagttatctcttgaatttctccatggaaatagttcagtgtgagtctctgagtttcctgtgaaagc

SEQ ID NO: 60077 - DNA, 86 bp, Mus musculus
tatgtgtgtgtgtatgtatgcatgtatatgtatgtatgcatgtatatatatatgtatatatgtacgtatatattatgctgcatcca

SEQ ID NO: 60078 - DNA, 68 bp, Mus musculus
cagtagaggatgtcctgtgtttctaaaggcctaagcccaggacttgagagagtggacagacagaactg

SEQ ID NO: 60079 - DNA, 152 bp, Mus musculus
gtgccattaaaatatgtacatgtatatatgtatgtatgtatatgtatgtgtgtatatatgatacatgtgtatgcatatgatgtatatgtatgtgtatatgtatatgtgtatgtatacaatatatatgcatgtgtatatgtacatgcctgtac

SEQ ID NO: 60080 - DNA, 102 bp, Mus musculus
tatcatattgtgggaagcagagtcttgattataggaggctagaagtcatatgatttcagagagaattttctagagagaggctctgtgagctgacatgtaata

SEQ ID NO: 60081 - DNA, 165 bp, Mus musculus
taatatatatcatatatttgttttacatatatatgtatatgtatatatatacataggtatgtatatatatagagagaggtgcatagtagatatgtatgtatatattgatatatgttgtgtatatagatctgatatagtatcaaatatatacagtatgaactacta

SEQ ID NO: 60082 - DNA, 84 bp, Mus musculus
ctgagtgtagagtaaacaacctttaggtcttttcttcacagagcaaagtgtgtggagatggcagagtcttgcatgcacattcag

SEQ ID NO: 60083 - DNA, 105 bp, Mus musculus
agagtgatgtaggtgggaaagggatctgtgagtgtagagacagtgcggagtgattctattgtctagaagtgaccacagcatcattttcttgccatgagctattct

SEQ ID NO: 60084 - DNA, 74 bp, Mus musculus
gaacttctgctgtaggggccagagagaataacacagggcgttccccaatttctctctgtctctgggagagtttc

SEQ ID NO: 60085 - DNA, 116 bp, Mus musculus
gccttccataacctctgagtcttgcaatccagatgagctgttctccagctaggagcctcactctgactgactttcatggtgctgggaggtactctgaagatatgtaggagaaaggc

SEQ ID NO: 60086 - DNA, 85 bp, Mus musculus
gtctattagggtggctcatgaggtgttgccatgctaaagggtgtaatcactgtgagcagactctgaggactgaaatctcacccta

SEQ ID NO: 60087 - DNA, 102 bp, Mus musculus
catatatgtattatatgtacatatttgtgcatatgtatgccataccatatgatatgtgtgtatatatatgtatgtatgtattaactatgtgatatatatatg

SEQ ID NO: 60088 - DNA, 81 bp, Mus musculus
tatggatctagataattaaaagggaatgaaaaacggttatagccccagaagggcaactgtcggtctctggctgagtctatg

SEQ ID NO: 60089 - DNA, 66 bp, Mus musculus
gcaggctgagttgggatagggactcctcagcaaccgaggcctctctcttgctctcagtgtccttgc

SEQ ID NO: 60090 - DNA, 73 bp, Mus musculus
cctgtgtccaactctgtgtctcacttcaacccattccagggctggtgaccacttgtactctgctggatatagg

SEQ ID NO: 60091 - DNA, 66 bp, Mus musculus
cacacacacacacacacacacacacacatatatatgtatgtgtatgtatgtatgtatgtatgtatg

SEQ ID NO: 60092 - DNA, 67 bp, Mus musculus
gttctactaagagactctgtcagtgtttctatttcctgcggaagaagcactaagtgctctcttgagc

SEQ ID NO: 60093 - DNA, 64 bp, Mus musculus
atgtgtgtatatatatatatgcatatgtatgtatgtatatatgtatatgtatgtatatatgtat

SEQ ID NO: 60094 - DNA, 111 bp, Mus musculus
ctatgcatatggtatgtgtggtatatggtgtatgatttgtatatgtatgtgtatattatggtatgtgcacatagtatgagtatagtttgttgggggaagtatttgtgcatg

SEQ ID NO: 60095 - DNA, 69 bp, Mus musculus
tatgcatctatacatatatgcatgtatacatgcacatgcatatacatatatatatgtatatacatcata

SEQ ID NO: 60096 - DNA, 71 bp, Mus musculus
agaagcctgagatcagagtgtgcgcaggctcaagagggccatgaagaagcactctgcttctctcagcttct

SEQ ID NO: 60097 - DNA, 81 bp, Mus musculus
gtcagagcgagtagcctgtttctgggtgtacactgtgcacagtactaagatgtgcctagacttactgcaacttgatgtgcc

SEQ ID NO: 60098 - DNA, 65 bp, Mus musculus
ccatttttctgagacagtagccataccttaccctcctggactcattctgtctcagagtatcatgg

SEQ ID NO: 60099 - DNA, 85 bp, Mus musculus; identical to SEQ ID NO: 57439

SEQ ID NO: 60100 - DNA, 81 bp, Mus musculus
agtcacttctctgtgtcactgactggcagacatgttacaacaacaatatgaaatagctggcaggcatggaacacagtggct

SEQ ID NO: 60101 - DNA, 112 bp, Mus musculus
caaaaatgggctcagcaagttgtgttcatatatgtatgtatgtatgtatgtatgtatgtatctacatacagagaaaaaggggatattaacttgagagcagggccatggaatg

SEQ ID NO: 60102 - DNA, 131 bp, Mus musculus
caccaaacaaggagatcataactagttagagatgtctgggtgggcatgaaagctactttgtgtgtgtgtctctcatcctcacagacactttgtgaaatttcttctctcaaggacagaattgatttaattgg

SEQ ID NO: 60103 - DNA, 68 bp, Mus musculus
tacatatacatgtatatatgtatatatgtgtatacaaacacatatatatgtatatatatatgaatgta

SEQ ID NO: 60104 - DNA, 85 bp, Mus musculus; identical to SEQ ID NO: 57439

SEQ ID NO: 60105 - DNA, 92 bp, Mus musculus
gcgtccactgatatatgagttttatgtgaaggcttcattcaaaataaggatgcaggttgaagtatgttaagtttactagtagaagtgggtgc

SEQ ID NO: 60106 - DNA, 88 bp, Mus musculus
gtcgggctctggggtgaggaagagttcagtaattttttattcttcaaagagaagctggaagcaatcccactaaaatcagggactagac

SEQ ID NO: 60107 - DNA, 65 bp, Mus musculus
aggtgtgtctgagtctgtctgtgtatgcagggcgtggacctggagttacagatggcagttagcct

SEQ ID NO: 60108 - DNA, 84 bp, Mus musculus
gtttgtaattgttagactttgttcatgtacttgtgtgtatcaaaatgtacacacagagacacacacagacatatacacacagac

SEQ ID NO: 60109 - DNA, 81 bp, Mus musculus
tgtgtgcattcatgcatgcatgtatgtatgtatatatgcattcatgtatgtatgtatatatgcatgcatgcatgtgccata

SEQ ID NO: 60110 - DNA, 70 bp, Mus musculus
atagagcagctctctgccagactcacagcctccacactaggctgggactcaggtaggcaaactgtattgt

SEQ ID NO: 60111 - DNA, 78 bp, Mus musculus
ccaaatgagtgctttagagcctgtgacaggaacatacaatattacaagtgtgcctgacaggctcactgttacatttgg

SEQ ID NO: 60112 - DNA, 85 bp, Mus musculus; identical to SEQ ID NO: 58712

SEQ ID NO: 60113 - DNA, 72 bp, Mus musculus
tgtgtgtatatatgtatatgtgtgtatacatatatatgttgatgtatacacacacatatatattcatataca

SEQ ID NO: 60114 - DNA, 73 bp, Mus musculus
gtatgcctgttgtatatgtatgtgtgtatgtgtatgtatgtgtgtatgtatgtatatatgtagattgtcatac

SEQ ID NO: 60115 - DNA, 103 bp, Mus musculus
gatgggtatcttagagtcttccttgatattaatattcagtgtagcatgcgctgactcactgtgtatcactgcgtctttagtatcacagagatcagatcctgtt

SEQ ID NO: 60116 - DNA, 114 bp, Mus musculus
tcaaatacggttgtcatgatagagaagtgagaaagtctagagagtgtgcacatttggtaccatgtggaaccctgcactgcctctgggtcctgtaacaagaaggctgtagctaga

SEQ ID NO: 60117 - DNA, 72 bp, Mus musculus
caggtagtaatgtgtatatatgtgtgtgtgtatatatgtatatatgtacacgtgtatatacatatatatttg

SEQ ID NO: 60118 - DNA, 59 bp, Mus musculus
gctgaggcacagttaagttccaggccagcctgagatacacagccacactgtgtctcagc

SEQ ID NO: 60119 - DNA, 109 bp, Mus musculus
gagatccaggctagcctgcagtaagaaccactgttttaaaaaacaaatttttgaagactctttttgtttttctgtaacgcgtgggcttgtagcaacactgactgatttc

SEQ ID NO: 60120 - DNA, 70 bp, Mus musculus
tgtacttggggttggagaggtggctcagcggttaggagtgctgactgctcttccagaggtcctgagttca

SEQ ID NO: 60121 - DNA, 57 bp, Mus musculus
ctggtctagagacactttctggtttccatttggagcttatggaggctctcaggctgg

SEQ ID NO: 60122 - DNA, 69 bp, Mus musculus
gatcagcaaagacatgagaccaacaaccgttgcacagcaaggttagctgagcctctgtcactgtctgtc

SEQ ID NO: 60123 - DNA, 106 bp, Mus musculus
tgtatatgtgtatatatacattatatatgcatctataagtatatatgtatatatgcatatatgtgtatatatatgtatgtataagtatatataagtatggttagca

SEQ ID NO: 60124 - DNA, 73 bp, Mus musculus
ctcagagttgtcagaagtgtgtttgtagttgatgcaaatctccctttcaaacacacaagaagacaagtttggg

SEQ ID NO: 60125 - DNA, 111 bp, Mus musculus
acacatacatatatatcatatacatacacatatcatatatatcatatgtgtgtgtatatgtgtgtatatgtatatgtatgtatatgtatgtatgtattgtgtgtatgtgtg

SEQ ID NO: 60126 - DNA, 84 bp, Mus musculus
tctgtgttgttgagaagcagagattacaagactctagttctctcacagagtctcagaatctcctcgttcagcttcattcataga

SEQ ID NO: 60127 - DNA, 90 bp, Mus musculus
ctgactgactgatatacacatacatacatatatatatatatatacatacatacatatatatatatatgagtaccctgtagctgtcttcag

SEQ ID NO: 60128 - DNA, 157 bp, Mus musculus
gacagctacagggtactcatatatatatatatgtatgtatgtatatatatatatatatgtatgtatgtgtatatcagtcagtcagtcagtcagtggtagcatacacctttaatctcagtactctgggaggcagaggcgggcagatttctgagtttga

SEQ ID NO: 60129 - DNA, 106 bp, Mus musculus
agctgcttgctaccacggttctgaggactggagtccgttgctgtctctctcactctaactgggtaatgtcaggtagctctctaccacttcataggctcctctttcg

SEQ ID NO: 60130 - DNA, 57 bp, Mus musculus
gctattgaggcttttgaggagcatggttatatcctgctcactcctctgtctcactgc

SEQ ID NO: 60131 - DNA, 74 bp, Mus musculus
ccttcgtcttcactggattgttggaaggtcggtgtgtttatctgcctgagtttctcaacctcgtgggggaaagg

SEQ ID NO: 60132 - DNA, 110 bp, Mus musculus
acagaagtttccacgtggctttttagatgaggttgactggagtgtgtgtggactctctataccctgacttcccctgcagcaacttcagatttataaattgccttttctgt

SEQ ID NO: 60133 - DNA, 68 bp, Mus musculus
taagtggaagccagggatcggcactggggtcaggggttcggtgtctgcctctatcactctccacctta

SEQ ID NO: 60134 - DNA, 65 bp, Mus musculus
ggctaaagcatcacacacagtctctgtctccccgcagggaaaggacacagtgtgaagaaagagtc

SEQ ID NO: 60135 - DNA, 77 bp, Mus musculus
gctggcttcttctctctgtgctcagtgtctgtcaggaaagtgccctggagaactgagaagtagggttaagcccttgc

SEQ ID NO: 60136 - DNA, 71 bp, Mus musculus
ggaccactctcttctgactctgtatctcaaaattaagttactgagcagagttttaagggcagcttggattc

SEQ ID NO: 60137 - DNA, 111 bp, Mus musculus
ggatggctttctaaaaccctggcttgaggctcagtgtctttatttatatctctcacaggaatatttttcaaactcatgacagcgcagtcagtatggctttgggcacactcc

SEQ ID NO: 60138 - DNA, 111 bp, Mus musculus
gagaactggttcggactcgtccagtcatttgtccacggctctcagacactctgtcctttccagtgctctcagacatataagaagggctaggtggttctgttagtatttcaa

SEQ ID NO: 60139 - DNA, 81 bp, Mus musculus
atatctatggacatatgtgtatctatatgtatgtatacatatatactcacatgcataatatatatacatatacatatatat

SEQ ID NO: 60140 - DNA, 81 bp, Mus musculus
ctagccagtgtctgactgcagcatcatgagggggttcaagagagatgcccaccactgaactcagtcaacacagagagctag

SEQ ID NO: 60141 - DNA, 71 bp, Mus musculus
ggaggaagtatgccactgaggtaggctttgaggtttcaaaaggtcaagccaggctcaggctctctgtctct

SEQ ID NO: 60142 - DNA, 92 bp, Mus musculus
atggattatcctctctgatcactctcagtgtggctatatactcttacaattcactgtaatgctacaatgtagtgacagttgtggaactctat

SEQ ID NO: 60143 - DNA, 89 bp, Mus musculus
ctccgacatactgtctgtcagtctgtttgtctgtccacatttacgggaccctaacatgtccagacatgactaggcatcatgtttttgag

SEQ ID NO: 60144 - DNA, 85 bp, Mus musculus
ggccatagtggtctgataggatacatgggacaatttcaatatttttgtatctattgaggcctgttttgtgaccaattatatggtc

SEQ ID NO: 60145 - DNA, 85 bp, Mus musculus
ggccatggtggtctgataggatacatggggcaatttcaatatttttgtatctattgaggcctgttttgtgaccaattatatggtc

SEQ ID NO: 60146 - DNA, 76 bp, Mus musculus
cctggcagaagattagagggaaaagggagggtgagggcagggcgccacaggtttccctggctccctgtctgcaagg

SEQ ID NO: 60147 - DNA, 106 bp, Mus musculus
gtgtatctgtatctgtatatatctgtatctgtatctgtatatgtatatgtatatgtatacgtatatgtatatttctgtgggcatttgatgtgaatcagagatgaac

SEQ ID NO: 60148 - DNA, 66 bp, Mus musculus
atgcacaaggatgagatggaggatttaaattaaaacttgtgtctctctctctctctctgggtgtgt

SEQ ID NO: 60149 - DNA, 91 bp, Mus musculus
ccaggaaaaggtgctttaaatagacactcagcagactgtgacctgtgtcatttggccaaacggttttgggagtggattttaagtgtcctgg

SEQ ID NO: 60150 - DNA, 92 bp, Mus musculus
tatgtatgtatctatgcacgtatctatgcatgtatgtatgcatgtatgtatgcatgtatctatgtatgtatgcatgtatgtatctatgtatg

SEQ ID NO: 60151 - DNA, 79 bp, Mus musculus
acttctgttagtttcactgtgtctctgtttagtttctgtttacaggatctgtccattgatgagagtggggtgttgaagt

SEQ ID NO: 60152 - DNA, 71 bp, Mus musculus
ggggatttacaatgagggaagtgacctttgaaggaaaaaaagatggcactgacactctctctgtcttcctc

SEQ ID NO: 60153 - DNA, 74 bp, Mus musculus
gactggctatctaaaccttgggttgctcactctttctctgagaaggagggctgcatggttaaggattgccagtc

SEQ ID NO: 60154 - DNA, 113 bp, Mus musculus
aggcggttgcaggcactcccgtcagacacccacaggctttctgggcagcctcactcagtctgtgtcaaggttgctgggccagaagccaaagctgttgggacttgtgttcccct

SEQ ID NO: 60155 - DNA, 66 bp, Mus musculus
gaggttctctcagccctacatcctgtctaccaccagggtctctgtgtggctgagtctctgaacttc

SEQ ID NO: 60156 - DNA, 57 bp, Mus musculus
agctgcctcaggcagggcatggcaccccaggatgctcactctgcctgtgtgtgagct

SEQ ID NO: 60157 - DNA, 78 bp, Mus musculus
gaggaggctctaaagggaaagcatgctaatccacgatcacatttgtgcagtctgtctgtctgtcttacggctcttctc

SEQ ID NO: 60158 - DNA, 85 bp, Mus musculus
ctccaaggcaggccagaacagtctcaggctgtgtgactgtgattcatacggaatcactgggaaggtctctgtctgtctttttgag

SEQ ID NO: 60159 - DNA, 111 bp, Mus musculus
agagaattcatcagccagccatggaagtgcagacttgctaacccagcactcaagaggctgaggtagaagattgtgaattcaagactggcctaggttatgtaatgagatcct

SEQ ID NO: 60160 - DNA, 100 bp, Mus musculus
atgtgtatggtgtttatgtgtatggtgtatgcatgtgtatgtgtatacatatatatgtatacatgtaagtatatatgcagatatgtatatgcatttgcat

SEQ ID NO: 60161 - DNA, 86 bp, Mus musculus
tctgtaattataaagttggcaagagctctgagaactgagtctggagagagggctcagctgtgaagagcactggctgttcttgcaga

SEQ ID NO: 60162 - DNA, 84 bp, Mus musculus
caccggataagtggggagagctgtcatggaaggtctggcaggtgtctggttctctgagactctgaaatatttatctcagtggtg

SEQ ID NO: 60163 - DNA, 127 bp, Mus musculus
gcagccctctttcccctcttacccctactgcccgggacccagttcaagtaattcaggataggttgtggtgctgaccagcctgttctccattacttggctcgggggccggtgccctgcagccttgggg

SEQ ID NO: 60164 - DNA, 111 bp, Mus musculus
cttctgagtgctgagattataggtgcctaacatcattactgaataacagtccttatttatttatattcagtgtgtgtatatgtgcttttaagtatgtagcatacgtggaag

SEQ ID NO: 60165 - DNA, 85 bp, Mus musculus
ggccatggtggtctgataggatacatgggacaatttcaatatatttgtatctgttgcggcctgttttgtgaccaattatatggtc

SEQ ID NO: 60166 - DNA, 94 bp, Mus musculus
ctatcatggagggctggagagatggctcagcggttaagagcactgacagctcttccaaaggtctggagttcaaatctcagcaaccacatggtgg

SEQ ID NO: 60167 - DNA, 64 bp, Mus musculus
caggggctggagagatggttcagcagtttagagcactgactgctcttccagagttcctgagttc

SEQ ID NO: 60168 - DNA, 138 bp, Mus musculus
cttgcctacaggccatttttatggaggtattttctcagatgattctagttaaccaaggctgggtctcactgtgtggctctggctggcctgaaagagagaaccctcccaactgctgggattaaggtgtgtgtccccatg

SEQ ID NO: 60169 - DNA, 112 bp, Mus musculus
tccacacatgatggaggggagttggccaggagagagagagatcacagagacctgtaaaactgaaacccgtctatgtggacatgtcctaaaaccccaagtcctgcatcttgtg

SEQ ID NO: 60170 - DNA, 108 bp, Mus musculus
acccctgcccttagacagcctaaaggaagcagtcttctgtgtcactgacacccctgtgctgggtcgtgcacagcagggaagctctcctgtgttctcaaggagctgggt

SEQ ID NO: 60171 - DNA, 68 bp, Mus musculus
cagtaccatggctctgggtgtgtgcagtgacgatggacctctgctctgtctctcacacagccatgctg

SEQ ID NO: 60172 - DNA, 115 bp, Mus musculus
ttcttagatcctgctgatattaaaatgggaatgcatgtgaatctttttcattcttaactcaatgaaaaggcatttacttaacgtataattctccttggtcactgggatatgagaa

SEQ ID NO: 60173 - DNA, 76 bp, Mus musculus
gaggtccaaagcagacatgtaaaggatggattttatttacaggttactcaagtctgtctgtctgtctctgtgtctc

SEQ ID NO: 60174 - DNA, 75 bp, Mus musculus
gcttgtcttagggaaatgagattttttttttcatactaggaattgaacccaaggtgtcatgcatttgaggcaagc

SEQ ID NO: 60175 - DNA, 115 bp, Mus musculus
gactcttctggaacttgttggttatgtgggtagtaccttagtattgttgctccattttaaaactgtacatgttagttacccacactactacgttaggataaaagtaagcaatgtc

SEQ ID NO: 60176 - DNA, 72 bp, Mus musculus
tatgtgtgtcactgtgtgtctgtcatgtaatatgaggcccctcatggatctttcatcatgcatatacacatg

SEQ ID NO: 60177 - DNA, 75 bp, Mus musculus
ggccctccgtctgtcattcactgtcacccgcagccagtctggccaatgaaaaaagtgggtggagacatggtggcc

SEQ ID NO: 60178 - DNA, 89 bp, Mus musculus
ctggagggctccccagttcctgtctctcagtcactgataaaggtctcttctgagaaaataaatacaggcactggctttggagagactag

SEQ ID NO: 60179 - DNA, 89 bp, Mus musculus
gtagtctggggagcgtggggtgctggagaaggggtttctgttaaaaagccacagagccttcggtccagccttctatccccttaggctac

SEQ ID NO: 60180 - DNA, 106 bp, Mus musculus
cttactgcttttaatattctgtccttatttactgcatttgttgttctgattattatgtgtcaggaggaatttgttttctggtccagtctatttggagttctgtagg

SEQ ID NO: 60181 - DNA, 65 bp, Mus musculus
cccatgtgtcaagcagtattccttacacctttacaatgtttcaggcactgtgtctgacacagggg

SEQ ID NO: 60182 - DNA, 107 bp, Mus musculus
acctgcccttgatgtctctgactggatcctgattgtgtcagaattcttcagagttcagctgtctctgtgattctctgactcttgtgatcctgagatcctgggtatgt

SEQ ID NO: 60183 - DNA, 69 bp, Mus musculus
gagctgtgacagtgtcctcactgcgtcctgctcagacttgccaggccagtgagaaactgcaatgtcctc

SEQ ID NO: 60184 - DNA, 70 bp, Mus musculus
agacttggttcactcaccctctgaggctctgaaggcatagggcaggcagacagagttcacagctgagtct

SEQ ID NO: 60185 - DNA, 88 bp, Mus musculus
aggctagatagggcagttatagagagaagctctatctcaaaatccccccaaagattgtctgtctgtctgtctgtctatctatctatct

SEQ ID NO: 60186 - DNA, 75 bp, Mus musculus
ttcaaattccaagaatgatttgacccaagtcaatttctacttgagaaaatggggtcaatgttctggacctcagaa

SEQ ID NO: 60187 - DNA, 100 bp, Mus musculus
gtatgtatggtgtatgtatgagtgtgccatgatgtctgggtggaggtcagaggaacacttgtgggaattggccttgtgcttgtgggaactcagctcatca

SEQ ID NO: 60188 - DNA, 123 bp, Mus musculus
aggcaggaactcaagacaagagcttgaagcagaaaccatggaggaatgctgtttgctggcttgctgtctctgactcactcactgcctcatgctcagctagctttcttaagccgcccacatcca

SEQ ID NO: 60189 - DNA, 63 bp, Mus musculus
tactatggagaccaggctggtcttgaattcacaagagatctgactgcctctgagtctcaagtg

SEQ ID NO: 60190 - DNA, 75 bp, Mus musculus
ggtggagcctcataactgtcccatataagagacttggagagcttcctcgtctctctcactgtgtgaggacacacc

SEQ ID NO: 60191 - DNA, 115 bp, Mus musculus
gtcaggatcagctctcaaaaggcttttctgaatcccacaaacatagctacaatttttgttaatcaaatatttagtgctgattagaatggacaggatcaattgagaggatctcagc

SEQ ID NO: 60192 - DNA, 77 bp, Mus musculus
tctgtctgtctgtctgtctgtctgtctttataaggaatatgcacaagagtggaggccagaaaaggacattagataga

SEQ ID NO: 60193 - DNA, 97 bp, Mus musculus
ccaggcggttgcatagtcatgcatatccaatgtaaagaagagaactaacataaataggaagttggtttacatttgcaagcttacagcagcagcaggg

SEQ ID NO: 60194 - DNA, 80 bp, Mus musculus
catatatgtgtgcatgtgtatatatgtatatgtatgtgtgcataaatatatatatatatatatatatatatatatatatg

SEQ ID NO: 60195 - DNA, 107 bp, Mus musculus
gttctaactattaaggagcacagccaagattagaagtacctgtgcagcctgacactctgtctgccatcatagtaattctccttacactgttctatggtctttaaaac

SEQ ID NO: 60196 - DNA, 78 bp, Mus musculus
aacactgaagggactggagagatggctcagctgtttagagcactgactgctctttcagagatcctgtgttcaattcct

SEQ ID NO: 60197 - DNA, 115 bp, Mus musculus
ggcaccacaggtctggacttgaagtttcaaaagcctatgccaatttcagagtctctctgcctgagaatcaggttgaaggttttaactacttctgcaacatgatgcctgccatgcc

SEQ ID NO: 60198 - DNA, 85 bp, Mus musculus; identical to SEQ ID NO: 57439

SEQ ID NO: 60199 - DNA, 97 bp, Mus musculus
aaaaatcagtaggctataggtgtgtggattcatgtctgggtttcaattgatccatcaaccaacatgtttgtttttgtgccaataccatgctattttt

SEQ ID NO: 60200 - DNA, 87 bp, Mus musculus
ggcagtcctgtaactattagatgtagggcaaatactgaagggtagaatagctgtctgtctgtctgtccgtccgtccatctgtctgtc

SEQ ID NO: 60201 - DNA, 115 bp, Mus musculus
gacaacatatggtgaactgtttgttttgtcttcttgggatctattatttttctgtaaaaaaaaaaagtgtttggatttcctatgggtgaaggtaccatcactgtacaatgtagtc

SEQ ID NO: 60202 - DNA, 118 bp, Mus musculus
cacacagaagttcctagttatggatccttggttttgcatatcacacattcacactctctttccagattctgagatatggccagaagggtgaccagtgttctagccactttactgtttg

SEQ ID NO: 60203 - DNA, 71 bp, Mus musculus
cacacatatatatatacatatatacttatatatatgtatgtatttatgtatgtatgtatgtatgtatgtat

SEQ ID NO: 60204 - DNA, 62 bp, Mus musculus
atgcatatatatatatgtatgtatgtatgtatgtatacatgtatgcatttgtgtgtgtgtgt

SEQ ID NO: 60205 - DNA, 95 bp, Mus musculus
gagagactgtctttatatatatgtgtgtgtgtatatatatatatatatatatatatatatatatatatacacacacatttatcaacccagttctc

SEQ ID NO: 60206 - DNA, 106 bp, Mus musculus
tcatctatctatctatctatctatctatctatctatctatctacctatctatgtttacatatgggtagacatagatatataaacatggatagagataaatatatga

SEQ ID NO: 60207 - DNA, 82 bp, Mus musculus
tctgaatgctgattgtgaatgactcaatctgtatttatgctaacttagttgcatgtatagagtttattagtcagtataaaga

SEQ ID NO: 60208 - DNA, 95 bp, Mus musculus
gtcataatctatcgaatcagaatgacagaagaatgagaggtatgggttcccaattaccattctaacgatttgtcacaagcttaatgggctatggc

SEQ ID NO: 60209 - DNA, 109 bp, Mus musculus
ccccacctactgagagactctggcctggccaccactccctctcactcattttcatcatctgtaccctaaggcttggttgtctgtgggagtcattccgcccttcctgggg

SEQ ID NO: 60210 - DNA, 91 bp, Mus musculus
agcatagagtatgtgtgcttttgtgtttcgtgtgtgtgcaatatatttctgaaaattatttatatgttacatattggttattctcagtgct

SEQ ID NO: 60211 - DNA, 103 bp, Mus musculus
ggccaggaaggtggccggttgtctggagccgaagatggcgccgccccagacgctctgtggctctcgcctgtcccagaaatggctggcctctgtattccacacc

SEQ ID NO: 60212 - DNA, 74 bp, Mus musculus
atgtatttgtgtatgtgtttatatgcatgtgagtttgtgtgcttgtgtgcatgtgtgtgtgtgtgtgtgtgtgt

SEQ ID NO: 60213 - DNA, 96 bp, Mus musculus
tggagttttccatctattttcctttgtagggccagattaatgaatagataccatgtaaatttgttcttgtcatggaatatcttttggttttctcca

SEQ ID NO: 60214 - DNA, 62 bp, Mus musculus
ttctcagtgtatgtatgtatgtacatatatatgtgtgtgcatatatatatatatatagagag

SEQ ID NO: 60215 - DNA, 70 bp, Mus musculus
tagaatatatatgtacattcatctgtctacacaaatatgtgtttatatatgtaggtgtgtatatatttta

SEQ ID NO: 60216 - DNA, 91 bp, Mus musculus
tcactttcagtaagaagaattcactcactgtaaactgggtagatctaaactcactcagtgtgacagtgacaacttcttttggcccagtcga

SEQ ID NO: 60217 - DNA, 85 bp, Mus musculus
ctctgcttctagatagcatttactagatggttctgtgagagtctctctcaaagaaccattttttttttgagtgactggaaaagag

SEQ ID NO: 60218 - DNA, 122 bp, Mus musculus
cctggagcttccaagccaggaggtaagctggaggttcagtgagagacagagaagtgactgaggaaacagttcaacagtaacatcactgagaatttccttccccctgcctgcctaggatctct

SEQ ID NO: 60219 - DNA, 115 bp, Mus musculus
gtatgtatatgttatatagagatttacatatctggtatatacacatatggtacatataaatatatttatagtacatatggatatctacatagcaatgttctctgcacatatttac

SEQ ID NO: 60220 - DNA, 76 bp, Mus musculus
acttaaggatggccattgtgggactaatcacactgatcatgtaaatcagtgtaataagtctctgcttatcaggggt

SEQ ID NO: 60221 - DNA, 105 bp, Mus musculus
ggtagccttccagatagtcactcttctctgtggataaacaaggattggctctcttcatctcagtggctctctctgtttgtcctgagctgacatcttcagacttct

SEQ ID NO: 60222 - DNA, 77 bp, Mus musculus
gctcttagtccgtcctgtggccaagtcatattcacactgtgcggtgagacgagtgtgagcacactggcgtgcagagt

SEQ ID NO: 60223 - DNA, 110 bp, Mus musculus
tagaaattgttttaatacaattatgtgtgtgcatatacatgtgtacacatgtgcatctatgtaagtatgtatgtatgtgtgtatacatatacacatgagaacaagtacta

SEQ ID NO: 60224 - DNA, 120 bp, Mus musculus
gaatgggaaaaggtggagaagggggtgtgtgtgactagatctgaagcaaggctcagtcattttctgactggtttctcaacgcctgccctccctccgtccctccctccctccttccctccc

SEQ ID NO: 60225 - DNA, 117 bp, Mus musculus
aatgctcttgtctggaaaagggcaacgtgaccaacaggaaggcatgggactctgaagtcaagtgaaattgttgagttgtggtttctaaaatatgtttctttctaaagtaagattatt

SEQ ID NO: 60226 - DNA, 114 bp, Mus musculus
acatgcatatacacacatatgtataatcacacacacgcacatatatgtatataaatatacacataccacatatacccgcacacgtgtgtggtacataagtatgcatatctatgt

SEQ ID NO: 60227 - DNA, 168 bp, Mus musculus
gtgtatgtacatacatacccatgcatgtatatatttatgtgtgtatatgcacgtttgtctatatttatgtatgtgtatatacgcacatatatgcgtgtctatgtatatatgtatgtatgtgtctttgtatatatcatatatatgtatatgtgtctgagtatataaatg

SEQ ID NO: 60228 - DNA, 94 bp, Mus musculus
gccccttgatttggatccctcagaacttagagagcactgcacacagtctttccatggaagaatgggtgcttgggtttataggtcaggttggggc

SEQ ID NO: 60229 - DNA, 67 bp, Mus musculus
gcacctatatatgtatatgtgtatgtgtgtgccatgtatgtatctatgtatctatatatgtgtgtgt

SEQ ID NO: 60230 - DNA, 79 bp, Mus musculus
acttctgttagtctcactgtgtctctgtttagtatctgtttccaggatctgtccattgatgagagtggggtattgaagt

SEQ ID NO: 60231 - DNA, 83 bp, Mus musculus
tctacagtgtgggcttctaaattggactgggaatcttgtctggaatgtctagaagattcaagaggctaagctcagactctgga

SEQ ID NO: 60232 - DNA, 116 bp, Mus musculus
tgcttttgttcctttgacttagaatttatggttgaacttcaatgagattttatttcaatgagattattatagctgtgttgattgtagattgctatattaaagtaagatacaatgta

SEQ ID NO: 60233 - DNA, 85 bp, Mus musculus; identical to SEQ ID NO: 57470

SEQ ID NO: 60234 - DNA, 80 bp, Mus musculus
gggactgtgccttgtctcactgtcagtcggcagaacttctaaggaggtacaagctgatgggatggagaaccacggcttct

SEQ ID NO: 60235 - DNA, 111 bp, Mus musculus
ggagcattacgattgtgtctttggaaatcaggtatcaattccaaagtgagaagtgagagtgaacaaggaaaaggaattaccaggaggcagggtaggatgtgtgtgtgctct

SEQ ID NO: 60236 - DNA, 95 bp, Mus musculus
tgtcctctattatacatgtgacactttacccatatgtacatttatttatgtatatacatatattactggctggattccatatatgagggagaaca

SEQ ID NO: 60237 - DNA, 79 bp, Mus musculus
acatctgattgtttcactctgtctctgtttagtttgtgaatccatgatctgtacattaatgagagcggggtgttgatgt

SEQ ID NO: 60238 - DNA, 111 bp, Mus musculus
taaagatacatttccaaatgtcactattaaagagggactcttacaaaagcaatttgtttctaaagtaatctgagttcctacctgggagaaacattaaggatttgggattta

SEQ ID NO: 60239 - DNA, 74 bp, Mus musculus
tagacttcccccagctcggaattagaaacagtcgataagctctttgtctggctctgttctgctgcaggagtcta

SEQ ID NO: 60240 - DNA, 63 bp, Mus musculus
cttccagactcactctgccagtcagaactcctggggtctgagggctatggagtgggtggggag

SEQ ID NO: 60241 - DNA, 91 bp, Mus musculus
gaggcagaaggatctctgagagctcctgtcctgcctggtttatataattccagtcacacagagtaactctctctttctcaaaaaagatctc

SEQ ID NO: 60242 - DNA, 88 bp, Mus musculus
gtgtatgggtgatctgtctgtctgtctgtgtactacatgtatgtctgggtgcccacagaggccagaagaggtattggatccctggaac

SEQ ID NO: 60243 - DNA, 77 bp, Mus musculus
acatatatatatacaaacatacacatacataaatatatgggatatgcatgtatgtatgtatgtatgtatgtatgtat

SEQ ID NO: 60244 - DNA, 92 bp, Mus musculus
agagctgagagttgcctgcctctgtcactctcatccttgcaggcgatgagttagttagacagacaagcattccttgggtgattccagtgtct

SEQ ID NO: 60245 - DNA, 67 bp, Mus musculus
gctgtgtgtctctgtgtgtctctatgtgtgtgtatctgtgttgggagacccaaggttgacatctggc

SEQ ID NO: 60246 - DNA, 74 bp, Mus musculus
cagaggtggagccacgtgcagcagcagaggcgatggagatgactcccgtccctgctcactctctctctcctttg

SEQ ID NO: 60247 - DNA, 77 bp, Mus musculus
ggcatgtgccctgtcctctctgccttagcccttacagtgggctcaaagtagagtgtctgctcactcccttacctgcc

SEQ ID NO: 60248 - DNA, 85 bp, Mus musculus
ctctgtcactcggtagctttgggaccctcaggtaaggtagtagctagtttacctgtgctccaatgctctgatctctgaagcagag

SEQ ID NO: 60249 - DNA, 78 bp, Mus musculus
tatataaatatataatatgtggttatttgtaattggctttttttaagaaaagatttccacacattttgtatttgtgta

SEQ ID NO: 60250 - DNA, 79 bp, Mus musculus
ccccatgagctactgattcttctggcagtgtatatgttctccttagcctattcctctctgagtgtctctgcttctgggg

SEQ ID NO: 60251 - DNA, 116 bp, Mus musculus
gtaaccttggatttgcatcattgtcttttgggtggccatcctacagttacattaatatttttaattggtagataatggctgtgcatctttagggggtttgagtgatgtgtaggtac

SEQ ID NO: 60252 - DNA, 93 bp, Mus musculus
taatttttaacttaagtcacttacatgtctctagttcttgtatgacaatatagagagcacagggctcctgaggtacttaatttaatttaatta

SEQ ID NO: 60253 - DNA, 79 bp, Mus musculus
gccctttgcctcaggatcagtgggagccatcttggttccgggactccactgaacttagtctgcacaggtgagagtgtgc

SEQ ID NO: 60254 - DNA, 88 bp, Mus musculus
tctgtgtgtgtctgcctgtctgtctgtctgttttaaaaaaaagaaaaatatgtcaggcttgcacataactataatccttaacctcaga

SEQ ID NO: 60255 - DNA, 110 bp, Mus musculus
gcaagtctgtaagaagcctggctgtgagcaatggtgttaataaagagagaactgagtgaagtgtgttccgtttgatcatgaatcaaagggtggggtttgtgtgtgtgtgt

SEQ ID NO: 60256 - DNA, 59 bp, Mus musculus
accctgggctttatgtagttgacataagcaatatgttaattacagttcagactcagtgt

SEQ ID NO: 60257 - DNA, 85 bp, Mus musculus
ttcaggcagacacaagagtgtgaccagtttcaatgctggagcatgctacgagtgttggatagactgagtgatatgaatgtgtctg

SEQ ID NO: 60258 - DNA, 85 bp, Mus musculus; identical to SEQ ID NO: 59744

SEQ ID NO: 60259 - DNA, 116 bp, Mus musculus
aagggctgaacatttggtaactggataaccaattgctcttccctgggaaaagactatctctcccactctcagcattccttggttgcctgtagttttttgtgtagggctgagtcctt

SEQ ID NO: 60260 - DNA, 73 bp, Mus musculus
gtaccaggcatgtatagaggcatgttgtctgggttgtgacctagatccattttgtatatgtgcatgtggatgc

SEQ ID NO: 60261 - DNA, 108 bp, Mus musculus
gttgagtagaatgttgtttagtttccacgtgaatgttggctttctgttatttattttgttattgaagatcagccttagtccatggttatctgatagcatgcatgggac

SEQ ID NO: 60262 - DNA, 80 bp, Mus musculus
gtcaaagatcaagtgaccataggtgtgtggattcatctctggatcttcaattctgttccattggtctacttgtctgtcac

SEQ ID NO: 60263 - DNA, 116 bp, Mus musculus
tatgaatagatatatagttgatatatagagatatgtgtatatgtatttacatatatgtgtatacatatatacatatatatatatatatatatatatacatacattatataaatata

SEQ ID NO: 60264 - DNA, 85 bp, Mus musculus; identical to SEQ ID NO: 57439

SEQ ID NO: 60265 - DNA, 81 bp, Mus musculus
taagtgagagagagaagacagacacctgtgaggtctaataaagagaatcattggtagttttcagtctttgagaattattta

SEQ ID NO: 60266 - DNA, 73 bp, Mus musculus
acaaggaaaccagagagcactggctgaggagcctggagacaaggattcatttaccctctctgagtctctgcgt

SEQ ID NO: 60267 - DNA, 90 bp, Mus musculus
ttagtcttctttatatatgtatatgtgtatatatatacatatatgtatatatgtgtgtgtatatatatatgtacatgctgtgcacactaa

SEQ ID NO: 60268 - DNA, 85 bp, Mus musculus; identical to SEQ ID NO: 57470

SEQ ID NO: 60269 - DNA, 128 bp, Mus musculus
gccatgttctgagcatccgaggcatgggtgggtagccttgaaaaaacaacctgaacaagattttttttaatatctaccacaagggatgtttattaatggcaaggaattcccagtaatttcctctctgc

SEQ ID NO: 60270 - DNA, 118 bp, Mus musculus
gaggattagagctctgaggtgggagggggaaaccttcagaggacttttgtgacacacactgaatgacagtccttagggattctcatgttgcaaaaccttggtatttaaaaatattttc

SEQ ID NO: 60271 - DNA, 91 bp, Mus musculus
ggagccctgagctatttcattactctctctgtgaccctgccccttaacagtaatcatcagaataggtactttgtgaggtttgtatggcttc

SEQ ID NO: 60272 - DNA, 85 bp, Mus musculus
ggccatggtggtgtgattggatacatgggacaatttcaatatttttgtatctgttgaggcctgttttgtgaccaattatatggtc

SEQ ID NO: 60273 - DNA, 101 bp, Mus musculus
cccttggagtgggctttggggtttcagatgctcaagccaggcccagtgtctctctctgcctgctgcctatgggtccggatgaagaactctcagtctacttc

SEQ ID NO: 60274 - DNA, 111 bp, Mus musculus
aggggctatactctactgtgcatcatagcacattgtctggctcactgcggcactcagtagatgctagttgaagctgtgttttgccagttagttattgtcagtatggctact

SEQ ID NO: 60275 - DNA, 67 bp, Mus musculus
gtcctgtgggtctcagcctgtatctcgtctctccctgaagcctttacagacactcagactcacagac

SEQ ID NO: 60276 - DNA, 64 bp, Mus musculus
tctgtgagtctgagtgtctgtaaaggcttcagggagagacgagatacaggctgagacccacagg

SEQ ID NO: 60277 - DNA, 62 bp, Mus musculus
tgcctgcatgtatgtatgtatgtatgtatgtatgtatgtatgtatgtatgtatgtgtgtgta

SEQ ID NO: 60278 - DNA, 92 bp, Mus musculus
tagatttgttattttacattttagagacatccgattttatactgttagaatggtattctacattgtctctgtctctgtgagaaaacactcta

SEQ ID NO: 60279 - DNA, 99 bp, Mus musculus
cagaactcggtcaactgtcccattcacctcagagaagattcaaagctctcatagctagagatattgcactgctgagatgagtccctagtctggcccctg

SEQ ID NO: 60280 - DNA, 96 bp, Mus musculus
aagactctctgaagggctgctcacagtgtgccagatagtagacccttctcatcgcctgtgtctgcatgtgttgtgattttgtaaccttcgtttctt

SEQ ID NO: 60281 - DNA, 122 bp, Mus musculus
tatgtgtgtagtatatatgtgtaatgtttatgttcaatgtataggtacaatgtatatgtgtatgtatatgtacaggtgcaatgtataggtgccatgcacaggcataatacatagatgtagtg

SEQ ID NO: 60282 - DNA, 81 bp, Mus musculus
cagatggctggtttctcactgtttctcacctctcagaaaggggaagaggaaaagggggagggatggagagaagaagggttg

SEQ ID NO: 60283 - DNA, 60 bp, Mus musculus
tatacacacacacacacacacacacacacacatgtatatgtgtatgtgtatatgtgtata

SEQ ID NO: 60284 - DNA, 78 bp, Mus musculus
gtgtatatgtatacatatatatgtatatgtgtatatttatgagtatgtatgtgtatgtgtatgtgtatatgtgtatat

SEQ ID NO: 60285 - DNA, 85 bp, Mus musculus; identical to SEQ ID NO: 57439

SEQ ID NO: 60286 - DNA, 81 bp, Mus musculus
ctattttctctctgtcagtcagaggttgtatccctttaaggagatggtagggcagagggctgactggtgtgagagtggatg

SEQ ID NO: 60287 - DNA, 65 bp, Mus musculus
tcctgggcaggctggagagatggtttagtggttaagagcactgactgctcttccaggggtcctga

SEQ ID NO: 60288 - DNA, 110 bp, Mus musculus
tctatctcttatgtgttatggatatgtatacacattatgtatatatatatactatatatactatgcatatatattatgtatacatacctatatacatattcatgaggagg

SEQ ID NO: 60289 - DNA, 84 bp, Mus musculus
cagcaaatgtcagaaggaatgagggttgctgaggcgtaagagggtggctctctcagtgtttcccagaattctgtgaatttactg

SEQ ID NO: 60290 - DNA, 106 bp, Mus musculus
tcatgtgtatgtgcatgtgtatgtatatataggtaggtatgtatgtacatatatattcatatacatacatacctacctatatatatacacatgcatacacaggtga

SEQ ID NO: 60291 - DNA, 106 bp, Mus musculus
tcacctgtgtatgcatgtgtatatatataggtaggtatgtatgtatatgaatatatatgtacatacatacctacctatatatacatacacatgcacatacacatga

SEQ ID NO: 60292 - DNA, 137 bp, Mus musculus
gtgcctctgtgtgtgtgcatgtatgtatgtgtgtgttcatgtctgtatgtatatgtgcatgttcatgtgagtgtgcacacatgagtgtgtgttcatatgtgtgcatgtatgagtatgtatgttcacatatgtatgtg

SEQ ID NO: 60293 - DNA, 62 bp, Mus musculus
ctgtgtatgcatatgtgtgtgtgtatatatatatatgtacatatacatgtatatatatgtgg

SEQ ID NO: 60294 - DNA, 74 bp, Mus musculus
gaggaagtgtgccagtgggaggcaagctttgaggtgtcaagggccctctctcattcagtggctccctctttctc

SEQ ID NO: 60295 - DNA, 71 bp, Mus musculus
gtcagagtctctcacacacgtatggctcatcttcccaagtcttgtattgtgtgtgtgtgtgtgtgtgtgac

SEQ ID NO: 60296 - DNA, 109 bp, Mus musculus
tccatagtgatctgataggatgcatgggacaatttcaatatttttgtatctgttgaggcctgttctgtgaccaattgtatggtcaattttggagaaggtcgcatgaggt

SEQ ID NO: 60297 - DNA, 112 bp, Mus musculus
agagcaacagtgattaaaaactgggagctggagagacggctcagaggttaagagcactgactgctcttccagaggtcctgagttcaattcccagcaaccacaggtgactcat

SEQ ID NO: 60298 - DNA, 69 bp, Mus musculus
ctggcagttgactactctctactttgcatagtttagctcattaaatctttgagaggtagagaatgctag

SEQ ID NO: 60299 - DNA, 125 bp, Mus musculus
agagagcactcactattcttcacatcaggaggggttgtacagagtctgactgtgtctgtgagtttcctcagctctgctcatgtggattaaaggtctttcttccccacagatacccagggtgactc

SEQ ID NO: 60300 - DNA, 116 bp, Mus musculus
tgtgtgtatatctatacatatacaaatatctatatatataactatatatgtatatatatatatacatacatatatatatatatatatatgtgtgtgtgtgtgtatatatatttaca

SEQ ID NO: 60301 - DNA, 85 bp, Mus musculus; identical to SEQ ID NO: 57439

SEQ ID NO: 60302 - DNA, 115 bp, Mus musculus
tctggtgcttcaaaggacaagacagacagacagacagacagacagacagacagacagacatcttcccctatgtcaaacacaatgtccaggtcatctgggttctcattaaatcaga

SEQ ID NO: 60303 - DNA, 68 bp, Mus musculus
gtattgcactgcgtagcaaatgctcagacaagctcagcatgggttgagagcattattgtgtgcagtat

SEQ ID NO: 60304 - DNA, 85 bp, Mus musculus; identical to SEQ ID NO: 57470

SEQ ID NO: 60305 - DNA, 89 bp, Mus musculus
ttactggattgctttgtctagctttatcaggagaggctgttcatagtcttactgcaacttgatatgctgtggctggcagatacctgtgg

SEQ ID NO: 60306 - DNA, 102 bp, Mus musculus
accattaactgtttctggctaagttgttaaataaagggtgccaggtactccaaaaagctatttatttatttatgagcattgatcaggaatattctctttggt

SEQ ID NO: 60307 - DNA, 73 bp, Mus musculus
gtgacatctgagaaggcacagtcacactgtatcagacttctgacatacagagtgaagtactagataggtgcac

SEQ ID NO: 60308 - DNA, 81 bp, Mus musculus
ggcagtatccattcaggcatggcacaggcagaaatgagagttctacatcttcatccaaagtcggctagtggaagactgact

SEQ ID NO: 60309 - DNA, 85 bp, Mus musculus; identical to SEQ ID NO: 58391

SEQ ID NO: 60310 - DNA, 66 bp, Mus musculus
caagggtgaaatgaggttagcaatgtgactctatctctgtcatatcactctcaacttccactcttg

SEQ ID NO: 60311 - DNA, 63 bp, Mus musculus
gcatgggtatgtataatgtttgtatatatgtgtgtccatatatgtatatgtacatattcatgt

SEQ ID NO: 60312 - DNA, 84 bp, Mus musculus
ggtggcagggagagaagaaactgtggactttggtaagcaccttggaccataataagctcatatcttctccaaagcctgtctgcc

SEQ ID NO: 60313 - DNA, 84 bp, Mus musculus
gctcttatgtttctttacatacaaatctgtttttcatgaataatgatgagggagcagattagtttaacctgggtacaaagaagc

SEQ ID NO: 60314 - DNA, 85 bp, Mus musculus
gtccatggtggtctgataggatgcatgggacaatttcaatatttttgtatctgttgaggcctgttttgtgaccaattatatggtc

SEQ ID NO: 60315 - DNA, 90 bp, Mus musculus
tccctctttcactgtgtatgtatgtaggtatgtatctatgtaagtaaagatatagatgcatacatacatagatacataggtagagagtga

SEQ ID NO: 60316 - DNA, 83 bp, Mus musculus
gtgcttgtatctggtatgctgggcttgaagtaaagagggctgtatttatttatttgaaagatcagagaccggagagttggctc

SEQ ID NO: 60317 - DNA, 95 bp, Mus musculus
gtatggtgaatattatcactttgaagactgcttgataaaatttgactctagaacaagagtgaaagctcagtggacaaggtgcttgtcatacgtgc

SEQ ID NO: 60318 - DNA, 97 bp, Mus musculus
tggaaaatgagtactgctgctagtctgaaagaattttttttccaataagaaagaagattcaaagcacagaaagaataagctggatgccgtgcctcca

SEQ ID NO: 60319 - DNA, 117 bp, Mus musculus
gtatctccatatgtaaactgaggcttaagacactgggcaaagaaaattctgacattcttgttgtttctgcttattgaaataatgccttcccctattttctgtcagcattggggagac

SEQ ID NO: 60320 - DNA, 102 bp, Mus musculus
tagaacaaatttaatattgaattccatggtcaattcaatcagaaataacaactgtttatgttgtgctgtatagtgatgtgttatttaatagcaaaggttctg

SEQ ID NO: 60321 - DNA, 91 bp, Mus musculus
gctgacactactgaatgaggggtgggcatgcatggtggctctcactgagtctgaaaatattccatcttaagttctacaggctgttgttggc

SEQ ID NO: 60322 - DNA, 96 bp, Mus musculus
gatcagccttagtccatggtgatctgataggatgcatgggacaatttcaatatttttgtatctgttgaggcctgttttgtgaccaattatatgatc

SEQ ID NO: 60323 - DNA, 79 bp, Mus musculus
acttctgttagtttcactgtgtctctgtttagtttctgtttccaggatatgtccattgatgatagtgggaatttgaagt

SEQ ID NO: 60324 - DNA, 116 bp, Mus musculus
gtttcaacttgttcaggtctcctgtgtgctgtcacagtctctgtggattcagatgtgtgtgagcactgctgggtctgaaagatgctgttccactggagtaatctaccgttgctgac

SEQ ID NO: 60325 - DNA, 87 bp, Mus musculus
ttggattttaacatttccaacactgaatattttgtttttcattgaaaagcaatgtattggtgcctgatgatgtgaatgagaatttga

SEQ ID NO: 60326 - DNA, 83 bp, Mus musculus
catgggacaatttcaatatttttgtatctgttgaggcctgttttgtgaccaattatataataaattttggagaaggtcccgtg

SEQ ID NO: 60327 - DNA, 96 bp, Mus musculus
ctttgctaagtgctcctgcttagactgtctgcatctggaactcatattatcccagatgttcttagttcagtagttaggtatgaggactttttggag

SEQ ID NO: 60328 - DNA, 93 bp, Mus musculus
ttcagctccttgggtactttctttagctcctccattgggggccctgtgttccacccaatagatgactgtgagcaaagagctcaagaagctgga

SEQ ID NO: 60329 - DNA, 95 bp, Mus musculus
gtatgaaaagtttgatgctcgatttgacaaattacactcagggtcagtacactctcgtgtctgcgtctgtctgtcaattcccgccgactctatgc

SEQ ID NO: 60330 - DNA, 70 bp, Mus musculus
ctttacagcatagcggtctctctcagtctcagcttcataggcagagactctggactagaatgctttacag

SEQ ID NO: 60331 - DNA, 104 bp, Mus musculus
tgaccaaaatagttagcaggagagatggctcagcagcggttaagagcactgactgctcttccaaaggtcctgagttcaaatcccagcaatctcatggtggctca

SEQ ID NO: 60332 - DNA, 88 bp, Mus musculus
ggggagatttgtcgtaatagagacaaaacagtcaggtcactggaatttttttcccatcatgatatttttgttgttatgtgaacttccc

SEQ ID NO: 60333 - DNA, 109 bp, Mus musculus
tctgttttttaagacaagcatggccaacatattcttctttcgaagattctatttttttaataaagtcagaagcaatgaatgagacatggttgcagttttagaactcaga

SEQ ID NO: 60334 - DNA, 105 bp, Mus musculus
gccttttattatatgtgatatactttgttgagatgatttgttctaagcaacatgcttgcatggtagcattggttcatatagatttagtatatgaactatataggt

SEQ ID NO: 60335 - DNA, 80 bp, Mus musculus
tggaggtggcctcctgacccctctgtctctctgagcatccagctagcctgggtcagtgggaggggaagttggcatcttcg

SEQ ID NO: 60336 - DNA, 116 bp, Mus musculus
gaagggggtgaagcagcagaggatgggcttcctgcctgcgtgagagtctccacacacggggtttgttatctcctttgagggtagatcagaagcaagtctctctcactaccccctgc

SEQ ID NO: 60337 - DNA, 77 bp, Mus musculus
cctgcctgcctgcctgtctgcctgtctgcctgctgtagcagtcatggctttcttttccacatggcagcatggaaagg

SEQ ID NO: 60338 - DNA, 60 bp, Mus musculus
cccatgagcaagtctactttatttatatatagtgagtagtagtactactatgttggtggg

SEQ ID NO: 60339 - DNA, 89 bp, Mus musculus
ttatgttgggtgcaagggaaagctgtgagggctttgattgcgcagagagtctctcacagtggctgtagttattctaaacaatcacataa

SEQ ID NO: 60340 - DNA, 116 bp, Mus musculus
aatctcttgctggcattgttagagcaggcccccattccctagggtgctaactgtctgtgtctgtttgatctttggacctttcttggtgtgtcatgagaacagtgccactagggatt

SEQ ID NO: 60341 - DNA, 77 bp, Mus musculus
ggcatcatcttgctctctctgtcacactcactgccggtggacccatggtgtaggcagagctgatgtgaggggatgtt

SEQ ID NO: 60342 - DNA, 88 bp, Mus musculus
ggagaatcaaaaaggggggaggggctagagagatggctcagaggttaagagcactgactgctcttccagaggtcctgagttcaaatcc

SEQ ID NO: 60343 - DNA, 88 bp, Mus musculus; identical to SEQ ID NO: 60342

SEQ ID NO: 60344 - DNA, 96 bp, Mus musculus
gctggagttcctggattaacttgtggagctagagagatggctcagtggttaagagcactgactgctcttctagaggtcctgagttcaattcccagc

SEQ ID NO: 60345 - DNA, 76 bp, Mus musculus
ggtcagtttcagtggctccctcagtggctctccaccttattttttggtgagggtctctctgggcctggagctcacc

SEQ ID NO: 60346 - DNA, 100 bp, Mus musculus
tacctggagcttgaaaattggcagtaaggatccactgagtcagtcagtcaatatgcatgaaggatctggtaaagctggatatgttactgttactggtacc

SEQ ID NO: 60347 - DNA, 68 bp, Mus musculus
acatagggactagtgtctgaaagttgaaacttagatactaatgtttcactttctctctgtctctctgt

SEQ ID NO: 60348 - DNA, 63 bp, Mus musculus
cagggggacacagacaccatgcatcagaggtaaagtctgtctgtctgtctgtctgtctgtctg

SEQ ID NO: 60349 - DNA, 85 bp, Mus musculus; identical to SEQ ID NO: 57470

SEQ ID NO: 60350 - DNA, 75 bp, Mus musculus
gcttcatacagttcttgtcctagagtctatttcctggaatttcattctaagagacagacctgacagtgttgaagc

SEQ ID NO: 60351 - DNA, 85 bp, Mus musculus; identical to SEQ ID NO: 57439

SEQ ID NO: 60352 - DNA, 85 bp, Mus musculus; identical to SEQ ID NO: 57439

SEQ ID NO: 60353 - DNA, 87 bp, Mus musculus
ccattcacactgatgatggtttcaggaagttttcagtagtcaggattgactggcacactcagtcctttgtgaaatgttctggaatgg

SEQ ID NO: 60354 - DNA, 64 bp, Mus musculus
tagacaggctctctcactgaatatggagctaatggtcgatgagattcagggataagcctttcta

SEQ ID NO: 60355 - DNA, 65 bp, Mus musculus
tgtttgacttgagcttatgcaggttttgggaatgctctcacagtctctgtgagttcatgtataca

SEQ ID NO: 60356 - DNA, 69 bp, Mus musculus
gcacttactctgtcacataaccttccaagtagtctcctctgctagaggtgtgtgtgtgtgtgtgtgtgt

SEQ ID NO: 60357 - DNA, 96 bp, Mus musculus
gtgttttggatttcttcaggatctgttgttatgtctccctgttcatttctgattttgttgattagaatgcaaaacaaccttgagattcctcctcac

SEQ ID NO: 60358 - DNA, 90 bp, Mus musculus
gtcatgccgcatagagagaacacacactggacaaataggctgctatcccccctcactctcgtctgtgttcctgctgtcaatttggttggc

SEQ ID NO: 60359 - DNA, 115 bp, Mus musculus
gacaactagtcatatgacatatattatcctaaagctatcctgataaaacataaattatcttaaaatgtttatttttagttatgtgcaaatgtgtatgtccatgtgcaagtgtgtc

SEQ ID NO: 60360 - DNA, 106 bp, Mus musculus
gccttagtgcatggtgatctgataggatacatggaacaatttcaatatttttgaatctgttgaggcctgttttgtggcctattatgtggtcaattttggagaaggt

SEQ ID NO: 60361 - DNA, 86 bp, Mus musculus
ggaagcctgtctgtgtagggtgtgtgcccagcatctattatatatttcaaaggcagtcacaaatttccctatgcacaaagggctcc

SEQ ID NO: 60362 - DNA, 86 bp, Mus musculus
tctgagaaccactgagacaggtgacagaagacagttttgtaaagagaactactgtactgacttggcattcagaggacattttcagg

SEQ ID NO: 60363 - DNA, 86 bp, Mus musculus
gtgttcatgtgtgtatgttcatgcaggtgtatgcatttgtttgtacatatgcatgtgtgtgtgcatgagcatgtatgtatggagac

SEQ ID NO: 60364 - DNA, 100 bp, Mus musculus
gtcagggctacatagtgaaaacatgtctcaaatgtatataagtatgtattgttaattattactgtgtgtgtatgaatgatgtgtgcatgtgagttcaggc

SEQ ID NO: 60365 - DNA, 111 bp, Mus musculus
tttttagatgtgatatttatagactgagccagtaattaatctacattgtattcagcaaaattagatttttgttttcaaatggctttgttggatgaaaatcttccctgaaga

SEQ ID NO: 60366 - DNA, 112 bp, Mus musculus
gcagttggtttcaggaagccaagccttgaagaagttgtgtgtgacaaagaaggtcctctgtcagtcagtgtgacttcacatcgaggctctgcccttttgaagtgtgtactgt

SEQ ID NO: 60367 - DNA, 100 bp, Mus musculus
gctataaatatggatttctatatatctttattttgctatatatatatatatatatataaaaacagattacagatagagagatagatagatagataatagc

SEQ ID NO: 60368 - DNA, 82 bp, Mus musculus
ttactttttttctatccaatctaggcgcaactctgctgtcttgagaatcagactggttgatttctgggttggtatcaagtaa

SEQ ID NO: 60369 - DNA, 109 bp, Mus musculus
ggaacattttcctgaattgtatgtgcttgccttttctgtttatacttcttaatttgaagatttgtaactgagggtagctactttttaaaaaagttcttggatccctgtc

SEQ ID NO: 60370 - DNA, 83 bp, Mus musculus
agagagagagagagagagagagagagagagagagagagagtgtctgactgtctctgtctatttctctctctgtttgatttttt

SEQ ID NO: 60371 - DNA, 98 bp, Mus musculus
ttgcttgttaagaactacacacaggctggagagatggctcagtggtggttaagagcactgactgctcttccagaggttcttagttcacttcacagcaa

SEQ ID NO: 60372 - DNA, 64 bp, Mus musculus
aggatctgagtgctggagagatagctcagaagttaagagcactgactgctctaccagaggtcct

SEQ ID NO: 60373 - DNA, 81 bp, Mus musculus
ggcctgcagagcagaaaagtgtgtttagaggctagagagatggctcagcagttaagagcactgactgctctaccagaggtc

SEQ ID NO: 60374 - DNA, 112 bp, Mus musculus
ggtaaggatgcttgctgtggggctggtgagatggctcagcggttaagagcactgactgctcttccgaaggtcctgagttcaaatcccagcaaccacatggtggctcacaacc

SEQ ID NO: 60375 - DNA, 78 bp, Mus musculus
tgtgtgtgtgtgtgtgtgtgtgtgtatgtgactgtgtagatagataggtacatgtgcatgcagtgcccacagaggcca

SEQ ID NO: 60376 - DNA, 93 bp, Mus musculus
acatgtgatatatatatatagtgtgtgtatgtatatgtatatattgcggtaatacacagatgcacacacataatatatatgcgtgtacatatg

SEQ ID NO: 60377 - DNA, 70 bp, Mus musculus
ctacctcactttttgagacaagagtggtctcgttgaccctggaactcactcactgattcagaaagggtgg

SEQ ID NO: 60378 - DNA, 94 bp, Mus musculus
agactagttgacattgccctttgaccttttcctaaaaagaattcatttatttattttaggagtactggtgttttgcggggtgttttgttggtct

SEQ ID NO: 60379 - DNA, 69 bp, Mus musculus
gcacacacatacatacacatttacatacacattcacaaacaccatatatgtatatatgtatgtgtgtgc

SEQ ID NO: 60380 - DNA, 96 bp, Mus musculus
catgatgtttttctggatgccgtcttgtgagagcgcatgtgatgctttgctgaaaacagacacttgagagtgcacatgatggttagaaaaaatatg

SEQ ID NO: 60381 - DNA, 74 bp, Mus musculus
gtgtgagagagagagagactcccctctgagacacatacacattacctctttgtctctctctctctctctcacac

SEQ ID NO: 60382 - DNA, 101 bp, Mus musculus
tgactagctgaaaagaagtttgtcccgtgctgcctgtgttagaaatcttgagtcacagctcacccacactgtatcactctgtatgggaaactagtaagtta

SEQ ID NO: 60383 - DNA, 92 bp, Mus musculus
agccatcggtaaggttgcttccagctctgtgtcagtgtcagtcaaacccagcaatgatgacctccagagagctgtcagtgatcccgggtgct

SEQ ID NO: 60384 - DNA, 101 bp, Mus musculus
gatatgtagctttcgatttattgacagatgactgtgttcagtccctggctgaaactaggcagctctaacttttcatttgccatctggactcggagcttatc

SEQ ID NO: 60385 - DNA, 86 bp, Mus musculus
ggggcaagctgtgtgtctgtgtctgagggacaggacctctgggcactcctcggttacagatggacgccagttcctttcacacacac

SEQ ID NO: 60386 - DNA, 95 bp, Mus musculus
gttgatgttggtatgatagattatcatagatttaggctttggagaacaagctgacagagctgagtctggtgatgtatgtggcttgccaggtcagc

SEQ ID NO: 60387 - DNA, 118 bp, Mus musculus
gtgagttctatgttacaatctgtaccccatttttaattgggttatttcatatatgtatatatataatcttttggatattaaccctgtatcagaggtttagtttgtaaaaatgttttcc

SEQ ID NO: 60388 - DNA, 105 bp, Mus musculus
acctagcctctgcagttaaattgactttaacactccagagatgctggcctgatgccaccctccgtgaatgccagaagtccatttgcctgcttggttctgaaaggt

SEQ ID NO: 60389 - DNA, 78 bp, Mus musculus
aggttacagttgtgtagcttggtcttcttgtgggactccccacagtgggagcaggggctgtctctgactctgttgcct

SEQ ID NO: 60390 - DNA, 81 bp, Mus musculus
gaaaatactactacctcttcccagactactgttttggatgatggcatccaaaacacttctggtttttttgtttttgttttt

SEQ ID NO: 60391 - DNA, 88 bp, Mus musculus
tcttgtactagctgtggttgtatgttcttgcttatatatatataaacctgtaagggatatagcaagacatagaagcaggctagttgga

SEQ ID NO: 60392 - DNA, 76 bp, Mus musculus
gggatgaagggctggagagatggctcagcacttaagagtgctgactgctcttccagaggtcctgagttcaaatccc

SEQ ID NO: 60393 - DNA, 66 bp, Mus musculus
cctctctgtcagtgactgacactgcgggcacaaaacatctctctctgtcagtgactgacactgggg

SEQ ID NO: 60394 - DNA, 66 bp, Mus musculus
cctctctgtcagtgactgacactgcgggcaaaaaccatcctctctgtcagtgactgacactgcagg

SEQ ID NO: 60395 - DNA, 99 bp, Mus musculus
ccgcagtgtcagtcactgacagagagaggatggtttttgcccgcagtgtcagtcactgacagagaggatgttttgtgcctccagtgtcagtcgctgaca

SEQ ID NO: 60396 - DNA, 77 bp, Mus musculus
ggtaacctttgattgtcctcatggagctgagcctcagcaatcaaggaggtgacagaactgagtgacagacggtttcc

SEQ ID NO: 60397 - DNA, 91 bp, Mus musculus
tgtgtctatgagtatatgtgtgtttgtgtgtatatgtatatatgtgtattgcagatatgtatatatgtatatatatgcttagtgagagaga

SEQ ID NO: 60398 - DNA, 88 bp, Mus musculus
tccaggccaaattgagaagttgtccctgaggtaaccaggtatgatggttgattctgagtgtcttgactggattgatgggaggcctaga

SEQ ID NO: 60399 - DNA, 77 bp, Mus musculus
gttcacagcaaggtgcagtcgccggatttgctggaactcacaagtaagatctcactgcccctcagtgtctgtgaggc

SEQ ID NO: 60400 - DNA, 107 bp, Mus musculus
tggtggaggcaggcttggtggcagttgtggctgagagcacagagagaccttctatgggagaattaagctgcggctctgtagttgaatgccttccccatggctcccca

SEQ ID NO: 60401 - DNA, 92 bp, Mus musculus
gcagcttggatattaggaagtcaagtctgtgtttgttgtctgcatggagcaaaggagacagcaacccaggaactgtacatcgttctcagctc

SEQ ID NO: 60402 - DNA, 116 bp, Mus musculus
tcattttacttggcaaaaggcatgtgctcagtggtaggagctgatgaaagagtgaatgaatgaatgaatgaatgaatgagtgagtgagtgcatgcccttcccaccacagcagttga

SEQ ID NO: 60403 - DNA, 68 bp, Mus musculus
agattgcaggcctgtcagttgcttgttggggtagttccatccccgtctgtctgtctgtctgtctgtct

SEQ ID NO: 60404 - DNA, 87 bp, Mus musculus
ggacaagatgtgagcttccttgagtggttttagtctgagtttgtctttacctgaaactgtagccctatcagtttggctatcttgtcc

SEQ ID NO: 60405 - DNA, 96 bp, Mus musculus
ctagagacacaatctctcaggggtactggttagttcatcttgttgttcctcctatagggttacagacccctttagctccttgggtactttctctag

SEQ ID NO: 60406 - DNA, 95 bp, Mus musculus
ttaccctgagttcatgatgcttagtttatctttatggttcagttttatttctgtctttcagtctgtatgatttctgtcaatgaagttcagggtag

SEQ ID NO: 60407 - DNA, 112 bp, Mus musculus
gtagtttttatccttgagaatctatgtgatgcatcccatttgtaaatgtatgtatattgaacaatatatataaatctctgggagattccaagtagatcatgggttatactat

SEQ ID NO: 60408 - DNA, 87 bp, Mus musculus
tttcaacctgagttacagagatctgaagacatgtttagaacaggcaggagcctgaagtgtctgagcccagagctgacagtgttgaag

SEQ ID NO: 60409 - DNA, 71 bp, Mus musculus
ctttccactgttggtggcactgtaatctgtggcagccaccacagaaatcagtgtgaagaactatcagaaag

SEQ ID NO: 60410 - DNA, 117 bp, Mus musculus
gcaaatgaggatatagaaggctgattttaagggttctcaagtctttttgattttcataatgagattattattagaatacaaggaaattgaccctttcagattgctagttcatggtgt

SEQ ID NO: 60411 - DNA, 66 bp, Mus musculus
gtaagttgtatttttgtaaatgtctccagaagctctggggcattcatttctaagaacacaatgaac

SEQ ID NO: 60412 - DNA, 106 bp, Mus musculus; identical to SEQ ID NO: 58252

SEQ ID NO: 60413 - DNA, 62 bp, Mus musculus
gcagaagagtgtgttcacagggagcaggcacatgaggaccagctgcctgcccacttttctcc

SEQ ID NO: 60414 - DNA, 136 bp, Mus musculus
gcatgtgtatgtgtgtgtgcttatatgtgagcatgtatatgtgtgtgtgcttatatgtgagcatgtgcatgtgtatatgtgagcatgtgtatgtgagcatgtgtatatgtgagcatgtgtatgtgtgtgtgcttat

SEQ ID NO: 60415 - DNA, 86 bp, Mus musculus
ggtttcagagatgacagagctgagaacttagtaaagcctcctttactttatatgaatttttctcaggtttttttcatttgacttcc

SEQ ID NO: 60416 - DNA, 113 bp, Mus musculus
gtcacaagcctctgatgcctggggtgggtgattagagcagacacacttgacactctcactttgtgaatgtgcctagtgtctggtccagcatactggtagagagaggctgtggc

SEQ ID NO: 60417 - DNA, 87 bp, Mus musculus
gtcttctttttctctgttgctatcttgtttttgtttgtggtttttgtcatgagacacagacactgtatgtcagaggtaaagtgagat

SEQ ID NO: 60418 - DNA, 109 bp, Mus musculus
gaaaatccatggtgactaaagagtgcatcctagggacacacacacacacactttcccaatggaagggttccagggcaagaaatgcaagttattacccatgaggtgtgtc

SEQ ID NO: 60419 - DNA, 56 bp, Mus musculus
gtgtgtttctctctgtctcatgtgcacagcacgtaagtagaggtaggagaacacgc

SEQ ID NO: 60420 - DNA, 82 bp, Mus musculus
cagaactcctggctctgcctcacttctggaccattctctgatggggaaataaagtcagtggaagggagcagaccaggatatg

SEQ ID NO: 60421 - DNA, 85 bp, Mus musculus; identical to SEQ ID NO: 57439

SEQ ID NO: 60422 - DNA, 68 bp, Mus musculus
gaaagtggggctggagaggtggctcagcggttaagagcactgactcctcttccagaggtcctgagttc

SEQ ID NO: 60423 - DNA, 67 bp, Mus musculus
tcacgcacatagtacatacgtatgtatgtatgtatgtatgtatgtatgtatgtatgtatgtggctga

SEQ ID NO: 60424 - DNA, 76 bp, Mus musculus
gtttgatgaggaactaggctttgattggctaccaaaaagatggcaagcagctcagagtggagactcagcacagaac

SEQ ID NO: 60425 - DNA, 89 bp, Mus musculus
agcctccctctcatagagtggccccagccagcctccctctaagcgtggagagtgctctgtgaggccacagtgacctgcttagaggaggc

SEQ ID NO: 60426 - DNA, 62 bp, Mus musculus
atgtatgtatgtgcatgtgtatgtgcatgaaagtatgtatgtgtgcgtgtgtgtgtgtgtgt

SEQ ID NO: 60427 - DNA, 75 bp, Mus musculus
ggaggaagtggtcaccggggctgtgcccttgggggttctctcttgccccagtccctccctgtatccctttcctct

SEQ ID NO: 60428 - DNA, 67 bp, Mus musculus
gctttaagcaaagacacgggagttaggccctcacaagggagccctctgtctgtctgtctgtctgagt

SEQ ID NO: 60429 - DNA, 68 bp, Mus musculus
agtcagggactaggggcagaaaatcaagcccacccaatgtctgtctgtctgtctgtctgtctctcact

SEQ ID NO: 60430 - DNA, 94 bp, Mus musculus
gtctgtctgtctgtgtgtctgtctgtctatcgtgtgtgtgctgagtgagtgagtgagtgagagagagagagagaatatgaaggaaaaggacagc

SEQ ID NO: 60431 - DNA, 104 bp, Mus musculus
gggcttgtatagcaagcacttgtttgctgagctccccaggagtcatttttttcttttaaagacagggagggtctcagcatgtaagcctggctgtcctagagctc

SEQ ID NO: 60432 - DNA, 87 bp, Mus musculus
gatggcacaaggagcacaccttcactgactcagactcaatcaaagaagccacatttctgaaccaaggaggtgcatctttttggcatc

SEQ ID NO: 60433 - DNA, 117 bp, Mus musculus
ttaagaagtgtccaaatgggctggagagatagcttggcggttaagagcactgactgctcttccaaaggtcctgagttcagttcccagcaaccacatggtggctcacaaccatcttaa

SEQ ID NO: 60434 - DNA, 100 bp, Mus musculus
gtgacacactacagctttccacaaagagatgttttctatgttttgattttgttgttatatgtttatacatgttttattgggggagggagttggttgttgc

SEQ ID NO: 60435 - DNA, 85 bp, Mus musculus; identical to SEQ ID NO: 57439

SEQ ID NO: 60436 - DNA, 85 bp, Mus musculus
gaaagtgcacagtcactgagtcacatggtgactaggaaaatgtcaggttgtgcttaggttccttaaatgacctgtgttgtctttc

SEQ ID NO: 60437 - DNA, 67 bp, Mus musculus
ttctatccatggagagcaccagcagcctgcttgcctgcctgcctgcctgcctgcctgcctggatgaa

SEQ ID NO: 60438 - DNA, 77 bp, Mus musculus
acactgagttgatattcctccgcatttttagatgacagtcagaaaacagggaggaggggtatgatcagctccgtagt

SEQ ID NO: 60439 - DNA, 91 bp, Mus musculus
gcagctccacagaaagagggagaggacaggaataagctaagtgacccttcatttcttactgtgtctctcactcttttgccaaaagcaatgc

SEQ ID NO: 60440 - DNA, 90 bp, Mus musculus
ggtctgtctagtgatcttactgctcatgagaaaagtgactggggagacacactcctgggcacatcctcacctagctgaataccacaggcc

SEQ ID NO: 60441 - DNA, 87 bp, Mus musculus
tttttggtcagctactcctctcaaaatgtctcccctggggacttggggacaacagtcagaggagacagaggtatagcaaatggagga

SEQ ID NO: 60442 - DNA, 131 bp, Mus musculus
agctcatcagttccaaggcatttggccctggcacctttctctgttgtgactcttgctttgtgaagatgtaagtacttgaggatgtggcagtcctgtgtttatattgctgttcagctctgtcatgggggaag

SEQ ID NO: 60443 - DNA, 74 bp, Mus musculus
tgtgtctctctgtgcgtctatgcacctgacctgtggaggccagaggcatgaggtcccccggaactggagttaca

SEQ ID NO: 60444 - DNA, 80 bp, Mus musculus
ggctggggtcctgggctgaataaaaaggaggaagtgagttgagtatcaacattcctgtctgtctgtctgcctctgtctct

SEQ ID NO: 60445 - DNA, 93 bp, Mus musculus
gaggctaatcctgtggcttgtcactgtgactgtcactgagaggcactttcaggaaacagtcgtagaagacctttctctgcagaatctagtctc

SEQ ID NO: 60446 - DNA, 95 bp, Mus musculus
gtgggggaggaggttgtgagcttgcctttctggacattatttgtatttttcttccaaagaagggcaatttcaaaattaaacccatgatgtgcccc

SEQ ID NO: 60447 - DNA, 71 bp, Mus musculus
gccccagagaatggatgagacggcacacacccatgcagtgggatgtgactgaccacacagcagcctgggtc

SEQ ID NO: 60448 - DNA, 60 bp, Mus musculus
gggctctgtctgtcagtgtccgatgcagaactgtgggaacctgagctcagaccaccgccc

SEQ ID NO: 60449 - DNA, 69 bp, Mus musculus
ggggcatctgtgcaacagtatggatatgttttgtaaaatgtgttatggtgcagtgggagggggtgcctt

SEQ ID NO: 60450 - DNA, 108 bp, Mus musculus
gaaggttgagaatttctcctgtaggggccagagagaataaaacagggcatcctccgatttctctctgtctctgggagtgttctaaaatccatttccctctatcccttc

SEQ ID NO: 60451 - DNA, 73 bp, Mus musculus
gttgcctgggtcccactgtccctttgaactgatttttcttctcagtctggaggaccataggtttccacgtagc

SEQ ID NO: 60452 - DNA, 98 bp, Mus musculus
ctgttgcttgaatacctgagtttatttctttatatgaagggtaccaaaatgatgaggttgatttctcagaagggaaatggtcaaagatgaaggcacag

SEQ ID NO: 60453 - DNA, 71 bp, Mus musculus
cttctttgatcctcagtgaagattctgaggtattagacaggaatcagcaataatggaggacttcaaggcag

SEQ ID NO: 60454 - DNA, 77 bp, Mus musculus
gaggtgtataagagagaagagatggagctgagagcacgcaagtgatgattcgtgtatttattttctctttgtccctt

SEQ ID NO: 60455 - DNA, 95 bp, Mus musculus
gattggatacagctggcctgggctggggagggagggatcacagtgggtgtttgttgtgtcaatcacactctctcttctgcccctgtaactcagtc

SEQ ID NO: 60456 - DNA, 68 bp, Mus musculus
ctctccttcactctctcacaggcttcaaggtaaaaacctagaaagtaagaagagagagagagagagag

SEQ ID NO: 60457 - DNA, 107 bp, Mus musculus
ctcattttagtcttcaagacctcatgcttctgcatcacactttactgtgtctccattggtcagtgacagaacagaatgagcagaacggagttgaagaagaggaagag

SEQ ID NO: 60458 - DNA, 78 bp, Mus musculus
ggtgtggagagggactggagagaaggctcagcaattaagaacactgactgctcttccagaggtcctgagcttataacc

SEQ ID NO: 60459 - DNA, 136 bp, Mus musculus
gctggctttgcatgctctttggtacacagcacctatcatattggaatgtcttggtaaatttcagtttttgttgttgtcactatagacacagaagcaaagctatcagaaacataggaagtgggagctgtgtgtagcc

SEQ ID NO: 60460 - DNA, 69 bp, Mus musculus
gctcatgaagcactgtaagaggaagttctcaaaggcaaagccttctgactccctctcagagttttaagc

SEQ ID NO: 60461 - DNA, 78 bp, Mus musculus
atgagggcatagttgacatgccagcggttggagttttgatctgcatctgtctggaaatgagaaacatcctgtcctggt

SEQ ID NO: 60462 - DNA, 81 bp, Mus musculus
gtgtgtatttatgtatatgtatgtgtacatttgcatatgtgtgtacgtgtatgtgcatgtatgtgtatctgtgtatatatg

SEQ ID NO: 60463 - DNA, 83 bp, Mus musculus
ctgtattcatcctggtcctgcctgtcttcctcactgggtcacacagtcaggaagcaaacagtcctaagatatcctcggtacag

SEQ ID NO: 60464 - DNA, 124 bp, Mus musculus
tcttggataactaaaagacacagatagggtcaggggtgggaggatgggggtggaaacagagaaactgcaagtccacgtgtttccctagagtctctctttgtctttggttgtattggaggaagtg

SEQ ID NO: 60465 - DNA, 75 bp, Mus musculus
tttacactcaagtcagagtcaagagacgggagctcagctgataggagcacttgttgctctgtcagagggtgtagg

SEQ ID NO: 60466 - DNA, 72 bp, Mus musculus
gtctgtctgtctgtctgcctgtctacacatgtgccacagtatcctaggagaggtcagaggacaatttcaggc

SEQ ID NO: 60467 - DNA, 87 bp, Mus musculus
aggggactttctttttgggtctagtctatttgaagttctgtatgcttggtaggcatctccttctttaggctaggaaagttgtcttct

SEQ ID NO: 60468 - DNA, 72 bp, Mus musculus
agcaccctcctccgagagaggacacagagaactgaggcttgtttgtctcaccactttggtttctctggggct

SEQ ID NO: 60469 - DNA, 113 bp, Mus musculus
ggtatggtacaggcctatgtttgtgtaggtgtagtgtatgctgtgcctctgtctgtgtgatagctatggtgtgtctgtatctgtgtgtacatgaatagaacaatatccagacc

SEQ ID NO: 60470 - DNA, 84 bp, Mus musculus
aaggaacctccaggtgaggtgggacactggtcttaaatgtcagtaaagactagtggcctcaatgtctcacactgtcatttcctt

SEQ ID NO: 60471 - DNA, 92 bp, Mus musculus
gcaaccctacccttttctatgtctgtctgtctgtctgtctgctctccttacagaagaagaaggcacctaaacagccaagagcaaagggttgt

SEQ ID NO: 60472 - DNA, 103 bp, Mus musculus
tctcctggcaagctgtgtagacatccttcttaccatgcccttgctgatatacctcagtggctcttcttttttgagacaggatgtcaatcttcccaggctgacc

SEQ ID NO: 60473 - DNA, 80 bp, Mus musculus
accatctgccttgtatttgcattgttttgtacaacagagtctctcactgtctttgagcttgcagatcagggtaggctggt

SEQ ID NO: 60474 - DNA, 86 bp, Mus musculus
gagatgaacagaggatgggccaactaggaagcctttagaacattctgtaccatgaattcaaggttctctctctctctctctctctc

SEQ ID NO: 60475 - DNA, 89 bp, Mus musculus
cctgtgctttccataagaaaagcccccacagggtcgtgtgtttgaacacactgtctctggctcagggtgctgtctgcgaaggttgtggg

SEQ ID NO: 60476 - DNA, 97 bp, Mus musculus
ccaggtctaaagtctctccttatatatttatgtttaaaggcagggcctgctcatgggcttctgaacacagtgtattgagtatagaaacgtttcctgg

SEQ ID NO: 60477 - DNA, 64 bp, Mus musculus
ctgctcagttgctttgtaggcgattagaacatacaggactagtcaccgactgactgactgacag

SEQ ID NO: 60478 - DNA, 79 bp, Mus musculus
cttcccggtcctcttgcttccctcagaggccataagatacctggagggccgatgagaagtatgtgaggagtcagggaag

SEQ ID NO: 60479 - DNA, 78 bp, Mus musculus
gtctgtctctttcactgtggatctcgcctgaagcattgcatttagagctggtgctgtggtcctgtgtgaaggacaggc

SEQ ID NO: 60480 - DNA, 90 bp, Mus musculus
aggtatgtggaagacagaggagagtcagcaggagtcaggtctcgccttctacttgtgagtccttgggactgaactcaggtcttcaggctt

SEQ ID NO: 60481 - DNA, 66 bp, Mus musculus
ggcttgtgatcctgacaggactcagtgtgtagtctaatgacaacactcccctgcagcttataagtt

SEQ ID NO: 60482 - DNA, 85 bp, Mus musculus
gggcacacggtggcgcgtaggttgaggtcagtggacaagtgtggaagctggctctcgctggctctctccttctgcatgtggcttc

SEQ ID NO: 60483 - DNA, 157 bp, Mus musculus
tatgtatatatatatatatatatatctcgcaggatatatacatatatgcatatattagtatatatttatatagtatattatatgcacacatagatgtatatacatacatatatatgtatacatgtatgtgtgtatatatatatatatacacatatac

SEQ ID NO: 60484 - DNA, 118 bp, Mus musculus
tgtgtgtgtatatatatatatcttgagtgcttagggtgtgtatatatatatcttgtgtgcttagggtgtgtgtgtatatatatatatcttgtatatatatatcttgtgtgcttagggt

SEQ ID NO: 60485 - DNA, 96 bp, Mus musculus
ccaggaggaagaatggacaggataggatgtatgtatgtatgtatgtatgtatgtatgtatgtatgtatgtaatcccagtgcagaagggatcgctgg

SEQ ID NO: 60486 - DNA, 80 bp, Mus musculus
gtatgtatgtttacgtatgtatgcatgtgtgtgcatgtgtgtatgcatgtgtgtgtgcgtgtgtgtgtatacatacatgc

SEQ ID NO: 60487 - DNA, 77 bp, Mus musculus
gagggagaagctggagtgtggatgagttctgcttgggaccccagggagaatcagagcccgccctggagttaagtctc

SEQ ID NO: 60488 - DNA, 83 bp, Mus musculus
gaggcatatcctcagtctcagtggtatgtatgtatgtatgtatgtatgtatgtatgtatgtattttctgagacagggtttctc

SEQ ID NO: 60489 - DNA, 118 bp, Mus musculus
tctttaatgcttatatatgtgtatattaatgttaactatatgtataaataacatataggtatatatgttatattttatataaatcatataaatattttatataaattatataaaaaga

SEQ ID NO: 60490 - DNA, 69 bp, Mus musculus
tggtaacatgtaccttagaggcagatagacttggttcaaagcccagctctgtctgtctgtctgttgcca

SEQ ID NO: 60491 - DNA, 79 bp, Mus musculus
gcagattatgtatgtatgcatgtgtgtgtatgtatatatgtatgtgtgcgtatgtatatatgtatgtgtatgtatgtgt

SEQ ID NO: 60492 - DNA, 87 bp, Mus musculus
atgtcatgtaagtggctggtgacactctggatatcttctacatccattcagaccactcctgtcactcagtccatctctcactgatgt

SEQ ID NO: 60493 - DNA, 83 bp, Mus musculus
caatgaggtccccagtgtcaccaccacgtttctttacagaactgagattggagagttggaagtggcgttggtgttactcattg

SEQ ID NO: 60494 - DNA, 92 bp, Mus musculus
ccctgaccccaactttgccccatatgagaacagagccaggacactcatagcagctgtccgctctctcatgacgagggactatgggatctggg

SEQ ID NO: 60495 - DNA, 64 bp, Mus musculus
gggagggcagacagatattctgcctgatacgtgggtgctactcagtctgtctgtctgtctgtct

SEQ ID NO: 60496 - DNA, 107 bp, Mus musculus
acaagggggctcttcaaggaagccactcctgcgagctttcagcattctcactgcctctctgggtatgagggctgcaggagaagctggccctctgactccctcattgt

SEQ ID NO: 60497 - DNA, 82 bp, Mus musculus
agcaggtgtttgtgccgccagtgaatgattggaagactagtgaaagtcttttcatcactcattacagtctcagatgcctcct

SEQ ID NO: 60498 - DNA, 84 bp, Mus musculus
gtctgggatgtgagagatgagagtgaccctgcacttccttgatggggtcctaattgatgaacattgctcacaaacttcccttac

SEQ ID NO: 60499 - DNA, 130 bp, Mus musculus
gtgtcatgcactagaatgtggtcccaatcccacagcagtggggacacagaggacagacagttcagacagtgatggaacaagagcagtggccatgctcagagctgggcctcttcacagtgctgtaggtcct

SEQ ID NO: 60500 - DNA, 87 bp, Mus musculus
gacaaggtctcctctccacaaaagggaggtggcaagcgcagcagttcctggctcactgcctctctgatttgtagtggggacaaagtc

SEQ ID NO: 60501 - DNA, 73 bp, Mus musculus
ctctctctctctcagactttcctctccactttctgtaacaaaggcagggagagcaggggctggaaggacagag

SEQ ID NO: 60502 - DNA, 78 bp, Mus musculus
ggccttgttggagtaaggtgtcactggacgtctcaaatactcaagccatgtccagtgtcacactctctccctgctgcc

SEQ ID NO: 60503 - DNA, 77 bp, Mus musculus
gggggggtagggcatgggggacacactctgtgtgtcaggctaacctggaatttgagagcctctagtctcagcctcct

SEQ ID NO: 60504 - DNA, 106 bp, Mus musculus
gcagacctgaactttgagcagcaagaaggaggagcatcagagaagagactgagcaggaagctggtcctgggaggagcctggcttctgcttgtagagtgtgtactgc

SEQ ID NO: 60505 - DNA, 102 bp, Mus musculus
tatacatacactcacacacgcactctctctctctctctatatatatatatatgtatatatatatatgtgtatatatatatatatatatgcatgtatatgtgt

SEQ ID NO: 60506 - DNA, 116 bp, Mus musculus
ggtccagagttctctgctcctgagtcctttcggggctgatgtcaggtgtctggcagtctcactttttgcagggccatcagccaccaaggctccagatcagagaactgaactgagcc

SEQ ID NO: 60507 - DNA, 77 bp, Mus musculus
ggtgtgcaccccacctctaaggggcaccttggaaattgtcatgctccgagaggctctgagagtcagtgtcacatgcc

SEQ ID NO: 60508 - DNA, 98 bp, Mus musculus
acagatgccagggagacagagtaaacggggcttgggtggagccccagtctggctcactctgtggctgagctgtgatacttatggccctccaacaatgc

SEQ ID NO: 60509 - DNA, 95 bp, Mus musculus
gagatgcttctctgaccaggcctgagcgcagccccaggactataagtattaacaaacatgtagaaggtagcattgtttaaaccttgaggtatctc

SEQ ID NO: 60510 - DNA, 76 bp, Mus musculus
ccgagtaagttatgaaatgattagtatagtaataaagaatattgctagctaagtttttctggactataatatttgg

SEQ ID NO: 60511 - DNA, 79 bp, Mus musculus
ctcgtgatggcttctctctgtgtgtgatgctatgtgtgctcagctgaggcacatatagtagtagagagaaggagcagag

SEQ ID NO: 60512 - DNA, 64 bp, Mus musculus
tgtgtgtgttattctcactggctctgtgggaccctgtttgtgtgtcagtgactgtatacacagg

SEQ ID NO: 60513 - DNA, 88 bp, Mus musculus
gcatgtatatatctatatatgtgtatatgtatatatgtatatgtgtacatatgtgtatatgtatatatgtatatgtgtatgtgtatat

SEQ ID NO: 60514 - DNA, 85 bp, Mus musculus; identical to SEQ ID NO: 57439

SEQ ID NO: 60515 - DNA, 108 bp, Mus musculus
tttggaagtccgtgtgagtggtgtgacacaggcaggtggcaaagggctgaagccaggtggtgagctctcctctgtctcactgcctgtgttagggcatttccttctaaa

SEQ ID NO: 60516 - DNA, 84 bp, Mus musculus
ggttacctgctggtgtacagactgtggtgccacgtcctgtgtgaccccatgtaacctggctgcctccctctatgcccagcagcc

SEQ ID NO: 60517 - DNA, 60 bp, Mus musculus
gtgaaaacctgggacaaaggtcagggctccaagaaaggcactgcctgagttcaggttcac

SEQ ID NO: 60518 - DNA, 70 bp, Mus musculus
cggagcctgtgtctgtctctggatgaggaggtgccctgggatggccctctctcggagtctgccagctctg

SEQ ID NO: 60519 - DNA, 83 bp, Mus musculus
ctgcgtgaaaacacaccctgcattgtactgcacagagtcaggtcgctggaacaggtgcatcagagggaagtgctgttcaccag

SEQ ID NO: 60520 - DNA, 85 bp, Mus musculus
ctgttttgtcagtttcttgttgtctcttggaggtgaaactgagggggaatgaatctgggggagggaagggggcggctcagaggag

SEQ ID NO: 60521 - DNA, 115 bp, Mus musculus
gggcaggagctcaaggcatggaacctggaggcaagaactgaagcagagaccacagggggctctgcctcctggcttgcttcccacggattgctcagcctgattccttacagaaccc

SEQ ID NO: 60522 - DNA, 93 bp, Mus musculus
tggcagcagtggggccagagatgtgggtctcatcccctctctgggtctcacagtggggatttctctgcacatatctgggtctacgtgattcta

SEQ ID NO: 60523 - DNA, 83 bp, Mus musculus
ggactggggttagggctcagtggctcagtggctcagtggcagagcacttgcctagcattcacaggccccaggttcaacccccc

SEQ ID NO: 60524 - DNA, 120 bp, Mus musculus
agggtctttggcatggccctcctggggactagcagaaggtagtggataaatagcacagttgtctctgcctcactgattctaaggtacattttacagtgggtcattaactccagagggact

SEQ ID NO: 60525 - DNA, 90 bp, Mus musculus
ggctccctatttggtcactgggttacttctgcagcagcaagcagggtgctgctggaggaccgtgcacctgctcagcggagttcggtggct

SEQ ID NO: 60526 - DNA, 114 bp, Mus musculus
ggttgagagcactggctgcgggggctggagaggtggctcagtggttaagagcactgactgctcttccagaggtcctgagttcaattcctagcaaccacatggtggcttataacc

SEQ ID NO: 60527 - DNA, 83 bp, Mus musculus
agagagagcaagcaaacacacgttggtgtgtgtgtgtgtgtgcgcgcgcaagtgtatgtctctgtgtgtctgtatgtgtgtct

SEQ ID NO: 60528 - DNA, 83 bp, Mus musculus
ggtatctgttggcagtggagtacgctgcaaaggtcagcgactcattggctgcagaggagccagtgtgcctgtgtgtcagtgtg

SEQ ID NO: 60529 - DNA, 72 bp, Mus musculus
tcagacaggtgtgggatggacagtagcccctcagcttctcctggcctctgagtcacacactcactgttctga

SEQ ID NO: 60530 - DNA, 86 bp, Mus musculus
ccctttgacagtttagctctggcagattcagtggagaccaaagggctaggtcagaagtcagtgtgctgtcagaacctgttgatggg

SEQ ID NO: 60531 - DNA, 86 bp, Mus musculus
tgttcagttgtgacttttattgctcagctcttccttggaatctaacaagagtgagtgcagagacggagaaagcctaaggatgaaca

SEQ ID NO: 60532 - DNA, 88 bp, Mus musculus
tttcaggctttgctttgtcctcagttggccgttgtatggagcattagctctgctggaagctctgatgtgactgagcagagagctggaa

SEQ ID NO: 60533 - DNA, 68 bp, Mus musculus
tgtatgtgcatgtgtatgtgcatgcatgagagagagagagtatgtgcatgtgtgcgcgtgtgcatgca

SEQ ID NO: 60534 - DNA, 118 bp, Mus musculus
gggttcataagcaggggtggtaacctcctctggactgaggctgtctgtggctgtgactgaaatgcacagcctgggcattttcaccaagggtagggtggggtaatctgtctgtggattc

SEQ ID NO: 60535 - DNA, 101 bp, Mus musculus
ggcagccggtcacgtcacagctgtagtcacagagcagagagacgccaatgctaagcctggtttctccttttgattgagtgtaggacccaagagacggtgcc

SEQ ID NO: 60536 - DNA, 116 bp, Mus musculus
gctcagggcctgaaggttgtctgtgacgtaaggtgatcagtaaggcttctctcccactctcacaaaggaagagtcctttcattacctgggtttcatcagtaacagggtctggggac

SEQ ID NO: 60537 - DNA, 67 bp, Mus musculus
cgtcaggacagagtcaggacactcggaccctaagagtccttccaagtgcttgtttcttcccctgatg

SEQ ID NO: 60538 - DNA, 76 bp, Mus musculus
agatggtggagatgctgtgagatgtctgtcaggaagtggagctgctgcagcactctgagcctgtctgtgcctgtct

SEQ ID NO: 60539 - DNA, 88 bp, Mus musculus
gcttttatattaatagaaatctaagggagagaaaggagaatcagactatccctctctctgtctaagttgttcttctcaggtatttggt

SEQ ID NO: 60540 - DNA, 85 bp, Mus musculus; identical to SEQ ID NO: 57439

SEQ ID NO: 60541 - DNA, 73 bp, Mus musculus
tctgtgtagatttgagctgactcttggggcccagtaaggggctgtctaagtctgtctgtaagagatatgggga

SEQ ID NO: 60542 - DNA, 104 bp, Mus musculus
ccacgggctgcagggtctgccatgcttaggcttgcagtgagagggcggagaccaaagccacacccactgtctcacagcctgaatggccccgtgccaggctgtgg

SEQ ID NO: 60543 - DNA, 62 bp, Mus musculus
agtctgtctgtgacagagccctgtgtccatccctcacaccagagtctgtctgtgacagtgct

SEQ ID NO: 60544 - DNA, 81 bp, Mus musculus
accaggtctatagttcagtgtgcctctgtccctcagttgtcctctacctcgttgggtattcaagtgcatacacagcctggt

SEQ ID NO: 60545 - DNA, 117 bp, Mus musculus
tggtccggctgctcctcatccttctcaagtttacacatgggcaaacggggccccagagagctcctttgtgactgtgtgtctgcgaagacagttcctcctgagggatggctgatgcta

SEQ ID NO: 60546 - DNA, 81 bp, Mus musculus
ctgcagctcctgggagtctgattagagtgtggacaatgcccctcttgttgcacatctgtcccttccccacagcccctgcgg

SEQ ID NO: 60547 - DNA, 93 bp, Mus musculus
tgatgtcctcttctctccagtggctcacacagtccctctcacccagtgctcccggggtagttgtgaaaatgcctctttggagccagttcatca

SEQ ID NO: 60548 - DNA, 70 bp, Mus musculus
cccatcagaggctctgggggctacagggaatacatcccacccacctgtgaccatctgtcagtctctgggg

SEQ ID NO: 60549 - DNA, 87 bp, Mus musculus
tccaccatggagccccacttgtaaccctccctatacttattgttgttgtgagtatatgtgtatgtgtgggtgctgtgctcatgtgga

SEQ ID NO: 60550 - DNA, 103 bp, Mus musculus
ctgagttctgtcgctcacagcctgcctggagaaaacagcaccatggaggacccagcctccctgtttcccaggagctcctctgaaggcacaatacagagcccag

SEQ ID NO: 60551 - DNA, 117 bp, Mus musculus
cggggccctcaggccagtgcccaggctctggctccgtgtcttcactcccgtgtttgtccgaggagggagggagggacgggggcggtgctggggcaactggaacagcgcaggtcaccg

SEQ ID NO: 60552 - DNA, 110 bp, Mus musculus
ctaaagtaaaaggtgatgtgtccaggggtcaggttgacacatgattgtcacgagactgacacaagcagactcatgattgttaatcttgataggcaagcagcaggatttag

SEQ ID NO: 60553 - DNA, 113 bp, Mus musculus
cagaacactcaaaggcgacctgtaggggctggagatagctcagcagttaagagcactgactgctcatccagagttcaaatctcagcaaccacatggtggctcacaaccatctg

SEQ ID NO: 60554 - DNA, 84 bp, Mus musculus
gctcctatgttttcactgtcattatgatcttgcattagatcattagatctatgtcattagatcattgcaggagtgtgttggagc

SEQ ID NO: 60555 - DNA, 76 bp, Mus musculus
tatatacgtacatatatgtatgcatgtatgtacatatatacatatatacatacatatacacacatatacatatata

SEQ ID NO: 60556 - DNA, 81 bp, Mus musculus
gatattaatatactgatgtatatatgtatagagatatagtctacatctattctgtgtatatatattcataaagtaaatatt

SEQ ID NO: 60557 - DNA, 96 bp, Mus musculus
ccatgtgacccctttcctactgtcactggccgctgtgcgtgttgacaggggtggaagctgttggtggcaatgccatgtagatttggagggcaatgg

SEQ ID NO: 60558 - DNA, 117 bp, Mus musculus
tcatggatactggccctgtggtacccacaggtaggaaatgcttgagacaggtgtagcctggctgcctgtgaccctctgtccctgcctactgcagttccaggtcttcaacatccagga

SEQ ID NO: 60559 - DNA, 88 bp, Mus musculus
cacttcttgcagccttcccttgtgcctccaggtatctttcctgccttgaaacaaatacctgtatgaggcgcgtgcgcagtgccgcgag

SEQ ID NO: 60560 - DNA, 70 bp, Mus musculus
gactcactgtgtctcagtgcttgccattccagtactggattgttccaggcactcagagggccagatgcgc

SEQ ID NO: 60561 - DNA, 79 bp, Mus musculus
ttgttccctggggctggagaggtggctcagaagtgaagagcactggctgctctctctctctcagataatccaggttcaa

SEQ ID NO: 60562 - DNA, 60 bp, Mus musculus
ctcaccctctgactctggctcacctgcaagtgcggttgtgtgcggaggtgaaagtgggcg

SEQ ID NO: 60563 - DNA, 103 bp, Mus musculus
tggaggaagtaccaggaagtaagtggttcaaggaaagcaggcacaaggttggggactattaggatgtaaagttctcagaccattagcctcctgcttctttgga

SEQ ID NO: 60564 - DNA, 98 bp, Mus musculus
gatcagccttagtccatggtgatctgataggatggatgggataatttcaatatttttgtatctgttgaggcctgttttgtgaccaaaattatatggtc

SEQ ID NO: 60565 - DNA, 73 bp, Mus musculus
atggaatccatacctgtgtaagaagagacatgaaagagtgctttctctcttctgctcatgtgtgtggagctat

SEQ ID NO: 60566 - DNA, 115 bp, Mus musculus
agaggttgtagctggctgcatggttacctttctcctctggcattgtgtagagtcactttcagcaccataaacgattgctagtagaattgaagcctctagttagccattagctttt

SEQ ID NO: 60567 - DNA, 62 bp, Mus musculus
ttgaaggtttggtgtgcagtctacacatatttcatggactgtgtgaacacagagacctttaa

SEQ ID NO: 60568 - DNA, 70 bp, Mus musculus
gtcctctgcctgagtcattaggaaggagggggcggcccttctacctgggtgtcactcagtctgactggac

SEQ ID NO: 60569 - DNA, 128 bp, Mus musculus
acatcgctttttgtttgatgttaacacctgaagaggtgttacatacaagatgttttttttatatagtaacataaataagtctttctctctgtgtgtctaacttctgtcaaagatgttagcatagcaac

SEQ ID NO: 60570 - DNA, 75 bp, Mus musculus
gtgaaatcgcctggcctaggagaaggaagtccaaacacagggcaggtgcctgctgtcttctcttggtgtcctcac

SEQ ID NO: 60571 - DNA, 76 bp, Mus musculus
cccactcctgattctactctggttccagatcttaattaattagatagagcacagctggcctcagggatgacgtggg

SEQ ID NO: 60572 - DNA, 70 bp, Mus musculus
gaagttgaagaaattcctttttggaagaatgaatctatttttttctattatgagggatttctttggattc

SEQ ID NO: 60573 - DNA, 76 bp, Mus musculus
cagcacagctcgatacaggcttttggtaggtacagtttttatccactgtctgtctgtctgtctgtctgtctgtctg

SEQ ID NO: 60574 - DNA, 78 bp, Mus musculus
ggtaaaatgtttcttctgcctctctgtgtgtctgtaggctcctcaggtcagcacatgtctacggcagctagctctgcc

SEQ ID NO: 60575 - DNA, 85 bp, Mus musculus; identical to SEQ ID NO: 57439

SEQ ID NO: 60576 - DNA, 80 bp, Mus musculus
tcttagcctcttctaagaatttgtttgctttcgatgtatttttttcttaaatacaagtaggccagcagatggggcttgga

SEQ ID NO: 60577 - DNA, 138 bp, Mus musculus
atatatatatatatatatatatatatatatatatatgtatgtatgtatatatacatatatatatacacatatatacatatatatgcatatatatatacatgtatacatgtatatatatgtatatgtgtgtatatatat

SEQ ID NO: 60578 - DNA, 89 bp, Mus musculus
gcatatatatgtatatatgtgtatatatatatgtatatatacatacatacatatatatatatatatatatatatatatatatatatgtg

SEQ ID NO: 60579 - DNA, 85 bp, Mus musculus; identical to SEQ ID NO: 57439

SEQ ID NO: 60580 - DNA, 80 bp, Mus musculus
tgtttgtgagtgtctgtatctgtcttagtcagctgctgggtggagcctctgagaggacaacatgctcttgtctacaagca

SEQ ID NO: 60581 - DNA, 87 bp, Mus musculus
ccttcacttagatgcaaactttaattcctaagagacagatacagcttctcaggtaattaaacagtttgtttcattaaatgttggagg

SEQ ID NO: 60582 - DNA, 73 bp, Mus musculus
tgtagtctctggtagagcagggtgtctccactggagttgggagtcaggacacagtgaggactaggggaacagc

SEQ ID NO: 60583 - DNA, 65 bp, Mus musculus
ctgtctatctctgtctctatctctaatcaggtttgaaaacagggatgtagttcagtggtagacag

SEQ ID NO: 60584 - DNA, 108 bp, Mus musculus
tatggttaagatcatgtgctcttagactcattctacgaatgtaacattatattaatttgaatatgtattatatgcccaggagtgatatagcagcatatggtagctgta

SEQ ID NO: 60585 - DNA, 105 bp, Mus musculus
ctctctctgtctgtctttctctctcataacctgttttcactgagagaagagcgagacctcttaccactagcagtgctttaaagtagaaaaagtagagtgagggag

SEQ ID NO: 60586 - DNA, 85 bp, Mus musculus; identical to SEQ ID NO: 58391

SEQ ID NO: 60587 - DNA, 110 bp, Mus musculus
gtatgtatgtatgtatataagtatgtatgtatgcatatatatgtatgtatatatgtatgtatgtatatatgtatgtatatatgtatgtatatatgtatgtatgtatgtat

SEQ ID NO: 60588 - DNA, 81 bp, Mus musculus
gtagagccttacaggttcttgcttcatggttttatttctattataatagctataatttcaagcatcagcttgttcatttac

SEQ ID NO: 60589 - DNA, 85 bp, Mus musculus; identical to SEQ ID NO: 57470

SEQ ID NO: 60590 - DNA, 112 bp, Mus musculus
cttctccctctcggtactgtggccattctgtgtgaacctttgcagctctcgtgatcactgtcacagtctctgtgggtttgtgattgtacatcagccctgttatgcctggaag

SEQ ID NO: 60591 - DNA, 103 bp, Mus musculus
ttatataaacatcagagttgtgagataagggttggtaggtgaaaatttaaagtattgtgtttggttatcaagctgacaacaaggagttctgatggtcttatga

SEQ ID NO: 60592 - DNA, 85 bp, Mus musculus; identical to SEQ ID NO: 57439

SEQ ID NO: 60593 - DNA, 86 bp, Mus musculus
atggcaatttctttctttaggttaggtaaactttcttctgattttgttgaagacgttttctggccctttgaattgggaatcttcat

SEQ ID NO: 60594 - DNA, 99 bp, Mus musculus
tttggaatttgagaggtctaaaccatgtctctgactctctgattaatactatttgtattctctgaagcaagagacattgaggacattttggaattcaga

SEQ ID NO: 60595 - DNA, 88 bp, Mus musculus
ccagatacatacataactctagtgaaagaatggtgtatattctacatacttactaaatatgactgttgttatgttcattgttgtctgg

SEQ ID NO: 60596 - DNA, 76 bp, Mus musculus
cctatctggtttgattagaagtttcttcaccactttccaggatgagtcacaggacactctaatcactgctcagagg

SEQ ID NO: 60597 - DNA, 95 bp, Mus musculus
gaggcattgggaatggggcagagcttgggatgtaaataaataaataaataaataaataaatatttacaaagaaaggaacacagtctcattgtctc

SEQ ID NO: 60598 - DNA, 97 bp, Mus musculus
tgttttatatacatattaaatatgtctataatacatgctatatgcatgtatttatgcatatatgtatgtatgtattcctaaatatgtaaataaaaca

SEQ ID NO: 60599 - DNA, 85 bp, Mus musculus; identical to SEQ ID NO: 57439

SEQ ID NO: 60600 - DNA, 99 bp, Mus musculus
catccatccaaacaattcccacttcatgttgagacattctctgaccagggatgagtccttcccaggccatgtccatgtgagtagtgtcgttggtgagtg

SEQ ID NO: 60601 - DNA, 180 bp, Mus musculus
acatgtaatatacacatatatatatatgtgtgtgtgtgtgtgtgtgtgtgtgtgtgtgtgtgtgtgtgtgtgtgtgtatgtgtgtggtgtttttctgtgtatatatgtgtatatatatgtgtctgaatatatataatttaaaatattggcgaaatgtagaaaaagaaacaagctatgcat

SEQ ID NO: 60602 - DNA, 88 bp, Mus musculus
tttcttatgaaaagatgtattgtggtgggatgactgatatttaccattcactcactgtgacagactttttttttctcttcaaaagaaa

SEQ ID NO: 60603 - DNA, 85 bp, Mus musculus; identical to SEQ ID NO: 57470

SEQ ID NO: 60604 - DNA, 92 bp, Mus musculus
ctcgggctggcggatccctgggaattctttttttagctctgtaccaccatttcaatagggttatttgattttctggattccattttcttgag

SEQ ID NO: 60605 - DNA, 66 bp, Mus musculus
acacacacacacacacatatatatatatatatatatatatacatacatatgtgtgtgcgtatgtgt

SEQ ID NO: 60606 - DNA, 98 bp, Mus musculus
taggattctaatattgtggaaagattttattttttaactatggtagagtcaatactctagattgaaagtcatggtcttatagaatttggaatgtcttg

SEQ ID NO: 60607 - DNA, 119 bp, Mus musculus
gtgagctgctgtgtctggtgttgcaaacacttttctatattaatctgccttaaacatgactttattttattctttaagtactatagttgagtgttaactattggaaatgtgcatccaac

SEQ ID NO: 60608 - DNA, 85 bp, Mus musculus
gggtggaggaattatgtcactgggtgtgaatgttgaagtctgagatgttcactcccgttccagtgtctcactctctcttcctctt

SEQ ID NO: 60609 - DNA, 117 bp, Mus musculus
gggctttcaagggacacagaagtccttaagtttaggcttgctactttaaaatgaatttttcgtttaatataaagtggggcctggtcaggataatgttttccccttgagaaatttccc

SEQ ID NO: 60610 - DNA, 66 bp, Mus musculus
aaccaggggctggagagatggttaagtggttaagagcactgactgctcatccagaggccttgagtt

SEQ ID NO: 60611 - DNA, 105 bp, Mus musculus
acactatatgtatttgctagatataatagacattatatatatatatatatcctatatatgtatatctctctatatctctctctctgtatatatacatatatatgt

SEQ ID NO: 60612 - DNA, 98 bp, Mus musculus
tcagccttagtccatggtggtctgataggatgcatgggacaatttcaatatttttgtatctgttgaggcctgttggagaaggtaccatgaggtgctga

SEQ ID NO: 60613 - DNA, 100 bp, Mus musculus
ggaaattggtctgaaattctctatgtttgttggatctttctgtggtttagatatcagagtacttgtggcttcatagaatgagttgggtagagtaacttct

SEQ ID NO: 60614 - DNA, 107 bp, Mus musculus
tctctctgagaagagcagttgctaggccctacatcatgtggctgagattccacagagtctctctgtctcaatgccaagctgaagtaatggtactcttccttttgaga

SEQ ID NO: 60615 - DNA, 92 bp, Mus musculus
ataggtgacaggtgatatatatatatatatgtatatatatatatatatatatatacacacatgtatatgtatatgtatatgtatatgtatat

SEQ ID NO: 60616 - DNA, 102 bp, Mus musculus
taggaagaaatgaatatgtgtatgtatgtgtatgtatatgtttctatgcatatgtgtctatgtatgtgtatatgtatatgcccctatatattatgtgtgtat

SEQ ID NO: 60617 - DNA, 107 bp, Mus musculus
ccagtccttgtttttgaagcttagtaggtttgtagagatggctcagtagttaagaccactgagtgctcttccagaggtcctgagttcaattcccagcaaccacatgg

SEQ ID NO: 60618 - DNA, 85 bp, Mus musculus; identical to SEQ ID NO: 57470

SEQ ID NO: 60619 - DNA, 102 bp, Mus musculus
aaataagacagagtaaaaaaaatattgtcatggaagctgtactgtgtcacagtgtgtcacacagtaaaccctttttctacatatctttacttgtaaatgttt

SEQ ID NO: 60620 - DNA, 117 bp, Mus musculus
atattttttttactctgtcttattttattttattttattttattttattttatttgcaaggttgtaagggttgggagtgcatatgaagggatggggagcagagtgggactgcggtgt

SEQ ID NO: 60621 - DNA, 112 bp, Mus musculus
gagaggttaatttgggtgtaatccagtgccaatgaactgtacccaaagatggcttctctgtagacagagtccagaggtcatgcagggcattcacacacacagagacactctc

SEQ ID NO: 60622 - DNA, 85 bp, Mus musculus
tcaagaatgggtctgtcataaaagccagcttgcatatatctctcatatatgagagtgtctctgtgtgtgtgaatgccctgcatga

SEQ ID NO: 60623 - DNA, 83 bp, Mus musculus
gaaccttaggaggtgtggagtccattctgcctaccttgcgtagatgtgactggcagaaaattctatctatctatctatctatc

SEQ ID NO: 60624 - DNA, 106 bp, Mus musculus
ggccatggtggtctgataggatacatgggacaatttcaatatttttgtatctgttgaggcctgttttgtcaccgattatatggtcaattttggagaaggtcccatg

SEQ ID NO: 60625 - DNA, 138 bp, Mus musculus
tatacagactgagcaagctgaatatatatatatatgtgtgtgtgtgtgtgtgtgtgtgtgtgtgtaaatatatatttacatatatgcatgtatgtataaatacatatgtatgtatgtatatatgtgtaacaggatata

SEQ ID NO: 60626 - DNA, 113 bp, Mus musculus
gtgtgtgttgctttgtttttccttgctttcatccagtatttccttaccttttggaacagtagtgtatatcctgtgctgtgttggaagtatgagatctgccttttgattttcat

SEQ ID NO: 60627 - DNA, 91 bp, Mus musculus
ggtgttgatggggaaagtgtgtcacagtggttgggctttgatgtttcagatgtttaagccaggcccactcacactctctctacccactgcc

SEQ ID NO: 60628 - DNA, 85 bp, Mus musculus; identical to SEQ ID NO: 57470

SEQ ID NO: 60629 - DNA, 133 bp, Mus musculus
ttgtgttggagttttccatttattatcctttgtagggctagaattgtggaaagctcttatgtaaatttgtttttgtcatggaaagtcttggtttctccatctattttaattgagagttttgctgggtatagta

SEQ ID NO: 60630 - DNA, 80 bp, Mus musculus
tgtgtctgtgtatgtctgtctgtgtatttctgtgtgtgtctaggagttactagggactaaactgggacttgcatatcaca

SEQ ID NO: 60631 - DNA, 102 bp, Mus musculus
tatgtacatgtatatacatgtttatatgttatatatgtatatatctatgtatttatgtatacttatatctatgtatatatattgtgcatatatgtatatatg

SEQ ID NO: 60632 - DNA, 110 bp, Mus musculus
ttgggacctgctccacaccaggtgtgcagccgggataaagtagacagtgtctctctcttagtctgatgtgtgctgctgtaacagaatattcgggagtaggtaattcttaa

SEQ ID NO: 60633 - DNA, 77 bp, Mus musculus
gagatcatgtgatgagcattgacgtttttcatacattgcttccacagtggttagggatttgtttgctatgtgatttc

SEQ ID NO: 60634 - DNA, 80 bp, Mus musculus
atgctctgtgtgtgcacacaagtagttacgtaatgcactgggggtgacaaacagagctgtgtgtgtgtgtgtgtgagcat

SEQ ID NO: 60635 - DNA, 110 bp, Mus musculus
atgtccgtatttccagatgaacactagcctgtacagttctaattttgtagtatatttggtatatgatggcaagcttaaactgactgtacatagcaagtcaatatagatat

SEQ ID NO: 60636 - DNA, 56 bp, Mus musculus
ctatcagacacacacacacacatatatatctatgtgtgtgtgtgtgtggggggggg

SEQ ID NO: 60637 - DNA, 70 bp, Mus musculus
acagcaacacttgcctctgtgcctctgtgtctgccctctgggtacaaggtagagtgaggaggccgtctgt

SEQ ID NO: 60638 - DNA, 103 bp, Mus musculus
cacaggaaagtctttgctgtcatggaaatgggcatattagaataatagttctttatttattctagtcattcttcacaatctgcatgggtattcttttcctgtg

SEQ ID NO: 60639 - DNA, 71 bp, Mus musculus
ctgtgtgtctctgtgtctatgtgtagtgtatgtatgtacagtcatacatgtgagtgtgcagaagcactcag

SEQ ID NO: 60640 - DNA, 81 bp, Mus musculus
atacatttatatacatatatacatttatacacatatatgtataaatgtatacatttatgtacttacatgtgtatgtgtata

SEQ ID NO: 60641 - DNA, 78 bp, Mus musculus
tgtgttttcctctactgcagattacttgggctggtcagatctgtgagtctgagtttatagagtctgtcatgaaacata

SEQ ID NO: 60642 - DNA, 85 bp, Mus musculus
ggccatggtggtctgataggattcatgggacaatttcaatatttttgtatctattgaggcctgttttgtgaccaattatatggtc

SEQ ID NO: 60643 - DNA, 103 bp, Mus musculus
agacaccttgtggtatctggctatggtagtacaagaagacagtaatatatttatacatgtatactaccatctatgtatttccatgtctatcaatatattgtct

SEQ ID NO: 60644 - DNA, 96 bp, Mus musculus
gcctggcttcataaaaactgttttaatgtttgaaaagtactaaataattcctttcttttcagacaatggatctcaggagtgtttgtgctgttttgt

SEQ ID NO: 60645 - DNA, 91 bp, Mus musculus
cagttttgttgagtataggcttgtgtagtaggatctgatgattttttttatttcctcagattctgttgttatgtctctcttttgatttctg

SEQ ID NO: 60646 - DNA, 85 bp, Mus musculus; identical to SEQ ID NO: 57470

SEQ ID NO: 60647 - DNA, 88 bp, Mus musculus
aagggaggcaagaagaaattgtagtcctcatgcattttaaacagtgatcggcatgacaatattttaatatctttgaagcttcacactt

SEQ ID NO: 60648 - DNA, 99 bp, Mus musculus
gaatcattttgggggctgaagagatggctcagcagttaagagcacagactgctcttctgacggtcgtgagttcaaatctcagcaaccacatgatggctc

SEQ ID NO: 60649 - DNA, 93 bp, Mus musculus
gaatctaaacagcacatttgttgcatttgttgtctattttcatatatttatgcttaataaccaaaaagtacaatggcaactgtgcagggattc

SEQ ID NO: 60650 - DNA, 85 bp, Mus musculus; identical to SEQ ID NO: 57439

SEQ ID NO: 60651 - DNA, 85 bp, Mus musculus; identical to SEQ ID NO: 57439

SEQ ID NO: 60652 - DNA, 110 bp, Mus musculus
cagaaaatcagtagctctttctttaggccactgagtgagggctttgcagataatttaaaaggtagagaactgatttagtagcttgaaacatgagagcaagggtgactctg

SEQ ID NO: 60653 - DNA, 118 bp, Mus musculus
gacttcttcctttccaatttgtatccccttgatctccttttgtggtctaattgctctgtgtaggatgtaaagtactatattgaataggtagggggaaagtgggaagccttgtctagtc

SEQ ID NO: 60654 - DNA, 94 bp, Mus musculus
ggtaaaaaagaaagaactgggactggagagatggctcagtggttaagagcactgactgctcttccagaggtcctgagttcaaatcccagcaacc

SEQ ID NO: 60655 - DNA, 112 bp, Mus musculus
tgaaatgtattttgggtattctgagcttttgggccaacatacactgatcattgagtgcataacatatgtgttcatttgtgactgggttagctcattcaggatgatattttca

SEQ ID NO: 60656 - DNA, 85 bp, Mus musculus; identical to SEQ ID NO: 57439

SEQ ID NO: 60657 - DNA, 112 bp, Mus musculus
gctagtttctgtgattgtgagatgtttggaactcagaattttttgagagtgtgctcagagggatcttgttagttcttggatagttaatggttatttgttgtttgttggtagt

SEQ ID NO: 60658 - DNA, 118 bp, Mus musculus
tcttgctgacactatttgctccctgtgtgtgtatatgtatgtgtgtacatgtttgtatgtatgtatctttgtatatttgtatacatataattgggtttggtagatttaagaaccacag

SEQ ID NO: 60659 - DNA, 107 bp, Mus musculus
cagagctgcagtcagttcaagagagcagtgactatgccatgttcagaatatatctttttgatatacataactattttctctatctcttgtattttgtgccctttctg

SEQ ID NO: 60660 - DNA, 85 bp, Mus musculus
gtccatagtggtctgataggatgcatgggacaatttcaatatttttgtatctgttgaggcctgtcttctgaccaattatatggtc

SEQ ID NO: 60661 - DNA, 85 bp, Mus musculus; identical to SEQ ID NO: 57439

SEQ ID NO: 60662 - DNA, 85 bp, Mus musculus; identical to SEQ ID NO: 57470

SEQ ID NO: 60663 - DNA, 85 bp, Mus musculus; identical to SEQ ID NO: 57439

SEQ ID NO: 60664 - DNA, 119 bp, Mus musculus
gtatgtgtgtatgtatgtatgtatttatgtttgcatgtatacatgtataaatgatatatttgtatatttatgtctgtggttgtgtacacatgggtatgcatatatgtgtgtgcatatgc

SEQ ID NO: 60665 - DNA, 79 bp, Mus musculus
gacactgttgcagactgtatatatgtatgtatgtatgtaaaataccacataggtatcttaatgtacatatgcaaatgtc

SEQ ID NO: 60666 - DNA, 76 bp, Mus musculus
gttcagtccgctctagttcatcaatactgaagagtgcacaatggtaagtaagaattgatgactgggccatatgaat

SEQ ID NO: 60667 - DNA, 78 bp, Mus musculus
gactgggaagcagcacagagataagcgaaagagatttatttacttcatttagtctctctgtctgtctgtctctctctc

SEQ ID NO: 60668 - DNA, 71 bp, Mus musculus
gtgtgtgtgtgtgtgtgtgtgtgtatgtatgagggggtaaggtatgtataagtgtgtgcacatacgtatac

SEQ ID NO: 60669 - DNA, 77 bp, Mus musculus
tgagtgtgtttgtatatatgtatattgtgtagtcgtatatatgctttcatatatgtgtacattaaataacacacaca

SEQ ID NO: 60670 - DNA, 81 bp, Mus musculus
gaccaagctacgatgagtagagaatttgttcagtttttatgaatatgtgggctttctctttttgttgttgttgctgttgtt

SEQ ID NO: 60671 - DNA, 89 bp, Mus musculus
gtactctaaaatatataaatgtacatacatatatgtgtgtgatacacacacacacatacatatacatgtatgtacttatttataagtat

SEQ ID NO: 60672 - DNA, 81 bp, Mus musculus
gtatgtatatatgtgtatgtttatatatacatgcaatatgtgtaaatgtatgtatatatgtgtatgtatgtatctatgtat

SEQ ID NO: 60673 - DNA, 91 bp, Mus musculus
ggtgactaaaatgtgtcctcaatcaagcatatggctgcagagactttcactgaagctctccctctcagtgtgtgaagatgcaacagctacc

SEQ ID NO: 60674 - DNA, 77 bp, Mus musculus
ggcaacagataatcaaagattagtctgattgattcagatgtactttcagactatttgtgattgttcatgatcatgct

SEQ ID NO: 60675 - DNA, 80 bp, Mus musculus
atctatatctgccacagactctctgggtccctggtctggaagaacgggatttcttaggcagatgggcaaagaatgtggat

SEQ ID NO: 60676 - DNA, 114 bp, Mus musculus
cagtcggatctgctctgcatagccctcattactgtcaacctgggttaaattcttttaatatttgaaaaacaaatagcccggtaaccagttctgagtgtaaagtgattgttgctg

SEQ ID NO: 60677 - DNA, 88 bp, Mus musculus
gtttattttggcagaggttctcctgcttatgtacgcttggcttctatcacactcactgtatatctgaggatgaccctgcttgtcctgc

SEQ ID NO: 60678 - DNA, 114 bp, Mus musculus
ctttacctactgagacatctttcttgaacatagtttgatggcatgaggacatagtgtcaaacacactctgagtctaaatggatcattgatagtggatgttgaagtagagaaaag

SEQ ID NO: 60679 - DNA, 117 bp, Mus musculus
aaagtaacttatacacagtcacggaagtaatacaacattgatataatgctgtggtttaatacagattttgttaatgtttgtctttcccccccgcaacgatgtacttcagtgtacttt

SEQ ID NO: 60680 - DNA, 115 bp, Mus musculus
gttcctgtgtcctgagggttctgggagtagaattggtggtctttcctgtgctcacaagtgtgtcagcactcctgggagaccagcactttcctggcctgacctgagtatggagagc

SEQ ID NO: 60681 - DNA, 76 bp, Mus musculus
tatatatatatatatatatatatatatacatgtattcatatgttcatgtatatatgtatatgtatgcatatgtatg

SEQ ID NO: 60682 - DNA, 73 bp, Mus musculus
tgtcagtgtgtgagctgtgcatgtgtcacattgtgatatgacatgtgacacattgtgcatgtgtcagctgtca

SEQ ID NO: 60683 - DNA, 91 bp, Mus musculus
cccatgtctgtctgtctgtctgtctttctaaaacattgaatatttattttattaatattagtaagctgttatcagacacaccagaagtggg

SEQ ID NO: 60684 - DNA, 107 bp, Mus musculus
ctttcaaatttgtatccattagatttccttttgttgtgtaattgacctagctagaacttcaggtactatgttgaatagatagggagagagtgggcagccttgtctag

SEQ ID NO: 60685 - DNA, 112 bp, Mus musculus
ttgtccttttccactaaggtgtcactggagagatggctcagcggttaagagcactgactgctcttccagaggtcctgagttcaattcccagcaaccacatggtggctcacaa

SEQ ID NO: 60686 - DNA, 80 bp, Mus musculus
ggccagtgctttaggatagaaacagaatgtaaactggaataccatgtcacatctctgtctctgatcttctcttcctggtc

SEQ ID NO: 60687 - DNA, 76 bp, Mus musculus
gctctactccatttccatccctgtaattctttcagacagaaataattatgggtcagagatgtgactgtggtatggc

SEQ ID NO: 60688 - DNA, 111 bp, Mus musculus
ttatctgatcctgatttaactttggtatttggtatctgtctagaaaattgtccatttcatacagattttctagttgtgttgagtataggcttttgtggtaggatctgatga

SEQ ID NO: 60689 - DNA, 110 bp, Mus musculus
atgcacacacaatatatacatatctattgtgtatgtatgtatatatatatatatatatatatatatatatatatataatatgtatatatatgtgtgtacatatatataca

SEQ ID NO: 60690 - DNA, 99 bp, Mus musculus
ctcctgccccagttctgagttttaaatgaatgtccatttactgtctggctgtctgtcagtaggactcttcagcttaaacacttcagaagctgccaggag

SEQ ID NO: 60691 - DNA, 94 bp, Mus musculus
atacgcatatgtatataatattaactatgtatatatgtatgtatgttcacacacatattatatatacacagttattttgcatgcgtgcacgtgt

SEQ ID NO: 60692 - DNA, 85 bp, Mus musculus; identical to SEQ ID NO: 57439

SEQ ID NO: 60693 - DNA, 65 bp, Mus musculus
tacatgtgtatgctatatatacaatatgtacctacaatatatgtatatatacatacacacatgtg

SEQ ID NO: 60694 - DNA, 116 bp, Mus musculus
atgcacacacaatatatacatatctattgtgtatgtatatatatatagagagaatatgtatatatatgtgtgtacatatatatacatatatgcacatgtgtgtatgtatatataca

SEQ ID NO: 60695 - DNA, 75 bp, Mus musculus
agagcgcggacaggagctggtggtccgtggctccgtttctaggggagccgtcattttcagtctctgtctgacttt

SEQ ID NO: 60696 - DNA, 85 bp, Mus musculus; identical to SEQ ID NO: 57439

SEQ ID NO: 60697 - DNA, 85 bp, Mus musculus; identical to SEQ ID NO: 57439

SEQ ID NO: 60698 - DNA, 65 bp, Mus musculus; identical to SEQ ID NO: 60693

SEQ ID NO: 60699 - DNA, 116 bp, Mus musculus; identical to SEQ ID NO: 60694

SEQ ID NO: 60700 - DNA, 115 bp, Mus musculus
ctgactgtttctgcctctccagtgctgggattacgaaaccatacttgattttttttttcacatgggttttggggattaagctcaggtcatcactggtacacggtatagatattag

SEQ ID NO: 60701 - DNA, 103 bp, Mus musculus
gtagtttagtctctgggagctctgggggctctagttggttgataagttttgattataaagccaacatgggctacatagtgagttgcaagataatctagcctat

SEQ ID NO: 60702 - DNA, 89 bp, Mus musculus
ccaggtcatgaaaaatggagggtcaagctaatggtagatgatgatgatgatgatcattattattatatatgcctttcaactatgactgg

SEQ ID NO: 60703 - DNA, 115 bp, Mus musculus
tccttgaccaaggtatcattgagaagagtgttgttcagtttccacgtgaatgttggatttctattatttattttattattgaagatcagccttagtccatggtgatctgatagga

SEQ ID NO: 60704 - DNA, 78 bp, Mus musculus
ctttgttccaccagccttcaatgtcctccttgggaacactgtccatttccttggagacagtctgctgttggcccagag

SEQ ID NO: 60705 - DNA, 89 bp, Mus musculus
gttctctcttgtatttagatgtatacacatgtaagtgtgcacacatgaatatgtgcagatgaatgtgcacatctgtgtgcatagtgagc

SEQ ID NO: 60706 - DNA, 85 bp, Mus musculus; identical to SEQ ID NO: 57439

SEQ ID NO: 60707 - DNA, 113 bp, Mus musculus
gactcgtgtttccactatgggccaagtctggtctgtggctatgcagcaacagaggtctgtgtcaatgtctgtggctcatattactaccaaaggccatgtggaaattcctggtc

SEQ ID NO: 60708 - DNA, 103 bp, Mus musculus
tgcaggaaagaagagactcaaattgtctggaggaatctcagatggctcagcaggtaagagcactgactgctcttccagaggttatgagttcaaatcctagcaa

SEQ ID NO: 60709 - DNA, 105 bp, Mus musculus
atgttgccaacttgtgtgtgtttatatgtatatatacatatatatgtatgtacatatatgcatgtatatatgtatacgtatgcatgaatatgtattgtgtagtat

SEQ ID NO: 60710 - DNA, 98 bp, Mus musculus
atatgtatgtgtatatatacatatgtgtgtgttgtgcatatatgtaagtttgcatgtgtatgtttatatgtttatgtgtgcattcgtgcatgagcaca

SEQ ID NO: 60711 - DNA, 84 bp, Mus musculus
gagtgtatatgtatatgtgtgtatgtcagtgtgtttctatatatctgtgtgtctctgtatatgtgtctgtgtgcatatgtattt

SEQ ID NO: 60712 - DNA, 64 bp, Mus musculus
gctgcccagtgacctcagtactgaaggggaagtgccgctctccccacagtctcactgtcgcagc

SEQ ID NO: 60713 - DNA, 65 bp, Mus musculus
atgaagaaagagacacagcaagagcctccattgcgcctgaggctcctgtctctctgtctgtccat

SEQ ID NO: 60714 - DNA, 81 bp, Mus musculus
tgtcggatctctctttgggacacttttgctagttttctgcttttgggcaagtgactcccagtgtctcagtctccatctaca

SEQ ID NO: 60715 - DNA, 70 bp, Mus musculus
ataggggcaaggcacagcttctcggtgtgtgtgcacgtgcatgcatgcctgtctgtgtgtgtgtgtctat

SEQ ID NO: 60716 - DNA, 104 bp, Mus musculus
tatgtgtgtgtatatatggataagtgtatgtgtgtatatatataagtgtatgtgtatatgtgtgtgtatatatatgtataagtatgtgtgtgtctgcacgcatg

SEQ ID NO: 60717 - DNA, 119 bp, Mus musculus
gcactcatggaaagcatatgtgtgtgcatacagccacatgcatattgaccttgataatttatttttatcttgtgtgtttctgtgcatgtgtatgtgcaagtgcatgtgtttgtgtggag

SEQ ID NO: 60718 - DNA, 78 bp, Mus musculus
atatggcctgcctgcctgcctgcctgcccactctgctatggggtggggtgtaaggagaagcagctgggcaggaaatgt

SEQ ID NO: 60719 - DNA, 68 bp, Mus musculus
agtcttgagagacatatgggggaggtgtctgtctctgtctatctctctgcctgtctgtctctgtgtct

SEQ ID NO: 60720 - DNA, 77 bp, Mus musculus
accctcctacctggctggctgtttgcctgtctgcaaagaagacttaggaaaaacagcacaaacaaaaccaccggggt

SEQ ID NO: 60721 - DNA, 83 bp, Mus musculus
gggcaggaattctctgtgcctgtgtgggtctctccaggagctgatggaaggatcaccatagcaccacagcaacatccatgtct

SEQ ID NO: 60722 - DNA, 107 bp, Mus musculus
cagactgatatagagagctggacagacagatagatgatagacagcagagggatttacttggtggttctcaggctgcctgctagcccatcaattctggtaatttccac

SEQ ID NO: 60723 - DNA, 119 bp, Mus musculus
tatgtgcatatgtgtgtatacatgtatagtgcatgcacatatgtatatgtatgtatgtgtgtttatatatgtatgtacatatatgtgtgtatgtatatgtgtaagtataaatgtgtgta

SEQ ID NO: 60724 - DNA, 97 bp, Mus musculus
accttctgtttgggttggagagatagctcagcggttaagagcacttactgctcttccagaggtcctgagttaaattctcagcaaccacatagcaggt

SEQ ID NO: 60725 - DNA, 83 bp, Mus musculus
cactgactgctcttccagaggtcctgagttcaattccaagcaaccacatggaggtttatgaccatctgtaatgggatctggtg

SEQ ID NO: 60726 - DNA, 117 bp, Mus musculus
tgattaatccacgttctgtgcttcttttacaatgggtgccactttgagtagtgattttattcatcacgactgatcaaagcaacttgggagttctgttctattgtggtctctgtatca

SEQ ID NO: 60727 - DNA, 100 bp, Mus musculus
agctacaggtttgtggcattggactataacagtgatgtcaaacaaaaactacatttttttagattattgaccacttaaaaagccaatgttttcctttgct

SEQ ID NO: 60728 - DNA, 114 bp, Mus musculus
ttgttgtttgtttttgttttgctttgttttcatgatagggtttgtctatatagctttggctatgctagaactcactctgtagatcaggctggccttgaactcacagaaatccaa

SEQ ID NO: 60729 - DNA, 84 bp, Mus musculus
cctcaaaccagcaacttctctgtgactctgagtttctttcaatggtggcactcagggctgtgactaagtgcttgcgatttgagg

SEQ ID NO: 60730 - DNA, 117 bp, Mus musculus
atgcgttttgttagcaaggaatccttcatcaagtttgctttaatgaaacatcctctctcctgtgtctgtttcagtgaaacattccttcatgagattgccttagcctttcacctgtgt

SEQ ID NO: 60731 - DNA, 85 bp, Mus musculus; identical to SEQ ID NO: 57439

SEQ ID NO: 60732 - DNA, 80 bp, Mus musculus
gctggcggcatcactgagaactccagatgacagttcagcagacagtcactgcatctgcttgtctaagtgaggcattaagt

SEQ ID NO: 60733 - DNA, 91 bp, Mus musculus
gtgggaggactggtattttactgtgtttgaaagaatagcctgttacatagatgacatagtaggatgtattcaaacccgctcctcattaagc

SEQ ID NO: 60734 - DNA, 104 bp, Mus musculus
tggtgtatagtaatgtctgataaattaacacagaggcaagatagggatagttatttttattttgcatgataagttaggtgttagttttgctaggatgaatatca

SEQ ID NO: 60735 - DNA, 117 bp, Mus musculus
atgtatctgtctatctatctatctatctatctatctaccatctatcttttgatttctacctgtaatgtagaaagacatatcagagggtttgttaagaaactggatagcacggctcat

SEQ ID NO: 60736 - DNA, 118 bp, Mus musculus
ttggaaaaactcctgtgcaagtgtcttgctgagactggatttgggacagactagtgattatgatgtggatagagagaaggcagctcaccaacacactgaacagaatcagaaatttcaa

SEQ ID NO: 60737 - DNA, 103 bp, Mus musculus
gtggcttctttggggtgtgggaggaagggtaatgccaaggattagggtgctggcttccagcctcactccctgtcagcctccacccacgctcagcagaggtctc

SEQ ID NO: 60738 - DNA, 71 bp, Mus musculus
ttcctgccagagccacagtcactcactcagcgatgcaaccctggttgggctgagttctgtaaaatcaggga

SEQ ID NO: 60739 - DNA, 99 bp, Mus musculus
ctgcttagtggtagagctcttgttcagccctgtcagctggactctatagagtagagcctgtgctctcaacagctgagcattacagttctcactgagtag

SEQ ID NO: 60740 - DNA, 102 bp, Mus musculus
catcctctctcttctttcctctgtgtttgagtatgcatgtatgtatgtatgcatgcatgcatatagataaatacttttggtggtatgaatgataatttgatg

SEQ ID NO: 60741 - DNA, 83 bp, Mus musculus
acagcggttaagagcaccgactgctcttccagaggtcctgagttcaattcccagcagtcacatggtggctcacaaccatctgt

SEQ ID NO: 60742 - DNA, 94 bp, Mus musculus
aggaaaactaacagagtctaccaacctggacccttcagactctctcagagactgaaccaccaatcaaagggttacgtgggctaaacctaggcct

SEQ ID NO: 60743 - DNA, 102 bp, Mus musculus
cactatccagtcttcttggatcctttccctcttcctcctcctcagatgatgatgacaatgatgatgatgatgatgataatgatgaagaagacaatgattgtg

SEQ ID NO: 60744 - DNA, 72 bp, Mus musculus
atatatgtatacatatatattcatatgtatattaatatatacagctgtggaggtacgtgtgtgtatgtatat

SEQ ID NO: 60745 - DNA, 75 bp, Mus musculus
tagactgcatagaaaggggagttctagcagagcccagtgctcattgttctctgcgtcctgactgtgtgcagtgtg

SEQ ID NO: 60746 - DNA, 114 bp, Mus musculus
ctggctacctctgcccactgaggcttaaggagtggccgtagccatcacaactcagggcctggctctctcagcctctccctaactctccgtgacactttgcagacacccagccag

SEQ ID NO: 60747 - DNA, 96 bp, Mus musculus
tatgtatatatatatatatatatgtatatatgtatatatatacatatatgtgtatatatgtatatatatgtgtgtatatgtatgtatatatatgta

SEQ ID NO: 60748 - DNA, 115 bp, Mus musculus
gcatcattattaaaaatgctgtgccttgggtctggagagatggcttagtggttaagagcactgactgctcttccagaggtcctgagttcaaatcccagcaaccatatggtggttc

SEQ ID NO: 60749 - DNA, 103 bp, Mus musculus
cctacactagcagaacacctaaaagttagatattgtgcaggttcaggggagacagtgaagcctctgaggtcacaatctgatggagaggcaagagcaggaaagg

SEQ ID NO: 60750 - DNA, 74 bp, Mus musculus
ttcttctctccctcagtctctcagtgaagcccagacagggcaagggtctgcagaggaggaaagggcgaaaggaa

SEQ ID NO: 60751 - DNA, 112 bp, Mus musculus
atttttatgtgcactggtgttttgcctatatgtatgtctgtgtgtgtctgtgtgagggtatcatatcttggagttacagacagttgtgagctgccatgtgggtactgagaat

SEQ ID NO: 60752 - DNA, 93 bp, Mus musculus
gaaatggtgcctcctgcattcgtggttgggtcttcctacctcaattaacatcaaggtagtttaccaaagacatgtttgcagaccaacccgatc

SEQ ID NO: 60753 - DNA, 70 bp, Mus musculus
tctgcaaacatgtctttggtaaactaccttgatgttaattgaggtaggaagacccaaccacgaatgcagg

SEQ ID NO: 60754 - DNA, 68 bp, Mus musculus
gggcatacagatggaacgatggtgcctgcctttgctgaaggcccttgtcactgtcactgtcactgtcc

SEQ ID NO: 60755 - DNA, 102 bp, Mus musculus
agtctactgttaaagtaacttttattctcctgttggtaattgtctcagaggctcactgcctccgtctgctaacctggtcctagttctgaaaccttctagact

SEQ ID NO: 60756 - DNA, 101 bp, Mus musculus
gtgactcatgcacagcctcctatacacataataaataaaatctgaaaaagtttttatttttatttattttatgtgtatgcatattttgcttgcttgcgcgc

SEQ ID NO: 60757 - DNA, 72 bp, Mus musculus
tgtgagagagtatgtgtatacatgtatgtatttatgtgcattcatgtactcctatgtgcatactgttttaca

SEQ ID NO: 60758 - DNA, 68 bp, Mus musculus
atgacttcccttgtcactggaaagttgactcgcttcacggcatttttcctggtgccagtgggaggcat

SEQ ID NO: 60759 - DNA, 112 bp, Mus musculus
tcctgactgttgagtaagttaagtttggggctgagcagagacacacgactgagagaacagtgtgcggcaaatgagtctgagtgcctgaggtgtagaccttaagaaagcggga

SEQ ID NO: 60760 - DNA, 112 bp, Mus musculus
gcgaactcaaggttctgagcccctggataaggtcactcactctgtcattcacttgttgttgggcctcagacaagcgagttcacctgtctgggtctcagtttcctcagtaagt

SEQ ID NO: 60761 - DNA, 70 bp, Mus musculus
ggactagactactaggttggaattgtcaaagctcaattttagatttgtaatgtaatctagaagttagtcc

SEQ ID NO: 60762 - DNA, 79 bp, Mus musculus
atttctgttagtttcactgtgtctctgtttagtttctgtttccaggatctgtccattgatgagagtggggtgttgaagt

SEQ ID NO: 60763 - DNA, 106 bp, Mus musculus
ttacccaggaacacatattttgtgtatatatatctatatacatgtaaagaaatatacatgcatattcatacagatgtatgtatgcagagtagatgctgctttgtaa

SEQ ID NO: 60764 - DNA, 114 bp, Mus musculus
tatatatgagtgtatatgtgtgtgtgtacccatgaatgtggatgtgtattgtatgtgtgtgtatccacacatgtggatatatgtgtgtgtttgggtgctcatgtatgtgtgtgc

SEQ ID NO: 60765 - DNA, 105 bp, Mus musculus
atatgtatgtgcatgtgtgtttacgtgtgtgtgcatgtgcatgtgtgtatatgaatatacatacacatacacacacacatacacacacatgcaacacacacatat

SEQ ID NO: 60766 - DNA, 92 bp, Mus musculus
tgtatgtgcctgtgtgtatagttgtgtgtgcatgtgcatgtgtgtatatgaatatacatatacatacacacacacgtataaacgcaagcaca

SEQ ID NO: 60767 - DNA, 119 bp, Mus musculus
ggaggcatgatccccttgctccacatccttgccagcatctgctatcacttgagtttttgatcttcgacactctgattggtataagatggcatctcggagtagttttgatttgcatttcc

SEQ ID NO: 60768 - DNA, 128 bp, Mus musculus
catgtatgtgaatgtgtgtttacgtgtgtgtgcatgtgcatgtgtgtatatgaatatatgtatacatacacacacacatacacactcatgtaacacacacacacacacacacacgaatggcactcatt

SEQ ID NO: 60769 - DNA, 63 bp, Mus musculus
aggtctgtgtgtctgtctgtctgcgtgtgtatctgtacatgcacaaagtatacacatacacct

SEQ ID NO: 60770 - DNA, 66 bp, Mus musculus
tgtgagaaactggagggtgtggatgcaggctaactcatctttacatcccacgcactgtctgtcaca

SEQ ID NO: 60771 - DNA, 107 bp, Mus musculus
tgtatgtgcatgtgtgtttacgtgtgtgtgcatgtgcatgtgtgtatatgaatatatgtatacatacacacacacatacacacgcacgcaacacacacacacacaca

SEQ ID NO: 60772 - DNA, 96 bp, Mus musculus
gagtctttccagctgggttcccatgtgagatctatgtatatctttttaaaaaaatgagtatggtcatctcctgggcatgcatcctctgagtagctc

SEQ ID NO: 60773 - DNA, 108 bp, Mus musculus
catgtgatgcccccagtgtatgtgcctgtgtgtatatgtatgtgtgcatgtgcatgtgtgtatatgagtatacatatacatacgcacatacccatacaagcatgcaca

SEQ ID NO: 60774 - DNA, 97 bp, Mus musculus
gcggagtgtagtttcaagctctgtgtcacactgtctcctgccccacacactcaggaaatattgtgcagttatcaaatgtttataggaacacacctgc

SEQ ID NO: 60775 - DNA, 96 bp, Mus musculus
agggaagatgagagacccataagcattgcacagctggctctataagcaagccaagctcagcctctgtcactgtctgtcgagtcctatttataccct

SEQ ID NO: 60776 - DNA, 87 bp, Mus musculus
attatgtcaacgagaacgagatttccagggtagagagggtgcacactgtctaacatagcttggagtctgtcatcttaagtgtgtgat

SEQ ID NO: 60777 - DNA, 118 bp, Mus musculus
tcatagctcgggccattcgtgggagtatgtttgcatgtgagtatatgcatattcatgtacagaagtgaatatgtactcaactatacacacatgcacattcttggtgggcatcacatga

SEQ ID NO: 60778 - DNA, 114 bp, Mus musculus
atgcatatatctatcaactatttattatcatcagtgcatatatgcatctatgtatctttgtatctatcatctatgtatatatttatatgtatattagtagtatcatgtatgtat

SEQ ID NO: 60779 - DNA, 138 bp, Mus musculus
gccagtttcagttggtggactcagtatgttcttagtcatggaggacccagctttctttccctgtgtgattcactgagtctaacatctcaccacctacactgtttggctagtcaacatctggtcctcttgctctccaca

SEQ ID NO: 60780 - DNA, 118 bp, Mus musculus; identical to SEQ ID NO: 60777

SEQ ID NO: 60781 - DNA, 98 bp, Mus musculus
gtatatatgcctgtgtgtatatgtatgtgtgcatgtacatgtgtgtatatgaatatacatatacatacacacatacccatacaaacatgcatacaaac

SEQ ID NO: 60782 - DNA, 101 bp, Mus musculus
atatgtgtatatatatgtgtgtgtatatgtgtatatatatgtgtgtatatatacacacatatacacacacacacacacacacacacacatattctttatac

SEQ ID NO: 60783 - DNA, 111 bp, Mus musculus
tgtgatgctacccatgtatgtgcatgtgtgcttacttgtatgtgcatgtgcatgtgttgatatgaatatacataacataaacacacgtgtatatgcaggcacacacacaca

SEQ ID NO: 60784 - DNA, 79 bp, Mus musculus
tgtatgtttatgtgtgtatagtttatgtgcatgtgcatgtgtgcatatgcatatacatatacatccatacaaacatata

SEQ ID NO: 60785 - DNA, 118 bp, Mus musculus
tgtgatgccacccatgtatgtgcatgtgtgtttacttgtatgtgcatgtgcatgtgttgacatgaatatacataacataaacacatgtgtatatgcaagcacacacacacacacacag

SEQ ID NO: 60786 - DNA, 111 bp, Mus musculus
ctggtgtgtctgaagacagtgacgatgtgctcattacatataaaaataaaaataaaagatttatttattttatgtatgtgagtacacaattactctcatcggacacaccag

SEQ ID NO: 60787 - DNA, 79 bp, Mus musculus
tgtgtgtatatttgtgtgtgcatgtgcttgtgtgtatgtgaatatatatatcatacgcacgcacacacacacacaaatg

SEQ ID NO: 60788 - DNA, 112 bp, Mus musculus
gtgatgcccccagtgtatgtgcctgtgtgtatatgtatgtgtgcatgtgcatgtgtgtatatgaatatacatatacatacacacatacccatacaaacatgcacacaaacac

SEQ ID NO: 60789 - DNA, 127 bp, Mus musculus
catgtgatggcgccccccccccccagtgtatgtgcctgtgtgtatatgtatgtgtgcatgtgcatgtgtgtatatgagtatacatatacatacacacatacccatacaagcatgcacacaaatacac

SEQ ID NO: 60790 - DNA, 107 bp, Mus musculus
agccaactttaaagagacttacttagcattttaagaaatggaaagaggtaataggcatacaattttgattttatttaaagcacacaagtcggtctgaagagatggct

SEQ ID NO: 60791 - DNA, 84 bp, Mus musculus
atgcccacgtcagagttagagcttaaatgtcacctgtttgtaactgaaagggaacaaaagcctctctctgtgactcacgggcat

SEQ ID NO: 60792 - DNA, 70 bp, Mus musculus
gtcagcctgcctatctgtctgcttgattatttatttttagactaagttttgctggttagcttgggctggc

SEQ ID NO: 60793 - DNA, 80 bp, Mus musculus
ctgactgagctatctctctgtgtctcccagctcctactgtgtaaaaatgctgcatatgtagcagaagatggcctagtcgg

SEQ ID NO: 60794 - DNA, 135 bp, Mus musculus
taaccactctccagccccaactgattctactttttacatttttattttatgtacacaagttatttgactatatgtatatctgtataaggtatcagatcccctggaacaggagttacattcagtcactttgtgagc

SEQ ID NO: 60795 - DNA, 86 bp, Mus musculus
gcacctccatgtcaggctccctgtttgcttttgctatgataagtaatagtaggggaacgcctttgacttatttattccaagagggc

SEQ ID NO: 60796 - DNA, 109 bp, Mus musculus
tgttgggtgccaatattgaagttcatactccctgcttttgtttatatttttactgcagatgtttaaaaatgtacaacatattgggctgtgaaggcagttggtaaaagca

SEQ ID NO: 60797 - DNA, 112 bp, Mus musculus
gggggtttagggtgggcggcaagtgcaacaccccctgggcaggctgtcagtagctctcacagtcagctcagggcacccaagtcagtgtagcaaggcgtctgctggggtaacc

SEQ ID NO: 60798 - DNA, 100 bp, Mus musculus
tagtactaggatttcaagtgtgtgtcactgtctctggcttatctattggctccattgccccagtgacttacatatatccactcttgatttactcatgcta

SEQ ID NO: 60799 - DNA, 74 bp, Mus musculus
aagtttaactgtgatcatgtttgaagatgctttgctgcaaatgcaggggcagtgagtgatcagagtggagactt

SEQ ID NO: 60800 - DNA, 98 bp, Mus musculus
gtgtgtgtgtgtgtgtacatatatatgtgtatgtatatacatattgaatataatgaattaatagcatatatatatgtgtgtgtgtatatatatatatg

SEQ ID NO: 60801 - DNA, 105 bp, Mus musculus
tgagtgagtgtgcctttgaggagtaggggtgccctgtttactctaccatttgatatcacagaatttgcacagctggacccaaccctccaagcccatacacattga

SEQ ID NO: 60802 - DNA, 85 bp, Mus musculus; identical to SEQ ID NO: 57470

SEQ ID NO: 60803 - DNA, 85 bp, Mus musculus
tgcaccaagcaacctagactagctgaccaatgagttttagggatctccctgtctctgactccctggtgctgggactgcaagtgta

SEQ ID NO: 60804 - DNA, 76 bp, Mus musculus
tggctgtctctctctgtccaagagtccctgccttcctggacatagggcatgggatggaagggagaggaagcagcta

SEQ ID NO: 60805 - DNA, 98 bp, Mus musculus
atatatgtgtatacattatatatgtaggtgaatatatgtatatatgtatgtttgcgtagtgtacacacacacttatatgtgtgtgtatatacatgtat

SEQ ID NO: 60806 - DNA, 114 bp, Mus musculus
gtggagtttccaggccatctagagtgatgcttcataatgtcccggctctctgcctctcactgagggtcccatcagatatccccaagtatccatttcaagacactgtttctcgat

SEQ ID NO: 60807 - DNA, 74 bp, Mus musculus
gcatgcatgtgtatgtatacatatactactgtagatgaatatatatttgtatatgtgtgcatgctgagtgttgt

SEQ ID NO: 60808 - DNA, 103 bp, Mus musculus
gccacaccccacccccatcccaacattgttcagtactcagcacaatgaatcattttcaaattgactcattgtgaactgtctcccagctgttggaatgtctggc

SEQ ID NO: 60809 - DNA, 88 bp, Mus musculus
ctatgtatttgtctggctctgacagagcctctcaggagacagctataccaggctcctgtcagcatacacttcttggcatccacaatag

SEQ ID NO: 60810 - DNA, 114 bp, Mus musculus
attaagtgtggattctgatttctcttactcagatttgttcttcagttttcagtagtgtttttgatgaacagaagtttgcagatttaatgtatgtcagttatgtttaatccctct

SEQ ID NO: 60811 - DNA, 85 bp, Mus musculus; identical to SEQ ID NO: 57439

SEQ ID NO: 60812 - DNA, 96 bp, Mus musculus
acttctcccactgtatcatactgtctctcagtcgctgtgcagcagggtttactattgctcacagatagacaacacctatggttagtgaggtggagt

SEQ ID NO: 60813 - DNA, 104 bp, Mus musculus
agtagaggaaaaggattttgactaggtgtgggatagcatggtagtgactgagttagaatcccctgactctctcactctcagaacctggattacttttctctatt

SEQ ID NO: 60814 - DNA, 115 bp, Mus musculus
ttctaatatctatctgtctgtctgtctgtctttctatcatctcacacatgcacacacacatgagagagaggagggagggagagggagagagggagggaggaagggagagagggag

SEQ ID NO: 60815 - DNA, 108 bp, Mus musculus
cttaacagcttttggaacacaataatgaactgtcatattctaaataaatattgaaactatttatttagaatatgacagttcattattatgttcattggttgcattaag

SEQ ID NO: 60816 - DNA, 56 bp, Mus musculus
atgtgtgtgtgtatgtacgtatgtatgtatgtacgtatgtatgtatgtatgtatgt

SEQ ID NO: 60817 - DNA, 110 bp, Mus musculus
tgtgtggtttgtgaggtgactcatgggccttaacaagagatgacataaatattccttgtaatgttttgtttacttccactatgaatctatacctaaacaaattttaaaca

SEQ ID NO: 60818 - DNA, 162 bp, Mus musculus
tatgtatatatctatatataatatggatagtacacatgtatatatgtggtattatttagatatctatgtatatatacatatgctaattattgtatactaatatagtatatatgaatataagcatatatgtacattatgatatataaataatatatttacata

SEQ ID NO: 60819 - DNA, 62 bp, Mus musculus
tttatgccactctctagtctatgggaatgtttcgtcccagtgactgatgacagtggcctgaa

SEQ ID NO: 60820 - DNA, 65 bp, Mus musculus
gctgcctgtgcatccagatgtagaactctccactatgtctctaacactgtctgcttgcatgcggc

SEQ ID NO: 60821 - DNA, 112 bp, Mus musculus
atgttttttatttatttattttattaagccaggtctttttcatatgtttccctccttgccaggagactgaatcatttagaagccctggccctggtaataacatggtggtgaa

SEQ ID NO: 60822 - DNA, 85 bp, Mus musculus; identical to SEQ ID NO: 60145

SEQ ID NO: 60823 - DNA, 119 bp, Mus musculus
acaatagagttttcccatggagaagggacaagatatcctcccaaggtatgtccttagtgactctctcacacagccaggtcctaccttccaaagtctctgccttctctccagattgtacc

SEQ ID NO: 60824 - DNA, 64 bp, Mus musculus
gctaagcagacagaactaagagaggcattatatatctaatgcactgtgctagtgagtgcttggc

SEQ ID NO: 60825 - DNA, 81 bp, Mus musculus
ggacactgaaacatgcctgggtctgaaacctaggaggcaactctgccttcacactcagattctcagtgaattcagaagtgc

SEQ ID NO: 60826 - DNA, 95 bp, Mus musculus
tggatgtttcgggcattatctaagtttttttaaaagtatcaattcgggggctggtgagatggctcagtgggtaagagcacccgactgctcttcca

SEQ ID NO: 60827 - DNA, 84 bp, Mus musculus
gacacactcactgtcatgtgttctgagcccacccactgacatgccccctccactctctcacacacacaggcagtgccccgtgtt

SEQ ID NO: 60828 - DNA, 110 bp, Mus musculus
tagtccctgttttagtcactttttatcaatgacttctttgcagctataattatttgggagtaagaactgagtctgcttaggcattaaggaggtgtgtggagcacgttttg

SEQ ID NO: 60829 - DNA, 85 bp, Mus musculus; identical to SEQ ID NO: 58391

SEQ ID NO: 60830 - DNA, 118 bp, Mus musculus
aagaatggcgcagtggatgaggacttgactgcttccccagagagaagagcctgtggagactctacttctactttgaatgaggcaggcaggcatccgacataatggctctgctcatctt

SEQ ID NO: 60831 - DNA, 56 bp, Mus musculus
gtgtgcgtgtatatatatatatatgtatatacatgtgtatgtatagacacagacac

SEQ ID NO: 60832 - DNA, 122 bp, Mus musculus
gtatatacatatatatatatatacacgcacacacactgcatgtatatacacatacatacagtgtctgtgtgtgtgtgtgtatatatatatatctatatatctatatatctatataggctctg

SEQ ID NO: 60833 - DNA, 70 bp, Mus musculus
gatggagacatatgtctgagcgaacaagcctgtgtccttgcggacatctgagtctgtttctgtcttcatc

SEQ ID NO: 60834 - DNA, 111 bp, Mus musculus
ggtacctggtatctgtctaggaaattgtctacttcatccagtttttctagttctgttgagtatagccttttgtagtagaagctgatgatgttttggatttccccaggttct

SEQ ID NO: 60835 - DNA, 85 bp, Mus musculus; identical to SEQ ID NO: 57439

SEQ ID NO: 60836 - DNA, 85 bp, Mus musculus; identical to SEQ ID NO: 57439

SEQ ID NO: 60837 - DNA, 71 bp, Mus musculus
tgtatggttgttttactgtatgtatatatatatatatatatatatatatatatgtataatttcactaaaca

SEQ ID NO: 60838 - DNA, 113 bp, Mus musculus
gctgaaggcagaagaacatgactttgcttctgggattgagaggagacagtgaactcacttttatcagtccgttcatcaccctcatgaccatgtatagccatctctctgaacgc

SEQ ID NO: 60839 - DNA, 159 bp, Mus musculus
tacatgcgtactgtgaaaacataagaaaatatatgtatgtttgtagtatatatgtatgtatgtgtatatgtatatgtgtgtatatgtttctgtatgtgtgtgtgagagagagagacagagagacagagacagagaggcagagagagataatggatgaca

SEQ ID NO: 60840 - DNA, 110 bp, Mus musculus
tttttaagattttctctgttcacttttacatctatctgtatgtgtctgtctgtgtgaatttatgccatttgtgtgcagatgcctgtgaaggtcaggagagccattggagg

SEQ ID NO: 60841 - DNA, 114 bp, Mus musculus
agaagattatctgtttcaattttatctatatttggataagaaatctctcatttttatatattttttgccaagtactcatagctcactaggtactgttgaacaccaaaatctttt

SEQ ID NO: 60842 - DNA, 117 bp, Mus musculus
tgtaagcagagctgtgaaaggggccaacccagtcctgtcataatatatgtatgtcatatatatatgttttcttagactagcaagccattaaacaatagctccaattccttgaatgca

SEQ ID NO: 60843 - DNA, 78 bp, Mus musculus
gtctcctgagaggctctgtcaatgcctgacatattcagaggtggatgttctcagccaaaaatcagaatcttagagagc

SEQ ID NO: 60844 - DNA, 108 bp, Mus musculus
cacactgtgattactgagacagggagtgagtggaaagaagtcagtgtccaaaggtactaagttttccttcagtgtgacttgtttcctggatgaacagtaagaaatggt

SEQ ID NO: 60845 - DNA, 73 bp, Mus musculus
tgtgtatgtatgtatgcatgtatgcatgcatgtatgtatgcatgtatgtatgtatgtggtatatatgtgagca

SEQ ID NO: 60846 - DNA, 71 bp, Mus musculus
gcatggcattcctgtatgtgcatgtgcatgtgtacgtgtatgtgcatgtgcatgtgtatgtgtatctgtca

SEQ ID NO: 60847 - DNA, 70 bp, Mus musculus
tcggaacaggattgaagctcggaatccaggcagctggctgagtggctccaggcatcattccttgtatgga

SEQ ID NO: 60848 - DNA, 78 bp, Mus musculus
cgtgtatgtctgcttttgtgtgtatatgtatgtatgtatgtatgtatgtatgtatacatatatgtaggcatctttatg

SEQ ID NO: 60849 - DNA, 85 bp, Mus musculus; identical to SEQ ID NO: 57439

SEQ ID NO: 60850 - DNA, 94 bp, Mus musculus
atatctatgtctatatccatgtgtgtgtgtgtatatatatacatacatatatatatatatatgtatacacacacacacacacacacatatatat

SEQ ID NO: 60851 - DNA, 67 bp, Mus musculus
tgtgtgtgtgtgtgtatacattccattatactatatatatgtatgtgtatgataccatacatacata

SEQ ID NO: 60852 - DNA, 74 bp, Mus musculus
gttcactttgtgacaatacattcagattctacacaaatctcctgtgttgatctgtctgtctgtcattcataaac

SEQ ID NO: 60853 - DNA, 120 bp, Mus musculus
gttgaggttaacacatctaagccatcttaggcagactaagaagtgacttttttttttcaaagtttgagtttgagttttctggcctttctctgtgagatgcactaatgtaacaagtttgac

SEQ ID NO: 60854 - DNA, 85 bp, Mus musculus; identical to SEQ ID NO: 57439

SEQ ID NO: 60855 - DNA, 96 bp, Mus musculus
gatcagccttaatccatggtgatctgataggatgcatgggataatttcaatatttttgtatctgttgaggcttattttgttaccaattatgtggtc

SEQ ID NO: 60856 - DNA, 102 bp, Mus musculus
tctccatttccatcagacagaaacaattatgggtcagagatgtgactgtgcaatgtcaaccccaccctcactttatgtcctgtcttcctgttggaagtggga

SEQ ID NO: 60857 - DNA, 113 bp, Mus musculus
aattgagccatttgcaatttctgtaagagtcagatggaaatcccagcctcctgcctctctgtatgcctgttactgggtgacctttgctcttttatcttgccaagagctgagtt

SEQ ID NO: 60858 - DNA, 94 bp, Mus musculus
gtgctgctattaaagtcttagaatgcaaagaagccatctcttgttatttaggatatcaggtttttttgtacttctcatttgtaataaagagcat

SEQ ID NO: 60859 - DNA, 85 bp, Mus musculus; identical to SEQ ID NO: 57439

SEQ ID NO: 60860 - DNA, 61 bp, Mus musculus
ccagtctagattcaaattagtagggaaaagtgatgtcattctctctgtgtgtctaggctgg

SEQ ID NO: 60861 - DNA, 132 bp, Mus musculus
gaagcatctcagcactgatatcaattatgacttggaattgcaactttctataatcccaacacagaagagtgagtgatgagctctgtgcagcaagttggttagtgagatgagtcaaacaggttcagtaagaga

SEQ ID NO: 60862 - DNA, 115 bp, Mus musculus
tccttgaccaagatatcattgagaagagtgttgttcagtttccacgtgaatgttggctttctattatttatttttttattgaagatcagccttagtccatggtgatctgatagga

SEQ ID NO: 60863 - DNA, 64 bp, Mus musculus
atgtatatatatatatatatatatatatatatatatatatatgtgtgtgtgtgtgtgtgtatgt

SEQ ID NO: 60864 - DNA, 85 bp, Mus musculus; identical to SEQ ID NO: 57470

SEQ ID NO: 60865 - DNA, 80 bp, Mus musculus
gagacagagagataaacatatgtaatatatatggaagccagaagtctgtgtgtgttctgatgtgtctgtcaatcattttc

SEQ ID NO: 60866 - DNA, 94 bp, Mus musculus
ggaaccaggtttaggctaacactcgtgaatttgttgatcagggttgttccaggacacacataataatacaagctattggcatttatttggtttc

SEQ ID NO: 60867 - DNA, 83 bp, Mus musculus
gcaaacatacagcttggtcttcatgtgggccccccccccaacaaatggagcaggggctgtctctgactctgttgcctgcctgt

SEQ ID NO: 60868 - DNA, 96 bp, Mus musculus
ccatgagagaagcatgccatcgctaggcaacactgtgcagttaaaccctttttcactgtctcactgtgtgtagtaagcaggaagcagcactcaagg

SEQ ID NO: 60869 - DNA, 56 bp, Mus musculus
atatatatatatgtatatgtatatatgtatatatgtatatgtatatgtatatgtat

SEQ ID NO: 60870 - DNA, 85 bp, Mus musculus; identical to SEQ ID NO: 57470

SEQ ID NO: 60871 - DNA, 116 bp, Mus musculus
tgggctattacaagagactagcatcatgcaaaacgatttgtgattctgttgtttacatttatatattggtacaggaaacaaatttggagcatatgttggagttgtcagtttgttta

SEQ ID NO: 60872 - DNA, 58 bp, Mus musculus
catgtatgtatgtatatatgtatgtatgtatgtgcatgcgtgtgtgcatgtgtgtgtg

SEQ ID NO: 60873 - DNA, 103 bp, Mus musculus
ttggtcgaattgctctggctaggacttcaagtacaaggttgaataggtagggagaaagtgggcagccttgtctagtcccagattttagtgggattgcttccag

SEQ ID NO: 60874 - DNA, 85 bp, Mus musculus; identical to SEQ ID NO: 57439

SEQ ID NO: 60875 - DNA, 95 bp, Mus musculus
ctctctgtgtctttgtctctctgtttctatctctttctctctgtgcagccaggactctctcaaggaagtaggctaggggtcaaatgcataggggg

SEQ ID NO: 60876 - DNA, 67 bp, Mus musculus
cagcaggctgtcccagactctctctttgtttttttcgaaacaaggtttctctgtgtagccctggctg

SEQ ID NO: 60877 - DNA, 95 bp, Mus musculus
ctaagggctaacatgatctgataaagtctgtctgtctctggtattaaagagaaaattaggactcagtaatagacatatacacagtggcttcttag

SEQ ID NO: 60878 - DNA, 117 bp, Mus musculus
ttttggcaattacatttaaagctgcctcctttataaatctatgtaaattgtgtttctatcattttatatataggtggaccaaaaaaagggggggggccttaaaaacggatgaggaaa

SEQ ID NO: 60879 - DNA, 85 bp, Mus musculus; identical to SEQ ID NO: 57439

SEQ ID NO: 60880 - DNA, 76 bp, Mus musculus
ctggtgtagatctccatgacgatcttgggcatctgagagtagatactgaagacacgcataggagcaatgtgcctgg

SEQ ID NO: 60881 - DNA, 92 bp, Mus musculus
ctgctaatgaatctatctgctccttcaatcgctttatcaagtgtgtctgggtaagactcgctctgttctgatgctgatgtggaatcatgcag

SEQ ID NO: 60882 - DNA, 72 bp, Mus musculus
tcttggcttatgatttgactgagtatttatatgtctaatcttgagttttcagttagcacagtgtagctaaga

SEQ ID NO: 60883 - DNA, 70 bp, Mus musculus
tacatatatacatatatgtatacatgtatatataatatatatgcagtgtgtgtgtatgtctatgtatgtg

SEQ ID NO: 60884 - DNA, 88 bp, Mus musculus
gtcttccaaatcctctggctcttacactctgtctgcctcctcttctgtggagttccctgagtccagaaaggagagatttgatggagac

SEQ ID NO: 60885 - DNA, 85 bp, Mus musculus
ggttgtttctagcaaggtaaagaactatgtttatcttattccttgggattcggtgatcgaatacattttttgccatgatatagcc

SEQ ID NO: 60886 - DNA, 85 bp, Mus musculus; identical to SEQ ID NO: 57470

SEQ ID NO: 60887 - DNA, 85 bp, Mus musculus; identical to SEQ ID NO: 57470

SEQ ID NO: 60888 - DNA, 107 bp, Mus musculus
cataggattttagaggatgtggttatgattttagttcgccttctcagagacactctatgtgagacgtgacttgctggaaatttgggaccgatgtgttcaaatccttg

SEQ ID NO: 60889 - DNA, 76 bp, Mus musculus
gctacagtaggattcaccatcagcatctggaagaggcttgatttctggaatgtagtggatctgattgcttcttggc

SEQ ID NO: 60890 - DNA, 85 bp, Mus musculus; identical to SEQ ID NO: 57439

SEQ ID NO: 60891 - DNA, 77 bp, Mus musculus
gctgtcagcctatataaaggacattgaagaagggaggtctctctctttgtctgattgctctcattctgctggcaagt

SEQ ID NO: 60892 - DNA, 102 bp, Mus musculus
aagctcaaacttctggggctggagagatggcttagatgttaagagcactgactgctcttccagaggtcctaaattcaattcctagtaaacacatggtggctt

SEQ ID NO: 60893 - DNA, 103 bp, Mus musculus
tacgtgtgatggttatatgtgtatgtgtctatgatgtatgtgtgagtgaagagtctgtggtgagtatttatttatgtggtatgtgtacatgtgtgtgtgtgtg

SEQ ID NO: 60894 - DNA, 85 bp, Mus musculus
ggccatggtggtctgataggatatatgggacaatttcaatatttttgtatctgttgaggcctgttttgtgaccaattatatggtc

SEQ ID NO: 60895 - DNA, 83 bp, Mus musculus
gcctatctgtctgtctgtgtcacatgatggcacttttaaatgtgtgggttatggtagggagagttcagtacttgttagtaggt

SEQ ID NO: 60896 - DNA, 118 bp, Mus musculus
gtgcatggtaaggcaagcttggctagtgagtcatagtttctttattgagtactgattttgcagttcactcatttcataactgtgacagtcacatttctaaggcctttctctcattgta

SEQ ID NO: 60897 - DNA, 95 bp, Mus musculus
agcagaactcaaggatttaaaagaagtatctatcactttgcgataaaaatgtctatagagggttggtgagagggttgagtggctgagtggctgct

SEQ ID NO: 60898 - DNA, 80 bp, Mus musculus
acatgtgtttacagatgtgtatacatgtgtatgagtacatgtatatatgtgtgtacatatctgtgtgtgagtgtgcatgt

SEQ ID NO: 60899 - DNA, 116 bp, Mus musculus
gcttcatgagctcactcaggcttgtgtgctcaccatcggacagagagactgaagtttgtctccagtcagcttcttttcctccttgacactgagcctttaaagcgtggctatgaggc

SEQ ID NO: 60900 - DNA, 105 bp, Mus musculus
gtatatacatagaagtgaatatataatatatgcatatatgagtatatgtatacatatatttgtatgtatgtatgtacgtatgtatattcaaaccaagtatcttac

SEQ ID NO: 60901 - DNA, 85 bp, Mus musculus; identical to SEQ ID NO: 57470

SEQ ID NO: 60902 - DNA, 82 bp, Mus musculus
tcagtaccaggagtgaatttcttcttgtgaagcaggttttaggtccaatcagaaagaagttggttaccactgaaaatgctgg

SEQ ID NO: 60903 - DNA, 76 bp, Mus musculus
gtacagctgggtctttaggtagaatagttttcaattttctgagaaactgtcagactgatttccagagtggatgtac

SEQ ID NO: 60904 - DNA, 68 bp, Mus musculus
tatatatatatacacatatatatatatatatattcaaatatgtgtgtgcatatatgtatatatatata

SEQ ID NO: 60905 - DNA, 85 bp, Mus musculus
ggtgcatcttaaaggactgtgactctcagtcatttaaaaaaatgtggttacacaatgtgagaatcaatatcccttagggacagcc

SEQ ID NO: 60906 - DNA, 149 bp, Mus musculus
tatgtatatatatatatatatatatatatatatatatatatatatgtgtgtgtatatatatgtgtatatatatatatgtgtatatatatgtgtatatatatatatatatatatatatacacacacacacacacatatatatatatatat

SEQ ID NO: 60907 - DNA, 76 bp, Mus musculus
ggagaaatagatgctgagtggcagagcaaactacaggttatctagtttagagtgtgccaccagccttcatgcctct

SEQ ID NO: 60908 - DNA, 85 bp, Mus musculus; identical to SEQ ID NO: 57439

SEQ ID NO: 60909 - DNA, 72 bp, Mus musculus
attatacagatggaatgctgtttatatatacatttatatgtatatgtgagtgtgtttgtatatgtgtgtaat

SEQ ID NO: 60910 - DNA, 108 bp, Mus musculus
actgtttttggttggtgataggatgttggctctgaagttaggtcattggtcagattttcctaacatgaatttttagagcattaggttaaagtcccaaggaaagacagt

SEQ ID NO: 60911 - DNA, 63 bp, Mus musculus
tatatatatatatatatatacatacatgtaacacatatatatgtatatatatgtgtgtgcatg

SEQ ID NO: 60912 - DNA, 85 bp, Mus musculus
ggccatggtggtctgataggatacatgggacaatttcaatatttttgtatctcttgaggcctgttttgtgaccaattatatggtc

SEQ ID NO: 60913 - DNA, 103 bp, Mus musculus
gagccaagaggagagattagataaagacatccaatttagggctgagtcttcaaggtttctcactctctgtgtactgtccagttataggtctctatatttgttc

SEQ ID NO: 60914 - DNA, 85 bp, Mus musculus; identical to SEQ ID NO: 60912

SEQ ID NO: 60915 - DNA, 132 bp, Mus musculus
gagacctgtgaggtgagagactctcggggctctaaggactttagatgaaatgcctgacagtagagagagagaatttataaagcccacctccagctcgaagacagggttgccatcctacagtcacacctctga

SEQ ID NO: 60916 - DNA, 85 bp, Mus musculus; identical to SEQ ID NO: 57439

SEQ ID NO: 60917 - DNA, 74 bp, Mus musculus
gcttttaaatccgggtctagctgttcgggtgtattggggtgccctggactggctgagttctgatgatggagagt

SEQ ID NO: 60918 - DNA, 112 bp, Mus musculus; identical to SEQ ID NO: 59330

SEQ ID NO: 60919 - DNA, 111 bp, Mus musculus
tctgaggcaggtggacaaggtgttggcgagtgacagacagatcaacacttgagattatgtagaatctgaatgtattgtcacaaagtgaacaccaatcttatatagtacaga

SEQ ID NO: 60920 - DNA, 57 bp, Mus musculus
ggcttcagtccaatggttgggtgtatctgtctgtctcagtcagctgttggtcgggtc

SEQ ID NO: 60921 - DNA, 105 bp, Mus musculus
gccttagtccatggtgatctgataggatacatgggacaatttcaatatttttgtatatgttgaggcctgttttgtgacaattatgcggtcaattttggagaaggt

SEQ ID NO: 60922 - DNA, 85 bp, Mus musculus; identical to SEQ ID NO: 57439

SEQ ID NO: 60923 - DNA, 63 bp, Mus musculus
gatgatcatgttgatgtgttcttgcattgggtttgcgagaattttattcaatatttttgcatc

SEQ ID NO: 60924 - DNA, 138 bp, Mus musculus
gtgtatgtatgtgtgagtgtaggtgcatatgtatttgtgtgtatgtacgtgtctgtgcatgtgcatgtatgtatgtatgtatgtatgcatgcatgaatgcgtgcatgtaggtgtctgcaaaacaaaaagccagatcca

SEQ ID NO: 60925 - DNA, 67 bp, Mus musculus
ggggtccgagcagagagggagcactctgcctgagcatcggcagcagacatcttggttctgggacccc

SEQ ID NO: 60926 - DNA, 83 bp, Mus musculus
tccagctgtctctgagactctgagatcctggtgtgactaagctcctgtgatcctatgatcctgggtgtgtttgagtgtctgga

SEQ ID NO: 60927 - DNA, 102 bp, Mus musculus
gtgcatgtacattgcaacattcacatactcatgagtgcatactatatacatcacacacgcacacactgaataagtgaatggaattgtaatctcattatgcat

SEQ ID NO: 60928 - DNA, 76 bp, Mus musculus
gttatatgtgtatatatgtgtgtatatatatgtatatacgtatgtatatgtatatatacatatgtatacatataac

SEQ ID NO: 60929 - DNA, 77 bp, Mus musculus
tctaagtaggatatggtttgtatagatacccaactccaaattataggagaggcagtcttgcaatacccccccttggg

SEQ ID NO: 60930 - DNA, 118 bp, Mus musculus
tgaagttattgtccatggtgactcaagtgtacttccagagaagggccctgagtctgtctctctgattcactggcaaattctagaggcattgggtggccttggtaatggacaagactca

SEQ ID NO: 60931 - DNA, 85 bp, Mus musculus
gtgctcttgtgcacaaacacacacacagactaacatttaaaaatataaggctgggctggtgaggttgctcagtgggtaagagcac

SEQ ID NO: 60932 - DNA, 92 bp, Mus musculus
gaagccaatagaccagctccttgggagcttaaggggagttttgctttgttttttattttttctttgctctaggtcaaagctgtataagcttc

SEQ ID NO: 60933 - DNA, 102 bp, Mus musculus
ctcagtttagtacagtttaggtaacccagactgggccaagacttcaagagtctgacctcagtgtatttatctctgttatatttaaacattgcacaattggag

SEQ ID NO: 60934 - DNA, 70 bp, Mus musculus
ttggtgtgagacagaagagagaaagctgttttttatccaagctaaaaattctttttactgtccaggccaa

SEQ ID NO: 60935 - DNA, 106 bp, Mus musculus
gccagactatttgaacttctgctttagtctattctgaatttttaaatatgatcaggtcatagaagtgagctcagagagataccagtagttaggaaggcagaatagc

SEQ ID NO: 60936 - DNA, 103 bp, Mus musculus
tggacgctgaaggggtgtttcccgtgtattttagtctggcagtcacttagaagctgacagttgactgtgagacggaaatggtatgattttcctttaacttcca

SEQ ID NO: 60937 - DNA, 88 bp, Mus musculus
catcttttgaaaatttgagagtgtaagaactggaaaactgacatttcagcccaggagtctctgcaactcaaactggtttctaaaaatg

SEQ ID NO: 60938 - DNA, 67 bp, Mus musculus
catatatattatatttatgtgtgtgtatgtatatgtatataagtatgcatgtatataagtatgtatg

SEQ ID NO: 60939 - DNA, 72 bp, Mus musculus
gatggtgtgtgtgtgtgtgagtgtgtgtgcgcgtgcgtgcgtgtgcacatgcacacacacacacacacagtc

SEQ ID NO: 60940 - DNA, 58 bp, Mus musculus
tgtgtgtgtgtgtgtgtgcatgtgcacacgcacgcacgcgcacacacactcacacaca

SEQ ID NO: 60941 - DNA, 82 bp, Mus musculus
ggtacaaaaatagagatcctggattcaaattctcattttgatgatcaaaaatagcatgggtgtggatgtttgtttctgaacc

SEQ ID NO: 60942 - DNA, 73 bp, Mus musculus
tgcgggggtactttataaaggttggacagaattttagaagagatgaaatcactgactctgactgaccctggca

SEQ ID NO: 60943 - DNA, 83 bp, Mus musculus
catgggacaatttcaatatttttgtatcagttgaggcctgttttatgtccaattatatggtcaattttggagaaggtcccgtg

SEQ ID NO: 60944 - DNA, 67 bp, Mus musculus
gggtccctgtttccataaggtcagccacataaagaacagtgtggctgtctgtctggcaggatggctc

SEQ ID NO: 60945 - DNA, 80 bp, Mus musculus
ggtaatgagatgactatttgccagagctataggtatagatgcgtataataacgtacagagctgtgaactgtcacattgcc

SEQ ID NO: 60946 - DNA, 92 bp, Mus musculus
tggttgctttgctttcagcatcacagggcttgaggaaggtctctctgtctgtctggatgcacacatttctgaaagcctttggagagcagtca

SEQ ID NO: 60947 - DNA, 113 bp, Mus musculus
acacagcactgctttgtagttattttattccaggaagagtgggcagggtgcctgaggaaccatctctggctccaggactcaaccgatctagtggcggagagaaactgttgtgt

SEQ ID NO: 60948 - DNA, 57 bp, Mus musculus
tctgggttgagcaggaaagaaggctcagcagttaagagcactgactgctctttcaga

SEQ ID NO: 60949 - DNA, 102 bp, Mus musculus
cttgactttattaaatggataaagtctatttgatttggggtaatgtataaagtatttctatatattttagtcctcagaggatttttttttttttgagtcaag

SEQ ID NO: 60950 - DNA, 90 bp, Mus musculus
tctttcattggtcatggcggactggttctgtaagagtgtgacaactgtcgtcattgcttatctatctctttcttttgactcatgtgctga

SEQ ID NO: 60951 - DNA, 85 bp, Mus musculus; identical to SEQ ID NO: 57439

SEQ ID NO: 60952 - DNA, 69 bp, Mus musculus
agcagagagaaatgactgtggacatgcttgctacttgcttgcttgttctcagcttaatttcttcttgtt

SEQ ID NO: 60953 - DNA, 72 bp, Mus musculus
tagcacatgtacatgcacacagacacacagtctctgtctgtctgtctgtctgtctgcctgtctctctggcta

SEQ ID NO: 60954 - DNA, 72 bp, Mus musculus
tagccagagagacaggcagacagacagacagacagacagagactgtgtgtctgtgtgcatgtacatgtgcta

SEQ ID NO: 60955 - DNA, 118 bp, Mus musculus
gccatctatctatctatctatctatctatctatctatctatctatctatctatcacccagtaaatatttatagatatgtatagatggtaaatttatatatatgtataggtggtacata

SEQ ID NO: 60956 - DNA, 100 bp, Mus musculus
gaggaagccttgatgcagatgcctgcctcgcctccctcttggctggtggcagtcacagctgagtgagtggtgagtcagcactgggcagtcattcatcctt

SEQ ID NO: 60957 - DNA, 86 bp, Mus musculus
gatgaatgactgcccagtgctgactcaccactcactcagctgtgactgccaccagccaagagggaggcgaggcaggcatctgcatc

SEQ ID NO: 60958 - DNA, 90 bp, Mus musculus
ggtaggagttgagaagagacagaccagagtttggcaaagcagagtccattctgctttggttttgtcgcctctgtccctccagctcctatt

SEQ ID NO: 60959 - DNA, 84 bp, Mus musculus
atattctgggctagaacacagagtggacagacggggtactctgtacagcactgtcctgctcaaactgtcataaaagcagaatgt

SEQ ID NO: 60960 - DNA, 91 bp, Mus musculus
ctttcctttctgtgacttgtcatagcatgttctttttttttaatagaagagaaagaatatgtctgaggccaaaggaaaaaagtctggaaag

SEQ ID NO: 60961 - DNA, 110 bp, Mus musculus
gtagatgctcaacttgtcactatgtgcaacatttagaaggttttccagaaaaggtaattttgtggatttcttttgataaatgttatgggtcaatattttaagatttttac

SEQ ID NO: 60962 - DNA, 119 bp, Mus musculus
aggaagactctgatgccaatcaaagagaagcacaagaaaaccttgttaagagtactcatttacttcttaacagcgccttcctgtattctttttaatgctgccctctaggattcgtttct

SEQ ID NO: 60963 - DNA, 81 bp, Mus musculus
ttacatgtgcacattcatgtgccatcagtatgtatatgtgtgtgctgtgtatgtagcatgtgtttgtgcaagtgcatgtga

SEQ ID NO: 60964 - DNA, 66 bp, Mus musculus
tggaactctagttctgtctataagagcagtaaggctctgtctcttaatcactgagccatggttcca

SEQ ID NO: 60965 - DNA, 95 bp, Mus musculus
atgctgtcttctggtctcactctggctttctctcactgggactccagtcaggagaaaaagcacagaagagtcgacggcataaggaggacctttgc

SEQ ID NO: 60966 - DNA, 86 bp, Mus musculus
cagttttggaggggctggtgagatggctcagcggataagagcacagactgctcttccaaaggtcctgaattcaaatcccagcaacc

SEQ ID NO: 60967 - DNA, 83 bp, Mus musculus
ggggccttgtgtttgagtgtgttcaagagtcttcctaggatctaggtctggggacactgtgtgcctctcttcaacagtttctc

SEQ ID NO: 60968 - DNA, 68 bp, Mus musculus
ctcattatgtatcactctgtgtctcaggccggcctcaacctcctggtgactagaattacatatgtggg

SEQ ID NO: 60969 - DNA, 105 bp, Mus musculus
actcctgtgtactcagcaagtgctattagccactgtctgtctctcacgttcccacatatgtaattctagtcaccaggaggttgaggccggcctgagacacagagt

SEQ ID NO: 60970 - DNA, 75 bp, Mus musculus
cacggttacaagatgactgttcttgtaaatctatgcccatgaactatgtctacagtatttcttgttggagctgtg

SEQ ID NO: 60971 - DNA, 82 bp, Mus musculus
agctaaaaggtcaagatattttagagaatacatgtcctaactatgagacagacatctctgcagattttcttcttcttgagct

SEQ ID NO: 60972 - DNA, 92 bp, Mus musculus
tgagccctcttgtggttgctgggaattgaatttagggcctctgctcgctccagttggccccactcactcagtccctgtttgctccagcccaa

SEQ ID NO: 60973 - DNA, 95 bp, Mus musculus
ttcatttcctgctgggtggctactgctgggcagacgtttttggttctgttttgctggatgagcttctagcttgtagatttgcagcttacaatgag

SEQ ID NO: 60974 - DNA, 78 bp, Mus musculus
agggagaatagaaagacaggagcaagaaactaaggctaatctatctacgtatctatctctctatctctctatctctct

SEQ ID NO: 60975 - DNA, 97 bp, Mus musculus
tgacagtgggtggtcatgtttataagtagacgaatgctgctcagtcacactctcaatctcagttacaaaatctgctatgggcaaaaccactcatgca

SEQ ID NO: 60976 - DNA, 63 bp, Mus musculus
ctacagcagacaaatgagacacaccctcacaggctactgggagggtagtaggttgtaatgtag

SEQ ID NO: 60977 - DNA, 92 bp, Mus musculus
gtatgtatgtatgtatgtatgtatgtatgtatgtatgtatgtacctaccttcctacctacccatccatgcgtgtacatgcctatatgcacac

SEQ ID NO: 60978 - DNA, 64 bp, Mus musculus
cacacacacacacatacacacacgcgcgcgcgcggcatgcatgtatatgtgtgtgtgtgtgtgt

SEQ ID NO: 60979 - DNA, 78 bp, Mus musculus
actgtcactcacagaggccatgagatcccctgggactatagttacagatgtttgtgagctgtcatgtgggtgctaagt

SEQ ID NO: 60980 - DNA, 117 bp, Mus musculus
tctcaggatgaacgtcacatgtcccagaaacactgggcaatgctggaagacaggcacactctgtgcctgactaaaaatggcaactgggcttgtggttgggtgtgaaaacaggaaaga

SEQ ID NO: 60981 - DNA, 67 bp, Mus musculus
gatacatacatacatacatacatgcatagatagatgatagatatgtatatatgtgtgtatatgtatt

SEQ ID NO: 60982 - DNA, 107 bp, Mus musculus
ggagaggagcccggtggtatcttggataaagacatcttgctttcaagtgaatttgtacatgagaggccattaaagaacattttccctctctgtggaatcaggagagc

SEQ ID NO: 60983 - DNA, 75 bp, Mus musculus
caccaagatctaggcaattgcaagttagtagaaatatttttctttaaaaatgcaggtgtcgtaacgaacatggtg

SEQ ID NO: 60984 - DNA, 91 bp, Mus musculus
ctcctctacacataaagagtcagcacagtgaggggtgagaagatactttcagctctaccaccatctgtctgtggatccagtgagccaggag

SEQ ID NO: 60985 - DNA, 65 bp, Mus musculus
ggaggccagaggaagatattccaaagaaaggcattaagtgtctttctctgtcactctctgccttc

SEQ ID NO: 60986 - DNA, 91 bp, Mus musculus
tcatgaacttcactgaatttcttgttcaggtcttgagttgactttctcatgtcatttctcagtttatttgaatttttcttgaggtcactga

SEQ ID NO: 60987 - DNA, 84 bp, Mus musculus
ggccatggtatctgataggttacatgggacaatttcaatatttttgtatctgttgaggcctgttttgtgaccaattatatggtc

SEQ ID NO: 60988 - DNA, 78 bp, Mus musculus
tttgctgtttgtgtgcctggctctcactgtctccattgctggaaatcctctagggccagttgtatcacctacagtaga

SEQ ID NO: 60989 - DNA, 104 bp, Mus musculus
gttcttcactcataaatcatatatacatatgtatgtgtatacatatatgtatatgtatatacatatgtatatgtgtgcatatgtatatatgtctatgtataagc

SEQ ID NO: 60990 - DNA, 72 bp, Mus musculus
cttcctcaatcactctctgtctcaatttttgagataaggtcttattttttgagataaactgtgacctggagg

SEQ ID NO: 60991 - DNA, 85 bp, Mus musculus
ggccatggtggtctgataggatacatgggacaatttcaatatttttgtatctgttgaggcctgttttgtgaccaattatatggtt

SEQ ID NO: 60992 - DNA, 109 bp, Mus musculus
tggcagagtgagtgctctgtgaggaaccatggcggagtgagtactgtgtgaggactgatggcagagtgagtgctctgtgaggaccagtagcagagtaagtgctctgtga

SEQ ID NO: 60993 - DNA, 83 bp, Mus musculus
tccgtgatgatagatggcagagtgattgctctatgataacccacagcagagtgagtgctctgtgaggaatcatggaagagtga

SEQ ID NO: 60994 - DNA, 62 bp, Mus musculus
ggacccatgacagagtgagtgatgtgaggattgatgacagattgagtgctctgtcaggagcc

SEQ ID NO: 60995 - DNA, 76 bp, Mus musculus
tccgtgatgatagatggcagagtgattgctctatgataacccacagcagagtgagtgctctgtgaggaatcatgga

SEQ ID NO: 60996 - DNA, 107 bp, Mus musculus
cagagtgagtgctctgggaggagtgatgacagagtgagagtaaggactcctggaagagtgagtacactgtgaggacccatggcagagtgagtgctttgtcaggagcc

SEQ ID NO: 60997 - DNA, 62 bp, Mus musculus
tgtagagtgagtactcagtgaggacccattacagagtgagttctctttggggacccatggca

SEQ ID NO: 60998 - DNA, 69 bp, Mus musculus
catggcattctgtctgagtgtctgagtgtcatgtgggtggaatgacatcatgcttttcagactgccttg

SEQ ID NO: 60999 - DNA, 79 bp, Mus musculus
atacagtgaaaagctcccggatagcaagagcagggggaggctctgtattctgtgtctgtgtgtctggctgtgtctgtgt

SEQ ID NO: 61000 - DNA, 90 bp, Mus musculus
ggtccagaacactgactgttcttgcagaagacttcggttggattcccagcacccacagtctctctgtataactgcgtgtaactcggttcc

SEQ ID NO: 61001 - DNA, 119 bp, Mus musculus
gctcctgttcttgacagctgcgttgtctgagttgccattgttagaaagctattatttttaattaaaagcaatggagctgggaataatagcacagcttgtgatgctagaatttaggatgc

SEQ ID NO: 61002 - DNA, 89 bp, Mus musculus
gcttcaggggctggagagatggcttggtggttaagagcactgactgctcttccagaggtcccaggttcagtcggcagcacccacaaggc

SEQ ID NO: 61003 - DNA, 87 bp, Mus musculus
cctgtgtgaccagagaagtgggggagcaggaaacaacagaactggtttccttcctacccactcacagcctctctgtgatggcaaagg

SEQ ID NO: 61004 - DNA, 114 bp, Mus musculus
taaaagcagtgcagaaacataatgagttcacttattttggagcatttaataacagttatagacagttatgtgatcaggcggagttatgacttattcattctttcactgctatta

SEQ ID NO: 61005 - DNA, 73 bp, Mus musculus
catatatatgtatatatacatgttttctttttctactaaagaaatgccttcagtgtgtgtgtgtgtgtgtgtg

SEQ ID NO: 61006 - DNA, 72 bp, Mus musculus
gtgaaagatgacacccagtgctgacctctgtcctccacaggtacagatgtctgcacatacatgcatactcac

SEQ ID NO: 61007 - DNA, 104 bp, Mus musculus
ggtactcattttagagtgttagtagtttatgcttttctaggtgtttgtgctttctttaaactttcagttggttggcataaagttatgcagttatttttattacc

SEQ ID NO: 61008 - DNA, 67 bp, Mus musculus
gtgtgctatgaatgcacatatatataaatgtatgcatgtacttatgtatgtatgtatttatgtatac

SEQ ID NO: 61009 - DNA, 73 bp, Mus musculus
gaggttcttacatctccctttaatgagatactgaagtgacagatctctcaggagacagagctgggggaatctc

SEQ ID NO: 61010 - DNA, 61 bp, Mus musculus
tgctgttggcagggagtggaggcaggcagctctgcacagctcactactcagtcagtcagta

SEQ ID NO: 61011 - DNA, 68 bp, Mus musculus
tatgtatgtatgtatgtatgtatatgtatgtatgattgtatgtgtgtatgtgtgtatatgtatgcatg

SEQ ID NO: 61012 - DNA, 82 bp, Mus musculus
ctatctatctatctgtctgtctgtctgtctgtggtggtttgtatatgctcagttcagggagtggcactattagaaggggtgg

SEQ ID NO: 61013 - DNA, 115 bp, Mus musculus
gccaaatgctgacgatgtcgaggagatgggcctgtaacatattatattttttatgaacatggaagtgtgagtatgagagtggagggagatgatagcctgatctgccagctgtggc

SEQ ID NO: 61014 - DNA, 77 bp, Mus musculus
tatatgcctatgtgtctatgtgcatgtgcatgtgcatgtgtgtgtgtgtgtgtgtacatgacgtgtggatgcatgta

SEQ ID NO: 61015 - DNA, 91 bp, Mus musculus
ctgttagccatctgagagtgtcactgtgtgttttaagggattgtatacatgtagagcacaacacaggtgaggaccgaagtggataaagcag

SEQ ID NO: 61016 - DNA, 104 bp, Mus musculus
cgtgaatatataccttcctagtatatgtgtgtctctctgtgagtatgttatgtgtaacaatagttaaaggagaagttatgaattttagaaagtgtgaagtcatg

SEQ ID NO: 61017 - DNA, 84 bp, Mus musculus
tagaggaatgggaagggaagtgattcctgggacacacactctggcagtgggtacttgagaaaatcattccctatgcatttcctg

SEQ ID NO: 61018 - DNA, 101 bp, Mus musculus
gttgaattgctctggctaatacttcaagtactacgttgaatagatagggagacagtgggcagccttgtctagtacctgattttagtaggattgcttccagc

SEQ ID NO: 61019 - DNA, 75 bp, Mus musculus
tcagagtgcagagaacccagagagaacacatggccagtgagatgcttggcctgtcctgtagtcactgttctttga

SEQ ID NO: 61020 - DNA, 121 bp, Mus musculus
gtatgtgtatgtatgtgtgtctatgtatgtatgtatgtgtgcatgtgtgtgtatgtatgtatgtatgtatgtatgcatgcatgcatgcatgcatgcatttaggagattatttgtatgtgtg

SEQ ID NO: 61021 - DNA, 89 bp, Mus musculus
tagcttatcactgtcatggaaccagtcactcagtagagagagagcagagctgtttgcctttctttgctctttattgcaattgatagcta

SEQ ID NO: 61022 - DNA, 77 bp, Mus musculus
ctcgagtgactatctctctgacacttttcccctcgtggtgacaggaaatgaagtgtcaatgcaaggaaacacttgag

SEQ ID NO: 61023 - DNA, 71 bp, Mus musculus
caggaggggcgtgccaagttccacaagaatcccagtgattctgagatgatggagaatgcaaactctttgtg

SEQ ID NO: 61024 - DNA, 74 bp, Mus musculus
ccctgagacctcaaaagtttagatcaatgaaagtttatttttctttgactaaaagtttcatcatgggtcctggg

SEQ ID NO: 61025 - DNA, 82 bp, Mus musculus
gggtgcatacacaatatctcagggggagcagagttggctcgcacccactctgtcattccaaaggaaatgtcttttataaccc

SEQ ID NO: 61026 - DNA, 71 bp, Mus musculus
tgtgtaacaaagaaaaatgctgagtgaagaaagagcccacagaatgtgcagaattcttcaccagctacaca

SEQ ID NO: 61027 - DNA, 72 bp, Mus musculus
ctggagggctaactgtctgtttctctgtgggatgttacccttgttaagattggataggacttagctctgaag

SEQ ID NO: 61028 - DNA, 64 bp, Mus musculus
gggtgggctgcagaggagaacgacactggaggtccagtaagatgctcttctctctctctcaccc

SEQ ID NO: 61029 - DNA, 116 bp, Mus musculus
agagctcaggatttctttgcaagcggcactgtttctatcacacacacccactctgtggtgcgtgcctcagagagggtgttactgtcagagcttggagggtttctgtaaacagttct

SEQ ID NO: 61030 - DNA, 81 bp, Mus musculus
aggaatgaagcccaggtcctgtgagagcagccagtgctcttagccactgagccatctttcccagccccaggctcttgtctt

SEQ ID NO: 61031 - DNA, 77 bp, Mus musculus
gagtgtgtgagaacactgacagctggcttctctgggtttcgtttgtgggatgtctctgtacaggtctcatttaactc

SEQ ID NO: 61032 - DNA, 67 bp, Mus musculus
gaagagaagaaagactcggaatgaggggaaccctggacattgaactcccagtctttctgtctctctc

SEQ ID NO: 61033 - DNA, 73 bp, Mus musculus
ggaggactgagagaagagacagggctgtgctgggatgtcagagatgcctcagggctccagtttttagtccttt

SEQ ID NO: 61034 - DNA, 85 bp, Mus musculus
gatgtgtcactgggagtgcgctttgggggttcaaaacatacatttcgttcccagtgtctccctgcctgcctcccagttgcagatc

SEQ ID NO: 61035 - DNA, 63 bp, Mus musculus
gcaaaggattgttctcagagagcacagaagctgtgctccctgctggcttagcaagacttttgt

SEQ ID NO: 61036 - DNA, 62 bp, Mus musculus
catgtgcttgattctctaatgtccctggaggggtacaactttccagaagagtgtgagctatg

SEQ ID NO: 61037 - DNA, 82 bp, Mus musculus
tcttcttcttcttctttatgcatgtgtttgtggtgtctgtatgtatttgtgaatttgtacatgtgtggaggctggaggttga

SEQ ID NO: 61038 - DNA, 114 bp, Mus musculus
tggtgtcccattggtgtttttctgtgtaggcctgtcagtgtctgtgtgtctgtgagcctggggggccatggccttgctgacttcaggccctcccacaggagatcgaggaagatc

SEQ ID NO: 61039 - DNA, 57 bp, Mus musculus
tggtgggggatggaatacagggttctgggagaactctgtgagtctctgtctccacca

SEQ ID NO: 61040 - DNA, 83 bp, Mus musculus
tcattatagttggtgactctctccttggactcaagcagtttctttacttttaggtgagggtctgtggctggctggttgggtga

SEQ ID NO: 61041 - DNA, 118 bp, Mus musculus
gtgtccttattagaggaagtgtgtcactgtaggagtgggctttgagacctgcctggctgcctggaagccagtcttctgtttgccttcagctcctccagtgccatgcttgcctagacac

SEQ ID NO: 61042 - DNA, 87 bp, Mus musculus
tctctgtcacagaacatagagggcagagtaggttggtcaaaacaaactcctagaaggttttctgctttccattcttccagccagaga

SEQ ID NO: 61043 - DNA, 64 bp, Mus musculus
cctttgtctctgagttagggtgttggtgacagaagttactgagcacccactccctctaataagg

SEQ ID NO: 61044 - DNA, 86 bp, Mus musculus
gggcaccatgtagacagcctctgtgacactctgttgcaaaaagccagatagggaagtgagtcttgaggtatagctgccctgtgtcc

SEQ ID NO: 61045 - DNA, 112 bp, Mus musculus
tccgactcccagtacagtcttgtctccctctgcccatcactgttatcttctgacaccagagtgtgacgacgtgacaaactgcaaagcaagcctggaaatgtttgaagtcaga

SEQ ID NO: 61046 - DNA, 68 bp, Mus musculus
gaaactgggactggagaggtggctcagtggttaagggcactgactgctcttccagaggtcctgagttc

SEQ ID NO: 61047 - DNA, 96 bp, Mus musculus
tcctttgaaaggctgaggtcacttgagagtgtgctcagtggtagatggcttgcctagcatacgttaagccctggtttcaatccctaggattcaaag

SEQ ID NO: 61048 - DNA, 85 bp, Mus musculus; identical to SEQ ID NO: 57439

SEQ ID NO: 61049 - DNA, 63 bp, Mus musculus
gggaacctggcttccgaggagctgagcggcctgtggctgcctcagaccctagcatgtgttcct

SEQ ID NO: 61050 - DNA, 117 bp, Mus musculus
ctgagtgtgtgagctccttaaagggtgaggacagtaagtggcccagaaagagcatctgcaaatggatagtaatgatgggcttttatggtagtgataagattagggactggcctgcag

SEQ ID NO: 61051 - DNA, 60 bp, Mus musculus
cagggggctggagagatggctcagtggttaagggcactgactgctcttccagaggtcctg

SEQ ID NO: 61052 - DNA, 87 bp, Mus musculus
ggcatattgaccatttttctgtttttatttctttgtgtgtgtgtatcagagacagagagacagacagacagacaggcaggcagtgct

SEQ ID NO: 61053 - DNA, 64 bp, Mus musculus
atatgtatgcatgcatgcatgtatgtatgtatgtacgcatgcatgcatgtatgtacgtacatat

SEQ ID NO: 61054 - DNA, 92 bp, Mus musculus
tgatttgggggatctggggagtggagagatggctcagcggttaagagcactgactgctcttccagaggtcctgaggtcaattcccagcaacc

SEQ ID NO: 61055 - DNA, 107 bp, Mus musculus
ctccctagtcctgcaggaaaccataacctttagacaagtctccactatggaaggctcttcacagcacccatggagctttcatgagggacatggtcagagctgaagag

SEQ ID NO: 61056 - DNA, 106 bp, Mus musculus
gacctacaagttcagatatgggctggagagatggctcagtggttaagagcactgactgctcttccagagttcattagttcaaatcccaattcccatatggtggctc

SEQ ID NO: 61057 - DNA, 73 bp, Mus musculus
ggtactgatgtgtgtgtgctcagaaggaagctcagctcgtagtgagtgcttcttaccactacgccatcttgct

SEQ ID NO: 61058 - DNA, 121 bp, Mus musculus
tatacatcattggcatatatatatatatatatatatatatatatatatatatatatatatatatgtgtgtgtgtgtgtgtgtgtgtgtatgtgtgtgtgtgttatgtacatgtatatatgc

SEQ ID NO: 61059 - DNA, 58 bp, Mus musculus
gggctcaccttcctcaggggcagagctctcagctgagctgtctctgtctgagctgccc

SEQ ID NO: 61060 - DNA, 95 bp, Mus musculus
ttctaatatatgaacttatgggatggggagattgctcagcagttaagagcactgactgctcttccagaggtcctgagttcaaatcccagaaacca

SEQ ID NO: 61061 - DNA, 113 bp, Mus musculus
gtgaggattacatttgaactacagtcctgttctcttccagtacagaatattctttgtttttaagattctgttccttttgaccaggcatggtagcacaggcctttaatcccaac

SEQ ID NO: 61062 - DNA, 103 bp, Mus musculus
gtgagactgcagtactttagtttttactcatcatcattgtatctgggctatatttgtttatataaatgctgactttataaaattgggtaggcagttagtgcgc

SEQ ID NO: 61063 - DNA, 99 bp, Mus musculus
ggtgtggactagttggaggctgtatgtcactttgggtggactttgaggcccagtctctctctgcctgtgggtcaggatgtagctctcagctacttcccc

SEQ ID NO: 61064 - DNA, 88 bp, Mus musculus
cttgatcaattgctctccctctgtgtgtgggtgtgcgcatgtgtggtgtgtgcctgtgtatgcatgtgtggaggccgttgacattagg

SEQ ID NO: 61065 - DNA, 89 bp, Mus musculus
tattatgtaagaaaaaaactgaaggtagattattgtagtaggttgaatggtttacaatatatctgcctcaatattttccaaacatttta

SEQ ID NO: 61066 - DNA, 78 bp, Mus musculus
ctgcctcggggaactgcctctgccactgtctgtctgtctttcctagtcatccttggtgcttctttcctgaaactgcag

SEQ ID NO: 61067 - DNA, 115 bp, Mus musculus
aatcctagccttggaggccaggctccatcaaaagttttaatgagaagatgaaagaagtcactgtggtgacacagaattatattctccccatttgagagcctgaggcaggaggatt

SEQ ID NO: 61068 - DNA, 86 bp, Mus musculus
gctctaaataaaattacatgttaggcttctgagactatccttaattaaaagtgagtctgtctgactgtgtaaattactctgagagc

SEQ ID NO: 61069 - DNA, 116 bp, Mus musculus
gtactagataaaggcatgtgctaacacatcctgcattttctcagtttttaaatttcttttgttagttgttaatagaatgagtgtgtatgatgtatgtatgtatgtaggacatagtg

SEQ ID NO: 61070 - DNA, 79 bp, Mus musculus
cagtgctctcatgtttctggaacactcagttactgtgtctctggaggcagtgctgaggggacgaaacatcctccacctg

SEQ ID NO: 61071 - DNA, 99 bp, Mus musculus
gaaacacccagagggctggagagatggctcagtggttaagagcactgactgctctttcagaggtcctgagttcaattcccagtgaccacatggtggctc

SEQ ID NO: 61072 - DNA, 97 bp, Mus musculus
cctcagtccttggactctgtgctgcagtctggatgatctctctgaccctctctcagggtaccaagatcatatgaactgagacaggaacaaggagagg

SEQ ID NO: 61073 - DNA, 107 bp, Mus musculus
aggggatggtttcctgttggttaagaggtgccagagcctcccaccctcactgtgtatgcgatgcagtgctgtgctcctcagctttaactctgacctgtgacccccct

SEQ ID NO: 61074 - DNA, 100 bp, Mus musculus
ggagttatggatagttgggagctgccatgtgggggctaggaattgaatcctggtcctctgaaagaacagtcagtgctcttaactcctgagccatttctcc

SEQ ID NO: 61075 - DNA, 171 bp, Mus musculus
gggtaacatcaaggacaaccgtctcagaaactgtctatcaagtgttcctctctcacagacactgggtaacatcaaggacaactgtctcagaaactgtctatcaagtgttcctctctcacagacactgggtaacatcaaggacaactgtctcagaaactgtctatcaagtgt

SEQ ID NO: 61076 - DNA, 80 bp, Mus musculus
agctactcagcctcctagcatcagggaacctgtctcactgtctcaccaggcccaggtgctagaaagtgggctcagtggtt

SEQ ID NO: 61077 - DNA, 102 bp, Mus musculus
acttgttttacatctacacatgtgttttacatgtacacatatgttttacatctacacatgtgttttacatgtacacataagatatatagtatgtaaggaagt

SEQ ID NO: 61078 - DNA, 93 bp, Mus musculus
gcacccacatgtcagcttacaaatgtctgtaatttcagttgtaagggatctgacaccctcacacagacatatatgtaggcaaactaccagtgc

SEQ ID NO: 61079 - DNA, 111 bp, Mus musculus
gcatcaagattcactgtggggctggagagatggctcagtggttaggagcactgactgctcttccagaggtcctgagttcgatccccaaccatccataatggaatctgatgc

SEQ ID NO: 61080 - DNA, 80 bp, Mus musculus
ggttaggtttcaaaggcagcccatcctggcctgtaactcagtacataaatcaggatgactgactgactgactgactgact

SEQ ID NO: 61081 - DNA, 65 bp, Mus musculus
ggggttatagagatggttcagaagagcacctctctgctcttccagaggtcctgagttcaaatccc

SEQ ID NO: 61082 - DNA, 119 bp, Mus musculus
ggctactcagctatatactcactctcaaagactcggagctagaaatgacagatgagagagaacatgtggtatttgtgtggtcttgagtcacctcattttatccatttacctccaagttt

SEQ ID NO: 61083 - DNA, 86 bp, Mus musculus
tgtacatgttctgagtgcattgttcaatgggtttagacaaattatttgttttgagatgaacagcattaaaatcacttggaattaca

SEQ ID NO: 61084 - DNA, 125 bp, Mus musculus
acaccctcacacagacatacatgcaggccaaataccaatatgtgtgtgtgtgtgtgtgtgtgtgtgtgtgtgtgtgtgtgtgtgtgtatatatatatatatatatatatatatatatatatatat

SEQ ID NO: 61085 - DNA, 82 bp, Mus musculus
tgctcttataggagaccctgtcagatcctattagccctgtgactccatctcctagtgatctgacaacctcttctgtcctgca

SEQ ID NO: 61086 - DNA, 96 bp, Mus musculus
gtctgtgcatctatagcaggccagagcatttcaaatacaataggtgagaatattttcatttttatgctatcccatgacatatctctctgcacagac

SEQ ID NO: 61087 - DNA, 112 bp, Mus musculus
ggtaaactatccacagaacattcgacatcctccaaacattctacacaagtcagctctttgcttcctagcttctgtctggttggttggttttgggttctgaggatagtctacc

SEQ ID NO: 61088 - DNA, 70 bp, Mus musculus
tggctacagtgctaggaaatgaagcactatcatagagcttcaccaatcctcagtcattctctctgagcca

SEQ ID NO: 61089 - DNA, 103 bp, Mus musculus
tgtttgctttgtgtgtgtgtgtgtatatgaatatatatatatatatgaatatatatatgtgtgtatgtatgtgtgtatatatatatgactagagtaatgtgca

SEQ ID NO: 61090 - DNA, 98 bp, Mus musculus
ttcagatgcatgtgttcttgtggaggccaaaggaggaagttggatgtcatcgtctctcattctctgattctttagacaaggtccctcactgagctgga

SEQ ID NO: 61091 - DNA, 85 bp, Mus musculus; identical to SEQ ID NO: 60314

SEQ ID NO: 61092 - DNA, 85 bp, Mus musculus
ggccatggtgatctgataggatgcatgggacaatttcaatatttttgtatctgttgaggcctgttttgtgaccaattatatggtc

SEQ ID NO: 61093 - DNA, 68 bp, Mus musculus
gccaaaaaacagagaagagagcaattgaagaagctaacattgctctctctgtctttgtgtttttgtgt

SEQ ID NO: 61094 - DNA, 71 bp, Mus musculus
ggaagcatgtgagagctgcaggcagggaggagggatggtgcctttctgtagagacagtggaaacagttgcc

SEQ ID NO: 61095 - DNA, 112 bp, Mus musculus
acagagagtttactgtgtgagccttgattcctcaggctcttcccaggactgcactctctgtgactctgcatgagatccgtcccacatttcatgcttcatgagttcagcttgg

SEQ ID NO: 61096 - DNA, 82 bp, Mus musculus
catggcagcatatatatatacacacacacacacaagcgtgcacgcgtgtctgtgtgtctgtgtgagagtatgtgcacttgtg

SEQ ID NO: 61097 - DNA, 92 bp, Mus musculus
gtgacctgagactggattcaagagaattggggggtatgaagtgtgagacgcactgacagacaggccccacagcctggataccatttctgcac

SEQ ID NO: 61098 - DNA, 64 bp, Mus musculus
catatgtatatatgtatgtgtctgtttgcatatatgtatatatgcatatatgtatgtgtgtgtg

SEQ ID NO: 61099 - DNA, 94 bp, Mus musculus
tgtgtgcgtatacatatatatatatatatatatatatatacatgtgtgtgtgtgtgtatatatatatatacatgtgtgtgtgtatacacacaca

SEQ ID NO: 61100 - DNA, 109 bp, Mus musculus
gctctgtagaacaatttgcaatctaggatggtggcacttccagtaatatttatttatttaccagatggttgtgagccatcatgtggttgctgggaattgaactcaggac

SEQ ID NO: 61101 - DNA, 71 bp, Mus musculus
ctcagtctatttctgtctcatattctctaccatgttcccatgcagaaaatctggacaggggatgatctgag

SEQ ID NO: 61102 - DNA, 194 bp, Mus musculus
catatattatgtatacatatatgtataatataaatatgatatgcacactacatatatattatacatatatgtatatgtgtgtatatgtatatatgtgtatatgtaaatttgagtatatgtgtatgtttatatgtatgtatgtgtgtgtatatatgttatacataggtatatatgtgtgtgtatgtatatatata

SEQ ID NO: 61103 - DNA, 80 bp, Mus musculus
ccctgtggctgctactgtctggacctacacttgattcccatccatatgaggtttccagagtagtgagtgtgcagacaggg

SEQ ID NO: 61104 - DNA, 66 bp, Mus musculus
tatatgtatatgtatatgtatgtatatgtacacacacatacatatatacatgtacatatacatatg

SEQ ID NO: 61105 - DNA, 85 bp, Mus musculus; identical to SEQ ID NO: 60314

SEQ ID NO: 61106 - DNA, 76 bp, Mus musculus
cacctggcatagtaatataaggtcttagcaggtcatactagctgcaaagtgtttgtatatattatgtagacagttg

SEQ ID NO: 61107 - DNA, 85 bp, Mus musculus; identical to SEQ ID NO: 57439

SEQ ID NO: 61108 - DNA, 102 bp, Mus musculus
atgtatacatgcttgcatgtttctgtgtatatgtatgtgtctgtatgtctttgtgtccatgtatacatgtatattcaatcacatgtctttatatgtatgtgt

SEQ ID NO: 61109 - DNA, 76 bp, Mus musculus
gagaagaaagagagtacagagctgctcgccttcttttaagaagagggccctttgggcctcttagtcaggacttctc

SEQ ID NO: 61110 - DNA, 87 bp, Mus musculus
tcagtgcaattacaaatctcatattcttcccatataggacattgtaaaaacctgtgtagtagacttgtgagtttgtactgtcagtga

SEQ ID NO: 61111 - DNA, 83 bp, Mus musculus
gcagtctcacctgactcctcttcctgtgttctgcctcagaccttgccagctcacttcaggaaactgtgtcagtctcgactagc

SEQ ID NO: 61112 - DNA, 85 bp, Mus musculus; identical to SEQ ID NO: 57439

SEQ ID NO: 61113 - DNA, 83 bp, Mus musculus
ggtgtttgcctttactttcagcatttctctagccccatggaaagatccatgtctcagaaaacactgagtccatagcaagctct

SEQ ID NO: 61114 - DNA, 79 bp, Mus musculus
ggggaagtaggttatgagagatgagagacagctttgaaagttgtatctgaagactctctctctctctctctctctccct

SEQ ID NO: 61115 - DNA, 85 bp, Mus musculus
gagaagcactgtaacaaaaaggaaagagttaagccaagttccagtaacttcttggtactgtgtgtctctctgtaaattgcttctc

SEQ ID NO: 61116 - DNA, 88 bp, Mus musculus
cagtgaggagtcaatggctgcctccctgtctgcaactgttctccttagatgatggtgcttacaaaagggtagggacgaatcttcactg

SEQ ID NO: 61117 - DNA, 86 bp, Mus musculus
aagttttgtggttgtttcatgactcatttatttgtatatatgcatgtttgcatatatataatagagaaacatatgtagccagactt

SEQ ID NO: 61118 - DNA, 71 bp, Mus musculus
gtgtatatgtatatatgtatgtgtatttcatgtcatgtatgcactcatgtatacatatgcatatatatata

SEQ ID NO: 61119 - DNA, 110 bp, Mus musculus
cacttgttcaggtcctctttatttcttgccaagtaatatttgtatcattttaaatgtatgttacaggtggcttggatatggtttaaaaatgtccccagggattttatgtg

SEQ ID NO: 61120 - DNA, 104 bp, Mus musculus
ccttagtccatggtgatctgataggatacatgggacaatttcaatatttttgaatcttttgaggcctgttttgtgacctattatgtggtcaattttggagaagg

SEQ ID NO: 61121 - DNA, 117 bp, Mus musculus
tctctgtcactttctctgtcactgtgcctctcttcttacacacccacacacagagacacacatacacattcacagagacagacagagaaaaacagagacagaaagggagagagacag

SEQ ID NO: 61122 - DNA, 106 bp, Mus musculus
gccttagtccatggtgatctgataggatgcatgggacaatttcaatatttttgtatatgttgaggcttgttttgtgaacaattatgcggtcaattttggagaaggt

SEQ ID NO: 61123 - DNA, 85 bp, Mus musculus; identical to SEQ ID NO: 57439

SEQ ID NO: 61124 - DNA, 90 bp, Mus musculus
atatatatatatacacacacatatatatgtatagtatatatagatatctatatatgtctatatatatatgtataggatatatatatatat

SEQ ID NO: 61125 - DNA, 83 bp, Mus musculus
agatactgctttactaacaagcccagtgtctcccacattgattacccatcaaacaagacagtgtgcttagttgagcattgtct

SEQ ID NO: 61126 - DNA, 117 bp, Mus musculus
cgtgtaattaaattctgagtgaaatttgggatctgtgatttcagtttgtgtgtatgcataattttttatgtataaactgaaatcatatatacctttgtgatatgtgtagaatatatg

SEQ ID NO: 61127 - DNA, 100 bp, Mus musculus
gtttctatttattcaagagtatgtatcgatgtgtgtgtatatatatacatatatgtatatgtatatatgtgtgtgtctatatttaggtgtatatagcaac

SEQ ID NO: 61128 - DNA, 110 bp, Mus musculus
tggtgacttagtctcggagagctctgaggagtcaaggttagtgatattgttgttcttcctatagggttgcaatccccttcagctcctcagtccttcccctaactcttcca

SEQ ID NO: 61129 - DNA, 92 bp, Mus musculus
tgcctttcagacagacagacagacagacagacagatatatgtatctatgtatatatgaagtgtgtgtgtgtgtgtgtgtgtgtgtgtgtgta

SEQ ID NO: 61130 - DNA, 107 bp, Mus musculus
ctggaagtggaactgatttcttgaagtagggtgtataagaaatatagcttttgagttttttttttattttctcacccctaattcagagtttacttcacatatcacag

SEQ ID NO: 61131 - DNA, 64 bp, Mus musculus
gaagtcagtgactcagtctgtcagcctgcttccacacagggagccaggcaggcctgccactttc

SEQ ID NO: 61132 - DNA, 111 bp, Mus musculus
atatatatatatatgtgtgtgtgtatatatatatacacatatatatatatatacacatatatatatgtgtgtgtatgtgtgtgtatgtattcaatatatgtatatatatat

SEQ ID NO: 61133 - DNA, 110 bp, Mus musculus
aagataggggatcaggcaatggagtggatatgctggtgttttttcataaagtaagtatatatcaatgtgtttaatatgttccaaagactgtttttaatctcctcagtttt

SEQ ID NO: 61134 - DNA, 109 bp, Mus musculus
taggtgtggaatgcagcagctgggatcctttgataagtatcatttctaggtcagctaggcactttatttttacattatcagaagatgcacagatgctcaaactcatgta

SEQ ID NO: 61135 - DNA, 93 bp, Mus musculus
ggcagagttctgggagtcttgtggaagagtgggtgatagaagtgagtaagcagaggagtcaataacaccacaagaagagccacagagtcagct

SEQ ID NO: 61136 - DNA, 97 bp, Mus musculus
gggtaaagtatttgattttctcttaggatgaccctggtctgtctctttctgtgagcttccatcactctgaggaacagaggattctctactttcatcc

SEQ ID NO: 61137 - DNA, 109 bp, Mus musculus
ttgcctcagaaatgtgcatttcctttcctgcaggattggaagtgaagtgttaatcatgctttaaattcttattcccttggccaggaattggagagacaattctgttcaa

SEQ ID NO: 61138 - DNA, 72 bp, Mus musculus
gcatatgtatgtgtgagtgtgtgtatgtatacatacagatgtatatatatatatatgcatatatatatatac

SEQ ID NO: 61139 - DNA, 68 bp, Mus musculus
ggtcttcagtctcactgacacaatgcacagtcaatctgtgttagaggaaggatgtggtgatgaggacc

SEQ ID NO: 61140 - DNA, 63 bp, Mus musculus
caggcagggtctctcactgactaggctagcctgggtagccagcaagtcccaggaatctgcctg

SEQ ID NO: 61141 - DNA, 110 bp, Mus musculus
gtgtgtgtgagtatgggtatatagtgtatatgaacatgtgtgagtatgtgagtgtatgaatttttatgtatgaatatgggtgtatattatgtacgaatgtgtataggtgt

SEQ ID NO: 61142 - DNA, 61 bp, Mus musculus
tatgtacgtatgtatgtatgtttgtatatatgtcatatgcacacatatgtacatacacata

SEQ ID NO: 61143 - DNA, 74 bp, Mus musculus
agactgcaggctagcctggactatacaatgaagcactgtctaaatagatacagtctgcctctctgcctcagtct

SEQ ID NO: 61144 - DNA, 103 bp, Mus musculus
tcatggctgcatcccatatgtaagcactcagctactgctccagagccatgcctgcctgcctgcctgcctgcctgctgccatgctcctactgtggcggccatgg

SEQ ID NO: 61145 - DNA, 63 bp, Mus musculus
tgactcagggggagcgcacaggagcgatgtgtgcccttcggctcagtgactccctctctgtca

SEQ ID NO: 61146 - DNA, 69 bp, Mus musculus
ggttcagccagactctctggctcagatacactaaggggtgttccctttgggaaggagagacaggtagcc

SEQ ID NO: 61147 - DNA, 88 bp, Mus musculus
ttggcatttggtgtctttgacagttgtgactcacctcagtttttgagatagggtctcttgcagaagcagaagttcaccaattttacaa

SEQ ID NO: 61148 - DNA, 110 bp, Mus musculus
agatagaatttttggaatagtgctctcttgaacttggaagatgacagatctctgtgtggaaaacatcccttctgtgattggcttcagttgaggagttctagacctatcta

SEQ ID NO: 61149 - DNA, 85 bp, Mus musculus
ggccatggtggtttgataggatacatgggacaatttcaatatttttgtatcctttgaggcctgttttgtgaccgattatatggtc

SEQ ID NO: 61150 - DNA, 71 bp, Mus musculus
tgtggccttcccttctattagcttatttatatataattacagagatgagccatggagattagaaggtggca

SEQ ID NO: 61151 - DNA, 85 bp, Mus musculus; identical to SEQ ID NO: 57439

SEQ ID NO: 61152 - DNA, 105 bp, Mus musculus
gatcaaggtgctgaaaaactcagtttctgatgacagactagtgtctctgtctgagaaccaggctccactggtacagtcttgaggaaagcagactcagcagtggtc

SEQ ID NO: 61153 - DNA, 85 bp, Mus musculus; identical to SEQ ID NO: 57470

SEQ ID NO: 61154 - DNA, 77 bp, Mus musculus
ctcagaaaggcctatcacagaagtgagtcttcagaagttgtcactgaggtacactgtgggatggagcatctactggg

SEQ ID NO: 61155 - DNA, 109 bp, Mus musculus
tatgtgtctgtgactgcctgaatactgttcagatgtctgattgtccctatgtctgcctctctctaacatagagctctgtcctgtatttatcaaacagcacagaaacata

SEQ ID NO: 61156 - DNA, 104 bp, Mus musculus
ggtatgcttagttgccattctagatacagtgtagagagatagcagagaagacaggttttattcttatagactttatgtgctttatctgtggcagtgttgtcacc

SEQ ID NO: 61157 - DNA, 69 bp, Mus musculus
ttctgtatgtctgtgtgtgcatgtgcatgtgtgtatgtaagggtatgtgagtacgcacagacacaagaa

SEQ ID NO: 61158 - DNA, 95 bp, Mus musculus
gaatcaactcaaagccctggatctgggcttggatggtagctgagtttgtcagcctgccaactctcactctcactcatgtccatacctttagtgtc

SEQ ID NO: 61159 - DNA, 79 bp, Mus musculus
gaatgccaacttggggctggagagatggctcagcggttaagaggacagactgcttttccagacgtcctaagttcaattc

SEQ ID NO: 61160 - DNA, 109 bp, Mus musculus
aggacagagctaaagaagtgactcaagctacttagagggacatagaagactgtgagcaaatcccagataactggacattgagttatttatactgttggagtttggtttt

SEQ ID NO: 61161 - DNA, 110 bp, Mus musculus
tactttaatagacaatatatttttatatatgtgcttatatgttcatattatatatgtatataatatgcatatatattgcttaaaatatgagaataatcagacaagaagta

SEQ ID NO: 61162 - DNA, 122 bp, Mus musculus
acacacatatacatacatacatatgcacacacatatatgtctatatgtatatgtgtgtatagtaatatattacattatatacatataatatatacagatataagtatgacattattgtggta

SEQ ID NO: 61163 - DNA, 87 bp, Mus musculus
cagaaagcagatgaagtactgagagaatgtttattattgatatgagtatggccgtgtcaagaattcctcaaatcttgtcttgctctg

SEQ ID NO: 61164 - DNA, 103 bp, Mus musculus
cagtctatcagtcaacctgtcagcctaccagcctgtgtcaatttgtcagtcaacctgtcagcctgtgtcagtctgtcattctatcagtcaacctgtcagcctg

SEQ ID NO: 61165 - DNA, 113 bp, Mus musculus
ctgtacaatctgagccatttccccagctccctgagctaatgcttttctactgtttttgttcaatagtccaaacatgttgttctgtgggcctgggagacgactcagtcataaag

SEQ ID NO: 61166 - DNA, 83 bp, Mus musculus
tgtgctgctgtgtcttttagctgtcactcgcactctctgaagctaaagagaagtggaaaagtgagctggaaaatatgaagcca

SEQ ID NO: 61167 - DNA, 85 bp, Mus musculus
gctattgattgatgtattaatcaatctatgtatatatgtatgcacatacatatttcatagaataattgatgtatccaagcaaagt

SEQ ID NO: 61168 - DNA, 87 bp, Mus musculus
ctactactgattccagcttctcccacaaaacactgattggctgtatctagagagcggtgttgagtagattgctgattggatagttag

SEQ ID NO: 61169 - DNA, 114 bp, Mus musculus
ccaggtgatggatactttcagctttatccacataccaaagtgtatttcttaatctgaacatgtgaattagagagctagtataataacaccagtgatagagatggtcccacttgg

SEQ ID NO: 61170 - DNA, 74 bp, Mus musculus
ggctttgcttgagagttctcagactctgtgtttgtgttcaagggtttagagaaactgggaaagttcagatggcc

SEQ ID NO: 61171 - DNA, 60 bp, Mus musculus
tggtgtctacacatgtgagagagtacacattcatggatgtgtgcatgtgtgtagaggcca

SEQ ID NO: 61172 - DNA, 112 bp, Mus musculus
cctttaggcttatccatcttgtgacaagactcttgtggaagcagcagctattccattgtatatatctatgttgcagctcctcttcctgtttttctgctgtcaaaccctcagg

SEQ ID NO: 61173 - DNA, 71 bp, Mus musculus
ttgtgcacatgaagaattgtgatactgtagttgtgagacaccaactactgtgttaaaataatgtgagacag

SEQ ID NO: 61174 - DNA, 89 bp, Mus musculus
aaggtggtaggatccagctagaagcagtacgtcactttgaagggtgtttacctatctgtctgtctgtctgtctctctgtctatctcctt

SEQ ID NO: 61175 - DNA, 85 bp, Mus musculus; identical to SEQ ID NO: 57439

SEQ ID NO: 61176 - DNA, 85 bp, Mus musculus; identical to SEQ ID NO: 57470

SEQ ID NO: 61177 - DNA, 76 bp, Mus musculus
gtacttgctgtgtgtgcaagaggatctgaatctgggagtagatccctagcacttgtgtaaaaacccagacgtgtat

SEQ ID NO: 61178 - DNA, 68 bp, Mus musculus
gtgtacttgtgtgcgtgcatgtgtgtgtatgtctctctatgtgtgtgtgtgcatgtgtgtgtgtgtgc

SEQ ID NO: 61179 - DNA, 66 bp, Mus musculus
gactgtgcctatacagtgtgagctgtgtgcatacaggtagatggtgcctatacagtgtgagcagtc

SEQ ID NO: 61180 - DNA, 87 bp, Mus musculus
gtttaagaagctgatactcaaagtcacagtgatgctgttggaaaacagcattcatcagttcagacatgagagtgagttcacataaac

SEQ ID NO: 61181 - DNA, 106 bp, Mus musculus
ggttagaagagtagcaggaacaagaaatacacacttgctgggtgaagtcatagactagagtttttcttgttgtgtcagaatttgttccatctagtacattgtattc

SEQ ID NO: 61182 - DNA, 75 bp, Mus musculus
gttaagggcatggcagacatcaacagggaggaaagctgagactctgcagctccccactgttctgtctctctcagc

SEQ ID NO: 61183 - DNA, 80 bp, Mus musculus
cagtctgagactcacatacactctctgctaagtgaattaatttttaaagatttatttaatgtatgtgagtgctctgactg

SEQ ID NO: 61184 - DNA, 69 bp, Mus musculus
aggtccttgtagctgctccaagcttctttgcccccaaggggctacagtttgagtagaagcctagcccct

SEQ ID NO: 61185 - DNA, 73 bp, Mus musculus
ggagatctatcatttatctgtctgtctgtctgtctgtcgcttactgcccagcaggagagtgtagatgatttcc

SEQ ID NO: 61186 - DNA, 62 bp, Mus musculus
ctgtctgtctgcctgtctgtccacaggtgggccactgtgagcatgttcaggtcagtggagag

SEQ ID NO: 61187 - DNA, 74 bp, Mus musculus
atatgtatatatacttatatacacatacacatgtgtgtatatatgtctatgtgtgtatgtatatatgtatatat

SEQ ID NO: 61188 - DNA, 186 bp, Mus musculus
tgtgtgtgtgtgtgtatgcacgtatatctgtatatgtgtgtatacatatatatgtatatatgtgtgtatacatgtaaatatacgtgtatacatactatacaggtacatagatgtatatatacatatatacatacacacatagacatatatacacacatgtgtatgtgtatataagtatatatacat

SEQ ID NO: 61189 - DNA, 98 bp, Mus musculus
aaaagattatgtaaatgtaagctgagtttctgactcccacacacactaacgagatgatgctggatattcagggacctctgaatgcaccatgatgtttt

SEQ ID NO: 61190 - DNA, 74 bp, Mus musculus
gttgtacctctgtgtgtgtgacacccaaggaggacagaagagggcgttatatctcctgggacagaggtactggc

SEQ ID NO: 61191 - DNA, 89 bp, Mus musculus
cattaggggctggagagatggctcagtggttaagagcattgactgctctttcagaggtgctgagttcaattcttagcaaccacatagtg

SEQ ID NO: 61192 - DNA, 106 bp, Mus musculus
gtgaccttggtttgtacaccagggccaggccgggcagtgctaagtgaccttggtgtcttctcactggctgagtagtccctttggtaaagtaggaagtttatctcat

SEQ ID NO: 61193 - DNA, 100 bp, Mus musculus
ctgctcactggttacagcacccaactctgccactcacaggctcacctggagggtcagtgactgagctgggatgcaggaaagagacactgtttggctagag

SEQ ID NO: 61194 - DNA, 116 bp, Mus musculus
ggccatcctggaacttgctctgtagcctgggtgatgttcaaacacatattcaactaatcatccttctgtctgtgccctgtaggaaagttcattctggtctgcagtccaggatatcc

SEQ ID NO: 61195 - DNA, 92 bp, Mus musculus
gctgctttaaaagatggtcagggtctggagagatggctcagtggttaagagcactgactgctcttccaaaggtcctgagttcaaatcccagc

SEQ ID NO: 61196 - DNA, 75 bp, Mus musculus
aaggacctttctagtctactctgctgccagtgggaggcagcagtctctccctgcctgtcagcaagaaacttcctt

SEQ ID NO: 61197 - DNA, 115 bp, Mus musculus
gcacttcactcaacagtgtgacgggcttggccacttttaagtttttatatttcactgctaagatgtctagtgttctaagaacccacttcctgtgacctggctgagtgttgagtgt

SEQ ID NO: 61198 - DNA, 97 bp, Mus musculus
caggaatagctattacatcccatcaggaggctagacagaagacagactgcacctggataggcctagctggtcagccagcctgatttgctccatcctg

SEQ ID NO: 61199 - DNA, 72 bp, Mus musculus
acacacacatatatatatatatagttagccagctagctagctagctagtgggtgtgtatttggcgtgcctgt

SEQ ID NO: 61200 - DNA, 74 bp, Mus musculus
tggcagctcacaactgtctgtgactccagatccatgggatctggcactctcacacagacaaaacacaatgcaca

SEQ ID NO: 61201 - DNA, 80 bp, Mus musculus
ggatagatggaccaaacaactagctagagcgagggagtggtgtcactctcactctgtggccagaatgggggagaagatcc

SEQ ID NO: 61202 - DNA, 107 bp, Mus musculus
ttctgcccctaccttgccttgaggagctctgagatgagagtccgtacacagggctcatctctcactctctgggctctttgtatctttccctgtgagtttcagcagaa

SEQ ID NO: 61203 - DNA, 82 bp, Mus musculus
tccttcaagcactctacctactcagtgcttttcttgtctccatttgagagaattgagactctagaggtagaagctccaaggg

SEQ ID NO: 61204 - DNA, 74 bp, Mus musculus
ccagtgagtgctgggtgaggtacagcctgcctcctcaacctccagcctgcctctctctcccaggctctctctgg

SEQ ID NO: 61205 - DNA, 75 bp, Mus musculus
actggtgggtagagagttcctccagaactggctctgagtgaacacagtctggatatactgctttgttggataggt

SEQ ID NO: 61206 - DNA, 90 bp, Mus musculus
gtggttcaagacattcagaactcacagagcacagccagcgaaggtggactgggtgatgactgtgttttctgtttactgtagctatatcac

SEQ ID NO: 61207 - DNA, 67 bp, Mus musculus
agagtgaaacactgaggcggcagcagaaaggacatgggactccattcctgagtcactgcctcactct

SEQ ID NO: 61208 - DNA, 75 bp, Mus musculus
cccaggaggagcagggcccacccagaatcatctcactccaatctgccctctgtctgcctctctgtaccccctggg

SEQ ID NO: 61209 - DNA, 58 bp, Mus musculus
gcatatgtacatacatacacgcactcgagagagagtgtgtgtgtgtatctgtgtgtgt

SEQ ID NO: 61210 - DNA, 87 bp, Mus musculus
gcatgtgggcatataggtactgtgaggatatgtttgtaagtctatataaatgtgtgttcatgtatatgaatggatgtttccatatgc

SEQ ID NO: 61211 - DNA, 103 bp, Mus musculus
tgctctccaaggccctggcaatgggttagctgccaaaagactctgtcagactctgagaaagatgtggcagatccgtgaaagctttggctggactctagatgca

SEQ ID NO: 61212 - DNA, 145 bp, Mus musculus
gtgtgtgtgtatatgtgtatatatatatacatatatatatgtgtatgtatgtatatgtatatatatgcatacacacacacacacacatatatgtatatatatatatatacatatatgtgtgtgtatgtatgtatgtgtgtgtgta

SEQ ID NO: 61213 - DNA, 99 bp, Mus musculus
ggctacttctagttgcccttgtggtcatgtgtctgagtccctctctcgatttcttctgagctaagacaagtgagtaaaaacagaagctacctgaaggcc

SEQ ID NO: 61214 - DNA, 74 bp, Mus musculus
aactcttcaatctggacagactatttggccaaggctatctgactgtctgtctttatccacccattgctagagtt

SEQ ID NO: 61215 - DNA, 80 bp, Mus musculus
tcatgccttccgggtgtcacactctgcctcactgtgggcccagagtcaccagagcagaggacaatggactgaaaccatga

SEQ ID NO: 61216 - DNA, 108 bp, Mus musculus
atattctactgtgataacacagaaagagactgtggaagtcactctgagggaggcacgttgtcttactatttttatttcatgggtttggctgtttatgggtttgaatat

SEQ ID NO: 61217 - DNA, 102 bp, Mus musculus
ggtcatggtgttttgtcacagcaacagaaaaagtaactaagatgctgcatttgtgtgtctctgtcactggctggtgtggctctgcagccgtggttctcgacc

SEQ ID NO: 61218 - DNA, 108 bp, Mus musculus
gctcctgtacttctgatgaagctgcctgttcatggtgtgtgtgtgtatacatatatacatactttttcttctgcattgtttaatacgacagctgcagttacaggagac

SEQ ID NO: 61219 - DNA, 84 bp, Mus musculus
gtgtgccaggagggggcgctactgtctgtgtctgtctgggagtgctggaaggatcaacacactgggctgatttctgaagcacac

SEQ ID NO: 61220 - DNA, 82 bp, Mus musculus
atctatatgtgtgtgtctatatctatatatgtgtagattcagatatagatagatagatagatagatagatagatagatagat

SEQ ID NO: 61221 - DNA, 72 bp, Mus musculus
gacaagcatgggtgagtgtgagcctcatgccaggaagtatctggcacagacactcagttaatcccacaagtc

SEQ ID NO: 61222 - DNA, 119 bp, Mus musculus
taatgtgggttttatgggtgttttgtctgtcatctgtctgtctgtctgtctgtgtgccatgtgtatgcagtgtccttggaggtcagaagaagatgtcatatctcttagaactggagtta

SEQ ID NO: 61223 - DNA, 62 bp, Mus musculus
ctgctcaggtctgtgtctgtcttacacgaaaagtgacaagtgccagcatcagcctgggttag

SEQ ID NO: 61224 - DNA, 99 bp, Mus musculus
ctccagcctggttcttctcttcctggccccatagtgctttccatggagtgagaactcactgtggtaaagagatgcccatggaggaagcaaagagaagag

SEQ ID NO: 61225 - DNA, 75 bp, Mus musculus
agtgtttcctgctcctaggtttacagggatgggcgaatctgtttctgtctctgggtcccagcagtccggagctct

SEQ ID NO: 61226 - DNA, 85 bp, Mus musculus
gcattctgcagttcctacttgtttacagtcacactggtctgagagaaagctgtgagcacaggttgaaatggagtgaaaggagtgt

SEQ ID NO: 61227 - DNA, 90 bp, Mus musculus
aagcccccattcttaactctgtgctctaccctcaattgcatatgataaccggagtccatgtggtgagaaaacagagagaattgaggactt

SEQ ID NO: 61228 - DNA, 80 bp, Mus musculus
gaatagaatttggaaaggccagccacattttgataagcccctacttttcataaggcatatgtgtttttcaagttctgttc

SEQ ID NO: 61229 - DNA, 70 bp, Mus musculus
tatgtgtgtgtgtgtgtgtgtatatatatatatatatatatatatatatatatatatatatatatatatg

SEQ ID NO: 61230 - DNA, 71 bp, Mus musculus
gctcttgctctgaacaggccctgtctatgtgcattgggagcactagacagcgtgctttgaggagccgtggc

SEQ ID NO: 61231 - DNA, 85 bp, Mus musculus; identical to SEQ ID NO: 57439

SEQ ID NO: 61232 - DNA, 118 bp, Mus musculus
aaactagccatctgactgactttcttcagtttgtacagtcagtccctggctcccagaaaggggaagtttagatgtggatacatggaagaagttagggttagatattaaaaactggttt

SEQ ID NO: 61233 - DNA, 112 bp, Mus musculus
gcatcagtaggcttcatatttcttgtagagaagatatatagttgcctattacatatatattctctgtctctgtctcttctcactctgtctatgtcttgctctctgtctgtgt

SEQ ID NO: 61234 - DNA, 117 bp, Mus musculus
gaggactcttgccttggagtcaggctgtccacagtgggttcagaggctgtgactcactgaggaaaaggagtgccctgggccctaggggaggctgctttctccaaacaagctgtcttt

SEQ ID NO: 61235 - DNA, 77 bp, Mus musculus
gggaattggagagatatctcagaggtcagaagcatatattgttcttaaagaggacctgagataagttcccagcaccc

SEQ ID NO: 61236 - DNA, 180 bp, Mus musculus
atatatatgtgtgtgtatatatatgtatacatatatatatttgtatatatgtgtgtgtatatgtatatatatgtgtgtgtatgtatacacacatatgcatacgtatatatgtgtgtatatatatgtatacatatatatttgtatatatgtgtgtatatatgtatagatatgtgtgtatac

SEQ ID NO: 61237 - DNA, 74 bp, Mus musculus
ttaactagtgtatatgtatatatgtatctatgtgtatatatttagagtatatatgtatgtatagttggagttaa

SEQ ID NO: 61238 - DNA, 68 bp, Mus musculus
agctgtgggactgaagagactgatcagtggtgaagaccacttcctgctttttcacaaaacccagagtt

SEQ ID NO: 61239 - DNA, 94 bp, Mus musculus
ataccttatataatatgtgtaaaacatgttatctaatacatgttatatatatattataacatgtatataacatgcattacatatatgaggtata

SEQ ID NO: 61240 - DNA, 113 bp, Mus musculus
agcctggcctgatttgactctgcctgacacacaggctttcacagaagcaggcaagatggctcctgacagtagactgtgtggctctagctgacattgcacatttgtctgtcttc

SEQ ID NO: 61241 - DNA, 105 bp, Mus musculus
aggcatctatggcagtcatgcaactgtctgctacttccacagggctgagttcacaggggcagactgtctgactgcctcctccttccatgaactctcaggacctgt

SEQ ID NO: 61242 - DNA, 92 bp, Mus musculus
gagctggttatggtgccttgttcctgtaatctgattactccagaggctgaggtaggaggatcactaggagtacaagaccaaagagagagttc

SEQ ID NO: 61243 - DNA, 133 bp, Mus musculus
ctagtatgtgtcctgctcctttttccttaacagagcccagtggggcgtctctgcttgagacagatcagagtcagaacacacagtagcgtgcagctggccttgcagcatgccggtaagttgtgagtaaggtttg

SEQ ID NO: 61244 - DNA, 117 bp, Mus musculus
ggagagtatggcatcagctaagcactagtggcatccttggaacccatgtgattatgtacaagtgggagaggagccacttaaggggcagtcttagaatatgtgcacataaatgtatct

SEQ ID NO: 61245 - DNA, 110 bp, Mus musculus
tctttatttttatttcctgtgcatattcgcctgtgtctatgtctgtgtgaaaggtcatatcctctcaaactggagttagaggcagttatgaactaccatgagggtactga

SEQ ID NO: 61246 - DNA, 58 bp, Mus musculus
ccctgagtggtgagtgtgtgcagagcctggctcccaaacacagattcaagcaacaggg

SEQ ID NO: 61247 - DNA, 108 bp, Mus musculus
gttacactcagcataaagtgatgcagtctcaattgattctgttcttatctctcccactgggcctgagagtgaggattcaggggacggtgtgtccctatctggtgtccc

SEQ ID NO: 61248 - DNA, 87 bp, Mus musculus
gataacagatggattttgtttcttgattcattcagtcagcctgtgtctctggttggagaattgaggccattgaaatttaaagttatt

SEQ ID NO: 61249 - DNA, 58 bp, Mus musculus
ggctgatctctgtgagctcaaggccagcctggcatacttggtgagttccaagacagcc

SEQ ID NO: 61250 - DNA, 92 bp, Mus musculus
gggatcctggtacacagggcacacctttcactgtgaggaaatgatgtcagcagccagttaagggtactctgcaaggatcaaaactggatctt

SEQ ID NO: 61251 - DNA, 67 bp, Mus musculus
gcgtggctggcacacagaacaatgagtgctgtatcaaatgcagtgagtttcatgatgaaggccaccc

SEQ ID NO: 61252 - DNA, 107 bp, Mus musculus
ccacagaaaccatagatacatggcagtgggacaatatactttttgttttaatggatggcttgtctacatgtatgtctgggaactgcatgtgtgtctggttcctgagg

SEQ ID NO: 61253 - DNA, 77 bp, Mus musculus
gtgaagggtttggtcatgaggggggctcctcttctttttgttagggcagtctctcactcagtgctttttttcttcac

SEQ ID NO: 61254 - DNA, 66 bp, Mus musculus
gccttggtaccttttccaacttagggaacctgtggcgccttggggaagagtgtgtgcagagagggc

SEQ ID NO: 61255 - DNA, 134 bp, Mus musculus
caccacactcattattcacaatttcatttactttttggtcctttgtgtgagagagagagtgtgtgtgtgtgtgtgtgtgtgtgtgtgagtgtgtgtgtacatacacatgcatgtgtgtgcatgtgcatgtgctt

SEQ ID NO: 61256 - DNA, 64 bp, Mus musculus
cctggccctggggtcatgagaacaggagaactgtccctgtctctcactgacttcagcacttggg

SEQ ID NO: 61257 - DNA, 96 bp, Mus musculus
gatggctcagtggttaagagcactcttccgaagatcatgatcatgatcatgatcatagatcatggtaagagctgctcttctgaaggtcctgagttc

SEQ ID NO: 61258 - DNA, 74 bp, Mus musculus
tagttagttgattggctagttggttggtcggttggttaattggctggctggctggctggctggttgcttggctg

SEQ ID NO: 61259 - DNA, 74 bp, Mus musculus
tggtgggcaggacgatggggagctgctgtgtatgttgaccttagcactcgtttctgactgactctgtccatcca

SEQ ID NO: 61260 - DNA, 68 bp, Mus musculus
cagagtttcagactatctctctctctgccataagaaagcagagtcctggggatttatctgacagactg

SEQ ID NO: 61261 - DNA, 109 bp, Mus musculus
cctggggcaaaatcaacagatgtctcttgaccacagccaagacactgagcacagaccaaagaaacagttctactcaagtctagcgtggtgggcagggtgtttacctggg

SEQ ID NO: 61262 - DNA, 83 bp, Mus musculus
gtatttagcagaattggacaaagggaatgtttgttcacaacagtaattgaggggagcagacagtcactgtctctgctgtctac

SEQ ID NO: 61263 - DNA, 74 bp, Mus musculus
gctgacagacgtgacagaggagagacaggctttgtggggggttttctctcagtccctttatttacatctgcagt

SEQ ID NO: 61264 - DNA, 66 bp, Mus musculus
gcagagataggtgtctctctgtaagtctgaggccagcctgatctatatagtaagaccctgtgtctc

SEQ ID NO: 61265 - DNA, 71 bp, Mus musculus
ggcataagaaagctgagatcaggggtgtctttgtgaaaacacagaacaaagtcagatgtgggctgtgtgct

SEQ ID NO: 61266 - DNA, 94 bp, Mus musculus
acgctgacacaagtctaactggatctgttttgaatttgcaaattgactctgcatctaaatagatatttgttgtgaaaactttattgtgttgtgt

SEQ ID NO: 61267 - DNA, 102 bp, Mus musculus
cagctggtcagagattgtttttgttttgcctgtatgtataattatgtatgtatgtatgtatatatgtacaactatgtaccacatgcatgtctggtgcctatg

SEQ ID NO: 61268 - DNA, 75 bp, Mus musculus
gccaactctggggaggctgctgggttggggggaggtcacatgactcacagctcagtctttgtctgtcaccttggc

SEQ ID NO: 61269 - DNA, 104 bp, Mus musculus
gtggcttgatttgtctgtcttcctgtgtcctgactctgtatatctatctgtctgtttccctgataagtgcctgagtaccagggagaaccggatgagatttccat

SEQ ID NO: 61270 - DNA, 67 bp, Mus musculus
gagatcccagagcacagagctacgtgtgggtctagcgagggctacactgcctctgagcctctgtctc

SEQ ID NO: 61271 - DNA, 106 bp, Mus musculus
gaaatggtttcacatgcctttgatcccagcacttgggaggcagaggttggtggatctgttcagtttgaggccagcctggtctacagagtgagtttcaggacagcca

SEQ ID NO: 61272 - DNA, 78 bp, Mus musculus
gattagatataggaatatatatatatacacacatatatacgtatatatgtatgtatgtatatatgctcaataataatt

SEQ ID NO: 61273 - DNA, 77 bp, Mus musculus
gggaagaaaagactcctggcaaggtgtcctctgaccttcatactcccagtggcaagcacagtgagtctctctctctc

SEQ ID NO: 61274 - DNA, 98 bp, Mus musculus
gaacctggcactagagctctgtggtctcagcagcagtcaggaacctgcaggaagcacttactgacagttgtgtgagaagagatttctgtaccagcatc

SEQ ID NO: 61275 - DNA, 103 bp, Mus musculus
gagttgttcacatttaggggctaaagaaatggcctagcagttaagagcactcactgctcttgcagaggaccctgggttggttctagcacccatatgatggctc

SEQ ID NO: 61276 - DNA, 65 bp, Mus musculus
ggtgacatatggtatgtgtgcaagtgcatgtgtgggtgcatgcacaagtgcacatgcaagtctcc

SEQ ID NO: 61277 - DNA, 73 bp, Mus musculus
ggtagagatgtgattatgttatagatcctgaggaggtcacccaaacaggccctaaacacaatctcatgtttcc

SEQ ID NO: 61278 - DNA, 93 bp, Mus musculus
gtttaagagacagaagtgagggctggagagatggctcagtggttaagagcactgactgctcttccagaggtcctgagttctattctcagaaac

SEQ ID NO: 61279 - DNA, 64 bp, Mus musculus
gggactgagtggctcagtgactgagaatatttgttattcttgcagagatctgagttcagtaccc

SEQ ID NO: 61280 - DNA, 77 bp, Mus musculus
gtaaggccccttccctagaagcaatcatcagttacagcagcattgcacacagatgactgggaggagtggcttggtac

SEQ ID NO: 61281 - DNA, 101 bp, Mus musculus
ggttgggaagggacatatatgtccatatttatttatgtttctgaagctattatttttttatttaattttataaatatggtttgtatgtatgtgcaccaagt

SEQ ID NO: 61282 - DNA, 60 bp, Mus musculus
atgtatgtgtgtgtatatatgtatatacatacatatacatagatatacacacacatacat

SEQ ID NO: 61283 - DNA, 114 bp, Mus musculus
cctcagcagagctgtcttcgtgctttcagcttctttacagtgctgccttgtagcattcaggtcaagcagcattgtacagggctatgaaagaaccaagaatgggctgcccttagg

SEQ ID NO: 61284 - DNA, 108 bp, Mus musculus
acacaggagggactggtggcaggcagacaacgttcattaagtttggcattttgtatgtaaagatgaaagggggagcatgcctgtgtgctgacaaggagaggcctgggt

SEQ ID NO: 61285 - DNA, 98 bp, Mus musculus
atgtatgtatgtatgtatgcatgtatgtatgtatgtatatatgtatctatctatctacatctacatatatatatatatttctaaattgtgtgtgtgca

SEQ ID NO: 61286 - DNA, 88 bp, Mus musculus
tcttggccctcccaaacccaaatccggtcatgttgtccagctcagagagagctgacagcatcttgagagcagatgaagggaggaagga

SEQ ID NO: 61287 - DNA, 75 bp, Mus musculus
agagtcaaccacttgagactgggtaccttatcagggagctcttccttggagaagactgagtctctctctctgtgg

SEQ ID NO: 61288 - DNA, 82 bp, Mus musculus
acttgtgaacagctctgaggctgactgagatgatatatatatatatcttcagccaaaacttcagcttacatggccagtaagt

SEQ ID NO: 61289 - DNA, 114 bp, Mus musculus
tgtgcatattcatgtgtgtgtgtgcgtgcatatgtatgtgtgtgcatgtgtgtacatgtgtatgtgtgcatgtgcttgtgtgtgtgcacgcgcacgtgtgtgtgtgtgtgtaca

SEQ ID NO: 61290 - DNA, 95 bp, Mus musculus
ccctttgtgtatccttcatagtaaaactgcagttaagattacagtgccttggtgactctgtgagtctttcttgtgaattattaaaactcagaggg

SEQ ID NO: 61291 - DNA, 87 bp, Mus musculus
tactcagtggcaacacagaggcacacattggtggagaactcacagaggagagtctgcaagccaaagagagtcctgcttgccacagta

SEQ ID NO: 61292 - DNA, 85 bp, Mus musculus
ggccgtggtggtctgataggatgcatgggacaatttcaatatttttgtatctgttgaggcctgttttgtgaccaattatatggtc

SEQ ID NO: 61293 - DNA, 73 bp, Mus musculus
actcttccttgttttctccctcaggcatttctaggcagttaggcctgaagtgagagatcagacaacacagagt

SEQ ID NO: 61294 - DNA, 82 bp, Mus musculus
gaagacttttgatcctagaagagaagtctgtcacctgtgtactcctgaaatataggtgacagaagatagattgccagtcttc

SEQ ID NO: 61295 - DNA, 106 bp, Mus musculus
gccttagtgcatggtgatctgataggatgcatgggacaatttcaatatttttgtatctgttgaggcctgttttgtgatctattatgtggtcaattttggagaaggt

SEQ ID NO: 61296 - DNA, 75 bp, Mus musculus
tggaactgtgtctttcagagactgtagtagtggacatgacagagaaactgcacgtgcatctgagagactaggaca

SEQ ID NO: 61297 - DNA, 67 bp, Mus musculus
gtatctgtacacaggaaagggcgccgttcacacagggctcggtactctgaagtctgtgtgcccatgc

SEQ ID NO: 61298 - DNA, 116 bp, Mus musculus
tttagggcacttttgtactgaatgtatgcagagccttccctgtgtctctctgtccttcacagaacacaattatttacatggtatttgcattgccttcggaagtacaatagtctaga

SEQ ID NO: 61299 - DNA, 56 bp, Mus musculus
gatacatcactctggctctcttgtgcaggttgtacattagggcggaaacatgtgtt

SEQ ID NO: 61300 - DNA, 80 bp, Mus musculus
gctattgatcacagatcacacagagcagccttgcttcaaacagaggctggctacacaggctgtgaatactgtgacagggc

SEQ ID NO: 61301 - DNA, 73 bp, Mus musculus
tgtcctcattgactggagatgacagcagggatgtggagaacacatctgtcttgtgtctctctgtctaaggaca

SEQ ID NO: 61302 - DNA, 81 bp, Mus musculus
tgaaaattgttcttcagggccctggagagatggctcagtggctaagagaactgactgctcttcctgaggtccagagttcaa

SEQ ID NO: 61303 - DNA, 113 bp, Mus musculus
ataaatctagggcttttccaggatgggagggagagttactagttaaatatctttatttgttacaagtctattcatattttctatttccgttgaggtaagttctagtagcttgt

SEQ ID NO: 61304 - DNA, 79 bp, Mus musculus
gcagtgccggagaggtgaacagatgggcagggcagcctcaccacttgactaagacatctcactgtcactgtctctctgt

SEQ ID NO: 61305 - DNA, 88 bp, Mus musculus
tgggactttattccttggtggacgggagagaataacttgaatctattcatcatcatcttcatcgactggaaaagagatgattggccca

SEQ ID NO: 61306 - DNA, 75 bp, Mus musculus
gctttggtcatgttgatttagagggcttcgtcttcctggtgtcctccagccctctgtctctaacactctttctgc

SEQ ID NO: 61307 - DNA, 104 bp, Mus musculus
ggaagagctcaataggaagtgtttgctgggctggagagatggctcagcggttaagagcactgactgctcttccagaggtcctgagtttaattcctagcaaccac

SEQ ID NO: 61308 - DNA, 104 bp, Mus musculus
taaggatatctccaggctgttggacattttgtgaagaacagtgggagagaccttatcgtcatcatcatcttcatcttcctccagaccctcgagtgtgagcttta

SEQ ID NO: 61309 - DNA, 65 bp, Mus musculus
gggacatcagggtatggggaatagagattcaatccctgatctctctctctcactccctgacactc

SEQ ID NO: 61310 - DNA, 105 bp, Mus musculus
tgtgtgttctggcatgtctggcatgtacacacacaaacagagagagacagagacagaaacagagagagactaagagaaacagacagacagacacagagacacaca

SEQ ID NO: 61311 - DNA, 123 bp, Mus musculus
ccactgttttatcactttttgcctggtgttctgaggcaagttcttaatgtctctaagctttgtctctctgtgagtctcagtaacactacctggtgaagttgggcacagtgggtgagagagagc

SEQ ID NO: 61312 - DNA, 76 bp, Mus musculus
ctctgtgtgtgtatgtctgtgtatatatgtgtgtgtgtgtgtgcatgtatgtgtgttctgtgacacatgtgtggag

SEQ ID NO: 61313 - DNA, 61 bp, Mus musculus
gtgatgtgacacactctgtctgatgagggcactgcttttagatgcatctgtgttacaacgc

SEQ ID NO: 61314 - DNA, 69 bp, Mus musculus
gagcagagctctggctgttgagtctgagctgtgtggcttatagtcagttgctttcccaagttctagttc

SEQ ID NO: 61315 - DNA, 56 bp, Mus musculus
agaccaggctggccatgaactcagagatctgtctctgtctctgcttgcctctgtct

SEQ ID NO: 61316 - DNA, 58 bp, Mus musculus
tatatatatatatatatatatatatatatatatgtatgtgtgtgtatgtatatgtatg

SEQ ID NO: 61317 - DNA, 71 bp, Mus musculus
gattatttgtaatccataatatatatatgtgtgtatatatatatacacatacatatatgatgtatatagtc

SEQ ID NO: 61318 - DNA, 102 bp, Mus musculus
gtgggcaaagagtcagcaagaaatgacaaacaaatacgggacacaagagagtgtgctgtatctgaatgtaatttgtcaaatcaagcatcagactttttatac

SEQ ID NO: 61319 - DNA, 76 bp, Mus musculus
cagtaagccctgaaatcaacccaagagaactgcagagccaacttgagatattcttgttgagtgagggctgggcctg

SEQ ID NO: 61320 - DNA, 91 bp, Mus musculus
tatatatttatatatgtacatatgtatccatatatacctatccattcatttatgtatcatctatatatgtatgtatatatgtatgtatgta

SEQ ID NO: 61321 - DNA, 81 bp, Mus musculus
gtgtgtgatagaagtgactgaagactaattcttcttactttaaccacttgtgaatttcttcattacctgctgtccacgtgc

SEQ ID NO: 61322 - DNA, 89 bp, Mus musculus
tatatgtagatatgtgggtatgtatatgtgtgatatgtgtatgtgtgcgtacatatgtatagatgtatgtgtgtattgtgtaagtatgt

SEQ ID NO: 61323 - DNA, 70 bp, Mus musculus
gttattttattctgcttttgagaaaagagacaggtgactcttctctcatctcagagggtgaatccagggc

SEQ ID NO: 61324 - DNA, 82 bp, Mus musculus
gaatgagtcagaagagtttgaagaggccccaggactcttgccagtctttctgaaggtgcccactgactcacagactcccttc

SEQ ID NO: 61325 - DNA, 71 bp, Mus musculus
acacacacacacacacacacacatatatgtgtcataactatgaatgtatgtgtgtgcttatgtgcatatgt

SEQ ID NO: 61326 - DNA, 112 bp, Mus musculus
ctggaatgtgaggaaacgtcagattaggagggacttttcccaacagaagagtgtgagcaattccctggggactttagcccattctaatctgagtaaagtcctctcaagttag

SEQ ID NO: 61327 - DNA, 72 bp, Mus musculus
agcatgtgtatgtgtgtgtatatatatataaatgcacatgtgtgtatatgtgtatgcatatgtgtgtatgtt

SEQ ID NO: 61328 - DNA, 80 bp, Mus musculus
ctgtcccagtggtctgggtggggcctgagatcctgaatttctaatgagctcccaggtgacaccctgactcactgtgccag

SEQ ID NO: 61329 - DNA, 121 bp, Mus musculus
ctgagcttgcaggatactctacctaattgagcatgtatgtatatatgtatgcatacatgtatgtatgtatgtatgtatgcatgtatgtatgtatgtatgtattcttatttccccagacaag

SEQ ID NO: 61330 - DNA, 98 bp, Mus musculus
gagaagaaccaaaaaggactttggatcctgtgcagctggagttgcagtctgttgtgaatctccatgtggttgttgggataggaacctgggtcttcctc

SEQ ID NO: 61331 - DNA, 109 bp, Mus musculus
ggacacaattaatggaggaaatagagtattttataagcccaggactctctgtcaatctgtgaccaagagaaattctttgctttaatcactatgcattccttttggattc

SEQ ID NO: 61332 - DNA, 64 bp, Mus musculus
caagctagagaatgaagtcagtgagcagtattcctccatggtctctgcttcagttcttgccttg

SEQ ID NO: 61333 - DNA, 74 bp, Mus musculus
ggcagagcttcctgatctctgacaggtgggagactcaagaccacaggtcacagagtagagtgaagacagctgtc

SEQ ID NO: 61334 - DNA, 85 bp, Mus musculus; identical to SEQ ID NO: 57439

SEQ ID NO: 61335 - DNA, 120 bp, Mus musculus
tgcttctaggagaaatttaagtctttgcttttatttgcccctagtgtaagtagaatctaggctcacttgtctctgtgtaagcatctggctatactcatatctttggggaaacaattgact

SEQ ID NO: 61336 - DNA, 100 bp, Mus musculus
agctaatatatgtatgtttgtatgtatgcatgtatgtatgtatgcatgtatgtatgcatgcatgtgtgtatgcatgtgggtatataatgtctctaatgct

SEQ ID NO: 61337 - DNA, 82 bp, Mus musculus
tttgctcagtccaatggttggctgtgtgcatctgcatctgtattggtcaggctctggcacagcctctcatgtcagcaagagc

SEQ ID NO: 61338 - DNA, 85 bp, Mus musculus; identical to SEQ ID NO: 57470

SEQ ID NO: 61339 - DNA, 72 bp, Mus musculus
gtgcagctttatcttcatggtgggttccctaacaattggagtggggactgtctctgactctgttgcctgcat

SEQ ID NO: 61340 - DNA, 84 bp, Mus musculus
gtctgtctgtctgtctgtctgtttataggcaaggtcccgttatgaagccttaagtggcctatacttgcttagctggcctcagac

SEQ ID NO: 61341 - DNA, 121 bp, Mus musculus
tgcctgcagagaccagaaggtgttttcaatcccctggaactggagttgcagacagttgtgagtcaccacttgggtgctgagaatcaaacctgggtccctggaacagcagccagtgcaattc

SEQ ID NO: 61342 - DNA, 83 bp, Mus musculus
ggctcatcagacagtgtacacagagcagaggttcccacactcacaaacacaggaatgtcattgctttattaacatgctgggct

SEQ ID NO: 61343 - DNA, 83 bp, Mus musculus
gtaggtgtgaagtgataatgttgaagttatttgtgtattacaagaccgaattaaactccagtatggttcaatcatacacctat

SEQ ID NO: 61344 - DNA, 81 bp, Mus musculus
cctttgatgaaatgtctgacagtagagagagggaacttatagaacccacctctatcagtaagacaggacatcaagtatagg

SEQ ID NO: 61345 - DNA, 109 bp, Mus musculus
tgaaaatttatttttccaaggaaaagatgctgtgaaaaatctttatatgtttattaccattttaaagaaaattcatccttttttttttttttggtgatacaattttaca

SEQ ID NO: 61346 - DNA, 85 bp, Mus musculus; identical to SEQ ID NO: 57439

SEQ ID NO: 61347 - DNA, 97 bp, Mus musculus
tgaagtctttctataattgccagatgacagagtgcacactataaaagagtacaaggtcagagtgtgtcctccgtttctatgtaatacaaaaccttca

SEQ ID NO: 61348 - DNA, 96 bp, Mus musculus
gagagatgttgtgacagttctgtttatgtaatactgaaaacaccactagcgagtttgcagtgtttcccatgtaacaaactggggctagcatagctt

SEQ ID NO: 61349 - DNA, 112 bp, Mus musculus
gatcagtcttaggccatggtggtctgataggatacatgggacaatttcaatatttttgtatctattgaggcctgttttgtgaccaactatatggtcaattttggagaaggtc

SEQ ID NO: 61350 - DNA, 112 bp, Mus musculus
gatcactcttaggccatggtggtctgataggatacatgggacaatttcaatatttttgtatctattgaggcctgttttgtgaccaactatatggtcaattttggagaaggtc

SEQ ID NO: 61351 - DNA, 84 bp, Mus musculus
ctggagagggtgagacagaagactgtgaggcccatttcagtgagggctacactttaagttcctgttttcaaaagcccaataaag

SEQ ID NO: 61352 - DNA, 66 bp, Mus musculus
ctctccaggaggtcatcatagtgagtttaatgaagctgtgtctcagtctgtgaaattctggaagag

SEQ ID NO: 61353 - DNA, 111 bp, Mus musculus
cctatgcctttataagtttccttaaggagggcagtactgcttctcactatggttgtactaagtagtttgaagagtgtggttttgctgatggaagaattgtgttttctgagg

SEQ ID NO: 61354 - DNA, 85 bp, Mus musculus
ctatgtctctctgtatatctctgtgcaattatttacagatgcatgtatacatgtatgtaacattatgcaagatatacaaacatag

SEQ ID NO: 61355 - DNA, 103 bp, Mus musculus
gcttcagttgtgtgtttgttcatgtatatgtatgtatatgtgtgtatacacacacacacacacacacacacacacacacacacacacacacacacacggaagc

SEQ ID NO: 61356 - DNA, 88 bp, Mus musculus
ttgatgctcagacactgacactgtggaattgatctagtagtagttcttgacccagcagattaattttgtggcttgtgtccagcattaa

SEQ ID NO: 61357 - DNA, 109 bp, Mus musculus
tctaaaatattatgaagattcaataaataaggtgcatagtgacatatgtgtgtatatattacacacacacacacacatttcattaaaggatgttcaaactatggataga

SEQ ID NO: 61358 - DNA, 105 bp, Mus musculus
aagctaagctctctatcatagtacctaacactagagaattatatgtatgcatttttgtattttatagtgtctttgtggtgttgaaggaacttgagaccttggttt

SEQ ID NO: 61359 - DNA, 97 bp, Mus musculus
cagaaacatacacaaactcagtgttgtatatttatattaggtactcagtgaagaaacagcagagatgccatgtgtagagactcctgtgtgtactctg

SEQ ID NO: 61360 - DNA, 90 bp, Mus musculus
aaatgaagggtttacaacttactgcatggttttgatcttgggcaattactatgtctcagactctgacagtcatctggggacctccaattt

SEQ ID NO: 61361 - DNA, 66 bp, Mus musculus
gtctgtccactgtggagcttttatagaaaactcttctgtcactgtctgagtgttgtagtagcagac

SEQ ID NO: 61362 - DNA, 94 bp, Mus musculus
atatgtatgcttgcatctatatgtttgtatatatctatgtatgtatttatgtatgtatgtaggtaggtaggtttgtatgtatgtgtgtgcatgt

SEQ ID NO: 61363 - DNA, 109 bp, Mus musculus
tgttgacaggagtacaatatagtgtgcagtcaggaatccttctgttacacgaatctttcttttttatgttaagaaatttcctgctgtattataagcttcagtctaaaca

SEQ ID NO: 61364 - DNA, 94 bp, Mus musculus
ctcagcagcttgactcttgtggactatctctgactctgtgcttgactccacatcagcacctccagcatagttccaacaggatctgcttcctgag

SEQ ID NO: 61365 - DNA, 60 bp, Mus musculus
tgtgtgtgagtgtgtgagtgtgcgtgtgtgcgcgcgcgcgctctcacgcacacacacata

SEQ ID NO: 61366 - DNA, 75 bp, Mus musculus
cgcagttttgtttattaggtccgtctgtcccaggcacctgggtagattgccgagtgagcactggtgaaggctgtg

SEQ ID NO: 61367 - DNA, 85 bp, Mus musculus
aagtaaatgcagaggacctcgcccagaccaaacaaggttctgtgtttgtcccttcagtctctgtgagctcctgtgagccctgctt

SEQ ID NO: 61368 - DNA, 97 bp, Mus musculus
gtgtgtgtgtgtgtctgcctctgtatctctgtatctctatgtctctgtctctctctcatacacacacaaacatacacacacacacacacacacacac

SEQ ID NO: 61369 - DNA, 85 bp, Mus musculus; identical to SEQ ID NO: 57439

SEQ ID NO: 61370 - DNA, 100 bp, Mus musculus
gggacattttccttcctacttagcaaattaaatattttgcacttaatttgtatatttttccaatagtgcaaaatgtaattgaggaaggtaccgttgtctt

SEQ ID NO: 61371 - DNA, 81 bp, Mus musculus
gacggagtgattccaggagtagtgtggccagtgtcacagaactaacaacatagacactctcacactcactacattccctcc

SEQ ID NO: 61372 - DNA, 126 bp, Mus musculus
tgctgatgcccaggccctctcagccgcactgagtcaggctcttaggtttggagcacagcagtctgtctgtgacacaggaaaatttgagaacacttagttgtatttcctgtggatacatccattttg

SEQ ID NO: 61373 - DNA, 86 bp, Mus musculus
gacatgttggaaagggagcttgtaggttggattcatttaggtgggtagacccaccttaaaagtagctgacacagttctacatgatc

SEQ ID NO: 61374 - DNA, 90 bp, Mus musculus
catctatgtatatatttgtgcatgtatgtatatatgtatgtatgaatgtatgtatgtatgtatgaatgtatgtatgtatgtatgtatgta

SEQ ID NO: 61375 - DNA, 96 bp, Mus musculus
ttcctttgatttttttcttctataaagagttaatgactaatttatgtgtgactcactcagagtatttgcttttgatgggaagatgatcaaaaggaa

SEQ ID NO: 61376 - DNA, 106 bp, Mus musculus
tctctctatatatatatatatatatatatatatatatatacatatatatatgtgtgtgtgtgttatatgtatgtatgtatgtataagggacatatatatatgtatg

SEQ ID NO: 61377 - DNA, 77 bp, Mus musculus
tatgtgtgtgtgtgttatatgtatgtatgtatgtataagggacatatatatatgtatgtataagggacacatatatg

SEQ ID NO: 61378 - DNA, 85 bp, Mus musculus; identical to SEQ ID NO: 57470

SEQ ID NO: 61379 - DNA, 57 bp, Mus musculus
tatatgtatatgtgtatgtgtatatatgtatgtgtgtatatatatatatatcatatg

SEQ ID NO: 61380 - DNA, 114 bp, Mus musculus
actttccgtactgtgaacatgttttagttaactacatctgccaagtctatttgctatataaacaaatgtgattttgtagttgtaggggctaggatgcaaacatacctggtgggt

SEQ ID NO: 61381 - DNA, 115 bp, Mus musculus
aggagccaaaacaaaaccttttaatttttaacattattaggcagcaaatgaaatgcataaatgtttatttttcataaatgtctgataatgttcattgtagaggtctttctcttct

SEQ ID NO: 61382 - DNA, 118 bp, Mus musculus
gttaactggttgcttgctacatctttagacctataattgactttatttaattctgtttacaataagcagaaagctcttagattaaaggtgtgtgctagggttgagcaacaccacatgc

SEQ ID NO: 61383 - DNA, 116 bp, Mus musculus
gagtcctgggttaacatataaggaggcaggctgagcaagtcagggaaagtaagcaagtaagtagcaccctccatagcctctgcatcagctcctgcctccaggttctatccctgctt

SEQ ID NO: 61384 - DNA, 81 bp, Mus musculus
ggcatgggggttatgtcagtctgtctgtctgccaaggggcaaattaggaccaggtgattgtcaagctgttttctgtccctc

SEQ ID NO: 61385 - DNA, 93 bp, Mus musculus
acatagtgtagaacggtctctccctctctctgaatattccacattggcaaatgcactgaattggggcaggaaggggtcggtttttcacaatgt

SEQ ID NO: 61386 - DNA, 76 bp, Mus musculus
catgagttatgatttacatgttttttccatgttccaaatatggatttggtagcaagtaagcaaatcataatacatg

SEQ ID NO: 61387 - DNA, 118 bp, Mus musculus
gtccttgtattcctggaaatgaacattgcggtgatatttcagcattagaatttagaattattgaaactatttttataaatgagctttattgttggtgtttctattcctttttatggac

SEQ ID NO: 61388 - DNA, 114 bp, Mus musculus
aagagaccaatcacttgtataattacatggtctattccatacatatgtatgtgtgcatgtgtatgtgggtatatagttttaatggattatgcataacagaggatggcatttctt

SEQ ID NO: 61389 - DNA, 78 bp, Mus musculus
taaatatgtatatgtgtatgtgtgtgtgtgtgtatatatatatatatacacacacacacactgacatacacattttta

SEQ ID NO: 61390 - DNA, 74 bp, Mus musculus
ggctcacagcagtctaccactacagtctgataaatagcatgcactgactgtatcacagactgctatgaaatgct

SEQ ID NO: 61391 - DNA, 83 bp, Mus musculus; identical to SEQ ID NO: 57504

SEQ ID NO: 61392 - DNA, 69 bp, Mus musculus
attgaaaaaaagtatatatgtatgtatgtatgtatgtatatacacacacacatatataactctttcaat

SEQ ID NO: 61393 - DNA, 81 bp, Mus musculus
tcatgtgcagggcagctaggcaaatgtgagcactttggaaagttaattctgcgtgcacgcgcacacgcacttttcacatgg

SEQ ID NO: 61394 - DNA, 83 bp, Mus musculus
ggttcaaagaatctggtagtctgaaaatattttgtcttgaccatggaccatctcaatcactcagggactcagattctgctgcc

SEQ ID NO: 61395 - DNA, 110 bp, Mus musculus
tactgtcctagctgttgtagctggggggtgtcttcaagtatgtatgtatgtatgtagcaagtatgtatggacataatacacttccccatcccctgactttgggctcagta

SEQ ID NO: 61396 - DNA, 85 bp, Mus musculus; identical to SEQ ID NO: 57439

SEQ ID NO: 61397 - DNA, 115 bp, Mus musculus
tgtggagctctttctctctgcactgttttccttctttacgttcccgacattaaaactactgttctgaatatgttctaaagaaactgaaaacccagattctgttggcagctcagca

SEQ ID NO: 61398 - DNA, 85 bp, Mus musculus; identical to SEQ ID NO: 57439

SEQ ID NO: 61399 - DNA, 84 bp, Mus musculus
tcttgcaagtgtgtgtgtctgtgtgtgcctcctaatgaagggtctggcaatcatggatacagatttgggctttggcttgcaaga

SEQ ID NO: 61400 - DNA, 85 bp, Mus musculus; identical to SEQ ID NO: 57470

SEQ ID NO: 61401 - DNA, 85 bp, Mus musculus
agttctcctcactcacttagtgactgctggatttcagggattctcctagagacaaccagcaaggcagagagttggggtgagtgct

SEQ ID NO: 61402 - DNA, 57 bp, Mus musculus
ctgtctgtctgtctctgtctgtctttgacagagagagagagagagagagagagagag

SEQ ID NO: 61403 - DNA, 75 bp, Mus musculus
aaacagaccgtgcaagttgtgtttatgtgtttaggaatatatatgtatatacaaatatgcatgcaacagctgttt

SEQ ID NO: 61404 - DNA, 85 bp, Mus musculus
ggtgtggccagcggagggagtaggtgataactaggcctaaaatcccagcttcctctcactctgtaaatctctctctggcacctcc

SEQ ID NO: 61405 - DNA, 77 bp, Mus musculus
ggggaggtttatgagatagagacgcgctgaaggagatgtgtcacctcaggcagctttctagaactcaatgccttgct

SEQ ID NO: 61406 - DNA, 58 bp, Mus musculus
tcaggagtcacagagtcatctcaggcatcccctgcttctgagtgtgcagactccctga

SEQ ID NO: 61407 - DNA, 115 bp, Mus musculus
gctgagaagaggttatgaaagtagtgttgggagaaacacgggcaaaatcttcacagaacaaagaatgaaagcctgggaaattgtctcagcaaaccttttcattcccacactcagt

SEQ ID NO: 61408 - DNA, 69 bp, Mus musculus
tgatccttgccatgtgaggagaagacatttatgtatctatataatttattctcagtcagtggaagggca

SEQ ID NO: 61409 - DNA, 85 bp, Mus musculus; identical to SEQ ID NO: 57470

SEQ ID NO: 61410 - DNA, 103 bp, Mus musculus
ggagacatttctgcaagcagtcttccagagtcaagataaatgtcaatatgaagattgactctctttgtctcactgctggatataaagaaagtagatgtgagcc

SEQ ID NO: 61411 - DNA, 85 bp, Mus musculus; identical to SEQ ID NO: 59674

SEQ ID NO: 61412 - DNA, 77 bp, Mus musculus
tctgtctgtctgtctgtctgtctgattttgtgtggaaaaagtgcaatggtagaaaggtagaccaggagggaatggga

SEQ ID NO: 61413 - DNA, 119 bp, Mus musculus
gtagcataaaagtagaatactgcatcttactatcatttcttaattttatgtatatgtcctacatatgtatatatataattctagaatgagagttcagtgttaatcttccttctcactac

SEQ ID NO: 61414 - DNA, 119 bp, Mus musculus
ggtcagggtgtaatgtttgagacaataataatagtagtgatgatgatgatgatgatgatgataaaaatccatatctcatgctagttatggctttaattcactcaaggatctgcattctg

SEQ ID NO: 61415 - DNA, 94 bp, Mus musculus
gtggtggtttgtacgtgctcagatcaagaagtggcatgatccataggtgttggagtaggtgtgtcactgtgtgtgtgggctttaagaccctcat

SEQ ID NO: 61416 - DNA, 145 bp, Mus musculus
gcatgcatatgtacatatatatatatgtgtacacagatatccatgcacaaatatgtatgtatgcatgtatgtacattatatatatatatatatatatatatatatatatatatatatatgtgtgtgtgtgtgtgtgtgtgtgtgt

SEQ ID NO: 61417 - DNA, 90 bp, Mus musculus
cactatgtgtgtgtgtgtgtgtgtgtgtgtgtgcacacgggcgtgtatttatgtatatatatgagtgtgtatatatgtatatatgtgtgt

SEQ ID NO: 61418 - DNA, 160 bp, Mus musculus
gtatatatgtatatatgtgtgtgtacatatatgtgtacatatatgtatatatgtgtatatacatatatacatgtatgtgtatatatagatatgtatatatatatatatatatacatatatatatacatatgagtatatatgtatatttatatttattgca

SEQ ID NO: 61419 - DNA, 123 bp, Mus musculus
atatacatatatactcatatgtatatatatatgtatatatatatatatatatacatatctatatatacacatacatgtatatatgtatatacacatatatacatatatgtacacatatatgta

SEQ ID NO: 61420 - DNA, 81 bp, Mus musculus
gcatgtgtatgtatatatgaatgtatgtatgcatgtgaaagtatgtgtttctgtgtatgtgtattatgtgtgtgtgtatgt

SEQ ID NO: 61421 - DNA, 78 bp, Mus musculus
acttctaattttaataaatacatgcatacatgtgtgtatgtatgtatgtatgtatgtatgtatgtattatttgctggt

SEQ ID NO: 61422 - DNA, 99 bp, Mus musculus
tgattttgaagttcatataagttattgaatgtatcaagactttattgatttttaataaatatagtcccaatttcttacatgtgtgaactacaattttca

SEQ ID NO: 61423 - DNA, 106 bp, Mus musculus
gcttattagacttgagttgagagatgggcatgggaaacaattttttctttttaagacaagatctcgctaagtagcccaggcaatcctaaactcatgatcttcttgc

SEQ ID NO: 61424 - DNA, 85 bp, Mus musculus
gaatgctgtgcctcactcagtgtctctcccaggtcccagatgcaaagcctgggccagggagccatatgtgcagctggtactgttc

SEQ ID NO: 61425 - DNA, 101 bp, Mus musculus
aggtttgtaacattaagggctagaggtgatggtgttggggtgagatgaaatcgtcactcttttactctctactatcacaggtaattcagagtagcttacct

SEQ ID NO: 61426 - DNA, 103 bp, Mus musculus
ctcagtgcatgttgaatgtgcatttttttttttttttttggtttgcttgtgttggtcgaggatgcaataactcacatcaaagaagcactttattttcattgag

SEQ ID NO: 61427 - DNA, 120 bp, Mus musculus
ctggatggttttagctcctttgtcaaagatcaagtgaccattaggtgtgtggattcatctctggatcttcaattctgttccattggtctacttgtctgtcactataccagtaccatgcag

SEQ ID NO: 61428 - DNA, 103 bp, Mus musculus
gccataaggtgtcctcaaaccagagatcatatctatatatctatatataattaataattaaataatatatattattatctcttgtttgtgaacactttatagc

SEQ ID NO: 61429 - DNA, 88 bp, Mus musculus
agatagggtttctcactgtttctctggctgacctgaaactcaccatttagaccaggttggccaggaactcaccatgatgaccctgcct

SEQ ID NO: 61430 - DNA, 95 bp, Mus musculus
cttacatatgaatacacaatgagtacatatatgtaaatagtatacatattaaaatagcatatgaaatgtatttatgtgtataggcatatgtatag

SEQ ID NO: 61431 - DNA, 115 bp, Mus musculus
gataatggtaggacattatctcttaaggcttaaatatttttagattggtatttatgttttcttttatctatttaaaaatgagttttattaggtctttactaaatgcttatatgtc

SEQ ID NO: 61432 - DNA, 116 bp, Mus musculus
gtcacctttacaaacggttctaaatgtgctgtagattgctgtcagaactgtgagtgctgtgcttaaactcagagtgacatctgactctacaagtgtaaggaccgtcagcaggtggc

SEQ ID NO: 61433 - DNA, 85 bp, Mus musculus; identical to SEQ ID NO: 57439

SEQ ID NO: 61434 - DNA, 96 bp, Mus musculus
gatggatgatcattttggtgtgttcttggatatggttagcaagaattttattatttttgcatcgatattcataagggaaattggtctgaaattctc

SEQ ID NO: 61435 - DNA, 85 bp, Mus musculus
gtccatggtggtctgataggatgcatgggacaatttcaatatttttgtatctgttgaggcctgttttgtgaccaattatatgcac

SEQ ID NO: 61436 - DNA, 85 bp, Mus musculus; identical to SEQ ID NO: 57439

SEQ ID NO: 61437 - DNA, 107 bp, Mus musculus
ggcatttcctttagattgcttaagcttaggtggtggtacttgagagacagtttattatgtgtcatgtctctctctttgtctgggcaggttatgtgacgatagatgcc

SEQ ID NO: 61438 - DNA, 85 bp, Mus musculus; identical to SEQ ID NO: 57439

SEQ ID NO: 61439 - DNA, 96 bp, Mus musculus
catgcagcacagagcctggaaggacatttaaaattttttagatttatttttcattttgttttatgtctatgaatgctttgcctgcttgcctgcatg

SEQ ID NO: 61440 - DNA, 111 bp, Mus musculus
ggtacctggtatctgtctaggaagttgtccatttcatccagattttcttgttctgttgagtatagccttttgtagtaggatctgaagatgttttggatttcctcaggttct

SEQ ID NO: 61441 - DNA, 93 bp, Mus musculus
cactacgaagcttctcacacacactgacagcgatttacctcaccaagcaggatgagaaagatcatctgcacgttaaggaggagccggagagtg

SEQ ID NO: 61442 - DNA, 76 bp, Mus musculus
tctctgtctctctgtgtctgtaagttaattatgaacagcgtgtatataactacagagatcacagaagaagcaagga

SEQ ID NO: 61443 - DNA, 80 bp, Mus musculus
ggccttggaggagatatgtcacttggctttgaggttttaaaagcctatgctatgcccagtgtctctctctgcctggagcc

SEQ ID NO: 61444 - DNA, 103 bp, Mus musculus
atatatatgtttaccatttatataaatatatatgatatatatgtgtgtatgtatatgcatatgtatatgtatatatttcctggatgtgagttgctatgtgtgt

SEQ ID NO: 61445 - DNA, 116 bp, Mus musculus
atctgtaaatagtttttggtagaatgatagtagtagtagttttcacagtggcagacttgagtagttttgacagaaaatggctatctcacagtactggaagtctggactttacagat

SEQ ID NO: 61446 - DNA, 106 bp, Mus musculus
gtttcagacggaatactatacaagcaacactgtgtccctctcaggctgccacactcagagacacactgtctacctattccttgatgatgttcctaattctgaatac

SEQ ID NO: 61447 - DNA, 137 bp, Mus musculus
tatatacaagtatatatacctatgtatatatgtacctattatgtaggcacatatgtattgaagtatatatgtatatgtacatatatgtatacataatgtatatattatgtgtgtgtatatatgtgtgtgtgtatgca

SEQ ID NO: 61448 - DNA, 112 bp, Mus musculus
ggtgtggacttctctgagtataagatagctgggtcatctggtagttctatttttaattttgagagctctccacactgatttccataatggctgtattaacttggacccccac

SEQ ID NO: 61449 - DNA, 85 bp, Mus musculus; identical to SEQ ID NO: 57470

SEQ ID NO: 61450 - DNA, 123 bp, Mus musculus
gtcccgaaccatcttcccacctcacaaactttcggggcaagttactcggctgcgttctctgtctctctcgagaagcagctctgaagagaacaatgaggccagaaagggaccggactatagggg

SEQ ID NO: 61451 - DNA, 119 bp, Mus musculus
agcaaggccatgtgaaattgctgctttgagggctagagagatggctcagtggttaagagcactgactgctcttccagaggtcctgagttcaaatcccagcaaccacatggtggctcaca

SEQ ID NO: 61452 - DNA, 64 bp, Mus musculus
ttctctttatggcatatataaatatttatatgggaatgtgcatatgtatgtgtgtttgagagga

SEQ ID NO: 61453 - DNA, 71 bp, Mus musculus
cagggcatagtggtacacacctttagttcctgaacttaggaggcagaggtagatggatctctgtgagtttg

SEQ ID NO: 61454 - DNA, 90 bp, Mus musculus
ggcacatcttcgtgttcctgactctgtctctgtcagaactccccttcatgagagggttcttacagggttctactcacaggaaagtgtgtc

SEQ ID NO: 61455 - DNA, 113 bp, Mus musculus
tttcagcatgttgattaacactcaggaggcactgaaaagaatgaaggtgggccctctctctgtctctatgcttcagtactgaggataagtcccacactcaaagcactttgaag

SEQ ID NO: 61456 - DNA, 115 bp, Mus musculus
atgtattttgttgactcagttgtttgtctgtgtatgtatgtgtgtatatatatatatatatatatatatatatatatatatatatatatatatgtctctctgtctctttttatgt

SEQ ID NO: 61457 - DNA, 114 bp, Mus musculus
ctctacacctgtagtgtgtgtttcatggcagtgtggtaatgaacttattattaatttttaagatcacaaagtaaccatttctcattcagtaaattgcacaatgcagaggtacag

SEQ ID NO: 61458 - DNA, 103 bp, Mus musculus
gcgactgtcgtgtgctctccatgcggccctgggtgagtgtctggctgtgagaagccacagaacgcagaaccccagtctgcaggggttggagaggaagcagtcc

SEQ ID NO: 61459 - DNA, 107 bp, Mus musculus
cttcagggaaaagtctgtatatatatacatatgtgtatatatatatatatatatatatatatatatatatatacacacacacacacatacacactgacttcttggag

SEQ ID NO: 61460 - DNA, 85 bp, Mus musculus; identical to SEQ ID NO: 57439

SEQ ID NO: 61461 - DNA, 85 bp, Mus musculus
cctttagacagtagacagtaagcatagggctctagtgacagggcaacctccagtttagcctctgttttctatgttgtctctgagg

SEQ ID NO: 61462 - DNA, 78 bp, Mus musculus
cttgttaatggttttgaaatctaaataatactagagatactgtttcagtattattgagatttaaaaaccatgagtaag

SEQ ID NO: 61463 - DNA, 63 bp, Mus musculus
agctcatatttcagtctctgactcccagtcttagagaatgggaggggcagtgagagtctagct

SEQ ID NO: 61464 - DNA, 118 bp, Mus musculus
tatcaatgctgtggaacttatcaagactagtatcatcagtgatgtagcaggtatactgtgagaggtgactgaggagatggctacagtcttttataaagtgcttataatagtgttagta

SEQ ID NO: 61465 - DNA, 63 bp, Mus musculus
caatgcactgtgtttctctgtcctgatgtgacatattcatgacagagtgaacacagtgtggtg

SEQ ID NO: 61466 - DNA, 107 bp, Mus musculus
cagtagtgctcatttgtaggatgtgctgtgtgtccagtggtcatgaaagtttttttttccatttcatagttatacacagaattgtaatctgaaaatgccatgtaatg

SEQ ID NO: 61467 - DNA, 87 bp, Mus musculus
cattctaagtgagtgagttcactgagatgattagtgtttggaactggtcaagtgtttcagtggcttctttatattaaccatagagtg

SEQ ID NO: 61468 - DNA, 90 bp, Mus musculus
atataaactgtgcagtaaaggtagttttctttagaaatatagaaagatagtactaaagaaaattatcaattaaaaaggcatagatggtat

SEQ ID NO: 61469 - DNA, 62 bp, Mus musculus
aatgagccactgattaagagtccgatggattcactccgtctctgagtctcacagtggccatt

SEQ ID NO: 61470 - DNA, 116 bp, Mus musculus
atgccttttagatgaggaaaatagatagtgtttggtagatgtccataatacagccagctatgttgtggaattggaattaaagaccagaaaccatgttattcaatagtggtgggtat

SEQ ID NO: 61471 - DNA, 128 bp, Mus musculus
gtcagccagcctagatgtgatgacagtagaggcggcctcaaagtcctatgtctgctccctcaggctgcctgtctgcctggaatgcaggcatactcattctatgtatgcctgtacaggtccaaggtaga

SEQ ID NO: 61472 - DNA, 72 bp, Mus musculus
agaggagctgtgtcactgtggttggactttgaggttaccaacgcccataccacttagtgtctctgtctctct

SEQ ID NO: 61473 - DNA, 117 bp, Mus musculus
tcttacacctaatatcagactgttctcaccctgtttaggagacacctgccatcttgccccacagcaatagcttgtggctcagctagcagggccaagaacacactaatgggttgttga

SEQ ID NO: 61474 - DNA, 107 bp, Mus musculus
cacatagtttgtttcttcttgtttgaagttaaaattttttcctcgagtccctctctctgacacctcactggaaataatttgtgaacttagaagaaatatctgagatg

SEQ ID NO: 61475 - DNA, 75 bp, Mus musculus
gcctgaatgtagcatagcaatgatactactaataatgtcttacatttttatatgttatgttgcatatttctaggc

SEQ ID NO: 61476 - DNA, 69 bp, Mus musculus
tcctgtccatttccatccctgtaattctttcagacagaaacaattatgggtcagagatgtgactgtgga

SEQ ID NO: 61477 - DNA, 79 bp, Mus musculus
ttatgtctagaagaagctgtttccttggagtcacccactctctctggcttttagaatctttctgcttcctctggcatag

SEQ ID NO: 61478 - DNA, 106 bp, Mus musculus
cctttctgcactggctggttttgcatgccaacttgacacaagttagagtcctcagagatgaagaggcttcagtcaagaaatgcctccctaagatccagttgtaagg

SEQ ID NO: 61479 - DNA, 98 bp, Mus musculus
tcaagaggaattacttttctggtctagtctggtctatgctttgtgtaccctgataggcatctactttttttttaagctagggaaagtgtcttctatga

SEQ ID NO: 61480 - DNA, 77 bp, Mus musculus
ttcatgtatctactctattctctaactcatatatatgtatatgtacatatatatagaaagagagacatagacatgga

SEQ ID NO: 61481 - DNA, 73 bp, Mus musculus
catgtctatgtctctctttctatatatatgtacatatacatatatatgagttagagaatagagtagatacatg

SEQ ID NO: 61482 - DNA, 107 bp, Mus musculus
atgtatatgtatgtatgcatgtactttggtgtggacacatgtatgtgtgtatacatgtgtgtgcatatgcccatgtgcacacatgtgcatatgtatgtgtgcaggcc

SEQ ID NO: 61483 - DNA, 98 bp, Mus musculus
gtgctcttaagttgtgggttccggggattggactcaagtcatcatgcttgtttgcaatcactgtatagactgagctctctcccaagcccctgtagcac

SEQ ID NO: 61484 - DNA, 115 bp, Mus musculus
atgttttctatgctttgttctgttaattttttgtttgtatgttttattttctttgatagggtgaggggatggttacaaagacaggaaatagatatgaggggatggagagatacgt

SEQ ID NO: 61485 - DNA, 101 bp, Mus musculus
gcctagcccaagatggatggagtcagcattgtgctttcccagcaggtagctgcttaccaccacagcctctgacagtctctgttcatctccttacctaaggc

SEQ ID NO: 61486 - DNA, 62 bp, Mus musculus
gtctgtctgtgtctgtgtgtgggccaggtcttgtcatggcattcatgtgaagatcagaagac

SEQ ID NO: 61487 - DNA, 194 bp, Mus musculus
gtatatgtatatgtatgtgtatgtgtacgtgtacgtgtacgtgtacgtgtatgtgtatgtatatgtatgtgtatatatatgtaagtatgaatatatgtgtatgtatatatatgtacacacacacacacacacacacacacacacacacacacacatatatatatatacacacactaagtaatcacaggcgcata

SEQ ID NO: 61488 - DNA, 118 bp, Mus musculus
ttgatgaggacagcactaatatggaactgtcccctgcttttctgtctagtctcatttttttttaaatctgccctggggagagtgggatagagattgtggaggtgcctgcatcatacag

SEQ ID NO: 61489 - DNA, 109 bp, Mus musculus
gaagcagaatatggcagctttatggaattatcatacacttccgttgcaaataatttatagttacagtgcaatgttatatggcctaaagcaaataatctttctgtgactc

SEQ ID NO: 61490 - DNA, 114 bp, Mus musculus
gcttgctacaaccagactcatacttgaaaattaaaatgtagtgaatttgttgtattctatatgaccaacctgttctaccctttaactttctgtcagttttggtctgacacaagt

SEQ ID NO: 61491 - DNA, 95 bp, Mus musculus
gatatctgggagaataaataatctcattttgttcttgtccaagattatttgggagaaaacaagattatttgagatttggagttctttcttttgtt

SEQ ID NO: 61492 - DNA, 110 bp, Mus musculus
ttggaaaattgatttccagccttttactctgaggtagttagtgtctgtctttgtcactgaggtgcatttcctgtaaggagcaacatgctgggtcctgattatatatccaa

SEQ ID NO: 61493 - DNA, 106 bp, Mus musculus
ggtgtgtattgttaagatgagctgaacaggggcaggagagatggctccgcagtcaagaatgtttgctctcttgcagaacactccagcctttcttagcacccacatt

SEQ ID NO: 61494 - DNA, 81 bp, Mus musculus
ctgtctgtctgtctgtctgtctatctccatgcagtaactgttagtaaagagggggttatgattttgaaggagagtagggag

SEQ ID NO: 61495 - DNA, 101 bp, Mus musculus
ttggggtatgatttagtatgtgtggaagatggttgtaaagtctgaccacaatcacagaacaatagcattgtcttacacaaaccatcctaggattaccctgg

SEQ ID NO: 61496 - DNA, 109 bp, Mus musculus
tgtgtgcacgtgtatgtgagtgtgtgtgtgtgtgcatatatacatataacatatatatatatatgcatgctcacaggtacacacacacaggtacacacacggacacaca

SEQ ID NO: 61497 - DNA, 100 bp, Mus musculus
tggcacatttaaggagatgaaatagggctggagagatggttcagtggttaagagcactgactgctcttccagaggtcctgagttcaattcccagcaacca

SEQ ID NO: 61498 - DNA, 75 bp, Mus musculus
gctcacatgacagaaaagtcagaggtgtgaatggttgaattcataccatgacctctcttccaatttccttgtgac

SEQ ID NO: 61499 - DNA, 85 bp, Mus musculus; identical to SEQ ID NO: 57439

SEQ ID NO: 61500 - DNA, 111 bp, Mus musculus
ttgaacatgttgatctggctagacagggatctagtcttttttttttttttttttttttttttgacttgttgggatcactctttttctgtctccccagtgctatggttacaa

SEQ ID NO: 61501 - DNA, 101 bp, Mus musculus
atatacatatacatatacacacatatatattatatatgtgtgtgtatatatgtatgtatatatatatatatatatatatatatatatatatatatatatga

SEQ ID NO: 61502 - DNA, 81 bp, Mus musculus
atatatatatatatacatacatatatacacacacatatataatatatatgtgtgtatatgtatatgtatatgtatatgtat

SEQ ID NO: 61503 - DNA, 68 bp, Mus musculus
gcaaggatgacagcaggacttgggggcctgatgtggctttgagctgtgcctgacttctcatcctgtgt

SEQ ID NO: 61504 - DNA, 98 bp, Mus musculus
ccttagtccatggtgatctgataggatgcatgggataatttcaatatttttgtatctgttgaggcctgttttgggatcaattatatggtcaactttgg

SEQ ID NO: 61505 - DNA, 85 bp, Mus musculus; identical to SEQ ID NO: 59744

SEQ ID NO: 61506 - DNA, 115 bp, Mus musculus
gttgtgagagaccaactctgctacctggagccctagtgaggtcccagcccaagctactgctgaggtctgtgtctgtgtcactggctttgcagtggcagggatcagtgtccatggc

SEQ ID NO: 61507 - DNA, 75 bp, Mus musculus
ggtgatgtgactgcctgtctgtctgtgtgaggatgtcagatcccgtggagcaggagttccaggcagttgctagct

SEQ ID NO: 61508 - DNA, 106 bp, Mus musculus
gtaaggagatatgcattcatcgcatatgtatatattcttatgtatatctaatatgtatatattcttatgtgatatatatatgatgtatatgcttatatatcctcac

SEQ ID NO: 61509 - DNA, 84 bp, Mus musculus
tcttgtaacatattggtagctttgtgtgcagccttcagtctctgggtagaggcttaaggctgatgctacaatggagttgattga

SEQ ID NO: 61510 - DNA, 94 bp, Mus musculus
gcagtggagatggaattggctgggattacagaattctgtgtttatttttctatcagaactcactttccagttgtcttacaatattctttgctgt

SEQ ID NO: 61511 - DNA, 85 bp, Mus musculus; identical to SEQ ID NO: 57439

SEQ ID NO: 61512 - DNA, 69 bp, Mus musculus
agcgtccccaggaggagatggtgatcagacaaaagtctcaccatgactcactctctcatggttgtagct

SEQ ID NO: 61513 - DNA, 74 bp, Mus musculus
agaggcaggatgcagggaaagcatgcattgagatataaagattatttttcaatgtttcttaaggcaaggtctct

SEQ ID NO: 61514 - DNA, 61 bp, Mus musculus
gtcttgtttgtgtgttcatgggcatgtttatgcatgtgcatgtggaagctagagagcaagc

SEQ ID NO: 61515 - DNA, 104 bp, Mus musculus
ctagagagttcctgaaagcttttgcataggaggtgtgttctctcactgtaactttttacaggtaaggaagctgagatgcagaaagcataagaaatgtgctcaag

SEQ ID NO: 61516 - DNA, 67 bp, Mus musculus
cacatatacacatgtatatagtctacatatgtatatatatatttctatgtgcatttatgtgtatgtg

SEQ ID NO: 61517 - DNA, 60 bp, Mus musculus
gtatgtatgtatgtatgcatgcatgcatgtatgtatgtatgtgtatatgtttgtatgtgc

SEQ ID NO: 61518 - DNA, 102 bp, Mus musculus
ggctggctgctgcctgggaaatcaactgctgaagagagaaacagaaggtagtctgcacgcagtccattcctgtctaaccagtttgaaccccagcagggcacc

SEQ ID NO: 61519 - DNA, 81 bp, Mus musculus
cctggaaagggggctgacgagatggctcagcggttaagagcaccgactgctcttccagaggtcctgagttcaattcccagg

SEQ ID NO: 61520 - DNA, 103 bp, Mus musculus
gctcaggttcccatagtgacacaaggtcagagagctcatctgggccaccccagacagagctgagtctgcactcacctgccactcgctgctgctgttcctgagc

SEQ ID NO: 61521 - DNA, 83 bp, Mus musculus
tctgtcacatgctggccagggaaatgttgagtagttgtttcgctctctgtgacacacacacttccttgtgagtaaatggcaga

SEQ ID NO: 61522 - DNA, 82 bp, Mus musculus
cgtcaccaggctcactctgtccctggctggtgcaaggctttgatgacaggtaccacagaggagatgtgggaggtatggaggc

SEQ ID NO: 61523 - DNA, 95 bp, Mus musculus
ctgcaactctacgagaggccaccccttgagtgcatagttgtcaggagaccacttggtatttatggagctgtggcctaatgtagggtctacctcag

SEQ ID NO: 61524 - DNA, 85 bp, Mus musculus
tatgttttatctatctatctatctatacatatatgtgtgtgtatacatatatatatatgtatacatagatatatatacatacata

SEQ ID NO: 61525 - DNA, 103 bp, Mus musculus
gtggcaaggtgtagagtcagtaacaatctggcagtgcaggaagaaggtacttggcattttattcctttctgaaaagtctttgttctgggctttcaaactccat

SEQ ID NO: 61526 - DNA, 112 bp, Mus musculus
gagatgaaacttacttgatcatggtggatactcttttttatgtgttcttgaatttactttgaatgtattttattgaggatatttacagttatgatcatacgggatatttttc

SEQ ID NO: 61527 - DNA, 97 bp, Mus musculus
gctgaaccctagtcacaaaagcattagagtttgtaggttttattttatttatttgttgtggagcaggataaacccagggcttttgcacatactaagc

SEQ ID NO: 61528 - DNA, 106 bp, Mus musculus
ctcaaacttgaagacatttcctgggatcttatgaaagggaacttcctgactcagtgtctcaaatttgggcagagctcaagaatctccatttctagtgggcttccag

SEQ ID NO: 61529 - DNA, 69 bp, Mus musculus
tgtgcgcactcgcatgtgcgcacacatacacaatttatgtgtgtgtttgtcactgtatcagtgtgccac

SEQ ID NO: 61530 - DNA, 94 bp, Mus musculus
ggccgctgacgtcctccagacctatttgctgggtagtggtggccgagggccacaggctgaagacagtagagactgtggggaatcaggagaagcc

SEQ ID NO: 61531 - DNA, 107 bp, Mus musculus
gctaagaatgccacgtacattatttcagttgagttagtgatccaggaagatctctgtattactgtatttctatttctgtattactgtggtagtgactcaggcttagt

SEQ ID NO: 61532 - DNA, 114 bp, Mus musculus
ggtcagaagaaggcattggatctcctgggactggagttccagacagttgtgagccaccacgtggatgctgggtatttcctctaggagagcaatcatgttcttcactgctctgcc

SEQ ID NO: 61533 - DNA, 85 bp, Mus musculus
tgtcagggtcccagaggccacttgactcccaggaactctgacacacacagaatcacaggatcacagaggcagctggactatgagg

SEQ ID NO: 61534 - DNA, 153 bp, Mus musculus
tatatacatatacatatgtgtgtatatgtgtgtgtgtatatatacatatgtgtgtatgtatatatatgtatgtgtatatgtatgtgtgtgtatatacacatgtaggtatatatgtatatatgtgtgtgtatatacatatacatatacacacac

SEQ ID NO: 61535 - DNA, 82 bp, Mus musculus
acaccaaagtcagcagttatggtgatgctgttttctcattcactgattcacactcagacactgctggttgtgccaatggtgt

SEQ ID NO: 61536 - DNA, 89 bp, Mus musculus
tccgtgtgtctgtctgtctgtctgtgtattggggggagagaattgatttcacatcagagtatggaaagaacacagttggacaagttgga

SEQ ID NO: 61537 - DNA, 66 bp, Mus musculus
gttctgaattacttgatctgtgattccatgagggaactggtggcataattctataattctaggaac

SEQ ID NO: 61538 - DNA, 82 bp, Mus musculus
ctggagctgtctgtgtgtctgtctgcctttggaaatatgcgtgtgtcgggtgggggggccttgtgattcttcaggtagctct

SEQ ID NO: 61539 - DNA, 73 bp, Mus musculus
gtgtatgtctgtgtgtctgtctgtgtaggtatgtgcatgtgtgtacagctgtgcacacaggtcagaagtgcat

SEQ ID NO: 61540 - DNA, 74 bp, Mus musculus
acgaggcttctagaacaggtaccatggtgaggactagccccactcactcagtatctctcttctacacagtctgt

SEQ ID NO: 61541 - DNA, 107 bp, Mus musculus
atatttgtccctcttaaaaagacactccaaagtattctctgggattttgatgtgtgtccaagaaacactgtgactcctatatctactttgctgtaagaggcaagtgt

SEQ ID NO: 61542 - DNA, 62 bp, Mus musculus
aactggagtgatgggaggctgttaggaagaatcactgactgctcttccagaggtcctgagtt

SEQ ID NO: 61543 - DNA, 74 bp, Mus musculus
gttataatagcccaagaaggcaaacacatacacctctggctaggtgtgtgggagttgcttcatttgtttttaac

SEQ ID NO: 61544 - DNA, 88 bp, Mus musculus
gtgacatgtttgggacgaaactgcttgggattagttgcttaggcaatctatgtatattttaaggaaccggtttgcactcacatggagc

SEQ ID NO: 61545 - DNA, 67 bp, Mus musculus
tctgactgtctgtctgtctgtctgtctgcctgcctgccagatagctagatggaaacagaaaggaaga

SEQ ID NO: 61546 - DNA, 69 bp, Mus musculus
agtgtgctcacattccgagtaggtagtcaggctcatggtttctgtgactctgactgactctgagacatt

SEQ ID NO: 61547 - DNA, 104 bp, Mus musculus
agagaagtggtgggctgcgctaattacaagctgctgtctctcacactcccatactcaactatatggatgtgagctgcgatcatggctgccccaccagctgctct

SEQ ID NO: 61548 - DNA, 103 bp, Mus musculus
gtctgtgactcattgccatgtagtgttttgagtttctgttgtgctctagaaaatatcaacccttagtctggtatacagttagcacagattctctcccattgca

SEQ ID NO: 61549 - DNA, 85 bp, Mus musculus; identical to SEQ ID NO: 57439

SEQ ID NO: 61550 - DNA, 115 bp, Mus musculus
tggtgccctatcaaaaccaaagaggaggggagacagccttgatgtttgttatttatttatttatttatccatttatttttttatgttatctgtctgactctgtgtttgggagaca

SEQ ID NO: 61551 - DNA, 66 bp, Mus musculus
tatatatatgtatatatgtgtgtgtatatatacatatatgtatatgtatatgtatatgtatatgta

SEQ ID NO: 61552 - DNA, 82 bp, Mus musculus
gcattactagcacaggataagaggtgtgtgcctgctgtgtatatgtgtgtctgtgtatatctgtgtctgtgtctgtgtctgt

SEQ ID NO: 61553 - DNA, 69 bp, Mus musculus
agatggccagtctcagtctgtcaaccactcacactctctagtggtccagagatgagcagctggtcagct

SEQ ID NO: 61554 - DNA, 82 bp, Mus musculus
ggaggcaagttaaaggttgtaaagttaaaagctggcaaaaatagccagaccctttcatctgttatataagttggaagcttcc

SEQ ID NO: 61555 - DNA, 125 bp, Mus musculus
agaaatcatgaatctttctcttgccagggccctgggacatcatcaaaggaactgcactttcagcatctgcatgagctacaggctcaaggcaggggaaggctgggaggtcttgttttggtctggtc

SEQ ID NO: 61556 - DNA, 116 bp, Mus musculus
gagcaggaagctccacccctgagcaagcaggtttcaggctggaggaggggagactacaatttttgattatctttacctgtttattaggctgaggagatggctcagtgagtaagggc

SEQ ID NO: 61557 - DNA, 64 bp, Mus musculus
gggctgcagactgaccagagacagcttaatggttaagaacacttgctgctcttgcagaaggtcc

SEQ ID NO: 61558 - DNA, 116 bp, Mus musculus
tggatcttgagatgggaagacaggtgtcttttttaaatagataaattatttatttatttatttatttatttatttatttatctatttatttatttgtctatctatctatctatcta

SEQ ID NO: 61559 - DNA, 92 bp, Mus musculus
taccttccggactgaagagatggctcagcgattaagagcactgactgctcttccaaaaggtcctgagttcagttcccagcaaccacagggtg

SEQ ID NO: 61560 - DNA, 81 bp, Mus musculus
taggaggggctggttttgcactggaaaattatctttacaggggtcagaggtgaggttgtaggttgaaggtcaaacctctta

SEQ ID NO: 61561 - DNA, 100 bp, Mus musculus
tgccggctgagggaagaggcctatggggaggtggggagttcaggggtttgttgtctgccgaggagctccaaaaatctgtaagtcattatcagcaaagaca

SEQ ID NO: 61562 - DNA, 97 bp, Mus musculus
gctgaactacaggggcatgtggctttcttaatgctaagattgattcattatttttcttaggtactttggaaatcatatattgattttgagattgagc

SEQ ID NO: 61563 - DNA, 99 bp, Mus musculus
gactaagtcaagagaagggttatatgctgtctggtagtgttgtgaagtagcttgaggtttcctgcctggcatcctgcctatttaaagatgactacagtt

SEQ ID NO: 61564 - DNA, 85 bp, Mus musculus; identical to SEQ ID NO: 57470

SEQ ID NO: 61565 - DNA, 86 bp, Mus musculus
gagagacatctgatgtaggtgctggggtcttaagcctctgggagagtagtgagtgttcttacctgctcaggtgcatctctagcacc

SEQ ID NO: 61566 - DNA, 76 bp, Mus musculus
aggcaggatatacgtctcctagtcagtcaattcttaatttgaacccaggactgcctgcctgcctgtctgcctgcct

SEQ ID NO: 61567 - DNA, 88 bp, Mus musculus
aatgagtctcttgttttttttttccttgtggttcatacaatggtatgaaaagaaaattcataaggcaaactaagcaagtgtatttatt

SEQ ID NO: 61568 - DNA, 60 bp, Mus musculus
cctctctctctctctgccaatggctcaggcactgccggtagctggctagagagacccagg

SEQ ID NO: 61569 - DNA, 118 bp, Mus musculus
cagcagtttctcttaatgtcccaactgtttgctaagtccctaacacaagtgtgcctgcacacagtgcacagttcaggtgctttcttctctccccatgcttgttggtccagctgtcctg

SEQ ID NO: 61570 - DNA, 76 bp, Mus musculus
ttgtgtatgcagtggtgtttgggtatgaaggccagaggccaatgtatgccgtcagcactcactttctctctcacag

SEQ ID NO: 61571 - DNA, 86 bp, Mus musculus
aatgggttcccagtggctctctgtgactctgtcatcaaaggacatgttgtcctgcgttgtcacgagtgctgttactgcagcctatt

SEQ ID NO: 61572 - DNA, 83 bp, Mus musculus
gctctgattggaaaagaacagagtcagctctccagctcttaggccctcctggccagctcacctgctgtctctgcaaccagggc

SEQ ID NO: 61573 - DNA, 92 bp, Mus musculus
ggggtttggttttatgacggtagctgttggtatttgccttgatcacttggcttaggtagtactttctgtctttacccactgtaaacctcctc

SEQ ID NO: 61574 - DNA, 104 bp, Mus musculus
gactgtgagtttggggcctggagagatggctcaggggttaagcgcactgactgctcttccagaggtcctgagttcaattcccagcaaccacatggtggctcaca

SEQ ID NO: 61575 - DNA, 61 bp, Mus musculus
acacatatgtccacattttcatttatatacacagtgtgtgtgtgtgtgtgtgtgtgtgtgt

SEQ ID NO: 61576 - DNA, 80 bp, Mus musculus
gaatggtctgcccgtgcttccatctctgatgctctgggactgaaactcagagaactaagtgtgcagggcaacagttgttc

SEQ ID NO: 61577 - DNA, 83 bp, Mus musculus
agtgaggagcacgaggagaagcggagaccattggtggcttggtaatccacacttactgagtctctgtgttttgagcatcactc

SEQ ID NO: 61578 - DNA, 95 bp, Mus musculus
cctgatgcagtgtcttctccaccatggtagactctgtcactctggatgtaagccttaagtgtgttctgcctgggtatttttaacacagcatcaag

SEQ ID NO: 61579 - DNA, 110 bp, Mus musculus
tcttccgataatgttgtttgagtgtaccagcagaggcacacatccacacatggactctctgtctctttccacaggatggtttttgctgcctcaggaccctgtcaacaaga

SEQ ID NO: 61580 - DNA, 110 bp, Mus musculus
gtatgtataaatgtgtgtagtatatatgaatatatgcatgtatgtgtatatacatatatattatacatatgtatatatacctatatatgtatatatatgtgtgtgtgtac

SEQ ID NO: 61581 - DNA, 68 bp, Mus musculus
tatactacatgtatgtgtatatatatgtattatttgtactatatatgtacataatacctgtatgtata

SEQ ID NO: 61582 - DNA, 111 bp, Mus musculus
gttcctcttctgacatagtataagggaagctctagaggaaaacatacattgattttgttgttcttatagggtctgctacaaatctcagtgtacttatagtcagtaaaatac

SEQ ID NO: 61583 - DNA, 66 bp, Mus musculus
gctggggaagcacctgagctgtatgctactgccaccttgtggtcatatctctttctgtgactcagc

SEQ ID NO: 61584 - DNA, 91 bp, Mus musculus
cagcaaatgttgtaccattaaatgatagtgctaacttagcattaaattagcattaagtttagtgttttagatgtagtgtgatttcttgctg

SEQ ID NO: 61585 - DNA, 102 bp, Mus musculus
gagggatagtttagactttgttttgtgggtttgggttttgttgaaacaaggtctccctctgtgactcagtctggcctcaaatttgtggaatcttcctcccac

SEQ ID NO: 61586 - DNA, 85 bp, Mus musculus; identical to SEQ ID NO: 57470

SEQ ID NO: 61587 - DNA, 79 bp, Mus musculus
ctcactctttctctcaatctggatgcagtggccatatcctcactagcttatagactgagtagataggcagaagactgag

SEQ ID NO: 61588 - DNA, 107 bp, Mus musculus
gcctaaccccagtgttttgacaatgcagctgtactacacctgtttctggaagcaaaaaagtgtgacagaagagagtgagagatcctgttaacactaggtgacagtgt

SEQ ID NO: 61589 - DNA, 106 bp, Mus musculus
cagttgaagggtctcagggtgaattccccctcactcagtttctcacacggaagtgggactgttggtgtggatatttaaatgagctttgccacaccctgcttaactg

SEQ ID NO: 61590 - DNA, 109 bp, Mus musculus
ctaataaattttgttgttttctgtggtgtgtgcatgtgtgtgtgcgtgctcgcacacctgtgtgtgcacacatgtgctcgcatgtgcttaagcagtgatcagtaattgg

SEQ ID NO: 61591 - DNA, 89 bp, Mus musculus
gctttccagagtgaccaggctgctttgagttcctctcttctgattttgaaattcacatagaggagtggtaaatagatgtccttgagagt

SEQ ID NO: 61592 - DNA, 64 bp, Mus musculus
ggtgtaactgtctgcctctgtctcagtcagctgcttattgggcttctcagcagacagccatgct

SEQ ID NO: 61593 - DNA, 85 bp, Mus musculus; identical to SEQ ID NO: 57470

SEQ ID NO: 61594 - DNA, 100 bp, Mus musculus
gggactgcttagttttagctcgtgtgttgtgtaccttcgggggtctccctccaactgggctggcttctgagcagagagcagagttattcagaggggactc

SEQ ID NO: 61595 - DNA, 78 bp, Mus musculus
gctctgtgtgggtcagtctctgtcagtggcttctgcagtcagcactggaagccaggaagcagagagagttaggcaagc

SEQ ID NO: 61596 - DNA, 76 bp, Mus musculus
atcacttcagtatcactgagtcagcccagtccagtgtcaaagaggatcaagtctgacacagtctcagataagtggt

SEQ ID NO: 61597 - DNA, 99 bp, Mus musculus
caacagaacagaaaagactaaaagagacctgaaccacacccccatatatattgggctagtgtgtatgtcagtctctcactttttctctgtgatttgttg

SEQ ID NO: 61598 - DNA, 73 bp, Mus musculus
gggtggcttggtgtgcacactgaagtctgagtgcacatagacgctcacacagaggtatatacatcacaccccc

SEQ ID NO: 61599 - DNA, 89 bp, Mus musculus
ggaaccaatctgcagacagccactggtctatgaccaggctgcattttattgttgttgttgttgttgctgttgctgttgctgttggatct

SEQ ID NO: 61600 - DNA, 68 bp, Mus musculus
tgtgttagcagagtcaagagaaagctcctacattctgaaactggctttctttgcctctgtctgactca

SEQ ID NO: 61601 - DNA, 107 bp, Mus musculus
tctgtttgtgaggaaaagcatctcttcatctgttttactcagtttttgtagttctgtgacaaaataacctttcataaacaagggggtgggtttcctttcgttcatga

SEQ ID NO: 61602 - DNA, 122 bp, Mus musculus
tgtgtgtaggaaaagcactgcatgtatgtatgtatgtatgtatgtatatattagtgcacactttatatataatatatatatgatataacatatatgatatatcatgtatatggtatatatga

SEQ ID NO: 61603 - DNA, 92 bp, Mus musculus
agtttgtagaaggcccacagagaagacagagctcatacaaaacttgagcacactgttgtctgctctaaacagggttgtatgcaggcttctgt

SEQ ID NO: 61604 - DNA, 79 bp, Mus musculus
atggaacaggcatgatgctgaacaatctaatcccaacactcagtgggtagaggtaggaggatcataagtttaagtccat

SEQ ID NO: 61605 - DNA, 79 bp, Mus musculus
gatttgggtatggtagatgagagtgtgcagtgctggggatcaaactgaaattcagtctacctcttagaccctcacaatc

SEQ ID NO: 61606 - DNA, 100 bp, Mus musculus
cttgactgccctatactcttagatttatttctgtgacagaaccgtgagagcagccaacctcatctacacatctgaaagaagtcagagctgggtaggcagg

SEQ ID NO: 61607 - DNA, 75 bp, Mus musculus
agtgcctgtgtgtataaatgaagttttattggaacttggccatgaatgtttctttatatattatctatgggcact

SEQ ID NO: 61608 - DNA, 75 bp, Mus musculus
aaagagttggggtgagagggacagtactacataacagagaaagttggggaaaacactgcctctcacttactcttt

SEQ ID NO: 61609 - DNA, 79 bp, Mus musculus
tagaggccgggttgctcactaaatctggagtttgccagtttggctagactgtagtcagtgagctccagggatccctctg

SEQ ID NO: 61610 - DNA, 67 bp, Mus musculus
gggacagaagagtcattgcattccctggtgccatgtggatgcagggagtcgatcctgtgtgggtcct

SEQ ID NO: 61611 - DNA, 74 bp, Mus musculus
aactatggactggtcagtttacaatgtgaccaaatgagaccacattctcagagtcactgactcggtaagtagtt

SEQ ID NO: 61612 - DNA, 108 bp, Mus musculus
gtgtaaaattgttttattggatgataatgtatgatttctgtactgtgagtgtttatactgtagtcagcacagtggtcctactgtattatccttgatggcaggagtagc

SEQ ID NO: 61613 - DNA, 72 bp, Mus musculus
ctttcaggaactagaacaggactgggtaaaagctgaggtaagatgtctcagtcactctctggaccttgaagg

SEQ ID NO: 61614 - DNA, 71 bp, Mus musculus
tggagctgatgaccttgggggacttgagtgagtaacacagttaccttgtctctctgtgtctcagccatcta

SEQ ID NO: 61615 - DNA, 90 bp, Mus musculus
gaaaagcaggacaatggacgagagagtttatggctcagcagttaagagcactgactgctctttcagagattcctgagttcaattcccagc

SEQ ID NO: 61616 - DNA, 103 bp, Mus musculus
gattgaggggctcctgatctgagtcctaccacactcactacctgtgactcactggatagaagagccttgaagagaacgccccatggtcaggtgctgaaagatt

SEQ ID NO: 61617 - DNA, 69 bp, Mus musculus
ccagatattaatgattttgacacgtgtgggtgtgcatgtgcaggtacatgtgcatgtgcatgtgtttgg

SEQ ID NO: 61618 - DNA, 80 bp, Mus musculus
gtccctaagtaccatgcactgcttggatgtaggtgtctgtatctgtctgagtcatctgttgggtgaaccccttagaggac

SEQ ID NO: 61619 - DNA, 85 bp, Mus musculus; identical to SEQ ID NO: 57439

SEQ ID NO: 61620 - DNA, 85 bp, Mus musculus; identical to SEQ ID NO: 57470

SEQ ID NO: 61621 - DNA, 66 bp, Mus musculus
tatgtatgtgtgggtgtgtgtacacatcatttgcatggagtgtgcatgtgcacgtgcatgtgtgta

SEQ ID NO: 61622 - DNA, 83 bp, Mus musculus
ccacatttagttaatatatgctcactatgtttaagatacagaagtaattttccccatatatagttagtatacgttaactatgg

SEQ ID NO: 61623 - DNA, 85 bp, Mus musculus; identical to SEQ ID NO: 57439

SEQ ID NO: 61624 - DNA, 83 bp, Mus musculus
tatgggatctactggcagatatggagtggtgtttataatcacaacatgagaaactctcactttttctgtctcaaatttccata

SEQ ID NO: 61625 - DNA, 89 bp, Mus musculus
aagatacacataagctataaagttgtacatgttcacatgatatatgaatatgtatattagcatgtgagcatatttataacttttatctt

SEQ ID NO: 61626 - DNA, 91 bp, Mus musculus
gtggtttgctaaagctgtctttctctctgggtgatagatccgaacatactacatctatcctctgaacaagtgagattttctttaatgctgc

SEQ ID NO: 61627 - DNA, 63 bp, Mus musculus
gggggccgagctgggataggggctcctcagcaactgagggcctctctcttgctctcagtgtcc

SEQ ID NO: 61628 - DNA, 69 bp, Mus musculus
tgttctgtgtgcattctgtttctataggctacttagcaatggaatgtttagaaatatgcatgtggatca

SEQ ID NO: 61629 - DNA, 123 bp, Mus musculus
cctatgttgtatataaacttgttgcctgagtcttccgtcctgtctggtatcctccttgacagcagtgagtgagaaggcacagaatcaacagctcagactccagcagcaggtgaggttgcggta

SEQ ID NO: 61630 - DNA, 85 bp, Mus musculus; identical to SEQ ID NO: 57470

SEQ ID NO: 61631 - DNA, 110 bp, Mus musculus
tctgtgtgtgtctgtgtgtatgtgtgtgcgttgtctgtttgtgtgcattgtctatctgtgtgtgtctgtgtgtatatgtgtatatgtgtgtatgtgtgtccatgtgtaga

SEQ ID NO: 61632 - DNA, 75 bp, Mus musculus
ttttgtgtgattcttgtgtgtgtgggaagctctttgcctctcaaccttcctgtaacacacagactcacttcagga

SEQ ID NO: 61633 - DNA, 77 bp, Mus musculus
ggatctttaagtcagacaatgcactagtgtggagttaatttagtttcactgtctgtgtgtgactcttctgaggattc

SEQ ID NO: 61634 - DNA, 82 bp, Mus musculus
actctggatagctccttaaagttcaccactaggttcttaaatacctttgagaaattgagagtggctgtactgtatcctgagt

SEQ ID NO: 61635 - DNA, 109 bp, Mus musculus
ggctgcttttatattgggtagctctatgaaactagttttatgttaactgctgtagattcatatcacagccatataaaatagtgtggtggttcctggaggggaggctgcc

SEQ ID NO: 61636 - DNA, 95 bp, Mus musculus
ctgctggcttatgttctgctgagatagcattccagatgagatggcttcccagactgctttctctgtgtctgtgtgttctgctctgctctagacag

SEQ ID NO: 61637 - DNA, 100 bp, Mus musculus
gtttactccaggggctggagagatggctcagcggttaagagcactgactgctcttccagaggtcctgaattcaaatcccagcaaccacatggtggttcac

SEQ ID NO: 61638 - DNA, 110 bp, Mus musculus
gaggtgtccaacattgtgaagcctttgcatataacagtagtctccagattcataaaataacacttgctggagagaatacatatgagagtaaccaatgtggtagagacttt

SEQ ID NO: 61639 - DNA, 119 bp, Mus musculus
catgggataatttcaatatttttgtatctcttgagatcttttttgtgaccaattatgttttttttttttttttttggagaaggtaccatgaggtgctgagaagaaggtatatccttttg

SEQ ID NO: 61640 - DNA, 85 bp, Mus musculus
gtccatggtggtctgatagggtgcatgggaaaatttcaatatttttgtatctcttgaggcctgttttgtgaccaattatatggtc

SEQ ID NO: 61641 - DNA, 85 bp, Mus musculus
tagtctgaggtcatgtctgtcattgtcactgagttgtgtttcctgtttgcaggaaatactgtgccctgtttacatatctagtctg

SEQ ID NO: 61642 - DNA, 80 bp, Mus musculus
agaaatgatgctagggctggagagatggctcagtggttaagagtgctgactgctcttccagaggtcctgagttcaattct

SEQ ID NO: 61643 - DNA, 85 bp, Mus musculus; identical to SEQ ID NO: 57470

SEQ ID NO: 61644 - DNA, 59 bp, Mus musculus
gagctcatacacacatagtgtagatacattctgtctctctgtgtgtgtctctgtgcctc

SEQ ID NO: 61645 - DNA, 74 bp, Mus musculus
ttagagatgctggcatcatggtctcctctgaactttatcccaggggaagaattaaatagaagttagtactttga

SEQ ID NO: 61646 - DNA, 128 bp, Mus musculus
ctccacaaggattgaggtaaactggcttagggtgagaggtctctagttctgtgtctgagtggctgcctctcattcccttactcactaggccctagagaatcctttgagctccttaaggtccagcatgc

SEQ ID NO: 61647 - DNA, 72 bp, Mus musculus
gaaggcaagtcactgacctcactatgtggggaaagcgtctccacaacaagggaaggcagttcttctggggcc

SEQ ID NO: 61648 - DNA, 97 bp, Mus musculus
gtgtgtgctggtgctttgttgctctcatttttctcaataaaggaacaactttatacatatttttatgtaggtaattggctgtatcctgtaggaacac

SEQ ID NO: 61649 - DNA, 77 bp, Mus musculus
agcagtgagatcaaactgtccttgtcaccccaagagctcatgtatttgtgtagggtgtctcagtttctctctcagct

SEQ ID NO: 61650 - DNA, 85 bp, Mus musculus
caaaacaaaactgaggggctagagagttgactcagcagttttaagggctctgactgctcttccagaggtcctgagttcaattttg

SEQ ID NO: 61651 - DNA, 64 bp, Mus musculus
tgtgtatatagcagtatatatgtttatctacacacagaaacatatatatatatatatatacaca

SEQ ID NO: 61652 - DNA, 73 bp, Mus musculus
ggcatggtagtgcacacatttaatcccagcactcaggatgcagaggcaggcagatctttgtgagctcaatgcc

SEQ ID NO: 61653 - DNA, 63 bp, Mus musculus
caaagtaagactggcaggcgcaggcctcgatcttttccctctgagtctgtctgtcaccatttg

SEQ ID NO: 61654 - DNA, 106 bp, Mus musculus
gccttagtgcatggtgatctgataggatacatgggacaatttcaatatttttgtatctgttgaggcctgttttgtgacctattatgtgatcaattttggagaaggt

SEQ ID NO: 61655 - DNA, 82 bp, Mus musculus
gtctgtctgtctgtctgtctttgtgtcagtgtgtgcttatgggtgcacatgtgacaagacatgattatggaggtcagaggac

SEQ ID NO: 61656 - DNA, 85 bp, Mus musculus; identical to SEQ ID NO: 57439

SEQ ID NO: 61657 - DNA, 74 bp, Mus musculus
gccttgagggacagtgtgtggctctctgggtctcagatctgacttataatgaaagcggactgtgtcctctaggc

SEQ ID NO: 61658 - DNA, 85 bp, Mus musculus; identical to SEQ ID NO: 57482

SEQ ID NO: 61659 - DNA, 85 bp, Mus musculus; identical to SEQ ID NO: 57470

SEQ ID NO: 61660 - DNA, 81 bp, Mus musculus
ggagcacacagagagcagtgagcctcagatgaaaggtgcagcagagtgccttcagaggagtcatcactgacaatctcctcc

SEQ ID NO: 61661 - DNA, 108 bp, Mus musculus
taagttttatatttcctttgtcagccactaaaatatttctgcatttgaattctctgtgggaaatatattttggtgacaatactgctggacacaaacttaatgtgctta

SEQ ID NO: 61662 - DNA, 72 bp, Mus musculus
cccatggaggacagaggtgatgtatacatgaagctgaaattagagctgctgtgagtcacactgtgtgccggg

SEQ ID NO: 61663 - DNA, 65 bp, Mus musculus
gatgaaagctgtgccagggggtcttcagaggattcatcactggaaatcttctccagccagtcatc

SEQ ID NO: 61664 - DNA, 85 bp, Mus musculus; identical to SEQ ID NO: 57439

SEQ ID NO: 61665 - DNA, 65 bp, Mus musculus; identical to SEQ ID NO: 61663

SEQ ID NO: 61666 - DNA, 61 bp, Mus musculus
ggacagaggtgatgtatacatggagctgaaattagagctgctgtgagtcacactgtgtgcc

SEQ ID NO: 61667 - DNA, 85 bp, Mus musculus; identical to SEQ ID NO: 58710

SEQ ID NO: 61668 - DNA, 72 bp, Mus musculus
gccctattttcatgaagggactcttgagttttatgtctctcacagactccctgtgttcactgagaagatggc

SEQ ID NO: 61669 - DNA, 104 bp, Mus musculus
gactggcataaaggccattgcatagttctctgtgactaccatagtcagtaaagtgatgatctctgggaggcaagcatagtgcatctaagtagctggtgttggtt

SEQ ID NO: 61670 - DNA, 107 bp, Mus musculus
cttatatttttcagtacaaattagaagtgactttttaaattttcagattttgttcatgtgttcatgtcagataagaggggctacaagtgggtacatgagtgagtgag

SEQ ID NO: 61671 - DNA, 175 bp, Mus musculus
ggatatatatatatatatatatatatatatatatatatatatatatatgtatatatatatatgtatgtatatgcacgtgtgtatgtatatgtgtatatatatgtgtgtatatatatatatacacatacacatatatgtatatgcacgtgtgtatgtatatgtgtatatacataca

SEQ ID NO: 61672 - DNA, 112 bp, Mus musculus
ggtgtggggaagggcagaggaagagaggagagagggagagctgtgtgagtcacacatacactcaagagaatcagtcatcccttgccttgccctttaaggcccttgtaatatc

SEQ ID NO: 61673 - DNA, 77 bp, Mus musculus
gtatgtgtatatatgggaagtctgtgtacggatatgtttgtatgtctgtatatatatatgtgtgtgtgtatatgtac

SEQ ID NO: 61674 - DNA, 86 bp, Mus musculus
ctcagatagccccaaatgtgtctgctctgagtgtggctttaattcaagccaatgccactgactgtcaggctgtcagagagggtgtc

SEQ ID NO: 61675 - DNA, 94 bp, Mus musculus
gcagcctgaacattgcatgtacacatgaagtagcttgtttactcttaacaagctaacccattgtatacctgctgtgatcattaaccttgactgt

SEQ ID NO: 61676 - DNA, 85 bp, Mus musculus; identical to SEQ ID NO: 57470

SEQ ID NO: 61677 - DNA, 72 bp, Mus musculus
ctctgtctgacagtgtctccctggccaaagtaagtcacttggccacagccattctggagaattggggaagag

SEQ ID NO: 61678 - DNA, 66 bp, Mus musculus
gggctggagggaactagcttgtttagttttcccagaaagacaagcaggtctggtccagcccagccc

SEQ ID NO: 61679 - DNA, 79 bp, Mus musculus
aggctaggcttcatgggaatctgcctttttaatctccgttgggacctaaggaaggaagtcactcccagagtctcagttt

SEQ ID NO: 61680 - DNA, 59 bp, Mus musculus
ctcgtcacctagtaactggtgggctcctgtccctctgtctctgggtgttctatcttgag

SEQ ID NO: 61681 - DNA, 102 bp, Mus musculus
aggccctagtgcagcttcaaggagtcagtacggagtgtgtacactatataacaaacaactgcacacatggctatgaactgtctgcccatgctcctgggtcct

SEQ ID NO: 61682 - DNA, 63 bp, Mus musculus
ctcttatctcaaggttggttctcatagagcccaggctggctcagaactgactgtgcacctgag

SEQ ID NO: 61683 - DNA, 81 bp, Mus musculus
gcatgtatgtatgtatgcatgtatgtatgtatgtatgcatgtatgtatgcatgcatgcatgcatgtatgtatatatgtatg

SEQ ID NO: 61684 - DNA, 117 bp, Mus musculus
gagtgttttctctgaggaccatctggcatctggaatgtggctctggagcctcactgtcggactgagtcccagggcccacagcgtctttgatgtgactttagattgggtcctgacctc

SEQ ID NO: 61685 - DNA, 93 bp, Mus musculus
ggaggaagcatgtcactgggggtgggtattgaggtttcaaaaacccatgccaagcccaatctctctgcctgcctgcctgcctgcctgcctgcc

SEQ ID NO: 61686 - DNA, 82 bp, Mus musculus
gcatatatatacatatatatatacacatacatacacacatatatgtatatatatatgcatatgtatgtatgtatgtatgtat

SEQ ID NO: 61687 - DNA, 121 bp, Mus musculus
ggcctgtggtgctgaggtagagagatctcccgtttggacacagcactcggtgttttctgtcactgcaaatccttctgcagtgtccatgcacagggagatcctagcatctctcatgttgtac

SEQ ID NO: 61688 - DNA, 77 bp, Mus musculus
gggagtaaaaaggacctactctgtatgtactgggtagttctgtgctatttcgtccgtctgtccgtctgtctggtccc

SEQ ID NO: 61689 - DNA, 85 bp, Mus musculus; identical to SEQ ID NO: 57470

SEQ ID NO: 61690 - DNA, 106 bp, Mus musculus
tagtgtgtatgagtgtctggcctgctctttcttgcttttcaaaaatttaggtttatttcttttattttgtgtgcaggagtgctttgcctgcgtgtgtgtgtcactg

SEQ ID NO: 61691 - DNA, 93 bp, Mus musculus
gttggttccgggttttggcaaactcaatatctgccttggtagccctgtgagaacagagatgagagacggcagaggtgaagtcacggatttaat

SEQ ID NO: 61692 - DNA, 111 bp, Mus musculus
accttactgcaagtcctccagattacctctcctatctacccaatgtcaagctctctctctctcttgataaaaaagaggggcgcgggggaactggagagattgctcagtggt

SEQ ID NO: 61693 - DNA, 82 bp, Mus musculus
ctgatggttgtgagtcactgtgtgggtgtgaggagctgaacttgggtcctctgcaagagcaacaagtgctctaaccactgag

SEQ ID NO: 61694 - DNA, 85 bp, Mus musculus; identical to SEQ ID NO: 57470

SEQ ID NO: 61695 - DNA, 88 bp, Mus musculus
ctctggtttctagtgtcgtcgtttgttaagaagtaagaataaagccctatgtgacagctggctgcagtactcaggactgaacccagag

SEQ ID NO: 61696 - DNA, 84 bp, Mus musculus
ttgaatagaaagaccaactaagggatggagagaaggctcagcagttaagagcactgactgctcttccagaggtcctgagttcaa

SEQ ID NO: 61697 - DNA, 122 bp, Mus musculus
aagggatctcatagctggggaatatagtagtgttgtgataatagtagtgttgtgatatagtagatctacccaatctacctgtgcagcatgtatgaacattaatagagttatgttttctttgc

SEQ ID NO: 61698 - DNA, 111 bp, Mus musculus
catagaacacttggcacagagcaaaagggcctgggactttggtaatgtgatgaccactgtagatagagagctcaggcatttcgcctgttctaccagaagtgccttctgctg

SEQ ID NO: 61699 - DNA, 63 bp, Mus musculus
agggggggggggcggagagatggctcagtggttaagggcactgactgctcttccagaggtcct

SEQ ID NO: 61700 - DNA, 88 bp, Mus musculus
ttatttttgctatctcagccagctttgttttcagtagagaaactgaaggctcatgatgcaagtggggaatgtggtagcgtataaataa

SEQ ID NO: 61701 - DNA, 86 bp, Mus musculus
cttctgcacgctctgcaggctcttgatgaagatattgtccatgtcactgaagagtgtctccacggccttaggaccatgcttggaag

SEQ ID NO: 61702 - DNA, 64 bp, Mus musculus
gggcatccataccacggaatagtgtctgtgtctgtgacagaacagagacaactgttggaaaccc

SEQ ID NO: 61703 - DNA, 76 bp, Mus musculus
atatatatatatatatatacatatacatacatacacacacatatgtatgtatgtatgtatgtatgtatatgtatat

SEQ ID NO: 61704 - DNA, 90 bp, Mus musculus
ttgaattcacaaagattgcctggctcagggctggagagatggctcagaggttaagagcactgtctgctcttccagaggtcctaagttcaa

SEQ ID NO: 61705 - DNA, 82 bp, Mus musculus
ccaaagcatgatccagtctcggactctccgtttcacagttgaagaggagacagtggtgaagtggaaatgtctagttctttgg

SEQ ID NO: 61706 - DNA, 116 bp, Mus musculus
tgaaacattttcattgttttcctttagtgtgtacatgtgtagtgtatgtacatgtgtagtgtatgtgcaagtacatgtgtctgtgtttcacttgtggaaactacagaaaattgtca

SEQ ID NO: 61707 - DNA, 57 bp, Mus musculus
cagtgttgtggctcagcttctgtcctctggactcagcacagagggtccacactgctg

SEQ ID NO: 61708 - DNA, 84 bp, Mus musculus
gctctaggaaagagtctctgacactcaggatcatcaacagatgtatagtaaatttgaggccagttggtcctttgctagaagagc

SEQ ID NO: 61709 - DNA, 90 bp, Mus musculus
gggttttgtagggtagagcacagaatagaggagaccacaggagagctgaggccctgggctctctctctctctgctggagcttgctgtctc

SEQ ID NO: 61710 - DNA, 72 bp, Mus musculus
tcacatctggaggtgctgacctgggacacaacagaagctcagtccctgtctcagagtcatctgtgggtgtga

SEQ ID NO: 61711 - DNA, 84 bp, Mus musculus
aggggagagggaggaggaggagaggagggagaggggtagacgacagcccacccattcactcgctcgctcactcactcactcact

SEQ ID NO: 61712 - DNA, 131 bp, Mus musculus
gtctggttctgacactccatgtatctgctttggtcttctgagccaatgagtcaagctctctctggctctcagtatcttcagccgcagaaggggagcacaccagcacatcagagatttagggattaatggag

SEQ ID NO: 61713 - DNA, 80 bp, Mus musculus
agacatgactgtattgttaaggctagagtgtttgggaactaactctctgcatgtctgcctgcctgcctgcctgtctgtct

SEQ ID NO: 61714 - DNA, 70 bp, Mus musculus
ccgagtggcagttaggacagcaggctctaactattgcagggtcatatcatagcctgcttctgtgcctcgg

SEQ ID NO: 61715 - DNA, 126 bp, Mus musculus
gcattaaaaaaatccattatatgggctggagagatggctcagcggttaagagcactgactgctcttccagaggtcctgagttcaattcccagcaactacatggtgggatctgatgccctcttctgg

SEQ ID NO: 61716 - DNA, 73 bp, Mus musculus
ggaaaacaggagagcctgtctcaaagcacagtgggagccaaggactgacacttgagactgtcctctgccttct

SEQ ID NO: 61717 - DNA, 79 bp, Mus musculus
gttttggggccagtgagtcaacacagtgggcaaaagcacttgccatcaaacctgatgacctgagttccatccccaggac

SEQ ID NO: 61718 - DNA, 81 bp, Mus musculus
gggatttttcttgtggttgtaccttgcttagctcagagagccctgaaaaggtggggtatgtgttgaactcaagggtattgc

SEQ ID NO: 61719 - DNA, 118 bp, Mus musculus
ctcagtgtgacatggagagtacctcattctctcttaaatgtacttatggcagaatgtccatgtgcatgtcggaggataacatgatggagtcgggtgtctccttccacctttacttggg

SEQ ID NO: 61720 - DNA, 69 bp, Mus musculus
cacagtgactcactttgtcagtctgagctgccgcaaggatgctcagttgatacaagcaggggcagtgtg

SEQ ID NO: 61721 - DNA, 80 bp, Mus musculus
caattatccctctaccactgtctttttctctgttccttctttggaagcaggaaccttgacaaaggacagaagagtgattg

SEQ ID NO: 61722 - DNA, 115 bp, Mus musculus
ggcagctttgtcaagtgaggtggtaggtgtgtgtgttagggccttgcgcctgtcagggtctctcaatccctgctggccattgttctcatccttcctccaactgagtaggtgtgtc

SEQ ID NO: 61723 - DNA, 80 bp, Mus musculus
aaggacagtattacagattttgttgtacactgctgttacatgtggggcagtgtgtctttaagtagggtaaagtactcttt

SEQ ID NO: 61724 - DNA, 77 bp, Mus musculus
ggagaaaatggattgctgagagtggacagtgaggttttataacctgtatcctctttctactcacactctgactctct

SEQ ID NO: 61725 - DNA, 56 bp, Mus musculus
tgtagatatacatatttgtgtatacatatttgtatatatgtgtatgtatatgtata

SEQ ID NO: 61726 - DNA, 125 bp, Mus musculus
cagaactatgtggggtgggggagtggctgttagcccagcggctgttcccacctaagccctctggctcactgtctctccttgggtcatttattgtcttggccctgggcaggagtgtgggcataggc

SEQ ID NO: 61727 - DNA, 107 bp, Mus musculus
ttgtggaattgttgagacaggtggttgagtctggtcaaagtgtgtgaatgtctgtgtgtttatgtgtgtgcttgaattctccctttcttcctcttctctgttcacag

SEQ ID NO: 61728 - DNA, 106 bp, Mus musculus
ctgatttgtttgaccacagtcacatgtgggatctctgaccagtggccctaggaggggtcactgtcacactcattctacgtggtggcatgaatactgtccatctcag

SEQ ID NO: 61729 - DNA, 72 bp, Mus musculus
gtcacatgtgggatctctgaccagtatgtggccctaggaggagtcactgtcacactcattctgcgtggtggc

SEQ ID NO: 61730 - DNA, 116 bp, Mus musculus
atggaaagaacaaatgtgtaggggctggagagatggctcagtggttaagagcactggctgctcttccagaggtcctgagttcaattcccagcaaccacacggtggctcacaaccat

SEQ ID NO: 61731 - DNA, 84 bp, Mus musculus
gcctctctgcctgtctctgtgcgtgcgtgtctgtgttcgtatgtcccacatgtgtgaggctgcccacagagaccagaaaagggc

SEQ ID NO: 61732 - DNA, 86 bp, Mus musculus
gtatgtactactgtgcctggtgtatgtaatatatctatagctgtatctgtgtatatatatatgtaaccagttacacacacacacac

SEQ ID NO: 61733 - DNA, 119 bp, Mus musculus
gaccgaggtcgggggatctagtgtgggccacatcctgtcactgaatttgcaggcaccagccttgaatgggcctcattttcccatctgtacagcgagaggctcacgtgctctctgtggtc

SEQ ID NO: 61734 - DNA, 74 bp, Mus musculus
ttcagccttcaagaggtaaagggaggtgggtcatgagttcgagatcatcttctgctacactcagtgagtctgag

SEQ ID NO: 61735 - DNA, 116 bp, Mus musculus
gtctaccacacccagttctctggctcccatttcatagataaagtaggctgaagcccagagaagtcacagaggccacccaacgatcagctatgaggctgggtttgctgggaccgagc

SEQ ID NO: 61736 - DNA, 82 bp, Mus musculus
cgtatgtgtctgtctgtgtgtgtgcacccgtgcgctcgtgtgcacatggtgcatgcttgccacggtttgtgagtcatgtatg

SEQ ID NO: 61737 - DNA, 115 bp, Mus musculus
caggaccaggctgcaggcttctgcatctccctcagtctcactcagtctgtgaaaaatggcccatgcctcactggggcttgctggggctggctgttggtaggagcccagagttctg

SEQ ID NO: 61738 - DNA, 83 bp, Mus musculus
actgcctggcttatccctagagacagggaccacctcctcaatatccctgtgtctttgtgtctctgattctaagtctagttagt

SEQ ID NO: 61739 - DNA, 84 bp, Mus musculus
cacatttggaaacatgggtgcccgctgaccttgaactcctgggagaactgattcctggccagcctcacagtgtctctgtttgtg

SEQ ID NO: 61740 - DNA, 105 bp, Mus musculus
cagttggcattgtaatagttttacagtgtgcaattatgtgggattaagtatagtcaaattgttctacagctgacattgccaaattatcataccttttcccaactg

SEQ ID NO: 61741 - DNA, 59 bp, Mus musculus
tgggctggagagatgactcagtggttaaaagagcactgactgctcttccagaggtccta

SEQ ID NO: 61742 - DNA, 87 bp, Mus musculus
ggaactctcctgtgtgtgtgtctgtcgctcatccacgctttgcccacctgcttcgagagaccacattccacgcagacacagggaccc

SEQ ID NO: 61743 - DNA, 111 bp, Mus musculus
gcatttcccactgtggggtggagggctgtgtgttttacacggtgtcgtttacgacagcttcctgactgactctgtgactgcccagtctgtccattttaaacagaaagatgc

SEQ ID NO: 61744 - DNA, 79 bp, Mus musculus
ggtgggaagagatagttggctctggagcaggtgtctgctcagccagtctcagctggctgagtctctgcgtctgtgaggc

SEQ ID NO: 61745 - DNA, 106 bp, Mus musculus
ggggatgctcctgtctctggctcctccgctctgcgattaagaagtgtgctgctgtgtccacttttctgtgtgtgtgagtgtgctgcagattcaaacttgggtcctc

SEQ ID NO: 61746 - DNA, 108 bp, Mus musculus
gtgacatgtggaaatgccataatgaaagatgggtgtgacggtgcagccttcaatcctggcccttgggggagaggcagcaccaggcatacctgtggtacacatgctcac

SEQ ID NO: 61747 - DNA, 70 bp, Mus musculus
gaattccggggactggagagatggctcagcggttaagagcactgactgctcttctgaaggtcctgagttc

SEQ ID NO: 61748 - DNA, 133 bp, Mus musculus
tatgtatgtatgtatgcatgcatgcatgcatgtgtgtatgtatgtgtatgtatgtatgtatgcatgcatgtatgtatgtatgcatgcatgtatgtatgtatgcatgtatgcatgcatgtgtgcatgtgtgtat

SEQ ID NO: 61749 - DNA, 76 bp, Mus musculus
ggcagggagaaaggaaagacagtgactgacaggcaagtactataaagccagtgtctgtgtctcactttctctctct

SEQ ID NO: 61750 - DNA, 73 bp, Mus musculus
tctgctcccctggctcgagagatggctcagcggtttagagtgctgactgctcttccagaggttctgagttcga

SEQ ID NO: 61751 - DNA, 80 bp, Mus musculus
atgtgtgcatatatgtatgtgtgtatatatgtatgtgtgtatatatgtatgtatgtatgtatgtatatatgtatgtaggt

SEQ ID NO: 61752 - DNA, 82 bp, Mus musculus
tacacatatacatataaaaatatgtgtgtgtatatatatgtgtgtctatgtgtatgtatgtatttatgtatgtatgtgtgta

SEQ ID NO: 61753 - DNA, 77 bp, Mus musculus
cagtaaactacgtctctctgagtctcagtttcctcttccgtgaagtggggcttaagaccctcaatatttgtaggctg

SEQ ID NO: 61754 - DNA, 82 bp, Mus musculus
cgtgctgagatatggaatggataaggaaggatgagctgcatggagttcccagtggcttagctctctctgtcacactggtagg

SEQ ID NO: 61755 - DNA, 97 bp, Mus musculus
ttcaaataaaacagggatgcacagctgctgtggagtaggagcataaaactatacatagtcactcactccatcactgacaaccatagtactgtttgaa

SEQ ID NO: 61756 - DNA, 103 bp, Mus musculus
cctgttccggctctctacatgcttggcagtggacgacaggggtgggcactgtgagtcactgtgtatttctggtggtccttgttgtggttagccttgctccagg

SEQ ID NO: 61757 - DNA, 91 bp, Mus musculus
agacctgagttctgatccctatcacccatgtaaagctagggtgtgggatagatgtgtctataacactctctcttagtgctggggaagtgga

SEQ ID NO: 61758 - DNA, 131 bp, Mus musculus
gtgtgtgtatatatatatgtgtgtgtgtgtgtgtacacatatgtatatataccatgtatatgtatatatatgtatacacacgtatacacatatatgtatgtacacacgtatacacacgtacacacacatgc

SEQ ID NO: 61759 - DNA, 113 bp, Mus musculus
atgtgtgtgtacgtgtgtatacgtgtgtacatacatatatgtgtatacgtgtgtatacatatatatacatatacatggtatatatacatatgtgtacacacacacacacacat

SEQ ID NO: 61760 - DNA, 92 bp, Mus musculus
tgttgaaaagtaaaggccagggactggagagatagttcagtggttaagagcactgactgctcttccagaggtcctgagttcaattcccagca

SEQ ID NO: 61761 - DNA, 72 bp, Mus musculus
gtctgtcttggcttgggataacacatactctctcacacacatctataatttaaaatccaagttgagtcaggc

SEQ ID NO: 61762 - DNA, 114 bp, Mus musculus
tattactagtatagtgtttttgttcatgaatatgcatggacacccaaacactggtgtgtgtgtgtgtgtgtgtgtatgtatgtgtgtgtgtgagatgcagatgtgctgtcagtg

SEQ ID NO: 61763 - DNA, 91 bp, Mus musculus
gctatttctaaaaggtcaatagtgggggcatctgaagaccctgagcacagaccctctaaggccccatcagttaccttgagaatgctttggc

SEQ ID NO: 61764 - DNA, 86 bp, Mus musculus
agtcagcttctcgggtgttccaggcctgcctgctgctctgtcagtctcacagcctgtgttctcccagtcatttcctttagctatct

SEQ ID NO: 61765 - DNA, 88 bp, Mus musculus
aggttagccattcctctctctgcctgtcctgacacactcgctcagtgaggtattctggcttcaaggacagagcaagtatttctcacct

SEQ ID NO: 61766 - DNA, 75 bp, Mus musculus
ctagatatgtatatgtgcatctacatatatacttgtatatacatatatgtgttgtatatgaatatacatacatgg

SEQ ID NO: 61767 - DNA, 101 bp, Mus musculus
tgcacgtggctaactagaatataataagcttttgaaaaggacggtgtcaatgtccctctgtctctcactgagctatgcatgtctaccacaggccccctgca

SEQ ID NO: 61768 - DNA, 84 bp, Mus musculus
gctccaggtgtgtgtctgtgtgtgcctgagtgtgtatgaatgtgcaccatacatatgcaggagcccacagagatcagaaggagt

SEQ ID NO: 61769 - DNA, 68 bp, Mus musculus
tgtgtgtaaatgtgtgtgtatgtatatatatatatatatatatatatatatatatatatatatacata

SEQ ID NO: 61770 - DNA, 63 bp, Mus musculus
cagctgactgtggctgtgactcagggacaatctcctgtcatctagagccagctcacggtgctg

SEQ ID NO: 61771 - DNA, 110 bp, Mus musculus
tgtttgtttgtttgtttgtttttaaatttgcaaaataataagaatgactttcttgtggtttggattctaaggaagttagtgggggttggaataaaataggtagatttata

SEQ ID NO: 61772 - DNA, 83 bp, Mus musculus
ccagcatgtatgtctgtgagactgtgtctataacccctggaactggagttagagacagttgtcagctgccacgtgggtgctgg

SEQ ID NO: 61773 - DNA, 70 bp, Mus musculus
gaactgagggctggggagagatggctcagcggttaagagcactgactgctcttccagaggtcctgtgttc

SEQ ID NO: 61774 - DNA, 80 bp, Mus musculus
agtggggatgtgagcttcgcaggtgtttgttttgggaatggcttcttagggccctgtcggactgactcacacatcatact

SEQ ID NO: 61775 - DNA, 117 bp, Mus musculus
ccatcccctaggcagggcatcctggactgtgtaagtgtgtaagtatatttgtatatgtgtataaaggactgtgctggtatagagaagatgctgagctcaagtaggcatggatgggtg

SEQ ID NO: 61776 - DNA, 85 bp, Mus musculus; identical to SEQ ID NO: 57439

SEQ ID NO: 61777 - DNA, 104 bp, Mus musculus
ggtttaagatttgctttcaaccaagtacttagttagtagcagaatagcagatatttctttgtatttttcagaacctaagatggtttaggagtagatcctgtact

SEQ ID NO: 61778 - DNA, 62 bp, Mus musculus
ccctggttcacatatgtatgtatgtatgtatgtatgcatgcatgcatttctgtgattaaggg

SEQ ID NO: 61779 - DNA, 108 bp, Mus musculus
cttgaaaaagcaattgactatagacatgtttgctttaaggttgaatactgttgggtccagcagtttcacattacaataatcaaactgtggataagttgctgtttctgg

SEQ ID NO: 61780 - DNA, 78 bp, Mus musculus
aggctagcctcagctacataatgagactcttttaacaaaagaagagtaagacagttcagtgggtagaggagtttgtct

SEQ ID NO: 61781 - DNA, 117 bp, Mus musculus
gcagccttttgagaactggaattgcagctgtggtctagaatgccttgctcacttgtttatttatttaaagagcaaagagggtattgtacatcctggagttgggatacaggtgggtgt

SEQ ID NO: 61782 - DNA, 97 bp, Mus musculus
gccaccatgtggttgctggaaattgaactcagaacctctgaaagagcagacagtgctcttaaccgctgagccatctctccagcccatatatgtgtgt

SEQ ID NO: 61783 - DNA, 71 bp, Mus musculus
ggccactggctgggaaccaggaagcttttgctgaactgttacagggtctcagtgtctcagtcatgtgagct

SEQ ID NO: 61784 - DNA, 113 bp, Mus musculus
ggcaatggtgggtttggttttgtagctggttgggggctataaagggaggcagtctcgcagtatctctctgtctccccccccccccaactacgaaagcacaggagcagccagag

SEQ ID NO: 61785 - DNA, 68 bp, Mus musculus
gtgccgggggctggagagatggctcagcggttaagagcactgactgctcttctgaaggtcctgagttc

SEQ ID NO: 61786 - DNA, 71 bp, Mus musculus
tgatggctcacaactgtctgtggctcagttccaggggatctgacaccctcacacagacagacacaccctca

SEQ ID NO: 61787 - DNA, 98 bp, Mus musculus
attatacagatgagactggctgtggtaagttaattagttactttttaaaattaagttattggggggcttactatatttagcctccctttctggttagt

SEQ ID NO: 61788 - DNA, 91 bp, Mus musculus
tgtgcatgtatatgtgtgtgtacatatatatatatatatattatatatatatatattgtctatgtgtatatatatatattgtctatgtgca

SEQ ID NO: 61789 - DNA, 116 bp, Mus musculus
ttggatgactctggaggccacaggctgtctggctggctgactgtctgtctgtctgtgaaagttcaggaaagcggctctgacacagcctgcctgcccaaccccttcgcttccttcag

SEQ ID NO: 61790 - DNA, 97 bp, Mus musculus
aaggcagtatgtctgaggcctgaaatgtttgcagcagaaatgacagaactttgggtccctctgtgtgtgcgtgtctgtctatctgtcgtgctctctt

SEQ ID NO: 61791 - DNA, 126 bp, Mus musculus
acacacacacacatatgtatacatatatgtatatatgtgtatatgtatacatatgtatatgtgtgtatatacatatgtatatatgtgtgtatatatacatatatacatatatattatatatatata

SEQ ID NO: 61792 - DNA, 86 bp, Mus musculus
ggggatcaggtttgctcaaaacagggaaagtttcttccccccccccccggggcatcccagctgcctgcctgactgcctgcctcccc

SEQ ID NO: 61793 - DNA, 85 bp, Mus musculus
ggccatggtgctctgataggatacatgggacaatttcaatatttttgtatctgttgaggtctgttttgtgaccaattatatggtc

SEQ ID NO: 61794 - DNA, 87 bp, Mus musculus
atcactgactggctagactagctccccggtgaactccagtgcctatacacagaccacaccccctctgtctatgtctctgtctctgat

SEQ ID NO: 61795 - DNA, 119 bp, Mus musculus
acatgctgcgtgcagagggctccacaaatatggctccttgccgtcaccgtcattgcaggcagagactagtgactcaggagagaccatcagcttcccttcttccctgtagctgtggctgt

SEQ ID NO: 61796 - DNA, 87 bp, Mus musculus
atgtgtatgtgtgtctgtctgtctgtgtacatgtatgcaaatgctattcagctatatatgtgtggaggccagcagtcaagctcatgt

SEQ ID NO: 61797 - DNA, 71 bp, Mus musculus
acacaaacagactcagtgactcatcagggcacccatgcgtgcctctgtgtgtgtgtgtgtgtgtgtgtgtg

SEQ ID NO: 61798 - DNA, 80 bp, Mus musculus
gtgtggctgtggctgtctctgtgtctgtctgaattatacttcttctggacacccgtgcctggagtgggccctcgcctctc

SEQ ID NO: 61799 - DNA, 76 bp, Mus musculus
tgcctggctgtgggtctctgtgtctgttcccatgtgctgcaggaggaagcttcccggatgctggctgaccaaggca

SEQ ID NO: 61800 - DNA, 86 bp, Mus musculus
atatatatatacgtgtgtgtgtgtatatatgtatatgtgtatgtgtgtgtataaatgtatatgtgtatatgtatgtgtgtgtgtat

SEQ ID NO: 61801 - DNA, 79 bp, Mus musculus
gtgatcctcctgtctctctgtctgagtgctagagttagcgcaccatcactgctagccttctgtcaagacagcgtctcac

SEQ ID NO: 61802 - DNA, 93 bp, Mus musculus
taaccacagggcaagcctgcagttccgtgtgtcttaaatcccctggggtcggagtctacagagacagctcagtggttaagagcatttgcagct

SEQ ID NO: 61803 - DNA, 71 bp, Mus musculus
gagtgcacactgctcttgctgaggacatgagttcagttctgtcactcatgtggggcagctcacaagtactt

SEQ ID NO: 61804 - DNA, 84 bp, Mus musculus
aatccactttatctttttgtatagaaagacttatgtgtagccacagctggagcctgggtcctctgaacagatctggtgtgggtt

SEQ ID NO: 61805 - DNA, 77 bp, Mus musculus
acatggatagagagtgagagaaagagaacttcagggggctttccccactgttctcgtgtctgtctgtctgtctgtgt

SEQ ID NO: 61806 - DNA, 89 bp, Mus musculus
tgtttgactcagctgttatctctgtctgtctgagtccatcatggacttagacaccacccagtgagatataccccagccctaactaaata

SEQ ID NO: 61807 - DNA, 68 bp, Mus musculus
tcagtgagctctcctactgtgggagctaacctcaacacaagcagacaagtatctcacagactcactga

SEQ ID NO: 61808 - DNA, 80 bp, Mus musculus
taccacccactctctgagtcagacattttgtggtaaggcctaccaatccatgttgtgtttatttagtgtgtgtgtgtgtg

SEQ ID NO: 61809 - DNA, 75 bp, Mus musculus
cctggctgaatgaagagagtaagctcttcaggatccttgcactgaggggactgcgaaatcttgtcagacaccagg

SEQ ID NO: 61810 - DNA, 78 bp, Mus musculus
ggtggatgctaagtgttttccttagtctcttcccaccttacttttgaggcaggctctctcagtgacatttagctcacc

SEQ ID NO: 61811 - DNA, 85 bp, Mus musculus
gaggtggatgctaagtgttttccttagtctcttcccaccttacttttgaggcaggctctctcagtgacatttagctcaccgcttt

SEQ ID NO: 61812 - DNA, 65 bp, Mus musculus
ggacagggctggggagatggctcagcacagcaagcatgatgacctgactctctttctcagtcccc

SEQ ID NO: 61813 - DNA, 81 bp, Mus musculus
ctcactggcactcactctatctggcatggctgcctggcaatgagacaggcgtctccacggttatagcagcagaggcaggag

SEQ ID NO: 61814 - DNA, 109 bp, Mus musculus
ggtagccttggctatcctggaactcactttgtagatcaggccggccttgaacttaaagatctgtctgcctgcctctctcccaagtgctaggattaaaggcagggccacc

SEQ ID NO: 61815 - DNA, 105 bp, Mus musculus
ccctcctacttactcttccattagagtccccaagctccatccactgtttggctgtgagtgtatgactctgtctgagtcagttggtgggtagggcctctcagagga

SEQ ID NO: 61816 - DNA, 116 bp, Mus musculus
gctagacagtgggaacccaggaagtaaagtgtgtgcatgcgtgcgtgcgtgcgtgtgtgcctgcaggagtgtgcatgtgcgtgctcgcatgcatgcatagcctggggctgtggagc

SEQ ID NO: 61817 - DNA, 91 bp, Mus musculus
ccttgctctgcactcaggggcagcacacagaagatgccccaagccccacacttaagggactctgcctgtgtgtgtgcctggcagctcgagg

SEQ ID NO: 61818 - DNA, 91 bp, Mus musculus
gccttatttgcccatctttatgtgggtcactggtcattctgtcagtgtaagtggtgacttgggtgtctgtgttctgtctgggtggtgaggt

SEQ ID NO: 61819 - DNA, 75 bp, Mus musculus
caggtcacccaggctggctgtggactgtggccctctgagtcagtggctcacagtctcctttcctggctgacactg

SEQ ID NO: 61820 - DNA, 74 bp, Mus musculus
ggaggtgatttgcagcagatgtgtgacagctcagaccgttggactctgaactccatttgcttgaaatccatccc

SEQ ID NO: 61821 - DNA, 98 bp, Mus musculus
ggcattgaagctcactacactcacagtctgccctgtggttgaaattaatttttttttttaaaggaaacaggtgtgctgaagtgagtagcgacacagcc

SEQ ID NO: 61822 - DNA, 75 bp, Mus musculus
cttcttcggcttcccagtgacggccactccctggttccccacctgagactggctccctctctctgagcacagagg

SEQ ID NO: 61823 - DNA, 89 bp, Mus musculus
catttgtgtatgtatatatgtatgtatctatccatctgtgtgtgttttatatgtgtgtgtatgtgtacatgcatgtacccatgcatttg

SEQ ID NO: 61824 - DNA, 77 bp, Mus musculus
gggggaggtgtgtcgctgggggtgggcttttgaggtttcaagctgaggacattctcagttaactctctctctctctc

SEQ ID NO: 61825 - DNA, 64 bp, Mus musculus
gggtttatgtgtctcacacttccgcaccacagttcatgactgaaggaagtcaggacaggagctc

SEQ ID NO: 61826 - DNA, 86 bp, Mus musculus
tggtgtgtgctgctggggagagccagggacccagagggcagctcaagccaccccagtgactctgtgactcttccacatgcacacca

SEQ ID NO: 61827 - DNA, 69 bp, Mus musculus
cagccctcgtgtacagagtgagcaaaacaaagcctagcagggtgtcttctcactctgtctcccaaactg

SEQ ID NO: 61828 - DNA, 119 bp, Mus musculus
cattgagaggaacacaagcagctggcctagcctcattgtagagccctgggctctttatcatctctgtttgttattctgacctcagtgcctgctggtcactgacgtggagaacacaggtg

SEQ ID NO: 61829 - DNA, 81 bp, Mus musculus
ggaactgagttgactcagtcagaccctctcagctccatccgtgactgggcttagctctgacctctgggttcccctagctcc

SEQ ID NO: 61830 - DNA, 116 bp, Mus musculus
aagtgagcacaccaacagcagccacacctccaggccctgcattgtgtcttagttactttcttgttgtgtgataagacaccctgcaaaggagtctaagggcagagcggtttattttg

SEQ ID NO: 61831 - DNA, 62 bp, Mus musculus
agactgctgatcagggagttttgggggtcctcctgtctcagcacctcactctctgtctgtct

SEQ ID NO: 61832 - DNA, 67 bp, Mus musculus
ggtctgtctgtctgtctgctccagaacaagtctggaggagtggatgtaaaactgacaaggctggacc

SEQ ID NO: 61833 - DNA, 75 bp, Mus musculus
tggaagcacggacagtaccagcttgggccttctccttgtccaggaaggtcacactgacagtactgagtgttgaca

SEQ ID NO: 61834 - DNA, 103 bp, Mus musculus
gctgggttgggaactgaaagcggctgtgcctctaaccactgtgtgacccactgagtcagtggcttaaccatctgagaagccttatctcagtctccctgtctgc

SEQ ID NO: 61835 - DNA, 58 bp, Mus musculus
gctgagtctcagtgcctgtcagccactcctgggctgaaaaatggtttggggtaccagc

SEQ ID NO: 61836 - DNA, 72 bp, Mus musculus
tgggcagagtcctgtctgtggcttcatcctcccagccaagtctgacagtcacggccagtgactcagacacca

SEQ ID NO: 61837 - DNA, 98 bp, Mus musculus
gtgagttcacacctgtgggtgagttcacacctgtgagtgagttcacacctgtgggtgagttcacacatgtgagtgagttcatacctgtgggtgagttc

SEQ ID NO: 61838 - DNA, 90 bp, Mus musculus
tgcactgccatggatctgggttggatttgcactgtctttcttgttctcactaagaccctgagcaagtttggctctgaccctttgcttgca

SEQ ID NO: 61839 - DNA, 80 bp, Mus musculus
tggatctgggtgtctgtgtatctgtgtatgaatgtgtatgtgtctgtatgttggtgtgcctgtgtgtggatctaggtcta

SEQ ID NO: 61840 - DNA, 111 bp, Mus musculus
atgatgggtgaggagtagtttgtcagtgtggcctgggtttacattctctctgtgtctgtgtcccaggacacatgctggataatcccaaatagcacccccaccctgagtcat

SEQ ID NO: 61841 - DNA, 183 bp, Mus musculus
gcatgtatgtatgtatgtatgcatctatgcatgcatgtatgcatgtatgtatgtatgcatgtatgtaaatatgtatatatgtatgcatatatgtatgcatacacatatgtatacatatgtatatatgtatgtatgtatatatgtatgtatatatgtatgtgtatatgtatgtatatatgtatg

SEQ ID NO: 61842 - DNA, 84 bp, Mus musculus
gaatgactattccagtgttcacagagcagtgctgggacatggtcctctttgtgtctttatctctgtgacatcggagtggcatac

SEQ ID NO: 61843 - DNA, 100 bp, Mus musculus
gtgccatccacaggggctggagagatggctcagtggttaagagcactgactgctcttccagagatcctgagttcaattcccagcaaccacatggtggctc

SEQ ID NO: 61844 - DNA, 60 bp, Mus musculus
cacgaatgtatgtatgtatgtatatgtgtatgtatatgtatatgaatatgtatatgtgtg

SEQ ID NO: 61845 - DNA, 79 bp, Mus musculus
gagggacactctttcacactgggtgaagcttgagcacgtggatgtctcaaagcctgcctacaccgtgacacacttcctc

SEQ ID NO: 61846 - DNA, 127 bp, Mus musculus
ggaatcctgcctactgctcacacgttcttcatctccaatagccctgcacagtctctcactctctcaggcttaatattctgctttgcttcatgaagtcgcgatggtgtgaaggttaaccctgtagaga

SEQ ID NO: 61847 - DNA, 78 bp, Mus musculus
tctgtgcaaaagacacccacagagcccgggctgcctctcagcctcacttacacccttccctgtgtgcttttgtgcaga

SEQ ID NO: 61848 - DNA, 97 bp, Mus musculus
gtgtctcttgctggacctgtggttctcagtgtctctggctggctggctggctggcgagctggagagatctacctggctccacacagcccctgcacac

SEQ ID NO: 61849 - DNA, 117 bp, Mus musculus
ggacagaaagcttacacgtttttttgaatgtcatggtttggaaggaatagaagtttggacatttccttttctgaaaacttctagaagtgtcacacttaaactatcaactttaagtct

SEQ ID NO: 61850 - DNA, 94 bp, Mus musculus
tacatatgtattatgtatgtattattacatgtgtatgtattatttatttatgtatgtattgcatacgtatgtatgtatgtatgtattggataca

SEQ ID NO: 61851 - DNA, 66 bp, Mus musculus
ccttagaggacggactgtcactggctcccagagataagggaacaaagagcagcccctctacctagg

SEQ ID NO: 61852 - DNA, 94 bp, Mus musculus
gagaagaatagccgaggaactgggagaaaaagccgaacattttaacagtgtgaactttgaaacgctctctctctgactcatgttcgacagtctc

SEQ ID NO: 61853 - DNA, 104 bp, Mus musculus
cagcagctcttttacttgctgagctcagctcagctccctggcagcctgaccgagcccactgtgcctggctggctggctgagttggtgtttgagaggctgctggg

SEQ ID NO: 61854 - DNA, 112 bp, Mus musculus
gcttgtgttttttccacagaatgctgtaggagcatgccagctgccagaatgattgatgtgacagcctgacttgtgagcttgctgagttccctgacaatggtgacaagaaagc

SEQ ID NO: 61855 - DNA, 84 bp, Mus musculus
ggcctccataacattcagatgcgtgttaaagggaaggacacagagccatccttaaccctacaggtagatgtttctatggttacc

SEQ ID NO: 61856 - DNA, 106 bp, Mus musculus
tgctgagtaatgtctcagagtatggacatacccacatagtgattttctttttctgttcattagattgtgggtgttgtgaattgcttctttttggctggtatcagta

SEQ ID NO: 61857 - DNA, 73 bp, Mus musculus
ggggcatcccaggctctctctctctatccctgccatcagggccaaagataggaaaggagacccaggtcacccc

SEQ ID NO: 61858 - DNA, 115 bp, Mus musculus
tgagcatggtgctcatggatctcaggtgtggcctgctggacagatgtcatcggtgatgagagacagatgtgaggcagcaggtagagagctgtgagcactgaagagagagtgggca

SEQ ID NO: 61859 - DNA, 79 bp, Mus musculus
gggttgtgagaaatatgtatatgtatgtatatgtgtatgtatatatgtacatatataccatatacatagtaaatggtgc

SEQ ID NO: 61860 - DNA, 65 bp, Mus musculus
agcaggaacttgacggagagactatggagcaattctgcttcctgtttcactctctggctcacgct

SEQ ID NO: 61861 - DNA, 70 bp, Mus musculus
gagacacacggatggggacggggcatggttaagatgcagtctgtccctccctgggtgcctgtgtgtgctc

SEQ ID NO: 61862 - DNA, 104 bp, Mus musculus
gtggaggaaatgtgtcactgggtgtgggtttggatgtttcaaagcccatgacagacccagtctctctgtctctctcacttgtgctctctctccctccctctctc

SEQ ID NO: 61863 - DNA, 90 bp, Mus musculus
ccagtatttcagctcatcccagtcagaacccagtgtggattcagaaatgcctccattgaggtgactctgcctggtcatgagctcacaggg

SEQ ID NO: 61864 - DNA, 81 bp, Mus musculus
gtgagagatctgcaccagaaggtctgaattagtgcaaatgtataattattgattatattttcatgggtgttgttttcttat

SEQ ID NO: 61865 - DNA, 139 bp, Mus musculus
gcatctttgtgtgtataggtacacacatgtgtacatgtgtgtatatgtgtatatgtatatatgtgcatatgtgtatatacatgtgtgtttatgtatgtatttatgtgtgcatatatatatgtgtgtgtgtgcacatatg

SEQ ID NO: 61866 - DNA, 95 bp, Mus musculus
agggccatgccaaagtctatgttatatacctatcaggactgttctggtctcattgtgccagaactgagccaggagaggtgtgatggtgtgccctt

SEQ ID NO: 61867 - DNA, 62 bp, Mus musculus
tatatatgtatgtatgtatatatatatgtatgtatgtatgtatgtatgtatgtatgtgtata

SEQ ID NO: 61868 - DNA, 117 bp, Mus musculus
gcagcctctcctgcaaggctttctcctaggacttgctggcaatgaaagacaccagaaggctgtgagctttcagggcaaaaataactatactgtagggttaaagtctctctgagagtc

SEQ ID NO: 61869 - DNA, 61 bp, Mus musculus
gttgtcagtagtcacagaggacttgggagaaagtgccaagttgtgccaattactgactgac

SEQ ID NO: 61870 - DNA, 74 bp, Mus musculus
tggagcacactttcagaggtcagaaaacaagtttgtagatttagttctttctgttcacctttatgtgggctcca

SEQ ID NO: 61871 - DNA, 64 bp, Mus musculus
agagtgggaggtgcaggcagtagtggtgtattcatctctctgactctctgtctctccggaagct

SEQ ID NO: 61872 - DNA, 76 bp, Mus musculus
ggggctagagatttgaactcaggtcctcctgtctgcacagcagggctctcactctctgagtcatctccctggcccc

SEQ ID NO: 61873 - DNA, 105 bp, Mus musculus
ctttgtccagcctgtctgtgatgtatgtgtcatctgctgttagccactcagtgactgtctcagttagcaggtcagctaccacaattcacagtgcttgtgctcaag

SEQ ID NO: 61874 - DNA, 85 bp, Mus musculus; identical to SEQ ID NO: 57470

SEQ ID NO: 61875 - DNA, 91 bp, Mus musculus
gaggtaaaaatgaatgagcatataaatgaatacattgtaacattttatatgttacaaaataacattgttatattgctttaattttgacttt

SEQ ID NO: 61876 - DNA, 85 bp, Mus musculus; identical to SEQ ID NO: 57439

SEQ ID NO: 61877 - DNA, 95 bp, Mus musculus
gatgggtgaatagtagtccattgtccacatatatgctgcatatggagacgtcttcatatattgtagatgtgtactgactgcatatcttagctatt

SEQ ID NO: 61878 - DNA, 85 bp, Mus musculus; identical to SEQ ID NO: 57439

SEQ ID NO: 61879 - DNA, 116 bp, Mus musculus
gttggaatgtccttagaagtaaaaattattttcatccacgtgataattcttatatacagaatattgtatgtaaagttgttagcataattttatttcccattatggcattttattgc

SEQ ID NO: 61880 - DNA, 111 bp, Mus musculus
gtctggaggattgctgacactggctcgttccttgagtatgttctcagggtcctagcatctttgccctcatagtttcccaaggaacagtcccagaaaaccagtagctcagac

SEQ ID NO: 61881 - DNA, 66 bp, Mus musculus
tgtgtatatgtatatgtatatgtatatgtatacgtatacgtatacgtatacgtatatatacacaca

SEQ ID NO: 61882 - DNA, 93 bp, Mus musculus
cccaccttaattagaagctatgactttcagagaaaatcaatgtgggcttcactcactctttgtctggcagtgagtcttcatgactaagtccgg

SEQ ID NO: 61883 - DNA, 83 bp, Mus musculus
cttcttgaacctatgcaggtgttatgcatgcttcaacagtctctgtgagtccgtgtgtgcatcagccctgttctgtttggaag

SEQ ID NO: 61884 - DNA, 57 bp, Mus musculus
ctgtctgtctgtctctgtctctctatgtgtatgagagagacagagacagagaggcag

SEQ ID NO: 61885 - DNA, 90 bp, Mus musculus
tgaaccccagggctgtcaaacttggaggataactggtttacctctttgttgagatgtgaatttcatgttgtgacctccaacctgagatca

SEQ ID NO: 61886 - DNA, 88 bp, Mus musculus
tttgttttggcctgtggttactgatcacgtctggctagcctccgttgagattggacatcatgacagtgagcacagatgctgaaggaaa

SEQ ID NO: 61887 - DNA, 85 bp, Mus musculus
gaataaatagcattgtgtgtatatatgtgtatatatacatatacatgtatatgtatatgtatatatacacacacactatactttc

SEQ ID NO: 61888 - DNA, 57 bp, Mus musculus
tgctccagtggaattttctgaggctataaaacacagagcctcagtgggttttgagca

SEQ ID NO: 61889 - DNA, 69 bp, Mus musculus
acacacacacacacacacacacacacacttggtgtctctctgtgtatgtgtctctgtgtgtgaatgtgt

SEQ ID NO: 61890 - DNA, 118 bp, Mus musculus
tttgtttcttggggtccagagccttgatacagtgtggtgtatgctgagactctgagtggacactcactctcagttacagtccatgctgagagggaagtacaggagccaaagcaacaga

SEQ ID NO: 61891 - DNA, 88 bp, Mus musculus
tcattggcctgggactctccaagcacgctaggcttgctgggcagcgaatcccagatgtctgtctgtctctgactccccagtgccagga

SEQ ID NO: 61892 - DNA, 114 bp, Mus musculus
ggtgtgtattatgtatatgtgtgtgtgcatgtgtgtgcatgtggatgtgcatatatgcgtttgtgtgtatgtgtatatatgtctgtacatctatgtgtgtgcatgtgtatgtat

SEQ ID NO: 61893 - DNA, 119 bp, Mus musculus
gcaagcagggaggagccagagcagacgaagaagttgtgtccctgcgtctgtccatctgtctctccctgcattgtctctggtaccgggggctggacaaggtgtcaggggacttgggctgg

SEQ ID NO: 61894 - DNA, 85 bp, Mus musculus
ctctcctgtcagtctctctccctttcagaactagtgcagaattcccacagtggtcctcaagctgggatgactggagcagtgagag

SEQ ID NO: 61895 - DNA, 82 bp, Mus musculus
gccctgccagtcactcagagactctgtaaaatcaatcagaaggcccctgacaaagttaacaagcttacagtgcagccagggt

SEQ ID NO: 61896 - DNA, 116 bp, Mus musculus
agggatgctggcctgtccccattctgcttgcccaatctgtaggagctgcccatctgtcagagactcagactgtcaggcaagctggtgaggggcctacaggcaagggaggcttctct

SEQ ID NO: 61897 - DNA, 57 bp, Mus musculus
gcttgcctgacagtctgagtctctgacagatgggcagctcctacagattgggcaagc

SEQ ID NO: 61898 - DNA, 75 bp, Mus musculus
gctgaaatgcactggggtcagtgcttggggtccagccccgactccaccgcttggtctccctcagtgtctctcagc

SEQ ID NO: 61899 - DNA, 85 bp, Mus musculus; identical to SEQ ID NO: 57439

SEQ ID NO: 61900 - DNA, 74 bp, Mus musculus
cctcacagtctcacactcaatgaacatacggccacctctacgtatggcctgagctatatagtgagaccgtggag

SEQ ID NO: 61901 - DNA, 101 bp, Mus musculus
tgtgtgtgtctatgtctctgtgtctctgtgtgtctgtgtgcgtgacttgtgtatgtacattcacacaccatatacagttaaagaatgataaagacatacca

SEQ ID NO: 61902 - DNA, 113 bp, Mus musculus
caagagattataaatccatacagttctattttcaaagctgtccctctgtccctgtctaggacataacactgagtgggaataagtcaaggacggagcctgtggtgtatttcctg

SEQ ID NO: 61903 - DNA, 73 bp, Mus musculus
ctggattctctctctctctgttatatgtatatggtatgtgcatacatacatgacccacctgtgcagaatccag

SEQ ID NO: 61904 - DNA, 111 bp, Mus musculus
tgctatataatcactgcctgtgacagcggggcagggccgtgcctgtgctaatattaggagagaggaaactgagcagagaggatccctggggtgcagggagcgagggtggta

SEQ ID NO: 61905 - DNA, 82 bp, Mus musculus
ttccacttcatatagcaaacactcattgtaaaggccgcatataatgaggatatttgcattttatatctatatttcagtggaa

SEQ ID NO: 61906 - DNA, 91 bp, Mus musculus
ggaggaatacagaaacacctgccaaggggcagctttgctcaccgcacgtgtgtgtaggtgtgtctgtctgtgcctgtgtctgtgtgtgtcc

SEQ ID NO: 61907 - DNA, 113 bp, Mus musculus
ggattactaattgatgttccatggcacagttgacttttccaaggtaccatctctcaggaagtggttctaggttgtagaagaaaccaagccagtcaagcagaatgtagtgtttc

SEQ ID NO: 61908 - DNA, 82 bp, Mus musculus
gctcagaaagtaatgcttttttggatgtgctagggagtcgtcaacatttcctcacaactgagtgtgtactatttgtatgggc

SEQ ID NO: 61909 - DNA, 106 bp, Mus musculus
tgtatgagttctctcactggttggaccagtgcactcttcagtgtctgtgttctgctttactccagtgctgatgtgtctgccaatcaataggggaagagcctataca

SEQ ID NO: 61910 - DNA, 76 bp, Mus musculus
gtatgtcaggaatgactgtgtgtgcaagtgcatgtgtgcgtgcattcacaactgcttagatattcattccctatgc

SEQ ID NO: 61911 - DNA, 66 bp, Mus musculus
ctgagtcagacccttagctctttagtggtcactcgctaacagttgctctgtctgtctgtcactcag

SEQ ID NO: 61912 - DNA, 101 bp, Mus musculus
ttccatcatgcaagcagcacttttgttactactttatatcaatttgaatatcactttggatggttttgtgacagagtctatgttgcctggctgacctggaa

SEQ ID NO: 61913 - DNA, 114 bp, Mus musculus
agagagagagagagagagaatgagcatgtgtgagcacttgtgtatgggtgagcatctctgtttttctgtctctgatttatttttaaggcagaaaatttgagtaacaaacgcgta

SEQ ID NO: 61914 - DNA, 77 bp, Mus musculus
gactgcatcagaaagacagagtactgtaccactaagtttaaatttggcctgtctgtctgtctgtctgtctgtctgtc

SEQ ID NO: 61915 - DNA, 67 bp, Mus musculus
atttcagagtggagacactgacataggagtttgttctcagactttttgtctctcctgtctcagaagt

SEQ ID NO: 61916 - DNA, 77 bp, Mus musculus
ggcccagcttctgtctctctggctctgcctccaagcagttgacatgccgatgtggatgggcagagggccaggatgct

SEQ ID NO: 61917 - DNA, 91 bp, Mus musculus
aagtgattagagagagagagagagagagagagagatcttagaagttagtcttgaatagctgtcactatcattttagctttttaaatcactt

SEQ ID NO: 61918 - DNA, 73 bp, Mus musculus
gagacagagactctcactgacctgggttgattagacttggctagtcaacaagccctaaggatttgtctgtctc

SEQ ID NO: 61919 - DNA, 88 bp, Mus musculus
tatgtacatgtgtgtgtatgcatgcgtgtgtgtacatgtgcgcacgcatgtgtatatgtgtgcttgtgcatgtgcatgcatgtgtgtg

SEQ ID NO: 61920 - DNA, 75 bp, Mus musculus
ttgtgagtcatcctgctgggccttgtggacacataacaagtgttgatattcactctgtctgacagtgactggtgg

SEQ ID NO: 61921 - DNA, 70 bp, Mus musculus
tctgtgtctgtgtgtctgagcatatgcatgtgtgtctgtgtatgtctgtgccatgcctgtggaggccaga

SEQ ID NO: 61922 - DNA, 86 bp, Mus musculus
ggtctatgtgttgttgcttggaggatggaagtttcggcctgaaacagaggtgctgagagtctctctgtgtaagctagaatgggacc

SEQ ID NO: 61923 - DNA, 96 bp, Mus musculus
acttttaattacatttcttatgtgtgtgtgtatgatgtgtatgtatgtatgtatgtatgtatgtattgtgtgtgaatgcatgtatgtggtgtttgt

SEQ ID NO: 61924 - DNA, 118 bp, Mus musculus
gacaagggctgggagatgcactaatctatagatgtaattgttaattatcagaatttaggttaattatatatctatttagtagaataatagtgaaaggttctcccctaggttataggtc

SEQ ID NO: 61925 - DNA, 118 bp, Mus musculus
cttctgttccaagacaagaagagatggaggaggggatgagagtggtataggtctccctcactgcctctatgccaagaaagtttcccagtctgtgtttcaactcttctagcagtgggca

SEQ ID NO: 61926 - DNA, 82 bp, Mus musculus
atgtatgtatgtatgcatgcatgtatgtatgtatttatttattatctaaatgctgtgtgtgtgtgtgtgtgtgtgtgtgtgt

SEQ ID NO: 61927 - DNA, 76 bp, Mus musculus
gtgtatatatgtgtatatatatgtgtgtgtgtgtatatatatatacacacacatatatatatatacatatatatat

SEQ ID NO: 61928 - DNA, 118 bp, Mus musculus
gctttgctgcataatgtgattttttttcccttgatctctgtcttagtcactcactcattgctgtgagaacatactctgaaaaaagcaaagtaggagaggaaggatttgcttgttttgt

SEQ ID NO: 61929 - DNA, 82 bp, Mus musculus
taagatagagaagacagtgaggagaaggatgttggtgttggttgagcgatgatgtctacctccttctgtttggaatgtttta

SEQ ID NO: 61930 - DNA, 91 bp, Mus musculus
gaggggaatagatttatttgtttatatctggcatatgtatatatgtgctatatatatttatgctttatatataatatatagcagtgctttc

SEQ ID NO: 61931 - DNA, 73 bp, Mus musculus
agtgaatgtgtgtgtatctctgtgtgtacatgtgtacaagagtgcagtgggcacagaggccatcggattccct

SEQ ID NO: 61932 - DNA, 119 bp, Mus musculus
gctgactgatgatttcagtaatatgaggttacattgaccctgtgcttggttatttttacatattcttagaccattcaaacatcaaaagaacaactgcatattgtgatcatatagagggt

SEQ ID NO: 61933 - DNA, 72 bp, Mus musculus
tgaaagcaagagatgtatgggctacccaattgtcctgctggaaatcagctcaggccctgtctctgtctctca

SEQ ID NO: 61934 - DNA, 102 bp, Mus musculus
ctgtcctgtcctttccaagccggcctcttctaccactgcctagagcaaagtttggctcacagaagagaatgagtaactgtttggtataaaggacaaacacag

SEQ ID NO: 61935 - DNA, 78 bp, Mus musculus
gcaagaaagaacagccaccctggcagccagcctctatgccaagtgtaagggcgtgagtgtcaaatggcttctacaagc

SEQ ID NO: 61936 - DNA, 104 bp, Mus musculus
ttttgctaaggaatatagacgcacccttgccttctggactcttgctgtctttgattatcatggagtcattaaccttggaggggagaatatttctcacaggaaaa

SEQ ID NO: 61937 - DNA, 68 bp, Mus musculus
gggtgtgtatacatacaagtgtatttacgtgcacgtatgtttgagtgcatgtgtatgtgcctacatgc

SEQ ID NO: 61938 - DNA, 119 bp, Mus musculus
cttacttgtgtggaatgagacctgggtaatcattacttccccttctctgaggttttgtgacatgagagaacagagtgtggaggcagatgggctacagggctgtccttctagagagctag

SEQ ID NO: 61939 - DNA, 64 bp, Mus musculus
tgtgtccatctgtctctccgtcagagccctgtgtgatagctctgagattggaattagggataca

SEQ ID NO: 61940 - DNA, 85 bp, Mus musculus; identical to SEQ ID NO: 57439

SEQ ID NO: 61941 - DNA, 79 bp, Mus musculus
acttctgttagtttcactgtgtctctgtttagtttctgtttccaggatttgtccattgataagagtggggtgttgaagt

SEQ ID NO: 61942 - DNA, 121 bp, Mus musculus
ccatctcttctcttcacttagccctgcctttgtactcactgaggacagtctggtcaggggaagatggagtcatggctttgtccttagtgtctggcacaggacacagtacagagacagcatc

SEQ ID NO: 61943 - DNA, 66 bp, Mus musculus
tatctatctatctatctatgtgtgtgtgcgcatgtgtgtgcacatctgtatggaggtctgaggata

SEQ ID NO: 61944 - DNA, 91 bp, Mus musculus
gctggtactgcaggaatcatttcacctgtttggcattagtaagcatcccaagactttatttttttaataagcaaggtctgcaatcaccagc

SEQ ID NO: 61945 - DNA, 105 bp, Mus musculus
cccgagacatggcagagcatgttgagcagaagaggggtgtggtctggtgtgtatataatgaatctctctctctctcgcgcgcgcttctctgtggatcctaatggg

SEQ ID NO: 61946 - DNA, 75 bp, Mus musculus
ggtgcatagacagccacacatgctggggattagaacatgggggtgtctctctgtgtgtctgtctgtctgtctgtc

SEQ ID NO: 61947 - DNA, 86 bp, Mus musculus
ggtctcttagaatctacaagacatctgcccagacccttaaatcttttagagtgtctgttgagagtcaggtgtaattctgataggtc

SEQ ID NO: 61948 - DNA, 76 bp, Mus musculus
gcaagtgcttcgcttgttgagtcatctctcctgccccaagtatgatgagttgtgttagtgatgtagagtaccaggc

SEQ ID NO: 61949 - DNA, 77 bp, Mus musculus
cagagagagtggagaaggaagggggatgggaggggctttgctcactcccattaaatctctgactcacgctcactctg

SEQ ID NO: 61950 - DNA, 86 bp, Mus musculus
ggctcttggacactggcctactctagatcttatctactgtgcactggctaggagagagagttcagagtgagcaaggcgccaaggct

SEQ ID NO: 61951 - DNA, 109 bp, Mus musculus
ctcttggtcttttaccattactggcccagagcacaggctatctctgtctctgagaagtgctagagatatcattggctggggagaagaagggccatgtgatgtgcaaggg

SEQ ID NO: 61952 - DNA, 78 bp, Mus musculus
cctctggctacctgggaactgtagaccaggctggcctctaactcagagatctgtctgcctctgtctcccaagcactgg

SEQ ID NO: 61953 - DNA, 100 bp, Mus musculus
ggatacaagggccgtgccagtgagcctttcttgagtgctgagcctgacggtgcagccttgagtcccggtgcctccctctgtcactgctacctatgttccc

SEQ ID NO: 61954 - DNA, 116 bp, Mus musculus
cccatgtatgtgcagaggccagaacaggacaccaggaatctctctctatccctctctgccttagagccttggagcaggatgtctcactggattggaagtttactgttttgggtggg

SEQ ID NO: 61955 - DNA, 101 bp, Mus musculus
catgcacacatgcacacacaggttttgtaatgtgtacaatattgtgggctttgttacattatttttatactacagttttactgtgtgtgtgtgtgtgtgtg

SEQ ID NO: 61956 - DNA, 79 bp, Mus musculus
gagggagggagggaggaagggagagaatcggggtgagcaaactatagagatcactgctcagtgactctctgcctgtttt

SEQ ID NO: 61957 - DNA, 80 bp, Mus musculus
ggaagagctttaccggctggagagatagctcagcagttaagagcactgactgctcttccagaggtcctgagttcaattcc

SEQ ID NO: 61958 - DNA, 107 bp, Mus musculus
tgtcccatttacaggtgagcattgttatcatttgaaggagtttttattaatatgtatcaatgcataaaataaggttctctgttcaagggagtggcgctatgggtata

SEQ ID NO: 61959 - DNA, 70 bp, Mus musculus
atgtaaattgtgtgtatatgtatatacatatatgcatgcatatatgtgtattatatgtacataagcacat

SEQ ID NO: 61960 - DNA, 111 bp, Mus musculus
ttcctgtgtgtacctatgtgtgcgtcaatgttgtgtgagactgagagacagagacagggagttgatgctgtcatccacacagaatgagagaaagacagaaacagagagggg

SEQ ID NO: 61961 - DNA, 92 bp, Mus musculus
ctcaaaaccaccagggttcctgtctcactgtctaagtcaataaggcctggtgcctggaggctaacacagtggacataactagggttttggag

SEQ ID NO: 61962 - DNA, 65 bp, Mus musculus
gccacaaagttctcctggtctctggaggcctaacacccctgaggtactaggttcatttgtgaagc

SEQ ID NO: 61963 - DNA, 117 bp, Mus musculus
ttcgggttcggctgctgcctatgccctgtgccctggaggtctcagcctcgctgtctgccaatgggcatccagtgcggcggggctgcacagctgtgtgggactgggctaggacctggg

SEQ ID NO: 61964 - DNA, 92 bp, Mus musculus
caactttgttgtaacaacatcttccgcatcatgagtgtgagctttgtggattgttttgcagtgtcacagggttgggcacatctgtgcatggg

SEQ ID NO: 61965 - DNA, 119 bp, Mus musculus
gcagggaaatgtaactttttggcagaacccttgatctctgcctgtgtcccactgtgactcatccgggtcagggaccccaggaggaggtcttctgggtacaacataagtgtcctccctgt

SEQ ID NO: 61966 - DNA, 85 bp, Mus musculus; identical to SEQ ID NO: 57439

SEQ ID NO: 61967 - DNA, 82 bp, Mus musculus
aagaactccctggagttggggtgtctatctctgtgttagctctcgcttctctgatgtgctctgggtccagggttctgttctt

SEQ ID NO: 61968 - DNA, 193 bp, Mus musculus
tatacatacatacatatatatatatatttatataatatattttacatatgtatactttatacatatatatatattctttatgggtatatatatatattctttatgggtatatatatattctttatgggtatatgtatatgtatatgtatatatatatatgtgtgtgtgtgtgtgtgtgtgtgtatgtatttct

SEQ ID NO: 61969 - DNA, 129 bp, Mus musculus
ggatgagtggtggttagggacggaggagctggggacttgagacaagtcatgtaataacctctctgtgtcaggctctctgtagaaaacaaagatggccacatttgcctgcagtgaaatgcccaggtgagg

SEQ ID NO: 61970 - DNA, 82 bp, Mus musculus
tctatctatctatctatctatctatctatctctatatatagatatagagatagatagacctagacctagatctagacctaga

SEQ ID NO: 61971 - DNA, 69 bp, Mus musculus
acctgagcctcagtttcttcatcaggaagtgcagataacactgcctctgatgctgtgtggtgggagggt

SEQ ID NO: 61972 - DNA, 75 bp, Mus musculus
tacatacatatgtatatgtatatatgcatatgtatgtatgtatgtatgtatatatgtatatatgtatgtatgtat

SEQ ID NO: 61973 - DNA, 64 bp, Mus musculus
gtgcatgtatgtgtgcatgtgtatgtgtgtaaatgcatgtgtatgtatgcatgtgtatgtgtgt

SEQ ID NO: 61974 - DNA, 57 bp, Mus musculus
tgaagacagtctcactgtggctggcagccaacaggctctgccatcttcctgtcttta

SEQ ID NO: 61975 - DNA, 71 bp, Mus musculus
cccaagctgcatcacacactgagtctcacagatagccgtgtgctgctaacccagggggctgaggcagaggg

SEQ ID NO: 61976 - DNA, 76 bp, Mus musculus
gttagcagcacacggctatctgtgagactcagtgtgtgatgcagcttgggtttcatgtgtgagtgtgctgttgcac

SEQ ID NO: 61977 - DNA, 81 bp, Mus musculus
ttccccttcagatttcagctaaggctggactgtacctaatatttttatatatgcaatagtctacactagcatgtctgggaa

SEQ ID NO: 61978 - DNA, 113 bp, Mus musculus
ttgcagatttgccccttgtacccagactcctgagttatagcaccattcaaaatcagttttaccagtaaaggaactgtgttgtaccagtgaggtcaaagggtcagtacatgcag

SEQ ID NO: 61979 - DNA, 97 bp, Mus musculus
ttacttgcttgtttctttggttttttctggggggggggggcacaagataaagagtatttctgttctacagttaagaatcgctgaatacttggagtag

SEQ ID NO: 61980 - DNA, 74 bp, Mus musculus
agctagactctgtatttattcatgtgtgtgtgcacacatgtgtgcacatatgtgagttagtatatgtgtgtgct

SEQ ID NO: 61981 - DNA, 87 bp, Mus musculus
tggtccacttgccccacggggatatatatatatatatatatatatatatatatatatatatatatatctgtgtgtgtgtgtgtgtca

SEQ ID NO: 61982 - DNA, 77 bp, Mus musculus
gtgtcctggtatgcacgtgggggagccaagagcaaatctgtggagctgtttctctccctcactgtttacctggggat

SEQ ID NO: 61983 - DNA, 74 bp, Mus musculus
cagaaggtcaccccgtggagggttctctcactgccatggcatccttatggacattctccctgagtgcctctctg

SEQ ID NO: 61984 - DNA, 66 bp, Mus musculus
gttcgctgctgtgatttcctggaatctagaagagagtcagaacacagggtgctttgtagtagtagc

SEQ ID NO: 61985 - DNA, 72 bp, Mus musculus
ggggggggtgacagcttgtggcagggtcagtctctgacacagcatgactggctgctaaggataccactctgc

SEQ ID NO: 61986 - DNA, 74 bp, Mus musculus
tgtaatatatatcatatatatggtgtgtgtgtatatatatatatacacacatatgtatataattttttaataca

SEQ ID NO: 61987 - DNA, 72 bp, Mus musculus
gcctgcctgcctgcctgcctgcctgcctatctgctctaggaatggggaggctgtggaggaagggcaggaggc

SEQ ID NO: 61988 - DNA, 116 bp, Mus musculus
ttcctcagaaattgaaacttacgtctttgtgactccaggtgcagatgggacagggggaagacaaactctgtctctggctgtaaaatgtcctcaaagaacttctgcctctcccggag

SEQ ID NO: 61989 - DNA, 100 bp, Mus musculus
tgtaggtgggtggcacttgtggtggggaatgacagccaggttagaagagcttgaaatgggcctgatttttctcccagcatgtcagctagaaatggcctca

SEQ ID NO: 61990 - DNA, 104 bp, Mus musculus
ggtagagtctctggctggagacatggcttagtggttaagagcactgactgctcttccagaggccctgagttcaattcccagcaactacacagtggctcacaacc

SEQ ID NO: 61991 - DNA, 103 bp, Mus musculus
tatggtgggtggggatttggggtgtcaactggacacaactgagtagacgtaacctcagttaaagagttgtgtccagattggcctgtggacatgcatgcctgtg

SEQ ID NO: 61992 - DNA, 75 bp, Mus musculus
cgggtagagcatgtgcatgtgcatatgtgcgtgcatgtgcgtgtgtgtgcatatgtgcgtgtgttgaggtttccg

SEQ ID NO: 61993 - DNA, 64 bp, Mus musculus
ggcttcactctccctgtactgaagatgtgtggaccactcagtctcacagacacagggtgaagcc

SEQ ID NO: 61994 - DNA, 118 bp, Mus musculus
ggggcaggtgtgtgtgtaacattgggcaggtgtggggtctcctggcttctctgtccaggcctctgttctctctctcacttctagcctcctattctctgttctctctgtcacatccttg

SEQ ID NO: 61995 - DNA, 80 bp, Mus musculus
ttttgcatgtgcatgtgtgtgctggcatgcatgttcgcatgtgtgagtgaacatgtatgagagtgcatgtgcttgtggag

SEQ ID NO: 61996 - DNA, 87 bp, Mus musculus
ggcatgtgaagaaaaagtgagcaaaaagagtccagaggaaataccctcccctaatcacatgagaccctctcactctctcctagtgcc

SEQ ID NO: 61997 - DNA, 70 bp, Mus musculus
ttcctcagctgacagagaccagagactgaccttgcagggctgttgatggttaagtgacagcaggatggag

SEQ ID NO: 61998 - DNA, 117 bp, Mus musculus
tctggtgtaacttcttctccaagagacgagtggtgtggtagatagagaggagagtgcgggcagaggggaagatctcctgtaagatcgctcggtgagggaatgaagggtccacaaaga

SEQ ID NO: 61999 - DNA, 72 bp, Mus musculus
gccactggctactccgatagcttgctttgcctcccaccacaggaagctcacctgtctgtctgtcagggtgcc

SEQ ID NO: 62000 - DNA, 78 bp, Mus musculus
agtgcgtgcctttgggtcctggtgtgggagaggctactggccttgttaaactctctcactgtctcccaaggcagaact

SEQ ID NO: 62001 - DNA, 64 bp, Mus musculus
agagccactcactgtcacactgcgatcgcgcatcacggggtcagggtgagggtgggggatctct

SEQ ID NO: 62002 - DNA, 75 bp, Mus musculus
agtctctctgcctctctgtgatatagctctgacacatcgccagagctatgctccccacagtgttgataatggact

SEQ ID NO: 62003 - DNA, 92 bp, Mus musculus
ggcctccgtgcatgtaccgtggcatgcgtgcaatgtggcatgcacgcactgtggcatgcacacactcactcacccatatacatgcacacgct

SEQ ID NO: 62004 - DNA, 115 bp, Mus musculus
ggtgtgtgtgcatttgcatgtgtgtgtgcaagggtgtgctcacgtgtgaaaatgcttgtatacatgtatgtatatgtgtgctcctacatgtatctacatgtatgtatgtttgcat

SEQ ID NO: 62005 - DNA, 77 bp, Mus musculus
tgtccctgtctctctgtctcagaaatcacacgaactcatctgcctgagggtgactgacaggcagggtctcagggaca

SEQ ID NO: 62006 - DNA, 97 bp, Mus musculus
tagacaaagtcccagaactgatgggttcttcagaggggacacgcatactaacctcttcctctgtcactgtatcagaattatcccggatgtctgtcta

SEQ ID NO: 62007 - DNA, 82 bp, Mus musculus
tgacatcctgactgtctgtctctccagaggacagtgggaccacactccaccattgttctggagtgacgctaagcgtatgtca

SEQ ID NO: 62008 - DNA, 110 bp, Mus musculus
ccgctctgacaatagacaggccaactagagacgaagactctgcctcactcagtgtctcaagcagagtgggcaacacagagtcctgacttcctagtggacacctcaggtgg

SEQ ID NO: 62009 - DNA, 108 bp, Mus musculus
gtgtgtgtgttaagtacactggacagggatcttttccttccagtcatggtgcctgcatgttcttgagtggaagggggctagactcggccagagtaggttcacacaggc

SEQ ID NO: 62010 - DNA, 84 bp, Mus musculus
tgtttgtacatgtttacgtatgtgtgtatgtgtaagtatatatatatgtgtacacatacacacacacacacacacacacacaca

SEQ ID NO: 62011 - DNA, 95 bp, Mus musculus
ggtgggcttcttcagaaaaattaactcttctgagatcttcctgtgaggcctcctggggcctcacaccgagctcagctttctctagatatctcacc

SEQ ID NO: 62012 - DNA, 73 bp, Mus musculus
tctgtccacctctgcgactcactgcctctgacttaacctcctggagcccagtagatttgtacggtggatgtga

SEQ ID NO: 62013 - DNA, 97 bp, Mus musculus
ggaaggaaggaaggacagccaggggctggtgagattgctcagtggttaagggcactgactgctcttccagaggccctgagttcaattcccatcaacc

SEQ ID NO: 62014 - DNA, 94 bp, Mus musculus
ggcagctccatcggggcctctgcatcctcagtgtgacctctatgacccgagagagacaactcagagcgcagagcctccggctccaggaggggcc

SEQ ID NO: 62015 - DNA, 80 bp, Mus musculus
ctcacagatccactgcctctgtctctgcctcagccctgagtgctgggattaaaggtgtgtgccacccccactgctctgag

SEQ ID NO: 62016 - DNA, 137 bp, Mus musculus
ctgggtaccagttagctcccttcttaagaatcataaacccctgtgttcttatgagacatgagtagactgtgagcacagcaggcaggagtcatccaagtttgagaccagcctggtctacacagcaggaccctgtctca

SEQ ID NO: 62017 - DNA, 108 bp, Mus musculus
tatggtatattccacagagtatgtagtatgtattatatagacattttatataaataatgtgtcttatataatacaaagcaatatatttatggggtgttatagcacata

SEQ ID NO: 62018 - DNA, 118 bp, Mus musculus
caatagaatccctaagacaagagctccacattgaaccaatcacaggcattttgttgagtctctagagagatacaatatgcctgtcccgagtggggccagctacagggtgagcaggttg

SEQ ID NO: 62019 - DNA, 90 bp, Mus musculus
ctctgaaggaagtgagtcagtagagacaggccttggggttttacagcttgaccccacttcctgtccctcttgtgctttctggttacagag

SEQ ID NO: 62020 - DNA, 106 bp, Mus musculus
gctttggaagtgtgtctctgaagtggactgcttaggacccaaccccgtgtccctcactctctgagcacttccccaactctgagcaaccctgtactcctgaagacac

SEQ ID NO: 62021 - DNA, 114 bp, Mus musculus
gtgtgtgtgcctgtgtgtatatgtggtgtgtgtgtatgtatgtatatataatgtatgtatgtgtgtggtatatgtgtgtgtacgtgtgtgtggtgtatgtatgtatgtatgtat

SEQ ID NO: 62022 - DNA, 97 bp, Mus musculus
gtccagtgaatgattagatgaacagatgaatgaatgaatgaatgaatgaagtttaaaagacttcactatgttcttgttcccgtcctgattgttgggc

SEQ ID NO: 62023 - DNA, 107 bp, Mus musculus
attttgaatggatatgtacacatacatatatgtatatatatattcatacatacatatctgtgtgtatatatatatatatatgtgagtgttacatatacaggtaaaat

SEQ ID NO: 62024 - DNA, 65 bp, Mus musculus
cggggcaagaacctgacacagaagccatgaagaaacactgctctgtgactcactctctggctccg

SEQ ID NO: 62025 - DNA, 106 bp, Mus musculus
ggcatcttcctgacttcatctcttcagctccagagtgacagatgtaagagaccaggcctgtgtctgcaccgtcacctggactctatatgaccgtcactagactgtc

SEQ ID NO: 62026 - DNA, 85 bp, Mus musculus; identical to SEQ ID NO: 57439

SEQ ID NO: 62027 - DNA, 77 bp, Mus musculus
tttggaagctgattatgggatggatccctggatatggcagtctcagtctcagtccatccttttgtctcagctccaaa

SEQ ID NO: 62028 - DNA, 96 bp, Mus musculus
tgtcggggggagacaaccattcacatacaggcttgtttgggactgtccattctactccactattctgtctgtctgtctgtttgcatcacctttaca

SEQ ID NO: 62029 - DNA, 115 bp, Mus musculus
ttcacccagaagctctgtgcccctctcaaaggatgctagtctctcactctgcctcagctgggctgaggtggatctaggcctagtggaggaggttgcaggcttccttgaacggtgg

SEQ ID NO: 62030 - DNA, 160 bp, Mus musculus
cgcccctgccttgattcctaggttgaagttcttcacttgtgaattcagtagagaattctcagctttttttttttttaaaggggggggggggcactggcaagatggctcagtggttaagagcactgactgctcttccaaaggtcctgagttcaaatcccag

SEQ ID NO: 62031 - DNA, 91 bp, Mus musculus
atcttgaggggctggagagatggctcaatgagtaagagcactgactgctcttccagaggtcctgagttcaattcccagcaaaccacatggt

SEQ ID NO: 62032 - DNA, 75 bp, Mus musculus
ggttgccggggagcacaagggtgtacatcaccttaaacaaaattcctctgtatcactctgtcactccctcgggcc

SEQ ID NO: 62033 - DNA, 74 bp, Mus musculus
gaaattagtcagaggtgtctgccttcactaccaagacactggtgacagaagagacacacatctagaacactgtc

SEQ ID NO: 62034 - DNA, 113 bp, Mus musculus
tatatatgtgtgtgtatatatatgtgtgtgtatatatatatatatgtgtgtatatatatatactgcgctactgcgcgcacacacacacacacacatatatatcatatacatat

SEQ ID NO: 62035 - DNA, 129 bp, Mus musculus
ggacccagaacttgctgctttggctcgtctagctaaccagcttgctctggggatcccctgtctctgcctctgagtgggttggggatcggctgccatgcctgcctgctatttatgaggtactggggattc

SEQ ID NO: 62036 - DNA, 115 bp, Mus musculus
gctgagggctgccaggtgtatgtgcacatgtctgtgcgggtctgtgagcttttgtagctgtatgttcacctagtcatgtatggctctgtgtatctttgtgcttgtgtgtttgtgt

SEQ ID NO: 62037 - DNA, 94 bp, Mus musculus
cataagggtcatgtgtgggtgggtgggcacacaaggggcagctggaccgtgaagaagagagctgtgtgtgcacactcaagtgtgtccctgtgtg

SEQ ID NO: 62038 - DNA, 83 bp, Mus musculus
gccgtccccgggtctgtctctctgtctctccatcctcgcttcaggccggggcccagcccgagagacattggcccggcccgtgc

SEQ ID NO: 62039 - DNA, 98 bp, Mus musculus
caccagggcatctgtcctcagtgagtctgtgcgtctgaagcctcgggacagcagtcccagatcacagcaagtatcaggggccctgatgaattgtgccc

SEQ ID NO: 62040 - DNA, 132 bp, Mus musculus
acgctgtgtgatggacagctatacaactgcagtgctgagcgtgagtctgtctgtctgtccatctctgtgtgtgtgtgtgtgtgtgcgcatgcacatgcgtgtgttttcatagacacatgtgagcatgtagag

SEQ ID NO: 62041 - DNA, 119 bp, Mus musculus
agggttctacctcctttgttcaaggcgatggcctttcatgttctaggattgtcttcagctctttgactcacacacactaaggcctagggaaggtcttgagcagcctgtcccagggccct

SEQ ID NO: 62042 - DNA, 62 bp, Mus musculus
gagggtctgagattgacttttgtttttaaataaatctagagctgtaggtgtctttgaccctt

SEQ ID NO: 62043 - DNA, 130 bp, Mus musculus
gtatgtgtatgtgtatatgtatatgtatatgtatatatacacacatacatatacatacatatatacatatatatatacatatacacatatacacacatatatatgtatgtatgtatatgtatatatatat

SEQ ID NO: 62044 - DNA, 74 bp, Mus musculus
agaaacagacctgcacagtgcagatcatctgcctgaaaagctggcaggccgtctgtctgtctgtctgtctgtct

SEQ ID NO: 62045 - DNA, 81 bp, Mus musculus
gcttttgactgtgtatatgtgtgtgcatgtgcatgtgtgtgtgcctgatgcgtgcacagacgtgtttacatatgtggaagc

SEQ ID NO: 62046 - DNA, 110 bp, Mus musculus
gtctgttcccccgtctgtactcttcctacctttgggagtgtgactctgttagtgactctgtgggggcggtttagggtcgacattccgggagggtggggccacaggcaggg

SEQ ID NO: 62047 - DNA, 92 bp, Mus musculus
ggctggccagtgactggagagtgtccctctgtgtctccttggacatcattgctcagagacagcacggtgactcttcctccagctctggagcc

SEQ ID NO: 62048 - DNA, 126 bp, Mus musculus
gtgacggcgtgtcttgttgttaaacatccacacactgggggctctgaggtagaaggctgtgtgcatagctgcatgcaacagagatcaaactgggtgtagcggcacacgcctgcactctcggcagtc

SEQ ID NO: 62049 - DNA, 58 bp, Mus musculus
agacagaaggtacctgatgacagtcacccagggtgtctgtctgtctgtctgtctgtct

SEQ ID NO: 62050 - DNA, 101 bp, Mus musculus
cagggtcccctttgtcctctttctgccacgggacagttgtgtgagaggaggtgatgtctcttctcagcagccatcttgtgacttggaggccaaacaccgtg

SEQ ID NO: 62051 - DNA, 78 bp, Mus musculus
gtgatgtctgttgagtattgagttttcagggaatgggcgtgggcaggctgatcttctctgtcaatctgactgtgtcac

SEQ ID NO: 62052 - DNA, 86 bp, Mus musculus
cttgtgtgtctgtcacttctgtccctgtctgtgagcatcatttagggctccatcccgggcctgaaacacctgatacagaccacagg

SEQ ID NO: 62053 - DNA, 122 bp, Mus musculus
actagcaagcaaaagggaagagagggccctctctctcccttactctgtgtgtgtgtgtgtgtgtgtgtgtgtgtgtatctatatgtgtgaatgtgtgtatgtatgtatgtatgcatgtatgt

SEQ ID NO: 62054 - DNA, 72 bp, Mus musculus
cagagatctgtctgcctctgcctctgcctctgcctcgtgagtgctgggattaaaggcgagcaatggtcgctg

SEQ ID NO: 62055 - DNA, 75 bp, Mus musculus
gtacagcctttcactcagactgagtgacagccagatgcaaagctgtcactgcagtccaggactcctcaggctggc

SEQ ID NO: 62056 - DNA, 58 bp, Mus musculus
ggagctaaacagacttaaggccacgagggctgggccctcacagtggagtctgtgctct

SEQ ID NO: 62057 - DNA, 103 bp, Mus musculus
aaagcctgactttcctaagttaatggatatatatatatatatggatctatctatctatctatctatctatctatctatctattggttttttgagacagggttt

SEQ ID NO: 62058 - DNA, 81 bp, Mus musculus
tgtgtgtccaggtggagcacctaatactcctgtgtagactgtgatctcactgtgagactgtgcctcaacctagacagaaca

SEQ ID NO: 62059 - DNA, 95 bp, Mus musculus
ctgagttcacagggcatggaaatactcattctttttcataaaatgttgcagttctttatttttacattgtgattgtttctttttgcctaattcag

SEQ ID NO: 62060 - DNA, 93 bp, Mus musculus
catgctgaaaccttccctggcagactgcgagagtttccatttcagtgaagtcactactgatattcttgttttctctccacaggtttcttagtg

SEQ ID NO: 62061 - DNA, 101 bp, Mus musculus
gtcgggaactcactgggatcctaagtacaaagctatcacagccaggttagagtaattcctttcaacgagcttcctgtgactggggccttctgtttccctac

SEQ ID NO: 62062 - DNA, 86 bp, Mus musculus
tgggtgcaaggaagagagagaacacagtcaccagtaagcttgagggctcttaagatgtcagggtcttctgtttgtcctgtccccca

SEQ ID NO: 62063 - DNA, 75 bp, Mus musculus
tggaaactgacaggagagagagagccctgccccggcagagatcaacagctctattcccttcttggcaagcatcca

SEQ ID NO: 62064 - DNA, 62 bp, Mus musculus
gagagtcactggatctctgaatcactgtggaaggggacggtgccggagcccacccgactctc

SEQ ID NO: 62065 - DNA, 114 bp, Mus musculus
tggttaagatcctgtacttggggctggagagatggctcagcagttaagagcactgactgctcttccagaggttctgagttcaattcccagcaaccacatggtggctcacaacca

SEQ ID NO: 62066 - DNA, 75 bp, Mus musculus
gtttccggtgtctgtgtgacagctcacaactgtctgtaacttctgtatctgacaccctcacacagacatacaagc

SEQ ID NO: 62067 - DNA, 87 bp, Mus musculus
cctacggtgactgtcacgacttctgctgttgtttttgttttaatccaagagatgacggcaaagctgagtgtgcgcagccagcctggg

SEQ ID NO: 62068 - DNA, 109 bp, Mus musculus
gtgaggctgtttgctcgggtgactttaatttgtggtgagttgacaccaaccctaaccctctctctcacacacgcacatagggacgcaagggaaggaaaacaaatcttac

SEQ ID NO: 62069 - DNA, 60 bp, Mus musculus
gtgcatgtgtgcctgtgtgcctgtgtacctgtgtgcatgtgtgcctgtgtacatatgtgc

SEQ ID NO: 62070 - DNA, 76 bp, Mus musculus
cctaaggatttgactagacacaggctccagaagcagggcgggccactgtagccagtctgtgtcagtctgagtcagg

SEQ ID NO: 62071 - DNA, 63 bp, Mus musculus
gctctggctcataatactgcagacttgagagaactgatcagtctgtgtctgtgacctgagagc

SEQ ID NO: 62072 - DNA, 88 bp, Mus musculus
ctctgcagactggagcagtcacacactgtgtgtctgggatctgagaacctaccagtctcaaggtgctgtgtgcatgctccgggcaggg

SEQ ID NO: 62073 - DNA, 102 bp, Mus musculus
tgagacacagctgttagagaacagagtgcagtcactgaaaagcaatttccctcttcacacatgagactcattcaggctggcaggtaattgtgtctcagtctc

SEQ ID NO: 62074 - DNA, 66 bp, Mus musculus
ggtctctgtccctctcgctgactttctggagcctaccctatggaagtcatgcaggtacatcaggcc

SEQ ID NO: 62075 - DNA, 68 bp, Mus musculus
taagggattcaggactgatttactgtcctgtggtgtgaactctggtcagtgggtctctctttctcttg

SEQ ID NO: 62076 - DNA, 71 bp, Mus musculus
actctactaccaccgtatgtatatgtgtatgtgagtttgtatgtatgcatgtatgtatgtatatgtgagta

SEQ ID NO: 62077 - DNA, 119 bp, Mus musculus
gagggagatttggggtttttaaacaaacattggattttttaaagtgtggaacagttttcttttttaatatttttattgagatttcatatgatgttgtttcgttagacaccctctctctc

SEQ ID NO: 62078 - DNA, 106 bp, Mus musculus
acaggcccctcagccctggaggctaggcaaagtgcagtaggtgagggagcagagtggctgcctgcctgcctgcctggcccaggagagctgagggattcaagcctgt

SEQ ID NO: 62079 - DNA, 81 bp, Mus musculus
ctgctgtgaagactgagcaaactatgatggactggtcagtggtggtcactgtctctcacagtttggtgacagccacagcag

SEQ ID NO: 62080 - DNA, 83 bp, Mus musculus
ggtagccccaaagtctccttgactcactcaatcattctgcatggggggatgggaacaggaggtagggtgggggagggggtgct

SEQ ID NO: 62081 - DNA, 84 bp, Mus musculus
gggcaggtggcctggctgcggtgacaagtgggacaaggtgtgaagtgagttgcacactgtccctctgactgccccgtcctgctc

SEQ ID NO: 62082 - DNA, 110 bp, Mus musculus
ttctggctaaaccactagagaccagtattcaagtggaaaagcacacagaaaagactgtgctcatgagatttcagaagtgaacaatggtttccttgggaatggaattagaa

SEQ ID NO: 62083 - DNA, 120 bp, Mus musculus
ggtgcctgagggtgatgtgtgtgggtctggccttgtggctcctgtgtgtctgtctcagtgtgcccacgcaggtctcgcacacctgtggaaggtgtgtctgagcaggcctgtggcccgggc

SEQ ID NO: 62084 - DNA, 109 bp, Mus musculus
gtgtttggctggctacacgtaggactcagtgctttggttgtgtgcggtctatcatgtgctcacctgtctgtgtctgtctgtggagcacctcagagaccaagcgctgtgt

SEQ ID NO: 62085 - DNA, 65 bp, Mus musculus
gactctgtcctgtctctgagtgagtccctgtcaggaggagtgtcactcaggatggtgctgatgtt

SEQ ID NO: 62086 - DNA, 68 bp, Mus musculus
tcagtcacagaagtcagaaggctgtgtggacagttcaactatcatctcagcccctgtctccagactgg

SEQ ID NO: 62087 - DNA, 61 bp, Mus musculus
gtttcagaaggctgtgagctgacacctgggtgctggaaagtcaactcggagcctctataac

SEQ ID NO: 62088 - DNA, 62 bp, Mus musculus
agcatccaggactgagccccggctgaggcttcatctgctggctctcagtgtcactgtctgct

SEQ ID NO: 62089 - DNA, 84 bp, Mus musculus
acacacacatacacatatatatgtatatgtgtacacatatgtatatatgtgtgtgtgtatatatatatgtgtatatgtgtgtgt

SEQ ID NO: 62090 - DNA, 70 bp, Mus musculus
agccctctttccacttgtgtctgtgtgtctgtgtctgtaggtcagagaacagcttgcaggagttggggtt

SEQ ID NO: 62091 - DNA, 81 bp, Mus musculus
taaccatgcgtgacagtacagacagttctccgtggatgtgccacacctcaggagctcggagtttgcttggcactcaggttg

SEQ ID NO: 62092 - DNA, 110 bp, Mus musculus
cccaggggacggcaggggactgggatgcacaggatgatagacagcacagagagagaatggtgacgagctgagagtctgtaactgctgcctctctcctgaatgccgctggg

SEQ ID NO: 62093 - DNA, 100 bp, Mus musculus
ctggcctcccctctgtccctgctgctgcccggctggagggaagacagagaacacagtgcttgggattccagatggtggagcttagggactcccgtgggcc

SEQ ID NO: 62094 - DNA, 80 bp, Mus musculus
ggctacagtctctctgtggctcccactctgtctcacacacagggcaggggcagtctttctgagagacaatgtttacagtc

SEQ ID NO: 62095 - DNA, 82 bp, Mus musculus
atatgtgtgtgtgtgcccacacaggtgaacctgatgtctgtgtgcacacaggtgaacctgatgtgtgtgtgtgtgtgtgtgt

SEQ ID NO: 62096 - DNA, 95 bp, Mus musculus
ctctctctccacttgctgttgtttttgtttttaaggcatggtttctctaagtcactctgtctgagcattgggactgacggtattgggactgatgg

SEQ ID NO: 62097 - DNA, 82 bp, Mus musculus
ggtttagaactcactatgcagagcaagctggccttgaattcacagaggtcagcctgtctctctgcctccctagtgctgagct

SEQ ID NO: 62098 - DNA, 162 bp, Mus musculus
tgtgtacccaagtatttgtgtgttgtgtatgtgtgtctgtacgcacacatgtgtaagtatgtttgtatatgtgtgcacatatacacgcacatgtgtgtatgtgtgcatgtatgtgtgtatatgtgtgtgtacatgtgtgtgtgcatgtaagtatgtgtgtgt

SEQ ID NO: 62099 - DNA, 87 bp, Mus musculus
ttccagagatatctgaccttccagctctgtttggctctctgtctgacagcagagagctgacagagaagaaatggcggctgtagggaa

SEQ ID NO: 62100 - DNA, 75 bp, Mus musculus
atgtatgtatgtatgtatgtatgtatgtatatatgtatatacacacacacacacacacacacatacatatatata

SEQ ID NO: 62101 - DNA, 66 bp, Mus musculus
atgtatgagcatgaatgtatgtatgtatgtatgtatgtatatatgcatgcatgtatgtatgtatgt

SEQ ID NO: 62102 - DNA, 122 bp, Mus musculus
tatatgtgcactgtgtccagatgtccagtatgtatatatgtgcactatgtatatgtatatttacatatgtatatgtgcatatgtgcattgtgtgcagatgtgcactatgtatatatgtgcac

SEQ ID NO: 62103 - DNA, 79 bp, Mus musculus
ggtgtagacgctgcagaagcttgagagttcttgggacaggtcctcagctgactctctgactctgccatctgtctccacc

SEQ ID NO: 62104 - DNA, 76 bp, Mus musculus
ccctcctctgtgtgtgtgtgtgcagtgtgtacacatgcttttgcatgtgtgtagtgcatgtgtgtgtgcttctggg

SEQ ID NO: 62105 - DNA, 77 bp, Mus musculus
tgccgtgatggaattgcactctctgtctgtgagaacggtgggcccttcttcctgcaaaagctgcttttcctcaggca

SEQ ID NO: 62106 - DNA, 84 bp, Mus musculus
ctcaaacagtccctgggagtttaccagtctaaacaggatggagccagttgagacagaccacagactcctgatgggcgggggggg

SEQ ID NO: 62107 - DNA, 100 bp, Mus musculus
ttcagctcacagacctctgccctgtgtcattctgtcactgtgtctggcccttattgatttactcagagacaaagcaggacgataaagccctgtgggtgaa

SEQ ID NO: 62108 - DNA, 95 bp, Mus musculus
ctgagccatagccccaggttctttaagagagaaatgactgagctggttacagccagtccgccttctttaaaccattagaggggctcagaggtcag

SEQ ID NO: 62109 - DNA, 71 bp, Mus musculus
ccttaattttttgaggcagtgtctctcactgagcctggagctcactgatctgctgcccagagaaccccagg

SEQ ID NO: 62110 - DNA, 90 bp, Mus musculus
ctgtgcatgtgagagagagttttgtgtgtgtataagagagagagctctctgcatattccaaagctcttttgtttgagtcgcgtgttccag

SEQ ID NO: 62111 - DNA, 111 bp, Mus musculus
tgcatatgtgtgtgtgtgtatatacatacatgtataaatatttttatgtgtgcatatgtatacctgtaaatgtgtatatttatgtgtatatacacatatacatgagatgta

SEQ ID NO: 62112 - DNA, 68 bp, Mus musculus
gagaaggacacatctcaggagctaacatgcgcatggtcactcggtgccataggctctctctgtctctc

SEQ ID NO: 62113 - DNA, 78 bp, Mus musculus
agctatgcatgtccatgcccatgaacacgtatgtgcgcatgtgtgcacatgtgtctgtgtgtatctgagtgtacagct

SEQ ID NO: 62114 - DNA, 73 bp, Mus musculus
cgggccgctgacacccactcgcacactcagtggaagaggccgcagaggggcggggcggggcaggagagggccg

SEQ ID NO: 62115 - DNA, 60 bp, Mus musculus
tatagatgtgtgtgtgtgcacacatgcacatgtgtgtgtctgtctgtatatgcgtctgtg

SEQ ID NO: 62116 - DNA, 111 bp, Mus musculus
gcggtcttggttgagggcctgggtcagtgcatatcagaagagtgtgagcataagttaaagtttacaggatagaatgtgctttgactttcagaggcctggagagaggagagc

SEQ ID NO: 62117 - DNA, 90 bp, Mus musculus
gtggtagtatgtctgtctgtctttcagcagtagtatatcccccacagtggtcatatgtctgtctgtctgtcagcagtagtatatccccac

SEQ ID NO: 62118 - DNA, 87 bp, Mus musculus
ggctaaaacacacggaacagggctggagagatggctcagtgattaagagcactgactgctcttccagaggttctgagttcaaatccc

SEQ ID NO: 62119 - DNA, 81 bp, Mus musculus
gcagcttggcactgacctgtcggaaatgtgttactaagtctctgactgacactcagtcacaattcagaaggataaagttgt

SEQ ID NO: 62120 - DNA, 115 bp, Mus musculus
gaagagggtggactgttctttctgagggtctgagcttgggtctcagttcctgtgacagacagcacactgcgccctgtaacttcagctccagcggaaggaatccactgccctcttc

SEQ ID NO: 62121 - DNA, 70 bp, Mus musculus
ctcatctgcctgtcacagtcacactggcatccgctttcccggctgagtcccaggtcctgtgcgcatgaga

SEQ ID NO: 62122 - DNA, 64 bp, Mus musculus
actggtgggggggggggtgggcaatggggtgaaggcgtctggactctctctgactctcagcagt

SEQ ID NO: 62123 - DNA, 80 bp, Mus musculus
ctctgtgtctgtctgtctgtcttttattccccctaggaccacgccacaagggatgtcaaggctcaggtctcagtgctgag

SEQ ID NO: 62124 - DNA, 114 bp, Mus musculus
acctccatagcaccctgtggcctgtgtgtttgtgcatatttgcgcatcacacacacacacacatacacatgtgcacacacacacatacacacaggcacaggcacacacacaggt

SEQ ID NO: 62125 - DNA, 79 bp, Mus musculus
gtctgtctctctgtgtgaatgtgtatatgtgtgtatgaatgtgtgtatgtgtgtgtgtatttacatatgggtgcagtgc

SEQ ID NO: 62126 - DNA, 88 bp, Mus musculus
ctatgtctgtatctgtgtatctatggtctatctatctatctatctatctatctagatacatttccactgctgcacagagtaggtctag

SEQ ID NO: 62127 - DNA, 83 bp, Mus musculus
ggggatacagttgcgagacaagggcttgaacccacggtttccaagttcagggttcctctctgtcattcactggctgtgtcgtc

SEQ ID NO: 62128 - DNA, 65 bp, Mus musculus
gtgctgtgtcagtgtctctgtccaatgcctgacctatgtggactagaggcattctgaacttgtgc

SEQ ID NO: 62129 - DNA, 76 bp, Mus musculus
gggctggagcagttggatgtccagagctgagcactcttcgtgagtggttctgtctgtgtgactgagtttcttttcc

SEQ ID NO: 62130 - DNA, 107 bp, Mus musculus
acttatgcatatatgtatgtgtgcatgtatgtatatatctatgtatacatatgtatgattgtgtgtgtattcggtgtttgtacatgtatgcatatgtatgcgtatgt

SEQ ID NO: 62131 - DNA, 64 bp, Mus musculus
cagggacaagatgatcattgggattttgttgccagcccagctacacagtgagactctgtctctg

SEQ ID NO: 62132 - DNA, 66 bp, Mus musculus
atgtgtgtgtatgtgtgtgcatgtatatgtgtgtacgtgtgtgtgtgtatgtgtctgtgtatatgt

SEQ ID NO: 62133 - DNA, 90 bp, Mus musculus
tctagcacattccttcagcctctctgtgcctctcactcttgtgatgattcaattattcagcaaagctgctccttaaagccctgtgctgga

SEQ ID NO: 62134 - DNA, 85 bp, Mus musculus
gtatatgtccatttgtgtgtacatttatgtatatatatatatatatgtgtgtgtgtgtgtgtgtgtcatgtagatgtggatatgc

SEQ ID NO: 62135 - DNA, 82 bp, Mus musculus
gtgtgtgcatatgtgtacgtgtgtgtacgtgtgcatgcatatgtgtgtgtacatgtgtgtatacatgtgtgtatatgcgtgt

SEQ ID NO: 62136 - DNA, 88 bp, Mus musculus
gaactctttagcgcttgaagagataacagcatcggtatgtgcagaaccttttctgcatctgatattcttcatctgttaatgtgaattc

SEQ ID NO: 62137 - DNA, 83 bp, Mus musculus
ggagatgggttagtgggtaaagtatttgctatgtgagcatgggacctgagctcgcatgcagtcacacactggcacacatctgt

SEQ ID NO: 62138 - DNA, 79 bp, Mus musculus
ggaggccttggctgaaacaagatgagagacacagacagactgacaacccagattgtcttctgatctccacgtgcactct

SEQ ID NO: 62139 - DNA, 60 bp, Mus musculus
acacggttgttgagggacctgggacggtatttcgtctctctgagtctctctatcctgtgt

SEQ ID NO: 62140 - DNA, 114 bp, Mus musculus
ctgacagacagacagacagacagacagacagacagacagacagacagacagacagagaaactgttgagactgtttctcttgtgtctacaggtctagagaagggactctgtccag

SEQ ID NO: 62141 - DNA, 84 bp, Mus musculus
ctttgggactcgaggttcattgattagggtagcctggctggccatcaagcccctaggaatgcctctgtctctgactccccattg

SEQ ID NO: 62142 - DNA, 71 bp, Mus musculus
ccttggctgagttagaatcctctctttgaaaatgaaactgttcatttcctgagaggaaaaactcagcaagg

SEQ ID NO: 62143 - DNA, 80 bp, Mus musculus
gtcagcagcccttccttccttgctgtctggccatctgatggacgtgaaaagatggctggctggctggctggctggctggc

SEQ ID NO: 62144 - DNA, 68 bp, Mus musculus
aggcacataaaggtggaaggggagaacatatgcagtccatctgtctgtctgtctttgcacataggcct

SEQ ID NO: 62145 - DNA, 66 bp, Mus musculus
tatgtatatgtatgtatgcatatgtatgtatgtatgtatgtatgtatgtatgcatgtatgtatgtg

SEQ ID NO: 62146 - DNA, 62 bp, Mus musculus
atgtatgtatgtatgtatgtatgtatatgcatgcatgtatatgtgtatgtatatgtatgtgt

SEQ ID NO: 62147 - DNA, 90 bp, Mus musculus
gagatcctacctcccagtctctctctttctgagttgctagctgtggtgccagggaagtcaagggggggcgctattaggaggtgtggcctt

SEQ ID NO: 62148 - DNA, 84 bp, Mus musculus
ggccactctctgtggctctggcagacacagaccggcaaatgaccttgcaggtgcaacgtctaagaagagaaaaggagaagggct

SEQ ID NO: 62149 - DNA, 66 bp, Mus musculus
tatgtatgtacgtatgtatgcatgtatgtataatctatcatctatgtatacacacacacatatata

SEQ ID NO: 62150 - DNA, 135 bp, Mus musculus
gtgtctgtgtgtgcacatatgcatatgcatacgtgtgtatgcatgtgtgtgctcatatgcatgtatgtatgtatgtgcatgtatatatgtatatgcatgtgtgtgctcatgtgtgtgtatgtgtgctcatgtgta

SEQ ID NO: 62151 - DNA, 85 bp, Mus musculus
gtgagattcagggagtataatatatgtgtgtatatgtatatacgatatacatgtatatatattatatacacacatagatctacac

SEQ ID NO: 62152 - DNA, 71 bp, Mus musculus
ttgactctggctcacagtctcagtggaccaagtccatcttggtgaggagggactggagagccagcagtgaa

SEQ ID NO: 62153 - DNA, 84 bp, Mus musculus
agggagagggagggagtgaaagacaaagggaagggacaagaaaagaagtgggctttgtaggtctgtctgtctgtctgtctgtct

SEQ ID NO: 62154 - DNA, 115 bp, Mus musculus
ttgtcagaagttgtattagaagaaaactcaagggctagagagatggctcagcagttaagagcactgactgctcttccagaggtcctgagttcaattcccagcaaccacatggtgg

SEQ ID NO: 62155 - DNA, 113 bp, Mus musculus
gagcgcgggcacctggcttctgtgtgaggcaggactgtgagctcaggtgagtcccggcttctctctctgcctcgctgtctccctccgcagagcgggctgcaggtcccttcctc

SEQ ID NO: 62156 - DNA, 116 bp, Mus musculus
atgtatgtgtgcatggtatggatgtgatgtgtataaaggtatgtaagtatgtatgagtgcatgtgtaagtatgtattggtacatgggtgtgatatgtgtgagatgtgtatgtgtgt

SEQ ID NO: 62157 - DNA, 86 bp, Mus musculus
gggtggctcctcacatctcccccttttcttttatttaaaaggcaacaagccacccagtactgagagtggagatagaggtcaaaccc

SEQ ID NO: 62158 - DNA, 64 bp, Mus musculus
tctgactagagatggaggtggggcatatcgaagcagcaatgccacactgggacactgagttaga

SEQ ID NO: 62159 - DNA, 81 bp, Mus musculus
gtgggttccagactagcatggttgacacagtgagttccaggacagtcagaacacagagtgagatcctgtctggaaaaaaac

SEQ ID NO: 62160 - DNA, 84 bp, Mus musculus
ggccaggagatatgatgactgtctttcataattactaataggagacttattttaatttttaaagacatgcagttctagatggcc

SEQ ID NO: 62161 - DNA, 117 bp, Mus musculus
atctataatgagtcaaagctttttgtttgtctagtttgagacagggtctctctctctctgtgtaacctgtcctggaactcactttgtacaccaagctaaccttgaactcacagagat

SEQ ID NO: 62162 - DNA, 193 bp, Mus musculus
atgtgtgtgtgtgtgtgtgtatatatatatacatatatacatatgtatatatatatacttttatatatgtgtgtatatatatacatatacatatatatatacttttatatatgtgtatatatacatatacatatacatatatatgtatatatatgtgtgtgtatatatatacacacatatatatgtatatata

SEQ ID NO: 62163 - DNA, 86 bp, Mus musculus
gtatatatatatatacatatatatgtgtgtatatatatacacacacatatatatacatatatatgtatatgtatatgtatatatac

SEQ ID NO: 62164 - DNA, 72 bp, Mus musculus
atatatatgtgtgtgtgtgtttatctataaatattgatatatttgttttatttatatacccactatatgtgt

SEQ ID NO: 62165 - DNA, 108 bp, Mus musculus
taagtgtgcatgtatgtgtatgtatgtgtgtatatatatatatatgtatatatatatatatatatatgcatgtgtgtttgagtgagtgtatgtatgtatatatgtatg

SEQ ID NO: 62166 - DNA, 127 bp, Mus musculus
gtgtatatgtatgcatgtgcatgtatgtatagacatatggtacatgcatgtgtgtatgtgtatgtatgtatgtatgtaagtatgatgtgtacatgcatgtgtgtgttatgtgtgtacatgccacagc

SEQ ID NO: 62167 - DNA, 86 bp, Mus musculus
ccgtggcacattgtgtggaggccggaggcttgcagaatgcagacacatgcattctaaatggcctctctctgtatgtcagtccacgg

SEQ ID NO: 62168 - DNA, 72 bp, Mus musculus
catatatgtgagtgtgcatgtgtgtatgtatatatgtgtatatatacatgtatatatgtatagtagtatatg

SEQ ID NO: 62169 - DNA, 64 bp, Mus musculus
gcaggcagggggaggggagactgtccatgtgtgcatctgtgtctgtctgtctgtctgtctgtct

SEQ ID NO: 62170 - DNA, 79 bp, Mus musculus
tgtgttcagtgttccagaaccgaatcaaacagacatggagacacatgcctgtgacactggcactctggaagtgggggca

SEQ ID NO: 62171 - DNA, 64 bp, Mus musculus
ctcacattctgacccactctgtctcccacggaagatctgacttctgaccgacgaggagtgtgag

SEQ ID NO: 62172 - DNA, 68 bp, Mus musculus
agtggccacagaggggctttcttactatgtgtggaatgactggccagcaagtcacactctgtgaccct

SEQ ID NO: 62173 - DNA, 57 bp, Mus musculus
gccagtctgtctatggaggggatgggcagtgtctctctccctctctgaaagcatggc

SEQ ID NO: 62174 - DNA, 106 bp, Mus musculus
gtgggtgtgaaagccagaagaagacagtatcaggtgttgttccttaggtgacatccaccttctctgtctgtctgtctatctgtctatctgtctgtctgtctgtctg

SEQ ID NO: 62175 - DNA, 71 bp, Mus musculus
ccccaagcaggcttggagccacaaacccgaggctgaattctagttctgtggctcactggctgactgagggg

SEQ ID NO: 62176 - DNA, 107 bp, Mus musculus
ggggatcctctcactgtctcacacggggatcctccactgtctcacacggggatcctctctcactgtctcacacggggatcctctcactgtctcacacggggatcctc

SEQ ID NO: 62177 - DNA, 93 bp, Mus musculus
gggtagaggctgtcgtgctggctcctaagcaagtccatgtgacacgtctctgtgtctgacactaactgctatacgccggtccccagagagccc

SEQ ID NO: 62178 - DNA, 57 bp, Mus musculus
agagaatgccacaagtgaatgagcacatgtgtgcatccattcattgctgtatgctct

SEQ ID NO: 62179 - DNA, 97 bp, Mus musculus
atgtgcacgtatgtgtatatatatatatgtatatatatcacacaaacatacacagacacacatatatatgtatatatacatatatccttatgtacat

SEQ ID NO: 62180 - DNA, 90 bp, Mus musculus
tatatgtatatatacatatatatgtgtgtctgtgtatgtttgtgtgatatatatacatatatatatatacacatacgtgcacatatatca

SEQ ID NO: 62181 - DNA, 106 bp, Mus musculus
gggaggggtggacattggagtatgtatgcacatatatgtatatgaatatatgtatacatatatatgaatatgaatgtgtgtgtgtgtatttcagcccaccccactt

SEQ ID NO: 62182 - DNA, 80 bp, Mus musculus
gtatatatgtgtgtatatatgtgtctgtgtatgtatatatgtatgtatgtatgtatgtatgtatgcatgtgtgtatgcac

SEQ ID NO: 62183 - DNA, 91 bp, Mus musculus
gtctcagggtgcagctcctgtctcctcacttccctgtgtgtaattccttaagagcgtagaagtgtttgtggttgtataatcctgttaggac

SEQ ID NO: 62184 - DNA, 114 bp, Mus musculus
tgaagagagctgaccagccctgcctgccctgctgggttatgcaaggccattagtctgactgatgtgtttttcttgtattgccttgggccctccccccactgtgctgttttgtca

SEQ ID NO: 62185 - DNA, 88 bp, Mus musculus
tgtgcatatatatatatatatatatatatatatacatatatacatatataatatatgatatatactatgtatgtactatatgtgcaca

SEQ ID NO: 62186 - DNA, 169 bp, Mus musculus
cacaggtatatgtgcatgcacgtgtgtacatgtgtgtatgtgtgtacatatgtgtgcatgtgcatgtgtatgtatgtgtgcacatgtgtttacagatgtgtgtgtgcagatgtgtatgtgtgtatgcctgtgcatgtatgtgaatgtgtgtgtgcatgcatatgtatgt

SEQ ID NO: 62187 - DNA, 74 bp, Mus musculus
actgtgtgtgagtgtgtgtctgtgtgtgatatgagtgtggttcatgggctcacatggcaaggctgggacagggt

SEQ ID NO: 62188 - DNA, 68 bp, Mus musculus
ggtttccatgcctgtctcactcacgctctgtgtggttattctgcagaccggatgtgaggtcatgggcc

SEQ ID NO: 62189 - DNA, 77 bp, Mus musculus
ctttgtctgataggagtcatgtctgttgatggctttgaagctcagagaagtcacactgcatgacactgtcctctgag

SEQ ID NO: 62190 - DNA, 76 bp, Mus musculus
agtgcttgcttgataggattgtagagtgggtaagctgaagccaccataagacaaagacttcaaggaatccagcact

SEQ ID NO: 62191 - DNA, 97 bp, Mus musculus
tcactgtggtggccaggatggcccagcatgtgtcagtgtagagatgtcagaagacagactgcaggcagaaaatgcttggcttttgcactgtcagtga

SEQ ID NO: 62192 - DNA, 79 bp, Mus musculus
cgccctcacagtctctgagtttaaggaattactaccctagtaggggcaggactttttagatcagacactcggagtcccg

SEQ ID NO: 62193 - DNA, 86 bp, Mus musculus; identical to SEQ ID NO: 62157

SEQ ID NO: 62194 - DNA, 68 bp, Mus musculus
gtatgtatgtatgtatataatatatgtgtatacataaatgcacatgtatgtatacttgacagacagac

SEQ ID NO: 62195 - DNA, 58 bp, Mus musculus
atgtatatatgtatgtatgtacatatgtatatatgtgtgtatacatatgtgtgtatat

SEQ ID NO: 62196 - DNA, 79 bp, Mus musculus
ggcagaagacagtgtcagcagagagggcccgcacagagggtgatgccggcggtcctgcagtcctgcttgttgtcagttg

SEQ ID NO: 62197 - DNA, 92 bp, Mus musculus
ggctctgagggcttaacttcagcatggcggtcacacagtccctcactaggacagtcaggacaggaacttgaagcagagaccacaaaggggtc

SEQ ID NO: 62198 - DNA, 74 bp, Mus musculus
gtggagggtacctatgtatacatgcatgtatgtacatgtgtgtatacatgtgtgtgtatgtgcatgtgcttcat

SEQ ID NO: 62199 - DNA, 87 bp, Mus musculus
gggtagagcaggttgagatccggagcctcagtgggcacatacctgagacttaggcgactctccctccctctgacagattcttggccc

SEQ ID NO: 62200 - DNA, 60 bp, Mus musculus
tatgcatatatgtgtgtgtgtgtatacacacacaaacacacacacacacatatagatata

SEQ ID NO: 62201 - DNA, 84 bp, Mus musculus
gggcatctgcatcaaattctctcttcccgagtttcggagatctttgaagaagagggtgtgtagagagtgaggtattggatggct

SEQ ID NO: 62202 - DNA, 58 bp, Mus musculus
gtgtacacatgcacatgatatactctagtgtgtgtgcacacatgtgcatgctgtgctc

SEQ ID NO: 62203 - DNA, 82 bp, Mus musculus
caatggtaaccctaaccagcacaatgggattcagagttaccatggaaacagactctgtgcctgtctgagagtgtcatcattg

SEQ ID NO: 62204 - DNA, 65 bp, Mus musculus
gtactggctttgctgtcctgtcacctgtagtgaggaagcgtgacagacaagagagacaacagtgc

SEQ ID NO: 62205 - DNA, 96 bp, Mus musculus
ggtctgtcttgctggtcatctgctaattcctgcacagtgttggacctctgtcctctctgcctccgtgtctggattgctgctgcgctccctcagagc

SEQ ID NO: 62206 - DNA, 95 bp, Mus musculus
gtatgtctttctgtgtctttctgtgtctgtgcctgtgtatgtgcctgtatttgtgactgcacatgtgtgtaagggcacatgcacatgtgatgtgc

SEQ ID NO: 62207 - DNA, 96 bp, Mus musculus
gagtgtgggcagtgctctgtaaggctgactctcagtcactgattctaggtctcctgggttgtgcacatagagtcagggagtcttgtaagtaaactc

SEQ ID NO: 62208 - DNA, 60 bp, Mus musculus
gtatatgtgcatgtccatgtgtgtgagtataggcatacgcatgtggtggtacactcatgc

SEQ ID NO: 62209 - DNA, 106 bp, Mus musculus
tgtatatatatatatatatatatatatatatatatatatatgtatgtatacacacatatacgtgtatatatgtgtgtgtgtatgtgcttgtgtaagtctgtatgca

SEQ ID NO: 62210 - DNA, 110 bp, Mus musculus; identical to SEQ ID NO: 61631

SEQ ID NO: 62211 - DNA, 75 bp, Mus musculus; identical to SEQ ID NO: 61632

SEQ ID NO: 62212 - DNA, 77 bp, Mus musculus; identical to SEQ ID NO: 61633

SEQ ID NO: 62213 - DNA, 90 bp, Mus musculus
cctcaactaagctctcctcactctctggctctctgggtgtggccaaagggcagcttcttgaaaaagtcagagagtaggagaaggtccagg

SEQ ID NO: 62214 - DNA, 77 bp, Mus musculus
gccttgtggccatgtcactctgtgtgtgtgatttcttaattgcttattgatgtaggagggctcagcccactatgggt

SEQ ID NO: 62215 - DNA, 80 bp, Mus musculus
atgtatatatgtctgtctgtctatatgtgtgtacatatatatgtatgtaggtatatgtatatgcatataagtatgcatgc

SEQ ID NO: 62216 - DNA, 98 bp, Mus musculus
cctgccccatcccccacaatggcctacccagctctgacctcatcctgtctccagtgacaggcttcaaagcagggtctatagaccatgaagatgctagg

SEQ ID NO: 62217 - DNA, 74 bp, Mus musculus
ggaaggggaaaattgagataaaagagaataaaagggagtcaggtgggctgcctctcacgctcagttattcatcc

SEQ ID NO: 62218 - DNA, 72 bp, Mus musculus
tcttggttctctccttcactctagcatcctccagaaagatggtgacagagattgaagaatgaaagctcagga

SEQ ID NO: 62219 - DNA, 69 bp, Mus musculus
ttgggggctgtgtgtgtgtgtatgcatgcatgcatgtatgtatgtatgtgtagcactggctgtcctgaa

SEQ ID NO: 62220 - DNA, 97 bp, Mus musculus
ccaagcagtaagttctctggcttaatgtctctgtggatcactctctttgaatgacagtaagacagagcgtttgccaactcagtgatgtactgttggg

SEQ ID NO: 62221 - DNA, 105 bp, Mus musculus
catagtttccaaaagaatgataccttggggaaacaggcttggaaacaaaagtagagagtctatattttattttaaagctcctttctgtgtatctgggaaagtgtg

SEQ ID NO: 62222 - DNA, 85 bp, Mus musculus
aggcctgaaacaggctggactagaactcactttgtagttcagatgacccctggacctgtgtgtgatcctcctgcctcagactcct

SEQ ID NO: 62223 - DNA, 114 bp, Mus musculus
cttggtgtcctatggatgttctttgatggctacaagcaaggggttctcctctgtaacactctctttgtggggttgatctcttggggtctcctcatgggtgtctatgactcttag

SEQ ID NO: 62224 - DNA, 77 bp, Mus musculus
agcacagaattacactggaaggtcccagagtgagaggcccctctgggtcaggagcagacagtagtgacagtggtgtt

SEQ ID NO: 62225 - DNA, 96 bp, Mus musculus
gcagagagctgagcgctccaggctggcgtgaggaagcagggctctgtctgtctgtcactttatggtgtgtgtgtgtgtgtgggggggtgtctctgt

SEQ ID NO: 62226 - DNA, 68 bp, Mus musculus
catgtgtgtgtgagcatgtgcatgtgtgtgcatatgtgtggacacgtgtgcatgctcaggtgtccatg

SEQ ID NO: 62227 - DNA, 132 bp, Mus musculus
ggagtggaaggaaggctgccaggggctcagctctgccgccccctagggagcctgcagtcactcacactctggcaacgcaggtcggtccctctcattgggacgagactggagccgcccaggtgtgtgtgagtg

SEQ ID NO: 62228 - DNA, 75 bp, Mus musculus
gtatatatgtatatatatatttatatatacatgtacatatatatgtgtgtgtatgtatatatatatatgtgtaca

SEQ ID NO: 62229 - DNA, 87 bp, Mus musculus
acaactaatgctccctgattagccatgtgtgtgtatatatatttgtgtatacatgtctatgtgggttaggcgaatctgtgtgtgtgt

SEQ ID NO: 62230 - DNA, 76 bp, Mus musculus
gagctgctggcatctttcatgggcggggaggaagggttgagttcttgtctgtctgtctgtctgactgtctgcattc

SEQ ID NO: 62231 - DNA, 106 bp, Mus musculus
gatgtgaacaactggctcctgctgaacctgcagctctcttcttcagtcaatgtctctctttgattccccagagccagcttacagccagcagaacacatagcacatc

SEQ ID NO: 62232 - DNA, 72 bp, Mus musculus
gctctccttcactctgtgagacaaggttatagccaaccggacagtcctccttgtctcctcgaggatatgagc

SEQ ID NO: 62233 - DNA, 58 bp, Mus musculus
catatgtatgtatgtatgtatgtgtgtatatacaaatgcatgcatatctgtatatgtg

SEQ ID NO: 62234 - DNA, 92 bp, Mus musculus
ccacccacctggagggttaagggactcgccctcagtcactctgagggtagacaaacttcccgatgcccgcaggaggaaaaacaggaccgtgg

SEQ ID NO: 62235 - DNA, 65 bp, Mus musculus
gtgggggcggggatgtgtgcaggcttcaatgttattgtttgacctgctctctctctgacactgac

SEQ ID NO: 62236 - DNA, 122 bp, Mus musculus
gtgcgtgtgtatgtatgtgtgtttatgtgtgtgcatgtatgtatgtatgtatgcatgtatgcatgtatgtatgtctgtgtgtgtatgtctgtgtgtgtatgtatgtatatgtatgtgtatgc

SEQ ID NO: 62237 - DNA, 84 bp, Mus musculus
gtgagtagaatactccaagcctctgactgtctcagagactttgctgttgcctctgcctagaccttagaggtttgcttagctcac

SEQ ID NO: 62238 - DNA, 75 bp, Mus musculus
tttcagagtggggagaatgtacaggagggtggggggcagcagctgactcagtcagcctctgggactcactggaaa

SEQ ID NO: 62239 - DNA, 74 bp, Mus musculus
ggtatgttttatggtcacacattgtcagtgtcttgagccctgcccgctctcagtctgtgactttggacctgtcc

SEQ ID NO: 62240 - DNA, 56 bp, Mus musculus
gcagtggtggcactacctagcagagtcagccaggctcagcctctgtcactgtctgc

SEQ ID NO: 62241 - DNA, 76 bp, Mus musculus
taagcttggtcacaggcacactgtcactgtccctaacacagcagttcaggttcatgttgtcatgtgccagagttta

SEQ ID NO: 62242 - DNA, 116 bp, Mus musculus
cacagggctaggactcaggtgggttttgaagtgcaggctgtgactgtacagagtgttctctggtgtgcaggcccctttcccagctgctgctgccaccattggcctgaggacctgtg

SEQ ID NO: 62243 - DNA, 79 bp, Mus musculus
gaggtattgggtaaaggtgtgtctccctccctcttactcatgtttagggaagttcagggcatggcactcccaaagtctc

SEQ ID NO: 62244 - DNA, 102 bp, Mus musculus
tgaaaatacactggattccctggaactgactgactgactgccacccagcgagggtgctggcattcaaattgcagccttcacgggactagccatcattcttca

SEQ ID NO: 62245 - DNA, 57 bp, Mus musculus
tcctctctctgtgtgtgcctggcttcatgttggtgctgacaaacagagagttgtgga

SEQ ID NO: 62246 - DNA, 69 bp, Mus musculus
tggggtttctccctctctgtcagccgagatttctcctggtgggctgagagtgctttcgagatgccacca

SEQ ID NO: 62247 - DNA, 71 bp, Mus musculus
ggagacataacactccccaacacatggattgattgattgattgactgatgtgtctctgtgtctgtgtctct

SEQ ID NO: 62248 - DNA, 78 bp, Mus musculus
cagctgtctgtctgtctgtctgtctagtcgcaaagctggggttgtagcaggtcctgcaggcctctttcagagcggctg

SEQ ID NO: 62249 - DNA, 115 bp, Mus musculus
ggagtggccatggcgatgcgtcccgggtttccgtgcgtatgtagagtgcgctagtctgtctgtctgagtctccgcgcgtcttttggtgtctgtggttcagagtcgcggtctgtgc

SEQ ID NO: 62250 - DNA, 84 bp, Mus musculus
tgttggaggaagtgcgtcactgtaggggtgggctttgagatctcatgctcaagctctgtccactgtgactcagtctctctttcg

SEQ ID NO: 62251 - DNA, 104 bp, Mus musculus
gtatatgtgtgtgtgtatacatgtgtgaacgtttgtgtgtatgtatacatgtgtgtatgtttatgtgtgcatggatgtatatgtgtgtgtgcatgtgtatgtat

SEQ ID NO: 62252 - DNA, 110 bp, Mus musculus
tcaaagtctagccacctaactcagtgatgccccagtctcactttgtctctgggatggctgccagtgaggatggtgacagggcgggacagagaggcatgctcagatcctga

SEQ ID NO: 62253 - DNA, 91 bp, Mus musculus
ggccttgttggaggaagtgtgtcagtgggggttggctttgacagttcagatgctcaagccactttcagtgtcactctctcttcctgctgcc

SEQ ID NO: 62254 - DNA, 75 bp, Mus musculus
ctgggtgatgagaaagctatggaaatgcatccggttaaaatgctgccaggcgctccacagtcactctctccctgg

SEQ ID NO: 62255 - DNA, 109 bp, Mus musculus
tgtgtctgtatctgtccctgtcccatccctgtccctgtctccgtctctctgcctcccctttgcagatcaagatgtgagctcccattggaagcacctactatgctggcca

SEQ ID NO: 62256 - DNA, 61 bp, Mus musculus
gtgtgcagtcaatgctggctctgtctgtctgtctttgatagtgactggccagggtgcacat

SEQ ID NO: 62257 - DNA, 115 bp, Mus musculus
tcattagaacgcttgctgcttctcctcctgctgctcaggctcaggtattacctgcctgcctgcctgcctgcctgccgcattgagagcgagcagcacaaccctgctctgctggtga

SEQ ID NO: 62258 - DNA, 67 bp, Mus musculus
actgtggatgcagtgtgacttgctgccttatgatctagccaccaagactcacactgtgggtcacagt

SEQ ID NO: 62259 - DNA, 75 bp, Mus musculus
gtagtatgtggccctttggtcaccagagacattgtgtgtgtcactgtgtgacaaaagaggtttcatggaacctgc

SEQ ID NO: 62260 - DNA, 78 bp, Mus musculus
tagtggtgatgcagatggtaaagattcccatccagggctgaacactcagtctcattctctgtcatctgactgctgcta

SEQ ID NO: 62261 - DNA, 93 bp, Mus musculus
tagcaagggataaagtacatatagtggaagttggagggatgtatcttttcatgttggtatgcctctgtctgtctgtctgtctttccctatcta

SEQ ID NO: 62262 - DNA, 102 bp, Mus musculus
tatctatatatctataatgtatgtagatatagatatttgtataaatgtatgtaatatgattgtatacatggatgtatggatatatagatggatgtatagatg

SEQ ID NO: 62263 - DNA, 92 bp, Mus musculus
tctctgagccttagtggtgatgcagattcccatccagggctgagcactcagtctcattctctgtcatctgactgctgctaattgtgatgaga

SEQ ID NO: 62264 - DNA, 68 bp, Mus musculus
gtatttactgtcactctctgtgtgctctgtgtgccgtggggtccaaggggagagttagaactgggtgc

SEQ ID NO: 62265 - DNA, 115 bp, Mus musculus
tcacaagggtggtgctgtggagtcaaacagcccaccaagcagctgtggggttcagagaggaaagagtgcccacggtgagcaaggtgtgcagattcccatgtgattgcctctgaga

SEQ ID NO: 62266 - DNA, 119 bp, Mus musculus
ctaagaattccattagacagagttgatcagagactttgttgtttgaatgaatgaatgaatgaatgaatgtgtatgtaggctgccaaaggctgggcgatctctttgggctgggagggtgg

SEQ ID NO: 62267 - DNA, 100 bp, Mus musculus
agccatttctgaacttggggcttctgttttgttctttgtgtgacctctctcacaggctcactctgatgaaaccgagaggcccaagtggtaaggagtggct

SEQ ID NO: 62268 - DNA, 78 bp, Mus musculus
gaggacctttgttacacatttgtaaaagcacatattttaaattagtgtagaaagaagtgtgtttccacaagggttttc

SEQ ID NO: 62269 - DNA, 71 bp, Mus musculus
ccagcagaaggcatagtggggtcagtcagtgctgctggggtctcagaaagcctgggtccctgcttggctgg

SEQ ID NO: 62270 - DNA, 99 bp, Mus musculus
tatgtatgtatatgtgtatatgtgtgtgtgcatgtgtatggatatatgcatgcatgcatgtatgtatgtatgtatgtatgtatgtatgcatgtatgtgc

SEQ ID NO: 62271 - DNA, 115 bp, Mus musculus
ttgggtttcctcagggtctgctgttacgacctttccatttctgattttgttaatttctctctctgccttttagttagtttggaaaagggtttgtccttcttgttgattttctcaa

SEQ ID NO: 62272 - DNA, 112 bp, Mus musculus
gtgaggtgattaaatgagtgcaggtggttgccatagaagcctgactgcctgagttctgctcccagatcccacagtagacagagacgacctgcacctccaacctgcaccccac

SEQ ID NO: 62273 - DNA, 112 bp, Mus musculus
gaaagtactgaagtctggggacttcctgggcttgatgtctgatccctgtctcaagtcagattagagtgaacacaggaggtaaaaacgaactcacagacattcagtgaaagtc

SEQ ID NO: 62274 - DNA, 115 bp, Mus musculus
ctatgtggaaggtgacaagagggcctttctggagggccccccctcaatcctgttgtgctcgcttcagagggttgggtggaggctctcctgaaggtgtccgcagagcgtcgcatgg

SEQ ID NO: 62275 - DNA, 108 bp, Mus musculus
gaggcataagaggcccaggcctttggcagaggagggctgttcttcccttgagttttatgactgggaggaactagccttctctcagcttaggagtgggccaacagcttc

SEQ ID NO: 62276 - DNA, 118 bp, Mus musculus
ctaattaccaattctgtgagctactgatgtatgtatgtatgtatgtatgtatggatggatggatagatgtatgtatgtatgtatgtatgtatggtcagatggatgagtgggtgggtag

SEQ ID NO: 62277 - DNA, 68 bp, Mus musculus
gtatatatctgtgtgtgtatgtgtctctgtgtgcctatgtatatatatatatatatatatgtgtgtat

SEQ ID NO: 62278 - DNA, 78 bp, Mus musculus
cttcagaatagcttggtatgtcttcagacccctcaggccaagggttcagtccaaggtgtcagaagacagtctctggag

SEQ ID NO: 62279 - DNA, 113 bp, Mus musculus
ggttggtagctgctaagtgtaatttgttttacctgggggattatatatatatatattcagtactttgagtgatttcttggggagataatgttttaagggctgctgagagggcc

SEQ ID NO: 62280 - DNA, 76 bp, Mus musculus
gagatatgggtcgggctggagagatggctcagcggttaagagcaccactgactgctcttccagaggtcctgagttc

SEQ ID NO: 62281 - DNA, 81 bp, Mus musculus
gccgtatcatcagcttgacactctctctctccttaaatcgcatgtaggagaacggaagtggaaaatttggtgcactgcggt

SEQ ID NO: 62282 - DNA, 80 bp, Mus musculus
tcctgacctttccctccctgtgtgccacagctgtctgctgcagcccgtcacggcatattgcatggaggtataagaaggga

SEQ ID NO: 62283 - DNA, 68 bp, Mus musculus
ggtgtgtgcatatgtgtgggtctgtgagtctgtgggtggaagcatgctacatcacaaatgtggagacc

SEQ ID NO: 62284 - DNA, 61 bp, Mus musculus
atagattggacagatagacggatagatgtctgtctatctatctgtctgtctgtctgtctgt

SEQ ID NO: 62285 - DNA, 114 bp, Mus musculus
tttgggagttcaggtgagccatgatgcctcagtcttgcccaagctcatcctcatgagagaagtctgggagcagcctgaagttcctcatgcttgccttcattttctctggaaagg

SEQ ID NO: 62286 - DNA, 71 bp, Mus musculus
agactgactgactgacttacttaagtggttgatggatcggttggctagttagttagttagttagttagttt

SEQ ID NO: 62287 - DNA, 108 bp, Mus musculus
ggccactcagaaagcacaggcctccagtctgtctggtgcggatacctctggggaagagagttcatcagagaacacagagaggacagtgggcataaagtctgtaaggct

SEQ ID NO: 62288 - DNA, 67 bp, Mus musculus
cttaaggctctgtctctgactgacatgatgggctcaccctcagcagcctcaacggatagagcagaag

SEQ ID NO: 62289 - DNA, 72 bp, Mus musculus
gtagtcaagagcagagagagagagttaatacatatctatttctgtttgactcactttctctcactcttacac

SEQ ID NO: 62290 - DNA, 62 bp, Mus musculus
tttctacatacatgtatatatgtatatagtgtatatatgtatatatggaatgtgtgtataga

SEQ ID NO: 62291 - DNA, 71 bp, Mus musculus
tatgcatatatttgtatgtgcatgtgagagagaatatatgaatgatatgtatgtgtgcaagtgtatgtgtg

SEQ ID NO: 62292 - DNA, 58 bp, Mus musculus
atgtgtgtgtgtacaaacacgtatgtatgtatgtatgtatgtatgtatgcatgcatgt

SEQ ID NO: 62293 - DNA, 85 bp, Mus musculus
ggccatagtggtctgataggatacatgggacaatttcaatatttttgtatctgttgaggcctgttttgtgaccaattatatggtc

SEQ ID NO: 62294 - DNA, 85 bp, Mus musculus; identical to SEQ ID NO: 62293

SEQ ID NO: 62295 - DNA, 67 bp, Mus musculus
tgagggatgatcatgttgatgttcttggattctggctaagggtttatctatattgatgattccctca

SEQ ID NO: 62296 - DNA, 85 bp, Mus musculus; identical to SEQ ID NO: 62293

SEQ ID NO: 62297 - DNA, 67 bp, Mus musculus; identical to SEQ ID NO: 62295

SEQ ID NO: 62298 - DNA, 85 bp, Mus musculus; identical to SEQ ID NO: 62293

SEQ ID NO: 62299 - DNA, 67 bp, Mus musculus; identical to SEQ ID NO: 62295

SEQ ID NO: 62300 - DNA, 85 bp, Mus musculus; identical to SEQ ID NO: 62293

SEQ ID NO: 62301 - DNA, 72 bp, Mus musculus
gatgtccatccgtgacactctagtgaagtggtgggggactctcccactgtctcactgtctgtgtggtacctc

SEQ ID NO: 62302 - DNA, 85 bp, Mus musculus; identical to SEQ ID NO: 62293

SEQ ID NO: 62303 - DNA, 67 bp, Mus musculus; identical to SEQ ID NO: 62295

SEQ ID NO: 62304 - DNA, 85 bp, Mus musculus; identical to SEQ ID NO: 62293

SEQ ID NO: 62305 - DNA, 67 bp, Mus musculus; identical to SEQ ID NO: 62295

SEQ ID NO: 62306 - DNA, 72 bp, Mus musculus; identical to SEQ ID NO: 62301

SEQ ID NO: 62307 - DNA, 77 bp, Mus musculus
tctaatgttattaatgcctttgtgttttctagatctggatatctgagacaacagtctgggcagtgataagagttaga

SEQ ID NO: 62308 - DNA, 85 bp, Mus musculus; identical to SEQ ID NO: 62293

SEQ ID NO: 62309 - DNA, 72 bp, Mus musculus; identical to SEQ ID NO: 62301

SEQ ID NO: 62310 - DNA, 85 bp, Mus musculus; identical to SEQ ID NO: 62293

SEQ ID NO: 62311 - DNA, 72 bp, Mus musculus; identical to SEQ ID NO: 62301

SEQ ID NO: 62312 - DNA, 67 bp, Mus musculus; identical to SEQ ID NO: 62295

SEQ ID NO: 62313 - DNA, 72 bp, Mus musculus; identical to SEQ ID NO: 62301

SEQ ID NO: 62314 - DNA, 106 bp, Mus musculus
tgtgtattttctttggatgctagttcagactctggaagcaccaggggttaaggtagttgatactattggtttttctgtggagttcctatgcattatggagaacaca

SEQ ID NO: 62315 - DNA, 72 bp, Mus musculus
agttgtcagctgtgtctctctcagcgaagtgaagaacagcaaagatgagagacccacaagcattgcacagct

SEQ ID NO: 62316 - DNA, 67 bp, Mus musculus; identical to SEQ ID NO: 62295

SEQ ID NO: 62317 - DNA, 73 bp, Mus musculus
ggagtatgtcaaaatgatgctccaatgaacgtgagggagcagctgtctccctcactgactgggttcatactcc

SEQ ID NO: 62318 - DNA, 102 bp, Mus musculus
actgaagatcagccttcatctgtggtgtttctgataggatgcatggaagtatttcaatatttttgttctgttgaggcctgttttgtgaccaggccagtcagt

SEQ ID NO: 62319 - DNA, 87 bp, Mus musculus
ggtgggtatgtatagtatgtgtgtatggtgtatatatgtttggtgtgcatgtgtgtgtagagtgtgtgcagtgtgtatatgaaaacc

SEQ ID NO: 62320 - DNA, 99 bp, Mus musculus
ggaggaacatgagtatacatgtggcagcccaaaagatacttatatattttagaataccagatcttcaggttgtcagcagagtgtgctgggctccaatcc

SEQ ID NO: 62321 - DNA, 58 bp, Mus musculus
gtcttctccactcagtgatcttgtctgtggtggtcagggtctctctgtgtggcagggc

SEQ ID NO: 62322 - DNA, 108 bp, Mus musculus
ttgagatatgacagtaccagaaatttccaggaggtttgaagtcagtcagcacagacagctattgtacaaaaatctacccacagatttcatactagtacagccattcaa

SEQ ID NO: 62323 - DNA, 100 bp, Mus musculus
gtgtgtgtatatatatatgtatatatatatacgtgtatatatgtatatatacatatatatatgtgtgtgtgtgtgtgtgtgcatgtgtgtgtgtgtgtgt

SEQ ID NO: 62324 - DNA, 81 bp, Mus musculus
cacatgctctcaacatgcatgtgtgtatgtgtttgctacatgagtgtacacatgtgtgtgcgtgtgcatgtgtgtgtatga

SEQ ID NO: 62325 - DNA, 98 bp, Mus musculus
gaccagacctgtcctgctcaaagctcggccaatacacagtgtacacagtaggtgctcagtcaatgtgaggtcagctttaaagtgtggaaggccttgtc

SEQ ID NO: 62326 - DNA, 87 bp, Mus musculus
ttgtctttgaacttgtgatctctctgcctcagcctcagcctctagagtagctgggactgcaggtctgcagagatatagctaaagcag

SEQ ID NO: 62327 - DNA, 78 bp, Mus musculus
agggtggtagatgacctgtcccagagcccacgttcacagggatagagagtgggctctgggactcacactcactctgcc

SEQ ID NO: 62328 - DNA, 59 bp, Mus musculus
ggagcctggctgactcagtgtgtgacctgacctggtccacactggcagtcttcactgcc

SEQ ID NO: 62329 - DNA, 96 bp, Mus musculus
ttaaaagtattgggcttcgcacagtgtatctgtctgtatcaggaacaatcattgatgcttcagacattttctttctgctaggtgtagtgatcttaa

SEQ ID NO: 62330 - DNA, 117 bp, Mus musculus
catgatggcgggtgagctccctaagaatactcacaggctggagagatggctcagctgttaagagcactgactgctcttccagaggtcctgagttcaattcttagcaaccacatggtg

SEQ ID NO: 62331 - DNA, 85 bp, Mus musculus; identical to SEQ ID NO: 57439

SEQ ID NO: 62332 - DNA, 103 bp, Mus musculus
gtgaatgatcatgtatatcttatctacagctatgcttgctacatacatgtgtgtgcacacatgtctgtgtgtatatggatgtgcatactcatagacctatcac

SEQ ID NO: 62333 - DNA, 62 bp, Mus musculus
tgtgtgtatgtctgtgtgtgtatatatatatatatatatatatatatatatatatatatata

SEQ ID NO: 62334 - DNA, 62 bp, Mus musculus
gggtggaggagagtattggactttccttgatcggtttctggaacaatctctctctctctctc

SEQ ID NO: 62335 - DNA, 96 bp, Mus musculus
atgtgtattcctgtgtagatgtgtctgcatgtgtattcatgtgtgtgtgtgtgtgtctatatgtgtgttcctgtatgtgtatctgcatgtgtgtat

SEQ ID NO: 62336 - DNA, 68 bp, Mus musculus
gtcagtgggtcagtgggtcagtgttggcttctcttacacaggacctatgatctgatcccagcactgac

SEQ ID NO: 62337 - DNA, 94 bp, Mus musculus
ccctactgcagccatatgcctctccctctgactctgaggagcctttggtgatggtcttggggtggggcagagatagaacgggttggaagagagg

SEQ ID NO: 62338 - DNA, 133 bp, Mus musculus
ggttctctgagtcacctggtgccattgttactggaagatagtcaataataatatcactcagaccctcagacacttagttcagagctctggcccagcattgtagacagttcttccaaccaagactgggcagaag

SEQ ID NO: 62339 - DNA, 82 bp, Mus musculus
ttatatatgtctctctctatctctatctagatctagttcagatgatatagatatagattagatataggtatgatatagatgg

SEQ ID NO: 62340 - DNA, 116 bp, Mus musculus
gggtccatgtgcatgtgtgtgtgtatgtgtgtacatgtgtgtacctgtgcctgtgtgagtgcctgtgtgtaagtgtgcatgtacctgtgtgtatgcatgtgtgtgtgcatgtgcct

SEQ ID NO: 62341 - DNA, 91 bp, Mus musculus
cctgtggccagccttctctctgtcacactgtggtattgatgatactcacctgcaatgacctgtgtgatcataatcacttggctcaatcagg

SEQ ID NO: 62342 - DNA, 71 bp, Mus musculus
tgcgtgtacatgagcgtgcattgcatgtgtgtgaatatgcatacatgtgtgtgcaagtgcatgtgtatgta

SEQ ID NO: 62343 - DNA, 100 bp, Mus musculus
gtctctgaaaatggaatgctttcccccaaagtctctcagtctctctgctctctcaagaggtacctgttgggggttagagacatagctcagtgactaaggg

SEQ ID NO: 62344 - DNA, 80 bp, Mus musculus
gcatgttcaggcctcatgggagctgggacccccacagtcagtctctccatgaccactggctgcacaggccacactgccat

SEQ ID NO: 62345 - DNA, 87 bp, Mus musculus
tatccacatgtgtgtgactgactgtgtcactagaggacacctgtagagaggtgggtttgggaagaggtacatatgcatttagagata

SEQ ID NO: 62346 - DNA, 70 bp, Mus musculus
ccaaagcttcagcaccatggaggtgggggttggggactcagaccctctgtggctgtgggttgaagcctgg

SEQ ID NO: 62347 - DNA, 106 bp, Mus musculus
agagaaggagcagcccagtaggtcactaaacatcactgcagattataaagtagtttttatgaatttataaggtggtggcatcttgggggaaataagacccttttct

SEQ ID NO: 62348 - DNA, 149 bp, Mus musculus
tgtgagaatgtgtgtgtgtgtgtgtgcatgtgtatctgtgtgtttgtttatatatatgtgtatgtgtgtgtatctgtatatatgtgtatatgtatatgtgtgtatctgtatatatgtgtatatatgtgtgtgtgaatgtgtgtttgtgt

SEQ ID NO: 62349 - DNA, 62 bp, Mus musculus
ctctgtgtctttcactgtgattagctacagtcaggagagcagctgtggtttgtcaaacagag

SEQ ID NO: 62350 - DNA, 95 bp, Mus musculus
gtatgcatgtgtgtgtctgtgtgtgaatctgtgtgtatgtgtgtgtatctgtgtgaatgtgtgtgtgtgtatgtgtgtggtacatgtgtgtgtgc

SEQ ID NO: 62351 - DNA, 93 bp, Mus musculus
atggacctgaggtctgtgatgtgtgtgaggataccagctgcatttatttccactgctcaaggggagctgagtcttcatgatgacaggtgccat

SEQ ID NO: 62352 - DNA, 65 bp, Mus musculus
atatgtgtactgtatatatgtcatatgcatattgtatgtatgttgtatgtatgctgtgtgtatat

SEQ ID NO: 62353 - DNA, 75 bp, Mus musculus
ttggcatgcaggtgttggagaggacacagggagcatgcctgagacactctgtgacatcctctctctgtgtgtgaa

SEQ ID NO: 62354 - DNA, 75 bp, Mus musculus
gtgtgtgtgtgtgtgtgtgtgcatattttcatcttgaaagacactcagatcatgtacacacacactcacacacat

SEQ ID NO: 62355 - DNA, 69 bp, Mus musculus
tgaataagggctggggagatggctcagcggttaagagcactgactactcttgcagaggtcctgagttca

SEQ ID NO: 62356 - DNA, 103 bp, Mus musculus
tacatgtgaccttgttggaggaagtgtgttaatgtagagatggtctccagctactcccagtgtgacacacagtctctccttgctgcctatggatcaggatgta

SEQ ID NO: 62357 - DNA, 66 bp, Mus musculus
gtgtatgtatatataaatatgttcatacatatgaatgtgtatgtataagtgaatgtgtacatacat

SEQ ID NO: 62358 - DNA, 93 bp, Mus musculus
ccagtgatgggacactcacgaatagatgtgatgtcgtgtgggtttctgtacacagatatttttatttttacactggtgatgttgggttgctgg

SEQ ID NO: 62359 - DNA, 81 bp, Mus musculus
gcttccgaggactgtgtgtctctgtgtcctctgtccccttctccagtactagtgtggggtcacaggcatcagcttccaagc

SEQ ID NO: 62360 - DNA, 124 bp, Mus musculus
gtgcatgtgtgtgtgcccacatgtatgtgtgcatatgcatgtgtgtgtgtgtgtgtgtgcatgtgcacacgtgtgtctctctcttgctctgtgaggatgtgcttgtgcatgtgtgtatgtatat

SEQ ID NO: 62361 - DNA, 59 bp, Mus musculus
ggagggagggagggagggagggagagattctgtctatctctgtttctctgtgtgtctct

SEQ ID NO: 62362 - DNA, 102 bp, Mus musculus
tatacatatatatgtgtgtgtatatatatacatatatattcacatatatattgtgtatgtgactatgtgtgtaagtgtatgtgtgtgaggtatgtatgtatg

SEQ ID NO: 62363 - DNA, 63 bp, Mus musculus
tcactgtctgtctgtctgtctgtttgtctgcatggatggatggatggatggatggatggatgg

SEQ ID NO: 62364 - DNA, 134 bp, Mus musculus
atgtgcatgtgtatgtgtgcatgtgtgcatatgtgtgtgagcctgtgtgtgtgtgcatgtgcatgtgtgtgtacatgcatgtgtgtgtgtgtgaacctgtgtgcatgtatgtatgtgtatgtgcgtgtgcatgt

SEQ ID NO: 62365 - DNA, 102 bp, Mus musculus
atcacaaatgaggcctccatcatctatactgctctcaacttgacacaagctagagtcaagagagaggagggagattcaattgagaagatgcctccatgagat

SEQ ID NO: 62366 - DNA, 69 bp, Mus musculus
tgtgtgtatgtctgactgtgtgcacaatgtaatacatcgtctctgtgtgtatgtctgactgtgtgcaca

SEQ ID NO: 62367 - DNA, 128 bp, Mus musculus
ctgtcaacagtcttctgaaaagcactgctctggtacaggctgtttcagatgctgacagagaggagtctgagcccacagaactgttgtcttttagggctaagggaagtttcaggatatctctgtatcgc

SEQ ID NO: 62368 - DNA, 72 bp, Mus musculus
gacctgtcacagggaagaggccaggcatgagtggtgccctcacttgagactctcccactctgtgacagcgtt

SEQ ID NO: 62369 - DNA, 108 bp, Mus musculus
tatgtatatacacatacatacacacatgtatacatacatataatcatacatatatacatgtgtgtatatatgtatgtatatatacacatatatatgtatatacacata

SEQ ID NO: 62370 - DNA, 108 bp, Mus musculus
atacatatatatgtgtatatatacatacatatatacacacatgtatatatgtatgattatatgtatgtatacatgtgtgtatgtatgtgtatatacatatgtgtgtat

SEQ ID NO: 62371 - DNA, 90 bp, Mus musculus
atgtcccaaattttaatctttgatggacagatagtcagtttgtttctggactgctctgtttgtttttgataccaaaagactcttgggcat

SEQ ID NO: 62372 - DNA, 104 bp, Mus musculus
tgtgtatatatgcctgtgtatatacgtatgtatgcatgtatttatatatgtctgtctatatatatgtgtgtatgcatatgtgtatatatatgtgtgtgtatgta

SEQ ID NO: 62373 - DNA, 77 bp, Mus musculus
tggtaggggttgcaaaactacagacagaagtcagagatctttgagcatctgacttgtggaagtcgaactccttgcca

SEQ ID NO: 62374 - DNA, 93 bp, Mus musculus
accatgtatgtgtttatatgtgtatatgtatgtgtgtgcatatatatgtgaatatatgtgtatatgtatgagtatatgtgtgtatatgcatat

SEQ ID NO: 62375 - DNA, 93 bp, Mus musculus
gaaatgctgggactcagcattgcagtggtcggagtggcagctgctgtgacctgcctggccctcacactggctctgtctgccagcatcgaattc

SEQ ID NO: 62376 - DNA, 170 bp, Mus musculus
tgtgtgtgctggtgtacatgtgcatgtgtgtatgtgtgtggttgtgtgtttgtatttgtgtgtatgcatatgtgtgtatatatgtatgtgtgtgtgcatgtgcatgcacatgtgtttgtgtgtgtggaaatgtatgtattgtgtgcttatgtgtgcgcatatgtgtgcat

SEQ ID NO: 62377 - DNA, 69 bp, Mus musculus
gcattcctccatctgacatccaagagctcaaaataccaagtggtggagatgctgggcaggtggtcgagc

SEQ ID NO: 62378 - DNA, 85 bp, Mus musculus
ctgggatgtttaagtctgtgtcgccagatggaagccagactcagtgatggtatctgtacagacagacagacagacagactcccag

SEQ ID NO: 62379 - DNA, 77 bp, Mus musculus
gcctgtctgtctgtctgtctgtctgtgtctgtgcacacacacatgtacacagatacccacagagaccaaaagagggc

SEQ ID NO: 62380 - DNA, 73 bp, Mus musculus
ggacacaggctccctgaatggctttctaagattcttggtccggtgagtgggaaccttttgggaaatgttgtcc

SEQ ID NO: 62381 - DNA, 111 bp, Mus musculus
ttgcatggttcccttgaagaagcaagaagtctagaaaattcaatttcattattagtttagagatgaagaggcttgaacttggagacgagctgtctgtaaggctggcatcga

SEQ ID NO: 62382 - DNA, 97 bp, Mus musculus
tgtgacatggtttggaggacagaatgacagtttggactgctctttgtgggtgttccctctgtctctggctgtcacctcttaaattatatgagtcaca

SEQ ID NO: 62383 - DNA, 98 bp, Mus musculus
gcacatgtgtgtgtatatatgtgtgtatatatgtatatatatgtgtgcttgtgagcatatgtgtgtatatgtgtatatatatgtatatatgtgtgtgc

SEQ ID NO: 62384 - DNA, 66 bp, Mus musculus
gatagttgccaacaagagtggagccacgggtgcctgtaggactctcactgactgtgggccactgtc

SEQ ID NO: 62385 - DNA, 92 bp, Mus musculus
cgtgaatgtgagcaactgaactgtgagaggtcagaggtcggagagcgtgtctgctcagagctcagatggacacggtcaggccaagcatcatg

SEQ ID NO: 62386 - DNA, 80 bp, Mus musculus
atcctggaactcactatgtagaccaggctagtccctagttgaaagagttctgtctatgtctgtctcctgagggctggggt

SEQ ID NO: 62387 - DNA, 73 bp, Mus musculus
cctgcattccacagtcctgacaagcaaatggaccagtcaccatttagcagtgaggagacactgtggacccagg

SEQ ID NO: 62388 - DNA, 78 bp, Mus musculus
tacagtttccatctgtggctgtggttgttgtctctggctgcctgtctgagacctcagatctgaacaagtggtgctgtg

SEQ ID NO: 62389 - DNA, 87 bp, Mus musculus
tgtgtgcacacgaatgcctgttagaatgtatgtacacctgtgtgcatgtatatctatatattcatatgtgtgtacatacctgtaggt

SEQ ID NO: 62390 - DNA, 76 bp, Mus musculus
catccatatacattatatatgtgtgtgtgtatacacatgtgtgtatgtgtgtatgtatgtatgtatgtatgtatgt

SEQ ID NO: 62391 - DNA, 67 bp, Mus musculus
agagagagagagagagagagagagagagagtgtgtcagcctgcctgtctgtctgcctgtctgtttct

SEQ ID NO: 62392 - DNA, 83 bp, Mus musculus
tacagagacctgtggaagccacatatatgtagctgctgagcacctgtggtctgggtgtctgtctgtctatctgtctgtctgtg

SEQ ID NO: 62393 - DNA, 69 bp, Mus musculus
ctctttcacactctgtgtctaggactcagggcatctccactctcagttcaggccagtgtcccataagag

SEQ ID NO: 62394 - DNA, 132 bp, Mus musculus
cagaaagcaggaaccagtttgaggtctccagctaccatctagtgtgcactcttgcctgtgtctctgtctgtctgtctgtctgtctctctgtggtgcgtgcatgtatgcatggaggttagaggtcagcatcag

SEQ ID NO: 62395 - DNA, 85 bp, Mus musculus
gtgtgctttactgtgtgacagtgtctgtgtgcatcattgtgtgacaatgtctatgtgtgcattattgtgtgacagtgtgcactac

SEQ ID NO: 62396 - DNA, 141 bp, Mus musculus
gcactactgtgtgacagtgtctatatgtgctttactgtgtaacagtgtttgtgtgcattacagtctgacagtgtctgtgtgtgcgttactatgtgacaaggtctatgtgtgacagtgtctatgtgcacattactgtatgac

SEQ ID NO: 62397 - DNA, 117 bp, Mus musculus
tctgcctcccgagtgctgggattaaaggcgtgtgccaccatgcccggcttgattatttcttgttgtctactcctttttggtgaaatttcttcttgttgttctagagctctcagatgt

SEQ ID NO: 62398 - DNA, 110 bp, Mus musculus
gttctctcgcttcctcccaagggctgcccttagaagagccacagaggcagtcatctcagtctgtttatctgagacaaggtctcgctctgtaaccctagatggcctggaac

SEQ ID NO: 62399 - DNA, 109 bp, Mus musculus
tctcagaaaaacaaacaaacaaaaacaaaaaacagatgatccattgtgaaaatgactttttttttcataaaagattattactgctacttttttctttgtggtgctgggg

SEQ ID NO: 62400 - DNA, 92 bp, Mus musculus
gatctattagagacttaaaggtgagaagataaacatctgtagggttttatgtaaaatgtatctttttaaatgatttaagtttctggtctttc

SEQ ID NO: 62401 - DNA, 119 bp, Mus musculus
caggcctcctagtgtgggttgacagggcccagctgctgtcagaagtctgtgtggtcacagttgccaggatgtggccctgcttttaccagcagcctgttaggcctcaggcacccaccctg

SEQ ID NO: 62402 - DNA, 65 bp, Mus musculus
tggtcctccctctgtgtgtctgtgccttaatcttaaggataccagtcacactggattaagggcca

SEQ ID NO: 62403 - DNA, 115 bp, Mus musculus
cagctctgaggcaggagaatggtgagcaaagctaacctggacaacctagtgagaccttgtctcaagagactcaggtccggtggctcatatttgtaatccatcaccgtggaggctg

SEQ ID NO: 62404 - DNA, 116 bp, Mus musculus
ttgtgcacactgaacctacctgcttgggacacatacttctttatatgcccatatgaacctgctaagctatggaatgtaaagaagtatgtatttcaggctaggaactctctcgccag

SEQ ID NO: 62405 - DNA, 76 bp, Mus musculus
gttcttctctggctgtgactggggggcactgagaagtcagcagttactcttccagaaacacagaaagcaaaagggc

SEQ ID NO: 62406 - DNA, 81 bp, Mus musculus
gcttgcttgcttgaggcccagggatggagcttggatgacacacacagagacagacttcatgggcctcagtcttgctattgt

SEQ ID NO: 62407 - DNA, 76 bp, Mus musculus
ctgtatctctgtctctctcatttgtgaggaaatgtgcagagagcaagcgagtgagtgagaagagagagagagagag

SEQ ID NO: 62408 - DNA, 70 bp, Mus musculus
gtgacattctgtgttgtttgaagagtgtgtactcactgtaagacactctcagtggcttcacagggaccac

SEQ ID NO: 62409 - DNA, 104 bp, Mus musculus
gatctgtccgtgtgcagctggagcgattggtgttatagccgggtcacctatggacacatctggatccaggcttgactccggtgcaaggtgctcaatgacatgtt

SEQ ID NO: 62410 - DNA, 63 bp, Mus musculus
tggacctgtctgtttctctgagtctgtcaggaaactgggcctcttaggaaacaagtgggttca

SEQ ID NO: 62411 - DNA, 69 bp, Mus musculus
gtgggacaccaggaccagggctctaagaggctgccagtctctcagacactgactccatgtgggacccac

SEQ ID NO: 62412 - DNA, 89 bp, Mus musculus
gtaaggcatttgtttgtgcatgtgcatgtgtgagcacacgtgtgtaaatgtgtgggtgagcatgcattcgtacgtgcaagtgtaggtat

SEQ ID NO: 62413 - DNA, 61 bp, Mus musculus
ggacatcaagagggaacagcactggctgctgcctcctgtctgtctgtctgtctgtctgtcc

SEQ ID NO: 62414 - DNA, 67 bp, Mus musculus
tctgtctgtttgtctctctgtgtatgcatgccataagtgttcaggtgcccaaagaggccagactaga

SEQ ID NO: 62415 - DNA, 83 bp, Mus musculus
gcagagtctctgagtcacacattttaactagcctctgaccagcagttttgaaagtcaagaatgtgtgcacagagcaggcctgc

SEQ ID NO: 62416 - DNA, 193 bp, Mus musculus
ggcttccgttgaccttcatcagagagtaatgctgaccaccttccccctagggcttctctgcctccgactctgtctgagaaaggccaagaagacctactatctcaattcaccccagctttcccagacctaactgcctggcaggctatagtcagtcaccctgtgtgcctgggaataagggtgtaagagtttaggg

SEQ ID NO: 62417 - DNA, 76 bp, Mus musculus
cactacacaaagtccttttgtcattttctagatttgaagggacactcccttcacaggtcagggatgtggctgagtg

SEQ ID NO: 62418 - DNA, 99 bp, Mus musculus
gcagccctgagggcccctctgcgtgttcacagcggaccttgatttaatgtctatacaattaaggcacgcggtgaatgccaagagaggcgcctccgccgc

SEQ ID NO: 62419 - DNA, 70 bp, Mus musculus
gtgtgcttaaatggacagacaatacagagaatagtttccacacattctcactctctgttctcatgtacac

SEQ ID NO: 62420 - DNA, 139 bp, Mus musculus
tatatatatatatatatacatatatatgtgtgtgtgtgtgtgtatttgcatatatatgtatatatgtatttgtgcatatagatgtgtgtacgtatgtatatatgtatgtgtgtatatatgtgtatatgtatatatgtat

SEQ ID NO: 62421 - DNA, 113 bp, Mus musculus
ctccgttacagttgcatctgctattccaaggtgaaatagaaggttgttttgttttatcagatgaaccttgtcctccactttaggtgtagtcttgtgctgactgttgtactgag

SEQ ID NO: 62422 - DNA, 75 bp, Mus musculus
ggttctaccaaccttcagacagtgaacagactaggtgagtatccacctcgtctccacctgaggttcagggtagcc

SEQ ID NO: 62423 - DNA, 86 bp, Mus musculus
tgcatgtatgtatgtatgtgtgcatgtgtatatatgcacgtatgtatgtgtgtatgtatgcatacatgtatgcatgtatgtgtgta

SEQ ID NO: 62424 - DNA, 94 bp, Mus musculus
ctttggatttggaaagcagtggaatgttaagtggggtttaatgggctatcctagtaagaatatggaagagtttgttgctgagggtgatttaaag

SEQ ID NO: 62425 - DNA, 74 bp, Mus musculus
ttgttttcaggatgagagatggctcagtggttagttaagagcactgactgctcttccagaggtcctgagttcag

SEQ ID NO: 62426 - DNA, 86 bp, Mus musculus
cttggggtcttcagcaaagagacaggtgagagaggccactagggcttcaaagtcatcagaactcttatagtgctgcagggcctggg

SEQ ID NO: 62427 - DNA, 98 bp, Mus musculus
agtcaaaataaggggctggagggatggctcagtggttaagagcactgactgctcttccagaggtattgagttcaattcccagcaaccacatggtggct

SEQ ID NO: 62428 - DNA, 97 bp, Mus musculus
ggttaaacagggggctggagagatggcttagtggttaagagcactgactgctcttccaaaggtactaagttcaaatcccagcaaccacatggtggct

SEQ ID NO: 62429 - DNA, 72 bp, Mus musculus
tgttttgcctgtatgtatgtatatatgtatgtattatgtgtgtatgtatgtatgcttgcatgcaggcagaca

SEQ ID NO: 62430 - DNA, 119 bp, Mus musculus
acacacataaagaaaaattgcagggaggtggggctagagagagagagaacacagttgctgttcttgcagaattgagtttccagcaccctcttcaggcagttcacagcttcagggaatgt

SEQ ID NO: 62431 - DNA, 74 bp, Mus musculus
agtagctaccaggagtttacagctatttttgaggtttaactcggagcagggttgtttcccaggggtggcatact

SEQ ID NO: 62432 - DNA, 100 bp, Mus musculus
ttggggaggggggtgctggagagatgatgacccagtggctaagagcactgactgctcttccagaggtcctgagttcaattcccatcagacctcattgcag

SEQ ID NO: 62433 - DNA, 78 bp, Mus musculus
atatatatgtatatgtatgtgtgtgtatgtgtatacatatgtatatttatacacacatacatacacacacatatatat

SEQ ID NO: 62434 - DNA, 77 bp, Mus musculus
gctaggggttagacagagatgagagaggacactgctgggggacgggggttgtcattcttaggtgcctgccatgtagt

SEQ ID NO: 62435 - DNA, 112 bp, Mus musculus
ctacctcatcagcctagaagtgtggcagaactgagtgaagggcgtaataaggatagacatgtcttctgtgtctgtgtgtcctgtgagcacagagccacagctaaacaggtag

SEQ ID NO: 62436 - DNA, 85 bp, Mus musculus; identical to SEQ ID NO: 57439

SEQ ID NO: 62437 - DNA, 110 bp, Mus musculus
gagtagagttcatgtcaccataaatgataacaacctttgctgaagatgtcataatttgtttatcatatattgtagcccttgtcatgtatatctgcatgttttctgggatc

SEQ ID NO: 62438 - DNA, 136 bp, Mus musculus
cagagagtctaatcagtgcccaacacccacaggggctcacaggcctcaattccagggaactgacagcctctctgtctgacctcatggcacacatgtggcacacatacacacatgtggtgcacacacacagatgggc

SEQ ID NO: 62439 - DNA, 92 bp, Mus musculus
gcacctctgattagcattcctggggtggtcatgggctgtttccaggacactcacactcatactcacatctcttacatagaatgctgtggtgc

SEQ ID NO: 62440 - DNA, 71 bp, Mus musculus
atgtaactcaggccgtcaggcttggtggcctcacccttacccactgagctctctcacagtctgagtgtcat

SEQ ID NO: 62441 - DNA, 72 bp, Mus musculus
caggcttcttcattaggactgggcagtaactcgcagagaggtcacagcgagctgacagcaccaggagcactg

SEQ ID NO: 62442 - DNA, 65 bp, Mus musculus
tcagtgagtgcacactcagggagaatgaggaaaagctcagccatcagtgagtgtgcactcaggga

SEQ ID NO: 62443 - DNA, 109 bp, Mus musculus
ctctgtatgtatgtatgtatgtgtgtgtgtatatatatatatgtatacatatatatatatatatatatatatatatatatatatatatatacatatatatatcccagag

SEQ ID NO: 62444 - DNA, 79 bp, Mus musculus
ggccagcctttgctaagtggctttgtacagatgctgagacctgtcctcagtgttcagacagccagcatacagctcggcc

SEQ ID NO: 62445 - DNA, 110 bp, Mus musculus
agatacagagatacatagatgtgtgtatatgtcagtatatatgtccatgtatctatgtgtctgtgtatgtgtctgtgtgttcatatatgcatatacatttcagatatgtg

SEQ ID NO: 62446 - DNA, 106 bp, Mus musculus
agggcttcacaggggagcacgatgttggagacagaagtgactttggacctggtgaaatgggctctgaagtagaaattttaaggttctttggaaagtcagttttgtt

SEQ ID NO: 62447 - DNA, 60 bp, Mus musculus
gtgtgtgtgtgtgtgtgtatgcgcgcgcctgtgtgtgtgtgtgtctatgtatctatccac

SEQ ID NO: 62448 - DNA, 101 bp, Mus musculus
ctttgggagtgataaaaatgctctgaacattgattgctgtggtgtccccatagacacacacatttaatgtgtgcatttacagtaattttacatttttaaag

SEQ ID NO: 62449 - DNA, 80 bp, Mus musculus
ctgggggctggacagatggctcagtggttaggagcactgactgctcttccagaggtcctgagttcaattcccagcaacca

SEQ ID NO: 62450 - DNA, 84 bp, Mus musculus
aaaagtgtagagatatattctaaacatgaatgttgagaagtgtggagacactgtctaagcatgagtgtgtctttaaaggctttt

SEQ ID NO: 62451 - DNA, 85 bp, Mus musculus; identical to SEQ ID NO: 60991

SEQ ID NO: 62452 - DNA, 105 bp, Mus musculus
tatatgtgtatgatatatacatatatatatttatatatgtgtgtatatgtgtgtgtatatgtgtgtatatatacacatatatatgtgtatatatgtatatatata

SEQ ID NO: 62453 - DNA, 77 bp, Mus musculus
tagctggtctttctgtctctgactgtggcttgtccctcctgcaagcctgtatgtcaatatgcctgggagaccagtta

SEQ ID NO: 62454 - DNA, 104 bp, Mus musculus
atcagagaggaataaaggagcagtatttaatttacacacacacacacacacacacacacacacacacattgtgtagtagtaccttctttattaattctattgat

SEQ ID NO: 62455 - DNA, 114 bp, Mus musculus
ttgttgatcagcctcaaaggctagacatgctgtttcactcttctgtctcattatctgtctccatagcgagggaagagtgtgggcatgttcactgtttgaaaaggctttccataa

SEQ ID NO: 62456 - DNA, 102 bp, Mus musculus
gaaatattcttgagggagctggagagatggctcggtggttaagagcactgactgctcttccagaggtcctgagttcaattcccagcaaccacatggtagctc

SEQ ID NO: 62457 - DNA, 91 bp, Mus musculus
acatttctacttgtgatgtcatggatttgctttcaaagtatttctaaatgagattttgaaagaaatctgggtcaataacttgtatgtttgt

SEQ ID NO: 62458 - DNA, 77 bp, Mus musculus
gtatgtgtatatatatatgtgtatatgtatactgactctctctctctctatatatatatatgtatatatatatatat

SEQ ID NO: 62459 - DNA, 78 bp, Mus musculus
tgtgtatatgtgtatatctgtgtgtctttgtgtgtctgagtaagtgcatgtgttcatgtatgtatgcatgtgtgtgta

SEQ ID NO: 62460 - DNA, 86 bp, Mus musculus
ggtaagcgtttgcagcatgggtctctaggctactaagggtgtgtttctcagtctgtctttctacccccacaaaaggaatgtggacc

SEQ ID NO: 62461 - DNA, 81 bp, Mus musculus
agtgtatttcctctgctgtaaactgggtcaatgtcaattgttctccaagggaaagatcagagatcagagagagaattcact

SEQ ID NO: 62462 - DNA, 104 bp, Mus musculus
ggaggagaaatcatagaaggagctgggctggagagatggctcactggttaaaagcactgactgctcttccagaggtcctgagttcaattcccagcaaccatgtc

SEQ ID NO: 62463 - DNA, 66 bp, Mus musculus
tatatatcatatgtatgtatgtatgtatgtatgtatgtatgtatgcatgcatatgataggtatatg

SEQ ID NO: 62464 - DNA, 86 bp, Mus musculus
gagaagagaagaggtgaatatatatatattacctactgagtccacttagtggagttgatatgtgtatgttctgtgtctgactactt

SEQ ID NO: 62465 - DNA, 74 bp, Mus musculus
ggtgtcacgctgactgagtgggagcatggaggagggaagacttgacatgagccagttgcaggcaggcggatgcc

SEQ ID NO: 62466 - DNA, 109 bp, Mus musculus
cttctgtaatttcaggcagattgctcaacagttactgtatggattggtgtctctgtttctctccctgagtttgctgtgatgtcattagcctaaattagaactatagaag

SEQ ID NO: 62467 - DNA, 95 bp, Mus musculus
caccttctcaagacagacactacagtgagacctgagtagtcatacttctatgagtatcctaatggtcgcagtgagaaatttttgttggagaagtg

SEQ ID NO: 62468 - DNA, 80 bp, Mus musculus
ttacatttcatgttgttcttcttcctctcatgcagtggcttatgcaagtggggtgaagaagaacataacattgagggtaa

SEQ ID NO: 62469 - DNA, 112 bp, Mus musculus
ttgttattccaaatgaatctgcaaattgttctttctaaatctttgaaaagttgagttgagattttgatgaggattgcattgaataggtagatagcttttggcaaaatggcaa

SEQ ID NO: 62470 - DNA, 97 bp, Mus musculus
acataatgtgctatgtaaatgattatgtatatgtatgtatctttgaatgattaacatgtattttatatgtacattcatagacacaggcatattctgt

SEQ ID NO: 62471 - DNA, 80 bp, Mus musculus
gccacagtcagagaacagagagagatggatgctgctgctcaccttgttttcctcttttcagttcttttttatttgtgtgc

SEQ ID NO: 62472 - DNA, 88 bp, Mus musculus
tcttccttgaccaagttatctttgagtagagagttgttcagcttccacatgaatgttggctttctattatttatgctgttattgaaga

SEQ ID NO: 62473 - DNA, 116 bp, Mus musculus
gtgctaagtgggcaggtcgggggagaacctactggtgtgcagactgcaggtattgtgacaggctcaatgtctcagtctgccttgccagttcattgccaacactctatttaaatcac

SEQ ID NO: 62474 - DNA, 91 bp, Mus musculus
atcaattatgtcacctgtcatctctgtgtcactgtaactaaatgcccaagacaggctactttgtgaagagagaaggttgatttagcttggt

SEQ ID NO: 62475 - DNA, 81 bp, Mus musculus
actgtctctccgtctcagatagtaaaaaatttaaaggcagccatacctgctatttgaattagtctatgacaggagttaagt

SEQ ID NO: 62476 - DNA, 63 bp, Mus musculus
gtcgtctgtgtctctgtgtggcttacaagtggctgtgtgccaacccacatgagtgccagggac

SEQ ID NO: 62477 - DNA, 79 bp, Mus musculus
gctgggaggcacaggctggagtggctgaatgaactggaaacacgcacatgctctctaagagtgtgtgcttaagaccggc

SEQ ID NO: 62478 - DNA, 120 bp, Mus musculus
gggcctgccttttccagctgggggaaatcctgagatgcagggttcaggagatgcagtagtcagagagcagtcaggtggtgctggcccctgggtacacagtgctgagcataggaggaacct

SEQ ID NO: 62479 - DNA, 57 bp, Mus musculus
agctctgcatttcctcacagggtcactctcagtgagtcccagaggatttgttatgct

SEQ ID NO: 62480 - DNA, 70 bp, Mus musculus
tggtggcagacatgtggagcagacagccagagcagaagctgagaggctctgtctctcacttaagccacca

SEQ ID NO: 62481 - DNA, 88 bp, Mus musculus
ttcacacctctcaggtaggtaggtaggtaggtaggtaggtatgtatgtatgtatgtatgtatgtatgtatgcgttttcaggatgtgga

SEQ ID NO: 62482 - DNA, 87 bp, Mus musculus
gctggtctgctggtgtggcaaaaagtaaactaaggaagtcagctgtgacctgtctctgtgacttagtgtgacatcttacgagtcagt

SEQ ID NO: 62483 - DNA, 71 bp, Mus musculus
gaagatggaggtagagtgtgtgagagagagagagatgaattcgtcaatttagctccttattctccattttt

SEQ ID NO: 62484 - DNA, 85 bp, Mus musculus; identical to SEQ ID NO: 57439

SEQ ID NO: 62485 - DNA, 85 bp, Mus musculus; identical to SEQ ID NO: 57470

SEQ ID NO: 62486 - DNA, 102 bp, Mus musculus
tcttagtccgtgatgatctgataggatgcatgggataatttcaatatttttgatctgttgaggcctgttttgtgacaattatatggtcaatttcggagaagg

SEQ ID NO: 62487 - DNA, 111 bp, Mus musculus
ctgaagcagggatggcaaaaaggtaaagaaatagaatcttcagtctccagggagaggtcagtgaggagagaggctgttctttttatttctttactggtctctgacagtcag

SEQ ID NO: 62488 - DNA, 100 bp, Mus musculus
gtatagaaaagtctggttttcatttggacattacattcagatccaacacactctctcgtgtctgtgtctgtttgtcattccattcccaccgactctatgc

SEQ ID NO: 62489 - DNA, 74 bp, Mus musculus
cacatttgttctcagctctcactgtgtgactgaaataaaacatctaaatattgtgggaccagagaatgactgtg

SEQ ID NO: 62490 - DNA, 85 bp, Mus musculus; identical to SEQ ID NO: 57439

SEQ ID NO: 62491 - DNA, 115 bp, Mus musculus
gactctgggagaactggtggtcaggccagctgtgcttgctgacaggaatctagtgtggtggttccttgggaggtctggccagcaactgaccaagcagacatggatgcttagagcc

SEQ ID NO: 62492 - DNA, 110 bp, Mus musculus
ttgaagatcagccttagtccatggtgatctgataggatgcatgggataatttcaatatttttgtatctatggaggcctgtttggtgaccaattatatggtcaattttgga

SEQ ID NO: 62493 - DNA, 85 bp, Mus musculus
ccagggacgacaggttctcactcttagacatcccagatgcttctgtatgtctcagaagagctgagaacagagtgtggaccctcgg

SEQ ID NO: 62494 - DNA, 96 bp, Mus musculus
gaacagcaaggctaaaggatgaatgagtgcgtctgatattatcactacagagacaggacacaagcatttcccccttaacctctggttttgttgatc

SEQ ID NO: 62495 - DNA, 77 bp, Mus musculus
agaaactgacatttcagatttagaagcacagtgaggggaaatattctccctgtgtgtctctctatgtgtctctgtct

SEQ ID NO: 62496 - DNA, 85 bp, Mus musculus; identical to SEQ ID NO: 57439

SEQ ID NO: 62497 - DNA, 85 bp, Mus musculus
ggccatggtggtctgataggatacatgggacaatttcaatatttttgtatctattgaggcctattttgtgaccaattatatggtc

SEQ ID NO: 62498 - DNA, 85 bp, Mus musculus; identical to SEQ ID NO: 57439

SEQ ID NO: 62499 - DNA, 94 bp, Mus musculus
gcaacagaaggagactgtgtgtcacactgagtgtagcttgatcatcgtagacctcaaagcccaccctacagtgacatacttcttccaacaaggc

SEQ ID NO: 62500 - DNA, 88 bp, Mus musculus
tttgatttctcctgaaaaaaataagtgatctctatttctttatgtataacattgagagggagagacacagtattggccaggtgtcaga

SEQ ID NO: 62501 - DNA, 83 bp, Mus musculus
catgggacaatttcaatatttttgtatctgttgtggcctgttttgtgaccaattatatgatctattttggagaaggtcccatg

SEQ ID NO: 62502 - DNA, 102 bp, Mus musculus
gtgttccctgatctctgacaggagggacatctgatttagagttcactgctccaaggtctcttactctctgcatgttgtctgtctgtgggtctcagtatttac

SEQ ID NO: 62503 - DNA, 88 bp, Mus musculus
tggcactgtaccaagagccaaaattatggaaagtaatgatgtcagatagcaagacatggtactattgccatagagggtgctgttgcca

SEQ ID NO: 62504 - DNA, 117 bp, Mus musculus
gtgtccagcattgcctgtgtcatggagatttgtattggggtcttggaatgactttttgtttatgtcatatcttcagcatgcaaaacctgtgtttagtgtattccttgctgctgatgt

SEQ ID NO: 62505 - DNA, 91 bp, Mus musculus
gtgtatatgtgtatatgtgtatgtgtgtgtatatatgtatatgtgtatatgtatatacacatatacatatatatacatatacatatatatg

SEQ ID NO: 62506 - DNA, 75 bp, Mus musculus
cactatgtatgtatgtatgtatgtatgtatgtatgtatgtatgtatgcatgtatgtatgtatgtattatgtggtg

SEQ ID NO: 62507 - DNA, 85 bp, Mus musculus; identical to SEQ ID NO: 57470

SEQ ID NO: 62508 - DNA, 102 bp, Mus musculus
aggtagaggtcgctcaaaaaatgtttcacagagccaagtttgtcccagcaggatccatattgtttctttatacttgaaaatctctgggcagcttctaagcct

SEQ ID NO: 62509 - DNA, 85 bp, Mus musculus
gtccatggtggtctgataggatgcatgggacaatttcaatatttttgtatctgttgaggcctgttttgtgaccaattgtatggtc

SEQ ID NO: 62510 - DNA, 85 bp, Mus musculus; identical to SEQ ID NO: 57470

SEQ ID NO: 62511 - DNA, 110 bp, Mus musculus
ggtttaaagggatacagtcctaccttcaggcaaagcacagcagtgggcatgagaggcacctggctacattgcatctgcagtcaggaggtagagagaggctccctctttcc

SEQ ID NO: 62512 - DNA, 107 bp, Mus musculus
agctctgtaattctttcagacaggaacaattatgggtcagagatgtgactgtgctatggaaaccccattcctcacttgatgtcctgtctccctgctagagatgagct

SEQ ID NO: 62513 - DNA, 68 bp, Mus musculus
gttggttcctggctcagacaccctgtctcaaaacgtaaggtggggagcagttgagtaagacaccagac

SEQ ID NO: 62514 - DNA, 72 bp, Mus musculus
tatatatatatatacacacacatatatatatatgtatatgtatatatatgtatatgtgtatatatatatgta

SEQ ID NO: 62515 - DNA, 87 bp, Mus musculus
ggagttgtttgcagagtagagagtgtcgacaaagattataactacattaatcctacgtttcaggcagtctccatttctgaagcctct

SEQ ID NO: 62516 - DNA, 85 bp, Mus musculus; identical to SEQ ID NO: 57470

SEQ ID NO: 62517 - DNA, 84 bp, Mus musculus
ggagcttttcccttctgtgagcctgtgagcctgtgtgcctgtgatattaggtgtgtcagcactcttgggagaagggctctctcc

SEQ ID NO: 62518 - DNA, 71 bp, Mus musculus
tgtgaagagtgaagagagtcaggatgctccagggatagaccctggatgcagccatctcttttgacaccaca

SEQ ID NO: 62519 - DNA, 69 bp, Mus musculus
ttttgaagatttagacagcatagcattttcgggcaaacctgaacagtgtctgcagtctgaacattaaga

SEQ ID NO: 62520 - DNA, 116 bp, Mus musculus
gtcactcagccagcttatttctttggcaaagaggaacctaacacaagactctgaggacaggccatggaggcttggttggtccagcttccagaactaggctagaggcacagagaggc

SEQ ID NO: 62521 - DNA, 79 bp, Mus musculus
acttctgttagtttcactctgtctctgtttagtttctgtttccaggatctgtccattgatgagagtagagtgttgaagt

SEQ ID NO: 62522 - DNA, 85 bp, Mus musculus; identical to SEQ ID NO: 57470

SEQ ID NO: 62523 - DNA, 65 bp, Mus musculus
accaggttctcagtctcagtcattccctgctggatactgcagaggagatgagaacagaatagggt

SEQ ID NO: 62524 - DNA, 103 bp, Mus musculus
ccctcaagcataaaattatttcattgctacttcatagctgtaattttgctactgttatgaattgcaatgtaaatatttttggagataaaagtttgctaaaggg

SEQ ID NO: 62525 - DNA, 65 bp, Mus musculus
cctggaggtctcactgcctctgtctctaaggcttctaggctaggcacagcagtgacagatcaagg

SEQ ID NO: 62526 - DNA, 85 bp, Mus musculus; identical to SEQ ID NO: 57470

SEQ ID NO: 62527 - DNA, 106 bp, Mus musculus
gccttagtcagtggtgatctgataggatgcatgtgataatttcaatatttttgtatctgttgaggcctgttttgtgtccgattatattgtcagttttggaggaggt

SEQ ID NO: 62528 - DNA, 92 bp, Mus musculus
gatggctaaggatgttgaacattattttaggtgcttctcaaccatttggtattcctcagttgagaatttgttgtttagctctttaccccatt

SEQ ID NO: 62529 - DNA, 64 bp, Mus musculus
tgtgagtctgtaagtctctgtcagcactcctgggagttctgacagttctgacagttctctctca

SEQ ID NO: 62530 - DNA, 112 bp, Mus musculus
ggtaattttctttctttttcatgtatgtatgtatgtatatatgtatgtatgtatgtatgtatgtatgtatgtatgtgtatatgtatatgagtgctcagacttcacattaacc

SEQ ID NO: 62531 - DNA, 110 bp, Mus musculus
tgctttctacctcaagggctgtgaagccaatttaatgaaaagatgcgcttctgcttggctcaggaagaagcatgtttcttgatgttgcttgcagccataattcctaagca

SEQ ID NO: 62532 - DNA, 74 bp, Mus musculus
tgagtgtctctattctttgaaccttacatgtactgaatgtattgttctaaagttttatatatagaatgcactca

SEQ ID NO: 62533 - DNA, 86 bp, Mus musculus
tgagctcctccccacccaggtctctctctctctctgacccagctctgctgaaggtttcttgggggaggggaaaggggacaagctca

SEQ ID NO: 62534 - DNA, 77 bp, Mus musculus
atatgcattatattatattagtgataaatatatattgtttatatatatttagaaataatgtacgtgtgtgtgtatat

SEQ ID NO: 62535 - DNA, 74 bp, Mus musculus
atcaaaatcaaaacccaggatgcaactgggtgatacctgaggacagtgtgtctcagtgcgtcggtggagagggt

SEQ ID NO: 62536 - DNA, 64 bp, Mus musculus
tatgtgtatgtatgtatgtatgtaggtgtgtgtctgcatgtatgtgtgtatatgtgtatgtgtg

SEQ ID NO: 62537 - DNA, 114 bp, Mus musculus
gtgacaaaggccatacataggtctctctgggcaaggactggggaaaggctaatagtgaaatttttagttactttatcaaggtccttcctcaggggaatctgggcgtccctacac

SEQ ID NO: 62538 - DNA, 71 bp, Mus musculus
tgggcaccagctgtggttccaggttcttttctctccctcagggtgtccaggaaacctggaattggagtcta

SEQ ID NO: 62539 - DNA, 89 bp, Mus musculus
tgcttctctgaaatttaagtgtgtctctgtgtgtgtgcgagagtgtgcgcgcgcacacacgcacacatatctttctccaaccagaagta

SEQ ID NO: 62540 - DNA, 74 bp, Mus musculus
ggggaggactcaaggcttagccagtaccagctgttaagggtgtcaaaacttttctggctctctgactctttctc

SEQ ID NO: 62541 - DNA, 117 bp, Mus musculus
ggggacacagtggttggaagttgtcctagtgctacattgctgggcctctgggcactcactgtcttagtctcagggcagcccagggtttaggtgctaggcttctccatggttgtgccc

SEQ ID NO: 62542 - DNA, 149 bp, Mus musculus
tgggtgtgtgtgtgtatgcctgtgtgtgtgtatatatgtgtctgtgtgtgtatgtctgtgtgtacatgcctatgtgtgtatgtgtgtgcctttgtatctgtgtgtgtgtgtgtctatgtgtgtgtattacagaatagctacaaaaggat

SEQ ID NO: 62543 - DNA, 82 bp, Mus musculus
gtcataatgagtgttgagtgacagcagatcttatagaacccttccaggctgtgacttcaagtcagccaatacaataggtgac

SEQ ID NO: 62544 - DNA, 77 bp, Mus musculus
gggggctggagaaatggctcagtggttaggagcactgactgctcttccagaggtcctgagttcaattcccggcaacc

SEQ ID NO: 62545 - DNA, 100 bp, Mus musculus
gtttcagtgttcttctgggctcctccgaagggctagtgtcactttgccagctctgctctctgtcacactctaagctcaggttgatccacttcactgctgc

SEQ ID NO: 62546 - DNA, 87 bp, Mus musculus
gcaggtggtggcagcatcaagctagagtgggctcctctttcagttacaaagtgtctgcaactggatctgatgtaccacccactgggc

SEQ ID NO: 62547 - DNA, 74 bp, Mus musculus
ttcagagtctagggtaatagcatcagtgattctcaactcctaccctactgtgtgcctcactcactggctctgga

SEQ ID NO: 62548 - DNA, 116 bp, Mus musculus
tggttggaagatgggtcctaacagcagcagcagcagattggaccaaacagaacttactgtccctgtctctatctctgagccaggttctgtattgagcaccatcgtagagcaaagcc

SEQ ID NO: 62549 - DNA, 108 bp, Mus musculus
agcattcaaaacataagcctgtggggctggagagatgctcagcagtaaagagcactgactgctcttccagaggtcctgagttcaattcctagcaaccacatggtggct

SEQ ID NO: 62550 - DNA, 92 bp, Mus musculus
ttgttggtcagtcagtcagcctcactgcctctctgggctacccggaccctgggaaccagagtagccctgtcccaggctgcccctgccaggag

SEQ ID NO: 62551 - DNA, 73 bp, Mus musculus
gccaggacctgtctatgtctgtctgagtgagcttggctccttctgtgtgctcatgacttacactgttcttggt

SEQ ID NO: 62552 - DNA, 118 bp, Mus musculus
tgtgcactattaagaagtatgaagggaggggctggggaaatggctcagtggttaagagcactgactgctcttccagagatcctgagttcaaatcccagcaaccacatggtggctcaca

SEQ ID NO: 62553 - DNA, 127 bp, Mus musculus
tcaggtccttggaggcgaatgtagatttcacgcgctttgggtctttgtctctgggtccctgaatcagtctggtgtgtgtctttgggtctgcagccatctggtttctggtggcccataagtgggatcc

SEQ ID NO: 62554 - DNA, 84 bp, Mus musculus
tctttttttcagttctctgtgttttccgtttgtattggtttactgtggttaccagacagagagaagagagactggacttaggga

SEQ ID NO: 62555 - DNA, 95 bp, Mus musculus
gggcatctaaagtccagccccatgcttgcttccgagagaagacagtttccacacttactctgcagtcagctggctagagctttccagaaaggccc

SEQ ID NO: 62556 - DNA, 96 bp, Mus musculus
tggtcaccatggggttgcagtctctcagagtcacattgtccaccccagccccctgctggccagggccatccaagtccaccagactgacaaactcca

SEQ ID NO: 62557 - DNA, 78 bp, Mus musculus
gaaatagttgacacactctcattctctttggccccaggattcggggggtggggtaaggtggggggaggtgttgtgttc

SEQ ID NO: 62558 - DNA, 113 bp, Mus musculus
gcctttaccatggttcctgtttgtctttctgttcgtcaaagtttgagtctgtcagtctgtttgaactttatcttgcaagcgttgggaggctcagagagcctatggtgtctggt

SEQ ID NO: 62559 - DNA, 117 bp, Mus musculus
aagattcaatggccaaggtgagagaggagttagccaagcagatgagagagagaacagagtctgggctggttcgagtcttggcttaactcctccccctggtttactaccttgatttct

SEQ ID NO: 62560 - DNA, 75 bp, Mus musculus
cctgacagaagccagtgttcccagctcttgaaaccagtcaaccagctattttgagggagcccagatcaagtcagg

SEQ ID NO: 62561 - DNA, 74 bp, Mus musculus
gttgctcctgcactagccaagagttggcttctattttttctttagataaagactactgactgggcagtggtggc

SEQ ID NO: 62562 - DNA, 85 bp, Mus musculus
cacctggtccaggctgttcctactgtgtctgtgtctgtgcctttagcacaaatgagtcagagtaccagtcagcctgctttgggtg

SEQ ID NO: 62563 - DNA, 85 bp, Mus musculus
ataaatgtgtgtatatgtatatatgtaaagtggccagagctttgtatgctccatccactcaatgtatgaatgtatatatatctgt

SEQ ID NO: 62564 - DNA, 75 bp, Mus musculus
actgcttttcagaagacagacagacagacagacagacagtatctcccagtgtgcttgtctggcttcccccgcagt

SEQ ID NO: 62565 - DNA, 66 bp, Mus musculus
agcagcatccaggcaggcatggtgcaggaggagctgaaggttctgcatctccatctgaaggctgct

SEQ ID NO: 62566 - DNA, 83 bp, Mus musculus
gtgtgagtgtatgtgtgtgagtgcatgagcatgtatatgtgtatatatgtgagtgatcctgtagataagcatgcattgcacac

SEQ ID NO: 62567 - DNA, 84 bp, Mus musculus
taggtctctctgggcaaggactggggaaaggctaatagtgaaatttttagttactttatcaaggtccttcctcaggggaatctg

SEQ ID NO: 62568 - DNA, 85 bp, Mus musculus
gcatgaggtgggtatctctgtctatgtctgtttgtttactgcactatagggccctaaacaaggagatggaggtataggctgtggc

SEQ ID NO: 62569 - DNA, 114 bp, Mus musculus
ggtataaggggcccttcatcacggctgagcctgtactgaactgagtgtttgtgattgctgaccagtgacagaagagagtgagaacacggtcctcagcaggtgcttcctcgtgct

SEQ ID NO: 62570 - DNA, 73 bp, Mus musculus
ttctcagcctcctgtctgtgcctctgttgcccagaagtagcgtctctgcctctgtgtggctgtatcctgagaa

SEQ ID NO: 62571 - DNA, 66 bp, Mus musculus
cacacacccacagagccctttgttgataggctgtgggcttgacctgagggtctctgtgtctttgtg

SEQ ID NO: 62572 - DNA, 71 bp, Mus musculus
tctgtgtgtgtctatgtctctctgtgtatctgtgtgtatgtgtgtatgagacagagacagacagagagaca

SEQ ID NO: 62573 - DNA, 65 bp, Mus musculus
gtctgtctctctgtctgtctctgtctcatacacacatacacacagatacacagagagacatagac

SEQ ID NO: 62574 - DNA, 80 bp, Mus musculus
gtgtgctctgaaagatgatagaaactcatgggcatctgatatgccactgtgtgtgtgtctgtctatctgtctctgcctgc

SEQ ID NO: 62575 - DNA, 115 bp, Mus musculus
aggcaaaataaacctttaagaaaagattaataagcaggcaaggggccctcagcctcactgagtcacttcttcaccccatccctatctatttctttaatggctttttgttttgttt

SEQ ID NO: 62576 - DNA, 82 bp, Mus musculus
ctgcccagtctctctggctgtgtagctgtctgagatccttatatatagcaaacgtggctatgctgaccacagagtgtagcag

SEQ ID NO: 62577 - DNA, 74 bp, Mus musculus
gtgggagatgagtgtgaggtcaggtagaggttgaaggccagggaaggaccactctatgtccacactcacctcct

SEQ ID NO: 62578 - DNA, 94 bp, Mus musculus
aggagaccagtgggttcacacatgagagtcactacacttcggcttcccagcctacagttcagctgacgaacgtgaaagggacctttggctcttc

SEQ ID NO: 62579 - DNA, 95 bp, Mus musculus
gtttcttaactctgatttctgtccctagtctatatctgtcccaacagatttccactcagctagtaggtactatacagaaatcggctgtagactac

SEQ ID NO: 62580 - DNA, 95 bp, Mus musculus
gagactccagcctgccctctctatctgtctctgggactgaggtggcactctgaggctctgaaccagggatctcttttcttagatacatctcagtc

SEQ ID NO: 62581 - DNA, 98 bp, Mus musculus
cgcatctttgccggtgacagcacattattacttttggtacgcgctgtgacacttcaaactcgtaccgtgagtaataatgcgcggtcagcagcccagcg

SEQ ID NO: 62582 - DNA, 72 bp, Mus musculus
agctgtgggggcagagcctggagatgcaaagtctctggctgtcagtctcaggcactgccaaagcacacagct

SEQ ID NO: 62583 - DNA, 82 bp, Mus musculus
gtattcaaaggctatcctctgtgatcagcagtctcaagcaccaatcctgcaggtgacaggtgacagtgtgaacacagagtga

SEQ ID NO: 62584 - DNA, 72 bp, Mus musculus
aggggcagggggagcagtggtcgagtatctgcctcacaggcatgaattgctggtctctctctctctctctct

SEQ ID NO: 62585 - DNA, 85 bp, Mus musculus; identical to SEQ ID NO: 57470

SEQ ID NO: 62586 - DNA, 72 bp, Mus musculus
ttcaagaaggcaggcagctcactgagccaggatgccttccgctgggtctctgggtctctgtcttgaattgaa

SEQ ID NO: 62587 - DNA, 74 bp, Mus musculus
ttacatgtgtatgtgtacatgttcatgtttgtgtgtatgcaggtgcaggtgtgtgtgtgcatgtgcatatgtag

SEQ ID NO: 62588 - DNA, 108 bp, Mus musculus
tgatgatagagatgctggagttgatgcttgtgccctagcagtggctctgtctgcctgtctccctgccatacttccttcaggcccaacctagttttttgtgtgtcttca

SEQ ID NO: 62589 - DNA, 95 bp, Mus musculus
tacccctctccccattttggtgtgcctcactcacagtctcaaggcacagccgtcctaggacatttgcatgaggccacattcttggatcaggtgtg

SEQ ID NO: 62590 - DNA, 116 bp, Mus musculus
gctgcactgttatctccacccaggttatctgcttcaagacctggccactcaaataagaacacagtctctgagtctcataacccctgggagccaagaagagcagttgaggaggcagc

SEQ ID NO: 62591 - DNA, 99 bp, Mus musculus
ggcacaaacttttaaatccaacagacaggaggcagaggcaagcagacagatctctgtgagttcaaggccagcctgctctacatagtgaggatctgtgtc

SEQ ID NO: 62592 - DNA, 107 bp, Mus musculus
tgtgtgtatgcgtgcatatgtatgcatatatctacatatacacacatatatgtatatatgtgtatgtatgtatgtatgtgtcatacatacatatttgtgtacataca

SEQ ID NO: 62593 - DNA, 67 bp, Mus musculus
ctgggcatagatgtcagtcacctcactagcacccattgctgctatgaatgatatcgtctgagccaag

SEQ ID NO: 62594 - DNA, 89 bp, Mus musculus
gggcactgtgcctcactgcctgcagtgggggtgatgtgggtcactgtgcctcactgcctgcagtgggggtgatggggggcacggtgcct

SEQ ID NO: 62595 - DNA, 96 bp, Mus musculus
cctcactgcctgcagtgggggtgatgtgggtcactgtgcctcactgcctgcagtgggggtgatagggggcactgtgcctcactgcctgcagtgggg

SEQ ID NO: 62596 - DNA, 79 bp, Mus musculus
ggttcctgtgaggttccaggagttaagatgcgaacgtagttttgaaagtctgtctgtctgtctccttgacatagtggcc

SEQ ID NO: 62597 - DNA, 98 bp, Mus musculus
gggggggaacgactcaagtagaaggtctggagagatggctcagccgttaagcgcactgactgctcttccagaggtcctgagttcaattcccaacaacc

SEQ ID NO: 62598 - DNA, 64 bp, Mus musculus
gagggttggtgcctctggagcagtttgacaacacagtgcagagtgaggagacgtgcaaaccctt

SEQ ID NO: 62599 - DNA, 107 bp, Mus musculus
ccaagtagttgagggtctggtagaattgagccagtctcagtcactcagggtagctaggagctgaaagtgacttggtccttcgtattctccccaccctcttttctggg

SEQ ID NO: 62600 - DNA, 83 bp, Mus musculus
gggaatgtgagtggctcagtctgtgtctcactggtagctgaggccaggctggccttgagagcagcaccagaagcaaaacaggc

SEQ ID NO: 62601 - DNA, 102 bp, Mus musculus
ggtctgggactccctggtgtggcacctgactgctctgtgtgaccactgttgtgtgctcagaaatactggcagcatacctcactgggcagagaagcctagatt

SEQ ID NO: 62602 - DNA, 73 bp, Mus musculus
aggatacggtggcatcaggggaggcaaggcgtgccaaagatggcctgcccctcactcccactctctgtctttc

SEQ ID NO: 62603 - DNA, 59 bp, Mus musculus
gcttgcccatctgtctcagggtcagtgtcctactgtcactgtctgactgactggcttgc

SEQ ID NO: 62604 - DNA, 82 bp, Mus musculus
gggaggggaggggagcatggtaggctgggtctaggctaggccctgtttctgtctgtctatctgtctgtctgagtctctctct

SEQ ID NO: 62605 - DNA, 85 bp, Mus musculus
gagtgtgtgtgtgtgcatatgcatgtgtatgttacgtttgtgcatatatgtacacgtgtacatatgcatgcatatgtgacacctc

SEQ ID NO: 62606 - DNA, 75 bp, Mus musculus
agagagggtgcaggatggggacttgagctgcagcgactgttgccaagtgtgtctctatcactctgcagtctgttt

SEQ ID NO: 62607 - DNA, 91 bp, Mus musculus
cttcctgtggttttatagggctggctgtcagtgcctctcatggtgtcctcgatcttggccactcgctgtgtactatggggaggaatgcagc

SEQ ID NO: 62608 - DNA, 118 bp, Mus musculus
tggaagatgtgggtgtccggtgtgccattccctccctgtggctctctccctatctgtccaataagaagatagagagctctctgaggtcttgcccagccccagaaaccttatgatttca

SEQ ID NO: 62609 - DNA, 61 bp, Mus musculus
gtgtgtgtgtgtgtgtgtgtgtgcatgtgatcaaatgaccaacacacacagagacagagac

SEQ ID NO: 62610 - DNA, 102 bp, Mus musculus
tactctgtatgtatgtatgtatgcatgtatgtgctatgtatgtatgtatattttatttatatatatatattgtgtgcatgcatgtgtctgtctgtacgtgca

SEQ ID NO: 62611 - DNA, 68 bp, Mus musculus
gcaagttttccctatctctctgtctctcttcagagaggaacactgagagtaatggggacagaggctgc

SEQ ID NO: 62612 - DNA, 63 bp, Mus musculus
ccccagagcagactagctggttctgagttcatgtaagagactctgactcagtgtgtaaggggg

SEQ ID NO: 62613 - DNA, 90 bp, Mus musculus
cttgggctgcacatgtctgtcacaaatgtcctttgtagagagacccagggtaattacaaagcagacagacaagagagtgtggagaccaag

SEQ ID NO: 62614 - DNA, 69 bp, Mus musculus
gtgtgtgtatgaacacatgtgggggcatgtacatgcatatgtgtgtctctgtgtgtgtgctgtgtatac

SEQ ID NO: 62615 - DNA, 64 bp, Mus musculus
gtgtacatatgtgtatgtgcatgtgtatgtgtgtgtacacatttgtgtatgcgtgtgtgtacat

SEQ ID NO: 62616 - DNA, 61 bp, Mus musculus
gagaaggagagtgtgggtgtcttgtgatctagggtcccttgtcatccccaactcctatctc

SEQ ID NO: 62617 - DNA, 82 bp, Mus musculus
ggcttgagacttatgtcaggagtcatccttggtcactgtctcattcacagacccagagattgccactgtaactagtcttgcc

SEQ ID NO: 62618 - DNA, 58 bp, Mus musculus
gtggcagtagagagtgtcctctctgtgtgctctcttccaggacaactctactttccac

SEQ ID NO: 62619 - DNA, 64 bp, Mus musculus
aaacagcatatataaacatctatgcatgtttctatatgtatattgtgcatgtgtatagttgttt

SEQ ID NO: 62620 - DNA, 65 bp, Mus musculus
tgtgtgtgtatgtgtgtatgcgcacatgtgtctgtgtatgtgtgtgtatatgtgtatgtacacat

SEQ ID NO: 62621 - DNA, 81 bp, Mus musculus
agagcctggctgcctggtctgtgggcttccttagggggaaatagtgtctgtcactccctgacatcagactaggaaggctct

SEQ ID NO: 62622 - DNA, 90 bp, Mus musculus
atgtgaatgagtatgtgtgcatgtgtgtaagtcagtaagtacatgtgtatgtgagtgagtgtgtgcctgtgtgtatgtcagtgagtacat

SEQ ID NO: 62623 - DNA, 95 bp, Mus musculus
atatgtatatatacacacatattatatatgtatatatccatatatgggatatgtaagtatatatatgtatatataatatatatgtgtgtatatgt

SEQ ID NO: 62624 - DNA, 110 bp, Mus musculus
ctccattgggtccctgtgctcagtctgatggctgtctgtgagcatctgcatctgtattggtcaggactggcagagcctctcaggagacagctgtatcaggctcctgtcag

SEQ ID NO: 62625 - DNA, 96 bp, Mus musculus
ggggtccctgtgctcagtccgatggttgtctgtgagcatctgcatctgtattggtcaggactggcagagcctctcaggagacagctgtatcaggct

SEQ ID NO: 62626 - DNA, 83 bp, Mus musculus
agtatgtaagtggctgcttagggacttggatgtcaaaagctaagaggctgtgtctgtctgtctgtctgcctgtcaccgcatct

SEQ ID NO: 62627 - DNA, 95 bp, Mus musculus
gctgagggtagccagggtgacacagttagatgcggtgacaggcagacagacagacagacacagcctcttagcttttgacatccaagtccctaagc

SEQ ID NO: 62628 - DNA, 93 bp, Mus musculus
atttgaactcaggacctttgaaagaacagtcagtgctcttaccggctgagccatctcagcagaccgattgattgattttttgcgagtgcagat

SEQ ID NO: 62629 - DNA, 99 bp, Mus musculus
gagttgcttttgggactggaatgatgactcagcagttaagagcactgactgctcttccagaggttctgagttcaattcccagtaaccacatggtagctc

SEQ ID NO: 62630 - DNA, 88 bp, Mus musculus
gagagcaggccctttgttccaggccctcgggagccacgtgacacctgtcactgtcactgcctggaacggaggatggccacaggagctc

SEQ ID NO: 62631 - DNA, 79 bp, Mus musculus
gaaagggggtcagagtaaaaaggcttgagctgttggcctatgggagtgaggagcttgtctgtctgtctgtctgtctgtc

SEQ ID NO: 62632 - DNA, 113 bp, Mus musculus
gtcttagcaaaacccatttagggcttcaacatgcagtcagccccactcactatgtggttcttcagcacctgttttcttcttccaggccgtattgaattgggacccaataagtc

SEQ ID NO: 62633 - DNA, 68 bp, Mus musculus
gtctagcttaacgggcagttccaggccagtgacagaccctgtctctgagatggtgtccctgagatgac

SEQ ID NO: 62634 - DNA, 104 bp, Mus musculus
gtgtatgtgtttgtgtgagtatgtgtgtctgtggacatatgtgtatatgtatttgtgtatgaatgtgtatgtatgtctgagtatgtgtgtctgagtgtatgtgt

SEQ ID NO: 62635 - DNA, 88 bp, Mus musculus
agtgcccaccagagaggtaagcagcatgcctgtagggtgaagtttgtgtgcactgtaggtgatgacctgtttgttgactggaagcact

SEQ ID NO: 62636 - DNA, 101 bp, Mus musculus
ttggagttatggccttgttggatggagggggactttgaggtttcagaagctcaagccaggcccagtgtcactcactctcttcttactgcctaattatccag

SEQ ID NO: 62637 - DNA, 90 bp, Mus musculus
gaaaggaaattggtccacaaggatatgggaaagagaaggtgctgggctgaagacagacagcagtgtgccacagtgtgggccctcctctgc

SEQ ID NO: 62638 - DNA, 67 bp, Mus musculus
tgagtgtgcacatgcgcacgtgtgtgcattcgtgcctgtgtgcctgtgtgtgtgtgcctgtgtctta

SEQ ID NO: 62639 - DNA, 101 bp, Mus musculus
gcttaggcgagctggacacacattggctgtgtctcactgagtctggtaaagtggtcaggaaaagagaggcatctttcaagtgaatccagcaggcgtccagc

SEQ ID NO: 62640 - DNA, 90 bp, Mus musculus
agcccttggggcagggtgctcctggtttggctttttctagagtgggagtttctcagaagaggctgagcccagagccttgagctcttggct

SEQ ID NO: 62641 - DNA, 87 bp, Mus musculus
cgctggctggtgctggcagccaggaacaggcgctggggtgtgcgcaagagttctgtgtgtgtatgtgtgtggcaggacctgcgggtg

SEQ ID NO: 62642 - DNA, 87 bp, Mus musculus
acacaaaggaggtagttgcgggtcccagagagaagtggcccaaggtgacttcactctctgagaacctgcaggttagctcatgttggt

SEQ ID NO: 62643 - DNA, 97 bp, Mus musculus
agccactgctctttgtgtgtgtgtggggtgggggggggctctctgagcctctgcctctcacagcaagtgtcagagagcaagctgcagagaggctccc

SEQ ID NO: 62644 - DNA, 98 bp, Mus musculus
gggcactttccggtgccggcacagatgagagacaggagaaggggtattgcctttgcctgcttgacttttcttgctcatctaccctgtacctgctgcct

SEQ ID NO: 62645 - DNA, 82 bp, Mus musculus
ggtggacattaagtttagaaggcacagattggaaacccaactctcctgaggactgatgtgtgcctgtagactgatgtgtgcc

SEQ ID NO: 62646 - DNA, 115 bp, Mus musculus
tactaatttggacttgggtccttaaagaacagtttttaaagctatgctgaatatttgaatatttaaacatttaggaagtactctgttgcttttgtacctttgtaaagctttggta

SEQ ID NO: 62647 - DNA, 88 bp, Mus musculus
agagcatctctgtcactgtcactcgggccgggcttaaggtgtaagccttcagctccacacatggcacccaggaaagtcaggatccttt

SEQ ID NO: 62648 - DNA, 115 bp, Mus musculus
gattctcatcacaacttcaacctctctagaacttcaggcgtggcatcctgaccaggggtcttggttgattttttttttttctgaagaggaatgtaggaggttgtcagggggactc

SEQ ID NO: 62649 - DNA, 79 bp, Mus musculus
acagtctctacctgggtagccctgagtcctctctcctcataaggtaaacattggtgactctgtctgtccctgagtctgt

SEQ ID NO: 62650 - DNA, 72 bp, Mus musculus
tctgcagaacagtaactgttgggtgagggagtgtggggctcgagatcacagacagacagacagacaggcaga

SEQ ID NO: 62651 - DNA, 99 bp, Mus musculus
tcacatagcgccaaacaggatctaagtgtgtctctttgtctgaattagcttctaagccaaacacaaggagcatgtatgtgattatgtgtgcgcatgtga

SEQ ID NO: 62652 - DNA, 63 bp, Mus musculus
gtctcaggctctctccctcttttagaggaacctggaacgagagagatgacagccagatgagat

SEQ ID NO: 62653 - DNA, 74 bp, Mus musculus
gaggtttaataaaggcacacccctcagtctccatcttggactgagtctgttttctgcctctctctgtgaatctc

SEQ ID NO: 62654 - DNA, 91 bp, Mus musculus
ggccctccgtgtcatttcacattttcctcagtcattctgtgagtcagtgctaggatatggctgcgtgggatatggggtgggaactggggcc

SEQ ID NO: 62655 - DNA, 102 bp, Mus musculus
ctggctacatgagactctgccagtgactgagtgaatgaatgaatgaatgaatgaatgaatgatttgtgctcagcccaaatgaatggcagtctgtggggctgg

SEQ ID NO: 62656 - DNA, 87 bp, Mus musculus
ctgtgaggcagaaaccctgagagcattggttgcatccggtctagagccttcttaacctgtcaggctccaggagtgactattttgcag

SEQ ID NO: 62657 - DNA, 96 bp, Mus musculus
agggagaccttgagcatgaatgcacttgaggcgcgctctctctctctctctgggtagggagcctgagccaggcctctgcatccatctaccttccct

SEQ ID NO: 62658 - DNA, 104 bp, Mus musculus
tatcctgtatcctgtatcctgtattatgtatgtatgtatgtatgtatgcatgtatgtatatataagtgcacatgccatggtatgtgtgtgcatgtcagaggatg

SEQ ID NO: 62659 - DNA, 158 bp, Mus musculus
ctgtggcacagctgggtcgctgaccgtgcctgctgagagcctcgctccagcactcacacggtctctcactctgcaggggtctcagtgcatgtgtgcagtcgctgactgtgcatgtctgagagcctcgctccagcactcacacggtctctctctctgca

SEQ ID NO: 62660 - DNA, 91 bp, Mus musculus
agcgggaggccctggggcactcagtctcagtccctggctagggcactactagagaaccggagggcactgggtgcccaagggtgcccctgct

SEQ ID NO: 62661 - DNA, 75 bp, Mus musculus
gccagtctggctaatgaggcgaccactgtcatcgtcccagggggaggatgtctctgtgtcactgagccactcggc

SEQ ID NO: 62662 - DNA, 71 bp, Mus musculus
tcaggagtggactctgtctctgagtgcttctcctcccttggaatgagtccagaggacagaaaactagctga

SEQ ID NO: 62663 - DNA, 76 bp, Mus musculus
gtctgtgtgtgtgtgtgtgtgtgtgtgtatacttgggcgtgcatgtgtgcacacacacacacacacatgcacacac

SEQ ID NO: 62664 - DNA, 77 bp, Mus musculus
ggacaatttaggagctggagagatggcccagtggttagagcactgactgctcttccagaggtcctgagttcaaatcc

SEQ ID NO: 62665 - DNA, 63 bp, Mus musculus
gttacagaagagagtgatcacttgggtcaggtggctgaactgcattcatttttgttttgtaac

SEQ ID NO: 62666 - DNA, 88 bp, Mus musculus
aggagagcttgtgtctctgtgactgtgtggccgcctgattaatgtcatgtggcctgcagatacacacacagacatacacacagcgcct

SEQ ID NO: 62667 - DNA, 106 bp, Mus musculus
ggaaaaaaaaaaaaaaagaaaagttattgcttggagctggagcgatggcttagcggctaagagcactgactgctcttccagaggtcctgagttcagtacccagcaa

SEQ ID NO: 62668 - DNA, 90 bp, Mus musculus
tctttgaaagggagacaggagctagacactgcagggttctgagacactctggggctctgccttttgtatctgttccctctttgctgtgga

SEQ ID NO: 62669 - DNA, 68 bp, Mus musculus
gtgagctctgccctcccacctgaacctgcatgttccctgcatctcagtgggactgtctctgtgctcgc

SEQ ID NO: 62670 - DNA, 72 bp, Mus musculus
ggcaggatttctctgtgtaactctgtctcacactataggccaggctggggttaaactcagagatcacctgcc

SEQ ID NO: 62671 - DNA, 77 bp, Mus musculus
tgtttgttttgcctgtctgagactgtgggtcaggtccctgacacacgtacacacacacacacacaggtatgcacaca

SEQ ID NO: 62672 - DNA, 115 bp, Mus musculus
agggagtcttgaggctgaattctcctcctgctggccagggtcttcttcaacagcaactggatgtgtggtggactctgtagcacagggaccctttcagcgaagctctatgacccct

SEQ ID NO: 62673 - DNA, 79 bp, Mus musculus
gagtatagtccaggggctggagagatggcccagcagttaagagcactgactgctcttccagagatcctgagttcaattc

SEQ ID NO: 62674 - DNA, 87 bp, Mus musculus
gaaaaatgcttggaagggctggagagacggctcagaggttaaaggcactgactgctcttccagaggtcctgagttcaattcccagca

SEQ ID NO: 62675 - DNA, 80 bp, Mus musculus
ggccctattgcttcctcatctggctgagagaaggatggacaggacagagagctcacaggcagggagaaggctctcaagcc

SEQ ID NO: 62676 - DNA, 64 bp, Mus musculus
gctggacttcttgtgggggaggtgggtggggctgagccactgagtctctgagggaatagctggt

SEQ ID NO: 62677 - DNA, 79 bp, Mus musculus
ggagtggttctgggagcagagagtgtacagagaagggaacctcggccagaacacttgtctaaatccaacttgctacttc

SEQ ID NO: 62678 - DNA, 62 bp, Mus musculus
caggaatacttcaggccggctggcccttggtgggagtcagtcactgcctgcctcctatcctg

SEQ ID NO: 62679 - DNA, 76 bp, Mus musculus
tctgtctctgtctcagaggaccagatccatcagggcctgtccacagcccctttcctgtcctccaggcaggtctaga

SEQ ID NO: 62680 - DNA, 108 bp, Mus musculus
tgtgtgtgtgtagatggtagagtccggatggttttctcttaagatttattatttactatgtgtctgtgtgagtgattgccaaatgtgtttaggtgcctgcagaggcca

SEQ ID NO: 62681 - DNA, 69 bp, Mus musculus
gtgtgtgcatgtagtgtatgtatgtatgtatgtatgtatgtatgtatgtgtgtgtctttgtgcatgtat

SEQ ID NO: 62682 - DNA, 70 bp, Mus musculus
aagcagactcagcgtcttcaccaactgagccgtcttgccatcctatgagtgtctctcgctgtgtctgctt

SEQ ID NO: 62683 - DNA, 108 bp, Mus musculus
gtggccacagagtgaattgtcctgtaggatggagaaggcacggcacccgtcctgggattgggctctctgtctgtctctcagctctgggaccttgtaccggtggcctgc

SEQ ID NO: 62684 - DNA, 68 bp, Mus musculus
ccttcactcatgacagttagcagacaccacggagagttctagtccctctgctaacctcagaaaggagg

SEQ ID NO: 62685 - DNA, 118 bp, Mus musculus
tgaattttgtagacacagttcactgccagaggggccagaactgtgtctgtctatttgtcagaagatggcccaactccaggcctggccctggtgtgggccagtgagctgtcagagtggc

SEQ ID NO: 62686 - DNA, 95 bp, Mus musculus
ctggcaagaatcgttgcttttgggctggagagacggctcagcggttaagagcactgactgctcttccagaggtcctaagttcaattcccagcaac

SEQ ID NO: 62687 - DNA, 92 bp, Mus musculus
cctggcatacgggcagagggtggcaatttgcctgagtccagcacccagcgactctggagagagtgtggtcactgtctgcacactgccccagg

SEQ ID NO: 62688 - DNA, 76 bp, Mus musculus
ggtgccagtgatgacagtgacactgtctcaaagccaggctgtgagcacatgtgtcctgaaacatccacggagcacc

SEQ ID NO: 62689 - DNA, 64 bp, Mus musculus
agggtcagtcagtacagaggctgcactgtgtacacaatgttccctgtgccctatgggggtccct

SEQ ID NO: 62690 - DNA, 72 bp, Mus musculus
atgatgggcatggatagactctagagtctcaccacagggaagggcgggagacctaagagctggggccattat

SEQ ID NO: 62691 - DNA, 96 bp, Mus musculus
tctctggtcctccagctccaggcctgtgtgctctcttctctgtgtatcaaacaaccacttattctgggccttgtcctgggtgctgagggtcacagg

SEQ ID NO: 62692 - DNA, 107 bp, Mus musculus
gtgaggcccattgtctgtctgaggactgtagctgagccccagccagacacagacactcagacatgtctcctcacagacggagggtctcgtgtttccttggctgtgtc

SEQ ID NO: 62693 - DNA, 62 bp, Mus musculus
ctttattctgagccgtgagggcatggttctccaacacactccctcactgtcccaggaagaag

SEQ ID NO: 62694 - DNA, 85 bp, Mus musculus
ctccttgtgtgcatttctgttggctactttgagctactggtgattggtgagaggacagagtgggcaaaagaagccccagggagca

SEQ ID NO: 62695 - DNA, 67 bp, Mus musculus
gcatgtatgtatgtatgtatgtatgtatgcatgcatgtgcatatatgtgtacatgatacatgcttgt

SEQ ID NO: 62696 - DNA, 113 bp, Mus musculus
ctggagaggaaagggttcatttggctcacatttctgcatccttgtccatcactgaaggaagtcaggacaggagcgcatgcagagctggagcctggaggcaggagatgatgcag

SEQ ID NO: 62697 - DNA, 88 bp, Mus musculus
ggctgtgtccacaggactcccggctttgagggttcagttctcttcaagacctgactgtgctcactgggtatttatgttctgttcagct

SEQ ID NO: 62698 - DNA, 68 bp, Mus musculus
gccgaagcatctctctgtccatagctttgaggcgcctgggtgagtctcataagagagtgtgcagtggc

SEQ ID NO: 62699 - DNA, 89 bp, Mus musculus
ctgagctgggagctttgctgattggctaggcaggctggccagagagctctatgtcctgcctgcctgcctgcctgtctcctcagctgcag

SEQ ID NO: 62700 - DNA, 128 bp, Mus musculus
ggaaatgagaactaaaggggcagccagaggaaccctttagccagttggggctcccctggactctctgtttctctcccaaagctgcagggcatccttcccagaatgccctagggcactgtcagagctgc

SEQ ID NO: 62701 - DNA, 84 bp, Mus musculus
ctgaagctccctcaggcacctcctcctctccacgcagctcttgtctgcagagagtgaacacaggagcctgtcccaggagcccag

SEQ ID NO: 62702 - DNA, 60 bp, Mus musculus
gccgggatgtgagaggctctcgttttaatccttagagcgcgcacacactcacacacaggc

SEQ ID NO: 62703 - DNA, 96 bp, Mus musculus
gtcacacagctaatggacactagagctgggatatgtggctaagcttgctggccactaatcctgactgtctctgtgattcatcacctttggcgtgac

SEQ ID NO: 62704 - DNA, 81 bp, Mus musculus
gttgctggttcaggcagagagatggctccatagatacagtgttgctgggcaggtgtgaggtttgaagtctgggtccagaac

SEQ ID NO: 62705 - DNA, 73 bp, Mus musculus
tagagaccatcaaatctgcctggctgcctggctgcctggctggcatcaggctcctaggatctgtctgtctctg

SEQ ID NO: 62706 - DNA, 119 bp, Mus musculus
ggcccagcctgggctgtcacagagggtcgtgggagtcagtgtggcagtggggcctgaagacagagaacactgagcacactggccaagccccgagaaaggccctggctgagcacgtggcc

SEQ ID NO: 62707 - DNA, 114 bp, Mus musculus
ggcgcagagctgcaggagtcagggcctgggaggttggacagggttgacagtgctgagagaggagatgcgctgcaaagatccctccaagccctgcccctgccccttgctatggcc

SEQ ID NO: 62708 - DNA, 61 bp, Mus musculus
gatcttggggaaaggaatgccctggcagtcacacgacagtctggcggtctgtccctcagtc

SEQ ID NO: 62709 - DNA, 71 bp, Mus musculus
catgtgggagtgtttaggtcacgttggctgagggcatgtctgtctgtctgtctgggaccgtcttaagcgtg

SEQ ID NO: 62710 - DNA, 76 bp, Mus musculus
gcctggcagaggacagtgggcgggcttccgggatcccacagtgtcagcatctctcactgtctgctgtctttttggc

SEQ ID NO: 62711 - DNA, 76 bp, Mus musculus
cataagtcagtaggagggaccatggccaacaggaacaccaggaaaagttctctgctgtgtctctctcagtgaagtg

SEQ ID NO: 62712 - DNA, 115 bp, Mus musculus
ggatagccattaacgaagtttggagatctggagatcttattatcactggcacctttgtgggagaaatattgattagtgtgtggcctcagaagttcaggctccttgttgtgctgcc

SEQ ID NO: 62713 - DNA, 63 bp, Mus musculus
tgtgtagactgtctctctctggggctggttcctacaccacccccacagaagcacagtctccca

SEQ ID NO: 62714 - DNA, 102 bp, Mus musculus
taagagtagattctgcagatatgaataaagagggtgagcacactgggctattgtgtccacgttcccagaagccagcccaggtctaggtgaggatctaccttg

SEQ ID NO: 62715 - DNA, 126 bp, Mus musculus
gtgtgtgtgtgtgtgtgtgaatgtgtattatacacaggttatatgtgtgcatatatatttgtgtatatacatatgtgtgggtgtgtgtctctggaaatgtgcacatatatgtgtgtatggggtgtg

SEQ ID NO: 62716 - DNA, 81 bp, Mus musculus
cctcttctctccctctatgtctgtctgtctgtctgtcctgaaaagtgagagatttatagtaaggatttggaattacagagg

SEQ ID NO: 62717 - DNA, 69 bp, Mus musculus
gcctaggcactgtgattctctgactttcaggagagcaaggctcagagaggtcccgctgcagcccgaggc

SEQ ID NO: 62718 - DNA, 86 bp, Mus musculus
ggacagtcctgtccctctgcctgtctgacagtgttagctccctgcagtgagatgcttccagaggtgacagctgaaggatcctgtcc

SEQ ID NO: 62719 - DNA, 87 bp, Mus musculus
cttgcctatctgtctgtctgtctgtcctaactggattctgggatctgtgaggacaggaaccatgtcttaccagatgaggtgggggag

SEQ ID NO: 62720 - DNA, 90 bp, Mus musculus
gagcagaaggcatcttctctgctcactcccactctctgggattatcctccacagcagagccaggaatgggctgagatgggcttctgcctc

SEQ ID NO: 62721 - DNA, 59 bp, Mus musculus
ggagaggatagcactgggcagagcagggccacttgggtctctcagtcactgtcctcttc

SEQ ID NO: 62722 - DNA, 115 bp, Mus musculus
ttctgctagttgagggggaagtaggaggctgcagggattagacattgagggtcacagagcatctccatgtgaggtattgtctctcctagtctacatcctacatcaacggggaggg

SEQ ID NO: 62723 - DNA, 80 bp, Mus musculus
aggtaactcagtctctctgagtcctgctttgccctgtggctgtgtggcaaggctcatgcatcactctgaaatgtgttcct

SEQ ID NO: 62724 - DNA, 117 bp, Mus musculus
ggaccagaggatacctccactccgtctacccagtgtttagactacctgttcaggactcccaaattgtacagtagtctgcacattggttaggctgggctgggttagaccctcggcacc

SEQ ID NO: 62725 - DNA, 112 bp, Mus musculus
actctttctgatcactagtgagcccatttctcagagttggagactgagactgaaaagagtgaggggatttcacagacattcagagataaggagtccctagcctgggatgggc

SEQ ID NO: 62726 - DNA, 85 bp, Mus musculus
caggtggccccagagtggagcagagagatagcactgaggatacaaggcatctgctcaggaaatgctggagaatcttggggtccac

SEQ ID NO: 62727 - DNA, 60 bp, Mus musculus
cttcgcgcccagtgtagactgagaggactggccgctcggcggcgctagggaccgcagagg

SEQ ID NO: 62728 - DNA, 86 bp, Mus musculus
gggcaaaagagcaaagggaggctggagagatggctcagcggttaagaccactgactgctcttccagaggtcctgagttcaaatccc

SEQ ID NO: 62729 - DNA, 111 bp, Mus musculus
caaatgttctgatccagtagcgacagccctggtcctggtccctgtgggagagagatgagagtgaacagggatatgacataggctggagtgtcctttggactagagcaggtg

SEQ ID NO: 62730 - DNA, 65 bp, Mus musculus
cagactgagagtacagagccaggtgctctgtgtgggaacatagcgctccctctaccctcattctg

SEQ ID NO: 62731 - DNA, 84 bp, Mus musculus
gctctcatttcagaaggtggtgtgtatatgtgtgacatatatgtatatatgtgtattctagttgctttctgttgctgtgaaagt

SEQ ID NO: 62732 - DNA, 102 bp, Mus musculus
gtgttttcttctatagacaaggccatcttatctaaatctgtctggttttggccaactcgaaaaaggtaagaagtttagagatgttgtctgattgaataatac

SEQ ID NO: 62733 - DNA, 62 bp, Mus musculus
ccgtcccatttatgcagctgaattgagcaggagagctcactcactctgtgtcagggtgacgg

SEQ ID NO: 62734 - DNA, 77 bp, Mus musculus
cacatggccggatgatgcacaggtggttagccttgcaccattttggtgatagttaactgaccctcagtggctgtgtg

SEQ ID NO: 62735 - DNA, 84 bp, Mus musculus
gtctgtgtgagtgtgtgtgtctgtgtgttgaggaagtctgtagacaaactaggggctgctgggcaggggttatctcactgggtc

SEQ ID NO: 62736 - DNA, 69 bp, Mus musculus
aacttagatgggctggagagatggctcagcggttacgagcactgactgctcttccagaggtcctgagtt

SEQ ID NO: 62737 - DNA, 95 bp, Mus musculus
tctgttgttcctgatctgtcttagctgtcaacactggggggcaggtctgacctcccctgtcagaagtcacttagctctcatgaacagacaattga

SEQ ID NO: 62738 - DNA, 87 bp, Mus musculus
gggttggggggatggagagtcggggacagaagcctcaggccaccacaggtgagtgagctcactgtcttctctgccttcccaggatcc

SEQ ID NO: 62739 - DNA, 72 bp, Mus musculus
gggaaggcagagaagacagtgagctcactcacctgtggtggcctgaggcttctgtccccgactctccatccc

SEQ ID NO: 62740 - DNA, 65 bp, Mus musculus
ccagggctgtctgccacactgtgtctcttgctgaaggacagcattttggaatggaaagagcctgg

SEQ ID NO: 62741 - DNA, 112 bp, Mus musculus
agtgacacactatgattttgttcctgtgaggatgagtccctggtcctctgtggctctgtcaatctctgaggactcatgaacacccatgggactggttgtagtttggggtact

SEQ ID NO: 62742 - DNA, 76 bp, Mus musculus
ttctagagggctctcagtctctctccctgaggagctctgcaaacttgagggaacaagatgggattatatgctagaa

SEQ ID NO: 62743 - DNA, 79 bp, Mus musculus
tctctgggtatgtctgtatgtctctctggctgtgctggaagtcaccctatacaccagactggcctcagactcctagaga

SEQ ID NO: 62744 - DNA, 60 bp, Mus musculus
tgtggcagtggagcccttgctgtggggtgtatcctgtccacctctcagtccctctgtcca

SEQ ID NO: 62745 - DNA, 68 bp, Mus musculus
gtgtatatgtatgtatgtatgtatgtatgtatgtaaatatatgtgtgtgtatatgtgtatgtgtgtgc

SEQ ID NO: 62746 - DNA, 66 bp, Mus musculus
ggcagtggatatgtgcttgtgccaggcttctgagtgttctcacctgtcactgtcactgtttatgcc

SEQ ID NO: 62747 - DNA, 80 bp, Mus musculus
attgaaagaaaagagagggctagagagatggctcagcggttaagagcactgactgctctttcagagtttctgagttcaat

SEQ ID NO: 62748 - DNA, 120 bp, Mus musculus
gagtgaagtcccaggagtgcagtagcagatgtgcagtcccacacccactctcactgacccttttttgtggttttgctctgcatttgttttttcactttatctcctgaaaatattttgctt

SEQ ID NO: 62749 - DNA, 61 bp, Mus musculus
tcaggtgtgtggccttgggaacaggctctgcattctgccctgttctcagtctctcacctgg

SEQ ID NO: 62750 - DNA, 104 bp, Mus musculus
agagggatgaaaaggagggtcacaagttagaagccatccagagtaacataagactcctatctgtctgtctgtctgtcttttatttatccatatctaatcccttt

SEQ ID NO: 62751 - DNA, 71 bp, Mus musculus
tgacagggatttcagagccagctctgaccacagagttttctcaagtgctgtcctctgtagctctctgtgca

SEQ ID NO: 62752 - DNA, 77 bp, Mus musculus
aggcatgcccccatggcaccctctttcctgctggctccactctcagtcagcactgacagggcccacagagcctgcct

SEQ ID NO: 62753 - DNA, 73 bp, Mus musculus
gccatggatgacagacctgcatgcttctgcctttcctataggtagagctgtgtgtgtctgtgtgtctctgtgt

SEQ ID NO: 62754 - DNA, 102 bp, Mus musculus
gggcttctttgctgggtttttgctagtcccactgcctctcccaccagcctagtatgctctgggcttgggatgggggtggggaggtgtcttctgcagaggcct

SEQ ID NO: 62755 - DNA, 117 bp, Mus musculus
tgtctctgtctgtgtctctctctctcacagagagagagagagagagagagagagagagagagagaaagagagagagaaacatgtgacctgagagagagagagagagagagagagaga

SEQ ID NO: 62756 - DNA, 86 bp, Mus musculus
tgggctaaatggaccatcctagtagtagcagtacctagtagtaactttgttattgagagtgatttgaattgtgtggacctggccta

SEQ ID NO: 62757 - DNA, 117 bp, Mus musculus
gttaccaaatctttgttgaaggagcagatgaaggctattctttaggaaatcagtctggctgactgtctcccctgctcacaagtctgctgtaccttcagcatatgttttgtctgttgc

SEQ ID NO: 62758 - DNA, 64 bp, Mus musculus
atagccaggggtgggggtagggcattctcattttgaggcaatgtctccctcactgacttactgt

SEQ ID NO: 62759 - DNA, 129 bp, Mus musculus
tatatatatatatgtatgtatgtatatatatgtatatacatatatacatatatatgtgtatgtatgtatgtatatgtatatgtatatacacacacatatatacatgtatatgcatatatgcatgctaca

SEQ ID NO: 62760 - DNA, 117 bp, Mus musculus
gggggtggggtgtgatttgtagagtgtccaccgagatggcttgatggttaagagcactgactgctcttccagaggtcctgagttcaattcccagcaaccacatggtgcctcacaacc

SEQ ID NO: 62761 - DNA, 80 bp, Mus musculus
catgctccaccagagtgttaaacttaaggacatctatgctgttcagctgagagcctcagtgtgtctgtctggtcagcatg

SEQ ID NO: 62762 - DNA, 94 bp, Mus musculus
gctaggacttttaaatgggttctggggattgtactcaggtcctcatgcttgcaagctcagtactttaccagcagaatcatctctccagccctgg

SEQ ID NO: 62763 - DNA, 73 bp, Mus musculus
tggtgtatgggtgtgtgtgtatgtgtgtgtggtgtatgggtgcatatgtgtgtatatatatgtgtgtgcatca

SEQ ID NO: 62764 - DNA, 87 bp, Mus musculus
ggcatatggttgagagcagagagtggacagtcctggatttgccgatcctgtggactttggatgtatcatttctgcacattgtctgcc

SEQ ID NO: 62765 - DNA, 107 bp, Mus musculus
acccagctgccaccttccagctgccatctacacagacctgacttgtctccctctctccgggtcaggtccgagagacattggcagcagagacaggcctcagcgtgcgt

SEQ ID NO: 62766 - DNA, 117 bp, Mus musculus
gccagagagaacaattctgtttatcttgttacttaggcaggtttctatctatctatctatctatctatctatctatctatctatctatctatttattgagacaggattcctctgtgt

SEQ ID NO: 62767 - DNA, 94 bp, Mus musculus
atatgtgtgagtgtgtgtgtatgtgctgacatgtatgtgtgtagagccgtgtgtatgtatgtatgtatgtatgtatgcatgcaggtatatgtgt

SEQ ID NO: 62768 - DNA, 121 bp, Mus musculus
atatatgtatgtatgtatacatgcgtgtatatgtatatatgtatgtatacatgtgtgtatatgtatatatatgtatgtatacatgtgtgtgtatgtatgtatgtatgtatgtatgtgtgtg

SEQ ID NO: 62769 - DNA, 111 bp, Mus musculus
tggagaagccctgggactatggtgggctcaatttcattcactcattcattcactcattcactcattcatcagccatccctgagccccactcctgccaggcacttgtctcca

SEQ ID NO: 62770 - DNA, 80 bp, Mus musculus
ggcctgcgccccattctctccgactctctgagctcagatctcagactgaaacctcagtgaggcggggaggcgggaaggcc

SEQ ID NO: 62771 - DNA, 81 bp, Mus musculus
acttagccagtcacctgctgagtgaatttgggctcatccccagtgaccctctctcagtgtgtgtgacttgatttgctgtgt

SEQ ID NO: 62772 - DNA, 106 bp, Mus musculus
ctcaacagggctctcctgggcccagtaagtctctagagtctctgctcatgggtaactgtgtgtcatggagctggcttctgtcctcctggttggccttccagtagag

SEQ ID NO: 62773 - DNA, 58 bp, Mus musculus
tcagtctgtcgctgtgtctgagcacgtgcatggagctcagaagagggcataagcctga

SEQ ID NO: 62774 - DNA, 102 bp, Mus musculus
gtgctatggaagccagtggttcatgtcaggtgtctttcttgatgatctttttcttctctgagacagcctctctcagtgaacctggtgctggccagtgagcac

SEQ ID NO: 62775 - DNA, 81 bp, Mus musculus
gagagcactagagggactggagagatggtttagtggttaagaacactgactgctcttccagaggtcctgagttcaattctc

SEQ ID NO: 62776 - DNA, 58 bp, Mus musculus
gctctgcaaagtctctgtgactttgtctctggcaaagtctggatgttgatgcagtggt

SEQ ID NO: 62777 - DNA, 67 bp, Mus musculus
gctctagtcaagagggaccaacaggaactccaggagaagttctcagctgtgtctctctcaggggagc

SEQ ID NO: 62778 - DNA, 110 bp, Mus musculus
agaacacaaggtcttggcagggtgtgtctgagcattagaattgtattttatttcattagaagttattagaggacattaaagcaagggagtgacctgtcacatggtattct

SEQ ID NO: 62779 - DNA, 94 bp, Mus musculus
ggttcaggggctggagagatggcttagtggttaagagcactgactgctcttccaaaggtcctgagttcaaatcccagcaaccacatgatgatcc

SEQ ID NO: 62780 - DNA, 68 bp, Mus musculus
tatatatcccatatatatatatgtatatacacatttgtataggtatatgtatgtgtatatgatgtata

SEQ ID NO: 62781 - DNA, 121 bp, Mus musculus
ggcatccgtgggtaattacatccccctttaacgcatgcaaattgtatcagtattatttatatattcaaagccacggatgaataatatatgcatttatgcagaggtaattgccttagccagg

SEQ ID NO: 62782 - DNA, 112 bp, Mus musculus
gagcttaaaaatgcttgaaaaccagtttgaaatggtgagtgtacactgagagcagactaaattgctgcaggatggctcacttttaaatggttaatctggtgcaaggtggctc

SEQ ID NO: 62783 - DNA, 68 bp, Mus musculus
caggcctgtctctgacactctcttctagcagcctgggcccaggcctcttcaacagggtggagctcctg

SEQ ID NO: 62784 - DNA, 68 bp, Mus musculus
tcctaggctcactcactcagtctgtggatgggagctattttagaacagcgtggacagtgggcaacgga

SEQ ID NO: 62785 - DNA, 62 bp, Mus musculus
catatatatgtatgtaacatatattctattaccatatatatgtatgtatgtatgtatgtatg

SEQ ID NO: 62786 - DNA, 60 bp, Mus musculus
ccctgagacaggctctctcactgaagctggatttaggctggtggccagtgagccccaggg

SEQ ID NO: 62787 - DNA, 121 bp, Mus musculus
atatatatatatatatatatatatatatatatatacacacacacactatatatgtatatgtgtatatgtatatatgcatgtatatatatatacatatatacatacatatatatatatatag

SEQ ID NO: 62788 - DNA, 84 bp, Mus musculus
gtgtatgtatgtatatgtctgtgaatgcatatatgtatgtgtatatgcatgtatgtgtatgtataggtatgtgtgtatatatgt

SEQ ID NO: 62789 - DNA, 66 bp, Mus musculus
gtatgcatgtatgcatgtatgtatgtatatatatgtatgtgtatatgcctctgtgtatatgtatat

SEQ ID NO: 62790 - DNA, 96 bp, Mus musculus
ggctggcgtcctgaactgaataaaaagcagagagtgagctgtgtgccagcacttgtctcaggcagctctttggctgagtatacagtgtgaccagct

SEQ ID NO: 62791 - DNA, 89 bp, Mus musculus
gcctattcctctgtgtgtgtgtgtgtgtgtgtgcgcgcgcgcgcgcgtgcgtgcgcgcgcacacacacacagacagagtgagaatgagc

SEQ ID NO: 62792 - DNA, 89 bp, Mus musculus
gctcattctcactctgtctgtgtgtgtgtgcgcgcgcacgcacgcgcgcgcgcgcgcacacacacacacacacacacagaggaataggc

SEQ ID NO: 62793 - DNA, 61 bp, Mus musculus
tgctcagatgagatactcagtgcggacctcccactcgctgagtggctcactctgcctggca

SEQ ID NO: 62794 - DNA, 76 bp, Mus musculus
tctctctctctctgtcaccctctgaagcctgggctgctgtgtcttctggccaggagtggggtgtaggttggagaga

SEQ ID NO: 62795 - DNA, 75 bp, Mus musculus
ggagacactgaatgtgaaatggtagagacagtaagggcgctcatctgctctgtctgtctctcacctgtctccagt

SEQ ID NO: 62796 - DNA, 219 bp, Mus musculus
ggccctgtggccctgtggcctgtggccctgtggcctgtgaccctgtggccccgtggccctgtggctctgtggctctgtggccctgtggccctgtggccctgtggccctgtggccctgtggcctgtggcctgtggcctgtggctctgtggccctgtggctctgtggccctgtggcctgtgaccctgtggccctgtggccctgtggccctgtggcctgtgg

SEQ ID NO: 62797 - DNA, 80 bp, Mus musculus
tgtgtatattcacacatatatatatagaaacatatgtatatatgtatgtatgtatgtatatatgtgtgtgaatatacata

SEQ ID NO: 62798 - DNA, 116 bp, Mus musculus
gtggaaactgttcaggaaggattaggattcgattgaggggctggagagatggctcagcggttaagagcactgactgctcctccagaggtcctgagttcaattctcagcaactacac

SEQ ID NO: 62799 - DNA, 104 bp, Mus musculus
aggaaggaaggaaggaaggaaggaaggacttaaccagtcctggagaggggggaccctcagtctgactgtcctgtcttattttaccatgcctgtgaccccaacct

SEQ ID NO: 62800 - DNA, 116 bp, Mus musculus
caggctggccttataagtacatgaatcagtatggatagcccctaaacaattttaattttttgagactgggtttcatgttatccagattggcctcaaatgctgtgtaactcaggctg

SEQ ID NO: 62801 - DNA, 114 bp, Mus musculus
caatgtttaaaattctcttctttccatatatgtgtatctattattgttgccatatatacatattgtatgtatacatgtatgtatatatgtgggaatgtggtattgttgctgttg

SEQ ID NO: 62802 - DNA, 97 bp, Mus musculus
cagtgtgtgtgtatatgtatgtatgtacatgtgtatatatgtatatgtgtgtgtatatatatatatatgtacatatatgtgtgtgtgtacgaaaatg

SEQ ID NO: 62803 - DNA, 74 bp, Mus musculus
ccagcactggaccaggcagtaggagctgggcagactcccaaagagtgagtgactctgcctggctcagtggctgg

SEQ ID NO: 62804 - DNA, 116 bp, Mus musculus
gccactgttaccctgaagcttattatgattcagattttgtttttgagacaagacacccaggtttcttgtattaaaaaggggagcaaaggtgtgaggattagtgagtgacatttggc

SEQ ID NO: 62805 - DNA, 74 bp, Mus musculus
cacagcctgctctccggcgctgttgactcccaggaaatctggcctcacacatgagagagtccagtagtgttgtg

SEQ ID NO: 62806 - DNA, 91 bp, Mus musculus
ggtgatgtcaaccgtgagtgtctggaagttttctgaaaatgaatcttggaggtcctctcagtgagctacaaagactcaaggtgcgtctgcc

SEQ ID NO: 62807 - DNA, 75 bp, Mus musculus
tttgtttacttactagtgcatatgcatatgtgtgtgtgcacacagcatggtgcgcttgtgcaaggaagagagcaa

SEQ ID NO: 62808 - DNA, 116 bp, Mus musculus
gataagtgttagtatctcttgggctggagagatggctcagcggttaagagcactggctgctcttccagaggtcctgagttcagttctcagcaaccacatggtggctcacaaccatc

SEQ ID NO: 62809 - DNA, 85 bp, Mus musculus
tcaaacttgtaagtgtagaatgagacagggagactgagagccttgactctctagtgagactctgtcagtgaaacaagacaaatga

SEQ ID NO: 62810 - DNA, 93 bp, Mus musculus
cgaagtcctgaagcttacactcagggtctcagtggttcatctcagtggtccacaaagggagggctcttgacttctgaggtcttcaagactttg

SEQ ID NO: 62811 - DNA, 111 bp, Mus musculus
tctctatctgtctatctatctatctatctatctatctatctatctatctatctatcatctatctatagagagagacaggcagacagacagacagacagacagagacagaga

SEQ ID NO: 62812 - DNA, 64 bp, Mus musculus
cactacacagtgtccacacaagctctgctgtcaccagtgctttggaggggatattgttgtactg

SEQ ID NO: 62813 - DNA, 97 bp, Mus musculus
cagtactccagtgcccaggaccacgctgactactgtttctgtgtggctccagcgtgaggccttaggaactcaagtctgtgtggaaagcgcgttactg

SEQ ID NO: 62814 - DNA, 105 bp, Mus musculus
gtgagtctgctaacttccagggctttcagagcctggtttcatgagcttcctgagcctcatgagtttccttaggtattgagtcttatgagttgcccagtcatctcc

SEQ ID NO: 62815 - DNA, 83 bp, Mus musculus
agcatcagtatagtgagcattaatactgtattactgatcagtgtctgcagtgaacagtcttggtctatctctacactgctcct

SEQ ID NO: 62816 - DNA, 77 bp, Mus musculus
ctgcttctggttattcactcacccagcttgtgagagggcagactgtgaggagagggtgggctgtgaggagagggcag

SEQ ID NO: 62817 - DNA, 83 bp, Mus musculus
gtgagagagtctgagtctgagtctgagtcactatctctctaacccgaaggtgccccagtccctctcagtttggctttctgcac

SEQ ID NO: 62818 - DNA, 66 bp, Mus musculus
gtgtgtgtgtctgtgtgtctgtacatatacatgtgtatatatgtgtgtgtggataggtgtatgtat

SEQ ID NO: 62819 - DNA, 81 bp, Mus musculus
tatgtaagcatatatatatgtatatatgtatgtgtatatgtgtgtgtaatatgtgtatgtatgtgtgtatgtggttgtgtg

SEQ ID NO: 62820 - DNA, 113 bp, Mus musculus
gagcggctgggatgaagtgacaacgtgcccttaacaaactgattttgtttttgacagaaaattccaagacagaactgggagcttgtggatggattttggtggctgcctcgttc

SEQ ID NO: 62821 - DNA, 92 bp, Mus musculus
catgcatgtgtgtgaggtgtgatgtggtgtgtgcatgtgtatagtgtgtgtagtgtgtgtgcacatggtataatgtggtatgtgtgtgtgtg

SEQ ID NO: 62822 - DNA, 80 bp, Mus musculus
agtctgggtagctacttcctctacctgcaagggtcaccaagtccaagccaggtttcagtcaggctgagtggctgacagct

SEQ ID NO: 62823 - DNA, 74 bp, Mus musculus
aggaggaaaaaagggaggaagggaggaaggacagagaaggactcactcactctctggtatttctgctgcttcct

SEQ ID NO: 62824 - DNA, 79 bp, Mus musculus
tcacaacgctgcaaagtgtcactcagtgtccctgtgacccagcacagaggcattaggggcctcatttcacagacagtga

SEQ ID NO: 62825 - DNA, 61 bp, Mus musculus
gcatgtatgtatgtatgtatgtatgtatgtatgtatgtgtatgtgcatgtatactgcatgc

SEQ ID NO: 62826 - DNA, 116 bp, Mus musculus
gtgaagacatagaggggacttgcaccctggtcccttggactctggctcactgtttcatttcaggttaaatgaggccataagagctttccttgacttgcctgtctcccatacttcac

SEQ ID NO: 62827 - DNA, 82 bp, Mus musculus
gccccacaatcccaggctaacacctttataaaaaaagatttattcattatttatacagtgttctgcctgaatgtgtgcttgc

SEQ ID NO: 62828 - DNA, 89 bp, Mus musculus
atcccagggtcatccagagattgagagcacagagtgaggctaccaaaccctttccctgctgtatcttatatcttatttaatcctgtgat

SEQ ID NO: 62829 - DNA, 88 bp, Mus musculus
gttttattttttgtatgtctttatattcagggaaaaatgttaagtgggatttttctttatatataaagaaacccactgaaagtaattc

SEQ ID NO: 62830 - DNA, 120 bp, Mus musculus
gggctcccaacctctccatgtcgccttttgcgtgctaatctctgggatttctctttctgtctcactaactcagctagggaaggctactaaaaactagggaaggctaccatgcggcagtgg

SEQ ID NO: 62831 - DNA, 83 bp, Mus musculus
gcttttgctctctgtctggctctggctctcttactgggtagccagagagagtgagcctggggttggatggagggcatcaaggc

SEQ ID NO: 62832 - DNA, 73 bp, Mus musculus
tatgtatactatgtatgtatgtatgtatgtatgtgtgtgtatgtatgtatgtatgtatgtatgtatgtatgta

SEQ ID NO: 62833 - DNA, 91 bp, Mus musculus
ctctctctctctctctctctctctctctctctcgtaatagccaaataaaaggagtctatcagtttgagagagaattagttgggagcatggg

SEQ ID NO: 62834 - DNA, 84 bp, Mus musculus
ggccatggtggtctgataggatgcagggacaatttcaatatttttgtatctgttgaggcctgttttgtgaccaattatatggtc

SEQ ID NO: 62835 - DNA, 85 bp, Mus musculus; identical to SEQ ID NO: 57439

SEQ ID NO: 62836 - DNA, 84 bp, Mus musculus
aaggtatcattgagatgagtgttgtttagtttccacatgtgtgttggctttctaatatttattttattattgaagatcagcctt

SEQ ID NO: 62837 - DNA, 110 bp, Mus musculus
ggatctatctctaggagctctgggttgtccaagtaactgatattgttgatctttctttggtgttgcagttcttcagttcttccccttattattcctttgtggttcctgga

SEQ ID NO: 62838 - DNA, 96 bp, Mus musculus
tatgatattgaagtcttccactattaatgagtaggttttaaagtattatttaagctttagaaatatttcatttatgaatgtgggtgtctttgcatg

SEQ ID NO: 62839 - DNA, 123 bp, Mus musculus
gggtgtgttgtcgtatccaccactgggtgatgtaggagtgctgtgttctgatgatagtgagcagtcttggtttctgttggtaggattattacatttgcgttttgccatccggtaataactgga

SEQ ID NO: 62840 - DNA, 86 bp, Mus musculus
tagacactattgctgatgtcagaaagtattctcagatagaagactagtatagctatcctctgagacactctgtcagcatctgacta

SEQ ID NO: 62841 - DNA, 85 bp, Mus musculus; identical to SEQ ID NO: 57470

SEQ ID NO: 62842 - DNA, 66 bp, Mus musculus
gtgctatatatgtatatatagtaagtgcatatgtacatacatatatacatacatgtatgcatgcac

SEQ ID NO: 62843 - DNA, 85 bp, Mus musculus; identical to SEQ ID NO: 57439

SEQ ID NO: 62844 - DNA, 85 bp, Mus musculus; identical to SEQ ID NO: 57439

SEQ ID NO: 62845 - DNA, 63 bp, Mus musculus
gtgcggacttcgtgaccagcagaactcgggagctctgagttctgtgtgtctctgagtctgtgt

SEQ ID NO: 62846 - DNA, 114 bp, Mus musculus
tgtctgtatctgtctgtctgtctctcagtgagtgtgtgtgtctgtgtgtgtgtgtgcgagcatgactgtcaggattagtagtcactggtgaaatgggagcctgggacacaatgc

SEQ ID NO: 62847 - DNA, 104 bp, Mus musculus
gaatgccttaacctgagtagtttcactttagaggattgaattatgttacatgtaagactatagattattttcttattaagtatagaaactaaaagaaggccttc

SEQ ID NO: 62848 - DNA, 106 bp, Mus musculus
gaaagttcacaatgtagagaaaggccagaagatttgcgtgtctcattctctgcctcagtttgaggcagtgagtcaggccacgggttttcattctctgggaggtttt

SEQ ID NO: 62849 - DNA, 92 bp, Mus musculus
gagaataagcaggataatgcatgtaaaaccagccaacactctgagtgctcagcaagaggtagttggttttaatcactgcacctgctttcctc

SEQ ID NO: 62850 - DNA, 84 bp, Mus musculus
aggcagtaactctgtgtctgtctgtaagataaattggccttctctagacccatgctatttcagataggctctgtgcatctgcct

SEQ ID NO: 62851 - DNA, 103 bp, Mus musculus
ccagatatggcgcagaagggggactgaataaatgtgtcttgaactaaattgagatcagttgaatgaaaggaaatagtcagtgtgtaatctggccatgttttgg

SEQ ID NO: 62852 - DNA, 69 bp, Mus musculus
ggttctaagaagacaagaagcccaagggctcaggccggtggggccctgtgtctggctgtctctgaaatc

SEQ ID NO: 62853 - DNA, 98 bp, Mus musculus
gaaagtggtaacaattcagggacagtatcttcaagctgtgggtcagtagtcctattgattgatctgtctatgtctgtctgtctgtctgtctgcctgtc

SEQ ID NO: 62854 - DNA, 74 bp, Mus musculus
gggcggggggctggggagatggctcagtggttaagaacactggcactgactgctcttccagaggtcctgagttc

SEQ ID NO: 62855 - DNA, 84 bp, Mus musculus
tgtttttcagttagcatcttcacagatctctactcctgggtcaaatttgagctgatcaagtagagagtgagcacatggacaaca

SEQ ID NO: 62856 - DNA, 81 bp, Mus musculus
ctggcacttcttttctaggtataagagccacctgtaccaggatcaccctgagtctgactctgtgcctcatgccctgtccag

SEQ ID NO: 62857 - DNA, 87 bp, Mus musculus
tgagtgtctgtctgtgagtgtctgtgtaaggtgtgtacatgtgaatgtgcatatgtctgtgtctgttatttgtagatatttaagtca

SEQ ID NO: 62858 - DNA, 96 bp, Mus musculus
tgggaagggagctgtgcttgagggaagtggtgacaagactgaacttactttgttctctgtccatctctccctctcacatcttgctttgctttctca

SEQ ID NO: 62859 - DNA, 64 bp, Mus musculus
gctggggctggagagatggctcagccggttaagaacactgactgctcttccagaggtcctgagt

SEQ ID NO: 62860 - DNA, 84 bp, Mus musculus
gccagcagactggatttggaattgcttaggagacacacttctgtgtctgtctctgagggatttttcagaaggtttgatggaggc

SEQ ID NO: 62861 - DNA, 99 bp, Mus musculus
gccttgggcagttggctaagtttctagtaccaggcatgatttccctcttgttgagtaggtcttaagtctaatttgggagctgttgggtattgccaaggt

SEQ ID NO: 62862 - DNA, 82 bp, Mus musculus
gctcagtccattagtaagagagcagagagtggagaaaagaatttcactgtctcattttccaacttgcctttgctggagtggc

SEQ ID NO: 62863 - DNA, 87 bp, Mus musculus
cacagacagtagaaatccacatgagctgtgctgggcttggcagaggacctgtggcctcactttctgtttttgattttatgcactgtg

SEQ ID NO: 62864 - DNA, 78 bp, Mus musculus
ccaccctaagcgcctctgactgactctctcactcatggactccaagatgaggaagtgggtggaacccaggcagggtgg

SEQ ID NO: 62865 - DNA, 119 bp, Mus musculus
tactgctacattgaaaaataacacagccctcttggagattgatggaatagcattgatagtactaaagatgctacagtctttgatgctggggattcacactctatggtaaatgctttgtg

SEQ ID NO: 62866 - DNA, 101 bp, Mus musculus
tgtggcttcttttgtttctgaactgtctctgattctttctgtctctcaggcttaccggccacttcaaggatcactgggaggacagtgaggccatacagaga

SEQ ID NO: 62867 - DNA, 120 bp, Mus musculus
cagttgcaacccacatagggttcagggaggaagccaccaaagcccagggactgtctgtgcctctctggctcttgggggttcctcactcaccctgcccttttgtctcacttgtcctgtgca

SEQ ID NO: 62868 - DNA, 81 bp, Mus musculus
agagagaagaaattgagcactgagctcaggcaaggcacctatggttgtacagctcagtgtgagtctaggtccatgctcttt

SEQ ID NO: 62869 - DNA, 81 bp, Mus musculus
tgtgggtcggagagatggctcagcatttaagagcactgactgctcttccagaggtcctgagttcaatttccagcaaccaca

SEQ ID NO: 62870 - DNA, 78 bp, Mus musculus
tcccacatcctagaagtttcttggcagtgtccataatcacgtttgtctcttacactagactgagagctctttgtgggg

SEQ ID NO: 62871 - DNA, 90 bp, Mus musculus
gaggactccatggaacattcaacgctgtcggtgagtttgggattcaaaaacaaaaaaaccaccgaccgttgactgtaccttgggattctt

SEQ ID NO: 62872 - DNA, 81 bp, Mus musculus
tggctgcactcaacattcattgctgtcggtgggtttgaatgtcaaccaactcactgatcaatgaatgcaaactgcgggcca

SEQ ID NO: 62873 - DNA, 110 bp, Mus musculus
tgcacttatccactgagccacctctccagtacagaatgattttatcttatacttttaggtaacaaatctgtcacagaagggggatggaagtcagggcaggaattcaagca

SEQ ID NO: 62874 - DNA, 81 bp, Mus musculus
gccatgctcctgactcatgctgtggccccaggtaactcagtctctctgaggcttgtcccttgtgactcagtgctgtgtggc

SEQ ID NO: 62875 - DNA, 93 bp, Mus musculus
ttatttattttacatgtatggatattttgcctgcatgtatgtatgtatgtatgtatgtgcatgcctggtatccttagacatcagaagaggtaa

SEQ ID NO: 62876 - DNA, 116 bp, Mus musculus
gctgtggtgtgtcacagtctgtcacacagtatgcccctggaagctgtggtgtgtcacagtctgtcacacagtatgcccccagaagctgtggtgtgtcacagtctgtcacacagtat

SEQ ID NO: 62877 - DNA, 112 bp, Mus musculus
ttgtgtctaaaggatatttgggggctggagagatggctcagcggttaagagcactgactgctcttccaaaggtcctgagttcaaatctcagcaaccacatggtggctcacaa

SEQ ID NO: 62878 - DNA, 97 bp, Mus musculus
gctagccctggatggcttaaactcaatttgtatatttgaaaagagctaagtctctagcttcaaatcttcaacatttggtgtcagccacaactgctgc

SEQ ID NO: 62879 - DNA, 80 bp, Mus musculus
tgaactaaaatttgaattttagtgcttttcaataactttggttaagagcactgactgctctttcagaggtcctgagttca

SEQ ID NO: 62880 - DNA, 113 bp, Mus musculus
cagtggcatggacctgtcccacaaggtagttgaggattgtatcaaagtggtagtcactctagttactcagcacccaacctttggtatctgtgagaacctccacatggttgctg

SEQ ID NO: 62881 - DNA, 69 bp, Mus musculus
tgtcatcacgcaccatcttctgagtggagagagcgcccacagtggatcagaaggtgaacatgtggagca

SEQ ID NO: 62882 - DNA, 87 bp, Mus musculus
cataacttctgttagtttcactgtgtctctgtttagtttctgtttccaggatctgtccattgatgagagtgaggtgttgaagtcttg

SEQ ID NO: 62883 - DNA, 115 bp, Mus musculus
tccttgaccaaggtatcattgagaagagtgttgttcagtttccacgtgaatgttggctttctattatttattttgttattgaagatcagccttagtacatggtgatctggtagga

SEQ ID NO: 62884 - DNA, 96 bp, Mus musculus
gatcagccttagtccatggtggtctgataggatgcatgggacaatttcaatatttttgtatctgttgagacctgttttgttaccaattatatggtc

SEQ ID NO: 62885 - DNA, 85 bp, Mus musculus
ggccatggtggtctgataggatccataagacaatttcaatatttttgtatctgttgaggcctgttttgtgaccaattatatggtc

SEQ ID NO: 62886 - DNA, 76 bp, Mus musculus
tctaagtatatctatttgaattatacattctggaactgggtaaatgaccacaggatgtgttcagggacctactgga

SEQ ID NO: 62887 - DNA, 80 bp, Mus musculus
gggctgctgaaacacactcactctatcccgtgcaatgagactagcctcgtggggtgcaagagctgagtggccagcgacct

SEQ ID NO: 62888 - DNA, 96 bp, Mus musculus
gatcagccttagtccatggtggtctgataggatgcatgggataatttcaatatttttgtatctgttgaggcctgttttataaccgattatatggtc

SEQ ID NO: 62889 - DNA, 85 bp, Mus musculus; identical to SEQ ID NO: 57439

SEQ ID NO: 62890 - DNA, 85 bp, Mus musculus
ggccatggtggtctgataggatacatgggacaatttctatatttttgtatctgttgaggcctgttttgtgaccaattatatggtc

SEQ ID NO: 62891 - DNA, 96 bp, Mus musculus
gatcagtcttagtccatggtgatctgataggatgcatgggataatttcaatatttttgtatctgttgaggcctgttttgttaccaattatatggtc

SEQ ID NO: 62892 - DNA, 102 bp, Mus musculus
atattttgtatgttgattttggtatacttctactcttctgaaattattgatcatttttagaattatactggtggaatttttgcaatatcgtatgcaaaatat

SEQ ID NO: 62893 - DNA, 95 bp, Mus musculus
gcattttaagaaggatatggcctgaaccatttgctgagtaagtacccaatcaccaaactacctcagttgtgtctctctgattccttcttctctgt

SEQ ID NO: 62894 - DNA, 90 bp, Mus musculus
gtatatgtaggtatgaacatatatatatatatatatatatatatatatatatatatatatgtttatgtatgtgtatgtatttttcaaagc

SEQ ID NO: 62895 - DNA, 85 bp, Mus musculus
ggccatgatggtctgataggatacatgggacaatttcaatatttttgtatctattgaggcctgttttgtgaccaattatatggtc

SEQ ID NO: 62896 - DNA, 78 bp, Mus musculus
tatgtgtatatgtgtatatgtgtatatatgtacgtatgtaggtatgtatatatgtatatatgtacatatgtatatata

SEQ ID NO: 62897 - DNA, 85 bp, Mus musculus
ggccatggtggtctgataggatacattggacaatttcaatatttttgtatctattgaggcctgttttgtgaccaattatatggtc

SEQ ID NO: 62898 - DNA, 107 bp, Mus musculus
acagaggtcctaattcagtcccctgaaggctccatggttgtcagttcactctctgtgagtccttatgggcccagactagttgattctgtgtattctattgtggtgtc

SEQ ID NO: 62899 - DNA, 67 bp, Mus musculus
gtatgtgtgcatatgaacacatatgtggactcacacacacacatacatgtacgcatgacacacacac

SEQ ID NO: 62900 - DNA, 86 bp, Mus musculus
aagagagtacattgactctgtatctgacactgttgctagcagcccaactgcacgagtattgtctgttctctgcaagtatctctctt

SEQ ID NO: 62901 - DNA, 123 bp, Mus musculus
gcatatgacatatacatatatgtatatatgtatatgtacctatataacagcatatattatagagtatatatatatatatgtatatatgtatatgtgtgtatgcatatactcattatataatgc

SEQ ID NO: 62902 - DNA, 85 bp, Mus musculus
gtccatggtggtctgataggatacatgggacaatttcaatatttttgtatctgttgaggcctgttttgtgaccaattatatggtc

SEQ ID NO: 62903 - DNA, 99 bp, Mus musculus
atatatatatatatactatatgcatatattatatacatatatatagtgatgatatatatatatgttcacatatatatgtacatatatatgttcatatat

SEQ ID NO: 62904 - DNA, 75 bp, Mus musculus
agcacgtacagggtaactgcagagatgaaggctataatcacactgtctcagcctctgtcaggctttgttattgct

SEQ ID NO: 62905 - DNA, 84 bp, Mus musculus
cggaggcaggaactgatgcagagatcaagaggagtgttgcctactggcttgctctacatatcttacccagcttatttgcttatg

SEQ ID NO: 62906 - DNA, 115 bp, Mus musculus
ttctatgtgtgtgtgtgtatatatatatatatatatatatatatatatatatatatgtatgtatacgtatacatatatatgaatacacatatttatatgtatacatatatatatg

SEQ ID NO: 62907 - DNA, 131 bp, Mus musculus
gacagacaggggagatcagggtaccataatctcttggctgtgcctcaggagatgccactctgcatcagtctgtgtgtcattcatgcccagaaccaattcttttggcttttgcatgtttgttgaccagctgg

SEQ ID NO: 62908 - DNA, 99 bp, Mus musculus
tatttatgtatatgtgtatatacatatacatatatgtatacatatatttattatgtaagtacatgtgtatatatgtatgcttctatatatgcatgtgta

SEQ ID NO: 62909 - DNA, 92 bp, Mus musculus; identical to SEQ ID NO: 57641

SEQ ID NO: 62910 - DNA, 85 bp, Mus musculus; identical to SEQ ID NO: 57439

SEQ ID NO: 62911 - DNA, 109 bp, Mus musculus
acacacatatgcatatatatgtatctatatatatgtgtgtgtatatatgtgtatatattcattatatacacatacatatatatgtatatatgtgtgtgtatatatatgt

SEQ ID NO: 62912 - DNA, 70 bp, Mus musculus
tctctctgtctgtctgtctctgtgtgtataagcatatatataaagagaggagggagagaggacagggagg

SEQ ID NO: 62913 - DNA, 72 bp, Mus musculus
ggatttatgtacgtatgtatgtatgtatgtatgtatgtatgtatgtatgtatgcatgtatgtatatttgttt

SEQ ID NO: 62914 - DNA, 85 bp, Mus musculus; identical to SEQ ID NO: 57439

SEQ ID NO: 62915 - DNA, 64 bp, Mus musculus
atgcaggcacgtgcacctgtgtatgtgtgcttatatatatatttatatgtgtgtatgtctgtgt

SEQ ID NO: 62916 - DNA, 85 bp, Mus musculus; identical to SEQ ID NO: 57439

SEQ ID NO: 62917 - DNA, 74 bp, Mus musculus
tatatgtatatgtatgtgtgtatatgtctatatatgtctatatatatatatatatatatatatatatatatata

SEQ ID NO: 62918 - DNA, 80 bp, Mus musculus
gtctcacactttggttatcagttctgaatttctttttcattttgagccaatgggattcagaatttcgctggtgctgtgac

SEQ ID NO: 62919 - DNA, 96 bp, Mus musculus
gctttaattcatgtagtcaactttgttatagattatttttcattgtaagataaggaagaattttcttcttagagctatgctgccagattttgaagc

SEQ ID NO: 62920 - DNA, 87 bp, Mus musculus
cacactgtatcaataaatgtgtgagtgtggacatatatatgcttatcaatttatatgtatacatttgcatgcatatataatgtgata

SEQ ID NO: 62921 - DNA, 97 bp, Mus musculus
cagtcttaacaggtacctctgtaaggcaagtatcacctgtaagacccagggagcattacagaagagagagtggagagattgcaagagccagaggatc

SEQ ID NO: 62922 - DNA, 84 bp, Mus musculus
ggatgaagcttgtctttcatttctaggaggcaaaaatctcctaatagatttctctccttctctgactcttagactcttctgtcc

SEQ ID NO: 62923 - DNA, 72 bp, Mus musculus
tgagtaagtacatgtgtttgtatataagtacgtttgtttgcatgtgcttgtatttttatatgtatgcattca

SEQ ID NO: 62924 - DNA, 109 bp, Mus musculus
tgaatacattttaaaggtttcatctataattggaatatttcaatatttgaataatttatctgaaatttaccagtatttatctgaaagctttataaaggtgttattttca

SEQ ID NO: 62925 - DNA, 84 bp, Mus musculus
ggcatctgggaagcacagtaagggtgtccccttagagtaggtacaataccaccccaatggcttgtcactcactgtgtccctgtc

SEQ ID NO: 62926 - DNA, 84 bp, Mus musculus
atatatcataatatcataaatatatatatacatatatatacaacatatgtgtgtatgtatgaatgtatgtatgtatgtatgtat

SEQ ID NO: 62927 - DNA, 111 bp, Mus musculus
tatttgttttggcattatggaggtgtttaggagagacaggaataacctattaacgtatttttgtatttctgtctaatttcctttacttcaaatatatgaccaaaatgtgtg

SEQ ID NO: 62928 - DNA, 105 bp, Mus musculus
tctaaaactggcttgcatttgtttaaagagagcatccttgagtccatttcttgggctgccttttaaggagtaaaatcatgagcagttgtaaagcaggtttgtaga

SEQ ID NO: 62929 - DNA, 65 bp, Mus musculus
ggttagccaattactggtccatcttgagacccatctcaagagagagagcacacctatggcctacc

SEQ ID NO: 62930 - DNA, 108 bp, Mus musculus
atgtgtgtttttttgtgattgggttatctcactcagggtgatgagttatttcataagttcattatttttaatatctgagtagtactcccttgtataaatgtaccacat

SEQ ID NO: 62931 - DNA, 82 bp, Mus musculus
gaatactgattcgaaaaggagaaacatctatggcaaagatgttctctgtcactgtatgtgtctctgtttctgtgtcggtctc

SEQ ID NO: 62932 - DNA, 78 bp, Mus musculus
ggtggcagtgtctctcagtcaaacacagaattccctgatataactaggctttctctggagctggaattatatgccatc

SEQ ID NO: 62933 - DNA, 99 bp, Mus musculus
tatatacatacagacatataacatatgatatatgtataaacatattaaatatatacatatatatgcatgtgtatatatatgtgtgtatatatctatatc

SEQ ID NO: 62934 - DNA, 101 bp, Mus musculus
gtgccctcatgtgtagcaaaggatacagtcaaaagtgacagtggagatttgattctaagcgctgtcatcttgcttacttcagttttcctcagtatgtgcac

SEQ ID NO: 62935 - DNA, 106 bp, Mus musculus
atttagtttttagtctcaagttttggcacagaggtcagaataaatttgaatttttacaaaggattattctgtgctcataataatttcccttagactatatctgaat

SEQ ID NO: 62936 - DNA, 129 bp, Mus musculus
gacttgggagttctccactgaatgtgtgttggtggcctcatatcagctggtgtatgttgtctgcttggtggtccagtgtttcagagatctcaggggtccagattaattgaaacttctggtcctcctgca

SEQ ID NO: 62937 - DNA, 87 bp, Mus musculus
atcttcaatgttagtcagtagactgagagctccattaagtcccacaaaaggacttgtatatggactctagctctgccttgtggggat

SEQ ID NO: 62938 - DNA, 98 bp, Mus musculus
acttgacttttttcccttactgcttttaatattctatctttagagcatttgttgttctgattattatgtgtcgggaggaatttcttttctggtccagt

SEQ ID NO: 62939 - DNA, 85 bp, Mus musculus; identical to SEQ ID NO: 57470

SEQ ID NO: 62940 - DNA, 86 bp, Mus musculus
tgtttgtagatatatgcttgtagatacatgtatgtgggtgtaagtatatgcatgtgcatgtggatgctttcataggtcatcagaca

SEQ ID NO: 62941 - DNA, 76 bp, Mus musculus
ctgtggagtggggactgatgactggcaggagctgacctggacacacattatttcagtccctggctcctgaacacag

SEQ ID NO: 62942 - DNA, 81 bp, Mus musculus
tcattcatcgcttttggcccctaaaaatcagagtctcagatcagcaggaagtctggttttagtgtcttaagtgttacttga

SEQ ID NO: 62943 - DNA, 103 bp, Mus musculus
gttagtgtgaccctgggtttgcatggcttacttctcattggtccgataggaacctggtcagaggagtttgagtgcactgaagtttttcagggtttgctctacc

SEQ ID NO: 62944 - DNA, 110 bp, Mus musculus
gtgttcatcagtaattaacagtaatcagtaatgtcaatactgctggcatttgtttcatctagaaaatttgttattgtgtccattattcattccttaatgctgatgtgtcc

SEQ ID NO: 62945 - DNA, 133 bp, Mus musculus
gcagagtggtcaaacggaattggaacaagagcgatagtggtgggcagtgtatgtacaaaggtggcagactcactctcagtgactgtgtcagaaaccgctgatcatgtagaactgcctctagatcatattttcc

SEQ ID NO: 62946 - DNA, 71 bp, Mus musculus
atgaggacgaaaagacatttcagcatgcctggcaagccaaacaatgctacagatgtctgctctttctttgt

SEQ ID NO: 62947 - DNA, 97 bp, Mus musculus
cctatatatgtgcttatatacatgtgtgtccattaacatgtgtacatagacacacatagacacacacagagacagttgtatgtaaatggcggtaagg

SEQ ID NO: 62948 - DNA, 65 bp, Mus musculus
acagacatttgtgtatgtatgtgtgcacataaatgtatgtgtatatgtatatatatgtgttatgt

SEQ ID NO: 62949 - DNA, 104 bp, Mus musculus
ctccaaattattttggtacattgtttcagacatgacagagtgtcctgagagatactgacaacaggacactatgggtgactgggctactgtgcagatccatggag

SEQ ID NO: 62950 - DNA, 85 bp, Mus musculus; identical to SEQ ID NO: 57439

SEQ ID NO: 62951 - DNA, 112 bp, Mus musculus
agagaatacagggtaaaatatgtcctttcagggagaaacaccaaatgaagcaaaaattttaaagtattttcatttagtatttgactgatattaagggcttgtccatttttct

SEQ ID NO: 62952 - DNA, 112 bp, Mus musculus
aggcgtagagtcatacatttgctactttttatctgggctcggaggctgtatgagacataatttatttatgtttaagccacagtgtatttaatgaggtaaagtgacctaacct

SEQ ID NO: 62953 - DNA, 98 bp, Mus musculus
gttctgcactggaaaggacagagcacacagtgagtctctcagatttgaatgcaaaagcactgagctggctgaattctgtcataacatgtgcattggac

SEQ ID NO: 62954 - DNA, 78 bp, Mus musculus
cattcaaggactgtcacttgtgtgtacattggtttgatgatgtcattgcctagaacacagggatttggtctgaaaatg

SEQ ID NO: 62955 - DNA, 103 bp, Mus musculus
tgaagtatatgttccaacataggcgaaaatagatctggcttatactatttttttattaggtaagctgttcagaggaattttaaagtgttagcagttggcttca

SEQ ID NO: 62956 - DNA, 90 bp, Mus musculus
gctgttagtcacagtctttttgtggtaggggttggctttggtgttgatgactactgactatgttgaactgtggctctggaagattgcagt

SEQ ID NO: 62957 - DNA, 73 bp, Mus musculus
agcagtgtgttaggtggtcacagactgtcacacagactgtgtgaaggctcgtgtgccaaatgaagataaagct

SEQ ID NO: 62958 - DNA, 127 bp, Mus musculus
gtgcatgaatgtgtgtgtgtgtgtgtgcgcgtgcgcgcgcgcgcatgcatgcatgtatgtgtgcatgtgtatgtgcatatgtgaacatgtgtgaacatgtgtgtgtgaggtgtgtgtgcttgcatgc

SEQ ID NO: 62959 - DNA, 92 bp, Mus musculus
catatatattgtttatgtttacatatatatgtgtatatttacatatgtgtataaatatgcaaatatatgtgtataaatatatgtgtgtatat

SEQ ID NO: 62960 - DNA, 70 bp, Mus musculus
gtacatatatatatatatacacacacacatatatgtatatatgtgtgtgtgtgtatgtatgtgtatttat

SEQ ID NO: 62961 - DNA, 82 bp, Mus musculus
tgcgagcagtgacggcgagcatatggagggtttgaactgtgtgcaggtcagctctcacaatgtctgtctgtcatttttagca

SEQ ID NO: 62962 - DNA, 98 bp, Mus musculus
gatcatttgcctcatattgagattagagctattcactaccatgggcactcagaagactagtgaatatgttttataggatatatataggtagagttgtc

SEQ ID NO: 62963 - DNA, 104 bp, Mus musculus
attgtccctttggagttctggtgaaaaggggacaaccctgcagtagaggctcgctcactctgattgacaggctccttctctgcattgcctctaaaaggtttagt

SEQ ID NO: 62964 - DNA, 106 bp, Mus musculus
gccttagtgcatggtgatctgataggatacatggaacaatttcaatatttttgaatctgttgaggcctgttttgtgacctattatgtggtcaattttggagaaggt

SEQ ID NO: 62965 - DNA, 82 bp, Mus musculus
agagagacaggggtgaaatgttggtgttatgttcatgcctgagatggaaagtggtactttacatttctgattttgtttttct

SEQ ID NO: 62966 - DNA, 80 bp, Mus musculus
ggaggaagtgtgttactgtgggggtggggctttgaggtctcctatgctcaactttgcccagtgtgacacacactgtctcc

SEQ ID NO: 62967 - DNA, 78 bp, Mus musculus
ggccactgatgttgtttttggtgttccaccaaaacctatggtaagaacttactactaaagatactacacacattggtc

SEQ ID NO: 62968 - DNA, 82 bp, Mus musculus
tgtctgtctgtctgtctgtctgtctatctatctatctatttatctagagaggtaggtaggtagatagatagataggtgagta

SEQ ID NO: 62969 - DNA, 105 bp, Mus musculus
aggcaggagcttgaagcataaaccaacagaggaatgttgtttgccagcttggtttcaggctcatattcaacttgctttcttaatacagcccaagctctcttgtct

SEQ ID NO: 62970 - DNA, 85 bp, Mus musculus
cggttacttatctgggggagagggagtggctacttccttgttagaaacactttttcttcttctctaggattaattaagaaacacg

SEQ ID NO: 62971 - DNA, 56 bp, Mus musculus
agaaataatgagagtgcgagagtgtgcatgtacaggctctctctctctctctgtct

SEQ ID NO: 62972 - DNA, 91 bp, Mus musculus
tggagctctgtggtgcccatgttagtgacatgtgtttttgttctggacaaagggcaagcacagatgaggaagggcaaacaataggacttta

SEQ ID NO: 62973 - DNA, 115 bp, Mus musculus
acacatacacatagagtcacatgcacatatacatacacacactcacatactcacatgcgtgctttcatattggtgtgcctatattttgtgcatatggcattatgctattctgtgt

SEQ ID NO: 62974 - DNA, 117 bp, Mus musculus
tatacacacacgcacgcgtgcgcacacacacacacacacatatacatgtatatgtgtgaacatgtatgtatgtgtgtgtatgtatgcatgtatgtatgtatgtatgtatgtatgttc

SEQ ID NO: 62975 - DNA, 82 bp, Mus musculus
tgtgtgtgtgtgtgtgtgtgtgtgtgtgtatacaggcttatagagacacagtgacacacacagatagatagacagacacaca

SEQ ID NO: 62976 - DNA, 69 bp, Mus musculus
aaaggcagcaatggatgactactgtttatgaaatcattccagtcagtcttgtatctactgtgtgccttt

SEQ ID NO: 62977 - DNA, 84 bp, Mus musculus
ttagctccaatctgtctctgtaatggattctcttacctagtaagattttttttcaaattcagagtctctgcacagttgggttag

SEQ ID NO: 62978 - DNA, 70 bp, Mus musculus
acacacacatatgtgtgtgtgtctgtgtgcacgctcttttgtcatattatgtatatatatatgtgtgtgt

SEQ ID NO: 62979 - DNA, 56 bp, Mus musculus
acacacacacatatgtgtgtgtgtatatatatatatacatatatatgtgtgtgtgt

SEQ ID NO: 62980 - DNA, 108 bp, Mus musculus
gcaagccagaagcatttgtatctgcaatatagtgtaccaggttgatgtcagtttgttaatgtgttgctttgcagtatcctttggcttcttttctacatcacggtctgc

SEQ ID NO: 62981 - DNA, 85 bp, Mus musculus; identical to SEQ ID NO: 57470

SEQ ID NO: 62982 - DNA, 63 bp, Mus musculus
tagagagtagagagtgagcttgctagtccttaaactcaggaggcaagcttaaattattccctg

SEQ ID NO: 62983 - DNA, 109 bp, Mus musculus
tatatatgtatatatgtgtgtatgtatgtgtgtatatatatacatatatatgtatatgtatatgtatatgtatatgtatatatatatatatatatatatatatatgtca

SEQ ID NO: 62984 - DNA, 95 bp, Mus musculus
atggcctttatgtatgtgtgtatgtatgtatgtatgtatgtatgtatgtatgtatgtatttatgtactttaatttatttgcatttcaagtgttat

SEQ ID NO: 62985 - DNA, 76 bp, Mus musculus
gcaggctcactctctggctcaggctgttctggttgtcatatactgcccagggtggcctacataagagtagacctgt

SEQ ID NO: 62986 - DNA, 85 bp, Mus musculus; identical to SEQ ID NO: 57439

SEQ ID NO: 62987 - DNA, 84 bp, Mus musculus
actgagaaagagagagagagaaagagagagagagagagatttgtgcagttctctgtcattaccttaagataaatctttttcagt

SEQ ID NO: 62988 - DNA, 67 bp, Mus musculus
ccgctcttgcattctatagcgtcagccttcattgaaatggttgtaaagttatatgattcggggatgg

SEQ ID NO: 62989 - DNA, 122 bp, Mus musculus
gcaaaatagaagtgtcctcttgctctacatcctcaccagcatgtactgtcacttgagtttttgatcttggccattttgacagatgtatgatggaatcttagagtcattttgatctgcatttc

SEQ ID NO: 62990 - DNA, 126 bp, Mus musculus
ataaatgtccttgatgtgcttatacaaagaggtattttgtgtgtaaatatgtatataaagatgtatgtacttacatttaaatgacaagatacttcatgtagaactttgtaaatttattgcaagaga

SEQ ID NO: 62991 - DNA, 85 bp, Mus musculus; identical to SEQ ID NO: 57470

SEQ ID NO: 62992 - DNA, 70 bp, Mus musculus
ctgcatctgggcctgtgtgtcagcctgcctgtctgcccctgttctggagactgactcagcttttttgtag

SEQ ID NO: 62993 - DNA, 82 bp, Mus musculus
tcagacacatagcccacaatacaagcgcagactgtagagtaagaatcacagttgtgtgtgtgcttttaggcttctcgtatga

SEQ ID NO: 62994 - DNA, 85 bp, Mus musculus; identical to SEQ ID NO: 57439

SEQ ID NO: 62995 - DNA, 93 bp, Mus musculus
tatatatacatatatatatgtgtgggtgtgtgtatgtatacatatatatttatatgcatgttttacatatatttatatgtatgtatgcacata

SEQ ID NO: 62996 - DNA, 90 bp, Mus musculus
ggttatatttataacatgtagctctacatttgtattaggatgttaactttaaatatctctctttgtgtgtaagtgtgcatgtgtgtgact

SEQ ID NO: 62997 - DNA, 80 bp, Mus musculus
ttctagaggtgacagaagtgaatgtgctggggcctctacggaaggctttaggacaagggaggctctgcagcacttgggaa

SEQ ID NO: 62998 - DNA, 85 bp, Mus musculus
gtatatgtatgcatgtatgtatatatatacgtgtatatatagtatatatatatatatgtacaaatatacataccatattatatat

SEQ ID NO: 62999 - DNA, 128 bp, Mus musculus
ttgtccccggatttctgggtgcagtctcccatctggcactccttccacatctctgcctcagtgtgtcagtagctgcttctgtctctcaccctagtctgaggacaggaacctgtgtgaggtcccgtgct

SEQ ID NO: 63000 - DNA, 94 bp, Mus musculus
tgcacctttaaaatggaccagggagctggagagatggctcagcggttaatagcactgactgctcttccagaggtcccgagttcaattcccagca

SEQ ID NO: 63001 - DNA, 85 bp, Mus musculus; identical to SEQ ID NO: 57470

SEQ ID NO: 63002 - DNA, 119 bp, Mus musculus
ggtgtgatatttctttgagtttgggtgtaaaatgttcctagtaggttcatgtatttaaatatttgttccaaaggtggtggcattttgggggaggttgtgaacttctaagaggtaggacc

SEQ ID NO: 63003 - DNA, 109 bp, Mus musculus
aagatcacaagtatattattgctgaaaggaaggaacaggaacaagatgagaggtaagaatattcttttattttataaggtaccattcacaaaagtgtatccatgatctt

SEQ ID NO: 63004 - DNA, 84 bp, Mus musculus
atgtgtgtgtgttcacgtgtgtatgtatatatatatacatgtatatgtgtatatatatatgtatgtatatgacaatataataac

SEQ ID NO: 63005 - DNA, 85 bp, Mus musculus; identical to SEQ ID NO: 57470

SEQ ID NO: 63006 - DNA, 74 bp, Mus musculus
aacttaaacctatggggctggagcggtggctcagcggttgagaacactgactgctcttccagaggtcctgagtt

SEQ ID NO: 63007 - DNA, 110 bp, Mus musculus
ttttaattataatatatcacaatgagtttcttttatagtcttgtgaatttgttgttcaatagattctttcacctggatagaaatctccttgccaaattttagaattaaaa

SEQ ID NO: 63008 - DNA, 85 bp, Mus musculus; identical to SEQ ID NO: 57470

SEQ ID NO: 63009 - DNA, 114 bp, Mus musculus
cagacacactgtgtcattctacagcttccataatgagattttgctttcttttgttttattttacattttttgttttatttttgtgggtttttttggggggtgtgcagttgtagg

SEQ ID NO: 63010 - DNA, 66 bp, Mus musculus
ttctgtctgtctgtctgtctgtctagcaatggtgagcctgcctaggccagaggacaacttgcagga

SEQ ID NO: 63011 - DNA, 92 bp, Mus musculus
ggagaaggggaagaataaagaggcatgagtggagaatatactcctactacagtatatattttcatgaaaatatccttatttaactcaagtcc

SEQ ID NO: 63012 - DNA, 71 bp, Mus musculus
gcttctctcttcagccataatatgataggctcctatctggaagccaatctgtctgtctgtcaggaggtggc

SEQ ID NO: 63013 - DNA, 83 bp, Mus musculus
tgggactgagactccagggtccttgtactggccattgatctctcaatagcacacagtcagtcactcaggctttctctgctcca

SEQ ID NO: 63014 - DNA, 94 bp, Mus musculus
atatatacatgtatgtatatatttatgtacatatatatatgtgtgtatatatatgtatatatatgtatatgtatatgtatgtatgtgtgtatat

SEQ ID NO: 63015 - DNA, 105 bp, Mus musculus
gaacaagttgtgaagttctcatagcatttctatggtgtcaggaactcagtgactctcagtgactggttggcagagtgggtagtgctttgtacctcagagatggtc

SEQ ID NO: 63016 - DNA, 68 bp, Mus musculus
gctgggacagatttcagagtctgcaatgatgagctcatggttgcagcaagctgggaaagagtcacagc

SEQ ID NO: 63017 - DNA, 113 bp, Mus musculus
tgtttaatagcaaatatgagggctggagagatggctcagcagttaagagcactgactgctcttccagagggcctgagttcaactctcagcaaccacatggtagctggcaagca

SEQ ID NO: 63018 - DNA, 102 bp, Mus musculus
cgctggatgtttagtatgcatctttcccaaccttaagcttagtctgtattccattctgcttgtattcactgttaggaatttgtatgaaagaatatgtaggcg

SEQ ID NO: 63019 - DNA, 87 bp, Mus musculus
agctctgccacaggttatgccaggaggtgaccagtgctaattataaacattgccactgtcactttctctcaccagatctgttcagct

SEQ ID NO: 63020 - DNA, 114 bp, Mus musculus
gagcaatatgtactcttaaccactgatccatctctcctgctctatttgtatataattcaaaatcagtgctaaagaaaggattattggtcaaagaaaagatgtaaattaaggttc

SEQ ID NO: 63021 - DNA, 74 bp, Mus musculus
caggaggtgtctgctgttaatttctacatttggcaaccagcacaaatggtgaaagaagacagtgatgttatctg

SEQ ID NO: 63022 - DNA, 74 bp, Mus musculus
gaaggctatagttagtatgtatatatgtatgtatgtatgtgtgtgtatgtatgtatgtatgtatgtatgtcttt

SEQ ID NO: 63023 - DNA, 104 bp, Mus musculus
tgaagttgggttccttctctctcaggtcagagcctagaagcagtgcagaattctctctctctatgtcctgacgagaagcagcagaatgaatctatacagagtca

SEQ ID NO: 63024 - DNA, 82 bp, Mus musculus
aggtaaatggaaaagactcagtgtggtgtgagagcacacacctgccctttaatacccagtgaaaggtgtctccgattcccct

SEQ ID NO: 63025 - DNA, 69 bp, Mus musculus
caaaagcactcactggctcactgattcaatgtaggtgattagatccttgagccaatggaaagtgatttg

SEQ ID NO: 63026 - DNA, 80 bp, Mus musculus
tgtgtgtatatgtatgtgtgtgtgtatgcatatatgtatgtatgtatatgtgtttgaatctacatgtatatatatacaca

SEQ ID NO: 63027 - DNA, 66 bp, Mus musculus
agagcttgacagcagagagtgctctgagcactgaaactcagaggagagaatctgtctcccaggtct

SEQ ID NO: 63028 - DNA, 88 bp, Mus musculus
acaaaatctccctgaaaactgcatttggtgtctccaggttacacaactttgagagaacagtttttgcagtttaagtcactaagtttgt

SEQ ID NO: 63029 - DNA, 62 bp, Mus musculus
gtggagatcctggaggtccctggtggatgccaagtgtcttcctcagtctctgggtccttcac

SEQ ID NO: 63030 - DNA, 119 bp, Mus musculus
acttaaggtcccagcaccttgtttggcacaggggcactgccaggctccctgtatctctgtcctcagtgtttcccaggagagtttgtactttccttgtgtgggtatggggtcctccctgt

SEQ ID NO: 63031 - DNA, 72 bp, Mus musculus
gttgtgtgtgtgtatatgtatatgtatatatcagtatgtgtgtatacatatacatacatgtacacacacata

SEQ ID NO: 63032 - DNA, 87 bp, Mus musculus
cagattccagaaccatgcgccaaacttctttgtgagtaacactgagtgactgtaactttgatactcagaagtattggtgtgagtttg

SEQ ID NO: 63033 - DNA, 80 bp, Mus musculus
ggtgcatctggaggaggggcactgtcactggctctgactcattcttccagcagtcgcctggaacagcagccagtggtcag

SEQ ID NO: 63034 - DNA, 107 bp, Mus musculus
tcatacagcattattgctccttcttgtatccatgatgtctctgtctgtatgtctgtctagctacaatgggaaaacactcaagaactgtgtgcattaatctgtgtaga

SEQ ID NO: 63035 - DNA, 117 bp, Mus musculus
gtggcatgttcagttccaaagcccatgcaggaaaggtaaggaactgggtctgactcaggcactcatagactcaatcactttcctctatagctttgggggcttcgagacacatgagca

SEQ ID NO: 63036 - DNA, 95 bp, Mus musculus
aggcttggcaatttctcatctgatcttgatggctaagctgaactcgagccttatgcttattttcacactggatcttcttaataagttgtgagcct

SEQ ID NO: 63037 - DNA, 111 bp, Mus musculus
gtgatgaattaatgccaaaagtaggtgatgtctgttaaaaaaccatgtaggtcagaaatgtgtgaatcactctctgaaatgcatggactgagttcacgccattagcatcac

SEQ ID NO: 63038 - DNA, 72 bp, Mus musculus
gtagaccagtctggcttccaagtcagagagatccacctgcctctctgcctctgcctctgcctctgcctctgc

SEQ ID NO: 63039 - DNA, 112 bp, Mus musculus
ttctattgcttagttttgttttttgagacaggattggtctgtgtttctctggctgtcccagaattcacagagatccacctgcctcttacacccgagtgctgggataatcgag

SEQ ID NO: 63040 - DNA, 66 bp, Mus musculus
taggatgagtgttcaaagtctctcactctctgcatacagatgggatcggctgtgggtctctgcctg

SEQ ID NO: 63041 - DNA, 64 bp, Mus musculus
ctcggagcagaaggaaatgtacatatataaagatatatatgtgcataattttgtattctcagag

SEQ ID NO: 63042 - DNA, 108 bp, Mus musculus
catgtgtgtctgtgtgtgtgtagttatgtgtatgcatgtatataggtatatgtgtatatatatacatgcattgtatgtatgtatgtatgcatgtaatatgatcatagc

SEQ ID NO: 63043 - DNA, 114 bp, Mus musculus
ggtttaagctggggcaaatgtgtgttaggcttctgataactgatttagaatacagatttttttttttcagttagctagctgcctgtgcttaaatgttaaccctttggaagaact

SEQ ID NO: 63044 - DNA, 114 bp, Mus musculus
ggaagcttctctgatgatgactgagtaaggcattgatgatctctgagtatagaagaatgttgttaggagtcattgccatgtcctttagctaggttaatttatttggtgttatcc

SEQ ID NO: 63045 - DNA, 122 bp, Mus musculus
acctaaatttttgatcttagccattctgactgatgtgaggtggaacttcaaggttgatttgaattgcatttccctgatggttaaggatgttgaggtagaatctcagggttgttttgaattgc

SEQ ID NO: 63046 - DNA, 84 bp, Mus musculus
gtgtgtgtatatatatatatagcattttattcatatctgtacatataactatatattaaaaactatatatatatatatatatat

SEQ ID NO: 63047 - DNA, 79 bp, Mus musculus
aaggcctgcagtctctttctcactgacaattgttatcaccaggtgtactcttttggtggggaggggtctcgtgagcttt

SEQ ID NO: 63048 - DNA, 85 bp, Mus musculus
agacagggtttctctgtgtaactctgactgtctgagacttgccctgtagacagactgacctctaactcagagattccccctgcct

SEQ ID NO: 63049 - DNA, 59 bp, Mus musculus
gcatgctgtctcagtgtgtcagtactagagggctgctggcgcttctgtgcaggtcatgt

SEQ ID NO: 63050 - DNA, 119 bp, Mus musculus
tgttagatggcaagtactgaatatatgtatgtatatatgtgtgtatatatatatatatatatacatatatatatatacacacatacatacatacatacacacatacatacatatacatc

SEQ ID NO: 63051 - DNA, 73 bp, Mus musculus
gtgctctgttttgtgtatggttaccaataacccggtctctgggtctctgtgattagacaccatgtcagagcac

SEQ ID NO: 63052 - DNA, 93 bp, Mus musculus
cagtatttatatccagtatcccagtgtctccaaatgggtctcaggcacactctaaatcatagacattggagatcacttctgttggttatattg

SEQ ID NO: 63053 - DNA, 112 bp, Mus musculus
tgtttgtgaaataatataatcaaagtctgtatggcatgggaccaaaatatatatcaatttaagatatttctggttgtagatcaatgggcatcattcaattattcacttagca

SEQ ID NO: 63054 - DNA, 146 bp, Mus musculus
acacgtaaatgcatggcatggatttgtgaagatagaaatatatatatgtatatatatatgtgtatatatatatatatatatactcacacacacatacatacatatatgtgtgtatatatatatatacgtgtatatatatatatata

SEQ ID NO: 63055 - DNA, 67 bp, Mus musculus
gcacacactgtgcacactgtacacactgtgcacactgcatacattgtgtacactgtgcacactgcgc

SEQ ID NO: 63056 - DNA, 92 bp, Mus musculus
gggtcctgtgattaaaaccaagagtagagattttggagattctgtgaaatagatgcttctccctagaaactaagcttttgcatacatgactt

SEQ ID NO: 63057 - DNA, 80 bp, Mus musculus
atctgtgcgtctctttctgtgtatttcacatgcccttggaggcaagaggatttggattccctagagctgagtggacagat

SEQ ID NO: 63058 - DNA, 84 bp, Mus musculus
tggctctcttcgggttcatttcagccttcaactctcgggtcactctctgtcactgggggaagtcagaacaggatctcaaagcca

SEQ ID NO: 63059 - DNA, 109 bp, Mus musculus
tattggtagtcattttaaggtccgctgctgtgtggatatgtggctctcaccctctgtggtttgagtctatttctaatatggcttatatggcttatatggctaaacaata

SEQ ID NO: 63060 - DNA, 118 bp, Mus musculus
gtatgagtgtgtatggtgtgacagtacatgtgtgaatttgtgtgtgagtgtatgattatatatataatggactacatacattcatgagtgtgcatacatataaatatacacatacatg

SEQ ID NO: 63061 - DNA, 115 bp, Mus musculus
cttgagtgagttaaagagctttaattatgcaattgtgagcattacatatctatctgatttttttaattaagaacctgtgtggccatgatctagttactaaggctttttcttagag

SEQ ID NO: 63062 - DNA, 61 bp, Mus musculus
tacatatgtatatatgtatgtgtgtatgtatatacatacatacacacatataccatgtgtg

SEQ ID NO: 63063 - DNA, 67 bp, Mus musculus
gaggcaggcgagtgtgggacaggactgggtcgacaactggctttgactccctgactctgtgtggttc

SEQ ID NO: 63064 - DNA, 137 bp, Mus musculus
ctctttgcaaatgggggtcttccatgtgttagtctatgatgagtgaggtcttgccttcaagattttttcattttgtcttagcacaaagtgcatgatttctcttgaatgttgctgagctcttctgaaaatgtagtcac

SEQ ID NO: 63065 - DNA, 81 bp, Mus musculus
tacactttgtatagtgagtatgtgaacacaattttctggatgatagtgtgtttggaaatgaagctgtggggcatgagtgtg

SEQ ID NO: 63066 - DNA, 80 bp, Mus musculus
acatctcacaaatatatctttatatagtatgattgcactcttgggtgagcatgcacgtatatatgtgtgtttgtgcatgt

SEQ ID NO: 63067 - DNA, 110 bp, Mus musculus
ttgtgtatgtaaggatgagtgtgtatgtatggagtgtgtgtcaagtgtgtgtgtacatgtgtgtgtataatatacatacacatcatatgcatacatatatacatgcatgg

SEQ ID NO: 63068 - DNA, 107 bp, Mus musculus
ccaaccccaaaacagtggcgctaagaagagtgaggttttcttgctttgactctcacacaggcactaggcaacctaacacgtttcctttgtgcagaaatttgagttgg

SEQ ID NO: 63069 - DNA, 119 bp, Mus musculus
ggtcgagagagagagagaaagagagagagagagatgtctttaaatctatctatctatctatctatctatctatctatctatctatctatctatctgtctgtctgtctgtctgtctgtct

SEQ ID NO: 63070 - DNA, 60 bp, Mus musculus
tgaaagcacatggatgccagaggaggctatctggtgtcttcctctgtcactgtcttttca

SEQ ID NO: 63071 - DNA, 78 bp, Mus musculus
tcagaagcagctaagtgaggccagtggggaccctggtggtgcctgttgcactggctcactcgctcactgtctctctga

SEQ ID NO: 63072 - DNA, 92 bp, Mus musculus
atatgagcaatgcattgtatacatgtaatatatacactgtatacatgtaagatatacagtgtatacatgtaaggtatgaattgtatacgtgt

SEQ ID NO: 63073 - DNA, 117 bp, Mus musculus
atttgcattgataactagttatttagcatgtcagttctctcagggagcgttgagacagtatctgcttctgcaaatgagcgcctgattgagtcatgagattgagttatgagatcgaat

SEQ ID NO: 63074 - DNA, 223 bp, Mus musculus
atgtgggtatattaaatatataatatatataaatataattattataattatatataatattatatataatatataatgatgttataaacacatatatgtatatatgtatatgtgtgtatataacatagttattatatatataattatatataatgtatgtatataatatatacacatgtaatatatatataatgtatgtatatatttgtgtgtgtaatatata

SEQ ID NO: 63075 - DNA, 73 bp, Mus musculus
gggtggtgctgttcattttcagggtgagttttccatgctgaatggaacctgacacaccctcacagacacaccc

SEQ ID NO: 63076 - DNA, 109 bp, Mus musculus
gtgggttgactagaacagaaggacagtggcatttgctctccgtctgtctgtctgtttgccttcagctgggatgtcagttttctgacatctgggctcctggttcttagac

SEQ ID NO: 63077 - DNA, 71 bp, Mus musculus
gttttgtctgtgtgtatgtctgtgtgagggtgttggatcctttggaactggagttacagacagttgtgagc

SEQ ID NO: 63078 - DNA, 87 bp, Mus musculus
aaagattatcatccctcttttagtgaggacagattccagggaacaattcgactgtctgtctgtgcctctaagttttggatagtcttt

SEQ ID NO: 63079 - DNA, 68 bp, Mus musculus
ctgtctgtctctctgtctatgtatttgtgtgtgtgtgcacgcgtgtgtaagatgtggggataaggcag

SEQ ID NO: 63080 - DNA, 73 bp, Mus musculus
gatagtactcagaagactgttagctgaatggagaaatccgcactccgctagggacttcttcatgaggcctttc

SEQ ID NO: 63081 - DNA, 85 bp, Mus musculus
ggcatcgatagggtcatctcaggcaactgattagtcttagccttccggctgactgttctcagtgtctgtcactctctggggtgtc

SEQ ID NO: 63082 - DNA, 99 bp, Mus musculus
gggtaaccacagagcctgcaagacaagagagagtaagaagtgagtgtgtgcacagccactgtgctaggtctatctgggtctagaaggggcatgggatcc

SEQ ID NO: 63083 - DNA, 83 bp, Mus musculus
gttctgagcctctcagtgtctcactctattccaacagcctagaggaaccaggctgtagttgtgttctctgtggagtctattac

SEQ ID NO: 63084 - DNA, 483 bp, Mus musculus
tgtatatgtatatatataattgtgtgtgtatatatatatatataattgtgtgtgtatatatatatatatataattgtgtgtgtatatgtatatatataattgtgtgtgtatatgtatatatataattgtgtgtgtatatgtatatatataattgtgtgtatatatatatatatatataattgtgtgtgtatatatatatataattgtgtgtgtatatgtatatatataattgtgtgtgtatatatatatatataattgtgtgtgtatatgtatatatataattgtgtgtatatatatatataattgtgtgtgtatatatatatataattgtgtgtgtatatgtatatatatgtgtgtgtatatatatataattgtgtgtgtatatgtatatatataattgtgtgtgtatatatatatataattgtgtgtgtgtatatatatatataattgtgtgtgtatatatatatatatataattgtgtgt

SEQ ID NO: 63085 - DNA, 396 bp, Mus musculus
tatatataattgtgtgtgtatatatatatatataattgtgtgtgtatatatatatatataattgtgtgtgtatatatatataattatgtgtgtatatgtatatatataattgtgtgtgtatatgtatatatataattgtgtgtgtatatatatatatataactgtgtgtgtatatgtatatatataactgtgtgtgtatatatatatatatataattgtgtgtgtatatatatatatataattgtgtgtgtatatgtatatatataactgtgtgtgtatatgtatatatataactgtgtgtgtatatgtatatatataattgtgtgtgtatatatatatatataattgtgtgtgtatatgtatatatataactgtgtgtgtatatgtatatatata

SEQ ID NO: 63086 - DNA, 199 bp, Mus musculus
tatatatatatatatatatatataattgtgtgtatatatatatatatataattgtgtgtgtatatatatatatataattgtgtgtgtatatgtatatatataattgtgtgtgtatatatatatataattgtgtgtgtatatatatatatataattgtgtgtgtatatatatatataattgtgtgtgtatatatatatat

SEQ ID NO: 63087 - DNA, 89 bp, Mus musculus
agcaggaggaatgccaggagttctcagctgtgtctctctcagtgaagcaaagatcaggaagacacaagacccacaagcgttgcacagct

SEQ ID NO: 63088 - DNA, 85 bp, Mus musculus
catatgtaagtatgtatgtatgcatgtgtgtatgtacatatatatatgtatgtgtatatacacatacatatgcatatacacatac

SEQ ID NO: 63089 - DNA, 103 bp, Mus musculus
gtacctatatgcatatgtatatatgtatgtatgtatacatatatatgtgtgtatgtatgtatgtttgtatatatatatgtgtgtgtatatatgtatatatata

SEQ ID NO: 63090 - DNA, 87 bp, Mus musculus
aggcagaaaggaactcaagatcggagtttgaagcaggaatcacagacgaatgctgcttcctggctcgctccctgtttctcatcacct

SEQ ID NO: 63091 - DNA, 84 bp, Mus musculus
actaatctataattcagagatgtaagagagtgtccataggcctgcagagggtggggctctcagtgcctctgaactatgtgtagt

SEQ ID NO: 63092 - DNA, 64 bp, Mus musculus
ttcttttctgacatagccacttgagtgacgagctactgtcactgagtccctgtgtacttaggaa

SEQ ID NO: 63093 - DNA, 82 bp, Mus musculus
tgaaaatgtgagggctggagagatgttgcagtggttaagggtactgactgctcttccagaggtcctgagttcaattcccagc

SEQ ID NO: 63094 - DNA, 104 bp, Mus musculus
ccacattgggtaagtatgctcctgtaacatgttagcactaactttttatttttagaaagtgactgaatcatacctaagaactgagcttctatatttaccgaagg

SEQ ID NO: 63095 - DNA, 86 bp, Mus musculus
gaggcgggcatgaaataattttatcagcttttgataacttcaaggaggtaggatgcatagttttgataagagttcacgaacgtctc

SEQ ID NO: 63096 - DNA, 74 bp, Mus musculus
gtcggaggaggtgtgtcactgggaatgggctctgaggtttcaaaagcccacactagactcagtctgtctgtgtc

SEQ ID NO: 63097 - DNA, 95 bp, Mus musculus
caatgaacctatgcaaatcagacacagcaaaagacataaagtgattctcttgactaaaacagtttttttgttgttgttttggttttggttttttg

SEQ ID NO: 63098 - DNA, 111 bp, Mus musculus
gtatattagttcagaaaatgcataatgacaccgtttgctctggtatagtgaaaaagcaggtgcagagaacagagtcagcagagttggtcattagtaagttgagtgatatat

SEQ ID NO: 63099 - DNA, 118 bp, Mus musculus
gtgggacaatgtggaaattttccctgttcacatcagtatgtcaagtattgtcattatgttgatcttattcaggcaaccctattgttgaaatttcatggaaacattttctctctcctgc

SEQ ID NO: 63100 - DNA, 116 bp, Mus musculus
tatgggaaggtgcagctcatgagtggttccattctagggcttgtggttctaggttctataagagagcaggctgagcaagccatgagaagtaatccagtaagcagcattctatcatg

SEQ ID NO: 63101 - DNA, 85 bp, Mus musculus; identical to SEQ ID NO: 57439

SEQ ID NO: 63102 - DNA, 84 bp, Mus musculus
gtctgtgtctttgactctgtgctaactcacccccaacctccaagagcaggtagggtcaggtggagagctctccagggcacaggc

SEQ ID NO: 63103 - DNA, 85 bp, Mus musculus
catataaatgtgtgtatgtttaaatgattatatatagatatgtgtgcactgtatatttatatatgcatatacacacagagatatg

SEQ ID NO: 63104 - DNA, 85 bp, Mus musculus; identical to SEQ ID NO: 57439

SEQ ID NO: 63105 - DNA, 85 bp, Mus musculus; identical to SEQ ID NO: 57439

SEQ ID NO: 63106 - DNA, 110 bp, Mus musculus
tttggtgaaatgatttatttggcctgttgttggtgttctctctggagtgaacaaacattgctcacatttttctaagacttaacacaacaaacagacatgagcacaccaga

SEQ ID NO: 63107 - DNA, 100 bp, Mus musculus
gaagtgttactatagtttatagttttacataatgtgaacagatgctaaaagaaaggaatcattttttaaaatttaagactgtaaactggagggatggttt

SEQ ID NO: 63108 - DNA, 66 bp, Mus musculus
gcagagggctcaggttagactcatgcaggctccataattgtcagttcagtctcagtgagcccctgt

SEQ ID NO: 63109 - DNA, 85 bp, Mus musculus; identical to SEQ ID NO: 57470

SEQ ID NO: 63110 - DNA, 95 bp, Mus musculus
gtccttgcttggtggatgagtttggctagaatgaactttgtatttttgaatataactcctctccctcccccatactttctttccctttgggaggc

SEQ ID NO: 63111 - DNA, 63 bp, Mus musculus
tgtgtgcatgtgtgtttgtacatgtgtcatggcacatatgtggagaccagaagacagctcaca

SEQ ID NO: 63112 - DNA, 84 bp, Mus musculus
gtagtaaagtgatgggatttgtttgagagtggggtggggcacagatgtgagtctcacactcagagagtactgagctttgatgac

SEQ ID NO: 63113 - DNA, 72 bp, Mus musculus
atatacacatacacatacatacatatacatacatatatgtatgtatatatatgtatgtatgtatgtatatat

SEQ ID NO: 63114 - DNA, 85 bp, Mus musculus
ggccatggtggtctgataggatgcatgggacaatttcaatatttttgtatctattgaggcctgttttgtgaccaattatatggtc

SEQ ID NO: 63115 - DNA, 90 bp, Mus musculus
gtatgtatatatgagtgtgtatatgcatgtgtgtgtatgtgtgtgtgtatgtaggcttatgtgtatatatgtatatgaatatgtgtgtgt

SEQ ID NO: 63116 - DNA, 86 bp, Mus musculus
ggctctatagtaaggcatgaaaacaagtttggtgataactctagcattattcttttcctcagagttgctttcagctacatagagtc

SEQ ID NO: 63117 - DNA, 87 bp, Mus musculus
tcagtgaggatgtttccatctgtaatgatagtaaaggatattgacctataactttattcaattttattttgtagcatccttctctgg

SEQ ID NO: 63118 - DNA, 85 bp, Mus musculus; identical to SEQ ID NO: 57470

SEQ ID NO: 63119 - DNA, 58 bp, Mus musculus
tacatacacatacacatacacatgcacatatatgtgtgtgtatatgtatgtgtgtgta

SEQ ID NO: 63120 - DNA, 85 bp, Mus musculus; identical to SEQ ID NO: 57439

SEQ ID NO: 63121 - DNA, 110 bp, Mus musculus
ggtagcttgcctcataacccaaacaacagtatttacaaatgagaatagcatgttttatttgtatgtatccaactatgtgattttggaagcctcatgagtagtcttctgcc

SEQ ID NO: 63122 - DNA, 106 bp, Mus musculus
cccaatttaaaatggggtgcagagctaaacagagaatttataacagaggaatcttgaatggccgagaagcacttaaagaaatgttcgacatccttagtaattaggg

SEQ ID NO: 63123 - DNA, 85 bp, Mus musculus; identical to SEQ ID NO: 57439

SEQ ID NO: 63124 - DNA, 108 bp, Mus musculus
tttatatgtattatatgtatgcattataaaatatacatatgtacttatatgtatatattacatatatgtatatttaaaacctatatgtatatataataaaatagtaga

SEQ ID NO: 63125 - DNA, 85 bp, Mus musculus; identical to SEQ ID NO: 57470

SEQ ID NO: 63126 - DNA, 85 bp, Mus musculus; identical to SEQ ID NO: 57439

SEQ ID NO: 63127 - DNA, 83 bp, Mus musculus
tataaataaggctgctatgaacatagtggagcatgtaataagcctatattcttccataagatttcacagccaccatatttata

SEQ ID NO: 63128 - DNA, 86 bp, Mus musculus
cttctacttttccatgtgtgtgtgtgtgcatgtgcatatgtgttatatatatacatatatcatacatgtatgctttcaagtggagg

SEQ ID NO: 63129 - DNA, 70 bp, Mus musculus
agatcaagtgaccataggtgtgtggattcatctctgggtcttcagttctgttccattggtctacttgtct

SEQ ID NO: 63130 - DNA, 93 bp, Mus musculus
tacatcctcaacaacatgagctgtcacttgtgtttttgatcttggccattctgacatatataagatggaatctcaaagttgttttggtttgta

SEQ ID NO: 63131 - DNA, 69 bp, Mus musculus
gaatactgtccctaacacatggaatacaatcatgagtgcatgtatgtgcctctgtgtgtgtgtgtgttc

SEQ ID NO: 63132 - DNA, 85 bp, Mus musculus; identical to SEQ ID NO: 57439

SEQ ID NO: 63133 - DNA, 108 bp, Mus musculus
gaaatgcaattgagctttgacttagttggatctagataggggagagaggtcctctagtctctatctgtctgatagtagcatttgacgtttccttttcttaattagttc

SEQ ID NO: 63134 - DNA, 83 bp, Mus musculus; identical to SEQ ID NO: 63127

SEQ ID NO: 63135 - DNA, 112 bp, Mus musculus
ttgaggtcttgggattttctccgatacactatgctacttattctatgtatattacaaagaaatcaagccaagcactgtgtaaattttgaggaatattttttcacatacttga

SEQ ID NO: 63136 - DNA, 96 bp, Mus musculus
tgtgtgtgtgtgtgtgtgtgtgtgtatgtatatatatacatatatatgtgtgtgtgtgtatatatatatgtacatatatatacatatatatatata

SEQ ID NO: 63137 - DNA, 106 bp, Mus musculus
gccttactccatggtgatctgataggatgcatgggacaatttcaatatttttgtatgtgttgaggcctgttttgtgaccaactatatggtcaattttggagaaggt

SEQ ID NO: 63138 - DNA, 83 bp, Mus musculus
atttcatatatatatggatatatatgcacgtactatctttatatatgtatatgtgcatatatattgataactaaaggtgggat

SEQ ID NO: 63139 - DNA, 85 bp, Mus musculus; identical to SEQ ID NO: 57439

SEQ ID NO: 63140 - DNA, 148 bp, Mus musculus
gtgatttagttggctatgtatgtatgtatgtacatatgtatgtatgtatgtgtgtgtatgtatgtgtaagtatgtatatatgtatctgtatacatgtatgtatacacgtatgcacatatatatacatgtatctaatgtctatacatgt

SEQ ID NO: 63141 - DNA, 62 bp, Mus musculus
tgtacatatgtggttttgtgtgcgtagacacacatagacacacacagacacacacatgtata

SEQ ID NO: 63142 - DNA, 114 bp, Mus musculus
tactcacctataaacaaatacatagcatgtttgtctttctgggtctggatcacatcagaatgatttatttttcatttcacagatttgcctatcattgtttataagagctgcgta

SEQ ID NO: 63143 - DNA, 69 bp, Mus musculus
tatgtatgtatgtatgtatgtatgtatgtatgtaccagtatatgtatgtatgtatgtatattatggatg

SEQ ID NO: 63144 - DNA, 60 bp, Mus musculus
acaaaaatggtgtgtgtgtatgtgtgtgcgcgcacacacatacacacacacagacactgt

SEQ ID NO: 63145 - DNA, 60 bp, Mus musculus
acagtgtctgtgtgtgtgtatgtgtgtgcgcgcacacacatacacacacaccatttttgt

SEQ ID NO: 63146 - DNA, 84 bp, Mus musculus
ctcgcagcctgcactatttttctgtgaattttgaatgaaaagaaatttggggaagatatttgcatttatatttgggagggtgag

SEQ ID NO: 63147 - DNA, 85 bp, Mus musculus; identical to SEQ ID NO: 57439

SEQ ID NO: 63148 - DNA, 133 bp, Mus musculus
ctggagttggctggggggcgggggggtctcggccagcatggaggcagtgactggcaggttctcaggctctcagacactgtagataccactggatgacctggaatagctgagaatggagtgtgggcctgtgggc

SEQ ID NO: 63149 - DNA, 94 bp, Mus musculus
ttatatgcctaaatgggtgtagatacatactgaattatatatgtatgtatgtaaatatatgtcatgtatactacacaaatattcaatagtataa

SEQ ID NO: 63150 - DNA, 85 bp, Mus musculus; identical to SEQ ID NO: 57439

SEQ ID NO: 63151 - DNA, 85 bp, Mus musculus
tgtgtctccactatctctgtgtctcggtctcttgaatgaagatggcccccatcgactcagggagtggcgcagttaggaggtgtgg

SEQ ID NO: 63152 - DNA, 95 bp, Mus musculus
tatcactcatacatatatatatatatatgtatttatttataactgtatatatataaaactgtatgtatgtatgtatgtagatagatagatagata

SEQ ID NO: 63153 - DNA, 85 bp, Mus musculus
gcattgtgtggtgaataacccttttactttcactgaatttgtttttcagattataaaagtaatacatgttcattatggataatgt

SEQ ID NO: 63154 - DNA, 97 bp, Mus musculus
tcttagtcaagttcacctgtctggacactcaagtctctgtgctcacatcccatcactttccatgtagtggtcagacagcacacttcagtgacgaagg

SEQ ID NO: 63155 - DNA, 108 bp, Mus musculus
aagacctgcattgatggtgtggtttggctgaccttgaagctagttaacaaatgtttatctgagcatgatgtttgctgctaaacacacaaacttttcacagcaagtttt

SEQ ID NO: 63156 - DNA, 121 bp, Mus musculus
gtatgtacatatgtatgtgtgtatgtgcatatgtatctatcatctatgtatgtatgtatgtatgtatgcatctatgtatgcatctatgtatctatctatgtatctatctatgtatctatgt

SEQ ID NO: 63157 - DNA, 82 bp, Mus musculus
gagttctttgtatattttagatattaaccctctaatgaactaggaaaggggagagcatttgaaatgtaatgaagaaaacatc

SEQ ID NO: 63158 - DNA, 81 bp, Mus musculus
gtgtgtgtgtgtgtgtgtgtacacgtatacttatacgtatacgtatatgtatatgtatatatacattgtggacatatatac

SEQ ID NO: 63159 - DNA, 90 bp, Mus musculus
tatgtgtatgtatgtatatgtatatgtatatgtaaatatatatgtatatatatgtatatatatgtatatatatacatatataaatataca

SEQ ID NO: 63160 - DNA, 72 bp, Mus musculus
gcagagtgaacactgtcagctgcccagccatcttcccacacaccgggattctgagttgatgtaccaccctgc

SEQ ID NO: 63161 - DNA, 118 bp, Mus musculus
taattgtaaaacaaaccatgcaaacactactgccatcaagttgtacactgactgtcactgtgagatttaaaaagtaacttaagttggctgaagtaggcatgggaagagattgaaattg

SEQ ID NO: 63162 - DNA, 93 bp, Mus musculus
ttcattgaacaacagctaaatgtgtgtgtatatatatctttcatgtactcacagaagaaattgtttatatttttatttggatgttgctgtgga

SEQ ID NO: 63163 - DNA, 112 bp, Mus musculus
gatatgcattatcagcagagaaaaacaaccgggatgttgaatattaatttattcatttgagctgttactattattgatattctctcttctcattgtgatctctggtgctgtc

SEQ ID NO: 63164 - DNA, 85 bp, Mus musculus; identical to SEQ ID NO: 57470

SEQ ID NO: 63165 - DNA, 85 bp, Mus musculus
ggccatggtggtctgataggatacatgggataatttcaatatttttgtatctgttgaggcctgttttgtgaccaattatatggtc

SEQ ID NO: 63166 - DNA, 84 bp, Mus musculus
cactgggtcaacgtgagcacagagtcagcagacaccgcaaaggtcccctagaggactctccaagcaatcttaggaccaccagtg

SEQ ID NO: 63167 - DNA, 85 bp, Mus musculus; identical to SEQ ID NO: 57439

SEQ ID NO: 63168 - DNA, 85 bp, Mus musculus; identical to SEQ ID NO: 57439

SEQ ID NO: 63169 - DNA, 81 bp, Mus musculus
ggcaaaatgttgtattttgtgtttttaacagctcagggtttgacagctgggagggaagcagacagaatgcagagagcagct

SEQ ID NO: 63170 - DNA, 80 bp, Mus musculus
tatgtgagtgttttgccaacatgtatgtatgtatgcatgcatgcatgcatgcatgtatgtaggtatgtatgcaccatatg

SEQ ID NO: 63171 - DNA, 83 bp, Mus musculus
tgtgctgtctgtctgtctgtctgcagttgtctgtctcacgtgtacattgaactgatactctcgggcacctttacagatacaca

SEQ ID NO: 63172 - DNA, 106 bp, Mus musculus
gccgtaatgggttaatgcagagggctagagagatggctcagcagttaagagcactgactgctctttcagatgtcctgagttcaaatctcagcaaccacatggtggt

SEQ ID NO: 63173 - DNA, 77 bp, Mus musculus
gagacagggtctctctgtgtaacagcgttggtggccatcgtggaactcattttgtcgactagtttgtccctgaactc

SEQ ID NO: 63174 - DNA, 69 bp, Mus musculus
ctcctgcctttctctcttgcctcatctctgcttgtgtagctgagagaagagactgtcagatgcagtgag

SEQ ID NO: 63175 - DNA, 87 bp, Mus musculus
tggttgccacagagataagagagtcctcacatagacccaagtgatgctatgcgacctggcccccaagttatttctgattggtaagta

SEQ ID NO: 63176 - DNA, 114 bp, Mus musculus
tgagattagctatgcttataagaaaactttagtgtctcctaaactttagtgtacagtgaaactttatatatatttgagacaactgaaactcttaaagcatgcttacaaatccca

SEQ ID NO: 63177 - DNA, 85 bp, Mus musculus; identical to SEQ ID NO: 57439

SEQ ID NO: 63178 - DNA, 76 bp, Mus musculus
tttctagttccatttgtttgcttgcaaattacatgatgtctttttttttaataggtgagtatgaaggagctagaga

SEQ ID NO: 63179 - DNA, 71 bp, Mus musculus
gtaactgagaaatgtagatgtatactcatacactcatgtatgtgtgtgcatctatttaaatatatatgtac

SEQ ID NO: 63180 - DNA, 80 bp, Mus musculus
tagctggctaaaccttcttttttatgatgcatagtatttgaaatgtcccactctgcatgagaataggtgagagacagcta

SEQ ID NO: 63181 - DNA, 96 bp, Mus musculus
atatatatatatatatatatatatatatatatatatatatacacctaggtatgtattatgaatgtgtgtatatgtatatgtatatgtatatgtata

SEQ ID NO: 63182 - DNA, 62 bp, Mus musculus
tatatatatatatatatatatatatacatatatatgtgtgtgtgtatgtatatatatgtata

SEQ ID NO: 63183 - DNA, 78 bp, Mus musculus
tgaagctaaaatcacttaaactttgctatcaagtaaacaattttattttaaatgacagtaaagagtgaggagctttca

SEQ ID NO: 63184 - DNA, 114 bp, Mus musculus
agtgttggttagtgtcggtgttgtataacacagtgaacagtgtcagtcattgttgtgtaacacagtgaacagtgtcagtaggtgttgtataactgaacattgtcagtcggtgtt

SEQ ID NO: 63185 - DNA, 104 bp, Mus musculus
ccttagtccatggtgatcagataggatgcatgggataatttcaatatttttgtatctgtggaggcctgttttgtgaacaattatatggtcagttttggaggagg

SEQ ID NO: 63186 - DNA, 73 bp, Mus musculus
cactatgctaagtgtttgggacatcaaagcagagtactttgttctgattttcttgaagtttacttccatggtg

SEQ ID NO: 63187 - DNA, 76 bp, Mus musculus
ccctctgtctctctctgtgtgtgtatttcatgtcacatggtgagatattaatatgcacacaagaagaacatgtggg

SEQ ID NO: 63188 - DNA, 86 bp, Mus musculus
ttaagttttgaacagtttgtcctactggatgggtaacgcactgattcagcaagaggaactgtagataccttatgatcactgcttgg

SEQ ID NO: 63189 - DNA, 87 bp, Mus musculus
gaattaacaatagctttatgtctttgtgaaaatgaaatttacttttagtttcatattatatttaaagacatggaatttgtctagttc

SEQ ID NO: 63190 - DNA, 89 bp, Mus musculus
caggcatgtcatatcagcaagaaggtcttaatttttagtttttgaacaatgagattatgagtttagtgagcttcttgtttgtttgtttg

SEQ ID NO: 63191 - DNA, 85 bp, Mus musculus; identical to SEQ ID NO: 57439

SEQ ID NO: 63192 - DNA, 60 bp, Mus musculus
atacatagatacataaatgatagaatgagtgtctctctctctgtgtgtgtgtgtgtgtgt

SEQ ID NO: 63193 - DNA, 89 bp, Mus musculus
gcagtgagcactttagttgatgagttcacatgggacactttgatcaaaaccattgttcatttatttttaaacaagagtcggcttgctgc

SEQ ID NO: 63194 - DNA, 101 bp, Mus musculus
cttttactgttgtacctagtactttttttaatttaaaatgactacttaaattagtgaaaaataaggtagttgttttaaagtagtacgttgtaaggtagaag

SEQ ID NO: 63195 - DNA, 96 bp, Mus musculus
gcatgcatattatacagagttcaatatttgttcacatttttctcctgtgatcaaatatttatatatgatattctgtgtattcactttgagaaatgc

SEQ ID NO: 63196 - DNA, 81 bp, Mus musculus
cagccacatagcactgaagagtgtgtccactttgctgagttctaactcaaaaaagtgtaacttttcctttctttttgctgt

SEQ ID NO: 63197 - DNA, 82 bp, Mus musculus
gcctgatactgtttatatttttgatgttaattctactctcctgggatgggttgcagatgaggagtaagtcatgtactcaggt

SEQ ID NO: 63198 - DNA, 66 bp, Mus musculus
acacagtcactctgtcatagttttaattgaccagcccaaaaccgtagacaggtgccatgactgtgt

SEQ ID NO: 63199 - DNA, 116 bp, Mus musculus
ggtcatgcagcaagttcaaggacaactcaagatacataatgaaacactcaagtgactgagcagtcactcaagccaaatcactctgtgaatgaggttctgaactggagggtataacc

SEQ ID NO: 63200 - DNA, 61 bp, Mus musculus
tgtgttcgtatgtatgtgtctgcacatctctgtgtatgtgtgtgcatgttgtatggatgca

SEQ ID NO: 63201 - DNA, 106 bp, Mus musculus
gatataattctaatctataagaccgtgtgcatatgatgtgatgtgatatgatatgatatgatatgatatgatatgatatgatatgaaaagtggataggattgtggc

SEQ ID NO: 63202 - DNA, 98 bp, Mus musculus
tatatgcatatatatacatatatatgtatatgtatacatgtatatatgtgtgcgtacatatatatgtgtgtgtgtgtgtgtgtgtgtgtgtgtgtgtg

SEQ ID NO: 63203 - DNA, 91 bp, Mus musculus
gtcatcaatccataccacacagtgtcaccatgtcaccccagagagctggttattgctacacagtgtcactgtgtgaccacagggtgctggc

SEQ ID NO: 63204 - DNA, 85 bp, Mus musculus; identical to SEQ ID NO: 57470

SEQ ID NO: 63205 - DNA, 71 bp, Mus musculus
gagagccaggcattagactccctggcttagccatggcagtagtcccagtctgtctgtctgcctgtctcctc

SEQ ID NO: 63206 - DNA, 89 bp, Mus musculus
catacacatataacacacacacatgcatgtgcatacgcacgtatgtatgtatctatgtatgtatatgcatatgtatggttttgagaatg

SEQ ID NO: 63207 - DNA, 83 bp, Mus musculus
acacttgagatgtggaagcataagaagtcaggttcaaggacagccttggttatgactacctatctgtctgtctctctgtctgt

SEQ ID NO: 63208 - DNA, 85 bp, Mus musculus; identical to SEQ ID NO: 57439

SEQ ID NO: 63209 - DNA, 99 bp, Mus musculus
gcagtattctctattgcttcctttctatggtacatttcaaaaaggattttttttttttcactgactgtcatgagctaataggaaaatggtgaacactgt

SEQ ID NO: 63210 - DNA, 94 bp, Mus musculus
atgggcaaatcactttaacatctctcagcctgacctgagtcatctgtaaaagggacacagaacacacagaggagtgagttggggtgcagcctat

SEQ ID NO: 63211 - DNA, 97 bp, Mus musculus
agagtgagtacttggtcagtgttacctgacaactgatgacgttatcttgcgatacagtagtgatttggtagaactgatgtctaaagtttatcgttct

SEQ ID NO: 63212 - DNA, 78 bp, Mus musculus
ctgtgtctctttgtcagtctttagctggggaagcagaacccacgccagctagttaaatacaggcaatttgaggcagag

SEQ ID NO: 63213 - DNA, 92 bp, Mus musculus
gtatgacaaatattctcatagtatttacattgcattaggtatgtatgctaatacatacagagttgacagtagacagtgagcataggttatat

SEQ ID NO: 63214 - DNA, 75 bp, Mus musculus
gagcatgcgtatctgtgtgtctgtgtcacttccagctcacttctgggaagatggcaggacagaagacagcagctt

SEQ ID NO: 63215 - DNA, 61 bp, Mus musculus
cctggctgctcactctctccctctgaactggcctgtggtccttctggagatgagctatagg

SEQ ID NO: 63216 - DNA, 79 bp, Mus musculus
ctggctgacatacacagacatctggacaaccggtccccttcttgtcacattttgtcactctgtgtctgtgttgaaccag

SEQ ID NO: 63217 - DNA, 124 bp, Mus musculus
tacaacatatatatgtatgtatgtatgtatgtatgtatgtgcatatatatgtgtgtgtatatatatgtatatgtatgtgtgtgtatatatgtatgtatgtatacacacacacacacacatatat

SEQ ID NO: 63218 - DNA, 82 bp, Mus musculus
tctctttggcaagccttctcttctttcgttagcctgggaaagccaggtagatgtttacaggacagagtgaggtctgaggaga

SEQ ID NO: 63219 - DNA, 115 bp, Mus musculus
aagtgctttgtccactgagccgtctcccaagcccctgttatttaacctgattgtcttttatttttaaaaaattgcacacactggactgggagcatagctcagaggcagagttttt

SEQ ID NO: 63220 - DNA, 104 bp, Mus musculus
tgatgaaaaacagactcctccagagttttgaaggtcagatgacagagtgtatacggaagtgtctggaacattgtaaatggcctcccaggcagggggaagcatcg

SEQ ID NO: 63221 - DNA, 106 bp, Mus musculus
ttgcttgcctgtttgtcgtgaacattgtgaagcttgatctgcagtcactttctctgtgactatgtttggtttatagctgattgcatgttctacagtggtcccgtaa

SEQ ID NO: 63222 - DNA, 85 bp, Mus musculus
gcagttttggctcatctgatactaattctagagactttcttgttgccttcgaagcctttggaatttttagcatgaactaagctgt

SEQ ID NO: 63223 - DNA, 77 bp, Mus musculus
tcctcttgtttactgtaaatcacagccagatgttaggcaatacctaatacaatggaaatgctatgtaaattggaggg

SEQ ID NO: 63224 - DNA, 72 bp, Mus musculus
gtggaacccacactggctctgtgtgtgaacacatgtttttataacaacagaaaatgcctgtgttacagtcac

SEQ ID NO: 63225 - DNA, 78 bp, Mus musculus
tctctctcgctcgctcgctcgcatgaaaacttggggtttctacctgcaggttcagtatagaggtagcagtgacaagga

SEQ ID NO: 63226 - DNA, 117 bp, Mus musculus
actctcacacacactcacacatattctctctcacacacacacacacacacacacacacacacagtcacacacatacatagtcacagtgggagagactggattggtgttgacctgggt

SEQ ID NO: 63227 - DNA, 70 bp, Mus musculus
cagcatgccctctgccactcacactgactgctgcacacagcacggccttggatagcagggggcgtttctg

SEQ ID NO: 63228 - DNA, 87 bp, Mus musculus
aggctgggatgggactcgggtgatattagcactctcagaaccagctgtctggtctgcagtgtctgtgtctctgtcttctgtctgcct

SEQ ID NO: 63229 - DNA, 116 bp, Mus musculus
agtctctcgtgccttgtgcctttttatccagcctagcagctctgattctgtctgtgtttatcacaaatgtgttagaatcttggtcctcgccatggggatgtaagaggaggcagact

SEQ ID NO: 63230 - DNA, 118 bp, Mus musculus
gggacagtcaagaggcatgtgtgttctgagtggttaaaacagatgagagtgtggacacgggatgtctaagcaaggtctgatagccccttgcggttgctgacattcctttccctgtgcc

SEQ ID NO: 63231 - DNA, 73 bp, Mus musculus
ctgctcatggttgtagctcagtgtgaactgacaaggaaatagttttgtctatttgtatttgaaatcatagcag

SEQ ID NO: 63232 - DNA, 72 bp, Mus musculus
cagcacagtgagcgggcaggtcttcagctcgcagttgctgctgctgttctctgtgccactctctgcctgctg

SEQ ID NO: 63233 - DNA, 129 bp, Mus musculus
tggtactgaaaggtgaattaaagagagggacctgagagggacttgattcctgcctcagtgtctccctgtgtcacctgagaaaagttacaggcactctgcattgagtcttgaacagagtccaggatcagg

SEQ ID NO: 63234 - DNA, 81 bp, Mus musculus
ttgttcaaaatgagcatcacgatgggccagtggtctgactcaggcccttaagtagtctgtttgttgatgtgctttgaatga

SEQ ID NO: 63235 - DNA, 61 bp, Mus musculus
gggggtggctgaagagatggctcagtgctggaagagcgctgactgctcttccagaggtcct

SEQ ID NO: 63236 - DNA, 74 bp, Mus musculus
gaatgctgaagtaggtctcacacttcaaggctgagaaacagtcctaactgtgtgtcttactctctcttggcttc

SEQ ID NO: 63237 - DNA, 74 bp, Mus musculus
tctctgcctctctgagtttctctctccctgtagcctgcagatcaggatggaaagctcctagctggtggtccaga

SEQ ID NO: 63238 - DNA, 76 bp, Mus musculus
ctgaggggaagaggcatcaacatgatttctgagtaaggggctctgctctgctctgagtgtctctgtcttgcctcag

SEQ ID NO: 63239 - DNA, 64 bp, Mus musculus
gtgcatgtgtgcgtgtgtgtgcgcgcgcgcgtgcgtgcgtgcgtgcgtgcgtatgtatgtgtgt

SEQ ID NO: 63240 - DNA, 72 bp, Mus musculus
gggctgcagcactggggaggtcgagagccatcgctctaggttattggcctttcagtcagtgtctctcaggcc

SEQ ID NO: 63241 - DNA, 67 bp, Mus musculus
ggtcactgagactgagtgagtgtggctgaaaccccgttcatgtgattaaaccctagactctgtggcc

SEQ ID NO: 63242 - DNA, 60 bp, Mus musculus
ggactggcccttgtcagagaagggggtgtccagtgatcccctccctctgtgtctctgttc

SEQ ID NO: 63243 - DNA, 85 bp, Mus musculus
ggccatgttggtctgataggatacatgggacaatttcaatatttttgtatctgttgaggcctgttttgtgaccaattatatggtc

SEQ ID NO: 63244 - DNA, 99 bp, Mus musculus
ctgctttcttggagccttagccctgcctgtctccctgtatgtcccacgaaggactgatgtctagatggacagtcattctcctaagtattcctcaagcag

SEQ ID NO: 63245 - DNA, 100 bp, Mus musculus
caagcttctagaaaaagcaaaatggattgactcttcctttagttctatgtatatatttaattgcagcctttgttttgtcctttttgttttgttttgcttg

SEQ ID NO: 63246 - DNA, 105 bp, Mus musculus
gagcagagttttgtgcctgtgaatgggcctttgagagagagttcactgtggggattccacaggctcagtagctttcaggtgcacagtggcgcgacgtggtcgctt

SEQ ID NO: 63247 - DNA, 90 bp, Mus musculus
gtcagttggttcggggtagttctttatctatgtatatgttttgctagtgaggcgtgcataaaaaagcaatgtatcaagggctagcgtgac

SEQ ID NO: 63248 - DNA, 75 bp, Mus musculus
ggcctccgagcagctctgagtactgagatgagcattcaggtcaaaagctcagagacagcactcagtgagccctgc

SEQ ID NO: 63249 - DNA, 78 bp, Mus musculus
tgtcccaagcacagatgaggtttaggggcttttctagcacatggaaaaatgggtcccacactggctgtgacagggata

SEQ ID NO: 63250 - DNA, 70 bp, Mus musculus
agaggaagctaaggagacaaaacggcaacatggagtggtcatactctctctctgtatctccatctcctct

SEQ ID NO: 63251 - DNA, 66 bp, Mus musculus
acaggagaagccttttcctgttgtctctcaagtgtcatctgaagagagtcaggaggcagagtctgt

SEQ ID NO: 63252 - DNA, 89 bp, Mus musculus
tataacatatgcatgtatgtatatatgtatacatgtatgtaagaatgcatgcatgtgtctatgtatttatatatttgtgtgtgtatgta

SEQ ID NO: 63253 - DNA, 74 bp, Mus musculus
atgtacatatatatgtgtatatgtatatacatttatgtatgaatgtatgtatgtatatatgtatgtgtgtgtat

SEQ ID NO: 63254 - DNA, 89 bp, Mus musculus
gtgtgtgtgtgtgtgatctgtcctcaccctaaagtttatttctttttaaataagaaagcgggctggagagaatcaagtgtttgtcacac

SEQ ID NO: 63255 - DNA, 76 bp, Mus musculus
ggagcagagagaacagactgaaatctgggtaaggccctgcattttcaaagcccttccccagtgctgttcttcctcc

SEQ ID NO: 63256 - DNA, 114 bp, Mus musculus
aatatatatgtgtgtatatatatgtgtgtctgttcatatacaagatgtatatatatatatattatatatatatataatgtatatatatacacaatgtacagatataaaatatat

SEQ ID NO: 63257 - DNA, 73 bp, Mus musculus
catttctgcaccacctagtgacacccagggtctctgagtgtctggggtcatctcaggacaggtctcagaagtg

SEQ ID NO: 63258 - DNA, 85 bp, Mus musculus; identical to SEQ ID NO: 57439

SEQ ID NO: 63259 - DNA, 82 bp, Mus musculus
acacttatacacccatacacacacgtgcatgtgcacacacccatttgtgtgtgtatatatatgtgtatgtatatgtaagtgt

SEQ ID NO: 63260 - DNA, 68 bp, Mus musculus
ccatggctctgggtgctttgaggactttaataaaacaagtcagactcaagtgtgagagctgaccatgg

SEQ ID NO: 63261 - DNA, 85 bp, Mus musculus
gacaatatatacattgtatatatatatgtgtgtgtgtgtatatatgcatatatatatgtatatatatatatatatcttgtatgtc

SEQ ID NO: 63262 - DNA, 95 bp, Mus musculus
ctcacagatactggtttgacatatgggcttgtgaaccccacccaccactgtggtagcaggttgattggttggatcttgcttaggttttctgtgag

SEQ ID NO: 63263 - DNA, 77 bp, Mus musculus
gcctcaggatagaccaatgtttaagccacttataccagttcctgcctggataatggactgtcagtctctgcctgggt

SEQ ID NO: 63264 - DNA, 100 bp, Mus musculus
ggaagctgagacaggaggactgctacatgtttgaggccaacctggctacacagtgaggacacagccagcatggaatatactgaagaccctgtctcaaacc

SEQ ID NO: 63265 - DNA, 107 bp, Mus musculus
gagttattaaaatgtgccttggggctggagaggtggctcagtggttaagagcactgactgctcttccaaaggtcctgagttcaaatccagcaaccacatggtggctc

SEQ ID NO: 63266 - DNA, 74 bp, Mus musculus
ggcgttatccagttggttttagaaaataaagaagctgataagtcagggtctctgtaactgactggggtggcacc

SEQ ID NO: 63267 - DNA, 85 bp, Mus musculus; identical to SEQ ID NO: 60314

SEQ ID NO: 63268 - DNA, 106 bp, Mus musculus
ctgttagcttggtatttttgtgggagaaactcctaatagtggaagctgatatgtctctgtgtgtctgctcttggggctctttttcctactggattgccttgtccag

SEQ ID NO: 63269 - DNA, 91 bp, Mus musculus
ctgaaaatccttggcactgtttcaaggaggagatgacagaatggggtcatagtgttattctctgtgagttgactgtgaggaaatgttttag

SEQ ID NO: 63270 - DNA, 85 bp, Mus musculus; identical to SEQ ID NO: 57470

SEQ ID NO: 63271 - DNA, 87 bp, Mus musculus
cttcatcatctagaacaggaggctggtgggaatgtggaatggtggcattttcacacacacacacctctctgtgtctgccatgggaag

SEQ ID NO: 63272 - DNA, 118 bp, Mus musculus
tcagtgagtgcttatcatgtgtgttcttttgtgattgggttacctcactcaggatgatattttctagttctaatcatttgcctaagaatttcatgaagtcattgtttttaatagctga

SEQ ID NO: 63273 - DNA, 111 bp, Mus musculus
gtaagtactatcctttgacccagtaagtgtgtctgtaggaacaaactttatttattttagggaaaaatatatgacacagtgtaaggagatgttgattggattgttatttat

SEQ ID NO: 63274 - DNA, 117 bp, Mus musculus
cactgtgattcttttaacatgtaagccatcatcttctgtgttctggactaaatgagagattttgttcatttattttgcaatgaaggtcatcggacattatttattggagttcatgtg

SEQ ID NO: 63275 - DNA, 85 bp, Mus musculus; identical to SEQ ID NO: 57439

SEQ ID NO: 63276 - DNA, 97 bp, Mus musculus
tgtgtgtgtgtgtgtgagagagagaggggggggggcatgtggcagtcagaagacagtttgcagcagtttgttttctccttcgacatgtgggtttagg

SEQ ID NO: 63277 - DNA, 96 bp, Mus musculus
agggatttgatagaagcatcctgttttaggctgagtgttccaaaggtctctctctctctgcgtgatatctggctgtgggtctctgtatttgttcct

SEQ ID NO: 63278 - DNA, 97 bp, Mus musculus
agcgaaggctttaagatgagtagttagggctagagagatggctcagcgtttaagagcactgactgctcttccagaggtcctgagttcaattcccagc

SEQ ID NO: 63279 - DNA, 64 bp, Mus musculus
ttcagtctgtcctacacactgtctcatagagctgcctcgagacagtcatttatgacacattgaa

SEQ ID NO: 63280 - DNA, 76 bp, Mus musculus
agctcaggtcaattacagacaaattcagtttttctctagaaatgtattgatttctgtcagatgttgagtgtgagtt

SEQ ID NO: 63281 - DNA, 58 bp, Mus musculus
cctcacagagtgggaagctgcccgggcgttcttctgagtttctcactgtgtgtacagg

SEQ ID NO: 63282 - DNA, 68 bp, Mus musculus
tcgatttgacatgacattcagatactacacaacctctcctgtgtgtatctgtctgtcaatccatccga

SEQ ID NO: 63283 - DNA, 94 bp, Mus musculus
tctgtgtgtgtatctgtatgtatgtctctgtgtgtctgtgggtggacatgagtggcagtgcccatggagtccagaggccttcttatcatgtgga

SEQ ID NO: 63284 - DNA, 118 bp, Mus musculus
ctaactgaacaaaaaatgtcatagaccatgtttggattctgggagctgtcatgtataattctttctatttaagaaatgaaggtgtctagaaggtcacagatgtcagggaagcagggag

SEQ ID NO: 63285 - DNA, 81 bp, Mus musculus
ctagagtgttgaaagaggtctgtccttagcaaaaagtacattttttttttctaatggcgtatcattctttctttgcttaag

SEQ ID NO: 63286 - DNA, 117 bp, Mus musculus
gtctgatgtttaaagatacacatcacatgattcattgtatcattccaatgatgaatatatttttatcagtctttgaggtgatgtgcaattctgatggtactcatgaaacaccatgac

SEQ ID NO: 63287 - DNA, 87 bp, Mus musculus
cccattccaccatctctgatggcatctccaaatgtgctctaagcggatctctgcttctgtccgtgtgtctcagtggagagggcccag

SEQ ID NO: 63288 - DNA, 81 bp, Mus musculus
tcctgcatgtgtgtctgtctgtcattcatccacgctttgcccacccgcgtcgagagaccccgttccacgcagacacaggga

SEQ ID NO: 63289 - DNA, 71 bp, Mus musculus
actaaattaaagcaaattccatacacgcaggcacacatgtgtgtgtgtgtgtgtgcatgtttgtgtgtagt

SEQ ID NO: 63290 - DNA, 113 bp, Mus musculus
ctaggcagaggagtaactttattccttaagtttataagttttgaatgtggaattagaatgtatttaagaagattagaatttggaaggaatatctgagagaaccgtcttactgg

SEQ ID NO: 63291 - DNA, 88 bp, Mus musculus
gatgcgtttgtcttgagttttgtgcagggtgatagacatggatatatttgaatttttctacatgctgacattttgttagatcagcatc

SEQ ID NO: 63292 - DNA, 117 bp, Mus musculus
cagttgtgagtgagtgggtgctagaagcagaaccctggtcctctgactgagcagacagtgccctcaactgctgagtcatctttccattctctagggcacctttggtccactctctgc

SEQ ID NO: 63293 - DNA, 125 bp, Mus musculus
aggttgggcatggaaacctacttgaatgtgagaatgctgtatctgttacacagaacacagagaggaaattccagcctccctagatctccatcttaatgagttttgactcagatgcacctgcttgc

SEQ ID NO: 63294 - DNA, 114 bp, Mus musculus
agactgaggtccaattgccttcagtgacattgttaagtgcaggcctagtgtcagtcattctctcacatagtaatctgagctttattatccaaagtggtggtagtttctcaatct

SEQ ID NO: 63295 - DNA, 117 bp, Mus musculus
gatcagtcttaggccatggtggtctgataggatacatgggacaatttcaatatttttgtatctcttaaggcctgttttgtggccaattatttggtcaattttggagaaggtcccgtg

SEQ ID NO: 63296 - DNA, 91 bp, Mus musculus
gtaggatgtggctagtggaaatgatttagtacttaagagcactgactgctcttccagaggacctgagcttgatttccagcacccacagggc

SEQ ID NO: 63297 - DNA, 85 bp, Mus musculus; identical to SEQ ID NO: 57470

SEQ ID NO: 63298 - DNA, 85 bp, Mus musculus; identical to SEQ ID NO: 57439

SEQ ID NO: 63299 - DNA, 78 bp, Mus musculus
gatgtagatatatattcataaatacaacttgctcggtctttatgacaacatttgtataagtgagtatttttctgggtt

SEQ ID NO: 63300 - DNA, 85 bp, Mus musculus
gtccatggtggtctgataggatgcatgggactatttcaatatttttgtatctgttgagtcctgttttgtgaccaattatatggtc

SEQ ID NO: 63301 - DNA, 61 bp, Mus musculus
tgagtgacaggagttaacagtgatagtggtttgagctttgtgtctgtgactcttgtcttca

SEQ ID NO: 63302 - DNA, 99 bp, Mus musculus
gtgccattcttttgagagttggagatatcctatctctgactcacagggtcacatctctctctgattcattatctcctttactcctcaattagacgtcac

SEQ ID NO: 63303 - DNA, 87 bp, Mus musculus
cttcattctacacttcatttcctctcacccactcactgggtataaaactggctcatgggcgagggagagacagagtgggtgtggagt

SEQ ID NO: 63304 - DNA, 85 bp, Mus musculus; identical to SEQ ID NO: 57439

SEQ ID NO: 63305 - DNA, 100 bp, Mus musculus
tgaatggatcaagatgccaccttctgctaatctgtgaactgaactgctgatttccagataacacagaacacagacaggagttgctccaaagaactattca

SEQ ID NO: 63306 - DNA, 83 bp, Mus musculus
tgttagccaactcttgacaaattctagtacattttctccatgaaagtgtatctaaagtttaaagtcagtatagatggctaaga

SEQ ID NO: 63307 - DNA, 231 bp, Mus musculus
atatatatttacatacctatatatgtatatatacatctatatattgggtttataccatatgcattttatagtgtgtgtgtgtgtatatatatatgtatatatgtatatatatatatatgtgtgtgtgtagcatatatattttatagtgtatatacataaaccatatatatttactgtatatatgtttatattagagatatcattttacatatatacatatacacacacata

SEQ ID NO: 63308 - DNA, 85 bp, Mus musculus
gtccatggtgatctgataggatgcatgggacaatttcaatatttttgtatctgttgaggcctgttttgtgaccaattatatggac

SEQ ID NO: 63309 - DNA, 128 bp, Mus musculus
atatgtacagatgtatatgtatatatgtgcctgggattatatatgtacagatatatatatgtatatatgtgcccggggttacatatgtacagatgtatatgtatatgtgtgcccggggttacacatgt

SEQ ID NO: 63310 - DNA, 115 bp, Mus musculus
ttcttttcattttgttatattaaacaggttcttgtttgtgaaaagtcagagaacactgtgttcatactaatctgcttcagggcagacagtatctgtttttataatagttctagaa

SEQ ID NO: 63311 - DNA, 119 bp, Mus musculus
gtcactcttggcaagtgagatattccttttataaaaatatccgctgagctttgacacttagactgaagtgtgtgtccacgtctctgttataatgtgaatatgtctttgttccctctgac

SEQ ID NO: 63312 - DNA, 77 bp, Mus musculus
tctgtgtcccaaacatcttaagtagagtggctaacatatggtggcatagtcagtaaacagatgacagagggcacaga

SEQ ID NO: 63313 - DNA, 81 bp, Mus musculus
ttgttaatccaataatctaataagttggacaatgtcttggaaaataaagacttccagtccaatgttgaatgggagtaataa

SEQ ID NO: 63314 - DNA, 85 bp, Mus musculus; identical to SEQ ID NO: 57470

SEQ ID NO: 63315 - DNA, 80 bp, Mus musculus
atgactctgtaactctctggaatgtgtaattatagcaacacaggcgtaaaattaccaaggacaaggagctgcagagtgat

SEQ ID NO: 63316 - DNA, 116 bp, Mus musculus
ttgaagatcagccttagtgcatggtgatctgataggatacatgggacaattttaatatttttgaatctgttgaggcctgttttgttacctattatgtggtcaattttggagaaggt

SEQ ID NO: 63317 - DNA, 81 bp, Mus musculus
atccctcttgcttgagaacaagaatgaatgaatgaatgaatgaatgttctgccttctcagagcaaaagattttgggggggt

SEQ ID NO: 63318 - DNA, 92 bp, Mus musculus
ttctagaaccagtctctagtcatttgtcaaggctgccatgcttccacagttttgggaccagccttctgtgcctggtgtgatgctctttggaa

SEQ ID NO: 63319 - DNA, 103 bp, Mus musculus
ctggactcctcccttaggctagttctttccttgtcggagctgtctctgtcaatcagtttgacagctgggatttacgagtagaatcctgcctgagaaagctcgg

SEQ ID NO: 63320 - DNA, 71 bp, Mus musculus
caaaaactggatgcaacaatacaggtgtctgtccccaggggtcttcaggacactctgtctgtgccagtgtg

SEQ ID NO: 63321 - DNA, 93 bp, Mus musculus
ggcctctctcaggctctgctctgtgtaaatgattatttttcaaattcagcctctaatcactcaacagaatcccaagggccacagcagaaggcc

SEQ ID NO: 63322 - DNA, 78 bp, Mus musculus
gattgtaactatgcacacgacactggactgggaatgtttcaatcaatatatatctaatgtgttgtgtgttggaaagtc

SEQ ID NO: 63323 - DNA, 116 bp, Mus musculus
caacgtctaggctccctttaagtgatagggtttctctgtgaagagtcagaatgagcatggtgaagtgactcatgtgaaggatctcattcgagaggtgccgaagggacagagacttg

SEQ ID NO: 63324 - DNA, 81 bp, Mus musculus
gtgtatatatgtatatgtatgtgtgtgcatacacatcataaagattgatatgcatatatgtatgtagatatatatatatac

SEQ ID NO: 63325 - DNA, 127 bp, Mus musculus
atgtgcatgtgtaaatgtatgtgtgtatgtatgtatgtatatatgtgtgtgtatgtatgtatatatctgtatttatatatctgtatatgtaaatatgtatgtatatatttatatgtgcatatgtttg

SEQ ID NO: 63326 - DNA, 79 bp, Mus musculus
atgtgagagctggcaaggacattgtagaggaaatattggattagtttcatttttacctgtgtcagagtcactgtcacat

SEQ ID NO: 63327 - DNA, 92 bp, Mus musculus
tatttctgcaaaaacagaagtctgaaagcactagatgagcccagggggaccaatggtagccagccagcgttttaacagctgttgcagttgtg

SEQ ID NO: 63328 - DNA, 76 bp, Mus musculus
acacatacacacacacacacacacacacacacacacacacacacacacgtatatgtgtatgtgtatgtgtatgtgt

SEQ ID NO: 63329 - DNA, 59 bp, Mus musculus
gactgcctgcctgcctgcctgcctgccaggcagagtcagagtcaaggcaggccaaggtc

SEQ ID NO: 63330 - DNA, 104 bp, Mus musculus
gcaggaaattaaggaaaatatgtatatctatcatataccacatatacatatgcatatatatatgtatattacagtattgtaggtagcattaacatttcaactgt

SEQ ID NO: 63331 - DNA, 89 bp, Mus musculus
atatatgtatatatgtgtgtatatgtgtgtgtatatgtacatttatctatgtgtgtataatatatatatacatattactatattggtat

SEQ ID NO: 63332 - DNA, 94 bp, Mus musculus
ccagcttttgataacagagatgtgtaccatttcggataccaagtcacagaagtatctgtggccactgagttgctgcttctttggtcatgttagg

SEQ ID NO: 63333 - DNA, 60 bp, Mus musculus
tgcttgcatatatatatatatatatgtacatatacatatatatatgtttgtgtgcatgta

SEQ ID NO: 63334 - DNA, 79 bp, Mus musculus
catgctgcctattttttaatactttaactatccgggatgtggctcatagtggactgttctgtatttgattttcagtatg

SEQ ID NO: 63335 - DNA, 116 bp, Mus musculus
tgcttcatgttgcctgcaaagtagcttccggctcccctttatgcctaggagtatataagactcacaaactgcttctcctttgggaagctggaaaactcaaggctcaccttcaagta

SEQ ID NO: 63336 - DNA, 114 bp, Mus musculus
cactaacctgaggagatgtttaggctacagggaggatgggctgtaaagagtttgacggttacactctgtggtaaggaacaacaccccttttctctgggttactttaaagcagtg

SEQ ID NO: 63337 - DNA, 86 bp, Mus musculus
accacaggcccagaaagaacagagccaggagaccatagactaaaccttttaaattgtgagtccaagccaatctttctgcctgttgt

SEQ ID NO: 63338 - DNA, 105 bp, Mus musculus
tgttgcagtgtgtgtatgtatgtatgtatgtatgtatgtgtgtatatatatatacatgtatatacatatatacatatatatatacatatatattacaaataagca

SEQ ID NO: 63339 - DNA, 85 bp, Mus musculus; identical to SEQ ID NO: 57439

SEQ ID NO: 63340 - DNA, 79 bp, Mus musculus
acttctgttagtttcactgtgtctctgtttagtttctgtttctaggatctgtccattgatgagagtggggtgttgaagt

SEQ ID NO: 63341 - DNA, 89 bp, Mus musculus
ctgttgctgcgggtgtctgtatctgtctgagtcatttgctgggtagagccactcagaggacaacatgctcctgtctgcaagcataacag

SEQ ID NO: 63342 - DNA, 82 bp, Mus musculus
tatgtgtgtatacacacacacacatatatatgtgtgtatgtatgtatgtatgtatgtatgtatgtatgtatgtactagcata

SEQ ID NO: 63343 - DNA, 112 bp, Mus musculus
cattccaagggacctctacaatgctattaaaatttgtcacagtcactctgtaaaatataattataggcactgaatgataacataattcatttcaacaatggttattggcatg

SEQ ID NO: 63344 - DNA, 66 bp, Mus musculus
tgcatctgcatctccatctccatctacatatttatttaatataaatatgtagatgttgtagttgta

SEQ ID NO: 63345 - DNA, 76 bp, Mus musculus
gacttcacctggcttgaacttatacaggtcctgtgcacgctgtcacagtctctgtgagttcatatgggtgttggtc

SEQ ID NO: 63346 - DNA, 59 bp, Mus musculus
gtgtacacatgatcacaattatgtgtacattagtgtgcacatctgtgtgtgtgtgtcat

SEQ ID NO: 63347 - DNA, 144 bp, Mus musculus
atatatatatatatatatatatatatatatacatatatatctgtgtgtgtatatatatatatacacacacatatatatatgtatatatatatgcgtgtgtgtgtttatttatttttattaattattttatttatatacatttca

SEQ ID NO: 63348 - DNA, 105 bp, Mus musculus
atatatatatacatatatatatgtgtgtgtatatatatatatacacacacagatatatatgtatatatatatatatatatatatatatatatatatatatatata

SEQ ID NO: 63349 - DNA, 116 bp, Mus musculus
tgctgcagtgttgggattgcatgtctgggctgtttatagtataatttcgattagaaatcgatttttgtttttcatgaaataacaagaaatgcctctcttaattctcattgttctca

SEQ ID NO: 63350 - DNA, 73 bp, Mus musculus
actgcattctttactagtgtcatatggtgactgtgtatatcactgtgacacacaaatgagaagggatggcagt

SEQ ID NO: 63351 - DNA, 85 bp, Mus musculus; identical to SEQ ID NO: 57439

SEQ ID NO: 63352 - DNA, 90 bp, Mus musculus
tgtgacttgcttgacttattttattatagatgaaagttgttgtcagatacaactcatttttataaagagaaaatgtttcattcaagcaca

SEQ ID NO: 63353 - DNA, 78 bp, Mus musculus
ctgtctgtctgcctacatgcctgcctccctgtctgacaatagaggtcagatatgaggtccatagaggtccatagaggg

SEQ ID NO: 63354 - DNA, 67 bp, Mus musculus
gtgagatacaagagttgagctgaggtcttcaggcctgtatgtaaggatctctgtgtctctgactcac

SEQ ID NO: 63355 - DNA, 85 bp, Mus musculus
ttggctaatatctacttatcagtaagtacataccatccatgtccttttgggactggatgaaatgactgaccagtgacctacccaa

SEQ ID NO: 63356 - DNA, 76 bp, Mus musculus
ctgtaagtaggatgtattcttctagctgggctgccttgtgtggcctcagtgggagaagaagtgcctagcttcacag

SEQ ID NO: 63357 - DNA, 110 bp, Mus musculus
gatacatgtgcttctggactaagatgagaaatgtgtgtctcattctgtctgatcagaaatgttacaggccatgaatctaatctatagtccttttgggggaaaaaaaagtc

SEQ ID NO: 63358 - DNA, 80 bp, Mus musculus
ctgctgctgaactgggacacgaatgatatcagcaaaaggtaaggatgctaaaagtcacactgagtctcattttagagtgg

SEQ ID NO: 63359 - DNA, 94 bp, Mus musculus
ttctaatctgacaaaatgtatgatactgtgcttaaaactagtttcaggtttttggcctttctaatagtgtcaggtataggttgtatcttatgaa

SEQ ID NO: 63360 - DNA, 85 bp, Mus musculus
ggccatggtggtctgataggatgcatgggacaatttcaatatttttgtatctgttgaggcctgttttgtgaccaattatatggtt

SEQ ID NO: 63361 - DNA, 79 bp, Mus musculus
gtttttatactatatatatgtatatacacatatatacatatatatgtgtgtgtgtatacacatatatatgtagatagat

SEQ ID NO: 63362 - DNA, 104 bp, Mus musculus
ggggagaaaggcacacaatgagattgctttgtccactcctagtttttttgttttatttttctctgttttttggacatgctgtctgtctgtctgtctgtctgtct

SEQ ID NO: 63363 - DNA, 85 bp, Mus musculus
cttgatgtgtatctattttggatcgattacaaatataatgtatattaattctgtaatcatagaaaatcaggtatctcatatcaag

SEQ ID NO: 63364 - DNA, 103 bp, Mus musculus
catatgcatacacacatgcacgcatatatgtatatatgtatacatatatgtacatatacatgtatatatgtacatatatatgtgtatgtatgtatatatgtgt

SEQ ID NO: 63365 - DNA, 64 bp, Mus musculus
ggctagagtcaggtattgaagtctcccactgtcagtgtgtgaggatcaatatgtgatctaagct

SEQ ID NO: 63366 - DNA, 105 bp, Mus musculus
gagagagtgtccatgaatttgtgtgtgtgtgtgcctgtgtgtatgtatgtatgtatgtatgcatgtatgtatgtatgccagagatttgtattgggtatcttcctt

SEQ ID NO: 63367 - DNA, 92 bp, Mus musculus
ttgtgtgtgtctgtgtctctctgtgtgaatatgtgtataaatatatgcctacatacacagacacacacagagacacataaggacacaaacag

SEQ ID NO: 63368 - DNA, 95 bp, Mus musculus
ccttatgtgtctctgtgtgtgtctgtgtatgtaggcatatatttatacacatattcacacagagagacacagacacacacaaacacacacacagg

SEQ ID NO: 63369 - DNA, 106 bp, Mus musculus
tgcttagcgcacgtggcagctggaatcgagtctggctcacttctcctcctccttcggagttagttagcacacacttggagtcccttctgcctctgttcacccagca

SEQ ID NO: 63370 - DNA, 60 bp, Mus musculus
tctggctcactgtctcactgagggacaagctgtctcacacacaggggatcaggattcaga

SEQ ID NO: 63371 - DNA, 102 bp, Mus musculus
ggcttccagctgcctcccttcctttcactcccaatctgcctttagcatcttcagacactcagagcagagagtgagcttatggaagaaaggtattgtgaagtt

SEQ ID NO: 63372 - DNA, 84 bp, Mus musculus
gtagtcagtctgttagtctctgtctttttgttggggaattgagtccactgatattaagagatattaagggaaagtaatggttgc

SEQ ID NO: 63373 - DNA, 112 bp, Mus musculus
acaacagggatcagctgcttctgtccactggttgggtgcaaatatctacatctgactctttcagtcacttgttgggtctttcagggtacagtcatgctaggtccctttttgt

SEQ ID NO: 63374 - DNA, 82 bp, Mus musculus
gtctggaaatgctgccactctcctgtaggtgagaccattagagaaagtgggtcactggaaataggttgtattgttttctggc

SEQ ID NO: 63375 - DNA, 60 bp, Mus musculus
caggaggctagagagatggcttggtgcttaagagcactgactgctcttccaggggtcctg

SEQ ID NO: 63376 - DNA, 116 bp, Mus musculus
acagagaggtcaaggtctggctggagagttggctcactgactaagagcactgactgctcttccagaggttctgagttcaattcccaggacccacatggtggctcacaaacatctgt

SEQ ID NO: 63377 - DNA, 75 bp, Mus musculus
gaaactcagcttctgggttggagaggtggctcagtggttaagagcactgactgctcctccagaggtcctgaattc

SEQ ID NO: 63378 - DNA, 105 bp, Mus musculus
tagcaactctacatatttggccttggataatggtatgtatgaattgcaaaattttttcatgtattttaaaactttatttatggctgctttgctttgagtgtgcta

SEQ ID NO: 63379 - DNA, 66 bp, Mus musculus
gtatgtatatatgtatatgcctatacacatacatatatatgtgtatatgtatttatatgaacatat

SEQ ID NO: 63380 - DNA, 62 bp, Mus musculus
gggggaagcaatgagcaaagaccagagactactgtctgcactctctcacactgacttctccc

SEQ ID NO: 63381 - DNA, 140 bp, Mus musculus
tatatatatatatatacatatacatatacatacatacacacatatatgtatgtgtatatatatatttatgtatatatttgtatacacacatacatatatggatagatatctctctctatgtgtgtgtgtgtgtacacaga

SEQ ID NO: 63382 - DNA, 69 bp, Mus musculus
gggatgttgtatcaacatatatgtatgtatgtgtgtatgcatgtatgtatgtatgtatgcatacattcc

SEQ ID NO: 63383 - DNA, 60 bp, Mus musculus
gctgctgacagactctcactgtcccttcctcgggatcattgacaggtgtgtaaagccagc

SEQ ID NO: 63384 - DNA, 103 bp, Mus musculus
cagtggcaatttctcatgagtactccagaatagtgaactgaagagagaaagcagagtgctttaagtggtattggtattctagatgcaaatgaaaatctccttg

SEQ ID NO: 63385 - DNA, 81 bp, Mus musculus
aatgtatgtatgtatgtatgcgtgtattgcatatgtatgtatgtatgtatgtatgcatatatgtgtgtgtacccgtgcatt

SEQ ID NO: 63386 - DNA, 99 bp, Mus musculus
ccagggcactcagaaccaagatgctctcactcagtgtgtcagctaggccaggcaggaacgcactgccagtgagtttgcaggcatgtgagcatgttctgg

SEQ ID NO: 63387 - DNA, 81 bp, Mus musculus
agtgatgggatgtacaattttactgtgaggctctgtctctcagatggatgagtttgcgtgtgagattgatgtcactactct

SEQ ID NO: 63388 - DNA, 91 bp, Mus musculus
catccatctgtctgtctgtctgtttatctatttatgtatctactataagtagatacatatagataaaaaatataggaaaacagggttcatg

SEQ ID NO: 63389 - DNA, 58 bp, Mus musculus
agtcacactgacactcagacttgacatcagtccagttcagtctggatgtccatggact

SEQ ID NO: 63390 - DNA, 70 bp, Mus musculus
cttgttgttccagagagatgagagtctggaagcatggcagcaggcgggtatggtgactggaacagccgag

SEQ ID NO: 63391 - DNA, 65 bp, Mus musculus
actcaggggctggagagatggctcagcggttaagagcactgactgctcttccagaggtcctgagt

SEQ ID NO: 63392 - DNA, 83 bp, Mus musculus
gcatgaatgcttgtgaaattattgaggcaggtggtccggcctgaccaaagtgtctctgtgtgtgtctacatgtgtctctgtgt

SEQ ID NO: 63393 - DNA, 56 bp, Mus musculus
tgcatgtgagtgtgtgtataaacatatacacacactctctctttatatttcatgca

SEQ ID NO: 63394 - DNA, 92 bp, Mus musculus
atatgtattttatatggggtgtataaattattatatatatgtgtagtgcatacatatgatgtatataagtatataatgcatattgtatatat

SEQ ID NO: 63395 - DNA, 73 bp, Mus musculus
taagtcacccagtgtctctgagtggccttgttacctgtcccctggccaatgggaaatagcaagggggtacttg

SEQ ID NO: 63396 - DNA, 80 bp, Mus musculus
gcatatgcagtgtatgcagtgtatagagtgtgtgcaatatatacagtgtgagcagtgaatacagtgtgtacagcatatgc

SEQ ID NO: 63397 - DNA, 100 bp, Mus musculus
tatcctggaactcatcatgtagatcagcctggcttgaattcacagaagtctgtctgtttctgtcccccaagtgccgagattaaatgtttgagccactata

SEQ ID NO: 63398 - DNA, 82 bp, Mus musculus
tatatgtgtgtatgtatatgtatatacatatatacatatatgtgtatatatatgtgtatgtatatatacatatatatgtata

SEQ ID NO: 63399 - DNA, 93 bp, Mus musculus
tatatatatgtttgtgtcatatatatatgtatatgtgtgtgtgtgtatacgcacatactggatattatatatgtgtatacaaatatatatgtg

SEQ ID NO: 63400 - DNA, 84 bp, Mus musculus
agctcgcccgagtcactgtgtctgtccctcaggagttcttccttttcctgtaccaagcaagactcctgtgtctgctctgcagct

SEQ ID NO: 63401 - DNA, 98 bp, Mus musculus
gtgcattgcaaatactttctccttgaggtagtagcttgtttttcaatctattaaaatgcctttgatggaaaatggtagatgtgtaattttaacagcac

SEQ ID NO: 63402 - DNA, 88 bp, Mus musculus
gaacctcagtaaatgacaaaagggatgttgaggctgtctaggtcatctctcacacacactcacacagtccctagaatcctgagagatc

SEQ ID NO: 63403 - DNA, 98 bp, Mus musculus
tcggttattctgcattgtgtgtcctttcctggacagtatatttttgtctttagatgagtagagcaatttttgtccagtggccaccttactataactgg

SEQ ID NO: 63404 - DNA, 113 bp, Mus musculus
ggctttggcattcaaccccaaactcctaaatgatgatgatgcctcctgtatcacttggctgggtcggtctaggcatctctttccagctaggatggtcttggctcagcctacag

SEQ ID NO: 63405 - DNA, 104 bp, Mus musculus
ctgcagtcagtgcagtcagtgtggtcactgcagttagtgcagtcagtgtggtcactgcagtcagtgcagtcagtgtggtcactgcagttagtgcagtcagcgca

SEQ ID NO: 63406 - DNA, 638 bp, Mus musculus
tgagtatgtgcaatcagtgcagtcagtgtggtcactgcagtcagtgcagtcagtgtggtcactgcagtcagtgtggtcagtgcagtcagtgtggtcactgcagtcagtgtggtcagtgcagtcagtgcagtcagtgtggtcagtgcagtcagtgtggtcactgcaagtcagtgtagtcagtgtggtcactgcagtcagtgcagtcagtgtggtcactgcagtcagtgcagtcagtgtggtcactgcagttagtgcagtcagtgtggtcactgcaagtcagtgcagtcagtgtggtcactgcagttagtgcagtcagtgtggtcactgcagttagtgcagtcagtgcagtcagtgtggtcactgcagtcagtgtggtcactgcaagtcagtgcagtcagtgtggtcactgcagtcagtgtggtcactgcaagtcagtgcagtcagtgtggtcactgcaagtcagtgcagtcagtgtggtcactgcagttagtgcagtcagtgtggtcactgcagtcagtgcagtcagtgtggtcactgcagtcagtgtggccactgcagtcagtgcagtcagtgtggtcactgcagtcagtgcagtcagtgtggtcactgcagtcagtgtggtcactgcagtcagtgca

SEQ ID NO: 63407 - DNA, 133 bp, Mus musculus
gtatcatatatatgtatatgtatgtatgcgtgtgtatatatgtatatgtgtgtatatatatatatgtatgtgtatatatatatatatatatacacacacacacacacacacatatatacacagcacacacaca

SEQ ID NO: 63408 - DNA, 91 bp, Mus musculus
aggcttgtaggcaatccagtcttgtccgtttcaactggctgcattttccactgtgaggagtgagaaaagactgtgagcttgctctcagcct

SEQ ID NO: 63409 - DNA, 114 bp, Mus musculus
gggtggagcacagcatctgcctagcttctggtacgagcctcgctgcagatggcaggaatgtttttgagagtagagagtgtgtttgtggaagaggctaagcatgagtggtcacct

SEQ ID NO: 63410 - DNA, 63 bp, Mus musculus
gggtgtgagtatgtgtatatgttacatgcatgtaagtatgtaagtgtgcaattgcatacacct

SEQ ID NO: 63411 - DNA, 70 bp, Mus musculus
acttgggtcagggcacttgggagtcagaggtcaatttcaagtgtctttctctttcactctctgcctgagt

SEQ ID NO: 63412 - DNA, 68 bp, Mus musculus
ggtctattaaacacttgaggcatgggaagttaaactcactgtctgacacaagtgtcttaaagatgacc

SEQ ID NO: 63413 - DNA, 103 bp, Mus musculus
actatgaaactcaggctggtcagaagaccctgcactctgtctcaatctctgaaagctggggatgtagttcagtggtggggcatttatccagcacgttcaaggt

SEQ ID NO: 63414 - DNA, 107 bp, Mus musculus
agagcagccggagtaaggcaaagttcaaatttcattaagataagagagtgtgcacactttaaatttaaatgcagacattagaaagatttgtacattttggtgtctct

SEQ ID NO: 63415 - DNA, 82 bp, Mus musculus
gcgtgcatgcttgcttgcttgcttgcttgcttgcttgcttgcttgcttgcttgcttgcgtgcgtgcgtgcgtgcgtgcgtgc

SEQ ID NO: 63416 - DNA, 118 bp, Mus musculus
ggttaagagccactagagagctaagactcttcagataactggtgcagcggaaagcccttctgagatctgagtgtggagagtcaagttgtgctctgggttacagcaaagggaaaggact

SEQ ID NO: 63417 - DNA, 100 bp, Mus musculus
ctatagtttcagagagttagttttagagagttagttagggtggcagaacaaagccatggtggcagaacacagagagctcaccatgatctgaaagtgggag

SEQ ID NO: 63418 - DNA, 110 bp, Mus musculus
taggcattcgaactgtcacgctgtgtgtttcatgtggtgctaggatgcaaacccagtggtaatctggaatcttacccaccaggccatagcatggcaaagagaatatccta

SEQ ID NO: 63419 - DNA, 66 bp, Mus musculus
aatctctctgtgtgtgcatgtgcatttgtgtgtgtgcacatgcatgtgcatgcagtgttaggggtt

SEQ ID NO: 63420 - DNA, 73 bp, Mus musculus
agaaatatgtatgtgtgtgtatatgtatatattatataattgtatatatgcacacacatacacatatatatct

SEQ ID NO: 63421 - DNA, 108 bp, Mus musculus
agctttagtgtaaggaaaagaaacattttgagtaaggagaatattggcagtatcctactgtagtgaaattcttgaaatagaaatgtctgtcacctctaatgtctagct

SEQ ID NO: 63422 - DNA, 122 bp, Mus musculus
agccagaaggtgctagagagatggctcagcggttaagagcactgactgctcttccagaggtcctgagttcaattcccagcaaccacattgtggctcaaaccatctggaatgggatcagatgc

SEQ ID NO: 63423 - DNA, 129 bp, Mus musculus
gtatgtatgtatgtatgtatgtatgtattgttatgtgtatatactattatatatgttatatatacatatatgttcacatatatactatatatgttatatattactgttatatataacagtgtgcatata

SEQ ID NO: 63424 - DNA, 78 bp, Mus musculus
cctgagtagacattttgccaatgatgacacacctctagctatgtctgtgaggatgtttccagagagaattcactcagg

SEQ ID NO: 63425 - DNA, 92 bp, Mus musculus
ttggagaagttgtattactgggagtaggcattggaatttcagaagccctgtgaagcccagtctctctctctgcctgatgcctgctgatctga

SEQ ID NO: 63426 - DNA, 125 bp, Mus musculus
gcagccatttcatccctgtcctgactgttccaacccttcacaccaagcttatgtcacacgagactctcagtgtgtgtttgtcgtgactaaactaaggaattcaatggacacttaactgtggggga

SEQ ID NO: 63427 - DNA, 110 bp, Mus musculus
gaaatagcatatagaatggtcggaaggtaataggagtttatgaggcaaatagaatatttatatatgcattcttaacctcctggtgcctcatgaaatagggtaactttttc

SEQ ID NO: 63428 - DNA, 104 bp, Mus musculus
gagcctcaatcacatcttttccatattcacatcacatgcctggcatattttaattttttaaagacttatgttttgtgtgtgcatgcataccagaagagggcatc

SEQ ID NO: 63429 - DNA, 78 bp, Mus musculus
gggaccttaagacataattgcttttcctttcctttctagccaagtagagacagagcagtcaggttggaatagggtctt

SEQ ID NO: 63430 - DNA, 95 bp, Mus musculus
ggtgcgcaggagttactaggtatgccattttgaattggaccacgttgacatcctttggtctgtgcttgttctaagtggtgagctgcctgcacact

SEQ ID NO: 63431 - DNA, 57 bp, Mus musculus
ggtgctctctctctctgtggttgtggagtttcattccacagtgaactgaatgccacc

SEQ ID NO: 63432 - DNA, 68 bp, Mus musculus
ggtcagagtgagaagaatgactgctctgaagccagaaggtcatgtttaagatctgcagcttaccgacc

SEQ ID NO: 63433 - DNA, 91 bp, Mus musculus
gagtgacagttctctggtaaacttatttaggatgaatattggtttgggctatgggaaatttcattttttttttcagagaatttagtcactt

SEQ ID NO: 63434 - DNA, 114 bp, Mus musculus
acttatcatgcaatataggagccacatggctgtttcttcagtttgacctgtgatttcacagtgaatatttctaatgaaagaatagttacagttcattgcctgcaaaggaaaagt

SEQ ID NO: 63435 - DNA, 63 bp, Mus musculus
aaggtgatttatgtacaaacagtgaggaggaaagaccctctctcactgtgagaagtcaacctt

SEQ ID NO: 63436 - DNA, 105 bp, Mus musculus
gaaaagtacttgtcagcattgatgcttccagtcaaaatcaaaacaagaacagctgcagtctggttttgggttgtaaagaagtaataagaattggccgtgcttttt

SEQ ID NO: 63437 - DNA, 69 bp, Mus musculus
gtctgacaaatggaaacccagtggctgagcaaatcacaccctggtatgttttcattttgaatggaagac

SEQ ID NO: 63438 - DNA, 85 bp, Mus musculus
gggatctgacactctcacactgtctgtagctccagttctaagggatctgacactctcacacagatgtgcgtgcaggtaaaacacc

SEQ ID NO: 63439 - DNA, 90 bp, Mus musculus
cctcaaatttaagaccaacctaggagatacatatgtatgtatatgtatatgtgtatgtatatatgacgtccctgtctgaaaaagaagagg

SEQ ID NO: 63440 - DNA, 119 bp, Mus musculus
agacctttctgaactgtaccatgtctgtagaatgagacctcccacagccttcttttgctccacacactgtgactgggtctgtgagtggtgttcattgtttttaatcctgctcagagtct

SEQ ID NO: 63441 - DNA, 116 bp, Mus musculus
tgttttaatctgcatatatatacatatatatgtgtatatatactatatatgtatgtatacatacattatatatatatacttatatatatatatatatatatatgtttattgagata

SEQ ID NO: 63442 - DNA, 92 bp, Mus musculus
tcttaactgctggctggcttccattgctacatacagagcacctatgctaatggttacagtgcctgtctgagtccctgtctccatttttaaga

SEQ ID NO: 63443 - DNA, 75 bp, Mus musculus
tatgtatgtatgtatgtatgcatctctatgtatgtgtgtatgtatgtgtgtgtatgtgtgtatgtatatatgtat

SEQ ID NO: 63444 - DNA, 92 bp, Mus musculus
caccagatgttgacctctgacctctagttctctctctctctctcatgtgtgaaagagagagagagagagaggggttaaaaaattggtgatat

SEQ ID NO: 63445 - DNA, 82 bp, Mus musculus
gagttggattgtaagtcatgccagagcagctccagaacttagcaccgtgcgcctctctctggcactctgccaatcatagacc

SEQ ID NO: 63446 - DNA, 126 bp, Mus musculus
tatacatatacacacacacacatgtgtatatatatatatatatatatatatatatatatatatatatatatacacatgtgtgtgtgtgtatatatatacatatatgtattctgcatattccatata

SEQ ID NO: 63447 - DNA, 137 bp, Mus musculus
tatatggaatatgcagaatacatatatgtatatatatacacacacacacatgtgtatatatatatatatatatatatatatatatatatatatatatatacacatgtgtgtgtgtgtatatgtatatgtatagtata

SEQ ID NO: 63448 - DNA, 101 bp, Mus musculus
atgcagtagtttactcaactttggcaattgtgtttggttgtaaaattcattttttatagaatgatctttctttaaactgtatcaggtagagttgactgtat

SEQ ID NO: 63449 - DNA, 94 bp, Mus musculus
taaaactcatgcaggggctggagagatggttcagtggttaagagcactgactgctcttccagaggtactgagttctaatcccagcaaccacatg

SEQ ID NO: 63450 - DNA, 117 bp, Mus musculus
ggtcaacagcaagtgtcttccagtcttattctccaccccatgtttagagactgattcagctagaccggtggctcttaacctgtgggtggagacccgtggcagtcaaccagcctttcc

SEQ ID NO: 63451 - DNA, 78 bp, Mus musculus
ctgagagatgacagtgacaggactgaatgacttctaagaagggaggacacatggcctagtttgctggggtagcctcag

SEQ ID NO: 63452 - DNA, 98 bp, Mus musculus
ataaaggaaagaaaaatgcatcctgtgagagaagagaaagagctggttccggaagctctggctctgccatggaagactctggaatcttgttcctttat

SEQ ID NO: 63453 - DNA, 80 bp, Mus musculus
tgggagtctcagtctgtcacagtgagcttaaacatttaatgttatatttagcagacttctgacaagattgagagctcgta

SEQ ID NO: 63454 - DNA, 88 bp, Mus musculus
tatatatatatgtgtgtgtgtgtacatatatatacatacatatatctctgtgtgtatacatatatatatacatatacatatatatgta

SEQ ID NO: 63455 - DNA, 77 bp, Mus musculus
acatatgtgtgtatatatatatatatgggtgtgtgtgtgtatgtaaacacatatatgtgtatatatatatgtatgta

SEQ ID NO: 63456 - DNA, 91 bp, Mus musculus
tgctgccattccgtgtctatggcgccagactgtgtgtagagagggagctgagcagcagagtgttcatctccctcccgctgtgctacatggc

SEQ ID NO: 63457 - DNA, 74 bp, Mus musculus
tgagccatcttgctggacatgattctatttatataaaatagacacatgtcatggtagcaaacagaagtggctca

SEQ ID NO: 63458 - DNA, 94 bp, Mus musculus
gagacagggtttctctgtggagccttggatattctggaactcactctctctgtagaccaggctggcctccaactcacagagatccacctgtctc

SEQ ID NO: 63459 - DNA, 96 bp, Mus musculus
ggtgtacatggggctgaaaagatggctcagtggttaagagcactgactgctcttccagaggtcctgagtccaattttcagcaaccacatggtggct

SEQ ID NO: 63460 - DNA, 112 bp, Mus musculus
ggtgtggccttgctgaaggaagtatgtcactaggagcaaattttttgttttttgaaacaggatctcactatgtacactatgctggcttcaaattcacagagagctgcctgcc

SEQ ID NO: 63461 - DNA, 123 bp, Mus musculus
atgtactagaactgcagcttgcacatttttctttttactggtagctcagctcactctggcagtctgtcactgatgtagcctacagctgtaggtaatggaacattactcactatgatagccaga

SEQ ID NO: 63462 - DNA, 105 bp, Mus musculus
ttcacttgaaattatattgctttatatattctagtagctataaatttgtatattctttaagttattgctggtctggagaactagagtctctgtaacaaaagtgag

SEQ ID NO: 63463 - DNA, 103 bp, Mus musculus
agtatgagtctaaaatataaacattgtatgattttttaaatgacttgaatatttgttattgaggtagtttaagggaattgttctggtttagtttggcttggct

SEQ ID NO: 63464 - DNA, 76 bp, Mus musculus
gcagaatcaggggtctgtgtcaatctgtgtgacccacattaccactaaaggccatgcagatctccctggtttgggc

SEQ ID NO: 63465 - DNA, 84 bp, Mus musculus
tgttattcttgctaggctctctctccctgactgtgcagttgaccctctatctctgctgcaggggcgagctgccttgctacaaca

SEQ ID NO: 63466 - DNA, 63 bp, Mus musculus
gggggctgagttgggacagggactcctcagcaactgagggcctctctcttgctctcagtgtcc

SEQ ID NO: 63467 - DNA, 98 bp, Mus musculus
ttcctgtattgttctcaaatcaacattttcaaaactcagaggttgttgttagtatagccatcctgagaaactatgtgttgagaaatactccttcggaa

SEQ ID NO: 63468 - DNA, 117 bp, Mus musculus
cacaggtgtgtgtcaccaggtccagcacctttgtggttaattctatctatctatctatctatctatctatctatttactttgggggtgttcgagtcaccaggtccggcacctttgtg

SEQ ID NO: 63469 - DNA, 91 bp, Mus musculus
tgtctggtagactcagaagtacctgtaggaaagcagactggctgcctgcctgtctgtgcacacagatcttgcttgctgcatccctaagata

SEQ ID NO: 63470 - DNA, 88 bp, Mus musculus
atgcccacacgcagactcacagggcgaagagcagggggcatgaacggctgactgacagtctgcttctgcttctggagttgaagggtgt

SEQ ID NO: 63471 - DNA, 128 bp, Mus musculus
agagcatttcacagcatctcctctatagcctgtgatgagaagggtcctcaaggtgagaggacacactgtgcctgactctggacagaagcgggcagttctggcccaccagctgcctgcttaagatttag

SEQ ID NO: 63472 - DNA, 68 bp, Mus musculus
caggttgtggtcctctgtgagtgatgtcagagtccacactcagactctgaacccagatccacgttttg

SEQ ID NO: 63473 - DNA, 66 bp, Mus musculus
gcttgtgagaacactctcagcactgggtctacccgtccacccaaagcaggagtggtaaacagaggc

SEQ ID NO: 63474 - DNA, 107 bp, Mus musculus
agttagttatctgcatatctatatatctcagtatatatatatatatatatatatatatcatctatgtatgtatgtatgtatgtatgtatgtatgtatgtatctatct

SEQ ID NO: 63475 - DNA, 64 bp, Mus musculus
gtgtgtatgtgtatatatatgtatatctatgtatatgcatatatatatccgtgctcttaaatac

SEQ ID NO: 63476 - DNA, 106 bp, Mus musculus
gaggttgtaacgttgtctatatataccctgtagaaccgaatttgtgtggtacccacatagtcacagattcgattctaggggaatatatggtcgatgcaaaaacttc

SEQ ID NO: 63477 - DNA, 89 bp, Mus musculus
ctctgtaggaatgtgtgtatatatatacatatatgcgtgtgtgtatgtatatatatgtgtgtgtatgtatatacatgcatatatatgag

SEQ ID NO: 63478 - DNA, 71 bp, Mus musculus
ggacagtgtcagcagggaggaagtaggctaagcacaagcctgcatgcactcattttctctctgcttctgcc

SEQ ID NO: 63479 - DNA, 70 bp, Mus musculus
gcattgttcgaggaggcatgtcactagggatgggcaaggcccagtctctctctctccctctggaccttgc

SEQ ID NO: 63480 - DNA, 88 bp, Mus musculus
catatatacatacatacatacatacacatatacatatgtatatacatatacatatatacatgtatatatatatatggccttatatgtg

SEQ ID NO: 63481 - DNA, 60 bp, Mus musculus
tatatatatatacatgtatatatgtatatgtatatacatatgtatatgtgtatgtatgta

SEQ ID NO: 63482 - DNA, 87 bp, Mus musculus
tgccacaactacttagaaagaaagggctcctaatggtggacctctgctcctgcatgccactgtggctctgtttgtctgtagatggca

SEQ ID NO: 63483 - DNA, 76 bp, Mus musculus
tggaatgcttcgaagccttctttgttttgtaatgtgtgaaagtctcaaaattacattgcatttggtttgtattcta

SEQ ID NO: 63484 - DNA, 93 bp, Mus musculus
gagcatctcgcctacgaagaggatgctagactctgctcggaaagttcattttccagtctctgtcactcattatctgtgtgggttttattgctt

SEQ ID NO: 63485 - DNA, 79 bp, Mus musculus
gtgactggggaagagtagtggtcaaggctaaggagggcttgctcttgagtgtgagctctgtctctcacccaacagtcac

SEQ ID NO: 63486 - DNA, 65 bp, Mus musculus
ggaggagaggtggtgggaggagggcgtcagggggaggggtctggtgtcttctgactctgtcttct

SEQ ID NO: 63487 - DNA, 92 bp, Mus musculus
cagacagagcctttattggtttttatttattttttgtagactatccacaaaaaatagccacttaaatatagactattgactcactgtgtctg

SEQ ID NO: 63488 - DNA, 70 bp, Mus musculus
gctccttcaatttggtatatatatatacttgagatatatatatatatctcaagtcaacttgctgaggagt

SEQ ID NO: 63489 - DNA, 107 bp, Mus musculus
gagtagtacacatcatgataggtggcttagactttcccttcactctctgtcaccacctccttggtaacagacatgtcagctgccatctctcaagtaagtgtcctgtc

SEQ ID NO: 63490 - DNA, 106 bp, Mus musculus
gtcacactggctaagttaagttagctattggcgtacactgtcacactggctgagttaactagctattgtgtctactgtcacactggctgagtaaacttcacaagtg

SEQ ID NO: 63491 - DNA, 106 bp, Mus musculus
gccttagtgcatggtgatctgataggatacatgggacaattttaatatttttgaatctgttgaggcctgttttgtgacctattatgtggtcaattttggagaaggt

SEQ ID NO: 63492 - DNA, 111 bp, Mus musculus
ggaaatcattttcttgacaaattgggtttaactgttgtgattatgttgttgcaggttgtaaatacagaatagcaaaaatgtcaccagctcattgccatagataggattttt

SEQ ID NO: 63493 - DNA, 85 bp, Mus musculus; identical to SEQ ID NO: 57470

SEQ ID NO: 63494 - DNA, 143 bp, Mus musculus
gtgtgtgcattcatgtgtttgtgtgcacaggtgtgtctgtgcatgtgcacatgtttgtgtgttcatctgtctgtctgtctgtctgtctgtctataaatactgtgtttgaagaagactgcagagggcagaggagaccagtggat

SEQ ID NO: 63495 - DNA, 85 bp, Mus musculus; identical to SEQ ID NO: 57470

SEQ ID NO: 63496 - DNA, 111 bp, Mus musculus
caagccaccccacccccacccctgagactgtaaagccagacactcacatactctcagatctgtctttactcacggaatttacggttgcaggcaagtaggggttggagcttg

SEQ ID NO: 63497 - DNA, 90 bp, Mus musculus
ggattggcttcagtcagttcgaaattctgctgacccttgtccatttccacagatgtctgaatttcttgttgtgtttgaaatgcctaatcc

SEQ ID NO: 63498 - DNA, 91 bp, Mus musculus
gaaaactggccccttgggtgtatttagatgacagcctctccttcaccagtcataaggggtgctcttttctgactctctcacctttgttttc

SEQ ID NO: 63499 - DNA, 105 bp, Mus musculus
ctgttaaatgtaggtgacattggacgtcaggaacagatgtacttcagcatcaggcatttcctgtgtgcgtctgtctctggcttacaatgcttttagacttgatgg

SEQ ID NO: 63500 - DNA, 65 bp, Mus musculus
gaatatgggtctggcgtctgttctggtcataagatggtgacagaagattcagacccacaatgttc

SEQ ID NO: 63501 - DNA, 105 bp, Mus musculus
agtgttctagtgaccgcatctatttaaaactgcttgttttcacatgctatagacctagtggaaataggttgtacagatgttacttcctggcctttctagaatatt

SEQ ID NO: 63502 - DNA, 104 bp, Mus musculus
tgtttttattatgtgtttgtatcaatgtatatatgtatgtatgtatgtatgtatgtatgtatgtatgtatatctgtagaggggtatgtgacatatgtgaagata

SEQ ID NO: 63503 - DNA, 75 bp, Mus musculus
tacacactcacatacacacactcattgaaatacacccccagtgtgtgtgtgtgtgtgtgtgtgtgtgtgtgtgtg

SEQ ID NO: 63504 - DNA, 81 bp, Mus musculus
gtgtgagcgagcaccagtactacagagagtggagagtgagatctgtgcccttccttactcgtagtttatagccgtttatac

SEQ ID NO: 63505 - DNA, 99 bp, Mus musculus
ggaaatagatgggaggctctggggaggtggggtagatgacgcctggctcctgattgcctagcctctccctcactctctgtttgaccctcattcttctcc

SEQ ID NO: 63506 - DNA, 111 bp, Mus musculus
cctagctgcatagcagtttcttaatttgagatttgcactgagtatttcaatgtatatgttttttaaatgccagtatgtttatatctccttcccttcagctgcatggtaagg

SEQ ID NO: 63507 - DNA, 85 bp, Mus musculus
gagcttgactgagaagggagatcaacagagaggtcaaagggtaactcagtggctgactctcagtctaaggtctttttttatacag

SEQ ID NO: 63508 - DNA, 74 bp, Mus musculus
tttgcctagtgattttcttcttccagatgtggattccttcacatcttattggaagtgaaaggaataaagacaag

SEQ ID NO: 63509 - DNA, 119 bp, Mus musculus
ggttattgcttcatttggaactgtggggagctttaattgacttggatttgctgtctctctgtatgacacaggtggtgaagtttaccaaatcctttgaactgatgtccccaaagtgcagc

SEQ ID NO: 63510 - DNA, 78 bp, Mus musculus
acatcacgacatacagccacaaacatagattggtgctcaaatccagcctgagtctgtgtgcctgtcttgtccttttgt

SEQ ID NO: 63511 - DNA, 80 bp, Mus musculus
gagagagagagagagagactgagagcaatgctggcatatgtagaggttaaaagttgacttcaggatgtctttccttattc

SEQ ID NO: 63512 - DNA, 92 bp, Mus musculus
catatatgtttatatgtgtttatatatatgtgtgtgtgatatatatgtatgtgtgtattgtgtatatgcatgtgtgttgtgtgtatgtgtat

SEQ ID NO: 63513 - DNA, 93 bp, Mus musculus
gcaagtggccagatgaaagaaactcctgtatgtcatgtcttacccggaagaggctgtcaatcactctgtgtcacacaactggcacgcctctgc

SEQ ID NO: 63514 - DNA, 91 bp, Mus musculus
acgaggtagccttagttctaaatatggtatttgtatttctatttcaaaattggacatttattctattttaaggaatgaagtgttacttggt

SEQ ID NO: 63515 - DNA, 85 bp, Mus musculus
ggccatggtggtctgataggatacatgggaaaatttcaatatttttgtatctgttgaggcccgttttgtgaccaattatatggtc

SEQ ID NO: 63516 - DNA, 79 bp, Mus musculus
actgagagaggggctggagagatggctcagcggttaagagctgactgctcttccagaggtcctgagttcaaatcctagc

SEQ ID NO: 63517 - DNA, 73 bp, Mus musculus
gtttgagacatacacaaaggagagacgaggggaggggggactctgattttattttctttgtatgcatcctgac

SEQ ID NO: 63518 - DNA, 88 bp, Mus musculus
gaacaaacaaacaaacaaaaaatcaatgggctggagagatggtttagtggttaagagcactgactgctcttccagaggtcctgagttc

SEQ ID NO: 63519 - DNA, 115 bp, Mus musculus
gcagaactatagctaaagaatatgaatacgggggctggagagatggctcagaggttaagagcactgactgctcttccaaaggtcctgagttcaattcccagcatcacatggtggc

SEQ ID NO: 63520 - DNA, 58 bp, Mus musculus
gtatatgtatatgtatatgtatatgtatatacacacatacatagatatacacatatac

SEQ ID NO: 63521 - DNA, 93 bp, Mus musculus
ttgtcagttgtgctggagaggcagctcagcagtgaagagcactgactgctcttccagaggtcctgagttcaattcccagcaaccacatggtgg

SEQ ID NO: 63522 - DNA, 105 bp, Mus musculus
ccattaaaaactgctttgtcaggactggagagatggctcagtggttaagagcactgactgctcttccaggagtcctgagttcaattcccagcaaccacatggtgg

SEQ ID NO: 63523 - DNA, 180 bp, Mus musculus
gtatgtatgtatgtatgtgtgtatgtatgtatgtatgtatgtatatgtgtgtatgtatatatatatgtatgtatgtatatgtgtgtatgtgtatatatacatacacacacacgtatatatatatatatatatatatatatatatatgtatatatatatatatatgtatatatatatatac

SEQ ID NO: 63524 - DNA, 85 bp, Mus musculus
tgtgtatgatgcagatgcagttttctgatacttcaatggcagtgaaatttggacagacatcagagactgcattccatcattcata

SEQ ID NO: 63525 - DNA, 81 bp, Mus musculus
gatccactggacccctttgacatctgggtgtgtgagttcaacagagaagactgcatcctgtgtctctgtcacagtgaggtt

SEQ ID NO: 63526 - DNA, 141 bp, Mus musculus
gtgtatattgattatattatgtatagttgtgtgtgtgtgtgtgtgtgtatatatatatatatatattcttatacatatttatatgtatatacatatatatggttgtacatgtatatacatatatacatacatatggaagag

SEQ ID NO: 63527 - DNA, 104 bp, Mus musculus
gtagaaggatctgatggtgttttgaatttcttcaggatctgttgttatgtgctccttttcatttctgattttgttaattaggatgctgtccctgtgccctctac

SEQ ID NO: 63528 - DNA, 62 bp, Mus musculus
gaggccctgtgggaaccagccagaagcctctcagttctatctctgtctccttctctggcctc

SEQ ID NO: 63529 - DNA, 136 bp, Mus musculus
aggaacctcggggaccgaggcatcatgtttgacacacatggttagaagtggccatagctgattctctcacccactcactggcctttgcagacactgagtgtgtcggttcagtcctgtagtctcggtcctttgggaa

SEQ ID NO: 63530 - DNA, 87 bp, Mus musculus
agacagacagacagacagacagacagacatgctttcctcatatcgtagtggatctctgggctccatgtggtcctatctgtgtcttct

SEQ ID NO: 63531 - DNA, 99 bp, Mus musculus
tgcccggaacatctaaagtcccgcctctgtctctctgtcattggctgccggcaaatttatttaccaattagagccaactgggggcagtgacccgtggca

SEQ ID NO: 63532 - DNA, 101 bp, Mus musculus
ggatttgttaaaggaaattagtcactgaggagtgggctttgaggttgcaaaaggcccagtgtctctctccctctcttgtggatcagctcttagctacttct

SEQ ID NO: 63533 - DNA, 85 bp, Mus musculus
cccctggagtgtgcctgtctctctgcctcccctgtgctgggattgcggcagacacgtgccaccactcctggatttttatgtgggg

SEQ ID NO: 63534 - DNA, 114 bp, Mus musculus
tattcatatgtgtgtatgtgtgtatatgtatatacacacatatgtatgactatatgtatatatacatatgtgtgaatgtatacatatacacacacatacaaatacatgtgtgtg

SEQ ID NO: 63535 - DNA, 116 bp, Mus musculus
tagagcatttctactgacaggatttttctgtattttctgatgatattagaagtgctgaatgtagtatatatttataagaatgtcccagaaattctgtcttctagccttgacatctg

SEQ ID NO: 63536 - DNA, 87 bp, Mus musculus
catcacatggaatatttgttacgtgatagattttaaagacatacttgtatgtatatatattatgcatgtacctagtgtctgtggatg

SEQ ID NO: 63537 - DNA, 100 bp, Mus musculus
ctgtatatgatataagggcaaaacaagacatagaacaaagtgtgtattatttatataaaaatacatctgtgtatttgtatatgtgttcatgggtataggg

SEQ ID NO: 63538 - DNA, 76 bp, Mus musculus
ttgcattagtgcatgtgtgtgtatgcctgtgcctgtgtgtttgaggttacatgtgtgtatatatatatgtttgcaa

SEQ ID NO: 63539 - DNA, 105 bp, Mus musculus
tctcctgggtctccagggtatgcatttcagtatatccatttacaattcaagtgatagaattgtttatgttgatgtaggtgcatatataataattagcccaagtga

SEQ ID NO: 63540 - DNA, 77 bp, Mus musculus
gactagaggcagggaaaggaagagaccctgcgagcatccaatagtcctggtggtctctgtctctgtcactgaagccc

SEQ ID NO: 63541 - DNA, 156 bp, Mus musculus
tgtgtgcttctatgtatatatgtatgtatgtatgtatgtgtatacacacacacacacacacacacacacacacatatatatatatatatatatatacatatatacatacatacacacatatacatgtgtgtgtgtgtatacctgtatgtacatatg

SEQ ID NO: 63542 - DNA, 81 bp, Mus musculus
agaggcaaagagttggattgatagagaattttgaagcagcagcaaactatgaattgcaagtcagtctgtcagtctgcctct

SEQ ID NO: 63543 - DNA, 117 bp, Mus musculus
tttccatgtctctctttctctctgtgtatatgaatatgtgtaagtgtgtgtgtgcatgtgcatgtatatactcctacatatttgtgttactcacatacttatagctgtgtttggaag

SEQ ID NO: 63544 - DNA, 85 bp, Mus musculus; identical to SEQ ID NO: 57439

SEQ ID NO: 63545 - DNA, 85 bp, Mus musculus; identical to SEQ ID NO: 57439

SEQ ID NO: 63546 - DNA, 85 bp, Mus musculus; identical to SEQ ID NO: 57439

SEQ ID NO: 63547 - DNA, 85 bp, Mus musculus; identical to SEQ ID NO: 57439

SEQ ID NO: 63548 - DNA, 81 bp, Mus musculus
tagcaactggaaactatgtatttgcacaacttgagaaaatttctttcttgagtagtgagcaaatttggcctcctatgactg

SEQ ID NO: 63549 - DNA, 80 bp, Mus musculus
cagtgtgtgctggctcagaggaaaccgtgatggtctcagtacctcggtatgactgcatctctctgtgtcagatatacctg

SEQ ID NO: 63550 - DNA, 93 bp, Mus musculus
tcctgttctagaaccttgtaagatatcaaaatatatagatattcatattagtggtataatattttgcagggcagagggtgtaggggaagaggg

SEQ ID NO: 63551 - DNA, 85 bp, Mus musculus; identical to SEQ ID NO: 57470

SEQ ID NO: 63552 - DNA, 64 bp, Mus musculus
tcatttatttgtaagtatgtatgtatgtgtgtgtatgtatgtatgtatgtgtgcaggtgaatgg

SEQ ID NO: 63553 - DNA, 116 bp, Mus musculus
gcatctgttaggtggtaagatgtcagtcagtccattgactgtgtccctgaatgactctcatctattgaggaggctgagatataaactcattgagggttgatgatctttggttatga

SEQ ID NO: 63554 - DNA, 98 bp, Mus musculus
aggaggaggtaggaaaatatgtacattcagtgtctgtcagtgacagtcatatgagcagaaagacacagagaggagtgtatcatggttctccttttttt

SEQ ID NO: 63555 - DNA, 85 bp, Mus musculus; identical to SEQ ID NO: 57439

SEQ ID NO: 63556 - DNA, 69 bp, Mus musculus
tcctctgtcactttctgtgactcagtttgtgggtagagcacttacaaagaggaaggattggctagagga

SEQ ID NO: 63557 - DNA, 90 bp, Mus musculus
gagcttcatgtattctgtgacttgtatcttggatatttcaagcttctgggctaatatccactgatcagtgagtgcataccatgtgtgttc

SEQ ID NO: 63558 - DNA, 85 bp, Mus musculus; identical to SEQ ID NO: 57470

SEQ ID NO: 63559 - DNA, 116 bp, Mus musculus
gttatgcaaagttatgtattaaagggccagtgtaatattttaaactatgtatatattatacaatgtttgaatgtggttaactattcctcttaagttattgatcattgctttataat

SEQ ID NO: 63560 - DNA, 85 bp, Mus musculus
ctgagaactgaagctatttattgcacacctgattttgtggcctctgtgttagagcggcctcagttctcagtgagcagtttcagtt

SEQ ID NO: 63561 - DNA, 113 bp, Mus musculus
acacagtgcttggaggacagatattttattatgttacttagtcactgagatattttataaatattctagcaacattatttcaaaaaatgttttacccttaccatagactgtgt

SEQ ID NO: 63562 - DNA, 101 bp, Mus musculus
tggtatcagggtatgaggatgttgctttactggacctgctgctgttttaggagagagtggaagactacagatgaacagtgcaacctgagctgcccgatcca

SEQ ID NO: 63563 - DNA, 98 bp, Mus musculus
tacatatatatatatatatatatatatatatatatatatatatatatatatacatatatatgtatgtgtatatatgtgtatatatatacatggttata

SEQ ID NO: 63564 - DNA, 77 bp, Mus musculus
aaagtgatcaaatgattttttaggtcaggcaacttgagctctgagtgtctgactgtttatcatgcttgatgcatttt

SEQ ID NO: 63565 - DNA, 94 bp, Mus musculus
actggtcacttcatatctgatgcctgcctgcctgcctgcctgcctgcctgcctggacagtgtcagcctttggaggcctgtctttaggtgtcaga

SEQ ID NO: 63566 - DNA, 78 bp, Mus musculus
tgatctgataggatacatgggacaatttcaatatttttgtatctgttgaggcctgttttgtgacctattatgtggtca

SEQ ID NO: 63567 - DNA, 79 bp, Mus musculus
gagtgcaaattgtatgtgatagtcaagcagcttttgatttaaaggagtgtgtgttggcatttatttataatatgtattt

SEQ ID NO: 63568 - DNA, 84 bp, Mus musculus
aggagttctaattctgaaagcagtttcaggagccactgggtaggcgttgtccacggtgctgattctgtcaggaagttatttcct

SEQ ID NO: 63569 - DNA, 85 bp, Mus musculus
atgttatatatacatatatgtgtatgtatatatgtatacatatacatataactgcacacacacatatatacatatatatatacat

SEQ ID NO: 63570 - DNA, 140 bp, Mus musculus
gtttatatatgtatctatatgtgtgcatatatacttattataaatatatatatatatacacacacacacacacatatatatatatatatatatatatatatatatatatatatatatatatacatatgtgtgtgtttgtg

SEQ ID NO: 63571 - DNA, 129 bp, Mus musculus
tatgcacacatgcccacacatgtacatgcacacacatatatactcatatacatacatacgtatgtatgtatgtatgcataaatacatatgtgcacatgtgcacatacacacacacacacacacacatac

SEQ ID NO: 63572 - DNA, 111 bp, Mus musculus
gcatccatcaatggctcagtgctctgtatcgtcacttttattcacataaccaattctctgagtgtctgactgtttgttgacgtttctgaccttgaagcggttgataagatc

SEQ ID NO: 63573 - DNA, 113 bp, Mus musculus
cacagggttgtgtttctgtctgcctatctgtctgcctgcctgcctgcctgtctatttcagaattgttactatcagagggaggcagcagcatcagaggtctacatagctctttg

SEQ ID NO: 63574 - DNA, 99 bp, Mus musculus
gtagacgctctcatgtactgagtgcttatgatatgttttcaagattggcttataaaacaatgggtatatcctgggagaaagaatatgcgagctgaatgc

SEQ ID NO: 63575 - DNA, 72 bp, Mus musculus
gtgtgagcctgtcagaagaattaaaaaaaaacagttttttttttttaaataaaaatctgttaggcttagtac

SEQ ID NO: 63576 - DNA, 71 bp, Mus musculus
atacgtgttcttggccatgaatgtgtacaggcatgtgaacatgcatgtacacacacacacacacaatgtat

SEQ ID NO: 63577 - DNA, 62 bp, Mus musculus
gataatgatggggacagaacttctctgtgccagcccagctcacactctgtctctgtctgatc

SEQ ID NO: 63578 - DNA, 64 bp, Mus musculus
acagtcctttgggtccatagacaagaccttcttccctttggtgtctctctgtgtgaccctctgt

SEQ ID NO: 63579 - DNA, 57 bp, Mus musculus
atgcatgtatgtatatatgtatgcattaggtatgtgtgtgtgtgtgtgtgtgtgtgt

SEQ ID NO: 63580 - DNA, 71 bp, Mus musculus
ctcaatatgcatgtatgtatgtatgcatgtgtcatcacagacttataaacatatacatacaagtttttgag

SEQ ID NO: 63581 - DNA, 77 bp, Mus musculus
gtatgtatgtgtatatatgtatgcatatatatgcatacatgtatgtatgtatgtatgtatatatacatatacacaca

SEQ ID NO: 63582 - DNA, 111 bp, Mus musculus
gtttttattgttcagttttagtcttattccttggggcctaaatacaagagtagtaattttcatcttgagttggcctatctggatgtagtcctagctgtgggctttgtctgc

SEQ ID NO: 63583 - DNA, 90 bp, Mus musculus
gtgccaccatgcccagccttcaccaggagtattaaacagcccttaaggaattctgtatactctctggtagagttctggaagactaggcgc

SEQ ID NO: 63584 - DNA, 85 bp, Mus musculus; identical to SEQ ID NO: 57439

SEQ ID NO: 63585 - DNA, 85 bp, Mus musculus; identical to SEQ ID NO: 57439

SEQ ID NO: 63586 - DNA, 62 bp, Mus musculus
gtatatatgtttgtatttgtacatgtatgattgtatacatgaacatatatacatatatatgc

SEQ ID NO: 63587 - DNA, 85 bp, Mus musculus; identical to SEQ ID NO: 57470

SEQ ID NO: 63588 - DNA, 119 bp, Mus musculus
aacattacatgaacatgtatatatgaatttaaatgcatgagaatatgtgtgtatatatgcatgtgtgtatgttatatgtatgtatatatgtgtatgtgtgtatatataagtgtatgtgt

SEQ ID NO: 63589 - DNA, 82 bp, Mus musculus
ctggagcctgttcctcctgtgagctttgttatgacagatctcctgggagtcaatctgtctctgagtgtgggaaaggttctgg

SEQ ID NO: 63590 - DNA, 69 bp, Mus musculus
ggggtgcagcaatgagagatgtgtgtgtacacacctacgtgtaccagctgctcatgtaggctacactct

SEQ ID NO: 63591 - DNA, 86 bp, Mus musculus
tatatatatatatatatatacatgtatatatgtgtgtgtattatatatgtatatactatatacatgtatatgtatacatgtatata

SEQ ID NO: 63592 - DNA, 85 bp, Mus musculus; identical to SEQ ID NO: 57470

SEQ ID NO: 63593 - DNA, 115 bp, Mus musculus
attgcttatcttggacaagaatatgtgattattaaagcaatatctactaccaagatttttatttaataatacatgacatgtattctgaaagccaagttgtccaatgatacacggt

SEQ ID NO: 63594 - DNA, 81 bp, Mus musculus
aggatcattgctctttaggatgtctgggcggttagatttgccatctgattttttttttttagccacagcatcttaggtctt

SEQ ID NO: 63595 - DNA, 90 bp, Mus musculus
atatgaaatgatgatatgggtctgaatatttctttcgaataggtaacgtgaggatatatatttaaattttcatgtctactcttttcatat

SEQ ID NO: 63596 - DNA, 106 bp, Mus musculus
tgtgtgataactgtagtgttattgctgttcttatctaggattttttcattttatttattttctttattccagaaagaatataatgtagtaactcagtattcctata

SEQ ID NO: 63597 - DNA, 112 bp, Mus musculus
acattgatgttgtaggggtgcagtatcatgcaaaaactttttttgtataaaaagggtctaaagattgtgagttgcatggtcattgtagcagctcatacaaactcttcggtgt

SEQ ID NO: 63598 - DNA, 76 bp, Mus musculus
gtggttctccctttatgaccattatctgtggaaccttagaatggagagtccagagtgaggtcaaagtgaagaccat

SEQ ID NO: 63599 - DNA, 85 bp, Mus musculus; identical to SEQ ID NO: 57470

SEQ ID NO: 63600 - DNA, 114 bp, Mus musculus
ggttttgctagttctgtgtatatttcagtattagttctctattgattgtgtagttttctcacattgtatgctgctggtatgtctgaattacagtgtctttcgccatatggaacc

SEQ ID NO: 63601 - DNA, 92 bp, Mus musculus
ggtgaagctacttatgtgtgggatgacttgtgtttatgttccatgaatgataaagtcatgtaaattctttatactttttcttagattttgcc

SEQ ID NO: 63602 - DNA, 70 bp, Mus musculus
tgtatgtttgtaagtatgtatgtgagtatgtgatatatgtatacacacacacataatgtgcaagtataca

SEQ ID NO: 63603 - DNA, 79 bp, Mus musculus
gctgctaaatagttggtccacagtcagagaaggaggatggtgtgctgacttctctgtcagtgttaagtagcttgacagc

SEQ ID NO: 63604 - DNA, 84 bp, Mus musculus
tctatctatctatctatcatctatctaattgtatatatgtatatacactatatacacacatatatagatatagatacagagaga

SEQ ID NO: 63605 - DNA, 69 bp, Mus musculus
gtgtctctgtgtctgtctctaaaccttgtatctaaagattcaaggtgagagttttggataccctataac

SEQ ID NO: 63606 - DNA, 108 bp, Mus musculus
actaggggtgggttttgaaattgcaaaaacccaggccagggtgagtctctctctttgtctctctctacctttgtctattttgtggctcttctgtctctgtttctatgt

SEQ ID NO: 63607 - DNA, 85 bp, Mus musculus
ccatctgtcaactatgtgtacatatcattggtatatgcgtacgtgtgtgtgtgcatgtgcttgtgtgtttttgtgaaatgcttgg

SEQ ID NO: 63608 - DNA, 85 bp, Mus musculus
ggccatggtggtctgataggatacatgggacaatttcaatatttttgtatctggtgaggcctgttttgtgaccaattatatggtc

SEQ ID NO: 63609 - DNA, 85 bp, Mus musculus; identical to SEQ ID NO: 63608

SEQ ID NO: 63610 - DNA, 99 bp, Mus musculus
tggtaggaaaatgttagttatcaaccttgaaagtgatagtactttattttttcattaagtatggctacttttaggaagtgattgttatcaattcaacca

SEQ ID NO: 63611 - DNA, 85 bp, Mus musculus; identical to SEQ ID NO: 57470

SEQ ID NO: 63612 - DNA, 108 bp, Mus musculus
ggccaggtagcgtcaccatagaagcagcactgtatctgggcagatgcactctagtgagtgtgctcccatcagctcttaaaaattgatatgcttcagttggaccgagcc

SEQ ID NO: 63613 - DNA, 85 bp, Mus musculus; identical to SEQ ID NO: 57470

SEQ ID NO: 63614 - DNA, 64 bp, Mus musculus
gtatgtatgtatgtatgtatgtatgtatcaatgtatgtatgcatgcatgtatgtatgtatgtat

SEQ ID NO: 63615 - DNA, 65 bp, Mus musculus
cctgtcaatgaggagaagcgtgactgcctctaactttgattcagtctctctctttgtggacacgg

SEQ ID NO: 63616 - DNA, 85 bp, Mus musculus; identical to SEQ ID NO: 57470

SEQ ID NO: 63617 - DNA, 76 bp, Mus musculus
gagcattttcctcctactgggatagaaatatataatatatggaatatgtatgtatattttagtttggaattggctt

SEQ ID NO: 63618 - DNA, 85 bp, Mus musculus; identical to SEQ ID NO: 57439

SEQ ID NO: 63619 - DNA, 85 bp, Mus musculus; identical to SEQ ID NO: 57470

SEQ ID NO: 63620 - DNA, 85 bp, Mus musculus; identical to SEQ ID NO: 57470

SEQ ID NO: 63621 - DNA, 119 bp, Mus musculus
agctctggatctgggtctgagaggtatctgagctgggcagcctgctggctctctcactctcacgtgcttgaggtcagctcaccagcatcccctgctaccaggaccagctccatcctgct

SEQ ID NO: 63622 - DNA, 69 bp, Mus musculus
gctcttactcacttactcactgagccatctcacctataagatggaacacagggtattgggagtaagagc

SEQ ID NO: 63623 - DNA, 85 bp, Mus musculus; identical to SEQ ID NO: 57470

SEQ ID NO: 63624 - DNA, 97 bp, Mus musculus
ctgtaacaagctggaagctttattttgatccttggttttagtagtttggctcacaaacacagaagaaagagtgcaaagcatccagtcaattatgcag

SEQ ID NO: 63625 - DNA, 85 bp, Mus musculus; identical to SEQ ID NO: 57439

SEQ ID NO: 63626 - DNA, 101 bp, Mus musculus
catctatctatctatctatctatctatctatctatctatctatctatctgaaccacaggacccgatatatagtgatagacttctagaggagttgatacttg

SEQ ID NO: 63627 - DNA, 86 bp, Mus musculus
gtaagaatatgcaactgggctggagagatagatcagaggttaagagcactggctgctcttccagaggtcctgagttcaattcctac

SEQ ID NO: 63628 - DNA, 108 bp, Mus musculus
tagaagtcctgtttagaaatgaacacttggcactcacatactctcactgtgttcaccagttctgagtctcagcagttgccactgtccactgtaaaacaaagctctctg

SEQ ID NO: 63629 - DNA, 73 bp, Mus musculus
gatatgtgtgtatatatgtatatgtgtatatgcatgtatgtgcatgtcccctatgtgcatgtatatcgcatat

SEQ ID NO: 63630 - DNA, 71 bp, Mus musculus
atgtatataggcatactgtatacatatgtgtataaatatttctatttatgtatacagtgtactacatgcat

SEQ ID NO: 63631 - DNA, 72 bp, Mus musculus
gctcccatgtgtgtgcctgtgtgtgtctgtgcatccatatgctggaacgtaggacagagggcaacactgagt

SEQ ID NO: 63632 - DNA, 68 bp, Mus musculus
ctcagtgttgccctctgtcctacgttccagcatatggatgcacagacacacacaggcacacacatggg

SEQ ID NO: 63633 - DNA, 71 bp, Mus musculus
gaaaatttctggactggagagatggtttagcgtttaagagcactgactgctcttccagaggtcctgagttc

SEQ ID NO: 63634 - DNA, 113 bp, Mus musculus
gaatatatacattaaaatgaatatatgcatatatttaaatggatatattatatttaataaatatatattcaagatgaatatatacatgtgtttatgtatatgatatatatgtc

SEQ ID NO: 63635 - DNA, 66 bp, Mus musculus
tatatatatatatatatatatatatatatatatatatatgtatgtatgtatgtatgcatgtatgta

SEQ ID NO: 63636 - DNA, 61 bp, Mus musculus
caggtgtggtggtgggtgggagccgctgtcgcctgcctgcctgcctgcctgcctgcctgcc

SEQ ID NO: 63637 - DNA, 74 bp, Mus musculus
tgtatatgaactacattttatgtatatgtgtgtatatatatacatacatatacacatatgtatatgtatatata

SEQ ID NO: 63638 - DNA, 127 bp, Mus musculus
ggactgggagaaagggtgaggaggcgggccggcatgcctttgctgctggccggagctcttttcacattgtgctactgtctaacgtgtaccgagcagtgcaatgttaaaagggcatcggccttgtagt

SEQ ID NO: 63639 - DNA, 114 bp, Mus musculus
gcacttgttgatcttccagaggaccagaggacttgggttcaattcccagcacccacatggtgactgatgactgtctctagccccagttccagaagatctaatgctctcatttgc

SEQ ID NO: 63640 - DNA, 77 bp, Mus musculus
aggaggtgggtcactaggggcgggccttgaggtttcaaaatcccatggaagacccagtctatctctctctgcctcct

SEQ ID NO: 63641 - DNA, 82 bp, Mus musculus
ggcgtgaagaaggccagggtgaggaccactgtgcaatgtcattcaatggagaacaggactcaaactctcaccttctcactcc

SEQ ID NO: 63642 - DNA, 95 bp, Mus musculus
taggggaaatatatgtatatgtatatgtgtgtgtgtgtatgtatgtatgtatgtatgtatgtatgtatgtatgtatgtatgtatgtgtctgtcta

SEQ ID NO: 63643 - DNA, 118 bp, Mus musculus
aagcacttttactgactgaactaaccatctctccagtctgcatgtgtgtgtgtgtatgtatatatatattctgcatatgcaagaaaagatgtggtatttgtctttctgaatctggttt

SEQ ID NO: 63644 - DNA, 65 bp, Mus musculus
tctgtctctctctctcactgtgtgcgtgcgcgtgcatgcccgtcacaatgtgttgagatcagaga

SEQ ID NO: 63645 - DNA, 106 bp, Mus musculus
tgtgtgtgtgtgtccatgtgtgcatgcatctgtgtgtatgtctatatacatatgtatatatgtgtatacatgtgcctttgtgcatgcatatgtttatacacataca

SEQ ID NO: 63646 - DNA, 101 bp, Mus musculus; identical to SEQ ID NO: 59975

SEQ ID NO: 63647 - DNA, 81 bp, Mus musculus
gtatgtatacatgtatgtgtgtgtatgtgtgtatgtatgcatgcatgtacatatgtgtgtatgtatgtatgtatgtatgta

SEQ ID NO: 63648 - DNA, 80 bp, Mus musculus
atgtatgcatgcatgcatgcaagtacatatgtgtgtatgtatgtatgtatgtatgtatgtatgtatgtatatatgtatgt

SEQ ID NO: 63649 - DNA, 118 bp, Mus musculus
gctctctctagcttctccattggggaccctgtgttccatcttatagatgactgtgagcattcacttctgtattttccaggtactggcatagcctcatatgagacagctataccagggt

SEQ ID NO: 63650 - DNA, 106 bp, Mus musculus
gccttagtctgtggtgatctgataggatgcatgggataatttcaatatttttgtatctgttgaggcctgttctgtgacagattatattgtcagttttggaggaggt

SEQ ID NO: 63651 - DNA, 112 bp, Mus musculus
gaaaataagctatttcagagctctcctgggaacagaagaaaaacgggagatgtcccactttctctctgactcctatggaaattttcttagctctggttaaaatatctgtgtc

SEQ ID NO: 63652 - DNA, 87 bp, Mus musculus
ccccaacaatgagggttacttgggggaaatttttctatttgttaatgagttctgtcttctcctcagggcctgtcagctgattggtgg

SEQ ID NO: 63653 - DNA, 84 bp, Mus musculus
ctagtcagtgtttatgatagaaataaccagctgggaatcttattgcatcttctgggtttacttctttttttatagaatgactgg

SEQ ID NO: 63654 - DNA, 99 bp, Mus musculus
gcaagggcggctcctcatatctcccccttttcttttatttaaaaggcaacaggccacccagtactgagagtggagatagaggtcaaatccccagtgtgc

SEQ ID NO: 63655 - DNA, 116 bp, Mus musculus
tttctccatctatggtaattgaaagtttggctgggtatagaagcctgtgctgtgttctcttagtgtctgtataacatctgtccaggagcttctggctttcatagtctctggtgaaa

SEQ ID NO: 63656 - DNA, 109 bp, Mus musculus
gatttattcatctgatcctgaagctttgatattttgtactgccaaaaaaaaaatgctttatttttgtttacaaaaaatcctcactgccatgggttatgaagaataaaac

SEQ ID NO: 63657 - DNA, 87 bp, Mus musculus; identical to SEQ ID NO: 60417

SEQ ID NO: 63658 - DNA, 77 bp, Mus musculus
gcctctgtgttttacaccttggtcatcccaatgctgaaccccatgatctacagcctgaggaacaaggatgtgaaggc

SEQ ID NO: 63659 - DNA, 62 bp, Mus musculus
ggtccagttatcttcactgcataaacatatatatttatagtttagcagcagatagctagatt

SEQ ID NO: 63660 - DNA, 65 bp, Mus musculus
ggtaatctagctatctgctgctaaactataaatatatatgtttatgcagtgaagataactggacc

SEQ ID NO: 63661 - DNA, 96 bp, Mus musculus
ggttcttgattcacttggatttgagctttgtgcaaggtgacaaatatggatctatatctatttttctatgtaccaactgccagccagaccagaacc

SEQ ID NO: 63662 - DNA, 84 bp, Mus musculus
ccattgagtggtacaggtagatggtaggttagttgtgtggctcatctgtttcatgaccagtttctatttgctcatcattttagg

SEQ ID NO: 63663 - DNA, 71 bp, Mus musculus
ccagataaggaaatattcttttacacatatagctagagccatgtgtagctccatgtgtaatctttggttgg

SEQ ID NO: 63664 - DNA, 108 bp, Mus musculus
gcatccatcttttataccatgattatccccatgttgaatcccttgatctacagcttgaggaacaaggatgtaaagaatgctggacagaggatatggaagaagttgtgc

SEQ ID NO: 63665 - DNA, 104 bp, Mus musculus
atctcattgtattgagagattaatgggttacatttatatatatcttgatctattatgagatttatatatgtatatatgcatatctcaaaaattttcagtgagat

SEQ ID NO: 63666 - DNA, 85 bp, Mus musculus; identical to SEQ ID NO: 57439

SEQ ID NO: 63667 - DNA, 111 bp, Mus musculus
gtcttaagaaatattgatttttactgtagtgtaagaaacagtttttaaatttttgaacttaatacttcagaatttaaactctctgtgcctaaatagtgaaaatggaaagat

SEQ ID NO: 63668 - DNA, 79 bp, Mus musculus
atgatagatagatagatagatagatagaaaaatagatagatagatatctgtatatgtctctctgtgtgtgtgtatgcat

SEQ ID NO: 63669 - DNA, 107 bp, Mus musculus
gtgttttacaccttggtcatccctatgttgaatcctctgatttacagcctgaggaacaaggatgtgaaggaagcagcaaagaagttgatttgtgggtggagtaacac

SEQ ID NO: 63670 - DNA, 106 bp, Mus musculus
tctctgctgtgttttacaccttggtcatccccatgctgaaccctctgatttacagcctgaggaacaaggatgtaaaggaagcagccaagaagttaatttgtgggga

SEQ ID NO: 63671 - DNA, 79 bp, Mus musculus
acttctgttagtttcactgtgtctctgtttagtttctgttcccaggaactgtccattgatgagagtggggtattgaagt

SEQ ID NO: 63672 - DNA, 99 bp, Mus musculus
gtgctagcactagatcacctagggcacagagtcagcagacacccccatggtccctagaggactctccatagatcttaggataactggtgagtggaacac

SEQ ID NO: 63673 - DNA, 92 bp, Mus musculus
ggatacagtttaatactcatttccatagaggctagattggtttgcattccacaaattattctctgtctctctgtgggtgtctctctgtctct

SEQ ID NO: 63674 - DNA, 81 bp, Mus musculus
tggtgatctgataggatgcatgggacaatttcaatatttttgtatctgttgaggcctgttttgtgacctattatgttgtca

SEQ ID NO: 63675 - DNA, 106 bp, Mus musculus
caattccaatatgtatatatatatacacatatgtatatgtatatatatagtatattgcctaagataagtataagtgtgtatatatatatctttaggcaatgagcta

SEQ ID NO: 63676 - DNA, 82 bp, Mus musculus
gttctgtctactttctagcaatgtatctttttatttgaatggatctcatttcctggacttcaagttatagtagatgcagaac

SEQ ID NO: 63677 - DNA, 94 bp, Mus musculus
tccagccctgctcactgtagctgtcttcagacaacatagaagagagcatcagctctcattatatatgtttgtaagccaacatgtggttgctggg

SEQ ID NO: 63678 - DNA, 85 bp, Mus musculus; identical to SEQ ID NO: 57439

SEQ ID NO: 63679 - DNA, 89 bp, Mus musculus
gttaagaatagagatttagggctggagagatgggtcagcggttaagagcactgactgctcttccaaaggtcctgagctcaaatcctggc

SEQ ID NO: 63680 - DNA, 85 bp, Mus musculus; identical to SEQ ID NO: 57439

SEQ ID NO: 63681 - DNA, 100 bp, Mus musculus
gttagtctcattatttttagccaagaatgatcctgtaatctagattgctcaatgatttatctcagaacacagtcagttcagggcagaaaatggattgtac

SEQ ID NO: 63682 - DNA, 104 bp, Mus musculus
gggaaaaacattgtgagagccagagttgttggataatgacaccacaaaacacagtttttgtttttctatacacaacagggcagttgcaaatatgaatgtgtccc

SEQ ID NO: 63683 - DNA, 110 bp, Mus musculus
tggatcctgttaaaaaattctgaaaaaaaaatctaagttggacaggctcaggtcctatttgagtttatttatctaagtgattttgtccaccctcctacgggataattcca

SEQ ID NO: 63684 - DNA, 85 bp, Mus musculus; identical to SEQ ID NO: 57470

SEQ ID NO: 63685 - DNA, 91 bp, Mus musculus
agcctctgactgatagaccagggctgttgttcaatatttggtggctgagtgtatggcacagaacatatttttctgtcagcttataaaggct

SEQ ID NO: 63686 - DNA, 85 bp, Mus musculus; identical to SEQ ID NO: 57470

SEQ ID NO: 63687 - DNA, 89 bp, Mus musculus
agaaaaagaacagctactgactgaccctgagtgcctgtctcaacgtgtcacatctcagggcaacagcgttatgcactgtttatgtttct

SEQ ID NO: 63688 - DNA, 85 bp, Mus musculus; identical to SEQ ID NO: 57439

SEQ ID NO: 63689 - DNA, 115 bp, Mus musculus
ttctgaagaacaattaggagtcatgcagaagactgaaacctgaaaatttatttcatgatattgtttattgtttcatctgtaactgcgtgacacttgagacataaaccctgaggaa

SEQ ID NO: 63690 - DNA, 81 bp, Mus musculus
tttacataaatatgtatgcatatatatttttatggatatgctgcacaaatatttataagtgtatgtatatgtatgtgtaga

SEQ ID NO: 63691 - DNA, 120 bp, Mus musculus
tatatatatatatatatatatataccttcaatgtctttacagatgaatatatatatatatatatatatatatattcaaaatctttacacatgaatacacacatatatatatatatgtata

SEQ ID NO: 63692 - DNA, 73 bp, Mus musculus
gcaccacaaaatgactacgcttccagaagagagacaggagataatactgttttctttcttgactgtcaggtgc

SEQ ID NO: 63693 - DNA, 89 bp, Mus musculus
ggatccactttataggaaggaatccatacctgataatgtaaaacttccaagctgtattagtgtatggtattgtatctttagggagattt

SEQ ID NO: 63694 - DNA, 62 bp, Mus musculus
gactgtgtctgtatctgtctgagtcagctgcgaggtggagcctctcagagtacaacacactc

SEQ ID NO: 63695 - DNA, 85 bp, Mus musculus; identical to SEQ ID NO: 57439

SEQ ID NO: 63696 - DNA, 99 bp, Mus musculus
atgagtaggactgttagttgcttactttgaaagtttattttgttccttctggaaccaagaaggctaattctcagtgaggaaacattcaggtcagctcat

SEQ ID NO: 63697 - DNA, 117 bp, Mus musculus
gcaacagaggagtgttcctctttcttcttatccttgccaacatatgctgtcagttgagtttttgatcttaacattctgactggtacaaggtggaatttcagggtcattttgatttgc

SEQ ID NO: 63698 - DNA, 60 bp, Mus musculus
gtatgtgtatatatatgtatgtatatgtgtctatgtgtatgcatatacatacacttatgc

SEQ ID NO: 63699 - DNA, 90 bp, Mus musculus
ttactctgaatactcacagtactcactgagatctgcaactgctgagttatagcattcattagtgagtgctaatatgtggtaatactgtaa

SEQ ID NO: 63700 - DNA, 126 bp, Mus musculus
ttacagattaatatcaggatttgattttgttttatagcttcctacataatttgtttttctttgtaaataaggctgttaaccagtaaaagatgcgataggtctgtgagctagagtactgaacctgat

SEQ ID NO: 63701 - DNA, 88 bp, Mus musculus
cccagaaatacaactactaaatctccatttaattgaagtttctagatttcttttaagcaataggtttatgtagatgtgtgtttatggg

SEQ ID NO: 63702 - DNA, 85 bp, Mus musculus; identical to SEQ ID NO: 57470

SEQ ID NO: 63703 - DNA, 97 bp, Mus musculus
accatataatataacgatatatgtatatattcattgctggatacatatacattatgtatatatgtatatagcatcaaatgtatgctagttagatggt

SEQ ID NO: 63704 - DNA, 115 bp, Mus musculus
ggaccttcaacattgtatcatgaagccccactttttacagttaaagatagaaagaggtagtattttctttagttatgtaagtgtaggtgagttcttccatgtttagtaattagcc

SEQ ID NO: 63705 - DNA, 133 bp, Mus musculus
tatacatatatatgtgtgtgtgtgtgtgtgtgtgtgtgtacatatatatatatgtatacatatatgtatgtatacatatatgtatatatgtatatgtatatatatatatatgtatgtatatatttttcccaca

SEQ ID NO: 63706 - DNA, 133 bp, Mus musculus; identical to SEQ ID NO: 63705

SEQ ID NO: 63707 - DNA, 130 bp, Mus musculus
tatacatatatatgtgtgtgtgtgtgtgtgtgtgtgtacatatatatatatgtatacatatatgtatgtatacatatatgtatatatgtatatgtatatatatatatatgtatgtatatatttttcccac

SEQ ID NO: 63708 - DNA, 125 bp, Mus musculus
tatacatatatatgtgtgtgtgtgtgtgtgtgtgtacatatatatatatatgtatacatatatgtatgtatacatatatgtatatatgtatatgtatatatatatatatatatgtatgtatatat

SEQ ID NO: 63709 - DNA, 133 bp, Mus musculus; identical to SEQ ID NO: 63705

SEQ ID NO: 63710 - DNA, 89 bp, Mus musculus
tatatgtagaatatgtatacatatgtgtgtatatatatgtatatatatgtgtgtgtatgtatatatatgtgtgtatgtgtatatatatg

SEQ ID NO: 63711 - DNA, 100 bp, Mus musculus
tcagaaagcattgatctcagctgattaggaaattgcatgtttatttaacttcctcacaccaggttgaagatttgtaaattcctaagctgaggcttcctga

SEQ ID NO: 63712 - DNA, 85 bp, Mus musculus
ggccatggtggtctgataggatacatggtacaatttcaatatttttgtatctgttgaggcctgttttgtgaccaattatatggtc

SEQ ID NO: 63713 - DNA, 78 bp, Mus musculus
gtctctgggatcagtccagtggttggctttatgtatttgcatttgtctcagtcagtcgctgttagattcattcagagc

SEQ ID NO: 63714 - DNA, 88 bp, Mus musculus
agaataagaagctctaggttgggtctagagagatgattcagaggtcaagagcagagtcttctcttccagaactcctgagtttaattct

SEQ ID NO: 63715 - DNA, 80 bp, Mus musculus
cagtctctggctctgagtatcagcccctatggatgctgttttcacagaaccctagcctaatcctcctgtccagagtgatg

SEQ ID NO: 63716 - DNA, 118 bp, Mus musculus
gctctctgaacactgaggggagggttttgatgaagacaccccatatggactgagtgtttcaaagtctcacactctcacattgatgtctgcattagttctcatctactgcaaaggaagc

SEQ ID NO: 63717 - DNA, 85 bp, Mus musculus; identical to SEQ ID NO: 57439

SEQ ID NO: 63718 - DNA, 116 bp, Mus musculus
tttctaaatattgaattgtataattaagccatttatttgtgaactttttgattttttatgtaggcacatagagtcatgatttgccttgttggtttgttttcagtgtgttctagaga

SEQ ID NO: 63719 - DNA, 73 bp, Mus musculus
cagaacttatcctatatacatacaacaagggctcaataagtatttgttgatgtgaataagtataggtaatctg

SEQ ID NO: 63720 - DNA, 67 bp, Mus musculus
ctctcatgtcttctgtgagtttatgattttatgtatctgttgaaagtctaaaactcacaaatgagag

SEQ ID NO: 63721 - DNA, 85 bp, Mus musculus; identical to SEQ ID NO: 57470

SEQ ID NO: 63722 - DNA, 85 bp, Mus musculus; identical to SEQ ID NO: 57470

SEQ ID NO: 63723 - DNA, 103 bp, Mus musculus
aaggggttgcttatcttggttttctcaaagaaacaaatttttatttatttgatgctttgtattaattatttttgtttctttggttctattattgcttttcttt

SEQ ID NO: 63724 - DNA, 101 bp, Mus musculus
gaagctgtggagaaggaaaattatttcatgacacaagtgagtcttctatagtaaatgaagtcatctgattgtgatgttatctccttatgattcatatcttc

SEQ ID NO: 63725 - DNA, 75 bp, Mus musculus
gctcagccatagcaaacatctttaacttacatactttttgtttattgtaaacaaagagctgtggtgtggctcagc

SEQ ID NO: 63726 - DNA, 68 bp, Mus musculus
agggtgctgcctcagtccctctgtgcttctgcctgttccagaggctgtcaggttctctggcgctccct

SEQ ID NO: 63727 - DNA, 89 bp, Mus musculus
catggtaaggaaatactggacagaagcaagactgaagaccagatgggctgtagccacttggttctctatgtctgtccatttcctgaatg

SEQ ID NO: 63728 - DNA, 80 bp, Mus musculus
acacacacatatatatatatatatatatatatatatatacacacatatatatatatgcatgtatgtatacttgttgatgt

SEQ ID NO: 63729 - DNA, 99 bp, Mus musculus
caaatatttagagcatagttagagattgtgatgattttgtaaaggagtggttgtaggttcttttccaagatccatgacatttgtagccctgaatagttg

SEQ ID NO: 63730 - DNA, 85 bp, Mus musculus
ggccatggtggtctgataggatacatgggacaatttcaatatttttgtatctgttgaggcctgttttgtgaccaattttatggtc

SEQ ID NO: 63731 - DNA, 85 bp, Mus musculus; identical to SEQ ID NO: 57439

SEQ ID NO: 63732 - DNA, 75 bp, Mus musculus
tatatatgtatgtacgtacgtacgtacgtacgtacgtacgtacgtatgtatgtatgtatgtatgtatgtatgtat

SEQ ID NO: 63733 - DNA, 118 bp, Mus musculus
atgtatctatgcatctatgcatctatgcatctatgcatctatgtatctatgtatctatgcatctatgtatctatgtatctatgtatctatgtatctatgcatctatgtatctatgtat

SEQ ID NO: 63734 - DNA, 87 bp, Mus musculus
tgttcgctgtgtgcacacactccctctctccctgaatcctgcatgggcaggctggctgtgtgtgtagcacatggcccttcgtgaaca

SEQ ID NO: 63735 - DNA, 107 bp, Mus musculus
acagcagaatactgggctagagttgcaggcttttattatttcttttcttaaaagaattgcattgagagagagaatggggggatgtgtctgtctgtctgtctgtctgt

SEQ ID NO: 63736 - DNA, 74 bp, Mus musculus
gaagagcctgggtgtgggcttgctctgccattcagtagttacaagaacaagccagtcactctctgtgactcttc

SEQ ID NO: 63737 - DNA, 68 bp, Mus musculus
gagaggacgacagcatagataatacccaatgtaacaagctatgggtctgtctgtctgtctgtcctgtc

SEQ ID NO: 63738 - DNA, 95 bp, Mus musculus
gtgtgtgtgtgtgtctgtgtattttagtgtgtgttttaaattcactcaaaatgcagtgagttagtagcatgtactcataggtgcttttgacaggc

SEQ ID NO: 63739 - DNA, 73 bp, Mus musculus
gtctgtgtgagtgcctgtcacgtgtgtgtttgtgtctgtgtgagtgcctgtcacgtgtgtgggtgcctcaggc

SEQ ID NO: 63740 - DNA, 89 bp, Mus musculus
cagccctggctgtcctggaacttgctctgtagactaggttggcctcaaactcagagatctgtctgcctctgactgcctcctgtgcgctg

SEQ ID NO: 63741 - DNA, 76 bp, Mus musculus
ctcagtagctaagatttaggtgtgtaactactgtaagtagtttataactatattttatgagttttagctgatagag

SEQ ID NO: 63742 - DNA, 135 bp, Mus musculus
acaagccgtgtgtgtgtgtgtgtgtgtgtgtatatatatatatatgtatatgtatatgtatatgtgtgtgtatatatatatatatatacgtgtgtgtgtatgtatatgtgtatgtatgtgtatgtatatatatac

SEQ ID NO: 63743 - DNA, 92 bp, Mus musculus
tcctgcccattgacaacaggattcactttcacgctccaggctagttggcatgttttagttgtgtgtatggttttgttatctacaggcttgga

SEQ ID NO: 63744 - DNA, 91 bp, Mus musculus
ctctagccacagctcctggaagccctacactggcactctctctgagttcaaggccagcttagtctatgtgtgagtttcaagccagagaagt

SEQ ID NO: 63745 - DNA, 97 bp, Mus musculus
ttcattttgtgtctgtgtggtttgcatgtatgtatgtatgtatgtatgtatgtatgtatgtatgtatacatgtgtacagatcctaaagatttgaaat

SEQ ID NO: 63746 - DNA, 79 bp, Mus musculus
gcactccttcgttgtttgtgtgccattaaaaccttgtgtggttacaacaagtttggtctcagcgtctcactgggtgtgc

SEQ ID NO: 63747 - DNA, 114 bp, Mus musculus
ttgcaatatcattttttaaaaattggacttataggactagagagatagctcagtcgttaagagcactgactgctcttccagaggttctgagttcaaatcccagtgaccatgtgg

SEQ ID NO: 63748 - DNA, 102 bp, Mus musculus
catatatatatatatatcatgtatgtatgtatatatatgtgtgtgtgtatgcatgtgtatatatatatgtatgtgtgtatgtatatatacatatatgtgtgt

SEQ ID NO: 63749 - DNA, 99 bp, Mus musculus
agaggctaactggctttccctccactcttagggggagggaagtcaagctctgacatcctcagtccctctcggggtggaggaccctaggtttgggtttct

SEQ ID NO: 63750 - DNA, 63 bp, Mus musculus
ttctggggctgaagagatggctcagcagttaagagcactgactgctcttccagagatccagag

SEQ ID NO: 63751 - DNA, 74 bp, Mus musculus
ggggtgggggaggggtgcatggtcagctctcccactctcatcctcttgggctgcctcactcattcactcatgcc

SEQ ID NO: 63752 - DNA, 107 bp, Mus musculus
gaattcaccagaggatgaattcactggtgagatggctcagcggttaagagcactgactgctcttccagaggtcctgagttcaactcccagtgaccacatggtgactc

SEQ ID NO: 63753 - DNA, 99 bp, Mus musculus
ctctctctggcagtagtgttcatgtatatgcagttagagtgttaggtctctgtgtctgtgtgtagtgaggaatgaataaaatgacagaagagtgccagg

SEQ ID NO: 63754 - DNA, 121 bp, Mus musculus
ggcaagtgagaaagcttagagaggaaatggtacttgtcacacaagcctgggacctgggttcaatctccagaggtcacaggagggtggaaataagaaaccaactctaccacgttgcccccac

SEQ ID NO: 63755 - DNA, 65 bp, Mus musculus
ggtggctcatgcctgatatccttctcaggggctgaggtagaaggatcttaagtttgaggccagcc

SEQ ID NO: 63756 - DNA, 70 bp, Mus musculus
ctgacccctctccagtctctgtctgtctcctgtccacagtagatttgcaaatgctgggaggcacgggagg

SEQ ID NO: 63757 - DNA, 64 bp, Mus musculus
agaatatctagggctggagagatggctcagcggttaagagcactgtctctcttctggaggttct

SEQ ID NO: 63758 - DNA, 61 bp, Mus musculus
atgtctgtgtacctgtgtgagtctgtgtgtaccatgtacccaccaggaggcaagaggacat

SEQ ID NO: 63759 - DNA, 65 bp, Mus musculus
gtgtgtgtgtgtgtgtgtgtgtgtgtgtgtgtgcgggcacgcactctcactcacacatggaacgc

SEQ ID NO: 63760 - DNA, 81 bp, Mus musculus
tgtgtgtgtattcctgagagtgtgtgtgtccatgtgcatgtgtgcatgcacacgcacacacgtgttctagggtggagatca

SEQ ID NO: 63761 - DNA, 82 bp, Mus musculus
tctgagttcaaggccaacctggtctacagagtgagttccaggacagcactcagaagaaagacaggaaagtcgggagttcaga

SEQ ID NO: 63762 - DNA, 109 bp, Mus musculus
gtggtcctgggttctatatgaaatcaggttgagggctggagaggtggctcagcagttaagagcactgactgctcttccagaggtcctgagttcaattcccagcaaccac

SEQ ID NO: 63763 - DNA, 101 bp, Mus musculus
gctcactgtgctggagctcattgtgctgtccaggctggcctcacactctcagtgattctcctacctcagcctccggagtactagaattatgggcataagcc

SEQ ID NO: 63764 - DNA, 107 bp, Mus musculus
cctgtgagacatttccagccatgtgaaagctacttgttagaggcccatgccagctgctgaggtgtgtctgtgtatctgttgggtgtggagaactctcgagatgaagg

SEQ ID NO: 63765 - DNA, 95 bp, Mus musculus
ggagtaccaaccatacctagagggacaaaagacttatcccagaagtggagcttaggaagtctctctgtctgaaagtaactctgtgctctggctat

SEQ ID NO: 63766 - DNA, 114 bp, Mus musculus
gattcataacagggctgaagtgggctgaattgatggctcagcagttaagagcactgactgctcttccagagggcctgagttcaattcccagcaaccacatggtcgctaacaatc

SEQ ID NO: 63767 - DNA, 117 bp, Mus musculus
ttgtgtggttaaaacatatggttcaagggctagagagatggctcagcggttaagagcactgactgctcttccagaggtcctgagttcaattcccagcaaccacatggtggctcacaa

SEQ ID NO: 63768 - DNA, 110 bp, Mus musculus
aacaagaaccccaagatcatagtggcctgtatagaaacactgaggaaagccttaaggtgagactttttgtagttctcttaagtatgctgactgaatttgggttctatgtt

SEQ ID NO: 63769 - DNA, 127 bp, Mus musculus
ttgtttgtttgtttgtttgtttagattggttttatgtatgtgtgtgcactctctctctctttggcactggctctctttacagatatatggatatatatgaataaaaattctgtgaacaaggtgggca

SEQ ID NO: 63770 - DNA, 80 bp, Mus musculus
ccacgcaccccgaggaaggctttgctcctttcctctgtgtctcacacagagaaggctttgccattcccttagggctgagg

SEQ ID NO: 63771 - DNA, 70 bp, Mus musculus
tgctgtgtcacttccactctctggctttcatcaatatctgtgaagaatagaggtctaggttacaagggca

SEQ ID NO: 63772 - DNA, 81 bp, Mus musculus
ggaatgattgattgtgtgtctgtgtgtctgtctgcacatgggcatgccatgcatgcatatggatgtcagaggacaatttcc

SEQ ID NO: 63773 - DNA, 94 bp, Mus musculus
gccatctcaccagccccaacttttttttttttaagagcaggtttattggtggtgcctttaatttttgttcttggtaggaaggcagaggtaggtg

SEQ ID NO: 63774 - DNA, 133 bp, Mus musculus
gcaggtaagtgaatggcatctctggtgacagaaaattataattgcgctattgtcctttgggactctgtctgtcagtggggcactagggtacctgtggagggcataggtagtccttcctactactcaagagtct

SEQ ID NO: 63775 - DNA, 71 bp, Mus musculus
gtctctgtctctctgtgattagtgattgggtcttactatgcagcccagactggtctcctgagtactgggat

SEQ ID NO: 63776 - DNA, 91 bp, Mus musculus
ttgagggagtttttgttttgttttgaggcaaagtctcactatctgtctttgattgggttagaacttgctttgtagatcaaccttcccttga

SEQ ID NO: 63777 - DNA, 76 bp, Mus musculus
gttttccaaatctctgtgtgatgggtttgtaaagcactgcagctgccaatcactctcacggtctcatttggatggc

SEQ ID NO: 63778 - DNA, 93 bp, Mus musculus
gttctgatggcagtcctcgagaggtggagggctggggtgaggaggtacgagcagcccctgactctgtgcctgtctgggagctgcggtgaatgc

SEQ ID NO: 63779 - DNA, 90 bp, Mus musculus
ggttagaactgaaggtcggtccgtccgtccgtccgtccgtgctgggcacacggcccttagtttccagtggcggggggcggtttggggacc

SEQ ID NO: 63780 - DNA, 72 bp, Mus musculus
gtgcctgcttcagtctcagaagagccacaggaaagtctcactgtacagtctgaggactagagaagacggccc

SEQ ID NO: 63781 - DNA, 69 bp, Mus musculus
gggatagagttggaggtgggcagaagctgtaagctgaggaagttatggctcagctctgtgtctgtcact

SEQ ID NO: 63782 - DNA, 96 bp, Mus musculus
gttattactcctagaaaacagtatggattcatagcccaggacacagaaggcagtgtcctgtgttaggattctactaaatactgttgcttgtgtgac

SEQ ID NO: 63783 - DNA, 66 bp, Mus musculus
gtctctgcctgtgactctgtcatgaagggtccatgggttctggcatttgagtcaaggagctgagac

SEQ ID NO: 63784 - DNA, 78 bp, Mus musculus
gtgtgtaatgactgagagaagagacacagcttagattggcctgacttctatcctgatgctatctcctacaccacacac

SEQ ID NO: 63785 - DNA, 68 bp, Mus musculus
cgggttagggttaggtttagggtggctactgttccgatgggatggctggctgcctgcctgcctgcctg

SEQ ID NO: 63786 - DNA, 100 bp, Mus musculus
gtatgtatgtatgtatgtgtgtatatgtgtgtatatatgtgtgtatatatatatatacatatatatatacatatacatatacatatacatatacacatgc

SEQ ID NO: 63787 - DNA, 83 bp, Mus musculus
cagagacgagcgtcctgctatgtgagtgttagtgaagcctcagaaattacactcatgtgtggcgggatttaagttcatttttg

SEQ ID NO: 63788 - DNA, 103 bp, Mus musculus
ggcctccgcctctgctcagtcagcaggagagaccagaaggagcaccagaagttctcagttgtgtgtgtctcagccaaaagaagatcagcagagacaagagacc

SEQ ID NO: 63789 - DNA, 96 bp, Mus musculus
gctgaacggagcagagggtgtgtgctggtgcagtcctgtgcactcgggcgagtgttactgcaagaccacctgtggctggcttctttctccttcagc

SEQ ID NO: 63790 - DNA, 82 bp, Mus musculus
cagatcttcattgtcagttcctctctgcctctctgggatgaagcctacttggacatggaggagatgtttgtgaagagttctg

SEQ ID NO: 63791 - DNA, 80 bp, Mus musculus
gcgtgcgtgcgtgcgtgcgtgcgcgtgcgcgtgtgcgcgcgagtgtgcgtgtgcatgtgcatgtaggcatagaagcaggc

SEQ ID NO: 63792 - DNA, 62 bp, Mus musculus
tggtagctgcctccgactgtcactcactccctctgaggtgggaggagacaggaggtgctcta

SEQ ID NO: 63793 - DNA, 114 bp, Mus musculus
ctattctgtctttaaaattttaatttatgggggctggagagatggctcagtggttaagagcattgactgctcttccagaggtcctgagttcaattctcagcaaccacatggtgg

SEQ ID NO: 63794 - DNA, 87 bp, Mus musculus
ctctgggcctccttactcctcttattctactagccagagcacttctggaagccgaatgtgaggacagaacagagttaggagacagag

SEQ ID NO: 63795 - DNA, 143 bp, Mus musculus
tatatatatatatatatatatatatatatatatatatatatatatgtgtgtgtgtgtatatgtatatgtatatgtgtgtgtatatatgtgtgtatatgcatatatatgtgtatgtatatatatgtatgtgtatatatatatac

SEQ ID NO: 63796 - DNA, 121 bp, Mus musculus
ggtattgggagctgacagaatggagataggggctggagagatggctcagtggttaagagcactgactgctcttccaaaggtcctgagttcaaatcccagaaaccacatgatggctcacaat

SEQ ID NO: 63797 - DNA, 62 bp, Mus musculus
ccccttctcagactccctgtaagcctcttagatgagagtgtggacatgggcatgttggggag

SEQ ID NO: 63798 - DNA, 79 bp, Mus musculus
tgcgcgcttcctctattcatggctcagtctgtctccctgtgcactggtggggcttctccagagagatggagccagtgca

SEQ ID NO: 63799 - DNA, 73 bp, Mus musculus
gtatgtatatatatgtatgcatatgcttgtgtgtttataaatgtttgtgtatgtatgtatatgtgtattatat

SEQ ID NO: 63800 - DNA, 83 bp, Mus musculus
cagtctgccatacaggtcaccagctcggaggccaccacaggaaactcagaggctggctgcctggctgcctgccttcagagctg

SEQ ID NO: 63801 - DNA, 80 bp, Mus musculus
ggaaggtgactctagagagtgtggcagggttaacttgtaacacaagtctctgttccccagctcaggatccgtcaatgtct

SEQ ID NO: 63802 - DNA, 99 bp, Mus musculus
gtgtgtctgtgtctatgtgtgtgtgcatatttctgcatgtgtatgtgcatgtttgcatctgtgtatatatgtatgtatgtgtgcatatttctgcatgtg

SEQ ID NO: 63803 - DNA, 75 bp, Mus musculus
gcacttagaggttcctctgtctctgcctcgcactctacctcactgtgaaactcagagattagggaacgatgatgc

SEQ ID NO: 63804 - DNA, 79 bp, Mus musculus
cacactatatattgtatgcatatgcatatatcctatgtaaatatgtttgtattgaatgtgtatactatgcatgtgtgtg

SEQ ID NO: 63805 - DNA, 73 bp, Mus musculus
gaggggagggacttggtggagacaactcatttagaactgagtgttctgctgtgtctcactctctgcattgtcc

SEQ ID NO: 63806 - DNA, 140 bp, Mus musculus
gttgtgcagggtgggcagaaagagggacaataaggcagccttcctgggtcctcccatgcctgagactctctgcctgagactgggagccaaccttggcagaggtccgtggtctctgcctgtctgctctattctgacagaga

SEQ ID NO: 63807 - DNA, 90 bp, Mus musculus
aggaagctgatgccccagttctaaagggaatgagttttggggtctgcactcagtccctccgtctctctggatttttgtatctaccttcct

SEQ ID NO: 63808 - DNA, 84 bp, Mus musculus
ggccctctgccactgagccacacccccagtcactcactgtgagcctatgggagaatgacactgggttgagtgggccacaaactc

SEQ ID NO: 63809 - DNA, 83 bp, Mus musculus
gcaattacttaggcccgaggagtttgcagctgtcactcagaccctatgaggttacagcagtcactcagaccctgtgaggttgt

SEQ ID NO: 63810 - DNA, 106 bp, Mus musculus
gacagatacagtactgaagtgtagagagtctcagctctggtcagaccgtctcactgggtctcaaatgtcagagggctggaggctgctcacaggagtccttgtcgtc

SEQ ID NO: 63811 - DNA, 117 bp, Mus musculus
cacggatgctcagggaggagtgaagcctcacgagcccctcctccatgacagaagtttgactggtcttgtcttgtgctggacttgtgtggatgatcacagctgctgtgagttccagtg

SEQ ID NO: 63812 - DNA, 66 bp, Mus musculus
gttggctaggaggcaggtagcctagttccccgcacacccactgtgtgcctgtgtcctttgttcagc

SEQ ID NO: 63813 - DNA, 85 bp, Mus musculus
ctgactctgtctctgtatgtgtgtgtacatgtgtgtacgtgagtgcatgtgttcacaaccactcgcaactctggcttagggttgg

SEQ ID NO: 63814 - DNA, 104 bp, Mus musculus
ttctgtaggttctgcaggacatgcacagtcagaacagtgtcagaacagccaagccctgctcccattcacgatgctgcctctgatcctctcagagctttctagaa

SEQ ID NO: 63815 - DNA, 88 bp, Mus musculus
gctgctgaccacagatagtttctcacacactccctcaggctccctgggagcctggcagagaggtgaggtgttacatagttctcacagt

SEQ ID NO: 63816 - DNA, 120 bp, Mus musculus
cacatatatatatatatatatgtgtgtgtgtgtgtgtgtgtgtatgtatgtatatgtatatgtgtatgtatacgatgtatacgatgtatacaatgtatatgtatatgatatatatgtata

SEQ ID NO: 63817 - DNA, 116 bp, Mus musculus
tcaggtgtcgttcttgaaagctgtttcattctgtgtccctcctgaggtggctggaagacatgctctcacacactcagtggaccttccagaggtagccagggttagacgggacgtga

SEQ ID NO: 63818 - DNA, 72 bp, Mus musculus
ccagggagagtggatggagattcggaacaatttcgactgctgtcgtccgtctgtccgtcactgagtcactgg

SEQ ID NO: 63819 - DNA, 74 bp, Mus musculus
tgtctatctgtctgtctgtctgcattttaaggggtcacctgcctgctcaaaatgagggatatgggctgtagaga

SEQ ID NO: 63820 - DNA, 81 bp, Mus musculus
tggggtggctggacatttgacagtgtgactcttgtgagccaatcagtcctcagccagtcacactctcagcctacctcagcc

SEQ ID NO: 63821 - DNA, 102 bp, Mus musculus
tctgcataactattctgaaaaatacccacactgttgcatgattagtagttttttcttatgtattagtgagggctaggggtatagttcagtgtggaatgttgg

SEQ ID NO: 63822 - DNA, 69 bp, Mus musculus
gtcagagctttgctgtttagtgttcattttttccctctagaatgtgagcactggggcaggaaccatggc

SEQ ID NO: 63823 - DNA, 92 bp, Mus musculus
ttctatgcgtcagaagcagacactactgtcagagcagagtctacacaactctgagaggttgaagcagtttgtcctgtagtattgagtaagaa

SEQ ID NO: 63824 - DNA, 116 bp, Mus musculus
tagcaagccctaggaagcgtcttacgtcttatgtacccatagtgctgggcttatagatgtgtgtgagcacaccctgcttgtttacataggatctgagaacgcctttgtgcttgctg

SEQ ID NO: 63825 - DNA, 80 bp, Mus musculus
cagtgcatgcctgagtgcgtgtgtgcgtgcgtgtgcatgcgtgtgcacgcgtgtgtgtgtctgcaccagtacatgagctg

SEQ ID NO: 63826 - DNA, 93 bp, Mus musculus
tttcctttttttgtctgcctcaggacaaggtttggtcagtggtaatgtctgaagatgtcagttcttcctgaaaggaaagtcatctgaagggaa

SEQ ID NO: 63827 - DNA, 117 bp, Mus musculus
tggtctgtagctcattcggtagcctaggcgggttactcaggagctatccaccttgttttattatttttagacagggtcttctctcattgatctgccactcacctatagctgaggcca

SEQ ID NO: 63828 - DNA, 70 bp, Mus musculus
gcttttctgaggctcagagagacgcagaggaccaaacactctgctgttaactgagagaacacagggaagc

SEQ ID NO: 63829 - DNA, 62 bp, Mus musculus
tgtacattaaacagaaaagtcactcctctgtgggccttagaggactgactctctgaatgtca

SEQ ID NO: 63830 - DNA, 102 bp, Mus musculus
ccagcttctgtagttttaggttgtgacggtcacaacaccctctgcctctgtctctcacgctaggctggtgagtgcttctgtcaacttgaaacaagctggagt

SEQ ID NO: 63831 - DNA, 76 bp, Mus musculus
ctcacaggcactctctggctcttacagtccttccagcccctcttctgcaatgaccccagagccttagaggcaggag

SEQ ID NO: 63832 - DNA, 114 bp, Mus musculus
ctcaagaagacagtcatgtcacctccattctcagtgctgagaatagcacgaggtacgcaggggagtgaaggcagtgtggactgaggtaggggagtgaaggcagtgtggactgag

SEQ ID NO: 63833 - DNA, 88 bp, Mus musculus
cctgtttgctaattgattcatttgaccagttagatgttaatttgttaaactgttaatattctagagcaatatcagtagacaagacagg

SEQ ID NO: 63834 - DNA, 88 bp, Mus musculus
acatgtatatatatgtatatgtgtgtatatccacatatgtatgtatgtatgtatgtacgtatatgtgtgtgtatatatatgtatatat

SEQ ID NO: 63835 - DNA, 98 bp, Mus musculus
atagaatttggagaattgtactgtataatatatagaagtatctatataggaaggctttggtgtgggtgtatgtgtgtattaggatttctgagttttgt

SEQ ID NO: 63836 - DNA, 70 bp, Mus musculus
tatatgtatgtgatgtgcatatgtatgtgtatgtatgtatgtatgtatgtatgtatgtagtgtatgtgtg

SEQ ID NO: 63837 - DNA, 92 bp, Mus musculus
ccactccttagggtgttcttgacatgtctctgggtgtctgtttacgatgtatagaaagaaagtggatggatagaagcagtggaggggagtgg

SEQ ID NO: 63838 - DNA, 105 bp, Mus musculus
cgggtagactgcctttcgcgaatctttttgcggtctgggcttgctgtacataactcaatagccggaagcccttaccccaaaaagcattcgcggagggcgcgctcg

SEQ ID NO: 63839 - DNA, 98 bp, Mus musculus
gttctccctccctcatattaactctcatgcctctgcctgttgcaagcgccacacagtctctcaggctgaaggcattggagtggttgtatccttagagc

SEQ ID NO: 63840 - DNA, 116 bp, Mus musculus
gctgaggtgtggcatatcttctgaaaccaccccattcaggcacacactctgatacacagattatcatgaaacaagggctattccgactggtttgaaaataatgcccatcattgagc

SEQ ID NO: 63841 - DNA, 83 bp, Mus musculus
gagtgttcctgggttctacttatgttcataaatatttgtatatttacatgcaccatgtttgtgaattagaaaacacacacacc

SEQ ID NO: 63842 - DNA, 71 bp, Mus musculus
tgctgaagcctctgatcatggtacactggctcattctctgtgcctgtggcacaccatggctggctgaagca

SEQ ID NO: 63843 - DNA, 88 bp, Mus musculus
gggggaggtgtctatttaggggtgcacatgtacatgcaggtagaaggcagagatcaataatgtgtgtctctctcagtcatttctcacc

SEQ ID NO: 63844 - DNA, 57 bp, Mus musculus
atatggcttccatgtgtgcacgtgtgcattcgtgtgcacacacacacacacacatat

SEQ ID NO: 63845 - DNA, 72 bp, Mus musculus
tatgtatatatgtatgtatgtatatatgaatgtataaatgtataaacatatgtatgaatatatgtatgcatg

SEQ ID NO: 63846 - DNA, 80 bp, Mus musculus
tcctccatctgctctgcctctcacactctttgggcctcctttaccacagagttccctgaaccccggtggtggttggggga

SEQ ID NO: 63847 - DNA, 85 bp, Mus musculus; identical to SEQ ID NO: 62895

SEQ ID NO: 63848 - DNA, 85 bp, Mus musculus; identical to SEQ ID NO: 57470

SEQ ID NO: 63849 - DNA, 70 bp, Mus musculus
gtgtgtgtgtgcgcgtatgtatgtgcatgtatgtatgtgtatgtatgtatgtatgtatgtatgtatgtgt

SEQ ID NO: 63850 - DNA, 110 bp, Mus musculus
tcatctaaagaggctggggttgttgtcacatcttgtgcctctcttcacattgtgtcaccagagcaatgcaaattgtgcataatatcacaaagccttactggttatcatga

SEQ ID NO: 63851 - DNA, 102 bp, Mus musculus
tagaaggtactgatggtgttttgtatttcttcaggatctgttgttatgtctcccttttcatttctgattttgttaattaggatgctgtccctgtgccctcta

SEQ ID NO: 63852 - DNA, 83 bp, Mus musculus
ctagacaagatcctaaatgattatcattatatccataatgctacttttgtggattttcctattattttgagggcttgagctgg

SEQ ID NO: 63853 - DNA, 89 bp, Mus musculus
ggagataacacagggtgggagtaagtagtcatgttcattatgcatgtatctatacatctatctatatctatatctgtgtctgtatctgc

SEQ ID NO: 63854 - DNA, 69 bp, Mus musculus
tctctccacctctctgtctgcctgtctgtctcacacacacatacacaggtatgaagaaaggaaaagaga

SEQ ID NO: 63855 - DNA, 85 bp, Mus musculus; identical to SEQ ID NO: 57439

SEQ ID NO: 63856 - DNA, 104 bp, Mus musculus
ccaggtgtgtgtatacagttgtttgtggagaccagaagttgacactgagtgtctttctcagtctttctccaccataagaaaacagtgtctgtcattaaacctgg

SEQ ID NO: 63857 - DNA, 58 bp, Mus musculus
actcaagtatatgtaatgtatacatatatgtaatatatgtatacaatacatatatagt

SEQ ID NO: 63858 - DNA, 85 bp, Mus musculus
ggccatggtggtctgataggatacatgggacgatttcaatatttttgtatctattgaggcctgttttgtgaccaattatatggtc

SEQ ID NO: 63859 - DNA, 85 bp, Mus musculus
ggccatggtggtctgataggatacataggacaatttcaatatttttgtatctattgaggcctgttttgtgaccaattatatggtc

SEQ ID NO: 63860 - DNA, 93 bp, Mus musculus
gaaatactctttctttgtcaagtctttctgttgttcaggaatcaggttaactgtggcctcatagaagcaatttggcaaagttccttctgtttc

SEQ ID NO: 63861 - DNA, 86 bp, Mus musculus
acacccactgcctaacatgtatgtatgtatgtatgtatgtatgtatgtatgtatgcatgcatttatatacatgtgcaagtgtttgt

SEQ ID NO: 63862 - DNA, 81 bp, Mus musculus
actaagctgacagccataacatagggacaagaggaactggccatgcttgtcacttcagtctctgtgagccctgcttagttt

SEQ ID NO: 63863 - DNA, 85 bp, Mus musculus
aaagttgaagtactatgttgaatagttaagaaaagagtgggcagccttgctttgtacctgattttaatggaattactttaacttt

SEQ ID NO: 63864 - DNA, 72 bp, Mus musculus
agctgactatagtttcagttctcaactctttcattgcctaaggcctgtctaagagaactgtctgaggtcact

SEQ ID NO: 63865 - DNA, 85 bp, Mus musculus; identical to SEQ ID NO: 57439

SEQ ID NO: 63866 - DNA, 79 bp, Mus musculus
gtatatatgtatttgtatatgtatatgcatatgtatatgtatataagcatgtgtatatgtatgtatgtatgtatgtatg

SEQ ID NO: 63867 - DNA, 71 bp, Mus musculus
ggcactctccctgccagaggagagtcagcctccaggaagggctcacactctgggactcaggtgacagtgcc

SEQ ID NO: 63868 - DNA, 86 bp, Mus musculus
gcaatggaggagtgttctaatgtaccacatccttgccagcatgggctgtcactagtgtttttgatcttagccattccgacagatgt

SEQ ID NO: 63869 - DNA, 85 bp, Mus musculus; identical to SEQ ID NO: 57439

SEQ ID NO: 63870 - DNA, 102 bp, Mus musculus
tctgtctgtctgtctgtctgtctgtctgtctatctacacacagacatacacacagacacagacacatgcatgcctgtgtgtgtgtgtgtgtatgtatgtatg

SEQ ID NO: 63871 - DNA, 114 bp, Mus musculus
gtaattatacatacatacatacatacacacacacacacacaggcatgcatgtgtctgtgtctgtgtgtatgtctgtgtgtagatagacagacagacagacagacagacagacag

SEQ ID NO: 63872 - DNA, 65 bp, Mus musculus
gtgggtatgtatatctgtgtggttttgtgcatgtgcatgaaggtgcccacagatgaaatagtcat

SEQ ID NO: 63873 - DNA, 94 bp, Mus musculus
agtgaaactagtgcaatcacaagattagtgttatacatgttgatttaattttctaaatcaacaagagagcgacttgagatgtctagtaatcatt

SEQ ID NO: 63874 - DNA, 107 bp, Mus musculus
atgtcatatgcatgccatatgtatgtcatatgtatatgtgtgtgctcattatatacatgtatatgtgaatatgtatatgtgtgtgctcattatgtacatggatatat

SEQ ID NO: 63875 - DNA, 104 bp, Mus musculus
catatacatatacatatacatatacatatacatatacatatacatatacatatacatatacatatgtatatatatatatgtgtagtatttgtgttatattggtg

SEQ ID NO: 63876 - DNA, 69 bp, Mus musculus
attctactctcatttttttctagttgcaaagccagctgtgcaaccttctcagaaaagagagagcagagt

SEQ ID NO: 63877 - DNA, 109 bp, Mus musculus
gaggttgtaaaaattcctcttatcttcactaacatttcttgttgttcagccaatagttgtagagagcagagagtggtcagagagccatcagtactggaatttacacttc

SEQ ID NO: 63878 - DNA, 85 bp, Mus musculus; identical to SEQ ID NO: 57439

SEQ ID NO: 63879 - DNA, 107 bp, Mus musculus
gagggttaggatcttgtgcctcttgctgtctgtgaactctacactgcctgtctctcactctctgatttcacatgacaatcaagaaaaaaaaatctccttaaaacccc

SEQ ID NO: 63880 - DNA, 85 bp, Mus musculus; identical to SEQ ID NO: 57439

SEQ ID NO: 63881 - DNA, 87 bp, Mus musculus
gtgcatgtttggatgcatgcatatgtgtgcatgtgcatatgcatgtgtgtgcatgtatgcatatgtatgtgcatgaatatgtatgca

SEQ ID NO: 63882 - DNA, 82 bp, Mus musculus
tgtacactttcatagttccattacaattgtgtttttgaacttctcaaaggccatgtatgtgatgatactaaggacacctgca

SEQ ID NO: 63883 - DNA, 66 bp, Mus musculus
agataaattttcttttattatagagtcctcaaatgagaattttatgatgggtgagaaaaggtattt

SEQ ID NO: 63884 - DNA, 122 bp, Mus musculus
gtgtatatgtataagtatgtgtgtgtatgtgtatacatgtagtacaatatataatatgtatgtatgtatgtatgtatgtatgtatgtatgtatgtatgcatgtatgtatttcctctctatac

SEQ ID NO: 63885 - DNA, 84 bp, Mus musculus
ttgtctccatgctccagggtctatacacactcagtctgtgttcatctaaacgcttaaatgtaggtatccctggtttcagagcaa

SEQ ID NO: 63886 - DNA, 129 bp, Mus musculus
atatggatatgaagatatatatgcatatatgtatatatacatatttctatctatatgtatcttcatatccatatccaatatatgtatatacatatatatatttcttagatacatagatacacagataga

SEQ ID NO: 63887 - DNA, 114 bp, Mus musculus
gaatgtagagactgaactgtgtgagttcattaaaaagagagagagagagagagagacagctccaaagtccttgatgattataataaattatgaacagagtttggttttcaattt

SEQ ID NO: 63888 - DNA, 85 bp, Mus musculus; identical to SEQ ID NO: 57470

SEQ ID NO: 63889 - DNA, 75 bp, Mus musculus
tgcagactggagatacagcttgagaaatgctgggtactagtggccggttactgtctgtctgtctgtctgtctgta

SEQ ID NO: 63890 - DNA, 81 bp, Mus musculus
ggctgtgaagatagttccctgggtcactgcacttgctgtcatcctgatgaactgaggtcagtccctgggacctacatagct

SEQ ID NO: 63891 - DNA, 103 bp, Mus musculus
gcttcagtaggagaacttgcagattttgagaggtgcagacaactgcagatccccctaaagttatcactgtgaatttcaaatggctttttttttattgcagagc

SEQ ID NO: 63892 - DNA, 93 bp, Mus musculus
gtgtagttgacgttcataatgatggcacagcttgtattgactgatcacttttgaaaaagttgtacaacatattatttaggactgtgactgcac

SEQ ID NO: 63893 - DNA, 78 bp, Mus musculus
tcctatgtggatcaacttggcatagaacccataaaggcctttctgcctgcctctgtctctgcctctgaagtattggga

SEQ ID NO: 63894 - DNA, 88 bp, Mus musculus
acatacacataggtaatatatgcatgtgtatataatatatgtgcatatgtatatatatatatacacacatatatgtgtgtgtgtatgt

SEQ ID NO: 63895 - DNA, 109 bp, Mus musculus
tcacaatgacattttcccccctccagttggtcagtctttctctgtctcaggcatatggggctagggatagtctattatgtgacaacagaaacagatattaataaaggag

SEQ ID NO: 63896 - DNA, 183 bp, Mus musculus
tacgttggaacatatatatatatatatatatatatatatatatatatatatatatatatatatatatatatatatatatatatatatatatatatatatatgcatgtatatatatatgtatgtatgtatgtatatatatatgctgtgtatatatgtgtgtgtgtgtgtgtgtgtgtgtgtgtg

SEQ ID NO: 63897 - DNA, 89 bp, Mus musculus
gatggcactgtggatttcttgaggatctgttgttatgtctcccatttcatttctgattttgttaattaggatgctgtccctgtgccctc

SEQ ID NO: 63898 - DNA, 91 bp, Mus musculus
ggatttgagccacttcatacattcatcactttctggatcaggccatggatgcagatgtgaagagtagtgtcattcttctgctacatggtcc

SEQ ID NO: 63899 - DNA, 116 bp, Mus musculus
ttgtacagtaaagacaaagttgatctatatcatggatgttatgtacctatttgtagattttttttaacaaatacagaacattagagaggttaagttaattgtcaaaactcgggcaa

SEQ ID NO: 63900 - DNA, 107 bp, Mus musculus
agttgatgggcagtgtttatggaagctctttttcctgtaccttgataaaactagaagttatccaggttaggaagtactaagcaacagaaacactatgtgcagaaggt

SEQ ID NO: 63901 - DNA, 85 bp, Mus musculus
ggccatggtggtctgataggatacatgggacaatttcaatatttttgtatctactgaggcctgttttgtgaccaattatatggtc

SEQ ID NO: 63902 - DNA, 71 bp, Mus musculus
gtgtggtactcgtatgtatacatgtttgtgtgtacatatatacatgtgtacaggtgaatgcatatgtgtac

SEQ ID NO: 63903 - DNA, 85 bp, Mus musculus; identical to SEQ ID NO: 57439

SEQ ID NO: 63904 - DNA, 73 bp, Mus musculus
tgagagagtgtggagcacagagtcagccccttgtacagagagtagcattttgtcactcactcacattctctca

SEQ ID NO: 63905 - DNA, 93 bp, Mus musculus
atgagtactggaatctgatgatgagactagagtgtgagtcaacagaccacattccaagttggcaataacagaacccaagcatccaaagctcat

SEQ ID NO: 63906 - DNA, 104 bp, Mus musculus
gctttaggcaaggcttgatctagaaactgagtagacactgaggacatgctctctgccactaattctcagtggtgtccagtttcattgttgcaccagccttaagc

SEQ ID NO: 63907 - DNA, 79 bp, Mus musculus
gacccttggcctttctgatccagtctctctctctcatcatgcaatgcaaagagaagaacctagattaggtatgtcagtc

SEQ ID NO: 63908 - DNA, 69 bp, Mus musculus
gcatagcagcttatataagtgacaagggagaaagataggatgtcgctctgtgtctgtatgtctgtgtgc

SEQ ID NO: 63909 - DNA, 117 bp, Mus musculus
agtgggatatttttatgtttggtaatgttgctgattgagagtcttttaatgtttccattgtaaagaattataatgttatctatcatagattctactctataacctttcataacccac

SEQ ID NO: 63910 - DNA, 79 bp, Mus musculus
tctgaaagctgtttatttaattataatggagcaggagactgttaaggacaatactattatcatgctgatagcatttagg

SEQ ID NO: 63911 - DNA, 113 bp, Mus musculus
gatcagccctaaacaagacatcttcatctaaactacctttttccgatgttcagagatcatcctgaaagaggacaagaaaggtagtaagattgagaaattttaaaaacatggtt

SEQ ID NO: 63912 - DNA, 77 bp, Mus musculus
ggagagaaaagccagtgtgtgaggctgagcccacagccactggggccagctttgacccacaggctctgtcactctcc

SEQ ID NO: 63913 - DNA, 85 bp, Mus musculus; identical to SEQ ID NO: 57439

SEQ ID NO: 63914 - DNA, 74 bp, Mus musculus
gccaggactagaactcaagcaggtcaggaagcaggatctaatgcagaggccatggaggggtgttagttactggc

SEQ ID NO: 63915 - DNA, 85 bp, Mus musculus; identical to SEQ ID NO: 57439

SEQ ID NO: 63916 - DNA, 85 bp, Mus musculus; identical to SEQ ID NO: 57439

SEQ ID NO: 63917 - DNA, 107 bp, Mus musculus
tgtgcatctatctatctatctatctatctatctatctatctatctatctatctatctataaatagatagatacatatggagagagataaagatatgacattttaaca

SEQ ID NO: 63918 - DNA, 85 bp, Mus musculus; identical to SEQ ID NO: 57470

SEQ ID NO: 63919 - DNA, 85 bp, Mus musculus; identical to SEQ ID NO: 57439

SEQ ID NO: 63920 - DNA, 85 bp, Mus musculus
gtccatgctgatctgataggatgcatgggacaatttcaatatttttgtatctgttgaggccttttatgtgaccaattatatggac

SEQ ID NO: 63921 - DNA, 69 bp, Mus musculus
gctttctgacaggtgcttgatatagctgtctcctgagaggctctctcagtgcctgtcaaatacagaagt

SEQ ID NO: 63922 - DNA, 85 bp, Mus musculus; identical to SEQ ID NO: 57439

SEQ ID NO: 63923 - DNA, 98 bp, Mus musculus
tgtgtgtgtgctgtgtgtatatatgtgtatgtgtgtgtaaatatgtgtgtatatagatatttacatatatatgtacaaatatataatagctatatata

SEQ ID NO: 63924 - DNA, 74 bp, Mus musculus
tatatatatatatatatatatatatatatatatatatatatgtatatatgtatgtatgtatgatatatatatat

SEQ ID NO: 63925 - DNA, 96 bp, Mus musculus
atataaaaattccatatgctttagatagtgtgcatgtgtatatatatatacatatgtgtgtgtgcatatattttaaagtgagaggataacatgtat

SEQ ID NO: 63926 - DNA, 97 bp, Mus musculus
aagaaatcattttataccatgattacatatttttattagaatatacatatattttgataaaaaacaaataccttcatggtagtgaagttcatctctt

SEQ ID NO: 63927 - DNA, 94 bp, Mus musculus
attaatgataaatagccattgaaaattctcactttgttgaattttagagtaatgattttgaaattgagatattttcagtgagtatatgattgat

SEQ ID NO: 63928 - DNA, 95 bp, Mus musculus
tagccagttgatcaatgtcagtgcctctttacacttggttctatatatccttattctgtggttgaaagtcagcattgaaaggtgattggaagcta

SEQ ID NO: 63929 - DNA, 127 bp, Mus musculus
tatatgaaatatatatgtgtgtgtgtatatatatataaatatatatatgtatgtgtatatatatatatgtatgtgcatatatatatatatatatatatatatatatatatatatgtatatacataca

SEQ ID NO: 63930 - DNA, 110 bp, Mus musculus
agtgctttcataagactccctgtgcttcatctaatgattgactctgtgtctctgcatctgttttcattggttggtgggtagcacacttaagagaacagatatgctagcct

SEQ ID NO: 63931 - DNA, 82 bp, Mus musculus
gcaatccaatatgatgtttctgtctgtgtcactgagaagttgtttcaggtcagacactattaagaggcaatatgttttctgc

SEQ ID NO: 63932 - DNA, 67 bp, Mus musculus
cagctatttgaaacattcagaagacagtctgtagaggcctggctgtggctgaatggagtgaatgctg

SEQ ID NO: 63933 - DNA, 74 bp, Mus musculus
ggctttttgcatctaggtatgtatgtatgcatgtatgtatttgctttatgtatatgtgtgggtcagcatgggct

SEQ ID NO: 63934 - DNA, 85 bp, Mus musculus; identical to SEQ ID NO: 57439

SEQ ID NO: 63935 - DNA, 109 bp, Mus musculus
ctaacaagaaccaatctaaaatttaaaaagtttccacacaagtaatgtagctttcaatgtatttaatttggggggaatatatgtgagtggcactttattgtcctgttag

SEQ ID NO: 63936 - DNA, 107 bp, Mus musculus
gggtgataaagtgatcaggccagtgtgatatttcatcagtgtgacagaactgaagtgtgtctttttctctgattgtcacactatgttctgagcatcctaggtcgcct

SEQ ID NO: 63937 - DNA, 116 bp, Mus musculus
cagtggtatccccgagttttcctctttgagcacagacttttgcccagtcctctatttttatatctaagtttgactggaattgtcaagatggttcattggggaaaggagtttgctgt

SEQ ID NO: 63938 - DNA, 85 bp, Mus musculus
ggccatgttggtctgataggacacatgggacaatttcaatatttttgtatctattgaggcctgttttttgaccaattatatggtc

SEQ ID NO: 63939 - DNA, 85 bp, Mus musculus; identical to SEQ ID NO: 57439

SEQ ID NO: 63940 - DNA, 90 bp, Mus musculus
cactatacttcatacactgaatatgtattcttattttctgtatatgaatatatgccttcaagtatacatgtacagtatgtgtgtatagtg

SEQ ID NO: 63941 - DNA, 125 bp, Mus musculus
tatgtatatatgcatatatgcatatatgcatatatgtatatatgtatatatgcatatatgtatatatgcatatatgcatatatgtatatatgcatatatgcatatatgtatatatgcatatatgt

SEQ ID NO: 63942 - DNA, 137 bp, Mus musculus
acacacatacacacatatatatgtatacatatacatacatatgtatatgtatatatgtatctatatgtatgtgtgtatatgtacatacatatgtatatgtatatatgtatctatatgtatgtgtgtatatgtacata

SEQ ID NO: 63943 - DNA, 73 bp, Mus musculus
gcatgatcatgaaaaatagacatgagacagtaccctgatatagctgtctcatatctgtttttcttgaacaagc

SEQ ID NO: 63944 - DNA, 85 bp, Mus musculus; identical to SEQ ID NO: 57439

SEQ ID NO: 63945 - DNA, 81 bp, Mus musculus
tggtgatctgatgggatgcatgagacaatttcaatatttttgtatctgttgaggcctgttttgtgtccaattatatggcca

SEQ ID NO: 63946 - DNA, 77 bp, Mus musculus
tctgtgtctctgtctgtctgtctgcctttgtgtaagagagggcatctatagaaaccaaaacagaaaaaggagtcaga

SEQ ID NO: 63947 - DNA, 110 bp, Mus musculus
cactgccttttatgtagctactcatttatttatttgaagattgtctgtttttatgtagatatctatttgtttatttgaatactgtgtgagtgaggatatgtatggctttg

SEQ ID NO: 63948 - DNA, 105 bp, Mus musculus
tagttttcctaccctgatttgggtatttgatatctatttatgtttgttatcattcataagcataactgtatgggaatgtaatgctatgtcttctagagaaaattg

SEQ ID NO: 63949 - DNA, 85 bp, Mus musculus; identical to SEQ ID NO: 57470

SEQ ID NO: 63950 - DNA, 102 bp, Mus musculus
ggcacagcagagaacatctcctggcctctgagccaattctggtcactccctctgactcatccaaatgtggtggaggcctgggtgtttctgctggattgtgct

SEQ ID NO: 63951 - DNA, 111 bp, Mus musculus
catcagcttttctatatgtatgtgtgtatgtatgtatgtatgtatgtatgtacacatatattcaggcatgtatgtatgtgtgcacatcatgacagatatgaagatcagatg

SEQ ID NO: 63952 - DNA, 116 bp, Mus musculus
ctctgattaataatagtatcctgaattttcaagaactccagggcattgttgacacatgaaagtgttcacttggctttgtgggttcagtgagggggaggcagttgtgtcacttaggg

SEQ ID NO: 63953 - DNA, 106 bp, Mus musculus
aagggaaaatacttgctggagaaatggctcagtggttaagagcactgaccagagtgctcttccagaggtcctgagttcaattcccagcaaccacgtggtggctctt

SEQ ID NO: 63954 - DNA, 95 bp, Mus musculus
gttgggccttttacataattctttaatgtctcagtttaatcagtaaaatatggttaataattgtatttgtttcatagattatgtaaaagctaaac

SEQ ID NO: 63955 - DNA, 97 bp, Mus musculus
ttggtctttggagccctgcacctgtagtaaggaatctagtgtggctggagaagccctgctaggagctaattataaacgctgctcttatagggaccag

SEQ ID NO: 63956 - DNA, 96 bp, Mus musculus
gatcagccttagtctgtggtgattagataggatgcatgggataatttcaatatttttgtatctctggaggcctgttttgtgaccaattatatggtc

SEQ ID NO: 63957 - DNA, 60 bp, Mus musculus
gccctcttcccagtggagaaatggtcaaatgactgtctgctgtcactgtctgggagaggc

SEQ ID NO: 63958 - DNA, 89 bp, Mus musculus
agtggaccagccttgtgagtgtgcatgcttgccctgctactgtctcactgtgtggctttggacagttctcacactcgctcgaggtcact

SEQ ID NO: 63959 - DNA, 92 bp, Mus musculus
gagagagaatagacagggatatataagtgtatatgaatgtatatgtatatatgtatgtgtacgcacacacatccctgactctataccatctt

SEQ ID NO: 63960 - DNA, 103 bp, Mus musculus
tgtcctcttctttctcacacagtgccctgtgtctctctgagtctgtcccttcccagggggagcatgttcttggacctctatgtgggtgtgtgacacttggaca

SEQ ID NO: 63961 - DNA, 79 bp, Mus musculus
acttctgttagtttcactgtgtctctgtttagtttctgtttccagaatctgtccattgatgaaagtggggttttgaagt

SEQ ID NO: 63962 - DNA, 105 bp, Mus musculus
ccctacagatgacataattttggtcatatatatgttgtatgtgtatatgtaaacttaattatgtatatatatcacatatccttgacccattcatctggtgacggg

SEQ ID NO: 63963 - DNA, 88 bp, Mus musculus
cttgctggctgattgctttccatctcatctgtcactcagggtctctcacctgaacccagtttacctgttggctagtctagctagcaag

SEQ ID NO: 63964 - DNA, 102 bp, Mus musculus
gtggtcatccctgaacaggtggcctgcactgtgtcactgtgaaagaggatattaggtatagtagtcattttgtaggtattctgtcatttcaggtatacacac

SEQ ID NO: 63965 - DNA, 104 bp, Mus musculus
ccgtcagagaccattaacaagtccttctgggttatggatctagaaactagtggtttcttagtttatatgtattaatggtgaggtttttttttggtttggtttgg

SEQ ID NO: 63966 - DNA, 74 bp, Mus musculus
tttgatttgtttcctgtttgtcttctggagtcttgaaaggatgagttagacagacagacagacagacagacaga

SEQ ID NO: 63967 - DNA, 111 bp, Mus musculus
aacgtgctctgagcttctcttatctgcaggtggcaggaaggtcgataccctgtggtctgaggaatgtagtcagcctttcccttgctgagaggagggatgcttggtgaagtt

SEQ ID NO: 63968 - DNA, 101 bp, Mus musculus
atgcatatatgtgtgcacttatgtacaagcatgtgtgtgtgcacgcgcgcacactcacacacacacacttgcttttacaatgcctatatttaactatgtat

SEQ ID NO: 63969 - DNA, 62 bp, Mus musculus
gtgtgtatgtgtgtgtgtctgtgtatgcgctcgcgtatatgcacacatgcatatgaacatgc

SEQ ID NO: 63970 - DNA, 98 bp, Mus musculus
acatctaagctggtttcagatctcagctattttgaacagttttaacacacggggacgtgtgtgcatctctgctgtagacctgaaagtcatttgggtgt

SEQ ID NO: 63971 - DNA, 59 bp, Mus musculus
gcatcctcactgtgacccggcagtagagcggttcactctgcctctgacacagtgtgtgc

SEQ ID NO: 63972 - DNA, 88 bp, Mus musculus
ggatgctggggcatgagcgatgagcaggcagcactgccctccatggtgactctctgtctgtctgcatcatactcagccctaaggggac

SEQ ID NO: 63973 - DNA, 86 bp, Mus musculus
tatgcatgtatatatacacatatatgtatgtatatatacacatatgtgtatgtatatacatatatatgtgtatatatgtgtgtgtg

SEQ ID NO: 63974 - DNA, 75 bp, Mus musculus
gtatgcggtgtatgtatgtatatatgttcatgtgtaggagtttgcatgtgttcaggtgtacctgcatgtgtgtgc

SEQ ID NO: 63975 - DNA, 101 bp, Mus musculus
ctgagggcatattttctagctttggggacatatgacaaagaagcttgttatcattcttgtctctgtcctgtctccttgctctttggagaattctcccatgg

SEQ ID NO: 63976 - DNA, 102 bp, Mus musculus
tagggctaggccaggacagggctgtggcaagtgaggtgcctatgacatagagtttaagtgtctttcacactcagggtcatacagatgtagggtcaatacctg

SEQ ID NO: 63977 - DNA, 106 bp, Mus musculus
gagctaaagcagaggccacagaggagcgctgctcactggctcgctctctgtagcttgttcagttctttcttatacaccccagaatcagcagcccgggagtagtagc

SEQ ID NO: 63978 - DNA, 87 bp, Mus musculus
gtctggtaatagatgcataatgtatgtatatggattttaaatccaatgtggtatttaaggtatatatgctttatctgtagttcagat

SEQ ID NO: 63979 - DNA, 113 bp, Mus musculus
ttttggtaaggctatagctgagatgtcttcatgttgagtctctcgtgattacagtcagatgttagctggagcttccttgaactgaagactcaactgtattggctatgccagaa

SEQ ID NO: 63980 - DNA, 75 bp, Mus musculus
gtggcatggggtggcagaaaggacgatattctagagatgctgtgtctctgaatctgactgtcacccgattgaaac

SEQ ID NO: 63981 - DNA, 102 bp, Mus musculus
agcttcccagaagatcccagcctgagagatgagtgagaagatacactgctggcaaggacatatccaagtagtgggcctctctgatctttgctcttccttgct

SEQ ID NO: 63982 - DNA, 122 bp, Mus musculus
gagcttggtgggcaggggtgtgatgacatcctgcctttggccgagtgttccaaggtctctcactctctgtgtaatgcctggctgtgggtctggctgtatttgctccctgtatttgttctcta

SEQ ID NO: 63983 - DNA, 83 bp, Mus musculus
tcagtgaaaccagggcaggaacaaaggtgtgacatctgtaaggcagttttagtctcactcactgtttctccaaggccatttga

SEQ ID NO: 63984 - DNA, 65 bp, Mus musculus
agtgactctcattctgtcagggttctgggacctgtctttcaggctctgggaggtgaaggtcagct

SEQ ID NO: 63985 - DNA, 103 bp, Mus musculus
acccccactgtcttagtagatgctcaatcttaccttccttctgtctcactctggatgtctgtaacacaggggggtaagaaaccctactccattagtgtgtggt

SEQ ID NO: 63986 - DNA, 136 bp, Mus musculus
tgcttagacttgtgtgtgcagtttcctgggtatagcaacttaggagtgcacaagcgcaaacaacagacagagcagagggtaggagtgcccaagaggccctggcacagttcctactgcgtttgctggatgcctggct

SEQ ID NO: 63987 - DNA, 89 bp, Mus musculus
ctcctcccccatctctctctctctctcttctctgggcaagcgagttctctctctctctctgggaaacatggcatgggatacaagaggag

SEQ ID NO: 63988 - DNA, 200 bp, Mus musculus
tatgtgtgtatgtatgagtgtgtgtatgtatgtgcatatgcatgtgtatatgtgtgtatgtatgtatgtatgtatgtgcaatgtatgtatgagtatgtgtgtgcatgtgtatgtatgtatgagtatgtgtgtatgtatgtaatgtatgtatgtatgtatgtatgtatctgtgtgtatctgtgtgttaagtatatgtgtgt

SEQ ID NO: 63989 - DNA, 113 bp, Mus musculus
tatatatatatatatacatatatatatatatatatacatatatgcatgtatgtgtatatatacatatatatgcatgtatgtgtatatatgcatatatattcatagacttatat

SEQ ID NO: 63990 - DNA, 90 bp, Mus musculus
gcaccactcctttgccatgtatgtatgtatgtatgtatgtatgtatgtatgtatgtatgtatgaatgtgtgcatgtgcatgtgcatgtgc

SEQ ID NO: 63991 - DNA, 82 bp, Mus musculus
tgctccttaaagttcagtcattgtagggtcttatccggagccttcccgatggcccagactcactccctgaccctgtggagta

SEQ ID NO: 63992 - DNA, 85 bp, Mus musculus; identical to SEQ ID NO: 57439

SEQ ID NO: 63993 - DNA, 117 bp, Mus musculus
cctgcccacatacccaagagttagggagaagaaaatggggagggagagagaaggtatatttgtctgtctgtctgtctgcctatgtgtctgtgtgtctttgacttaatatattgcagg

SEQ ID NO: 63994 - DNA, 73 bp, Mus musculus
ctggagtctgtgcctctgactgactgaatgtgtaagaagacaaattgtcaagaagctggcaagacaagtccag

SEQ ID NO: 63995 - DNA, 87 bp, Mus musculus
aactcaggatgtgagacttgccagcaagagctttcagtggtcgatgggccatttcaaaggtctctctctctctctcaaattattgtt

SEQ ID NO: 63996 - DNA, 99 bp, Mus musculus
ttgaatttcgtatccccttttccggaattaggcagacttgtataagattcgactgtatatttttctatgataatgttgggtaggggatgcccaggttaa

SEQ ID NO: 63997 - DNA, 98 bp, Mus musculus
gtgtgtgtgtgtgtgtgtatgtacatgtgtacatgtgtgtacatgtatgtgtgcatgtacatgtatgtgtgcctgtacatatgccacagtgaatatat

SEQ ID NO: 63998 - DNA, 104 bp, Mus musculus
taagaatatcaagtgctcctcattgctgggccatccctccaaaccctcttcatcactgaagaatctgagggctggagagatggctccgaggttaagatctctta

SEQ ID NO: 63999 - DNA, 115 bp, Mus musculus
tactggacgtgtttttgaaggtctttccagaagaggttagcatttgtgtcatcagactgagcacagatcactgtccctaacatgggtgccattatgtagctgagggggtccagta

SEQ ID NO: 64000 - DNA, 75 bp, Mus musculus
gtgtgtgtgtgtgtgtgtgtgtgtatacatatatatgtatatatgtgtatatatagtgtgcacacactcacacac

SEQ ID NO: 64001 - DNA, 85 bp, Mus musculus
ctatcattgaacaattaggttgattcccattctttgctatagtgctatagacagtagacatgggatgcaaacatctctatggtag

SEQ ID NO: 64002 - DNA, 67 bp, Mus musculus
agttcaaagctgtgttctcttagctcttagaacagctccaagaggtagtagaatctagagttgtact

SEQ ID NO: 64003 - DNA, 102 bp, Mus musculus
agtaggtcattgtaagtatgatgttgatggtccatcttgctccttcctgtctgtctgcttcttgatcatcatgatcaactatgctctgttatatcccctact

SEQ ID NO: 64004 - DNA, 114 bp, Mus musculus
gtgaaaaaatggaattgtatgggacaggtggggatccagggaatgtcagaggtgactgtggtcaaattccatgatgcatttgtataaaaatctcaagtgatatctattttttac

SEQ ID NO: 64005 - DNA, 85 bp, Mus musculus; identical to SEQ ID NO: 57470

SEQ ID NO: 64006 - DNA, 105 bp, Mus musculus
ccgttctccttgctacttgctttgctttgctctggctctgactctggctctggccttggggttttctttggcagttcatttcataagtaatggcaataactctgg

SEQ ID NO: 64007 - DNA, 94 bp, Mus musculus
tctgtctgtctgtctgtctgtctatctatctatctatctatctatctatctatctatccatagagagagagggagagagagggagagagacaga

SEQ ID NO: 64008 - DNA, 100 bp, Mus musculus
tcagatttgtgcttggcattgtcatccagattttatgcacatttatttgatttatatatgctggatggtttctaattgtaaggccattaagcacctctga

SEQ ID NO: 64009 - DNA, 70 bp, Mus musculus
gtcacactgggtcttctttatcttggtctgctctgacatctatccttaaagactggcctttggcggtgac

SEQ ID NO: 64010 - DNA, 131 bp, Mus musculus
gctgaagatgcacttcagaaacagggcttaaagacccttgagctagatctgacctgaatctgtctgcttctgtctgaggataagcttttatggtaccaacaggtgccatagaaagttccaaaggaaggaag

SEQ ID NO: 64011 - DNA, 73 bp, Mus musculus
tctatctatctatctatctttgtgtgcatgtatgtatgggtatccatgtgcatatgtgtagataatatgaagg

SEQ ID NO: 64012 - DNA, 106 bp, Mus musculus
tcttgatccaaaggctgccaggaggagagactatgtcacactcagtgtagcttgggcatatatgagttttcaaagcctgcctccatggtgacacattcctctaaga

SEQ ID NO: 64013 - DNA, 117 bp, Mus musculus
gcatcacatctgtgtttttcttgttgacaagatacttgttttgggcttcttttttgtatttttgtacaaatcttgcatggacacacatcttcaaatgaaaatcgcttggagaaatgc

SEQ ID NO: 64014 - DNA, 119 bp, Mus musculus
tatgtgttcatattcaaggaggttgagaggatgacattggaaaaataagtaggattgtttttttttaagatctatgtaatttttaactgtgtatgtctgtttgtatatgtgtacacgtg

SEQ ID NO: 64015 - DNA, 109 bp, Mus musculus
ttatgtttcactgtttaggttgttaaaatatatatgaaggtacatattcatgtaaatttatagtgatactgttcttctgtttgtagcgtaccaatcttacaaaacataa

SEQ ID NO: 64016 - DNA, 85 bp, Mus musculus; identical to SEQ ID NO: 57470

SEQ ID NO: 64017 - DNA, 110 bp, Mus musculus
gacttcccttaatgatggactatgcttgagatctataagccaaataaacttctgagggtctgtctctgtttctggcctcagagtattcaggcaccattagttgtgagctc

SEQ ID NO: 64018 - DNA, 79 bp, Mus musculus
tgggggctggagagatgactcaggagttaagagcactaactgctcttccagaggtcctgagttcaattcacagcaacca

SEQ ID NO: 64019 - DNA, 65 bp, Mus musculus
cctgcctgtctgtctgtctgtgtatgactggtccagttttgatcagctgtactgacagagctagg

SEQ ID NO: 64020 - DNA, 79 bp, Mus musculus
aggaggcatgtaggctggagagatggctcagcggttaagagcactgactgctcttccagaggtcctgagttcaattcct

SEQ ID NO: 64021 - DNA, 134 bp, Mus musculus
gcatatatattcatctatatgtatatatgcatatatgtgtgtgtacatatgtgtgtgtgtgtttgtgtgtgtgtgtgtgtttgtgtgtgtgtgtatatatatgtgtgtgtatatgtgtatatatatatatatac

SEQ ID NO: 64022 - DNA, 90 bp, Mus musculus
gaggcagacagatctctgtgagctcaaggccagcctggtctacaaggtgagttccaggacagccagggctacacagagaaaccctgtctc

SEQ ID NO: 64023 - DNA, 84 bp, Mus musculus
cagagtcttctgttacttcaccatcatcttcgtcctgctcaaactctggcaaaggagtgaaggtcctgtctgagtagatctctg

SEQ ID NO: 64024 - DNA, 96 bp, Mus musculus
tgttgcaagaaactgttaaatttgcttcctggttctctgaacacagtgaggtgtaacctaacttgtgagaacagagtacaacacattcctgtgata

SEQ ID NO: 64025 - DNA, 59 bp, Mus musculus
aggtagaactggaggacagaggaggaaaatatgttgtctgtctgtctatctgtctgcct

SEQ ID NO: 64026 - DNA, 108 bp, Mus musculus
gtcagaaaaccgtatggggctggagagatgatggctcaatggttaagagcactgactgctctttcagaggtcctgagttcaattcccagcaaccacatggtggctcac

SEQ ID NO: 64027 - DNA, 99 bp, Mus musculus
agggaaattatgaatacattgtattgatgggagaaggagccagcactgtgtgtctctgtgtgtgtccccgctagcgtgcatgtgtaaagtagggtgtct

SEQ ID NO: 64028 - DNA, 75 bp, Mus musculus
gttctttaatccatatgtatgtctgcttgtgcatgtttgctcatgtacggggtgcacatgtgtgtgttggggtac

SEQ ID NO: 64029 - DNA, 100 bp, Mus musculus
cctgggattctagtgtagattgaagactggcagctctctaggacttgggattagagattgggactgctgattacatactaaacaactacaggatccttgg

SEQ ID NO: 64030 - DNA, 98 bp, Mus musculus
gtgacagaggtcagagggagagagcgagccatggcccaccaggtaggacaactcagggagtggctggctggctgtttacctcccacctctcgatttac

SEQ ID NO: 64031 - DNA, 114 bp, Mus musculus
tagttgatgccaggaaggtgggtgaagggctaagagaatgaattggttgagggcaatgaacactgcccactgagttctctgggtgtgctgggcatggtctctttcctgcagctg

SEQ ID NO: 64032 - DNA, 68 bp, Mus musculus
ctatatctatatctctatatctatatctatatctagatatagatatagatatagagatatagatatag

SEQ ID NO: 64033 - DNA, 96 bp, Mus musculus
gtataaaaagtttgatgctggatttgacaaattacattcagatccagcacactctctcgttctgtgtctgtctgtcaattcccgccgactctatgc

SEQ ID NO: 64034 - DNA, 114 bp, Mus musculus
agctcatggttagatttgtgcttgtatttggagcgacatgtgtagtgaagggactcttgatctgactcactgtgtcatacatgtgaaccctccgcttgcagatctccatgttct

SEQ ID NO: 64035 - DNA, 106 bp, Mus musculus
tgaggtaagacagactttaatttttattaattactgtgtgtgcaagtgcatatgcatatttgtgcataatgtgtaggtcagtagtcaatattagatgtctacctca

SEQ ID NO: 64036 - DNA, 72 bp, Mus musculus
ttgaagataggactggagagatggctcagcggttaagagcactgactgctcttctgaaggtcctgagttcaa

SEQ ID NO: 64037 - DNA, 122 bp, Mus musculus
ccagttgtttcaggtcattgtcccgtttgggggtatggcttaaaatctgcttctctcagtctctccattagctagctgctcttactcagggtgttcgccagaaagaggtggggggaggggga

SEQ ID NO: 64038 - DNA, 100 bp, Mus musculus
tcttcttttcagatttatttatgtgtatgggtattttgcctacatgtatgtatgtatgtatgtatgtataccatgcatatgtttagagttcagaagaggg

SEQ ID NO: 64039 - DNA, 77 bp, Mus musculus
ccatttgcctgcctgcatgtatgtatgtatgtatgcatgcataccttgttcatgccttgtagacattttatgaatgg

SEQ ID NO: 64040 - DNA, 115 bp, Mus musculus
tctacttgagattttgttctacttaaaaattgatatcaaggagggacttttggtttttgtttgttttgtttgtttgtttgtttttaggtgtatgtggacactattgccatatagg

SEQ ID NO: 64041 - DNA, 85 bp, Mus musculus; identical to SEQ ID NO: 57439

SEQ ID NO: 64042 - DNA, 68 bp, Mus musculus
ctgagtgtctctctctctcctagatttccttataacttgaggattggtgggcaagtctaagacctcgg

SEQ ID NO: 64043 - DNA, 81 bp, Mus musculus
cacgtggggtagttcagtcttggggattgaactcaggtacctgggtaagcgcctttctagttgagcccttctcatttagtg

SEQ ID NO: 64044 - DNA, 71 bp, Mus musculus
ctgtcccttgctgcctgtggtttatttgaggtcaaggctgggcttgactcacacactggcacagtagtcgg

SEQ ID NO: 64045 - DNA, 93 bp, Mus musculus
atgggtcagtcaatataggcccagtcacatggtcccagagatgacagtctgagtcagtgtgatgggtactcttggttgtcaacttgaccacat

SEQ ID NO: 64046 - DNA, 104 bp, Mus musculus
tctatctatccgtctgtctatctatccatctatccatccatccatctatctatccatctatctacctgacatagtcataagcatagacagagggataatatggg

SEQ ID NO: 64047 - DNA, 112 bp, Mus musculus
tcatccagcacccttctgcttgaggtattgtaatgagtgagacaactggtcctgttgggaccctcactgtgtcacacacatgccctcaccacaccaagctgagctgtcgtga

SEQ ID NO: 64048 - DNA, 118 bp, Mus musculus
atccatccaaatgtatgtatctatgtataatgcctgtctgtttatatatatatatatatatatatatatatatatatatatatgtatgcaagcatgcatgaatacttgtggagttgat

SEQ ID NO: 64049 - DNA, 62 bp, Mus musculus
gtctgtctgcctgcctgcctgcctatgtacatacaagtgcctggaggtcagaggcattagat

SEQ ID NO: 64050 - DNA, 85 bp, Mus musculus
ggtctgggggttggagagatgatggctcagcagttaagagcactgactgctcttccagatgtcatgagttcaattcccagcaacc

SEQ ID NO: 64051 - DNA, 74 bp, Mus musculus
acacacacatatatatgtatatatatgagtatatatgtccatgtgtctatagatatgtgtgtgtatgtgtgtgt

SEQ ID NO: 64052 - DNA, 110 bp, Mus musculus
ggatggaaactggtgcagggaggtgataaaaggttcaaaataacaagagccgaggagacagagttcagagaggaccttgagctcaccttactgttactgagttactcttc

SEQ ID NO: 64053 - DNA, 77 bp, Mus musculus
tgcacccgccaccattcagcagtccacatcctacgggacacgctttctcctgtcactgactgtagtgtgtggggaca

SEQ ID NO: 64054 - DNA, 133 bp, Mus musculus
ctcaatgtgcaagtcaatgttgtggagctgtctgggatcattaatcaggatgtcactcacagactcagtacaactgccaggaggttagcagaaatcagtcacatgatttagtagttgctggctttcctagagc

SEQ ID NO: 64055 - DNA, 112 bp, Mus musculus
ctcctgcatggaattctccactcagaccgagaaagccaggtccagactctttctgtctctgggcagggccatcattgtccgaaatggggagatcattccgatgtcccgggag

SEQ ID NO: 64056 - DNA, 92 bp, Mus musculus
ttggtgacagataggagggagaacagagagtggaaagagggaggcatttagaatacccaaatcaaggactttgcttttgtaactgttgctga

SEQ ID NO: 64057 - DNA, 85 bp, Mus musculus; identical to SEQ ID NO: 57470

SEQ ID NO: 64058 - DNA, 67 bp, Mus musculus
tgtcgactgactcagtgtgtctgtgttctactctggagcagaaggctatccctatgagcagtcaaca

SEQ ID NO: 64059 - DNA, 80 bp, Mus musculus
ccctgtgtgcattcgaggaggccagagagggccctgggggtctccctctgtcactctttgcctattcctttgagacaggg

SEQ ID NO: 64060 - DNA, 79 bp, Mus musculus
acatgtatgtacatgcatatatttaggttttgtgtgaacatgtgtttttttatgtttatgtgtgcatgtttatgtgtgt

SEQ ID NO: 64061 - DNA, 90 bp, Mus musculus
tatatacacatatatatacatatatatttctgcgtgtacatgactatgattattttcatgtatttacatatgtatatttatgtgtgtgta

SEQ ID NO: 64062 - DNA, 77 bp, Mus musculus
tctgagctagacaaaggctctcttgctcatataaagaaactttgtctgtctgtcggtcagtctgtctagaatccaga

SEQ ID NO: 64063 - DNA, 80 bp, Mus musculus
ccttccactgaagcggaatttcctaggcctggaaagactagggaaacctcagacagttgacaggcaggagtgtgggatgg

SEQ ID NO: 64064 - DNA, 85 bp, Mus musculus
atgtatgtatgtatgcatgtatgtgtatgtgtgtgtgtgtatacacacatatatacacacatatgtacatatatgtatacataca

SEQ ID NO: 64065 - DNA, 60 bp, Mus musculus
cagaggccagacagaggagcaatggggcctgggtctgtctgtctgtctgtctgtctgtct

SEQ ID NO: 64066 - DNA, 93 bp, Mus musculus
agtaagaaaacttcttagtgaacaaagagagcagtgtagaatctaagattatcactctctactggtcttagcactatggaagttatgtaggct

SEQ ID NO: 64067 - DNA, 85 bp, Mus musculus
ctaggccctgtctgcctttctcataggtctttctgaagagttgctgaagcagggcacatgctgaggtgtcagggcagtttcctag

SEQ ID NO: 64068 - DNA, 89 bp, Mus musculus
gatggagaaaaacagttaacatagccccggaggatgacaaggagtgctcactgctgtctctgtctctgctgtgttcaggtaactacatt

SEQ ID NO: 64069 - DNA, 94 bp, Mus musculus
ataggagcgttgccgtgaacagaaaactgagagtgcagagaaaaggtcagcgctgtgtggtccatgttgaacggcaacaagagtacgttgttgt

SEQ ID NO: 64070 - DNA, 77 bp, Mus musculus
cactaagcctccactgttctggatttgttgatctcatataaggtttacttcaaatccagcagccttcagtcttggtg

SEQ ID NO: 64071 - DNA, 57 bp, Mus musculus
aggaactcagctaggctaaagagacatcaggactattctctgtctctctgagtttct

SEQ ID NO: 64072 - DNA, 100 bp, Mus musculus
tcttgctcccagctaatggtggtggccaggagctcttgacttgggggtgcatcactcctatctgtgcctctgtctctgcatcaccatcctgaggagatga

SEQ ID NO: 64073 - DNA, 85 bp, Mus musculus
caatctagcagaagcatgggtggcaggagaatgggagagaaggggactgtatttgtgcatctgactgtgtatctgtctgtatttg

SEQ ID NO: 64074 - DNA, 81 bp, Mus musculus
cagcaggattacaacagttcagttgttaacctttaccctagtgactaggtcggttggtctgtctgtctgtctgcctgcctg

SEQ ID NO: 64075 - DNA, 124 bp, Mus musculus
ggtgtctgtatataggatggatccccaggtggtctctggttgatctttccaataccacactctgtctctgtattttctttagacagaagcccttctgggttagcaatttggagatgactgggtg

SEQ ID NO: 64076 - DNA, 112 bp, Mus musculus
aggagagctgtctttatctaactgggtggcttttagagaatttgttaatctgagtttccaattatttaactttaaaatgtacaaagttggttggttatggtatagcattcct

SEQ ID NO: 64077 - DNA, 85 bp, Mus musculus; identical to SEQ ID NO: 58391

SEQ ID NO: 64078 - DNA, 79 bp, Mus musculus
acttctgttagtttcactgtgtctctgtttagtttctgtttccaggatctgtccactgatgagagtggggtgttgaagt

SEQ ID NO: 64079 - DNA, 111 bp, Mus musculus
atggttttagctcccttgtcaaagatcaagtgaccataggtgtgtggattcatctctggatcttcaattctgttccattggtctacttgtctgtcactataccagtaccat

SEQ ID NO: 64080 - DNA, 111 bp, Mus musculus; identical to SEQ ID NO: 64079

SEQ ID NO: 64081 - DNA, 102 bp, Mus musculus
gtgtgtgtgtgtgtgttttgtgatgtatgtatgcatttatgtatgtatacatatatgtatgcatgtatgtatgtcatacctatgaaacactatatgacactc

SEQ ID NO: 64082 - DNA, 85 bp, Mus musculus; identical to SEQ ID NO: 57439

SEQ ID NO: 64083 - DNA, 119 bp, Mus musculus
aatagaaaagacatcagaacttaagggaatgcttaagtttcccaagtttggaagactactgagattgtaggcaggcttgaggaaagggagttttcagatagttccttggctatttctat

SEQ ID NO: 64084 - DNA, 76 bp, Mus musculus
tttacatgtgtatatatatgtgtgtatatatatatttatatatgtgtatatatatacatatatatatagagagaga

SEQ ID NO: 64085 - DNA, 98 bp, Mus musculus
tctggggactgtcaggtaagaatcagttagttaataggttctaaacttttagtgtcttatcttctaaataagtgcttgagcttgcctcagaacctgga

SEQ ID NO: 64086 - DNA, 85 bp, Mus musculus
ggccatggtggtctgataggagacatgggacaatttcaatatttttgtatctgttgaggcctgttttgtgaccaattatatggtc

SEQ ID NO: 64087 - DNA, 115 bp, Mus musculus
tccttgaccaaggtatcattgagaagagtgttgttcagtttccacatgaatgttggctttctattatttattttgttattgaagatcaggcttagtccatggtgatctgattgga

SEQ ID NO: 64088 - DNA, 76 bp, Mus musculus
ttgttacaggaattgtgtatgtatgtatgtatgtatgtatgtatgtatgtatgcacatatatcaagtcaagcagca

SEQ ID NO: 64089 - DNA, 102 bp, Mus musculus
tggacacctgtcctctggtccggacagtggccggctgtttgaggctcgcaaagggtgctgcctcagtggctctgtgcctctgcctgtcccagaagctgtccg

SEQ ID NO: 64090 - DNA, 85 bp, Mus musculus; identical to SEQ ID NO: 63165

SEQ ID NO: 64091 - DNA, 119 bp, Mus musculus
agtgtgtgcccagtcaggttctctaatctggcctagatgtatatatgtatgtaactaactaactcatacagtgtgtttctgggggattgataggttctttcgtggctataacacatgct

SEQ ID NO: 64092 - DNA, 65 bp, Mus musculus
cagttctgtcaggctgagtctaagccacttgacacgtggggctcagcatttcctctgcagctctg

SEQ ID NO: 64093 - DNA, 115 bp, Mus musculus
agaatgaatatatatatatgtgtatgtataatgtatatacacacacttgtgtatgtatatatatatatatatatatatatatatatatatatatatatattctagtgcacatagt

SEQ ID NO: 64094 - DNA, 85 bp, Mus musculus
ttaaaatatatatatacatgtgtgtgaatatgcacacttaaattttaactgagttatatatatatatgtatgtgtgtgtatttga

SEQ ID NO: 64095 - DNA, 60 bp, Mus musculus
catgttaaccttgaagcagaggctcaggccaggggcactgagtctgtcactcagggcatg

SEQ ID NO: 64096 - DNA, 81 bp, Mus musculus
gtctgtccttctgtctgtctgcctgtctgcatgtatttctgtgtaccacactgtgcctagtgcctaagtcagaagagaggc

SEQ ID NO: 64097 - DNA, 113 bp, Mus musculus
ccctggcatgaggctaagagggaaatggtaaagcctccctctggtccatgtgtgggtgttgacagtgtacacagaaaatgtctaccattgctttctgcatgctgcacgcaccc

SEQ ID NO: 64098 - DNA, 118 bp, Mus musculus
ggggctttaatgacacattctctgtctttgtcttcaaagatgggaccgttgttgttgttgttgttgttgtttcaggaaggtctgagcctttgaggtgtggctgatgtgctaatgttcc

SEQ ID NO: 64099 - DNA, 101 bp, Mus musculus
gtggttggtttgctctgaccatctcatcactgactgataaggactctgaaagtcactgagtcagagagccagatacaaaggacagaaagaagaaatgcaaa

SEQ ID NO: 64100 - DNA, 110 bp, Mus musculus
gctgtgggatttgcatgcaaagtgttcattctgtgtctctctgtgtcactccagaatgaagcacaggtgggtatagaccagaagagcccattggatgtcaggtctgaggc

SEQ ID NO: 64101 - DNA, 78 bp, Mus musculus
ggagtcagctgggaaggggtatgaaacacaaacggaccaaccctgtgtcagtccttgcctctcccagtctctctctcc

SEQ ID NO: 64102 - DNA, 71 bp, Mus musculus
gcttaggaagaagggccagagaattactaaaggaggtctgtctgtgtggctctgagtctgcctcccagagc

SEQ ID NO: 64103 - DNA, 83 bp, Mus musculus
ctggagctgcttccacactcgctgtctcacccacttgagcaccttgagcctagagaacaaaggctgagaaagcagcatgtcag

SEQ ID NO: 64104 - DNA, 88 bp, Mus musculus
gaaaagaaaaagaaccagggctggagagatagttcagtggttaagagcactgactgctcttccagaagtcctgagttcaattctctgc

SEQ ID NO: 64105 - DNA, 115 bp, Mus musculus
catacgctgctgcatgtgcaaggaagtcagaagacaacaccaggtgtcagtctcactctcaaacctctctgacccaggtctctaactgcttaccactgcatgcacagactggatg

SEQ ID NO: 64106 - DNA, 68 bp, Mus musculus
gtcttgtttcttgtaacgagtcaggaaaatactaaaccatatttctgtggctccagctgaaacatgac

SEQ ID NO: 64107 - DNA, 85 bp, Mus musculus
gctgcattagaaagccccactgtgcctctctcagagctctgaagtcttcactgccaggaaggccaccgggctgttcaaggaaagc

SEQ ID NO: 64108 - DNA, 92 bp, Mus musculus
tctaagtgtagtgtgtctccagatcagcaatgggtcaacacctcagaagcgtgtgtgtagagtctccgttgtattccaagccctgcgccgga

SEQ ID NO: 64109 - DNA, 74 bp, Mus musculus
gaacttctgctgtagggaccagagagaataacacagggtgtcccccgatttctctctgtctctgggagagtttc

SEQ ID NO: 64110 - DNA, 189 bp, Mus musculus
gtgtatatgtgtacgtgtgtgtgtgtgtgtatacacatatacatatgtatatgtatatatatatgcatgtttacaagtatgtggcgtgtgtgtatatatatgtatgtgtatatatatatgtgtgtgtatatatgtatatatatgcatgcttacaagtatgtggttgtgtgtgtgtgtgtgtatgtgtgt

SEQ ID NO: 64111 - DNA, 78 bp, Mus musculus
cgactcctgggcactctttctgtctggctgtgattccaagaagagacccatttggagagaccaaagtgtccagtttcg

SEQ ID NO: 64112 - DNA, 125 bp, Mus musculus
gtactggtttctaagggctggaactcagctggatagagttcaagtctagaattcagaccactgtctgtctgtctgtctgcctgtctgtgcttcattcacgacggactctgcaggggctgtcctag

SEQ ID NO: 64113 - DNA, 88 bp, Mus musculus
gataatgcttccaagtcggggtgcagaaacatttagtcacatccgtttatagggttctttcagttctctgcagtttacttacattatc

SEQ ID NO: 64114 - DNA, 100 bp, Mus musculus
gagtgactatggttttggacttggtaaaggcagagatgggtagagggaagaatctttctgcctgcctgcctgcctgcctgcctttgagacaaggtttttc

SEQ ID NO: 64115 - DNA, 162 bp, Mus musculus
gaatgtgtgttgtatgaatatgtatgtgcattatatgagtatatatgcatgttatgtgaatatgtatatctgtatgttatatgaatgtgtattatatgaatatgtatgtatgtttgtataccttcatgcatatgcatgtacagagtccagagaggttgacat

SEQ ID NO: 64116 - DNA, 95 bp, Mus musculus
ttgctgtaaagttttggaaggtggggtggagagatggctcagcggttgagaacactgactgctcttccagaggtcctgagttcaattcccagcaa

SEQ ID NO: 64117 - DNA, 99 bp, Mus musculus
tgtccaggtatggcttttaaaggggatcctgtctcagtttgtctctgcttcaaggtctccatgagctgtacactcccattttaacactgtacctcaaca

SEQ ID NO: 64118 - DNA, 128 bp, Mus musculus
gacccgggacctgtaggatggggcagcaatgagggctttcagggatggtaagactggaaagttgtctgtctgtctgtctgtctgtctgtctatatccacccacctcccaccccctggtcacctcctgc

SEQ ID NO: 64119 - DNA, 76 bp, Mus musculus
ttggccagatgtggtagtgcatgtccatgtgcatcccttgtgagtgggagcagcgggtgcatgagttcagggccag

SEQ ID NO: 64120 - DNA, 74 bp, Mus musculus
atgcacgcacacacacacacacctgcactgggctgaggaaatagctcagtagtgagagtgttcactcagtgcat

SEQ ID NO: 64121 - DNA, 93 bp, Mus musculus
catgatggggtatgatggatgtgtcagtaatggattagaaaagagtaattacatcttccaaatatgtatatatctatatatgcatatatcttg

SEQ ID NO: 64122 - DNA, 134 bp, Mus musculus
caccaccactgcccagcaagggatagtttatctctaatgttcattgctgggttctcatttggatgatttgtttagaaatgagtagggtactgaaatcacccactattattctatcaagacttgatccaaaccta

SEQ ID NO: 64123 - DNA, 85 bp, Mus musculus; identical to SEQ ID NO: 57439

SEQ ID NO: 64124 - DNA, 62 bp, Mus musculus
cttgtgagcctgcctggctccctggaagagaatggtttgatggagaggcggcagcttgcagg

SEQ ID NO: 64125 - DNA, 112 bp, Mus musculus
ttgcctggtggagtgctacttacttcagggagttctctgggagtgtggtttgctggacgctgtacacctgccttagagggaacgaggcttgggtctggcctccacctcacag

SEQ ID NO: 64126 - DNA, 72 bp, Mus musculus
ttgagacagtctgtcactggctcggaacatatcaccaccactgggatcagagctgtgggatactgtacttgg

SEQ ID NO: 64127 - DNA, 71 bp, Mus musculus
gcctcctgtagaattgctcttggctcttctgtttggccagatctgagtgaggagagaagtctaagagtggc

SEQ ID NO: 64128 - DNA, 70 bp, Mus musculus
ggagtcaagccatctcaccttttggtgggtcttcctcacagactctctgggagttctgagtcttgcttcc

SEQ ID NO: 64129 - DNA, 96 bp, Mus musculus
ttctttatgcagggcatggcaactacacaaggaaaatctatgttgcaaaggaaaaagcagagtctcagtgtgtgtgtcggcctcggcatgagtgaa

SEQ ID NO: 64130 - DNA, 92 bp, Mus musculus
cgtttctcccttccctggttctgtctttttcatcacagtatgcgtatttccttttgtgcctcagagaagccagtgagaacaggtgggtagcg

SEQ ID NO: 64131 - DNA, 122 bp, Mus musculus
aggggagaatgagaaacctgcctgactccatttttaaggtaggagacattttgttgtattgttaaacacaaagtttcgtttattgtaagagttgagtttctgtttttaagtttctgtttctt

SEQ ID NO: 64132 - DNA, 78 bp, Mus musculus
ttacatagtaaagtgaattcaaagtggagatctggaaacagattttttttttttctgagacaatttttctctatgtag

SEQ ID NO: 64133 - DNA, 93 bp, Mus musculus
ccagcaacatgactcctctggcacggtatcttgtctttggatatgatccaactaaagtgcagacatgccctagattacagtatgacctggctg

SEQ ID NO: 64134 - DNA, 108 bp, Mus musculus
tgagatcagcgtctggtgactcctggaccctaacaaaaatggcagtactcaagacaagcttgtttttttttttaaatcttcagtgggatatcatcattcattgtctca

SEQ ID NO: 64135 - DNA, 95 bp, Mus musculus
gccaggtgtgccaggtatgggcagagtataaaaggactgccggccaccacagttctgtttctctgttccagtgccccaccccataccctcatggt

SEQ ID NO: 64136 - DNA, 87 bp, Mus musculus
ggcaaactgtgtcattgaaaccactgtgccttgtaaatttgttattcagtaaatttgatatagtgggaagtcacaaacatgtttgtc

SEQ ID NO: 64137 - DNA, 68 bp, Mus musculus
ctcgaaggagctgtgtcaccagggaactgagaggctcctcacagaactgagtgacttggggtatcgag

SEQ ID NO: 64138 - DNA, 118 bp, Mus musculus
atgagtggatagagctactgctactgatttatgtctcccttttcatttctgattttgttaatttggatactatctctgggccttttagttagtttggctaggggtttatctatcttgt

SEQ ID NO: 64139 - DNA, 119 bp, Mus musculus
acatcagccatcaaggaatgggccagtctacagctttccaagtcacccctctgttttgcagagagtctctctgtgtgcctgctgtgtgtctgcttcctcaccctaaaaagggcacttgt

SEQ ID NO: 64140 - DNA, 65 bp, Mus musculus
ctcttatctctgggcagtgtgactcactggctgtcattgacagctggagcatttgtgggtgggag

SEQ ID NO: 64141 - DNA, 73 bp, Mus musculus
tcacttgtcttcctcagtggctcgtggcaatcggtcccaagagacagtgaggagagactgagggtagaggtgg

SEQ ID NO: 64142 - DNA, 84 bp, Mus musculus
ttggccacacccattctttacattctagagtctaatgttctgaaaactgttctggaaggactcatgtgaaaagtggagttccaa

SEQ ID NO: 64143 - DNA, 112 bp, Mus musculus
caggaaaacgactgggaatgtttgttcacttaaagctaatcagagaatccatgagaacacagtgagcacaaggggtctgagaagagagtgatggcttcctaacaaaaggctg

SEQ ID NO: 64144 - DNA, 117 bp, Mus musculus
gaactagtatagtaggtggattttcctctcatgttcccactgtattactgtcagttaatgagctgttggattaatatgtatgggaattaagattatgtctatgtctataaaggagtc

SEQ ID NO: 64145 - DNA, 85 bp, Mus musculus; identical to SEQ ID NO: 57439

SEQ ID NO: 64146 - DNA, 65 bp, Mus musculus
tacagagaaaagagtgacgtcagtgtagccagtgggctgcagactgaagactctgcgtctccgtg

SEQ ID NO: 64147 - DNA, 98 bp, Mus musculus
tgtgtaccctgtttggctacatactctcactcttcctgtctcagtgctgaatgctaggatgtcaggcaagtgtcaccaaacatggcttttattataca

SEQ ID NO: 64148 - DNA, 85 bp, Mus musculus
ggaatgcttggagcatctgtcagtctgtctcagccccatgggggataaccaaaggcttagctttggtaggtagcaccagctctcc

SEQ ID NO: 64149 - DNA, 85 bp, Mus musculus
gaggagtagtgagtgagctagtagtttccagggtgtactctctcctgagccagctttgatgaccactaaatctctcctgtttctc

SEQ ID NO: 64150 - DNA, 75 bp, Mus musculus
atgcatgtctttgtgtgcatatgtatgtacgtgtgtataaatatatgtatatgcatgtgatgggtgtctatgcat

SEQ ID NO: 64151 - DNA, 85 bp, Mus musculus; identical to SEQ ID NO: 57439

SEQ ID NO: 64152 - DNA, 84 bp, Mus musculus
tccttcctgtaattattctgataccaagtaggaagcaacctggaaatgtctacaggtattcaatctactgtgtatcgaagagga

SEQ ID NO: 64153 - DNA, 75 bp, Mus musculus
cagctcagtgtgtgggtcggtgtggtcatcactgatgagtgtcaggaccctgccgggaagcagacagactggctg

SEQ ID NO: 64154 - DNA, 71 bp, Mus musculus
ggtctctgcctggtttaggccccctgtttttcactctatcagagtcacaggcagtgtgctaggcttggatc

SEQ ID NO: 64155 - DNA, 87 bp, Mus musculus
ctccattgaggttctgtgattagctcaatggttggctacaagcatctgcctctgtatgtgtcaggctctgacagagcctctcaggag

SEQ ID NO: 64156 - DNA, 98 bp, Mus musculus
gaagtgggaaggaaaaataagatattactgagatctgctggctaagtccccataggacagcctgacagaacagtgtctctacctctaagtcttttttc

SEQ ID NO: 64157 - DNA, 83 bp, Mus musculus
atacatataaacatatatagacatatagagataatatgtagacaatatatatacacaatatatgtgtatatgaatatatgtat

SEQ ID NO: 64158 - DNA, 85 bp, Mus musculus; identical to SEQ ID NO: 57439

SEQ ID NO: 64159 - DNA, 101 bp, Mus musculus
cctgcatgatgaacatttttaattacttgtgtatgtgtgcaagtgcatgtgtgaagtgcatatgtaccatggcacacatatgtatatgtggaagtctgagg

SEQ ID NO: 64160 - DNA, 85 bp, Mus musculus; identical to SEQ ID NO: 57470

SEQ ID NO: 64161 - DNA, 115 bp, Mus musculus
actggttggatgtgagcaaaaataactgattttcatgtattcttaaatcatttttattagaattatttaattttgtgaaaccagtctaaaggttagttgaaatatatctctcagt

SEQ ID NO: 64162 - DNA, 118 bp, Mus musculus
tgtgttttaggtatcagagtaattgtggcttcatagaatgagttgggtagagtacagtgtgtgcagaactggaattagatattctttgaagttctgatagaactctgcagtaaaccca

SEQ ID NO: 64163 - DNA, 70 bp, Mus musculus
agatcaagtgaccataggtgtgtggattcatctctgggtcttcacttctgttccattggtctacttgtct

SEQ ID NO: 64164 - DNA, 115 bp, Mus musculus
atagatagatagacataaagaaatagatgatagctggatagattttatatatacacactatctatctatctatctatctatctatctatctatctatctatctatcatctgtcta

SEQ ID NO: 64165 - DNA, 74 bp, Mus musculus
tgtgtgtgtgtgtgtaaaacatcaatgaatatatagtcattatatttgtatatgtttgcatatattaacatata

SEQ ID NO: 64166 - DNA, 91 bp, Mus musculus
aaatcattctataactatatgtatatattcatatggattatatatgtatgtatgtatgtatgtatgtatgcatgtgtcttagtcagggttt

SEQ ID NO: 64167 - DNA, 87 bp, Mus musculus
cctctctctctctgtacatacatatgtatatatatgtatacatatgtatatatgtgtgtatgtatgtatgtatgtaaaaagttttgg

SEQ ID NO: 64168 - DNA, 68 bp, Mus musculus
tgtatcatatatatgtgtatatatataaacatatatgtctctgtgtgtgcatctgtatgtgtagtgca

SEQ ID NO: 64169 - DNA, 116 bp, Mus musculus
tataattatatatatatatatgtatatgtatatttgtgtgtgtaatattgcatatatatttatatttatatttacacacatacatatatatgtgtgtgtctgtgtgtctgcatatg

SEQ ID NO: 64170 - DNA, 85 bp, Mus musculus; identical to SEQ ID NO: 58710

SEQ ID NO: 64171 - DNA, 111 bp, Mus musculus
gcatcacagttgtagttatgatgatcacaaaggttttatatatatatagatacatacatacatatatggcatgatgggaatcattatgattattttcaagaaactatatgc

SEQ ID NO: 64172 - DNA, 94 bp, Mus musculus
tacttctatctatcagtctgtctgtctgtatgtatgtatgtatgtctatctaaaataataattaaagaaattacagacatgattttgaggagta

SEQ ID NO: 64173 - DNA, 71 bp, Mus musculus
atcttactatatacgtactataatatgtatgtatgtatgtatgcatgtatgtatgtatgtatgtattagat

SEQ ID NO: 64174 - DNA, 78 bp, Mus musculus
acacacacagaaacacacacatatgtatgtgtatatatatatatacatgtgtgtgtgtgtgtgtgtgtgtgtgtgtgt

SEQ ID NO: 64175 - DNA, 107 bp, Mus musculus
ccctcacttcaatatgatcagagaagactagtcttactgcaacttgatatgcaataatttgttggtatccctgaaaggccttctgttttctgaggtgaaacagaggg

SEQ ID NO: 64176 - DNA, 94 bp, Mus musculus
gtttatcagtttagcatatatatgtatgtatgtatatgtgtgtatatatatatatgtgtgtgtatatatatatatatcacctaaaattggtttc

SEQ ID NO: 64177 - DNA, 65 bp, Mus musculus
agttatgtcagcatgactgggcagtgagctccctggatctttctgcacagtcaccacacatggct

SEQ ID NO: 64178 - DNA, 85 bp, Mus musculus; identical to SEQ ID NO: 57439

SEQ ID NO: 64179 - DNA, 77 bp, Mus musculus
gtgtgtgtgtgtgcttatgtatatatgtgtatatatgtatatatacacatttgatatattttccctcatataaccac

SEQ ID NO: 64180 - DNA, 92 bp, Mus musculus
gtgaatacaatttctttggttctattttttctcatgtaattcattttatatgaatatatcaagactaatattagtacttagaggttggtcat

SEQ ID NO: 64181 - DNA, 85 bp, Mus musculus; identical to SEQ ID NO: 57470

SEQ ID NO: 64182 - DNA, 85 bp, Mus musculus
gcctcattctgaggtagtgtctgtctttgtcactttgtctcctataatcaaagacagggtctagcataattgtcatcagagcggc

SEQ ID NO: 64183 - DNA, 106 bp, Mus musculus
gccttagtccatggtgatctgataggatgcatgggacaatttcaatatttttgtatctgttgaggcttgttttatgtccaattatgtggtcaattttggagaaggt

SEQ ID NO: 64184 - DNA, 108 bp, Mus musculus
ttagctaaattatgtttatgaacactttgagtagtccacagaactgtcagtgcacacatttttgtgcagatatgcttctgtttaaagttgttcattatgaataggtga

SEQ ID NO: 64185 - DNA, 58 bp, Mus musculus
gtgggtctctgtgtctgtttctatcagctacagtggaaggaggggaacacaatcccac

SEQ ID NO: 64186 - DNA, 118 bp, Mus musculus
atgatgagtattcaaggacaatgtgaattgcatagagtgttcacagaacagcctgagctctctatacgaacagtctaacttacaaatgcatatatggcggtcaagaaatattgtacat

SEQ ID NO: 64187 - DNA, 89 bp, Mus musculus
ggtatctctatatgaaattgtcttttatcttttttttttttccaggagaaaagttgatttggaggtttcatttttcgaatggagctagc

SEQ ID NO: 64188 - DNA, 85 bp, Mus musculus; identical to SEQ ID NO: 57470

SEQ ID NO: 64189 - DNA, 67 bp, Mus musculus
tatgcatatatacacatatatatgtatgttttatgtatgtatgtatgtatgtatgtatgtatgtatg

SEQ ID NO: 64190 - DNA, 85 bp, Mus musculus; identical to SEQ ID NO: 57470

SEQ ID NO: 64191 - DNA, 74 bp, Mus musculus
gtttggctatggttctctgcgtctctttctgtcagctgctgggaggagtctctcagaggacaattatgtcaggc

SEQ ID NO: 64192 - DNA, 114 bp, Mus musculus
ttttacacacacacatatatctatgtatatatatgtatgtatgtgtatatatatatatatatatatatatatatatatatatatatatatttgtatatgccttacgtggtgagg

SEQ ID NO: 64193 - DNA, 104 bp, Mus musculus
tcagtgataatagcttggcatgtgtttcgaattccatgatgacttttctatttatgaatataaatggtagaattctgttaccatgctacgtctgtagtatttgg

SEQ ID NO: 64194 - DNA, 81 bp, Mus musculus
gctagtgaggtccagcactctgtctgtctctatcctcagcttcaagggatggtgttacaggtatttggcctgtcatgatgt

SEQ ID NO: 64195 - DNA, 109 bp, Mus musculus
gtaagaaatgtgaagtgacatgaatgctggtattctggtagctagcctctgaaatgactctcactgactgcctgccacttggtagctgtacattgtgcatacctctcac

SEQ ID NO: 64196 - DNA, 123 bp, Mus musculus
gtgggatttatatgtatatatatatatatatatatatatatatatatatatatatatatatatatatgtatatatatatatgtatatatgttccattctctattttattatatatatatataa

SEQ ID NO: 64197 - DNA, 120 bp, Mus musculus
gtggtgttgatgggtgctgtgagagtaaaatgtgtatgatagtgtacagattttcatgttccttctttgagaaatgtcctctctgccaacgttaatgactccatggtaatcacagtaagc

SEQ ID NO: 64198 - DNA, 116 bp, Mus musculus
tctttcatttgtccctgtctttcctctagtctttgtaatattacacagattctgtgtcagtttctttataaatttttagagttggaatgttaatgaatcagaagttagtgcaaaga

SEQ ID NO: 64199 - DNA, 65 bp, Mus musculus
tatattcatatatatacacacacacacatatgtatatgtgtgtgtgtgtgtgtgtgtgttagata

SEQ ID NO: 64200 - DNA, 85 bp, Mus musculus; identical to SEQ ID NO: 57470

SEQ ID NO: 64201 - DNA, 136 bp, Mus musculus
tgcagaagatcatatatatgtatgtatatatacatacatatatgtttgtgtatctgtgtatatatatatatctgtacatatacatgtgtgtgtatatgcacatatgtatatatatatgtgtatatctatatgtata

SEQ ID NO: 64202 - DNA, 148 bp, Mus musculus
tgcagaagatcatatatatgtatgtatatatacatacatatatgtttgtgtatctgtgtatatatatatatctgtacatatacatgtgtgtgtatatgcacatatgtatatatatatgtgtatatctatatgtatatatagatatgtg

SEQ ID NO: 64203 - DNA, 148 bp, Mus musculus; identical to SEQ ID NO: 64202

SEQ ID NO: 64204 - DNA, 82 bp, Mus musculus
acatgagtacacagtatgtatatatccactgcaaggaaacattttgggggtagatatatgagcacactctgtttatcactgt

SEQ ID NO: 64205 - DNA, 148 bp, Mus musculus; identical to SEQ ID NO: 64202

SEQ ID NO: 64206 - DNA, 180 bp, Mus musculus
tgcagaagatcatatatatgtatgtatatatacatacatatatgtttgtgtatctgtgtatatatatatatctgtacatatacatgtgtgtgtatatgcacatatgtatatatatatgtgtatatctatatgtatatatagatatgtgattatatatatatatatatatatatatatata

SEQ ID NO: 64207 - DNA, 73 bp, Mus musculus
gaagttctgctgtagagccagagagaataaagcagggcatcccccaatttctctctgtctctgggagaatttc

SEQ ID NO: 64208 - DNA, 85 bp, Mus musculus; identical to SEQ ID NO: 57439

SEQ ID NO: 64209 - DNA, 85 bp, Mus musculus; identical to SEQ ID NO: 57470

SEQ ID NO: 64210 - DNA, 89 bp, Mus musculus
gattattaattcaggggctggagagatggctcagcgattaagagcactgactgctcttccagaggtcctgagttcaattttcagcaacc

SEQ ID NO: 64211 - DNA, 78 bp, Mus musculus
ttcttgctgtacaggctctgtggaaccatctgtgggtaagaaggagaaggtccagtagagtgtctgtgtctgtgagag

SEQ ID NO: 64212 - DNA, 93 bp, Mus musculus
tagcaggtgataatccataactagcatttcagctttagggttctgttgctctcagtctgtctgtgctaatcgtcctggaggtaacctttgctg

SEQ ID NO: 64213 - DNA, 93 bp, Mus musculus
gttcatctgtattgcactcaatggaccgtatagagctacatggttcaattcttcccattgtccacatatggctattgagcactgagaatgaat

SEQ ID NO: 64214 - DNA, 116 bp, Mus musculus
acagcactataggcaagtatgctctaaaactgagttatagctacaatacctgaaacagtttttttttcattaagtgccttatctcagttattgaaagttcttgtttattaacaggt

SEQ ID NO: 64215 - DNA, 116 bp, Mus musculus
atgtaaattatatatatatatatatatatatatatatatatatatatatatatatacacacatatatatacatatatatgtgtatatgtgtatgtgtatgtatatatattcatata

SEQ ID NO: 64216 - DNA, 85 bp, Mus musculus; identical to SEQ ID NO: 57439

SEQ ID NO: 64217 - DNA, 63 bp, Mus musculus
caattatgagtgggagggaccctatggaaacctccaatttagtcactttctctcacataattg

SEQ ID NO: 64218 - DNA, 91 bp, Mus musculus
ggttcatgatttctgttagtttcactgtgtctctgtttagtttctgtttccaggatctgtccattgatgagagtggggtgttggagtctcc

SEQ ID NO: 64219 - DNA, 74 bp, Mus musculus
gctatatgtgtgtgtgtatatatatgtatgtgtatagattctaattatgtatgtgtatagatttacatgtatgt

SEQ ID NO: 64220 - DNA, 94 bp, Mus musculus
gaaatgataataatacttatcctttgtggtttccctcatataattcattataattgtaagaataatgtggggtaaaaatctcaattaacatttc

SEQ ID NO: 64221 - DNA, 82 bp, Mus musculus
ctgctatctagagacctcattcaggccactgtcagatgtttgaggtggtcagacagtgagcagagagtgagcagacaggcag

SEQ ID NO: 64222 - DNA, 85 bp, Mus musculus
aacctaggatagaaaaccactctaggggcagaagagatggctcagcagtttagagcactgactgctctttcagagatccagagtt

SEQ ID NO: 64223 - DNA, 75 bp, Mus musculus
agctagtcttgctgtctctgactgtggcttgtcagtcctgcaagcattggtgtcagtactgagtgaagactagtt

SEQ ID NO: 64224 - DNA, 79 bp, Mus musculus
tatatatatatatatatatatatatatatacacatttatatataatgtgtgtctgtgtgtctatatatatatatatata

SEQ ID NO: 64225 - DNA, 85 bp, Mus musculus; identical to SEQ ID NO: 57470

SEQ ID NO: 64226 - DNA, 85 bp, Mus musculus; identical to SEQ ID NO: 57439

SEQ ID NO: 64227 - DNA, 105 bp, Mus musculus
tctttgtcctcactttaaatacatctcaatacatctatggttgttccatttttatatttgaaaaagcattgtgagtattgagacatgtcgaaagtaaaactcagg

SEQ ID NO: 64228 - DNA, 74 bp, Mus musculus
gtatatatatatatatatatgtgtatgtgtatacatgtatgtgtatatatgtatgtgtgtatatatatacatat

SEQ ID NO: 64229 - DNA, 115 bp, Mus musculus
tgagctacatatgatgtgattgtcttgagagatatatatatatatatatatatatatatatatatatatatacccatatctgtaaaaatattttttcatttccatgatggctgca

SEQ ID NO: 64230 - DNA, 76 bp, Mus musculus
atacatacatatatatgtatatatataaatgtatgttaacatatatgttaatatctatatatgtatatggatgtat

SEQ ID NO: 64231 - DNA, 106 bp, Mus musculus; identical to SEQ ID NO: 58252

SEQ ID NO: 64232 - DNA, 99 bp, Mus musculus
gctttttatcagttgagacatgaacgtcttcaaaaggcaaacagcccaggtgattcactctcatagactgtctcagtaattgatttctccaaattaagc

SEQ ID NO: 64233 - DNA, 85 bp, Mus musculus; identical to SEQ ID NO: 57439

SEQ ID NO: 64234 - DNA, 84 bp, Mus musculus
cactggcacttggtcttttgctccatatacatatgtatgtatggatgtgtgtacgtgtgtaattatgaggtactatgtgaggtg

SEQ ID NO: 64235 - DNA, 111 bp, Mus musculus
tcctttttaaatgagagtacttattctgtttcatggtatattggaaatgtgcaacttgtttctagaatatatatattaacaataaggaaatagttttgagtttagaaggga

SEQ ID NO: 64236 - DNA, 81 bp, Mus musculus
ggtattatgtaacatgtcagagttaatttgttcttctgtagggaagacagacagacagacagacagacagacagacagact

SEQ ID NO: 64237 - DNA, 82 bp, Mus musculus
agacagagacaaatacagagatatagatatctacagatatgtaaatatttatctctccatatctgtctgtctgtctgtctgt

SEQ ID NO: 64238 - DNA, 97 bp, Mus musculus
ctggcaaataaaagttactttgcatatgtatgtatgtatgtatgtatgtatgtatgtatgtatgtatataaagggtatcttttagaatgacttacag

SEQ ID NO: 64239 - DNA, 71 bp, Mus musculus
tagcagatgagcagcttggtcttcaagtgggcccccaacaactggagcaggggctgtctctgactctgtta

SEQ ID NO: 64240 - DNA, 115 bp, Mus musculus
aaacaggtggctgtcctggaattcgctatgtagaccaggctggcctcatagggatccacctgcctctctgtctttgtctctgcctgctgaatgtaccaggtccagctaagggttt

SEQ ID NO: 64241 - DNA, 106 bp, Mus musculus
tggaaaggaaaaaagagacactgaactgtgtggaaatgaatgcaaaactcaggaagataccgttgtggttgtgtctatacagaccactcaagctgaccactttcta

SEQ ID NO: 64242 - DNA, 113 bp, Mus musculus
ctgggatttagtccaactaccaagattaataaatatagagagaaagctggtagttatatttattttcatgaagttatatttattttctggttcttggaaagtgtgtctaaaag

SEQ ID NO: 64243 - DNA, 85 bp, Mus musculus
cagtgacttgtccccagtgactgacccagtgactgtccccagtgactgacccagtgactggctcagtggctgaccccagggactg

SEQ ID NO: 64244 - DNA, 68 bp, Mus musculus
atgtgtatgtatgtatgtatgtatgtatgtatgtatgtatgtatgtatgtgtgtgtgtatatgtgcat

SEQ ID NO: 64245 - DNA, 110 bp, Mus musculus
gctctgttgcgttgcttcagagggggatgttttcagtctgagagggatatacttgtgcgagtcacccactcagtgactctgaagattcgcttcttgtccgtggtcatggc

SEQ ID NO: 64246 - DNA, 70 bp, Mus musculus
cttcagagtcactgagtgggtgactcgcacaagtatatccctctcagactgaaaacatccccctctgaag

SEQ ID NO: 64247 - DNA, 100 bp, Mus musculus
cactgtaatgaggagcgtgtcctgccctgtcttaggcagtagtcactgtgcagtagccgttgagcctgtcgctgggaggatgattgctttgagtgctgtg

SEQ ID NO: 64248 - DNA, 118 bp, Mus musculus
ctcatggggtaagaaaaggacagggctaaaaacatttcagtagtctctagtgaatttgttcaaaactgacaaatgatggaggcaatgcaagggccttcgactcatgctcagctcagag

SEQ ID NO: 64249 - DNA, 98 bp, Mus musculus
ggcggtgtgcaaggtctgtgtataacgagtgaaacacaagtcaatttcatgtttgcatcctgtgtgtttgtgcaaatactacggactctgaacaagtc

SEQ ID NO: 64250 - DNA, 65 bp, Mus musculus
gtctcactggctcactggctcacgggctcacgggcttacaggagggacaggctccagtcagagac

SEQ ID NO: 64251 - DNA, 72 bp, Mus musculus
ttttacctgtgtctgtgtgtgtgtgcgcgcattcgcacttgcctgcacacatatcatagagcatttgtgggg

SEQ ID NO: 64252 - DNA, 100 bp, Mus musculus
gataagtgactgtggagtatcctaggttaggcaacatggtagagattttcttcttttcagtgttgtattcccctgtattgcctcaccagcagcacctgtc

SEQ ID NO: 64253 - DNA, 85 bp, Mus musculus
agatgcaggcagctgtaagtgctccacccaggggctgggaattgaactgggaggagagctacaaggttgtatttaaaaaccatct

SEQ ID NO: 64254 - DNA, 98 bp, Mus musculus
gggttgtcatactgtgtgcagtgcccgtcctcagtcatcactgtgagctgtcacatggccatctgggtcaagggttgtcatactgtgtgctgtcacct

SEQ ID NO: 64255 - DNA, 97 bp, Mus musculus
gggttgtcatactgtgtgcagtgcccgtcctcagtcatcactgtgagctgtcacatggccatctgggtcaagggttgtcatactgtgtgcagtgccc

SEQ ID NO: 64256 - DNA, 125 bp, Mus musculus
gctcggggttgaaagccttgtagagtggtggctacagtagcagtgcccgtcctcagtcatcactgtgagctgtcacatggccatctgggtcaagggttgtcatactgtgtgcagtgcccatcctc

SEQ ID NO: 64257 - DNA, 111 bp, Mus musculus
ggcaatctgtgtatatgtttccatttttacatatgcatacatatatactatatatgcatatgtacctgtatgtgtgttttaaaaggtaaatattaggactgttcataggcc

SEQ ID NO: 64258 - DNA, 89 bp, Mus musculus
tggagagcttagctgccaaccctgtgagtctgtgtgtgtgcctgttccacagcatgggaggaggggtcagagtcagttatctctttcca

SEQ ID NO: 64259 - DNA, 81 bp, Mus musculus
tctgcctctgacaggctctgatacccagtgtgcacaatcatacagatgtgtatacataactatcacactcacagacacgga

SEQ ID NO: 64260 - DNA, 118 bp, Mus musculus
tgggggggggggtggcgtgtgggtgtgtgtgtggggtgtgataagagacagagacagagagtcattttatcagttctgctcctttagaagacattgattaatatacctatgatatcca

SEQ ID NO: 64261 - DNA, 84 bp, Mus musculus
ggtaggggagatgttcagagaacctgatgaccagagtgcaacccttaggttgtacatgatggaaggagagaactgacttctgct

SEQ ID NO: 64262 - DNA, 83 bp, Mus musculus
caagagtttctctgtagctacagtttcagggctgtcctggaactgaccagggtagtctcaaactcactcacagagatatcctg

SEQ ID NO: 64263 - DNA, 118 bp, Mus musculus
cactgagagccttgactgggttcatgatctgactattaatgtctgtgtctcagtctatcactgaaagccatgcagatgtccatggtttgagctgcagtctgaggccatgtcaatgttc

SEQ ID NO: 64264 - DNA, 94 bp, Mus musculus
gcctttagtggcttacaatggaaaactgaaagaaatttttttcatatagatttaaattgttgctgtgtcatttctccagtgtgaggatggaggc

SEQ ID NO: 64265 - DNA, 97 bp, Mus musculus
caagatcctaaatcctttgttagactctgccttcagctttctatcctgacagatgtcagtgagatcaggaagcagctctgaaagtttataactcttg

SEQ ID NO: 64266 - DNA, 113 bp, Mus musculus
ggtataagaacatttaataatacagtcaacacattgtaagtatacattatgattatatcattattacagtaattataattacaacatgctatggtttgaatgtgaatgtgacc

SEQ ID NO: 64267 - DNA, 116 bp, Mus musculus
tgtgtgaagttgggattgaggggcatcctataagcccatctctgcttttgatatctattgtaaatttgtattcctggagaacagagttggctagagtaactcataagaaaagcaca

SEQ ID NO: 64268 - DNA, 115 bp, Mus musculus
agccatccagggaactgctgtttgtttctcaccagtatttcttgtgtcccagactctgttacacacagactcttggtgctgcgtgaaataggcatggtccctgacccacaaggct

SEQ ID NO: 64269 - DNA, 70 bp, Mus musculus
tgagtagtaagcaagtgaagtctagtctcagtggtctacaagagatctgactttgttgtttacaaactga

SEQ ID NO: 64270 - DNA, 82 bp, Mus musculus
cgtgtgcaccatgtgacatgtgtgcacctgcactcacacatacacagagacacacacagaatcacatgacgcttgttacacg

SEQ ID NO: 64271 - DNA, 114 bp, Mus musculus
gcagtgtagggagagtcagtcagttctgttcactcatttgagttgagtcagtcagttggaagtcagtacagtgagtgcagtgcactggagttgaggtcccctgtgatttcatgc

SEQ ID NO: 64272 - DNA, 79 bp, Mus musculus
gtgccaggtgtgtgaggtgataaaggggtccccagacatcccagatctctctctatctctgttcctggcatttcctggt

SEQ ID NO: 64273 - DNA, 85 bp, Mus musculus; identical to SEQ ID NO: 57439

SEQ ID NO: 64274 - DNA, 107 bp, Mus musculus
atttattcattgtgtttgtatgtatgcatgcatgcatgcatgtatgtatatatgtgtgtgcatatgtatgaatgtatgcatttatgtatatatgcatgtatgtatgt

SEQ ID NO: 64275 - DNA, 85 bp, Mus musculus
tctatctatctctatagagatatatatttatatatatatttatatatgtaaatatatatagatatttatagatgacatagctaga

SEQ ID NO: 64276 - DNA, 77 bp, Mus musculus
ctgtcagaagggcctaaggagaagttaaacatacaagctgtgtgcttgatatttcctagtctctctctctgaatcag

SEQ ID NO: 64277 - DNA, 64 bp, Mus musculus
agttgttctgaagtgtgctcattgccagtgcactacttgccagctgagatacttcatggctgct

SEQ ID NO: 64278 - DNA, 85 bp, Mus musculus
ggtcagttaagaatgtccctctctgtctcagactgaatttgcatttacagtcagagaacaggaagagatccaaagtaacctgacc

SEQ ID NO: 64279 - DNA, 64 bp, Mus musculus
gtggctcagtggtttagagcactctctgctcttgcagaggtcctgtgttttgttcccggcacac

SEQ ID NO: 64280 - DNA, 75 bp, Mus musculus
gctgctcgatctgatctactcacaaacactcacagatatatcagcagtcctgttcagcagagtcaggttagcagc

SEQ ID NO: 64281 - DNA, 104 bp, Mus musculus
agaaagagcatagtctatgtgagtatatgtgtgtgtgtctgtctgtctgtctgtatgtatgtatgtgtatatacatatattcctaagtacaacatgcttggtct

SEQ ID NO: 64282 - DNA, 78 bp, Mus musculus
ggtgacagatgagactcagctctttgcctactgcatttgattgccacatgccagctctgtccttccatctacatcacc

SEQ ID NO: 64283 - DNA, 72 bp, Mus musculus
gaaagggtgaggttctaggttccatattgttaccccactcacacaacaggaaaaacagaatttgaccctctc

SEQ ID NO: 64284 - DNA, 85 bp, Mus musculus; identical to SEQ ID NO: 57470

SEQ ID NO: 64285 - DNA, 92 bp, Mus musculus
gtgaatgttgatagtctgcattgtgctgtctcaaaatgtcttggaatacagttgactgcagatagcaaaaggaagaatgtgaatcattaggc

SEQ ID NO: 64286 - DNA, 85 bp, Mus musculus; identical to SEQ ID NO: 57439

SEQ ID NO: 64287 - DNA, 94 bp, Mus musculus
tggggtttcatctgccctatgtctttgtgccatagtttctttatctttgtatagaaaccagtcattaagaaaaggcgcagtctaaccagaacca

SEQ ID NO: 64288 - DNA, 75 bp, Mus musculus
ggtatcaactgaggcctgcacagaagtgtggttacaggtggttttgagctactatatgtgtctggtaatgatact

SEQ ID NO: 64289 - DNA, 85 bp, Mus musculus; identical to SEQ ID NO: 57439

SEQ ID NO: 64290 - DNA, 112 bp, Mus musculus
gttttctggctatgaatcaaatatcttaaaattaattgtgtttcttttatatttttaacttaaatgtgaaaacacattttgtatttgtgtcaataatgcttaataagaagac

SEQ ID NO: 64291 - DNA, 72 bp, Mus musculus
gtctccatcagctctcttccttcagagataagggaacatcacagaagatggagaggaaagattgtaggagac

SEQ ID NO: 64292 - DNA, 91 bp, Mus musculus
tggtccatattttatgtatttatttcattaacaaatcacttatcgtgatatgtgagagatgacactctaaatgcattttagatatcaacta

SEQ ID NO: 64293 - DNA, 85 bp, Mus musculus; identical to SEQ ID NO: 60314

SEQ ID NO: 64294 - DNA, 93 bp, Mus musculus
aaggttggctgcaagcatctgcatctggatctgtaaggctctagcagagcctcttagaaaacatccatatcagactcatgacagcaagcactt

SEQ ID NO: 64295 - DNA, 71 bp, Mus musculus
agccaggaggagagtgtagtgagtgtggagctgttttgtaagctccttacctcctttactgttcccttgtt

SEQ ID NO: 64296 - DNA, 119 bp, Mus musculus
gcagcttggccctctgactctcttcggtgacgggtattcttgggtggataatacggattacgttgttattgcttaagaatacgcgtagtcgaggagagtaccagcggcaggcgggcagc

SEQ ID NO: 64297 - DNA, 86 bp, Mus musculus
ttggatcaccttctctgaatatgcccagcagttgtattgctgtgtcctgaggtagtactatgtttaattttcagagggtcctccaa

SEQ ID NO: 64298 - DNA, 72 bp, Mus musculus
tgcgactgatgagagtgtggagcacacaagtacaaatgctgaagacagtgaatgcctccactccaagttgta

SEQ ID NO: 64299 - DNA, 58 bp, Mus musculus
atttctctctgtatatgcatatatatgtatgtatatgtatgtatatgtatagtgaagt

SEQ ID NO: 64300 - DNA, 114 bp, Mus musculus
atataatactaaaattatatatatatatatgtatatatatagttatatatagttatatacatatagttatatatgtagttgtatagattgtatatgtatgtgtatgtatatgat

SEQ ID NO: 64301 - DNA, 98 bp, Mus musculus
ggtgagtactagactgtcacaggtggtgaggggttttaattcctatgtcatgaatgtttaaacataggatgagatatggctacccagtaaagatggcc

SEQ ID NO: 64302 - DNA, 87 bp, Mus musculus
ggaagtaaagtcttggtcacagtatagagtgaagcctgttatacatgccgggagtgcccactgagatacccaccgaggagaacttct

SEQ ID NO: 64303 - DNA, 83 bp, Mus musculus
catgggacaatttcaatatttttgtatctgttgaggcctgttttgtcaccgattatatggtcaattttggagaaggtcccatg

SEQ ID NO: 64304 - DNA, 104 bp, Mus musculus
atgttctaatacatatgtgtgtatgtatgcatggatgtatgtatgcatgtatgtgtatatatgtatatgatacatatatatgattatataaacatatatatgtc

SEQ ID NO: 64305 - DNA, 71 bp, Mus musculus
gtttatgggtatctttttctttaggttagggaagttttcttctactaattttgttgaagatatttaatggc

SEQ ID NO: 64306 - DNA, 76 bp, Mus musculus
gtgtgtgtgtgtgtgtgtatgttttatgtctataatgtaatgtatatgcatatgatgtatatgtatatatgtgtat

SEQ ID NO: 64307 - DNA, 112 bp, Mus musculus
ccatctgtctgtctgtctgtctatctacacacacacacacacacactcacacacacacacacacacacacacaggatccaaatgtcaagaagagagagagagggagagaggg

SEQ ID NO: 64308 - DNA, 86 bp, Mus musculus
gttcttactgttggctgggttaactgggttgtcactctttgtctcagtccctccttccgtttatatcctgagccacatagatgaac

SEQ ID NO: 64309 - DNA, 98 bp, Mus musculus
ctgagggcggtctttgaggtttcaaatgttccagtcaggtccagtgtcattctctctttctgatgaaccagatataaaactctcagctagctctccag

SEQ ID NO: 64310 - DNA, 96 bp, Mus musculus
aagacatcggggttgaagagatggctcagtggttaagagcactgactgctcttccagagttcctgagttcaatttctagaaaccacatggtggctt

SEQ ID NO: 64311 - DNA, 73 bp, Mus musculus
tcacagatggtgcttttataagcctgcagtctcctggtgatcaatctgcagagtagtgtgagagcacttgtgg

SEQ ID NO: 64312 - DNA, 110 bp, Mus musculus
tccagaactgtataaagtgctccagaggaaggttgatcagtgtcaaacacaaaaacatcatcttcttcttcttctgcaggcactttgaaaaatgactttataaacttgga

SEQ ID NO: 64313 - DNA, 112 bp, Mus musculus
caatatttagagctggctgccttaataaatgcacatatcgtatgttgctctctctgtgtctgataggcgggacggtgttgggcggaagaaggtcacggtgatgttaaatttg

SEQ ID NO: 64314 - DNA, 117 bp, Mus musculus
ttagtacagggaggaagaaggtttttgaaatgtgggtgtggagagagaagactgtgtggtaagaattaggacctagcggggcccatgactttgaaaagtttctgggaaatgggctaa

SEQ ID NO: 64315 - DNA, 88 bp, Mus musculus
ttctagcaccaaggattttatatttttcatagaatgatatttttggaatataaaagtattggtatataagatttttgagtccctggag

SEQ ID NO: 64316 - DNA, 88 bp, Mus musculus
cctgtctgtctctgcgtgtctgtctgtctgcacatgtgtggatgtctatagtatagcacatgggcggttgcagagaacagttttaagg

SEQ ID NO: 64317 - DNA, 80 bp, Mus musculus
ctggagaaactggtgcctgataaatcaatggtgagacaacgattcaggccaagggaagaatgagagcacacactgtccag

SEQ ID NO: 64318 - DNA, 96 bp, Mus musculus
gatcagtcttagggcatggtggtctgataggatacatgggacgatttcaatatttttgtatctattgaggcctgttttgtgaccaattatatggtc

SEQ ID NO: 64319 - DNA, 123 bp, Mus musculus
ttgtttttgaggtattgttaatggggctgttttctgagtctctttcttggccaattatttatttgtatataggaagactactactttttgaactcccactttgtcttcttttgacaacacttt

SEQ ID NO: 64320 - DNA, 84 bp, Mus musculus
gatttctctcttgagcaggtaaagatttgtcattgttctgtcacaggtgacagtgaacagagatggatgtcattgggggtaatc

SEQ ID NO: 64321 - DNA, 68 bp, Mus musculus
gttcctgtagctatgatggttcccatactcttgatttaagggtgtgtcactgtcacagtctctggtac

SEQ ID NO: 64322 - DNA, 88 bp, Mus musculus
atgctacttcttcaagagattatatttttttcaatgcatgttctcaaaacaatggttgaagatccattagctgttggtgggtaagcat

SEQ ID NO: 64323 - DNA, 109 bp, Mus musculus
gctactcaaactagcaagttggaacatgagaacgtaaggaggcacaattgtgattatcttggaatgtccttcaactttgagctgaacaagaggctgggcataaaggtgg

SEQ ID NO: 64324 - DNA, 110 bp, Mus musculus
gtataggatatattaatgtgtatgtatatattaatgtacatgtatatatggtgatatatatatatatgtatatatatatatatatatatatataatgtttgttaacatgc

SEQ ID NO: 64325 - DNA, 120 bp, Mus musculus
aactttggtacctggtatctgtctagaaaattgtccattttattcagattttgaagttttgttgagtacaggctttgtaataggatatgatgatttttttggatttccaaggtttctgtt

SEQ ID NO: 64326 - DNA, 57 bp, Mus musculus
tggggtatcagggccagcatcctctgtgctcacagacacactgtctctgacacttca

SEQ ID NO: 64327 - DNA, 116 bp, Mus musculus
gtgaacacaagatactcatgggtcctccatttaccagacctgtaactttttgagaaagtctttttttttttaacatcagtgtagagaggtatctgtctgaatatcaagtgtattat

SEQ ID NO: 64328 - DNA, 83 bp, Mus musculus
ggcaacagatgacagaagagagagaataaaaggtagtataaggtattatgggatgcatcatgtctctctatatgtcactggcc

SEQ ID NO: 64329 - DNA, 85 bp, Mus musculus; identical to SEQ ID NO: 57470

SEQ ID NO: 64330 - DNA, 128 bp, Mus musculus
aacttatgtgttccatttctttaatcactatgaaatatatatatatgtatatgtatatgtatatgtatgtatgtatttatacacacatatatgttcctaaatatataaatataacctgtacaatttca

SEQ ID NO: 64331 - DNA, 117 bp, Mus musculus
ctatcacctgagctaaaatagtggattatcaaagtttcatagaatgtgtgacttctgaacaacctacactctgagaagttacaatgggtggagaatcagctgaggatcagaaggtag

SEQ ID NO: 64332 - DNA, 75 bp, Mus musculus
gtctgtgtctatgtctgtgtgtctgtgtgcctgtatctctgtacacacatacacaagcacctttaaaggccagat

SEQ ID NO: 64333 - DNA, 89 bp, Mus musculus
gtgctgagtggtaaggtagagtagcagggagttaatggtgagaggagacagagcccattcattaccttgtttccccatttgctcagtgt

SEQ ID NO: 64334 - DNA, 85 bp, Mus musculus; identical to SEQ ID NO: 57439

SEQ ID NO: 64335 - DNA, 82 bp, Mus musculus
acatttactctgtatatctctgtctttttattggtggaattgcacccacttatgttgagacacattgatgaccgatgattgt

SEQ ID NO: 64336 - DNA, 82 bp, Mus musculus
ggtcagggagaaggaagtatactaaaggtgtcctgtatcctaaatgcctgcagggcctacttagtgacgagcctgcagtgcc

SEQ ID NO: 64337 - DNA, 117 bp, Mus musculus
gaagcaggaggtagtggaggatgaggcagggaagatgtggtagtgataagtggttaagagctctgactgctcttccagaggtcctgagttcaattcccagcaaccacatggtgactc

SEQ ID NO: 64338 - DNA, 116 bp, Mus musculus
gcagctaactgtgctctgagtttttttatatgtaagagagtttggaatttttcttttaaaattagccttcacacagttcttttccgaagcacagggcgcagttcatacctagttgc

SEQ ID NO: 64339 - DNA, 69 bp, Mus musculus
gccctgtaggccagctgtctttgggctcaaatcctggctcttccagtgaggagacactgggcacagggc

SEQ ID NO: 64340 - DNA, 85 bp, Mus musculus
cctggcaggacccctgaagaggacagaggcggccgctggcaggcttcccctctcacagtctctctggtggtggtttgcagcctgg

SEQ ID NO: 64341 - DNA, 85 bp, Mus musculus
ggccatggtggtctgataggatacctgggacaatttcaatatttttgtatctgttgaggcctgttttgtgaccaattatatggtc

SEQ ID NO: 64342 - DNA, 68 bp, Mus musculus
ggcttagaagaaagagaggactcaggaccgaatgctctcagtgcctgagattctacttcgtctgagcc

SEQ ID NO: 64343 - DNA, 85 bp, Mus musculus
agtgctttgcttggtctgtccctgccagagagaacagaatgtccacaaccaatcagtttgtggtaagggaggatattgaaccact

SEQ ID NO: 64344 - DNA, 107 bp, Mus musculus
ttcacccctggtttcatggtgtcatgtaagcagaactgaacagaactgtgtctgcactgactgtgtctgttttagtgctgcctatgtgatgttcaaaaccacatgag

SEQ ID NO: 64345 - DNA, 82 bp, Mus musculus
ctcaactgaggtattctcttcccaggtgactccagtttgtgtcaagttgacagaagctaaccaatgaaggaactcagatgag

SEQ ID NO: 64346 - DNA, 84 bp, Mus musculus
gagagacgataggtgtttggcaaggcattggtgctctgtagcggtcatctgcatgcatgcctgcctgcctgcctgtccactttc

SEQ ID NO: 64347 - DNA, 73 bp, Mus musculus
cttccagttgcctgatagacatgccatggaaatctcccctgagactcagtgtgtgtcatgagggctctagaag

SEQ ID NO: 64348 - DNA, 123 bp, Mus musculus
tcccatgggagcactgtggaaattgcagcatgggggctggagagaagcatcagcggttaagagcactgactgctcttccagaggtcctgagttcaattcccagcaaccacgtggtggctcaca

SEQ ID NO: 64349 - DNA, 82 bp, Mus musculus
tgtgtgtgtgtgtgtgtgtatacatatatatacacacatgtatatgtgtgtgtgtatatatatatatatgcatatatatgta

SEQ ID NO: 64350 - DNA, 105 bp, Mus musculus
gccaaaaaataaagttacattttacttgcacgtgtgtgcctgtgtgcgtgcgactgcaccatagtgcacatgtggaggtcaaacacagctcttctaccatgtggc

SEQ ID NO: 64351 - DNA, 73 bp, Mus musculus
atatatatacatatatttgcacatgtgtgtttgtatgtggtatatccatgcatgtatgtatgtgtgtatgtat

SEQ ID NO: 64352 - DNA, 62 bp, Mus musculus
ggcctttacagcccttctcagcagcagatctggacagagaagggtgtgaggtgatatttgcc

SEQ ID NO: 64353 - DNA, 67 bp, Mus musculus
cagtgaagtttggtatgtgagggggtcttcacagcaagagatgcctcactttatctctcattctctg

SEQ ID NO: 64354 - DNA, 113 bp, Mus musculus
gctaatttgacacgaattattcagttctttttactcatgaattgactttaaacttgttaatcttttaatttttgaaatcatctttatcagtgactctgactaagtgtctagtt

SEQ ID NO: 64355 - DNA, 58 bp, Mus musculus
gcaaacatatacatctaacctcatatatatatatatatgtggatggatggttgcctgc

SEQ ID NO: 64356 - DNA, 66 bp, Mus musculus
gagacagggtctctcactgacttgacctcactggttgggctgtgtttatattgagccttggagctt

SEQ ID NO: 64357 - DNA, 68 bp, Mus musculus
tcagggactctctttccctcagtagcagtcaactgctaattgcacttcggatggggtggggcccctgg

SEQ ID NO: 64358 - DNA, 69 bp, Mus musculus
gtatgtatgtatgtatgtatgtatatgtatctatatatacatacatatacatatatatatacacacata

SEQ ID NO: 64359 - DNA, 93 bp, Mus musculus
cagaggcataggtaggctcctggagccctgacatatggactggcccaggagggtctgggtgtgtctgccactgtgtctaccccatgcccactg

SEQ ID NO: 64360 - DNA, 108 bp, Mus musculus
aacttcgggaaaaccttgaatttgaattccagtgttttcaggcagaggagataagtggtagcaggcttgatacgcgctgtgtagggcagggcagggagactgggagtt

SEQ ID NO: 64361 - DNA, 82 bp, Mus musculus
ccagagcagctcagctatggttggatccagttctcaaatgactcactgctggctggctggctggctggctggctggctctgg

SEQ ID NO: 64362 - DNA, 77 bp, Mus musculus
tggaaacacccccaaagacatttctggaggtgtgctttcctacctcctaagtgttttatgctgattggtgtttgtca

SEQ ID NO: 64363 - DNA, 65 bp, Mus musculus
aagctgcactcactgtctctctgtgggagtccttgctcttcagagggagcagagaagttctgttt

SEQ ID NO: 64364 - DNA, 92 bp, Mus musculus
cctgccattgcatgtccacagcgagtgtgaggagacagagttgacgtactctgcatctggccaggttactgtgaactgaaatgaatggtggg

SEQ ID NO: 64365 - DNA, 122 bp, Mus musculus
ggcagccctagagagtgggggtgggggagtgtctcctgcctcctgcttatcagtgactgcttgttgacagcggacctaacaacctaattcagtgcttctcaatagctcagttactagatagc

SEQ ID NO: 64366 - DNA, 127 bp, Mus musculus
ggacagaagacagtggacactcgcttgccccattgaagcaggggtggctttgtcagtctgtgtctcctaccctgtggcacaggaacttctctgagataagtcactgccttcagaaaagggtccaagt

SEQ ID NO: 64367 - DNA, 80 bp, Mus musculus
cggcggctcgcttcagtcgtgtctctctcactcactggggaacccggtggtggtggcggcagctttcgaggcagacgctg

SEQ ID NO: 64368 - DNA, 100 bp, Mus musculus
gtcatgtctccttccaaactaaaagagcttatcactatgtatttatctgtcttgatttagacttttttgaagagtacagggtagttgttcttagactgac

SEQ ID NO: 64369 - DNA, 87 bp, Mus musculus
gtttgacacttcctttctttcaatgtgcgtctctgtctctgagaactccccgaagcagacttgttggagagatagccccggtcaagc

SEQ ID NO: 64370 - DNA, 105 bp, Mus musculus
gaaccctcctgcttgtgttctgacttctctttatggagctagtagaaggtagtttactatttaatgtgctcatttaataagaatcaatgcagagttgttgggagc

SEQ ID NO: 64371 - DNA, 122 bp, Mus musculus
catatatatacatatgtatatatatatgtgtgtgtgtgtatgcatatgtgcatgtatgtatatgtgtatatatgtacatatatatgtatatgcatatgtatatattataagacatatacatg

SEQ ID NO: 64372 - DNA, 110 bp, Mus musculus
gtccatgttgatctgataggatggattgcataatttcaatatttttgtatctattaatgcctgttttatgactgattatagggtccattttgtagaaggaaacctgagat

SEQ ID NO: 64373 - DNA, 61 bp, Mus musculus
tctgtctgtctgtctgtctgtctacctacgtttttttaggtgcagttcaggcaggcctaga

SEQ ID NO: 64374 - DNA, 102 bp, Mus musculus
gcttttctgctctctggtgagcagtgtgtgtaaacagttgagcagtctgtctgtctcagtgactgggcctgcactgcctggggagaactgaacagaaaggct

SEQ ID NO: 64375 - DNA, 95 bp, Mus musculus
tgctgcataaggtctaaggctagagtttgcatttctagctgtttctgagagggagagagaaggagctggcagacaggcaggcagtaagcaaggca

SEQ ID NO: 64376 - DNA, 109 bp, Mus musculus
atatgtgtgtgcatatatatatatatatgcacatgtatatatatatatgtgtgtgtgtgtatatatatatgtgtatatatatatatatatatatatatattcttcaata

SEQ ID NO: 64377 - DNA, 78 bp, Mus musculus
ggacactggggcatgaagagtctggataagccaaaccaacagggtgcttgctgctgacagaccaaagtgttcagaagt

SEQ ID NO: 64378 - DNA, 79 bp, Mus musculus
aggatgaccggagcaacagacacctagtgctcagcattccgaccagcacacagtcagtctgtcagctcacagtcagtct

SEQ ID NO: 64379 - DNA, 99 bp, Mus musculus
agagtctgtgctgagtatgtccctgagcatacattttatttttattgcattaaattatgaaagattgcacagaggttttaaactatatagggagattct

SEQ ID NO: 64380 - DNA, 89 bp, Mus musculus
agtatatgtatgtgcatatatgtgtatgtatgtgtgtatattggtgtatatatatgtatgtatgtgtgtatatgtgtatgtgtgtgtct

SEQ ID NO: 64381 - DNA, 84 bp, Mus musculus
gagatattctgaacctagggaacggtaccaggcaagaaacaggactggcagaaggctggctcagtcagtgggtgtcaggagctc

SEQ ID NO: 64382 - DNA, 77 bp, Mus musculus
tatgtaagtatgtatttatgtatgtatgtatgggtacatatatatgtatatatatatgcataaactatataagtaca

SEQ ID NO: 64383 - DNA, 67 bp, Mus musculus
ggccttgcaagaacgtgtggtgaagggcaatgatgtcagccaccctgtgactttaccttgctaggtc

SEQ ID NO: 64384 - DNA, 79 bp, Mus musculus
taaacacatatacacgtgagcagcactaaatggacccaccaggttatagtttgtatatacatgtgtgtgtatatgttta

SEQ ID NO: 64385 - DNA, 59 bp, Mus musculus
gtctgtctgtctgtctgtctgcctgtctgtctatcatggcagacagagatgtgacattc

SEQ ID NO: 64386 - DNA, 77 bp, Mus musculus
acaggatatgccattatcatggttcttagtgagggcacaccttattactctatatatgtatatatgtatatctctgt

SEQ ID NO: 64387 - DNA, 87 bp, Mus musculus
cccagccctaactgatccatccacagcattccccctaaaccaaaggctcagggattgtcgtagaagagagtgtggagaggctatggg

SEQ ID NO: 64388 - DNA, 85 bp, Mus musculus; identical to SEQ ID NO: 57470

SEQ ID NO: 64389 - DNA, 64 bp, Mus musculus
tctgaggctctgtgtcactgacggggctatgcatgcccatgtcaaaaatatacattcactcagg

SEQ ID NO: 64390 - DNA, 67 bp, Mus musculus
atgtgcatgcctgtgtgtcaccctctgtcaaataaccagaagagggttgtgtatagtgttcccacgt

SEQ ID NO: 64391 - DNA, 75 bp, Mus musculus
cacagaagtcactctgcctctgtctgtagtgttgtcttcagtcactagggaggaatgactaagatgtgatttgtg

SEQ ID NO: 64392 - DNA, 85 bp, Mus musculus; identical to SEQ ID NO: 57439

SEQ ID NO: 64393 - DNA, 87 bp, Mus musculus
ctgaaatgagccgacagagatggaacaccacagtcaccccctctctcattgtctttggtgttatagctcttgtatctgacgttacag

SEQ ID NO: 64394 - DNA, 115 bp, Mus musculus
gagcttttgaaaatatgtatatctgtatatatacatatatatgtatacatatatatgtgtgtgtatatatatatatatatatacatatatatatatatatgacttttaaaatctt

SEQ ID NO: 64395 - DNA, 72 bp, Mus musculus
gtgatccacttaggggtaaagctggagattaaatgacatctaggagtctctggctcacacagtgtgatgcat

SEQ ID NO: 64396 - DNA, 80 bp, Mus musculus
ggtccctctggctagagagactgcagagagtgagggctcagtctgccaccttcccttgttattccctggcaatgggttcc

SEQ ID NO: 64397 - DNA, 85 bp, Mus musculus; identical to SEQ ID NO: 57470

SEQ ID NO: 64398 - DNA, 136 bp, Mus musculus
ctatttgctgctgttctgcatctgaccaaaccgatgttcattaactctgctcccatctggagagatgtctgagagctcatgggtgatttcataatgatgtggacctcttcctagtagacaggtggaagagagttag

SEQ ID NO: 64399 - DNA, 85 bp, Mus musculus; identical to SEQ ID NO: 57439

SEQ ID NO: 64400 - DNA, 85 bp, Mus musculus; identical to SEQ ID NO: 57439

SEQ ID NO: 64401 - DNA, 85 bp, Mus musculus; identical to SEQ ID NO: 57439

SEQ ID NO: 64402 - DNA, 111 bp, Mus musculus
tacatatcacctatagatatgtgtgtgtgtgtgtgtgtgtgtatgtatctaccttctacctatcattcatgtatgtatgtatgtatgtatgtatgtatgtatgtatgtata

SEQ ID NO: 64403 - DNA, 84 bp, Mus musculus
tcatatatacatatgtatatatctaaatattcatatgcatgtatgtgtgtaattgtctgtgtatctatatatgtgtatatatga

SEQ ID NO: 64404 - DNA, 111 bp, Mus musculus
ctgttcttgaaacaaaagctttgaaggattgacttcctgttcaaggtaaatatttttcgttttataaagagagtggaaagtgactctttcttagccctgtgttcctgacag

SEQ ID NO: 64405 - DNA, 85 bp, Mus musculus; identical to SEQ ID NO: 57470

SEQ ID NO: 64406 - DNA, 97 bp, Mus musculus
gtgtgtgtacatgtgatatggtatgtgtttatatttgtatacacaaatatgtgtatgcaaatttacacaaatatatgtgtgttataggtgtgtgtgt

SEQ ID NO: 64407 - DNA, 98 bp, Mus musculus
gtcttattagaataggtgtggcctctgtcactgtgtgggtgagcaatgtgaccctcttaaccacatgggacccagtcttctcctagcagccttaagat

SEQ ID NO: 64408 - DNA, 116 bp, Mus musculus
gctattctgagctgtggttggcttttgggctgcctgagttatggtccagactctcactcactaactgttctcagagttgcctcaactgcaaagtggctctagaacagattggttga

SEQ ID NO: 64409 - DNA, 89 bp, Mus musculus
gttccatgggctcatgtgataaagtttaggtcccatgtggcaatattaaaggatgatgacacttgagagtgtgagcctctgaatggaat

SEQ ID NO: 64410 - DNA, 68 bp, Mus musculus
gagacagctccggggcaagcgagagccgggcaggcactgggtgactctgtgcctcacggaggaaaatc

SEQ ID NO: 64411 - DNA, 80 bp, Mus musculus
ttggtgcctgggactgtttatggcactccaagataaactgcagaatgtttgaaggctgcccgaaactgttttagggccaa

SEQ ID NO: 64412 - DNA, 102 bp, Mus musculus
atggagcagttgtacagcttagtcttcaggtgggactcctaacactcaagctgtctctgactctgttgcctgcctttggatccctttcccctaactgggctg

SEQ ID NO: 64413 - DNA, 85 bp, Mus musculus
gaagtagttcatttacttagagaagagtcagagctgttttccgacagatgggagcagtcatcactgagcttctgtgtattatttc

SEQ ID NO: 64414 - DNA, 118 bp, Mus musculus
tctgtctttcagtctgtctgtgtgtttatcatctatctgattttttaaactaaattcttatattttattcttaatgacttctgactggcatgatatccatcacaactgggggtaaggg

SEQ ID NO: 64415 - DNA, 74 bp, Mus musculus
ggcagatacctacaagagccaactgacaggagcctgatatagctgtctcctgtgaggctctgtcagtgtctggc

SEQ ID NO: 64416 - DNA, 89 bp, Mus musculus
tgggaaatataggctaaggtagaagtcacaaaggcaatctggaatctcattcctttctccattgagactttctgctgcagcatttctta

SEQ ID NO: 64417 - DNA, 87 bp, Mus musculus
ttaggcactctctcagtctctgcttcatctttgtctctgtacttgttatatataggacatatttttggtagagggatatgtgtttgg

SEQ ID NO: 64418 - DNA, 99 bp, Mus musculus
ccatattcataagagaaattggtctgaagttctctatctttgttggatctttctgtggtttagatatcagagtaattgtggcttcataaaatgagttgg

SEQ ID NO: 64419 - DNA, 74 bp, Mus musculus
tgcatatgcacacacatacacacacatatatatgtatatatacatatatatatgtgtgtgtgtgtgtatacaca

SEQ ID NO: 64420 - DNA, 116 bp, Mus musculus
ggtaaaccacatcagtctacctttataaattatttccatcaaatataaaagacagccagctttccagaatctctgaaggggataatgacctagtactggtgttgaacattttcacc

SEQ ID NO: 64421 - DNA, 72 bp, Mus musculus
attactgagtgtgtatatgtgcatatgtgcatgtgtttacatgtgtgtgtgtatacatgtatatttattaat

SEQ ID NO: 64422 - DNA, 81 bp, Mus musculus
tttgtgtcctagtatgtgttcagttttatatctttatatccatggggtgaagagaaaaatgaatttattttggggggtaaa

SEQ ID NO: 64423 - DNA, 102 bp, Mus musculus
ctctcacacatacacacacacacacatatatatgtatatatatatatatacatatatatatatatatatacatatacatgtatgtatatggatatttgagtg

SEQ ID NO: 64424 - DNA, 85 bp, Mus musculus; identical to SEQ ID NO: 57439

SEQ ID NO: 64425 - DNA, 114 bp, Mus musculus
gtagctttcttccttcaatgtgtatggcactaacaacaaaagtaggatcaaggaaagaattagtaattcaatttttttaatgacacttagatatgacaatggagcaagtggcac

SEQ ID NO: 64426 - DNA, 85 bp, Mus musculus; identical to SEQ ID NO: 57439

SEQ ID NO: 64427 - DNA, 78 bp, Mus musculus
gctgtgagcatctgcatctgtatttgtcaggctctggcagagcctctcaggagacaggtgtatcaggctcctgtcagc

SEQ ID NO: 64428 - DNA, 83 bp, Mus musculus
cacacatacacacactcactcacacatgcatgccagtatgcacgtgcttgtgtgtgtgtgtgtgtgtgtgtgtatgtgtgtgt

SEQ ID NO: 64429 - DNA, 74 bp, Mus musculus
atatacatatacatatacacacatatatgtatgtatacacacatatgtatatgtatgtatgtatatatgtatgt

SEQ ID NO: 64430 - DNA, 93 bp, Mus musculus
tgtaatcagtttactggccacataatctctaccaatacaagagtatattctatattacttttgtatattaggtgttcagcatagtctgataca

SEQ ID NO: 64431 - DNA, 93 bp, Mus musculus
tataacaagcgtggttgtgtggatttagattcttctgagtacattcacagaaatacaatatctggatctgcaagtggttctattgcttttata

SEQ ID NO: 64432 - DNA, 85 bp, Mus musculus; identical to SEQ ID NO: 57470

SEQ ID NO: 64433 - DNA, 96 bp, Mus musculus
ctgaaccagtaaggcccttaactattctgtgcattaatatatctatttctatcctgtgactcctatgacatagatgtttttgagggactgagttag

SEQ ID NO: 64434 - DNA, 85 bp, Mus musculus; identical to SEQ ID NO: 57439

SEQ ID NO: 64435 - DNA, 136 bp, Mus musculus
gtgggtatgaatgtgaatgtatatatgtatatgtgtgcatatatgtgggtttaatttgtgtgtgtatatatatatacatatatatatacatatacatatatacacacacacacacttacatatatacatatataca

SEQ ID NO: 64436 - DNA, 103 bp, Mus musculus
ctacaggaatatgcacaaatgtttcttagaaaaacccttaagtctgttaacaaaatattttgttttgtatcaagataaagtttagaaacagtatatttctgag

SEQ ID NO: 64437 - DNA, 87 bp, Mus musculus
tctattgcttttgttgactgttatacagacttccttcctcagggaagttgaagcttgtaaagtagtcagtgatgatcaagtgacaga

SEQ ID NO: 64438 - DNA, 113 bp, Mus musculus
ggaattcatgagcctgaaggaagggaactagattaaattacttgaaaaaattctatatgtttttaaccatctaatttgtatagctgctgtgaagtctaaaaggcatgagctct

SEQ ID NO: 64439 - DNA, 97 bp, Mus musculus
atgttatattgaaatatatatatatatgcatatatacatatatatatatgcatatatatatgcacatatatatgcatatatatttggaatggaatgt

SEQ ID NO: 64440 - DNA, 76 bp, Mus musculus
ggaggaagtgtcccactgggggtggctaaagggtttcagaagctgaagccagattcagtggctctctgtctcttcc

SEQ ID NO: 64441 - DNA, 80 bp, Mus musculus
tgtagaaatgaagggacttataagacagtgctgccagtttcaaaaactgtctctttgtctctgtatctccttctctctca

SEQ ID NO: 64442 - DNA, 101 bp, Mus musculus
tgctaggctcaccgaagaatgcaataaaaatgatagtatcattatatatgaaacattgtatactatgatacctgtcttcattttagtgtgtggtctatgta

SEQ ID NO: 64443 - DNA, 116 bp, Mus musculus
gttcaatttgtcaatgtgtggagaattggatcagttgagagtcagttcagtgagtgcagtgcactggagctgagcttgcttgtgagttcatatagttcagagcagggcaacagagc

SEQ ID NO: 64444 - DNA, 105 bp, Mus musculus
cagggaatctagcattactagttgggttatagtgatgttagatagctgaagttcattctttatttatatagccatgactcaatccagatagcattcttttctttg

SEQ ID NO: 64445 - DNA, 85 bp, Mus musculus
ggccatggtggtctgataggatacatgggacaatttcaatatttttgtatctattgaggcctgttttgtgaccaattttatggtc

SEQ ID NO: 64446 - DNA, 83 bp, Mus musculus
gtgtacttacatatatagaatacatgtatgtagatatatttattatatgtgtatatccactatgtatgtatgtatgtatgtat

SEQ ID NO: 64447 - DNA, 85 bp, Mus musculus; identical to SEQ ID NO: 57439

SEQ ID NO: 64448 - DNA, 101 bp, Mus musculus
agaagatgacgtggcaaaagaacaagatgacagttgtaaggctggaccacaactggttgggcctgcattgaaaacatcagctaaagggcatggatactttt

SEQ ID NO: 64449 - DNA, 112 bp, Mus musculus
acaagcagattagggaagtttatttctaaaagttctgacaagtgagtgtccagagaccaatctgctgctgattctgttcctagttttatagtttccatcatggtttgcttgt

SEQ ID NO: 64450 - DNA, 102 bp, Mus musculus
tactgcttttagtattctgtctttatttagtgcatttgttgttctgattattatatgtcaggagcaatttcttttctggtacagtctatttggagttctgta

SEQ ID NO: 64451 - DNA, 95 bp, Mus musculus
ctactatgatattaaaagttaaatataaaaatgtttaatttttcttggagaaagtagacattttgttgtagatgtaatagaatagcttatagtgg

SEQ ID NO: 64452 - DNA, 117 bp, Mus musculus
taaatatattttctgtgttttgtcctctatacacaatataaatatacatatatatatatatacatgcatatatatatatgtatatgtgtgtatattcataaaaatagtttacattta

SEQ ID NO: 64453 - DNA, 85 bp, Mus musculus; identical to SEQ ID NO: 57470

SEQ ID NO: 64454 - DNA, 99 bp, Mus musculus
gtatatatatatgtctgtgtgtatatatacatatatatgcatatatatgtgtgcatacatatatatatatatatatatatatatatatatacatatata

SEQ ID NO: 64455 - DNA, 81 bp, Mus musculus
gaactctgactctcacagtctttctacccagtcctctgcagaggtctctgagccctggagagggagtgtgaaacagatgtc

SEQ ID NO: 64456 - DNA, 78 bp, Mus musculus
tatatatgtatatatccatatatctatagatatctctctatatagatctatatatgatgtaggatgtatatttatata

SEQ ID NO: 64457 - DNA, 85 bp, Mus musculus
gtccatggtgatctgataggatgcatgggacaatttcaatatttttgtatctgttgaggcctgttttgtgatcaattatatggtc

SEQ ID NO: 64458 - DNA, 92 bp, Mus musculus
ggtacagttgggacttctgggatgtagtagtttgaatagtaatggtccccatacatttaaatgcttgggcttggtccccagggtattgtact

SEQ ID NO: 64459 - DNA, 75 bp, Mus musculus
gggggttatggtagataagtacattaaatttatttgatactgaaaacaaatttaatgtgaagcttcatagcttct

SEQ ID NO: 64460 - DNA, 57 bp, Mus musculus
tcccatgtggcattgaagtcagaagggtgacaccagaggacttaagtgtctgtggga

SEQ ID NO: 64461 - DNA, 61 bp, Mus musculus
atgtgtgtgtgtgtataatatatgtgtgtttatatatatatatatatatatatatatatat

SEQ ID NO: 64462 - DNA, 98 bp, Mus musculus
agatgaacattttctctcatgtattaaccatacatttggaatgtatatctatatatgtatgtttaggacagaaaagcagaagagagaggagaatatct

SEQ ID NO: 64463 - DNA, 79 bp, Mus musculus
tctgagaatgctgggatacaaacaaagtaatatctctatattgcgaactctctttctgtgtggctcagtagcgttcaga

SEQ ID NO: 64464 - DNA, 98 bp, Mus musculus
tatgtatgtgtatgtgtatgtgtatatatgtacatatatgtgtatatatatataaatatatatatatatatatatatatatatatatatatatatata

SEQ ID NO: 64465 - DNA, 61 bp, Mus musculus
gacaatgaggtcaaattaagaaatggggctgagtacaactcacccacagtgactcattgtt

SEQ ID NO: 64466 - DNA, 81 bp, Mus musculus
gagcatagtgtcagaagactgagagcttccaaactactctttgtaatcttgggagtttgagatgctgtatataaaatgttt

SEQ ID NO: 64467 - DNA, 72 bp, Mus musculus
gtctcggatgtgtcgctccctgattggctgcagcccatccgccaagttgtcgtcacagggaaggcagagcac

SEQ ID NO: 64468 - DNA, 115 bp, Mus musculus
tggataacctcaggctttgttcttcactcctacctgggttgagacagattctgtttggtattctttagctctgtacaccaggcttggaggcctgagagcttcttggggttcttca

SEQ ID NO: 64469 - DNA, 66 bp, Mus musculus
tgtctgtctgtctgtctgtctgtctatctatccctaatagatagatagattataggtagacagata

SEQ ID NO: 64470 - DNA, 83 bp, Mus musculus
gtctgtctgtctgtctgtctattacttatctgtctacctataatctatctatctattagggatagatagacagacagacagac

SEQ ID NO: 64471 - DNA, 77 bp, Mus musculus
gacatagggactcttgtctggatcctggagactctgaccccacatcaacaggaaggactcttagcagtctgtgtttc

SEQ ID NO: 64472 - DNA, 71 bp, Mus musculus
ggaaatggctcaccttgtacttgaattataaaacccttcagttataaaattcagacaagtcagtgagctcc

SEQ ID NO: 64473 - DNA, 68 bp, Mus musculus
tatgtatatatatatatatatatatggtttatttcatatgtatgtatacacacacatatatatatatg

SEQ ID NO: 64474 - DNA, 76 bp, Mus musculus
gtccactattgtcctgaggcctgagcgaggggctcctctcggagtctctcagtgtcagaatcctctgggactggac

SEQ ID NO: 64475 - DNA, 85 bp, Mus musculus; identical to SEQ ID NO: 57439

SEQ ID NO: 64476 - DNA, 117 bp, Mus musculus
cacgatatacatacatatacatgtatatatatatatatgtgtgtgtgtatgtatatgtgtatatgtacatgtatatatgcatatatattatatacacatatatatgaaatatatatg

SEQ ID NO: 64477 - DNA, 59 bp, Mus musculus
catacacacacacatatatatatatatacatgtatatgtatgtatatcgtggtggtttg

SEQ ID NO: 64478 - DNA, 72 bp, Mus musculus
tctctgagactcagtgtgtgaggtgattttcggggtcataaccggaaccaactcaaacaaaagctctagaga

SEQ ID NO: 64479 - DNA, 70 bp, Mus musculus
gcatgtgtgtgtgtgcatgaccatgtgtgcctgtgttcatgtgggtacatgtctgtaagctgatgcatgt

SEQ ID NO: 64480 - DNA, 140 bp, Mus musculus
ttttggggggggggcgttgtttgtggtcttttgttttgttttatttttgttgttttgaggcagagtctctctgtgtgtaacagtcctgagtgtcctggaacttctatgtagaccaggctggcctccaattcacagagatc

SEQ ID NO: 64481 - DNA, 102 bp, Mus musculus
cagattgttggcactggcatgaaagccagaaataggatacgttaggtatttaaaattatctatctatctatctatctgtctgtctgtctgtctgtctgtctg

SEQ ID NO: 64482 - DNA, 82 bp, Mus musculus
tctattatgcaactttaaacatgtggtggattctttactgatgacagtgagcatttagctgtgtcgggggttgtgaaaagga

SEQ ID NO: 64483 - DNA, 93 bp, Mus musculus
ttttgtttttgagacagtctttctgtgtctccctgactatcctgggattcactatgtagaccaggctggcctcagactcgcagagatctgtct

SEQ ID NO: 64484 - DNA, 101 bp, Mus musculus
ccctttcctctgagtcttcttgaattttatgttgccagtgtgtagagagtgatcactaaataccactgtgggaatgtcttccagaagtttactggggaggg

SEQ ID NO: 64485 - DNA, 119 bp, Mus musculus
gtatgaacatttcccttgcctggaaaaaaacattatggtagaattctgtataagtaacttaattgttatttattctatggaagaaacaactattatagccaggcagtggtggcgcatgc

SEQ ID NO: 64486 - DNA, 89 bp, Mus musculus
acttatgtaatatacatgtgtatgtatgaatgtatgtgtgtataccggaatatacgtgtgtgtgtgtgtgtgtgtgtgtgtgtgtgtgt

SEQ ID NO: 64487 - DNA, 68 bp, Mus musculus
atataaacatatatgtatatatatacacacacacatgtgtgtgtatgtatgtacatatgtatgtatgt

SEQ ID NO: 64488 - DNA, 114 bp, Mus musculus
gtgcgtggttgtctgtcagtcagtccctggccgtgtggctgctggcacgcgactccaaggcactccagttaaagccgagctgcttgtggttcagtggctgcgtgtctggcacac

SEQ ID NO: 64489 - DNA, 68 bp, Mus musculus
atatattcacatgctcgaggccctgggttcaatccttagtgccctcccctctgtgtgtgtgtgtgtgt

SEQ ID NO: 64490 - DNA, 68 bp, Mus musculus
gtgtgtgtgtgtgtgtatctatgtgtatatgtatgtatgtgtatatatatgtatgtgtatatatatac

SEQ ID NO: 64491 - DNA, 113 bp, Mus musculus
ttctaccatagacggcaaatataggtaaatttattactctatttcatgttgtcttacagctgaaattcttgtcatgtttatgcatgtgttaaatgtctagtctacatttagaa

SEQ ID NO: 64492 - DNA, 132 bp, Mus musculus
tatatatgtatatgtgtatgtatgtatgatgtatgtatatacacacacatatatttgtataggtatatatgtattttatatatacactatgtatgtatgtatgtatatatatgcgtgtgtgtgtgtgtgtag

SEQ ID NO: 64493 - DNA, 98 bp, Mus musculus
gtgtgtgtgtgtgtgtttgtgtgtgtgtgtgtgtgcatgtttatacgtgtatgtatgtatgcatgtatgtatgcatgcatgtatgtatgttgagtgag

SEQ ID NO: 64494 - DNA, 115 bp, Mus musculus
gactgtagcatccttgggccaatgttgtttccttcatagcagggattagaaagtcacacacagagactctcatccagtgcttgagaaagaagattcctcctcccttttgctcttc

SEQ ID NO: 64495 - DNA, 90 bp, Mus musculus
cttaggtaacttggtaccaagctctgagtcaacagagagagcacataatggctcttgctacgatttgagtatggcatgtggactccaaag

SEQ ID NO: 64496 - DNA, 117 bp, Mus musculus
gacttgaaaaagcccttagggtctcagatatatatatatatatatatatatatatatatatatatatatatatatatatatatatatatatatcacagacttgtagatttttctgtc

SEQ ID NO: 64497 - DNA, 114 bp, Mus musculus
taattaaattatgttgtatcagatagcgtatttcacacgattttgttagtattcaagtatgtataactaacattaattctgtggtaaacatgactgaatataccatacagattg

SEQ ID NO: 64498 - DNA, 109 bp, Mus musculus
tctgtgtgataagatgtctctgatgtatgttcttgtatttttcttatacattatgaaatgttcctaaagtgtgtatgtattgttttatgggatgacttattgtatgaga

SEQ ID NO: 64499 - DNA, 109 bp, Mus musculus
ctacaaattcagaaaagcatttatggtaaacaagaaagagaagagtgtgtccacattggacacagatcgtctctctccatcttactacaagaactctgcttttgtccag

SEQ ID NO: 64500 - DNA, 121 bp, Mus musculus
tatatgatgtatatgtatatgtatatgatgtatatgtaaacatataatatagtaaatattaaattatatattatatgttaaattatatattatatataatatgttatacatataatacata

SEQ ID NO: 64501 - DNA, 109 bp, Mus musculus
ctatctatccataaatatctggttggcaatctttgtatttttttttccatttgcctcaggaggaagcatctctgaagatggctaattgagtatggcgggatattattag

SEQ ID NO: 64502 - DNA, 109 bp, Mus musculus
ggtttatatatatatatgtacatacacacacgtatatattacaattataatatattgtttaaaatactgcatatatgtttgtatatatacatatgtacatgtttaaacc

SEQ ID NO: 64503 - DNA, 105 bp, Mus musculus
atctaattcagataaagtagtcaggactctgaaatacaaaaatccaaacatatgccgtaacattttttttttttccagtgctggctcctttaacatggattttgt

SEQ ID NO: 64504 - DNA, 67 bp, Mus musculus
gctaaacaacagtggtaagttccctcttcaggcctctcccaagagtggatttttgactgggtttagt

SEQ ID NO: 64505 - DNA, 69 bp, Mus musculus
gtgtgtatatgtgtatattatgtatgtatatgtatatatctgtatatatgcagatatacatggactcat

SEQ ID NO: 64506 - DNA, 95 bp, Mus musculus
gatgaaaagtttgtcatggatatctagtattttacatagaaattttattttcttatagtgagaactcagaaacttctagtgatagaatgtttgtc

SEQ ID NO: 64507 - DNA, 110 bp, Mus musculus
ttgaagatcagccttagtccatggtgatctgataggatgcaggggacaatttcaatatttttgtatctgctgaggcctattttggaaccaattatgtggtcaattttgga

SEQ ID NO: 64508 - DNA, 84 bp, Mus musculus
aggaactggaatgcagagttcattgtctttgtctcactccttgtgatcacggtgaccccagatgcagaattcacaccagtctct

SEQ ID NO: 64509 - DNA, 88 bp, Mus musculus
tctttctgatgtttggcagtttcagtttgatcacatgaattcagattttgattttatgtatcatgactgatacttgtttgtctgagga

SEQ ID NO: 64510 - DNA, 132 bp, Mus musculus
atatgccagacactgttttactcaccttaaatgtgttaataatttactttcatcctaactctgtctgtatgtgtgtgcatgtgtgagtatggtgtatgtggtatgtggtatataattatgggggtgcataac

SEQ ID NO: 64511 - DNA, 93 bp, Mus musculus
cactattgtggatgtcaacaagttcttactggcaggagcctgatatagctgtcccctgagaggctctgtcagtgcctgagaaatacagaagtg

SEQ ID NO: 64512 - DNA, 102 bp, Mus musculus
aaggtagctgccccagacactcctgtgattttagtcagtggtctgccagtgtctgtctcttaccttaatttgctttaagtggatcctagacacttacagcca

SEQ ID NO: 64513 - DNA, 73 bp, Mus musculus
gcataataatggtgaatggcgagtgcgtgtgtgtgcacacacacacacactcacagtttatggattcaggtgt

SEQ ID NO: 64514 - DNA, 74 bp, Mus musculus
agccagtctctctgtcagagacagatctgcttgctacgtacaagtctgtgtttcgagaggagactagataggct

SEQ ID NO: 64515 - DNA, 113 bp, Mus musculus
taaagtgtttgaggctgtgttcctaagatacgtgagtttatttctttataatcacactgctatacaaagaaatacattttgaatcttaaaaatttaaacacgtaaacatttta

SEQ ID NO: 64516 - DNA, 80 bp, Mus musculus
tggactcacggactggagagatggcttaggggttaagagcactgactgctcttccagaggtcctgcgttcaattcccagc

SEQ ID NO: 64517 - DNA, 75 bp, Mus musculus
caggccacagtgtcagtccctgtctcaaacaaccaacatcagaaagagtttagggccaagaaacactgtagcctg

SEQ ID NO: 64518 - DNA, 81 bp, Mus musculus
gtatatgtatatgtatatgtatatgtatatacacacacatatatatatgtatacatatatatacacatatatacatatata

SEQ ID NO: 64519 - DNA, 241 bp, Mus musculus
gaagatatgtatatgtgtgtatatatatgtatatgtgatatatatcatgtataaaacatatatatttatattcattatatatttataatatattaatatatgtgtatgtgatatatcacatataaaacatatattactatatgtatatgtgtatacatgtatatatatgtatatatgtgtatatatatgtatacatatatatatgtgtgtgtatatacatatacatatacatatacatata

SEQ ID NO: 64520 - DNA, 85 bp, Mus musculus
ggctgagacttgcgtcacaggcagctttgtggagcacagtaattaaagcgtcctccaaaggcttctgtcagaagcttgttgttcc

SEQ ID NO: 64521 - DNA, 60 bp, Mus musculus
tctcgctgtgctccaactccagggagagcggatgcctctgatgtgtgtgagcataaggga

SEQ ID NO: 64522 - DNA, 91 bp, Mus musculus
tgcaggcagccttagacgctgagagaccctgactgtgtggctccatcacatccagaagacagcgtttcacagcccctctccccagccccca

SEQ ID NO: 64523 - DNA, 76 bp, Mus musculus
ccaaagaaagcaaaaagagaaacagtaactagcctggcaacagccatcctgtcagactgtgtccctctgactttgg

SEQ ID NO: 64524 - DNA, 89 bp, Mus musculus
ggattcaccctggtccatgcttcccctgggagcaggctcccgtttggaaactctcaaagactctcagatagcaccaccagctggaatcc

SEQ ID NO: 64525 - DNA, 76 bp, Mus musculus
gcactggggaggttgaagcttcacctattgctccaagattagcggttctgtgaccctctcacgctccctagcttgc

SEQ ID NO: 64526 - DNA, 85 bp, Mus musculus; identical to SEQ ID NO: 57439

SEQ ID NO: 64527 - DNA, 78 bp, Mus musculus
ctgcctcagtcagtcagtgttttgtgatgcttgtaagaatgagagtataataaaacacaatctcagacactgatccag

SEQ ID NO: 64528 - DNA, 114 bp, Mus musculus
gcatctcagccgcacactcagaaacctttttatgcagggtgcataaatgcatgtgtgtgtgtgtgcatttgcatgtgtgtgtgtgtatgtctgtgtatgtgtgtgtgcatttgc

SEQ ID NO: 64529 - DNA, 68 bp, Mus musculus
aggcagacacacacagtgagtaacttagttagtagtactaagtcagtacttctgggtcaggtcagtct

SEQ ID NO: 64530 - DNA, 90 bp, Mus musculus
cagacctgagaatggagagaccacagaggacctggtatgtcaagctaagtcagtttctaaatgtgtgccatctccggaggacttaggctg

SEQ ID NO: 64531 - DNA, 77 bp, Mus musculus
ttggtgagggtgtggtcatgcttatttatttttcttcatgaaactatgaatgtagtattcactctactttataccag

SEQ ID NO: 64532 - DNA, 85 bp, Mus musculus; identical to SEQ ID NO: 57470

SEQ ID NO: 64533 - DNA, 74 bp, Mus musculus
gtttcttccaatggaggatgtgctagatggttctatgttaacatgcaacctagagttatttgaaaggagggaac

SEQ ID NO: 64534 - DNA, 85 bp, Mus musculus; identical to SEQ ID NO: 57439

SEQ ID NO: 64535 - DNA, 92 bp, Mus musculus
tttttcacatttttatctatttatctcattgtatgtgggtgtgcaaatgcatgcacatacaagcccccgtgtgcaggtggaagtcagagaag

SEQ ID NO: 64536 - DNA, 76 bp, Mus musculus
ctaaggtgggtgtgtctgtcactctgagacagcacagcatattctgagtcgagtaataggacacattcacacttgg

SEQ ID NO: 64537 - DNA, 96 bp, Mus musculus
ttttgctaagagaatgcagacagcattcgggatcaaaccacaaggattagtttcaaagtctgtgaggttatgtggatgtctgttattttctcaaga

SEQ ID NO: 64538 - DNA, 93 bp, Mus musculus
aaagtattgcaaggggactctgggctagtgggctgtcaggggttggggggccaagacacagacactatctcactctcctctgcatttgacttt

SEQ ID NO: 64539 - DNA, 85 bp, Mus musculus; identical to SEQ ID NO: 60314

SEQ ID NO: 64540 - DNA, 93 bp, Mus musculus
acaaatcacagataacggaagcgtagatcaagtcttgatttttattacttaaaaaatgtgcatatctattttgctttctgactctgtgcttgt

SEQ ID NO: 64541 - DNA, 68 bp, Mus musculus
tgtggttaccactccctgtatttgtctgtctgtctctgttggtagcttcaagtgcagattggtacaca

SEQ ID NO: 64542 - DNA, 118 bp, Mus musculus
tggagctactgaagtaatggcagtgttaatacaaactttaattgttacatagtttaaatttaaatacactagctgacatattttacatgatctcttaacatttctattcagtatttca

SEQ ID NO: 64543 - DNA, 73 bp, Mus musculus
gtatgtatgtatatatgtatgtatatatgtgtgtatgtatgtatgtatgtatatatgtatgtatgtatgtgta

SEQ ID NO: 64544 - DNA, 81 bp, Mus musculus
gcatgtgcgtctgtgtgagtgtgtgtatgtgttgcacgcttgtctgtgtgtgtgcctacatgagttcacgagtgtgcctgc

SEQ ID NO: 64545 - DNA, 60 bp, Mus musculus
gtatatgtatgtatgtatgtatgtatgtatgtatgtatgtatgtatgtatgtgtgtgtat

SEQ ID NO: 64546 - DNA, 78 bp, Mus musculus
tatatatgagtatatatgtgtatatgtatatgtatatgattgtgtgtgtgaatatgtgtgcatatgtatgagtgtgtg

SEQ ID NO: 64547 - DNA, 74 bp, Mus musculus
ttgtcatcagggggctggagagacggctcagctgtcaagggcactgactgctcttccagaggtcctgagttcaa

SEQ ID NO: 64548 - DNA, 86 bp, Mus musculus
acattttgggaacatctgctgattttttttttaaaactggaaagtaagatttacctgaatgaagaagcagcagatgtcacctttgt

SEQ ID NO: 64549 - DNA, 101 bp, Mus musculus
gtccatgttgcttattgctgccattacttcagaggaatgttctgtgagtcagtagaaaatacctgtcgcaggctaacctcttgtgatccgtgagagtgggc

SEQ ID NO: 64550 - DNA, 103 bp, Mus musculus
tgcacttgcagagtccgtacagacaggaaagggcgagccagtgactctccctgtctctctggctggccacctcgttctgtctgtgcgtcctgtccatacagca

SEQ ID NO: 64551 - DNA, 82 bp, Mus musculus
cagaggaggcatgtcacttggggtgggctttgaggtttttaaaagaacccatcaggcccagtgtctctctctgcctcctgtg

SEQ ID NO: 64552 - DNA, 78 bp, Mus musculus
tcctcctcacctctgaggctctcagttactcaagagtcttctggtcaggggtggtttggactccttgagaactgtgag

SEQ ID NO: 64553 - DNA, 117 bp, Mus musculus
gaaagagggcagaagcaggagattcagagaacagacatggagggaacagacagagtacagagtacagactgaccagatgaccacatggttggctctgaacctttctctgctcaggtc

SEQ ID NO: 64554 - DNA, 117 bp, Mus musculus
gttgccttggtcatggagtctgttcacagtagtaaaaaccctaactaagacactcactgtttctcaaagggatctttaagggttggggataactcagtggttgagtattgacctaac

SEQ ID NO: 64555 - DNA, 72 bp, Mus musculus
ttatataaattgatatacatatgcatatgcatttttgctgtgtgtgtgtgtgtgtgtgtgtgtgtgtgtgag

SEQ ID NO: 64556 - DNA, 73 bp, Mus musculus
gacagttggcccacagggagcactctgaccccaggactcaggaggtggatcagagctctgttctgtggctgtc

SEQ ID NO: 64557 - DNA, 78 bp, Mus musculus
cgaagtctctcactctctgtatactgcccagttgtgagtctctgtgttaatcaccagttattggagggagaagctttg

SEQ ID NO: 64558 - DNA, 95 bp, Mus musculus
gagatctccatctaatccttactgaagcagaagtgctcaggggtgacaggacacagagcacagtttggagttttcagaggaatggagagctgttc

SEQ ID NO: 64559 - DNA, 111 bp, Mus musculus
ctcagtgatagccaagggagcccaagtgacaaaagggggcgtggcctcaggtttcagcctcgctcagactatgcctcttagctgaaatccgccatctatcacaaatctggg

SEQ ID NO: 64560 - DNA, 131 bp, Mus musculus
gtatgtgtgtgtggtgtgtgtatatgtgtatatattgtgtgtgctttgtatatgtgtcttgtgtgtatgatgtactgtgtgcatatgtgtatatgtatgtatgcatgtatgtatggtgtatgcatatatat

SEQ ID NO: 64561 - DNA, 117 bp, Mus musculus
gctaactcagcatgtagacaacggcacttcagagaacaggactgcattggacacccagctttcatgagctttctctccacccttctcttgttactgttcctaacgctagatcaaagc

SEQ ID NO: 64562 - DNA, 103 bp, Mus musculus
ggtgtccttctccctggtggattcagttgacagaacagagagatttcctttgacctggagtgtcctgtaagctctcttgtctgcgttccctgataggatttcc

SEQ ID NO: 64563 - DNA, 67 bp, Mus musculus
tctgtatttgaacacatggtatggtgagaagagaatctatctcacacactctgttttcttctacaga

SEQ ID NO: 64564 - DNA, 83 bp, Mus musculus
tgtatatatgtgtgtgtatgtatatatgtgtatgtatgcatgtatgtatgtatgtatataagtatgtatgtatgtatacatac

SEQ ID NO: 64565 - DNA, 106 bp, Mus musculus
gtattatatatgttatacatatatatctgtatatatgtacatgtatatctgtatatatatacatgtacatatatgcaaatatacatttatacacatatacaagtat

SEQ ID NO: 64566 - DNA, 66 bp, Mus musculus
acacaccataatgaatagaacagagaaacagtttttctctctctctctctgtgtgtgtgtgtgtgt

SEQ ID NO: 64567 - DNA, 85 bp, Mus musculus; identical to SEQ ID NO: 57439

SEQ ID NO: 64568 - DNA, 96 bp, Mus musculus
gctgggtgctagtaccagcatttgactctttcagctacttgttgtgcctctcggagggcatcaacgcttggctcctgtctgcaagtacaccacagc

SEQ ID NO: 64569 - DNA, 72 bp, Mus musculus
tcatcacatagaacagtctcagctctgagcctggctctttcaggcaggatttgttggcattctatggaatga

SEQ ID NO: 64570 - DNA, 115 bp, Mus musculus
tagtcacacatgactgttatataagttctgagaaatagacttctgattatgtccttctgattattattaaaatctgttttggtcatcttatagatgcctgttctactgtggagta

SEQ ID NO: 64571 - DNA, 79 bp, Mus musculus
cacacacacacacacacacacttctttaaggctgaaatttctaatctcctctccccatctgtctgagtgtgtctgtgtg

SEQ ID NO: 64572 - DNA, 113 bp, Mus musculus
tttgaatattttgtagctgtattttaattcagtgctatatatatatatatatatatatatatatatatgttttagttttattggattggagtcagaagttacatgctgttaaa

SEQ ID NO: 64573 - DNA, 112 bp, Mus musculus
ggggcacagacattcattcagcttgagtttccatatcactgttcatcactgaaggaagtcaggacaggaacctggaggcaggagctaagacaaaagcaatgaggagtgctgc

SEQ ID NO: 64574 - DNA, 109 bp, Mus musculus
tcatgttgagcatcaaaaagttatacatggccaagcatggtgggtgcctgcctctaacccagcactaaggaggcaaaaccagggttgatatgtttgagatcagctaggg

SEQ ID NO: 64575 - DNA, 94 bp, Mus musculus
tccatttttttacattttactgtgtgcgtgctggtttgtgtgcatgtgtttgtgcaagtacatgtgcatatgtataccagtggtgtgatgtgga

SEQ ID NO: 64576 - DNA, 112 bp, Mus musculus
atgtttgctatgtgagcaaagtcagatttaaaatgctgtctctcttgaagcccttttgtcttgataggaatgatggctgcttaggtctactgaatctccaatgtttgaacat

SEQ ID NO: 64577 - DNA, 90 bp, Mus musculus
aacgcagttatgggtaggagatggggaggcttgacagtcctgtgtgtccaaacatctgtgctcactcagtctctgcctcttgacagtgtt

SEQ ID NO: 64578 - DNA, 103 bp, Mus musculus
tagaagcttcccattttctgtcttttgagagataatggcaaacatctttatatacaatctctgtctgtgcctctgtcatctcagatgctgtgggcctcatctg

SEQ ID NO: 64579 - DNA, 63 bp, Mus musculus
ctggcacgggatcaaggtgacctcctggggcatctcctgaggatcacactgtctcacagccgg

SEQ ID NO: 64580 - DNA, 66 bp, Mus musculus
aactcaaaagtagcagctgcctgtaatccagctacttgggaggatgaggtagaagcatcatgagtt

SEQ ID NO: 64581 - DNA, 93 bp, Mus musculus
tgttctggttctagatgaaggcatgagaagagaacccgctctgtgggtctctgtgactgttcatacggggcagtgaggaagggaaggagagtg

SEQ ID NO: 64582 - DNA, 65 bp, Mus musculus
atgaggtgtcagtgtcactgacacagtcacacacgtggctgctgtgtggtgatcactgccttcat

SEQ ID NO: 64583 - DNA, 80 bp, Mus musculus
ggagtgggtgtgtccctgtgtgggtgggctttaagggctctatgcttaagctccacccagtgcagatgagagcctcctct

SEQ ID NO: 64584 - DNA, 78 bp, Mus musculus
aggtggggggtggtgtgggggggatgcatgcaccagggttgtgtctggtgcctacagaggacatcatgccctggtcct

SEQ ID NO: 64585 - DNA, 133 bp, Mus musculus
ggagtgtgtgtggaagacactgaagtgtgtgtgatctcccaaagcaggtaagggagcttcaagctctctctctctctctcttctttctacacctcttttcttccatacctctctttccttcttacagtttctt

SEQ ID NO: 64586 - DNA, 85 bp, Mus musculus
ctccccggggagcctgagaccagggttcattccccagggctcctcctagcgaggctcccaggtaagatgagaagcctgtccaggc

SEQ ID NO: 64587 - DNA, 121 bp, Mus musculus
agtaacctggaacttgataggtaggttgggctgcttggcccgtgagccccagagatctgtgtgtctgactcccggcactgcacagcaccatgctttgccttttacaaactaggttctgagg

SEQ ID NO: 64588 - DNA, 62 bp, Mus musculus
accacagagttggaaatggaatggcaacaggagactgcaggctgctgcttgttctttgtggt

SEQ ID NO: 64589 - DNA, 78 bp, Mus musculus
gtcttggaacttgctctgtagaccaggctggtcttgaactcagaagtctgcctgtctctgcctcccaagtgctgggat

SEQ ID NO: 64590 - DNA, 83 bp, Mus musculus
catgggacaatttcaatatttttgtatctgttgaggcctgttttgtgaccaattatattgtcaattttggaaaaggtcccgtg

SEQ ID NO: 64591 - DNA, 106 bp, Mus musculus
ctaagaacaagactaatttctttttcttttgctgctgagactgccagactcactggaaataacaatagccagtggcaagaggaatgggggataagatttcatttgg

SEQ ID NO: 64592 - DNA, 184 bp, Mus musculus
cagtgacctttgtgtatatatatatatatatatatatatatatatatatatatgtatatatgtatgcatatatgtatgtatgtatgtgtatatatgtatgtgtgtatatatgtatatatgtatgtgtatatatgaatatatgtatgtatgtatatatacacacatatatgtatatataatatac

SEQ ID NO: 64593 - DNA, 74 bp, Mus musculus
agggtaaatgtatgagctttgaaattacagatctattgtgtattagctgtgtatttcaatttatcatttagcct

SEQ ID NO: 64594 - DNA, 102 bp, Mus musculus
aaaaatagtaattaaccccttgtgttttctctaagagggcaatgtatccactgatttattgttcttcatattaagacattggatctttagtgaattattttt

SEQ ID NO: 64595 - DNA, 67 bp, Mus musculus
gaggcagaagctgtggaggaatgctgcttgctggcttagtgtctggctcactcacaagttctgcctc

SEQ ID NO: 64596 - DNA, 66 bp, Mus musculus
aaggtcaggcagaggtctctaagtttaaatttcagagttcagccttgacactctctgtgtgacctt

SEQ ID NO: 64597 - DNA, 92 bp, Mus musculus
atatgtaggtatatatgtatatatttatgcatggatggacggatgcatgtatatatgtgtgtatgcatgtatttatatgtatatataatcta

SEQ ID NO: 64598 - DNA, 94 bp, Mus musculus
gcttgatatatatgatatgtatgtatatatatatatatatatatgtgtgtgtgtgtgcatatatatgtgtatatatatgtgtgtgcatatatat

SEQ ID NO: 64599 - DNA, 94 bp, Mus musculus
gtatgtatgtgtgtgtatatatatatatatatatatatatatatatacatatatatatgtgtgtgtgtgtgtatatatgtatatgtatatacac

SEQ ID NO: 64600 - DNA, 66 bp, Mus musculus
gtgtgcatgtgtatgtgtgtgtttatctatatcattatatgcatatcatactatataaatgtacac

SEQ ID NO: 64601 - DNA, 111 bp, Mus musculus
acagtttacatgagtatgatctatgtgacttagctgggtatctgtgactctgacacattcagaagtctaccattgaggtgttcactagggttgtcttcatctgtattcctg

SEQ ID NO: 64602 - DNA, 111 bp, Mus musculus
acacacacatgtgtgtgtgtatatatatgtgtgcgtatatatatatatatgtgtgtgtgtgtgtatgtatatatatatatatatatatatatatatatatatatattccca

SEQ ID NO: 64603 - DNA, 70 bp, Mus musculus
acatatgtatgtgtatatatatgaatatgtgagtaaatatatgtacctatgtgtatacaggtatatatgt

SEQ ID NO: 64604 - DNA, 121 bp, Mus musculus
gggggtatgggggacttttgggatagcattctaaatgtaattgaggaaaatatataataataaaaatatttttaaaaaattcccttagtgctgcttaatgattgtctctgcgtctgtctcc

SEQ ID NO: 64605 - DNA, 115 bp, Mus musculus
ctggtttaagaaattgtcttgaagattctctgttatgaggtacatagttttttcatatttaaatcaacaaactgtttctcatcaacaaaaaatttttggaataaactgaagtcag

SEQ ID NO: 64606 - DNA, 85 bp, Mus musculus; identical to SEQ ID NO: 57439

SEQ ID NO: 64607 - DNA, 121 bp, Mus musculus
atggtgtgatacttgatattttgtgtggtatttgtacagtcccaaattaattatgactctttttctatttctgatatagttttattggttttgatgagaatcgcactcactctgtcagttc

SEQ ID NO: 64608 - DNA, 85 bp, Mus musculus; identical to SEQ ID NO: 58731

SEQ ID NO: 64609 - DNA, 116 bp, Mus musculus
ttatttgggagtggtggtggtagtgagatattgcacaggttaagagcattgactgctcttccagaggtcctgagttcaaatcccagcaaccacatagcacacacaaccatctgtaa

SEQ ID NO: 64610 - DNA, 117 bp, Mus musculus
gaaagatacatagacaagtgacatagatcttaaatggccctgatacctgtttttacttactttctttaattatatatctgttatctatctatgtatctatatacctatgtatctatc

SEQ ID NO: 64611 - DNA, 66 bp, Mus musculus
tggttctatgggaactagggctgggattaattatggattacagttctgtgtttgtatatcaaacca

SEQ ID NO: 64612 - DNA, 112 bp, Mus musculus
agagtgttgttcagcttccacgtgtatgtgggttttctactgtttatgttgttattgaagaccagccttagaccatagtgagctaataggatgcatgggattatctcagtct

SEQ ID NO: 64613 - DNA, 104 bp, Mus musculus
gtatgcagtggtacattacaggagaccccttgaaactttttatttatagcactctggttttattttttttccttgttgtatgtgatatcattaaattagcatac

SEQ ID NO: 64614 - DNA, 102 bp, Mus musculus
acttgacctttttccttaattctttttaatattctatgtttattcagtgcatttgttgttctgattattatgtgtcaggaggagtatcttttctggtccagt

SEQ ID NO: 64615 - DNA, 83 bp, Mus musculus
tgtttgcagattggagagatggctcagcggttaagagcactgactgctcttccaaaggtcctgagttaaaatcccagcaacca

SEQ ID NO: 64616 - DNA, 115 bp, Mus musculus
ggcacttgagtatataggtatatgcatccagaggccagagaaggaggtccggtttcttctgagcctctctctgtgccttaattccttggcagcattgctcagtgatcaggaggct

SEQ ID NO: 64617 - DNA, 96 bp, Mus musculus
gacatcattagggctggagagatggctcagctgttaagggcactgactgctcttccagaggtcctgagttcaattcccagcaaccccatgggaatc

SEQ ID NO: 64618 - DNA, 64 bp, Mus musculus
ggacttgaagtggaagccttggagaaatggcttgctggctccctctctggctccctcacaggct

SEQ ID NO: 64619 - DNA, 98 bp, Mus musculus
gttttctgtcactgtcactgcccctgctccccattcctgttctctgtcactttctctcttccagactagggttgagttggcacagtgactaagagaat

SEQ ID NO: 64620 - DNA, 73 bp, Mus musculus
ggctactccctggctccctgcctgcctcctcagaacctgttctgagtgagttttgttcaagtcaggacatgct

SEQ ID NO: 64621 - DNA, 78 bp, Mus musculus
caagcaggtattgctaactgattacaaatttagggtttgctctatcattttttttgttagatagcatttatctttttg

SEQ ID NO: 64622 - DNA, 109 bp, Mus musculus
tgcactcagctgtattgtgccctaaatgtttgttgacacatgagtctgaggacggctcggatcagaatctctgtcagcattcagaccttttgttcagtccagtggtgta

SEQ ID NO: 64623 - DNA, 105 bp, Mus musculus
ggtatgagagtgtatatgtatgcgtagtatgtgtgtatgcatgtgtagtatgaaagtatgtatgtatatgtagtgtgagtgtgtgtgcatgtatgtgtgtatagt

SEQ ID NO: 64624 - DNA, 64 bp, Mus musculus
gacaggtatacatgcacgtgtgtgcacatgtatgtatgtatgtatgtatgtatgtatgtaggtc

SEQ ID NO: 64625 - DNA, 60 bp, Mus musculus
atgtgtgcatatgtgtgcatatgcatgtatatgtgtgcatatgtgcgtatatgcatgtat

SEQ ID NO: 64626 - DNA, 72 bp, Mus musculus
tatatatatatatatacatacatatatatgtgtatatatatgtgtatatatgtgtgtatatatatgtgtata

SEQ ID NO: 64627 - DNA, 111 bp, Mus musculus
tcatatgctcttcagaaagacttggaagaatgtatgtgtgtatgtgcacatgcatgcatgtatgtatgtatgtatgtaagcatatttgtacgtggccacgtatctgtgtga

SEQ ID NO: 64628 - DNA, 65 bp, Mus musculus
ttatgtggttggacagtacagcagatggacagaacacctccaactctcactgtctctctgcatga

SEQ ID NO: 64629 - DNA, 67 bp, Mus musculus
gtctaatggttggctttgaacatctgcctctgtatttgtcaggctctgtcagagcctctcaggagac

SEQ ID NO: 64630 - DNA, 95 bp, Mus musculus
agactgccgcagaaccccatggaactgcctcaggacaggcgtcaggcctcataggtcacaggattcttctctggagggtggggaaggtgcagtct

SEQ ID NO: 64631 - DNA, 77 bp, Mus musculus
tgagtacataaggcaagcagttctcatacagggcagatgagggagacagaaccctgagaggactcatttgtgaacca

SEQ ID NO: 64632 - DNA, 84 bp, Mus musculus
gccgaaaccaatgtattgaagtatccaccagtggaggcatgggcatcaatggtgagaaggtttcaatgactattgagcactggt

SEQ ID NO: 64633 - DNA, 106 bp, Mus musculus
ccatatatatgtgtgtatatatatgtgtgtatatatatatgtatgtacacacacacacacacacacacacatatatatatacatacatacatacatacatacatgg

SEQ ID NO: 64634 - DNA, 88 bp, Mus musculus
atagatagatagatatgtgtgtatatatgtgtgtgtatatatatgtgtatatgcacatatactatgtttatacatatatgtatgcatc

SEQ ID NO: 64635 - DNA, 103 bp, Mus musculus
atatgaaaattcatatactcatatattcatatatatgtttgtttatttggtctgtggtttgtgtatgtatgatttatgtgaacatatgaatcatgagtcatgt

SEQ ID NO: 64636 - DNA, 116 bp, Mus musculus
atgcttaaagtgtgaatgtgtgtctcttttttgggaggggtgctggagttactcagtggagtgtgaggacagtgtgggattggctctgaaaagaatcaccagaagcttgtgagtgt

SEQ ID NO: 64637 - DNA, 70 bp, Mus musculus
gggctcaggattggagatatactctaaggcaatggactttccccttctatgactccctgtcactgtgtct

SEQ ID NO: 64638 - DNA, 100 bp, Mus musculus
attttgaatgcttagtcacctggtagtagaaatatttgggaagaattaagagatgtgatcttgttgaagaaggtgtgtcactaggaatgagctttgaaat

SEQ ID NO: 64639 - DNA, 81 bp, Mus musculus
tgtgtgtgagtgtgtgtgtcagtgtatgtatgcttgcatgtgtgtgtacacgtatatacatgtgtatgtgcatgtgtgtgt

SEQ ID NO: 64640 - DNA, 85 bp, Mus musculus; identical to SEQ ID NO: 57439

SEQ ID NO: 64641 - DNA, 88 bp, Mus musculus
tgtgtatatatatatatatatatatatatatatatatatattcagtgtgtatatacatatattcagtatatatatatgtatgtataca

SEQ ID NO: 64642 - DNA, 63 bp, Mus musculus
tagatgtatagatgtataaatgtgtgtgtattttacatacatatgtatataaatatatattta

SEQ ID NO: 64643 - DNA, 127 bp, Mus musculus
gcatataaagtgcattaaacagcatatatatacatatatgtgtatatatgtatgtacgtatgtatgtatatatgtatgtatatatgtatgcatgtatgcatatatatatatatatatcctgttgtat

SEQ ID NO: 64644 - DNA, 100 bp, Mus musculus
gcatctaagtcagttatctgcagggattacttctgtcctgtcaactgcacccaggcgacagtagtcaggcagcactcctgatttgctcatttagaacagc

SEQ ID NO: 64645 - DNA, 117 bp, Mus musculus
agatatgtaccccatttttaaattagattatttggtttgttgaagtctaatttctatagttctttatatattttggaaattagtacttcgtcagatgcagagttagtgaacatgttt

SEQ ID NO: 64646 - DNA, 85 bp, Mus musculus; identical to SEQ ID NO: 57470

SEQ ID NO: 64647 - DNA, 74 bp, Mus musculus
gctcatgggcagagtgctgctgtgctctactattttctaggaggatgtcagtctgtctgtctctgcctgcctgc

SEQ ID NO: 64648 - DNA, 118 bp, Mus musculus
caagcatgaagacctgtgattggatcctaacacctggagaaaaagttgagagtggccacacacgctcctcttagctcagtattgtgggtggaggaggcaggaggattcctatgacttg

SEQ ID NO: 64649 - DNA, 68 bp, Mus musculus
gtgtgtatatatatatgtgtgtgtatacatatatgtatatatatacacacatatatgcatgtatatac

SEQ ID NO: 64650 - DNA, 88 bp, Mus musculus
ttgagcagtctaagccagaactcacagtggactctctaaaacagaccttctctgtattgacagtggtgggaagctctagaaaactcaa

SEQ ID NO: 64651 - DNA, 81 bp, Mus musculus
aggctcttaagcagaaatgagacaggctatcagtagtgatttttttcttcaatggtacctcattgctttaattctgagcct

SEQ ID NO: 64652 - DNA, 73 bp, Mus musculus
ctaaggcccacaaacgtgtcacagtgtctctgcatccctctgggacaaagcataagtgatgggtgggcttagg

SEQ ID NO: 64653 - DNA, 101 bp, Mus musculus
gtgtatgtgtatatatatgtgtatatatgtgtgtatatatatatgtatttgtgtatatatatacatatatatgcatatatatgcatatttgcatatttata

SEQ ID NO: 64654 - DNA, 125 bp, Mus musculus
tatggtcaccctgtgggagatgctcccgtgggtggggaaagtggggctctctgacagtcacacacagtttccgccaacctgagctcgggcctcagcaggagcttcatgaacagtagcccccttcc

SEQ ID NO: 64655 - DNA, 75 bp, Mus musculus
tgctcctgagacaacaatgacaagggtttttgatgatgcttgctccatcagcctggatcatgattgtaaggagca

SEQ ID NO: 64656 - DNA, 83 bp, Mus musculus
ctgtctgtgtctgtctcagtcagttgggcctcttggagagtagccatgataggctcctgtctgtaagcataccatagcatcag

SEQ ID NO: 64657 - DNA, 104 bp, Mus musculus
ttctcctgtattcccagttcttggtatctccatgaatttttctttatcaatcttgattttttgaaaattcaatacttgaagtgtgtttcttgtatgcagcagaa

SEQ ID NO: 64658 - DNA, 96 bp, Mus musculus
gatcagccttagtccatagtggtctgataggatgcatgggacaatttcaatatttttgtatctgttgaggcctgttttgtgagcaattatatggtc

SEQ ID NO: 64659 - DNA, 89 bp, Mus musculus
tgtgtcagaaaatcttgcaatgaggacagcagtggagagctctgagaacagagacagtattgagatcaacaagatgggtgctggctaca

SEQ ID NO: 64660 - DNA, 81 bp, Mus musculus
tgctgtgtgtttattaaaagcataaatctgaacttgtgctgaataggtacaagggaggtttgatttgtgcagtgtatagca

SEQ ID NO: 64661 - DNA, 94 bp, Mus musculus
ccttacactccagttacagaacagactgaggactctcacatgtgtgggaacttctctccctctgacctctctcctgtaactctggggtcaaagg

SEQ ID NO: 64662 - DNA, 117 bp, Mus musculus
tccaactctgcctttttcctacccttgtgtatgtggatatgtgtgtgtgcatgtgcatgcactcacatgtgtatgcatgtatatttgtgtgaatgggtctaggtgtgcacatatgga

SEQ ID NO: 64663 - DNA, 81 bp, Mus musculus
attggttgtgcttttctatgctagtctctctgtgttgcagtggttcaagatacagagcagagcttgggaggtaggatgagt

SEQ ID NO: 64664 - DNA, 60 bp, Mus musculus
cgggctctcactgaaagtgcatctccatgggaatttatggaggcttccagccccagcctg

SEQ ID NO: 64665 - DNA, 118 bp, Mus musculus
aaagaaacaaagttggggttttctctcagtttggtgtatggagagtctatgtggatgtcatatgatatactgatttaacatgtgctgaaagagtggaacctagggccctgtggttttg

SEQ ID NO: 64666 - DNA, 87 bp, Mus musculus
aatgtttggcccatagggagtggcactattaggaggtatggctttgctggaggaagtgtctcactgtgtgtgtggggggtaaacgtt

SEQ ID NO: 64667 - DNA, 114 bp, Mus musculus
cctatccctgtagttaagtaatggcaactaggactggagaggtggctcagaggttaagagcactgactgctcttctagaggtcctgagttcaattgccagcaaccacatggtgg

SEQ ID NO: 64668 - DNA, 101 bp, Mus musculus
ctgatacaagtgctggcaagtctcgctggtttctctgtatggttatgcagtactgtaacataggaaggcacttttgagtgacactgtagcgctttcatcag

SEQ ID NO: 64669 - DNA, 77 bp, Mus musculus
gcatctgtctctctgtgtgtgtctgtgtctccctcccctcctctctctctcacacacacatacacagatacacatgc

SEQ ID NO: 64670 - DNA, 82 bp, Mus musculus
tagaagcagaaaagggttcagctctgacaacggtaaaaactaaagaacctttgtctgtttccctcactctttctgatttctg

SEQ ID NO: 64671 - DNA, 102 bp, Mus musculus
accagccagtaaaaatgagctcttcagcatgccctcttctctgcctggcttgtcctttgacacacacagaggctctggacccactgcagagctcagctgagt

SEQ ID NO: 64672 - DNA, 63 bp, Mus musculus
tgccggggggggggggggggggtagcctacagtagtctgcacagtactccaacacttttggcg

SEQ ID NO: 64673 - DNA, 113 bp, Mus musculus
tgtggatcagactgtagcctcaaacttatatgaagctctgtctgtctgtgtgagcttttcatgtcccatatcccataattcagagcttctgaggctgagacgagagggtcaca

SEQ ID NO: 64674 - DNA, 60 bp, Mus musculus
acatatatcatatagacatatatgttaatatgagatatgtatgtatgtatgtatgtatgt

SEQ ID NO: 64675 - DNA, 82 bp, Mus musculus
tgagtcagcagactggagttgctctctgatctctgtctggctagtacacaccgtaggctcagggtctctctctgttttctca

SEQ ID NO: 64676 - DNA, 73 bp, Mus musculus
gttacactggacagtctggacacagtgggcacgagactgcagagttacactggacagtctggatacagtgggc

SEQ ID NO: 64677 - DNA, 114 bp, Mus musculus
tcaaactctattactcctaaatgaactgctttgatatgtatagcatattcatgtatatgtttatatatgtgtagatagacatttcctccacagttaggtaatagagcccagtga

SEQ ID NO: 64678 - DNA, 81 bp, Mus musculus
gggagaaagggcccgtgttaaggtggctcatcaggtatgacctgtctctgtctgccactgatgggcaccctgcagactccc

SEQ ID NO: 64679 - DNA, 106 bp, Mus musculus
agcttctctgtctttccccagctctgcttctgtgtgcttctgagacagacttgtgatctcagagaacactgtcaggagcaaggcttcaggtcacggtagcccagct

SEQ ID NO: 64680 - DNA, 92 bp, Mus musculus
atgtgctacagtgtgtgtgtgcatgcatgtgtatgtgtgaatgtgtgcttcagtgtgtatgtatgtatgcatgtgtgtgcttcagtgtgtgt

SEQ ID NO: 64681 - DNA, 171 bp, Mus musculus
atacacatatacatatacatatacatgcacacatatacatacatacatatatgtgtgtgtatatgtatatgtatgtatgtatatatatatatatatatatatatatatatatatatacacacacacacacacatatatatatatatatatatatatatatatatatatcat

SEQ ID NO: 64682 - DNA, 78 bp, Mus musculus
ccacagatggatggataaagaaagtgtgaaatctatcatctacctatgcttctgtctgtctgtctgtctgtctgttgg

SEQ ID NO: 64683 - DNA, 112 bp, Mus musculus
gagagagagaagacagtttcctgtgtgtatgtgtgtttatagtgcgcgtatgtgtgcatgtgcttgtatgtgtgcacacatgcaaaagccagaagcagaagtctatttcctc

SEQ ID NO: 64684 - DNA, 102 bp, Mus musculus
caattacttgctgtgtatgtgtacttatatgtgtatgggtgttttgcatgtatgtatgtatgtacgtatgtgtatgtatgtacaccatgtatgtacctgggt

SEQ ID NO: 64685 - DNA, 66 bp, Mus musculus
ggcagaagagagtggagggtgtggaagaaggaagctctctctgtgtctgtctgctctcacctagct

SEQ ID NO: 64686 - DNA, 78 bp, Mus musculus
cctgatgagcatgctgagaccggaagagctgactcttaaacactgagccgtctgtctgtctgtctctccagcctcagg

SEQ ID NO: 64687 - DNA, 83 bp, Mus musculus
cctttatcttgctggtgactgtttatctgtcacctaaagctcctaggctgacaggtctggacaatgtcattaagtcctaaagg

SEQ ID NO: 64688 - DNA, 95 bp, Mus musculus
gtatatatgtgtgtatttgtaagtatacatatatgcatatatatgtaagtatacatatgtatgtatgtatgtatgcatgatacatgtagatgtat

SEQ ID NO: 64689 - DNA, 112 bp, Mus musculus
caaaatctaggcttgacactgcagctccttaaacgtgagacgagacttaaaaacagtcactgtctggctgtgagcgctggcatgtgttcagctgggttctagagagatggtg

SEQ ID NO: 64690 - DNA, 75 bp, Mus musculus
tctctccctttcactgtctctcaccggtatttggtcacggcactgaacaaatcactgggtactggaagtaagaga

SEQ ID NO: 64691 - DNA, 86 bp, Mus musculus
gacagatttgatagtgggagtcagaaggttttggtatcagagggttggagtttgaatctgtctgtctgtctgtctgtctgtctgtc

SEQ ID NO: 64692 - DNA, 63 bp, Mus musculus
ccagtgaagagggtgacaaattggtgctctggtgtcacaagcagcaggcttgtttcctcctgg

SEQ ID NO: 64693 - DNA, 132 bp, Mus musculus
acatatgtatacgtgtgtgtatatatacatatgtatatatgtatatatacatatgtatatgtatgtatatatagtatatatatacacatatatacatgtatgtgtatatatgtatatatgaagtatatatgc

SEQ ID NO: 64694 - DNA, 100 bp, Mus musculus
acccttgctccaagggagctactttaaaagttctgtcacggttagtttactattgctgtgacagaacacagtgaggaaaaataacccggggagtgagggt

SEQ ID NO: 64695 - DNA, 81 bp, Mus musculus
gctgtactctgctcttcatcatttatgacactcacactgatacactggacagcgataaatgttgagagaggaggtgacggc

SEQ ID NO: 64696 - DNA, 118 bp, Mus musculus
ccctaaagaaccattgtttaaggtcgtgggctcttttttgatttcatcctataagccaatacatagtttttgaaaagagccttggtgtgtctttggatcaacagttttgagccatggg

SEQ ID NO: 64697 - DNA, 97 bp, Mus musculus
tcctttatgcattctagtttagcatatctaagcataactagaatatttcctctgaagcattctaattgtttattaatgtagagtagagtctggagga

SEQ ID NO: 64698 - DNA, 83 bp, Mus musculus
agttctgcacatttgaatgtttctttttaaataaggcaggctcttcaaagccgcaaatgaataagtcattcagagccagatct

SEQ ID NO: 64699 - DNA, 61 bp, Mus musculus
gtcttcacaggtgagagtgtggacaggccctgtttccggccttcatattctgacaggaggc

SEQ ID NO: 64700 - DNA, 115 bp, Mus musculus
attaaagggaaagaaaggggaaaattcagtatgaagaaactgagttggatctaaagcacattttctacttcaaattcgacacactgagttcagctttcatgtatgccctggtaat

SEQ ID NO: 64701 - DNA, 58 bp, Mus musculus
gtatgtatgtatgtatgtatatgcatatatgcctatgtatatgtacatacatacatat

SEQ ID NO: 64702 - DNA, 85 bp, Mus musculus; identical to SEQ ID NO: 57439

SEQ ID NO: 64703 - DNA, 95 bp, Mus musculus
actgtgacacactacagcttctacattgagatgattttttctctctcactgtgtgagggaggttgccagggtgtagggtatgtaggaggggaggt

SEQ ID NO: 64704 - DNA, 85 bp, Mus musculus; identical to SEQ ID NO: 57439

SEQ ID NO: 64705 - DNA, 85 bp, Mus musculus; identical to SEQ ID NO: 57439

SEQ ID NO: 64706 - DNA, 85 bp, Mus musculus; identical to SEQ ID NO: 57470

SEQ ID NO: 64707 - DNA, 73 bp, Mus musculus
tgtctgactgtgagtctctgtatctgctcccatctgctgtgggaggaagcttctctgatgactgtaccaggca

SEQ ID NO: 64708 - DNA, 66 bp, Mus musculus
gtccatcgactctcagtctgactgagttcccgggtcatcttgttgaggactgagggtctgctggcc

SEQ ID NO: 64709 - DNA, 103 bp, Mus musculus
gacagtggaagcagccggtcctgagtctctgagcttgttctttgttgactgataagattggacaaggcacagtaggccctccagaactcctattcagactgtt

SEQ ID NO: 64710 - DNA, 68 bp, Mus musculus
gttgtggtttttgtcatgggacagactctgtgtgtgtcaaccctttgtctctgactgtgaacttggac

SEQ ID NO: 64711 - DNA, 136 bp, Mus musculus
acattattaatacatatacatgtatatgtatatatatgtatgtgtatatacatatacatatacacacacatatacatatatatgtatatatatatatatatgtatatatatatatatatatatatatacatacata

SEQ ID NO: 64712 - DNA, 160 bp, Mus musculus
tgtgatattgtgtgtgcgtgtgtgtatgtatgtatatatatatatatatatatatatacatatatatatatatatacatatatatgtatatgtgtgtgtatatgtatatgtatatacacatacatatatatacatatacatgtatatgtattaataatgt

SEQ ID NO: 64713 - DNA, 74 bp, Mus musculus
tgcggaagtcattatgattatgttagggttgcactcttgtaaaggtgtcattttgatataatgagtcttttgta

SEQ ID NO: 64714 - DNA, 108 bp, Mus musculus
aatctcatggctttgtgaagaacaagaggagactatttttatatctaatgaagtctgtatgattggatagttgtggaagtattctgatgtctaaaagcttatgatgtt

SEQ ID NO: 64715 - DNA, 84 bp, Mus musculus
gtgaattctgtatttctatttctgtgactaataaaagaccttcacaggtattgtagtcattgatatatagctgtgaagagacac

SEQ ID NO: 64716 - DNA, 210 bp, Mus musculus
gtgtatgtgtgtgtgtgtccatgtgtttgtatgtatgtgtgtgtgtgcatgtgaatgtgtgtatgtgtgcatgtgcatgtatatgtgtgtatgtgtgtatgtgtatgtatgtgtgtgtgtgcatgtgtatgtgtgcatgtgcatgtgtatgtgtgcatgtgtgtatgtgtgtatgtgtgtatgtgtatgtatgtgtgtgtgtttatgcat

SEQ ID NO: 64717 - DNA, 83 bp, Mus musculus
tctcctcatccccagctcagtagagggtgatatgctaccactgtcattttctctctgctcctaccaccagtggatgacacaga

SEQ ID NO: 64718 - DNA, 73 bp, Mus musculus
cttacatgtgtattaatgtatgtatgagtatgtacctgtatgttaatatatatatagactatgtatatgtgag

SEQ ID NO: 64719 - DNA, 72 bp, Mus musculus
gaatgtatatctatatatgtgcatagtgcatagaatatgtatctatatatgtgcatatatatgtttatgttc

SEQ ID NO: 64720 - DNA, 65 bp, Mus musculus
gtctgtatgtatgcataagcatgtaggtgtgtatatatctgtgtgactctgtgtgtgtgtgagat

SEQ ID NO: 64721 - DNA, 100 bp, Mus musculus
tatacacagacacactcacatacatgtgattgcatgtgtgtgtgtatgaatgtttataaatatattttatatactgatatacatgtttgtcattcatgta

SEQ ID NO: 64722 - DNA, 61 bp, Mus musculus
gtgcgttgggcacatgtgtgtgtgtatatataagtatgtgcacactttgtgtcatatgtac

SEQ ID NO: 64723 - DNA, 85 bp, Mus musculus
gctctctcattcttactgtgtgtgtgtgtgtgtgtatgtgtgtgtgtgcacgcatgcacacacactcgtgtccataaatattagc

SEQ ID NO: 64724 - DNA, 90 bp, Mus musculus
tcagagaagggctctgtgtctgtttctctgatcctgtacatagtattttggctctggagaataaaaatagcagcacatacattatcctgg

SEQ ID NO: 64725 - DNA, 85 bp, Mus musculus; identical to SEQ ID NO: 57470

SEQ ID NO: 64726 - DNA, 98 bp, Mus musculus
ttggttgctgttcaccttgtttagccagactgagtcaaacagagtctctcacagagagcatattctaattgattaggcaaggttgactagctagccag

SEQ ID NO: 64727 - DNA, 67 bp, Mus musculus
gctctctctgtctctgactggagcctgtccctcctgtgatcctggttgtgtcagagctcccgagagt

SEQ ID NO: 64728 - DNA, 96 bp, Mus musculus
tgtttccagtaatgaatgaaattcctagaaatgtaaagtagaatgaacccttttctttcagagttgcttttagtggtggtggttactgcaggaaca

SEQ ID NO: 64729 - DNA, 86 bp, Mus musculus
acacacacacacacacacacacacaaacacacacacgtatgtatgtatgtatgtatgtatgtatgtatgtatgtatatgtgtatgt

SEQ ID NO: 64730 - DNA, 103 bp, Mus musculus
aaataaacgaacttgcttatgattaaagcaccattagctttgagttgaatgtagacagggttttactcagatcttcggtgttctggtcaagatttgttttttt

SEQ ID NO: 64731 - DNA, 89 bp, Mus musculus
gtctcccaattcagtagcttgaggtccttttgagaacatgtgacccacaatgtcactttagtgtcccacacactctgaattgggagcac

SEQ ID NO: 64732 - DNA, 103 bp, Mus musculus
agacgttcaattagactgcaaagaagtgcttgttgtggcagagttcagattttctaaaacgtatcattgaaatgccataaattcttggtgggtatgacagtct

SEQ ID NO: 64733 - DNA, 102 bp, Mus musculus
ctatctatctatctatctatctatctatctatgtatgtatctaatgtcaggaattggtgcttgcccatggaataggtttcaagatgggccagttttggttag

SEQ ID NO: 64734 - DNA, 106 bp, Mus musculus
gccttagtccatggtgatctgataggatgcacgggacaatttcaatatttttgtatctgttgaggcctgttttgtgaactattatgtggtcaattttggagaaggt

SEQ ID NO: 64735 - DNA, 121 bp, Mus musculus
gggtgatattttctagttccatccatttccctgaaaatttgattatgtccttctaattgtttttaaatatgtgaaacagttgactcaaataaatgggagatgaaaactgtcatttactggg

SEQ ID NO: 64736 - DNA, 90 bp, Mus musculus
atatatatgtatgcttttatattatttatataatatataactatatatatagttacacatatacatgatatattatgtatacatgtttat

SEQ ID NO: 64737 - DNA, 104 bp, Mus musculus
gttagttttcttcctaatgtctgacatgctgttttcactgagttcccggggaagctgactgactctggctctctgaaggcactgtgtacactcatggagctaac

SEQ ID NO: 64738 - DNA, 85 bp, Mus musculus; identical to SEQ ID NO: 57439

SEQ ID NO: 64739 - DNA, 85 bp, Mus musculus
cctcttgttccagcattagaaatgagagctactggttgtaatatagtttgagagtgcaccccctgatgtggatggatacaggagg

SEQ ID NO: 64740 - DNA, 86 bp, Mus musculus
acaaaagcactgattaacatgatctataatatgcatgtacaccaatatgtaagtgcatatatatatttgtatctatgtgtatgtgt

SEQ ID NO: 64741 - DNA, 117 bp, Mus musculus
gtaaggagagtgatgttacaaagaatatgtattgaggaatatatatacatatatatgtatattccatatatatgtaataatgtgtatgtatgaatgcgtatttatcatatttcttac

SEQ ID NO: 64742 - DNA, 87 bp, Mus musculus
ctgcttggtgtctagctctcagctgcctagtcctctcaatgcttctgtcttcttgtaaggggagtagacacagagcctacctcgtag

SEQ ID NO: 64743 - DNA, 68 bp, Mus musculus
cagtctcacagtctcagagttagccacgttattataggtacagcatgctctggggaaagtgatgggtg

SEQ ID NO: 64744 - DNA, 83 bp, Mus musculus
cagagagggtcaattaaataaaattttagctaaaaggccacacactgtagcctgagttgagagaagtttctgaacagtctctg

SEQ ID NO: 64745 - DNA, 64 bp, Mus musculus
tacatatgtgtgtgtaaagtcatagatgcatgtatatatgcgtaaagaaatatacacatatgta

SEQ ID NO: 64746 - DNA, 79 bp, Mus musculus
acataaagcgaatgtagtaggttacaggacaagttgagactaatcacagcttgatttgatgtgctatattgttttatgt

SEQ ID NO: 64747 - DNA, 96 bp, Mus musculus
gtatgtatatatatatgtgtgtgtgtatatatgtatatgtgtgtatgtatatatgtatatatgcgtatatatacacacacacatatatatatgtgc

SEQ ID NO: 64748 - DNA, 80 bp, Mus musculus
tagcaggctgagcagccacatctgtgtctctctgaatgtgccccatcttggttttaaatgtggtaatgttctatttgctg

SEQ ID NO: 64749 - DNA, 69 bp, Mus musculus
gactggatctactctctgtgtttttcagtgtatgattgaagctccctgagcacggggattgatcttttc

SEQ ID NO: 64750 - DNA, 111 bp, Mus musculus; identical to SEQ ID NO: 64079

SEQ ID NO: 64751 - DNA, 86 bp, Mus musculus
gcaagtgcaggtgtgtctgtgtgtctatatgtctctgtgtaccatgatatacatatgcaagtcaatagacaaccttcagtgtttgt

SEQ ID NO: 64752 - DNA, 105 bp, Mus musculus
cccagtagaatctctgtaatatcttactggttgtcttctgattttggcctggtctcatctgtcttaatctgcttagcctagttggatgctaagcttgccattggg

SEQ ID NO: 64753 - DNA, 117 bp, Mus musculus
ggacactgctttgaagctctcttagactgcttttctttaccctgtttatagaaagagaatgtatttatttcttttgaaaggaaagcagaagattctctttgtagctgaatgtaatcc

SEQ ID NO: 64754 - DNA, 79 bp, Mus musculus
gtctgtctgtctgtctgtctgtctgtctgtctaactgcattaaagtttggcagtagagtagatctttcagtatcccagc

SEQ ID NO: 64755 - DNA, 66 bp, Mus musculus
tgtctgtctgtctctctgtgtgtctgtgtgcacaggccatgacatacacagggaggtcagaggaca

SEQ ID NO: 64756 - DNA, 70 bp, Mus musculus
acttcaacactgctaaagctaaggagagactctaagtctcactgccaggctgattggcagatctcgaagt

SEQ ID NO: 64757 - DNA, 93 bp, Mus musculus
aggaccacccattaaaacataataggtacagatttagaaactatttctatatcaaaattgtatttactgtggttatatggtttgactggtctt

SEQ ID NO: 64758 - DNA, 75 bp, Mus musculus
ctttctgcaatctcccccacagggcattgtttttctatattaaaacattcactctgtatgaggaggtgctgaggg

SEQ ID NO: 64759 - DNA, 98 bp, Mus musculus
ctcagctccattagcaaagctatttccctaaactgacacactctctatgttgtgtacagttttaaaaatatgctaccacctttttataggagctgcag

SEQ ID NO: 64760 - DNA, 74 bp, Mus musculus
gtagcagatgtgaagtttggccttcctgtggctccactaacagatggagcagggactgtctctgactctgttgc

SEQ ID NO: 64761 - DNA, 108 bp, Mus musculus
ggagaccttagatctgagctgtgatgcaggctctcctgttgtctactctgcacattgcagatttcctagccccgtcgctgcatggccaagtcctagagataactctcc

SEQ ID NO: 64762 - DNA, 99 bp, Mus musculus
tgtccgtctgtccatccatccatccatctagccatctatctatgtatctatttaatttccagctagctgtgcacaggatgtgtggatgtcagaaggaca

SEQ ID NO: 64763 - DNA, 65 bp, Mus musculus
ttgggagggtgactgtgggccattcggggagattggttgtagtttgttaatagtcatgctcaaga

SEQ ID NO: 64764 - DNA, 117 bp, Mus musculus
gtctctctacagatctgtgtggcaaagatcttcctgctgtgttctctgtgtatctgtgtgtacttggtgcccatgaagaacagaagaaggtatcagattcctcagaactggagttac

SEQ ID NO: 64765 - DNA, 82 bp, Mus musculus
tatatgtgtgtgtgtgtatatatgtatatatgtgtgtatatatacatatatacataagtgtttatatatacatacatatata

SEQ ID NO: 64766 - DNA, 119 bp, Mus musculus
ctccttagaaggcttcctaattgtttgttccttagctaacacactgtcagtgtctgagagtaaaggtggtgtatgtgtgttgcagatttggggagcagatctgttaagatggtctggag

SEQ ID NO: 64767 - DNA, 119 bp, Mus musculus
tctcctaattgggacacctccttgtataacctcaaaagaaaaagttgtgcctaatgtaactgcaactacatatgcaaaagctaggtgatatccatgggaggtatccctcttttctgagg

SEQ ID NO: 64768 - DNA, 68 bp, Mus musculus
ggaattggcattgggtacctggtccagtggtgctcattagctcactgatctgtctgagtcacagtttc

SEQ ID NO: 64769 - DNA, 92 bp, Mus musculus
ttccaggtaagatgtctcagtgagaggctctccttgaaagaatacaacttagtacatgcagaggctctgtttggacccctacctatctggaa

SEQ ID NO: 64770 - DNA, 88 bp, Mus musculus
ttctgactattataaataaggctgctatgaacaaagtggagcatgtgtccattagtgcatttgttgttctgattattatgtgtcggga

SEQ ID NO: 64771 - DNA, 65 bp, Mus musculus
gagatgacaatcttgatcatgctgaatgcaaggaggcctgcgaagcactgtcaagttgtgtgttc

SEQ ID NO: 64772 - DNA, 79 bp, Mus musculus
ggctgtcaccagattttacagtctctgtctcactaatgtgaactgcaaagagggaaggagagggtcatttgtataagcc

SEQ ID NO: 64773 - DNA, 116 bp, Mus musculus
acttgaagaagagaatgagactgaagggtgcgggtccagttgttacacccacacactgtgtttctggcaaggttacaccacccctctaagtcttgggtgtcctttttccccaaagt

SEQ ID NO: 64774 - DNA, 112 bp, Mus musculus
cacagacaatgccatcaccacctgtcttaagaggactggaagtaactttacaaagtattagaaatcttaagtcacaaccatctgcttatgatgctaggctgagtgcaatgtg

SEQ ID NO: 64775 - DNA, 87 bp, Mus musculus
gagagagagagagagagagagagagagagagattccttcaaacacttggagctgtctccctctgtatcctcacacagacactcactt

SEQ ID NO: 64776 - DNA, 82 bp, Mus musculus
acatatatgtgtgtgtatatatgtgtgtgtgcgtatatatatgtgtgtgtgtatatatatatatgtatatatatatgtgtgt

SEQ ID NO: 64777 - DNA, 185 bp, Mus musculus
gtgtcccattctctttctctctgtgtctttatcccccctctacacacacacacaacacacacagactgagagagagagagagagagagagagagagagaacaattgaaagacacacacggtgactgagtgtatgactgtctctctgtcgcattctgtctctgtatctgtgtcgctctctttcgct

SEQ ID NO: 64778 - DNA, 63 bp, Mus musculus
tggggaactctctctctgcctgtgtcacctcatggaaggcgagggttggagctagttcttcca

SEQ ID NO: 64779 - DNA, 58 bp, Mus musculus
gtgtctgtgtctgtgagtgtgtgcacatataggtatatatttgcatgagtacatgcat

SEQ ID NO: 64780 - DNA, 139 bp, Mus musculus
gtgctgcatgtatatatatatatatgtgcatattataaactaatatatttacatatattatatgtatatatgtacatatgtatatatgtgtatatattatatatgtatatatatttatgtgacatataaactcttgtaa

SEQ ID NO: 64781 - DNA, 105 bp, Mus musculus
gggaaaaaaaatgtagacttcagacaatgaaagagaatgagcaaaggaccgacggaaatcacagcctctctctcagcctctattataagctgcatagcctagctc

SEQ ID NO: 64782 - DNA, 98 bp, Mus musculus
cttcagttgtaaatagatgcctttttcctaagacagatagagtgagcacacagggacctgcttttgttaatctgttccatggtggggcacagaggaag

SEQ ID NO: 64783 - DNA, 92 bp, Mus musculus
gacagtgccgaggattctgatgtgtgtgtgtgtgtgtgtgtatgtgtgtgtgctgtatagagcactccaactaagattctttagtccttgtt

SEQ ID NO: 64784 - DNA, 86 bp, Mus musculus
aaggcatacttattgagtgcctattgtatgctgtctaatattgtagagagtcaggacacaaatttcacttcatgggtatgaacctt

SEQ ID NO: 64785 - DNA, 64 bp, Mus musculus
ctcagcaggatgcatgagttctggaggggctgagcctctcactgactcagcttctgagatgtag

SEQ ID NO: 64786 - DNA, 58 bp, Mus musculus
tctatctcgcaaggtccctgggtgccagatgggcactctgtgactgcgtgagcgtgga

SEQ ID NO: 64787 - DNA, 64 bp, Mus musculus
cctgtgtggctgtcatggtcgacaaggagattttctgtctgtctgtccatcactcacccggagg

SEQ ID NO: 64788 - DNA, 66 bp, Mus musculus
accagatgtcaatatctaccctctaagatgtgacgagcatcagagaagatggagtggacagaaggt

SEQ ID NO: 64789 - DNA, 94 bp, Mus musculus
gaggactggactctgcaaagctgttgtaactttccttgttcctgatgtatattacacaagagagagagcagaacagctggggagatggtggctc

SEQ ID NO: 64790 - DNA, 118 bp, Mus musculus
tgggtggcagaggcaggtgcaaggaggaaatggggagttactgtagtctgtgaggagaacggctcagtcatgtaagggaagaaacttctagatctcaggagcatacaactatgactta

SEQ ID NO: 64791 - DNA, 76 bp, Mus musculus
tctgcactggaaacaaagacttgagtggatgcacactgttagccatgtgcatctgactcacacagtcccagtaaga

SEQ ID NO: 64792 - DNA, 87 bp, Mus musculus
ccacacacttggtttattattttacttaagttgttcttgtgttatgtcgtgatagctcaaggaattctagaagacctagtcctgtgg

SEQ ID NO: 64793 - DNA, 100 bp, Mus musculus
ggcagcacacagtgtggacactgctgagtcacttagggggcaggcagcacacagtgtggacactgctgagtcacttagggagcaggcagcacacagtgtg

SEQ ID NO: 64794 - DNA, 59 bp, Mus musculus
gcaccagtgtgacaccatgtggatctggtgaccaaggcagctacagagtcatagtgggc

SEQ ID NO: 64795 - DNA, 95 bp, Mus musculus
ggatccagaggctcaggagtgttgtcttgctcaaggtcactcaactgaactggatagagagcaccctgacaaacagacctgaggcaatctgctcc

SEQ ID NO: 64796 - DNA, 90 bp, Mus musculus
taggacaaaatttagtatcttaacaatttgctctcaaagtttttgtttattaagaacttgggaagagttgggctgggtatttttggctta

SEQ ID NO: 64797 - DNA, 91 bp, Mus musculus
aggctgactccataattatatagttgggtgggtgtgactctctattcagtgtttgctctatctatgtatctatgtatctatctgtctgtct

SEQ ID NO: 64798 - DNA, 70 bp, Mus musculus
gtagtctgcaaaggtgagagtgtgcacagagaagctgacagcttctgggacagcatccttttcaggctcc

SEQ ID NO: 64799 - DNA, 81 bp, Mus musculus
taggagttggctttgtgatcctatgcctttgtgatggcgagtctctcatggttgcctttggatcaagatgtagaactcttg

SEQ ID NO: 64800 - DNA, 96 bp, Mus musculus
tatgcatatatatatatgtgtgtgtgtatatatatatatatacatacgtgtgtatatgtgtgcatgtatgtatgcaaatatgtatgtatgtatgtg

SEQ ID NO: 64801 - DNA, 101 bp, Mus musculus
tgatttgaactgcaagccaatgggatgagctgtggctaaagtctagtgtatctgttctgatcactgccggctatgactctcccatggaacagcacacatca

SEQ ID NO: 64802 - DNA, 85 bp, Mus musculus
tgtaaatggcatatgtgacctcagaatctttctctctctgtcagaggacaggacggctggagtgaactaacgtatgagatctaca

SEQ ID NO: 64803 - DNA, 97 bp, Mus musculus
cttctgagtgagattcatgcatcctcccttgggccctccttattacctagtttctttgggtctgtggattgttgtatggttatcctgcactttatgg

SEQ ID NO: 64804 - DNA, 111 bp, Mus musculus
catgcttgccacacactttagtcacagaggcattgttgtaagtggcagtgaagttaggtctttgacacacactgaaaatatctgcattttttctggacaggttggcttttg

SEQ ID NO: 64805 - DNA, 96 bp, Mus musculus
tgtatatgtgtgtacatgtatatgtgtgtatgtgatatatgcatgtatgtgtatatatatctatgtatgtacatgtatatgtgtgtatgtgatata

SEQ ID NO: 64806 - DNA, 111 bp, Mus musculus
gggtccccgggctcagtccagtggttggctgtgagtatctgcatctgtaactggaccatccagagctcccagagactaaaccaccaaccaaagagaacacatggagggtcc

SEQ ID NO: 64807 - DNA, 69 bp, Mus musculus
tccagaattctgtctctctgtgagtgcgtgtgcatgcacgcacacacacacagataaatatttgaagga

SEQ ID NO: 64808 - DNA, 62 bp, Mus musculus
tcaggcaggatgggaagcagaactcagagagtctctgaaagtctgtggatcagctagcctgg

SEQ ID NO: 64809 - DNA, 58 bp, Mus musculus
tgtgagtgtatgcatgtgtgtatatatgtttatatgtgcatgcatgtatgtatttgca

SEQ ID NO: 64810 - DNA, 119 bp, Mus musculus
gggggaggatctgggaagaggggggatgttaatattgggatgcaaaatgaatgaatgaatgaatgaatgaatagtctcagcctaacttcttaattttgacttagaagatgttagctctc

SEQ ID NO: 64811 - DNA, 86 bp, Mus musculus
gggctggaatgatggctctgcagttaagggcattggctgctcttgcagaagacacaagtttgactgcagcgcccacatagtggctc

SEQ ID NO: 64812 - DNA, 97 bp, Mus musculus
cgtgctggggacataccttcttacagacagatgagactaaccagagctaactagttgggagtctctatgagttggcctagaggatggacctaccatg

SEQ ID NO: 64813 - DNA, 70 bp, Mus musculus
catgtgttgtcctaggcagaggaagttgctagatagaagtctgactctgacactgaggagagagagcatg

SEQ ID NO: 64814 - DNA, 69 bp, Mus musculus
tgtgcagttaaatccacattttctagttcactcacctggactgaagtctggcggggagtacactgcata

SEQ ID NO: 64815 - DNA, 102 bp, Mus musculus
gagaagagcaggggacatggagtggagaaaaaaaaatttttttaaatactattattgtattttatttatgtatgtattctctctgtgtctctctctgtctct

SEQ ID NO: 64816 - DNA, 84 bp, Mus musculus
gagtcaggaaaggttacaacctccacaggcactgggctggaagcagggctgcctcctggtgggtgtgatgtgtgcctggggatc

SEQ ID NO: 64817 - DNA, 73 bp, Mus musculus
gcacagcacacagagcacacagagcaccatacctgtcagtcgtgcttggagtgttcctagctctgaatgccgc

SEQ ID NO: 64818 - DNA, 80 bp, Mus musculus
ggggggaagaaatggaagtctttcaagctatggagctttctcaactagtgaaggagatttgtctgtttctctgtctctct

SEQ ID NO: 64819 - DNA, 152 bp, Mus musculus
atgtgtgtgtgtgcatatgtatatgcgtatgtatatgtatatatatgtgtgtatacatgtatatacatatatatgtatatatgtatacatgtatatacatatatatgtgtatacatgtatatacatatatatgtatatatatgtatacatgt

SEQ ID NO: 64820 - DNA, 80 bp, Mus musculus
cagatatgtaatacgtatatacacacatatatacacatatatgtatatgtatatatgtacatgtatatatgagtacactg

SEQ ID NO: 64821 - DNA, 61 bp, Mus musculus
cagtctcttgagtgaggccagcccagcctgtctgtgcctcagtatctcagtgctaggactg

SEQ ID NO: 64822 - DNA, 83 bp, Mus musculus
tgtggctcactaggggcgtggctcagtggtgcttgtttgctgtgtgcaaggtctacagggacctgggttcaacccctaccaca

SEQ ID NO: 64823 - DNA, 71 bp, Mus musculus
gatgctatagggactgaagagatggctcagtaattaagagcactgactgctcttccagaggtcctgagttc

SEQ ID NO: 64824 - DNA, 90 bp, Mus musculus
gggtgcagatttaaaatggtcgccgttctttgtacagacaatattgtcagtacagagatggatggaaggagaccttttgtcattgctttc

SEQ ID NO: 64825 - DNA, 96 bp, Mus musculus
gctatggagttgaagagatcagaggaaaatatttctatctactgtgtttactctgacttgagtgggatagccttggatatttaatgacttcaaagc

SEQ ID NO: 64826 - DNA, 72 bp, Mus musculus
tcgaaatacattctatacatgtatgcatatagggtcaaactacattgtatacatgtaagacatgttcaaaga

SEQ ID NO: 64827 - DNA, 82 bp, Mus musculus
ggacacagatggcaggcacatcagatcctgatgcagttctgtaagcgctgaaagggtgtctctgtgtctctgctctgtttcc

SEQ ID NO: 64828 - DNA, 77 bp, Mus musculus
atgcacagcagtgtatgatgtatatatgtatgtatgtatgtatgtatgtatgtatgtatgcatacacagcagtgtgt

SEQ ID NO: 64829 - DNA, 74 bp, Mus musculus
ctcctctgagctgcagcaacctaaactagagcaggaaggacggttctgctctctcagtgcctctcagagtcgag

SEQ ID NO: 64830 - DNA, 64 bp, Mus musculus
cttagagtctgtctgcctctctcatcaaagtccagaatcctagagagggaggaggggctccagg

SEQ ID NO: 64831 - DNA, 64 bp, Mus musculus
cagtggtttctgcctcactgaatctgtgttgcgtacagctcctcagtgtgccgtaggtcccctg

SEQ ID NO: 64832 - DNA, 85 bp, Mus musculus; identical to SEQ ID NO: 63165

SEQ ID NO: 64833 - DNA, 149 bp, Mus musculus
agagaaaacagtgtccaccctggtcagtctcttcaatattattctgactgggtgccttctgttgctctctacaatattttgcttatgggttggtcgatcaactgactaatagtcattacccaacttggaaagtaaatatgaaagtgggg

SEQ ID NO: 64834 - DNA, 73 bp, Mus musculus
ggctccatctgactccctcactggcttacctgatttaaaaccatcctggggcgatcgggagtccccgggtgcc

SEQ ID NO: 64835 - DNA, 93 bp, Mus musculus
gtccttagctggaggtttgtatatgagatggaccttatttctatgttgatatatataataacttaggtaactacgaatataaatcttctgggc

SEQ ID NO: 64836 - DNA, 77 bp, Mus musculus
ctgccacttttgagctgtgtgaggacactgggtgcttgtgtggccttggtgatgcccacatttcttaaagcttgtag

SEQ ID NO: 64837 - DNA, 87 bp, Mus musculus
gggaatatgcatatacagtgaatgtgcctggcatgtttttgttttttaatcaaacaatatggatgcacaatgtgcatatatgttccc

SEQ ID NO: 64838 - DNA, 85 bp, Mus musculus; identical to SEQ ID NO: 57470

SEQ ID NO: 64839 - DNA, 93 bp, Mus musculus
catcactgtgattaagtgaggtaccagggttcatagcgtcggagactgctgacgctagctgattatgatttcacatgctagttataaaagatg

SEQ ID NO: 64840 - DNA, 100 bp, Mus musculus
gaaaacaccatctgggctggagaggtggctcagtggttaagagcactgactgctcttccagaggtcctgagttcatttctcagcaaccacatggtggctc

SEQ ID NO: 64841 - DNA, 90 bp, Mus musculus
gctggctctgaccttgctgccactgagaatgagaccacctagagtgaagctttctgacctagatggttctattctgtcaccagctttgtt

SEQ ID NO: 64842 - DNA, 111 bp, Mus musculus
catcacagtggagtccctgtcttgcctagagagctgacgtccccctcaccgtctgtcagtttctcacactctaggtagcaaaggagaggaaatgggctgcaactttggctg

SEQ ID NO: 64843 - DNA, 81 bp, Mus musculus
ttctcactgtctctgtcagcattaatctacggtggaggacatgcctcaatttggacttgatcatgatatgaaccatgggaa

SEQ ID NO: 64844 - DNA, 119 bp, Mus musculus
atcaaaggcacttggggaagaaagcgtttatttggcttccacttccactgtactgttcattgttgacagaagtcaggcaggaccggaacttaaatggggtagaaaccttgagtcaggat

SEQ ID NO: 64845 - DNA, 115 bp, Mus musculus
atgccaggatctaagcagtgaccttgatctgtggtcactggtgtctgatcttactgaggacataaccactctggccccagatcaatgtgaaatcttggaaacgctacatattctg

SEQ ID NO: 64846 - DNA, 82 bp, Mus musculus
tcctttaatgtctctgtgcctctgtggatcttaagtaaaacaatgatagtcttgccacatttgcatagggactttatgagga

SEQ ID NO: 64847 - DNA, 111 bp, Mus musculus
tgagtaatttgtgccttcctgtagggaaatttgcatcattttatattgtttcaatgttaacaaatagtgtgtgtggtgtgtgtgtatgtagtggaggccccaagaggttca

SEQ ID NO: 64848 - DNA, 107 bp, Mus musculus
tgacccgatccttgcagaagggtagtgcttcactattgagttaggtagagagaaactaaatttatattttaggaagcaatagaattcatcaggaagatcttgggtgg

SEQ ID NO: 64849 - DNA, 189 bp, Mus musculus
agtggtgtgtcagcagatatctgtgaatcagtgtgtcagaagatatttgtgagtagtgtgtcagcagatatctgtgaatcagtgtgtcagtagatctgtgaatcagtgtgtcagaagatatttgtgagtagtgtgtcagcagatatctgtgaatcagtgtgtcagaagatatttgtgagtggtgtgtca

SEQ ID NO: 64850 - DNA, 144 bp, Mus musculus
tgaatcagtgtgtcagaagatatttgtgagtagtgtgtccgcatgtatctgtgagtagtgtgtcagcagatatctgtgagtagtgtgacagcagatatctgtgaatcagtgtgtcagcagagcggggagcaggaacaaagatca

SEQ ID NO: 64851 - DNA, 73 bp, Mus musculus
gggggtgggggtgggctttaaggtcctctatgctcaagctatgctcagtgtgacacagtctctccttgcttcc

SEQ ID NO: 64852 - DNA, 85 bp, Mus musculus; identical to SEQ ID NO: 58710

SEQ ID NO: 64853 - DNA, 113 bp, Mus musculus
gtctttaagatctaccaggcccatgtgactaggtagattgtattttaagctcagaactgtgtctccacacaaaagcagatctgtatatcctagatgaggtcttgatatgagac

SEQ ID NO: 64854 - DNA, 84 bp, Mus musculus
tgggtacttcagtgtgcttgctttgagttcactgaagtggggatctgtctcactctcacttcaatcccaagcacatttgtctca

SEQ ID NO: 64855 - DNA, 85 bp, Mus musculus
ggccatggtggtctgataggacacatgggacaatttcaatatttttgtatctgttgaggcctgttttgtgaccaattatatggtc

SEQ ID NO: 64856 - DNA, 113 bp, Mus musculus
gaggtaaagaggtcactagagtccttcactggaatctccaaaggcctaaccctgagtctcactgggactctgtcttaccttcggctttctgcgtgttggggttgatcttcctt

SEQ ID NO: 64857 - DNA, 87 bp, Mus musculus
gggctcttagactcagtctcactctggatttagtcaaaggtgaactaaccatgtttgctgatggatctgatgttgagtgtagagttt

SEQ ID NO: 64858 - DNA, 85 bp, Mus musculus; identical to SEQ ID NO: 57439

SEQ ID NO: 64859 - DNA, 72 bp, Mus musculus
tgggcatggagtctgcttattaattccttgctgcatgacagaagtgagttagtattctgtcaacaagcctca

SEQ ID NO: 64860 - DNA, 117 bp, Mus musculus
gatagatagatagatagatagatagacagacagacagatagattatatatatatatatatatatatatatataatttttctctccctctctctctgtctatctgtctgtctttgtct

SEQ ID NO: 64861 - DNA, 112 bp, Mus musculus
tctatctatctatctatcttagatatgtataaatgtctatattaatacagatataaatatatctataaatttagacaggtatagataacttagctatagatagataaataga

SEQ ID NO: 64862 - DNA, 106 bp, Mus musculus
gccttggtccgtggtgatctgattggattcgtgggataatttcaatatttttgtatctgtggaggtctgttttgtgaccaaatctatggtcaaccatggaagaggt

SEQ ID NO: 64863 - DNA, 92 bp, Mus musculus
cttatggtagatttccttggcttaattcccctttctgtctctgtggatcagtgtttgacagaggtgcagaggactaagacccttaccaccag

SEQ ID NO: 64864 - DNA, 70 bp, Mus musculus
atggtacgcttctcattgcatgagtgctgtcagctctttctgtgtgcctcactgctctggtagctgctgt

SEQ ID NO: 64865 - DNA, 115 bp, Mus musculus
atatatttgtgtgtgtgcatatatgtacacatatatgtatacacagacacatgtatgtatgtatgtatgtatgtatgcatttatatatgtgtgtatgcatttatgtatgtatgtg

SEQ ID NO: 64866 - DNA, 86 bp, Mus musculus
tgggcagactttggaaagttaacatgttacttaattagattgttctttttctttggtaaggaagggctggattcaaagtttgctca

SEQ ID NO: 64867 - DNA, 116 bp, Mus musculus
gagttttactgtgagccactttatgatgttagagctatggaaagaattgtagtcagagacactcattctctgataacaccctagctgtgaaacggcatgcaggtcacataaaagtc

SEQ ID NO: 64868 - DNA, 76 bp, Mus musculus
tgtgtgtgtgtgtgtgtgtgtgcgcgcgcgcgcctctatgtgtgtctctgtgtgtatactgagcatatatactata

SEQ ID NO: 64869 - DNA, 108 bp, Mus musculus
tctactactgagccttagacagtgaatccagaagcctgagctgtgaacgtgacttgtctgtttcacacagcctctgactatactgactcaaacagtttccatagtgga

SEQ ID NO: 64870 - DNA, 104 bp, Mus musculus
gagtgcacagatattttgcattgataatgtgttacacaactgattttgaacctatatcacagacttggtttgtttttcacaattttctgcttctggtagcactt

SEQ ID NO: 64871 - DNA, 85 bp, Mus musculus
tatctatgtgtgtaggtatgtatgcaagtgtgtgtgtgtgttcgagcatgcacgagtgtgtgtgtgtgtgtgtgtgtgtagcatg

SEQ ID NO: 64872 - DNA, 77 bp, Mus musculus
tatatatgtatatatatatgcatatatgcatgaaactataatgtacatatatatatgtatgtatgtatgtatgtatg

SEQ ID NO: 64873 - DNA, 56 bp, Mus musculus
gtgtagtgaactcagtacagaatcacttctgtggagtgatgtctggctgactacgc

SEQ ID NO: 64874 - DNA, 78 bp, Mus musculus
acagacagacagacagacagaccaggatattcctatcatttaagacaactccagggaagggtctgtctttgttttggt

SEQ ID NO: 64875 - DNA, 80 bp, Mus musculus
acatagatgcatacacacacacacacacacacacagatgtagagaggtgtgtgtgtatgcatgtatgtatgtatgtatgt

SEQ ID NO: 64876 - DNA, 67 bp, Mus musculus
gccagggctacacatatgtatatctgtatatatatgtatatgtatgcgtatgtgtgtgtgtctgtgt

SEQ ID NO: 64877 - DNA, 87 bp, Mus musculus
catatatatgatatatgtatatatatatatatatatatatatatatgagatgtatatatatatgctgtatgtatgtatgtatgtata

SEQ ID NO: 64878 - DNA, 78 bp, Mus musculus
gcagctcattccctgagttcagactgtgctcttgcagagactgtgaaggtgactctgggcctagagagatggctcagc

SEQ ID NO: 64879 - DNA, 87 bp, Mus musculus
gctcttgagtggaagagttctgagttactttctattcccatcattctgggaagaagagacccacccagcccttgtagtcctctttgc

SEQ ID NO: 64880 - DNA, 102 bp, Mus musculus
aggtgacccttctccattctattcaacaatcttgactgctctgactgtgactgtgtgagaagagcagggcagtcattggatacagaggatgaaatttcattt

SEQ ID NO: 64881 - DNA, 92 bp, Mus musculus
agcacttaattggtgctggcctgcactttcagtggtttagtccattatcagcatggagagaagagtgccagcacacaggcagacatggtgct

SEQ ID NO: 64882 - DNA, 81 bp, Mus musculus
gtgggcacaggattgccgaggctcttcaggccaggcacagtcactctctcgatcctggtactgtcctttcctggtagcccc

SEQ ID NO: 64883 - DNA, 99 bp, Mus musculus
acaactctatggttgcttcttttgagtttgtctttgattgcaaatgaaatgtaaaagttctgtttttaagagaaatttagaagatactatacatgttgt

SEQ ID NO: 64884 - DNA, 113 bp, Mus musculus
gtaatgaaaaattaaactgtatttactattttaaagtagtcagcactaaggtttctacatgttaggcttgcgccaatttagaatggttaaatctttttaaatacttctcttgc

SEQ ID NO: 64885 - DNA, 70 bp, Mus musculus
gggaattgactgaagagtggctggagacatggtaaagctacgttcctggcactccagtgagagagtttct

SEQ ID NO: 64886 - DNA, 97 bp, Mus musculus
agggcagatagaacctagatgcagaatgcttgcctagaaaattcagagtcttgggttcattctctctatgtgtctctgtctatgtctctgtctctct

SEQ ID NO: 64887 - DNA, 142 bp, Mus musculus
tatgtatatgcatgtgtgcatgtatatatctatgtatatgtttatgtatgtacgtgtttacatatatatgtatatgtttatatatgtatgtatttgtatctgtatgtatatattgtatgcatgtgtgtatgtttatgtatac

SEQ ID NO: 64888 - DNA, 65 bp, Mus musculus
agagacagggtctctctgtgtaacaagccctggctggcctggactctctttgtagtcctgtctct

SEQ ID NO: 64889 - DNA, 80 bp, Mus musculus
gagctgttaggtcattgctgtgggaagggagacaccagccaccggaagccactggtgtttctagacagtctgctcagttc

SEQ ID NO: 64890 - DNA, 106 bp, Mus musculus
agaatagagctgtacggatgctgtcgagacgttgtgctactgtggaatgatgaaagccaaaataacacagagcttgaacatgacaaagacctggccactcacttct

SEQ ID NO: 64891 - DNA, 111 bp, Mus musculus
gttggggtgcttggaattgaacgttaagagttagacaaatatggaagcaagtgaacactgagagctcactaaataagtcaacgaactttaaaagttctttgtcattccaac

SEQ ID NO: 64892 - DNA, 66 bp, Mus musculus
gagggaggaccaccaggcagggggtgaggtcttaggagactgtcagtaacactctgggtgtccctt

SEQ ID NO: 64893 - DNA, 68 bp, Mus musculus
tggtcaagggcagacactggagtcaaaaaatacccaggttcaagggtcagtgactgtctgtgtgtcta

SEQ ID NO: 64894 - DNA, 88 bp, Mus musculus
gttccctgagccaactccccagcctcactctgtgtctctgatagacacggtccagcatacagacaggctccatggcactctggctcag

SEQ ID NO: 64895 - DNA, 79 bp, Mus musculus
agcatggtggctatgtcagtcagtgtcacaggtgtccagtctgtgttgctcttcgtgtctgaaagccttcgcaccagct

SEQ ID NO: 64896 - DNA, 79 bp, Mus musculus
gtgtatgtatatgtatacctatacctatacgtatacctatgcgtatatgtatatgtatatgtatatgtatatgtgtatg

SEQ ID NO: 64897 - DNA, 78 bp, Mus musculus
agccataatacagagagagagcctacatctggacgtgttcctcgtttcacatgcatctctctgtctgtctgtctgtct

SEQ ID NO: 64898 - DNA, 106 bp, Mus musculus
tgcttcataggagctgtgtgtatatgaatatcctcattttgtaaatgaatgaattacagcttaaggagtttatataacttcaaaggcacaatagttactgaaagcg

SEQ ID NO: 64899 - DNA, 97 bp, Mus musculus
tcactcactcagtcagtcattcagtcagtctgtgtgcttgagatcaggtctcatgtagccctgactgtccttgaacttgctcgatagtctagggtga

SEQ ID NO: 64900 - DNA, 122 bp, Mus musculus
tatgtcaatatatatgtgtgtgtatgtatacatatatatgtatatatgtgtatgtatatatacatatatatgtatatatgtgtatgtatatatacatatacatgtatatatatacatatata

SEQ ID NO: 64901 - DNA, 60 bp, Mus musculus
atacatatacatatacatatatatgtatacacacacatatatatgtatatgtatatgtgt

SEQ ID NO: 64902 - DNA, 99 bp, Mus musculus
ggaagatgctcagtcttgggggacaagttggggcagggactcctcagcaacggagggcctctctcttgctctcagtgtcctttctggcatgtgcagtcc

SEQ ID NO: 64903 - DNA, 75 bp, Mus musculus
aacctagctagatcagagatgtttcaggaacatatccttcaggtttgggctctttatgtctctgtctctatggtt

SEQ ID NO: 64904 - DNA, 120 bp, Mus musculus
agtgagatttgtgtttgtgtgactgttcaaatgctgtatttaacatttcaaagttttagaattcttcttactcatgagattaatgtacatattacatatatgtccacataatgatctact

SEQ ID NO: 64905 - DNA, 85 bp, Mus musculus; identical to SEQ ID NO: 64855

SEQ ID NO: 64906 - DNA, 70 bp, Mus musculus
aaatatacatatgaatgtatatgcgtgtgtgtttatatatgtatatgcatacatatatgtgtgtatattt

SEQ ID NO: 64907 - DNA, 85 bp, Mus musculus; identical to SEQ ID NO: 57439

SEQ ID NO: 64908 - DNA, 88 bp, Mus musculus
cccaatagacaaaatcagaaagtgcatgtgcttgtgggcttggcctttataagccagtagctactgtagtttggttccatcgtctggg

SEQ ID NO: 64909 - DNA, 98 bp, Mus musculus
tcttttgatttgtcatgtgtgtgtgtgtgtgcatatgcatgtgcatgtgtgtgtttgtgtgtgtttgtgtgtgtatgtgtatgtgtgagagagagaga

SEQ ID NO: 64910 - DNA, 85 bp, Mus musculus; identical to SEQ ID NO: 57439

SEQ ID NO: 64911 - DNA, 116 bp, Mus musculus
ttcaagttacctgctgaagtcttagtacaacagctagagaactttatatatttttgtaacgaagtcctctgcatgccattgtaaagctagagtaagatttcaaaaggtgggaagaa

SEQ ID NO: 64912 - DNA, 150 bp, Mus musculus
gaatatatatatatatatatgtatatatatatatatgtgtgtgtgtgtgtgtgtgtgtatgtatgtatatatacatatatatatatatatattcaatacatatatattacttactgatatatgtatgtatatgtatatgtgtgtatatat

SEQ ID NO: 64913 - DNA, 75 bp, Mus musculus
ctagtgacaagacatccttgttctttttatgtaattcaaatagggaatgtgtaaaacagatgttttgttttctag

SEQ ID NO: 64914 - DNA, 112 bp, Mus musculus
ttgattctgcaataccaaatgctcagctctaaaataaatatatatatatttcttttataagatatatatagagagatagatgatagagatagagctagatagatagatttag

SEQ ID NO: 64915 - DNA, 61 bp, Mus musculus
tatgtatgtatgtatgtatgtatatattatgtatgtatgtatgtatgtatgtatgtgtgta

SEQ ID NO: 64916 - DNA, 67 bp, Mus musculus
tggctccagtgtgttgcctgtgctcactctaatgattggctgtgagcatctgcatctggattggtca

SEQ ID NO: 64917 - DNA, 107 bp, Mus musculus
agtgtgaagtagtatttgtcttcatttagagtgtccccatgtacatataattatttgttatttacaaagtacacttcaaattgaactaaatggttttaaaacacact

SEQ ID NO: 64918 - DNA, 119 bp, Mus musculus
tgtgactgattttcctgagatttttgtcctcatgatgccagaacctatatttttacatatacagaaatgtacgtggttgataatacatagaacaggaatcaggatggtccccagtctca

SEQ ID NO: 64919 - DNA, 114 bp, Mus musculus
gcttgtttacttattttatgtgtatgtgtgctttgactatgtgtgtatctctgtgactaatgatccatggaggtcagaagaggacactgtgtttgctgggatggagttaggggc

SEQ ID NO: 64920 - DNA, 116 bp, Mus musculus
caattaaatttctgtatatatatatatatatatatatatatatatacatatatataagattatgtatatatatatgtgtatgtatatgtatgtatgatatatgcaataatgatttg

SEQ ID NO: 64921 - DNA, 106 bp, Mus musculus
gaatgcatcattccaaaacataagacaatgttctgcacaccttcatttcataccgttctgccatgagaagatagtgagcacatggattgttgggacagtgctgctc

SEQ ID NO: 64922 - DNA, 117 bp, Mus musculus
tgtgtgttctttgcatgtgtgtatgtgtgtgtgtgcatgtgcatgcatctgtgaatctctctgtgtgtgcctatgtttgtgtgtgcctgtgtgtatacatgcatatgagcatatata

SEQ ID NO: 64923 - DNA, 86 bp, Mus musculus
tgttttttctcctagcagggacatttcagagtacacagtttggacacctaggctcttatggaaatgttgtaactgttgtaaaggca

SEQ ID NO: 64924 - DNA, 99 bp, Mus musculus
gtcatgttgttgttttcctgcctgagtgcttcctgacagagactcactcactctgcataagtctgggttcctctcatgctgaaagaccgctacattgat

SEQ ID NO: 64925 - DNA, 87 bp, Mus musculus
gtctgtatgtctctatgcatgtatgtatgtatgtatgtatgtatgtatacatgtgtatatatatttgtgtgtatgaagtcattggat

SEQ ID NO: 64926 - DNA, 59 bp, Mus musculus
agtgtttctctgtctcagtgatattgtaacctgtgtcaatcactgagacacataatact

SEQ ID NO: 64927 - DNA, 112 bp, Mus musculus
gtgctgtagttgtaccactggataccatgagaggacagaactcatgatctaccaccttggttgagagaaaaatgagagctgtgtaatgagactccatctgatagactagtat

SEQ ID NO: 64928 - DNA, 112 bp, Mus musculus
agatgatagatagataggtagatagatagacagacagacagacagacagacaggggccaaggtctgaggatgtagtttgtggaagagtgcttacctatgcccaacataatct

SEQ ID NO: 64929 - DNA, 114 bp, Mus musculus
ggatgccagaggagggtatcagatctctctggagctggaaaaagagaagactgtgagcagtttaatgggagttctagggacagaactgagactcttttcaagacagtgtgctcc

SEQ ID NO: 64930 - DNA, 108 bp, Mus musculus
gcatgtatatgatcttaaatatttctataggaaattgcttgtatatttgtgacatagccaagtgcatatcgagtacttattagaaatccatgaagatgcataagatgt

SEQ ID NO: 64931 - DNA, 65 bp, Mus musculus
caaggagccaacctttcaggcctggggtctttagagactcaggcactctgtcagaagctgccttg

SEQ ID NO: 64932 - DNA, 80 bp, Mus musculus
gacagggaatggagaattaggcagacacagcatggtgactttgcttcaagttaacctgctttggatttccagtttctgtc

SEQ ID NO: 64933 - DNA, 93 bp, Mus musculus
gctgagttcatttcttactttctttctctgaggttcgttagtcaacagaaatttgtttcgacagtctctgaggaactcatgagcgatgatagc

SEQ ID NO: 64934 - DNA, 85 bp, Mus musculus; identical to SEQ ID NO: 57439

SEQ ID NO: 64935 - DNA, 73 bp, Mus musculus
gtgtatatatgtgtgtatatgtgtgtataaatgtatataatgtgtgtgtgtataagtatgtatatatgtatat

SEQ ID NO: 64936 - DNA, 85 bp, Mus musculus
tccatgtcaggtactgcattgggaatacagtgtgactctctgtcacctttatttccattgagcatgcattgtgtgccaacaaggg

SEQ ID NO: 64937 - DNA, 85 bp, Mus musculus; identical to SEQ ID NO: 57439

SEQ ID NO: 64938 - DNA, 74 bp, Mus musculus
atgtgtgcatatagagagataggtgtatgcatgtgtatgagtctgtgtgagtgtgtgaatttgtgtgtgcacat

SEQ ID NO: 64939 - DNA, 75 bp, Mus musculus
tcttgaggcagttccttgttatgtattcaggctgtccatggactcctgagttcaaatggttatcttgcctcaggg

SEQ ID NO: 64940 - DNA, 77 bp, Mus musculus
ggttttcttggtgtaatgatggagtgaaaatcctcacatgagagggtgcactcttggtctattcattttcaatttcc

SEQ ID NO: 64941 - DNA, 120 bp, Mus musculus
gcatatatgtataggtatatggcatatatgtatatgtacatgtatatacatatatgtgtgtgcatatatgtttatgtatatacatatatacatagatgtgtgtgtgcatatataaaatgt

SEQ ID NO: 64942 - DNA, 98 bp, Mus musculus
gcacaaaaagggcgggagtgggagctccggaaagaaaggctgcacgtgggcactgccccatctctccctctcactgttcctagccagcttccttatgc

SEQ ID NO: 64943 - DNA, 85 bp, Mus musculus
gactttgtcgtgtgcctgttttgtgtgtctgactctgtgcctgtccaaatgctgacttgtgagccagtcatggtatatgtgtgtc

SEQ ID NO: 64944 - DNA, 67 bp, Mus musculus
gcccacactcacagtgacacacctactccaacagggccacaccttgtagtagtgccactccctgggc

SEQ ID NO: 64945 - DNA, 102 bp, Mus musculus
ttgattgtacaaacgcattactggagtcctgtgtgatttcagtgtgtacatactgggacagcatcctttctgaggcttctctgtagtgtctcttgaactcag

SEQ ID NO: 64946 - DNA, 93 bp, Mus musculus
ggcagtgtgctgactggcactctctttggcagatggcaaatgtccaatattcactctggcctctgagggtggcttacttagtccttcacttcc

SEQ ID NO: 64947 - DNA, 60 bp, Mus musculus
gactctaacactgagtgtctgctagttcatgcccagggctgttctagctctctgtgagtc

SEQ ID NO: 64948 - DNA, 91 bp, Mus musculus
gtgcatgtgcacatgtgtgtgtgtgtgtgtgtgtgtatgtgcatgcctgtgtgtatatgtatgtgtgtgcaaatgcatgtgtgcgtgatac

SEQ ID NO: 64949 - DNA, 85 bp, Mus musculus; identical to SEQ ID NO: 57439

SEQ ID NO: 64950 - DNA, 139 bp, Mus musculus
tctggcccattcatgcaacgttgtgggggcgtctgaacctccccatttgacttaatgcatcaatgtggatgagtactgtatctttcctgccttgtctgcctcggcaagatgcctgagaggctcttctgctaaaatgggc

SEQ ID NO: 64951 - DNA, 67 bp, Mus musculus
gtcagcgggaaagatcactggctgctcgtcagaacgacctggctttgatctcaagcacccacatgac

SEQ ID NO: 64952 - DNA, 77 bp, Mus musculus
actagaatagatcaggctagcctcaccttcacagagatgggcctgactctgtctctgagtactggaattagtcatga

SEQ ID NO: 64953 - DNA, 80 bp, Mus musculus
tcttgggtgaatagattttggccgttatggtctccctctgactctgagcgtcctttggaattctgttgtccatcctgtga

SEQ ID NO: 64954 - DNA, 74 bp, Mus musculus
ggatgagagatgagtgtgaagcctgccgccagagcgaggcagagggaagcagggttctgttcgggcgcttaccc

SEQ ID NO: 64955 - DNA, 61 bp, Mus musculus
gagggcaccgctggtctcctcatcctcccatgtgctggatgcctggctgcgtgtttccttc

SEQ ID NO: 64956 - DNA, 79 bp, Mus musculus
agtggagtctgtctctctgcgtgagtggtactggccacttcacttaagcatgctgagtaaataagtcataggctgcact

SEQ ID NO: 64957 - DNA, 87 bp, Mus musculus
ggggcagccagtcagtcccctcaggccttcgtacgtacacaccactgttgaaattggagccacagtgggtctgtctgtgtgagtctt

SEQ ID NO: 64958 - DNA, 64 bp, Mus musculus
ggaagtctggggaattttaagtggcacttaaaagagtgcctcacttcagttcttctagtcctcc

SEQ ID NO: 64959 - DNA, 96 bp, Mus musculus
cagcaccacacacacacacacacacacacactgccattcctcctacacgcctacatgtatatagtgtgtctctgtgtgtgcgtgtgactgtagttg

SEQ ID NO: 64960 - DNA, 83 bp, Mus musculus
cacacgcacacacagagacacactatatacatgtaggcgtgtaggaggaatggcagtgtgtgtgtgtgtgtgtgtgtgtggtg

SEQ ID NO: 64961 - DNA, 83 bp, Mus musculus
agagagacagacagagatagagagatagaggcaaacatgtgtggatgtttctctatacatctgtgtgtctctgtatttcggtt

SEQ ID NO: 64962 - DNA, 70 bp, Mus musculus
agagacacacagatgtatagagaaacatccacacatgtttgcctctatctctctatctctgtctgtctct

SEQ ID NO: 64963 - DNA, 167 bp, Mus musculus
gtgtgcatgtatgtgtgtgtatgcatgtgtgtgtacatgtatgtgtgtatgtatatgtgtatgttgtatagatgtatgtgtgtatatatgtatatgtgtatatgtatatgtgtatattgtgtttatgtatgtgtatatgtatatgcatgtataaatatatatttgtg

SEQ ID NO: 64964 - DNA, 82 bp, Mus musculus
agatatttatttagagtcatgtgcatacacatgtctatggggaggtgtccacacacatgtgtgtgtccagacttgggtgtct

SEQ ID NO: 64965 - DNA, 87 bp, Mus musculus
tgcatgttcatgtctgtctgtctctctccatatctatctatctgtatatatagatagatatagatgatctatattgtgtaatatgta

SEQ ID NO: 64966 - DNA, 78 bp, Mus musculus
acattcaaacacagaattgtgactctaaaggctatgctttgcacttaatagggtcaagctttctggcaatctttatgt

SEQ ID NO: 64967 - DNA, 98 bp, Mus musculus
atttatgttgctctcaatgttggtcagagaagtctctgttctcagtggggaatagttaatgttgagactcataactgatcaaaatgccaaatataagt

SEQ ID NO: 64968 - DNA, 85 bp, Mus musculus; identical to SEQ ID NO: 63858

SEQ ID NO: 64969 - DNA, 80 bp, Mus musculus
gtgtgtgtatgtgtgtgtatatatatatacatatatatatatgtacatatgtatatgtacatatatatacatttatgtgt

SEQ ID NO: 64970 - DNA, 96 bp, Mus musculus
gatcagccttagtacatggtaacctgatagggtacacaggataaattcaatatttttgtatctgttgaggcctgttttgtgaccaattatatggtc

SEQ ID NO: 64971 - DNA, 118 bp, Mus musculus
cacttatgtgtttatgtacttgtgtatatatgtgtgctctatgtgtttgtatatatgtgtgtatataaatatgtgtaagtatatgtgtatattcatgtgtatgtttgtgtatatattg

SEQ ID NO: 64972 - DNA, 77 bp, Mus musculus
tatgtgaatatatatgtatattaacatgtgagtgtgtgtactatatgtgtgtatgcatgtgtgagtatatatatatg

SEQ ID NO: 64973 - DNA, 102 bp, Mus musculus
ccagcctggagggtttaagagaggagagctgcctcagtctctcacaggctgcatgtggcacttgggagagtgggcctactccttgactgggcagcacagtgg

SEQ ID NO: 64974 - DNA, 118 bp, Mus musculus
tctctggtctctactttcactcaggctctagaatccaagtgaactacacacacacacacacacacacacacacacacacacacacagagagagagagagagagagagagagagagaga

SEQ ID NO: 64975 - DNA, 121 bp, Mus musculus
aatgggtgacatctcagattttacttggaagcatttgaaggagtctgaagtcagtgtggacttttaggtgacattgggtaaaatgttggctggtgagaccactcattcttcagtgattcct

SEQ ID NO: 64976 - DNA, 83 bp, Mus musculus
tgagggcacgtttctcactgtttgtcactgaggatgggcagcccttggcatctggcgagctgcgtggtgagagaggccgctca

SEQ ID NO: 64977 - DNA, 117 bp, Mus musculus
gtgaaatgtccatcagaacatgtcaaacatgctcattctaaggacaagggacacaacagtcacagctgtgtcctggttatgccgaggcgttggctgttctgagctggagacctgcac

SEQ ID NO: 64978 - DNA, 111 bp, Mus musculus
ctctaggtcctctgcctgattctgattcctccggtgtctgtctgtgtgtgagccagcagcgtgctggtttgggcctcctgcattgctttttctgttcaggattgcttggag

SEQ ID NO: 64979 - DNA, 114 bp, Mus musculus
gcccctcccctttacctttatgaagttagtaactgcaacttggtgtggtttcttgtgtagctcctgcaccgtgtgttttcgtggtttggactcaattaccttacaaaggcaggc

SEQ ID NO: 64980 - DNA, 105 bp, Mus musculus
agacagacagacagacagacagacactggctatttgtgtgtgtgtgaaggagagagacagagagacagagaggggctagctgtgtgtgtgtgtgtgtgtgtgtgt

SEQ ID NO: 64981 - DNA, 127 bp, Mus musculus
atgtatgcatggatatacgggggctgtggatatgtggggggtctatggatgtatatgtttatgtatatattacatatgcacatagtgcactcgacatctgtgtggtggtatgtatagatgtatatgg

SEQ ID NO: 64982 - DNA, 85 bp, Mus musculus
gagagggaaacagagacacagacacacgcatacacacagagagacagacagagaatgtgtgcatatgtgtacctgggttacattc

SEQ ID NO: 64983 - DNA, 108 bp, Mus musculus
ggagagtgtgagctgaactccagtgggtggggcaggcatctgtctctctctgtttaccaactgcagcatcaccatgaccagccaccacacacttctgccacaccttcc

SEQ ID NO: 64984 - DNA, 88 bp, Mus musculus
aggcagagacaggcagagacaaggccagcctggtctacacagtgaatgagttccaggacagccagtgctacatggttgtattctgtct

SEQ ID NO: 64985 - DNA, 99 bp, Mus musculus
ctagcatcttttcctacgcatctcagactcaggccagtgtgcacatgctgcaggaacacagtgagtacacaatgagtaactagtaggctcaggtgctag

SEQ ID NO: 64986 - DNA, 97 bp, Mus musculus
gggatttgaaagagatgaaagggggctggagagatggctcagtggttaagggcactgactgctcttcctgaggtcctgagttcaattcccagcaacc

SEQ ID NO: 64987 - DNA, 66 bp, Mus musculus
ctgtgggccttgggattgggtgttcctatacagcactgccctatctgacactctctcagcccccag

SEQ ID NO: 64988 - DNA, 78 bp, Mus musculus
tccaaggtgcactggtttgtgtctgtaattctgacgctggggggctggggggagggcaaggacaggagtgaccctgga

SEQ ID NO: 64989 - DNA, 85 bp, Mus musculus; identical to SEQ ID NO: 57439

SEQ ID NO: 64990 - DNA, 94 bp, Mus musculus
ctctgttaagaaatgactttctaggagttagagatggctcagtggttaagagcacagactgttcttcctgaaggtcctgttagatctagtggag

SEQ ID NO: 64991 - DNA, 77 bp, Mus musculus
tcagggaaccactagggagagtgttttatcctctaagctcctcaggccattgctgcatcctctctgtgtctctctga

SEQ ID NO: 64992 - DNA, 104 bp, Mus musculus
atgcatgtgggtgtacatgtgcatgtgtgtgtgatatgtatgcatgtgggtgtgcatgtgcatgtgtgtgtgatatgtatgcatgtgggtgtacatgtgcatgt

SEQ ID NO: 64993 - DNA, 125 bp, Mus musculus
atgcatgtgggtgtgcatgtgcatgtgtgtgtgatatgaatgcatgtgggtgtgcatgtgcatgtgtgtgtgtgatgcatgtgtatgcatgtgggtgtgcatgtgcatgtgtgtgtggtatgtat

SEQ ID NO: 64994 - DNA, 63 bp, Mus musculus
gcatgtgggtgtgcatgtgcatgtgtgtgtgatatttatgcatgtgggtgtgcatgtgcatgt

SEQ ID NO: 64995 - DNA, 63 bp, Mus musculus
gcatgtgggtgtgcatgtgcatgtgtgtgtgatatgaatgcatgtgggtgtacatgtgcatgt

SEQ ID NO: 64996 - DNA, 95 bp, Mus musculus
tactacttatgtctttgtctgcctctgtctctccgtaggtcagaatctttaatctttggtagtgaaggctgaacaatcctagaatttaagttgta

SEQ ID NO: 64997 - DNA, 76 bp, Mus musculus
tctgtagcgtctgagtactgagagacctcagaatgtataatttctctgtagtgtctgagtcctcagagacctcagg

SEQ ID NO: 64998 - DNA, 128 bp, Mus musculus
aggccgtttgttcaggctcctcatccacaggtccacttccttaggggaggggtctggagcctctgtcagtctctctgtggtaatactgtgagtgtgctctgttgcctggagtgcgggcagccttgctc

SEQ ID NO: 64999 - DNA, 81 bp, Mus musculus
ttcatactgcatccttattttttgcagagttgagaaattatatatttttgaactcatgctctattaaagggctgtactgaa

SEQ ID NO: 65000 - DNA, 79 bp, Mus musculus
gtctagcctgaaggtgcgtgtatgtgtgtatttatatgtatgcatgtgtatatagatatatatgtatgtacatgcagat

SEQ ID NO: 65001 - DNA, 99 bp, Mus musculus
tatgatgttagtggaagtgttaacatgcttatttaatgttttattcaaagggattacaagaattaattgtggcagtggttatatttgttaaacatcata

SEQ ID NO: 65002 - DNA, 136 bp, Mus musculus
gtatacatatacatatatgtatatatgtatacatatacatatgtgtgtgtatatatgtatatgtatatgtatatatatatatatatatatatatatgtgtgtgtgtgtgtgtgtgtgtgtgtgtgtgtgtgtgtat

SEQ ID NO: 65003 - DNA, 85 bp, Mus musculus; identical to SEQ ID NO: 57439

SEQ ID NO: 65004 - DNA, 113 bp, Mus musculus
gtcttcatcaaagattaagcgaccataggtgtgtgtggcccaaatgattcagagagcaggcatgattggtgggaaaagggaagcttatctgtgtggttaatgatctggaggtc

SEQ ID NO: 65005 - DNA, 85 bp, Mus musculus; identical to SEQ ID NO: 57439

SEQ ID NO: 65006 - DNA, 98 bp, Mus musculus
gccatcttgggaactatgtgtagagtcgttcagtgacacggtgactgtgtaaccatggcccatcacccccagtccgttctctcactggtcatgatggc

SEQ ID NO: 65007 - DNA, 96 bp, Mus musculus
ctgtgaatggatagataagtagatgaccgatacagagatagaaacacttgtatgtatagaagtctgttcatttaagaatctataattcagccacag

SEQ ID NO: 65008 - DNA, 85 bp, Mus musculus; identical to SEQ ID NO: 57470

SEQ ID NO: 65009 - DNA, 115 bp, Mus musculus
cagatacggacaagagctggcttagtggctatgcgtgtggtcagagactgttgtcagtgtctgtctcagttatctgaaccttatctgctgaggcagagcctcctacagactctgg

SEQ ID NO: 65010 - DNA, 89 bp, Mus musculus
ggggtttgtgaatctctcactctctcattcttgttaacaattaaaatatggaaactcagcatgggaggaaggaaagagggagaagcctt

SEQ ID NO: 65011 - DNA, 86 bp, Mus musculus
ctccctgagccactcagtgtctccgtggctgttgggaagatgtactgcggacttcctcacagacattaggcattctgttgggggtg

SEQ ID NO: 65012 - DNA, 86 bp, Mus musculus
tcagagactgtgagaatagacagagggcaaatgcatttttcatggaattgcatgctcttcattccgggttctgttcacagtcttga

SEQ ID NO: 65013 - DNA, 118 bp, Mus musculus
atgtacttatgtattatatatatgtactatgtgtgtatatatgtgtatatatatatatttatgtgtatatgcatttatgtattatatattatgtgtgtatttatgtgtgaatgtatgt

SEQ ID NO: 65014 - DNA, 71 bp, Mus musculus
gcatatatatatatatattcatgtgtgtatgcatttgtgtattagatatatgtatttatgtatgtatgtgt

SEQ ID NO: 65015 - DNA, 92 bp, Mus musculus
tccaatgcactcagagaagagactcagcaaagagaccagaagtggaagctctggcatgtcctccaggttgaaaattctccaagtgggtgggg

SEQ ID NO: 65016 - DNA, 116 bp, Mus musculus
atgtgatgctcatgtggatggtaatgaattcaagtgacgatagtggcaaagctagatggttgtctagtttgtacacttttctctgctggacttcttgcttagctaggagattatat

SEQ ID NO: 65017 - DNA, 70 bp, Mus musculus
gtgtgtgtgtgtgtgtgtgtacatggaatagatgtgtatatatgtgatgtatatatatgtatatgtatgt

SEQ ID NO: 65018 - DNA, 86 bp, Mus musculus
accagctcccccacaaggaggccagagatgaagcttgagcctatattgtcaattttcactgtctggatcttgttttttgagcaggt

SEQ ID NO: 65019 - DNA, 85 bp, Mus musculus; identical to SEQ ID NO: 57470

SEQ ID NO: 65020 - DNA, 78 bp, Mus musculus
gctagaatccaagtctccaacttcttcctctaagttctgcagagctaggagagtagagaatgagctcagatcaatggc

SEQ ID NO: 65021 - DNA, 74 bp, Mus musculus
aggtacattctccaggctgtgctggtactctgtccctctcactatgtcaccatgtcacactgcctgagaagcct

SEQ ID NO: 65022 - DNA, 114 bp, Mus musculus
gtcagaggtgactgggtgcaaaacattttatggactaccaagctcaaattttattaatttttgacagctaagaaatgggaagcctaagaattcagttcccctattatgttcggc

SEQ ID NO: 65023 - DNA, 77 bp, Mus musculus
gtgtgtgtgtgtgtgtgtgtgtgcatgtgttgtccctgtgtgtatgtgtgtgtgcattagcatgtgtacgctaacat

SEQ ID NO: 65024 - DNA, 120 bp, Mus musculus
tctgttcaatgttattattagtaacactgaatatatatatatgtgtgtgtgtatatatacatatatatatatatgtatatatatatatattagtgtttactttcaatatatttcatgaca

SEQ ID NO: 65025 - DNA, 79 bp, Mus musculus
gcatgggctgagacttcactatggcttcagatggcagggtaggctactcacatcagtctgtttctctcttctctcatgc

SEQ ID NO: 65026 - DNA, 118 bp, Mus musculus
catcccatggataggcaccaatacctgaaactctcattgatgatatattgtgcttgcagacagaagtcagtatggctatcttctgagaggttctattcacagctaattgagatagatg

SEQ ID NO: 65027 - DNA, 118 bp, Mus musculus
ggagtgtgtcaccaggagtggactttgaagtttcataggctcaaggcagtcatagtgtcccactctctctttcttgtgcccaccaagccagatgtagaactttaggtggcttctccac

SEQ ID NO: 65028 - DNA, 118 bp, Mus musculus
ggagtgtgtcaccaggagtggactttgaagtttcagaggctcaaggcagtcagagtgtcccactctctctttcttgtgcccaccaagccagatgtagaactttaggtggcttctccac

SEQ ID NO: 65029 - DNA, 99 bp, Mus musculus
ttgtggatgccaacaagagcttgatgacaggggcctgatatacctgcctcttcagaggctctgtcagtgcctcacaaatacagaacttgatgctcacag

SEQ ID NO: 65030 - DNA, 111 bp, Mus musculus
tggctttgcccaagtgtacttgttttacataggaattaaatgagagttgtactttccattggttttctagctgttttgtctgtaagatacagtgtatatgtagttgagtca

SEQ ID NO: 65031 - DNA, 74 bp, Mus musculus
ctgatttctgactgatctgtcttggtcagacaataatgtttacttagatactggacagacagacagacagacag

SEQ ID NO: 65032 - DNA, 65 bp, Mus musculus
tctgtctgtctgtctgtccagtatctaagtaaacattattgtctgaccaagacagatcagtcaga

SEQ ID NO: 65033 - DNA, 95 bp, Mus musculus
tacacatacatacacacacacacacacacacacacacacacacacacacgtgtgtgtgtgtatatgatgtatatgtatatgtatatgtatatgta

SEQ ID NO: 65034 - DNA, 79 bp, Mus musculus
acttctgttactttcactgtgtcactgtttagtttctgtttccaggatctgtccattgatgagagtggagtgttcaagt

SEQ ID NO: 65035 - DNA, 86 bp, Mus musculus
tatgtgtatatatgtatgtgtgtatatatgtatgtgtgtatatatgtgtgtatgtatgtgtgtatgtatgtatgtatgtatgtatg

SEQ ID NO: 65036 - DNA, 128 bp, Mus musculus
aaacactaggtggaacactgttactaacaggcattgtatgtgtgcatgtgcatgtgtgcatgcatgtatgtgtgtatgtgtgtgtgtgtgtgtgtgtgtgtgtgtgtgtgtgtttatattggtaggag

SEQ ID NO: 65037 - DNA, 85 bp, Mus musculus; identical to SEQ ID NO: 57439

SEQ ID NO: 65038 - DNA, 77 bp, Mus musculus
gatctgtgtgtgcctatgtgcatatgtatttctcatgtatatatgaatgtatttatgtatgtgtgtatgtaaatgtc

SEQ ID NO: 65039 - DNA, 106 bp, Mus musculus
tgtgtcattgaaatctactatgtatgcatatgtacatgtatatacatatatgtgaatattgtgtgtatacacacatgctttaacaagtgattgccacaatgaacat

SEQ ID NO: 65040 - DNA, 109 bp, Mus musculus
tgtctcctcctaatttctggttcatctttggttaccattttcaaagtttttttttcctctgaattatggtaaaattcaaagacatatttttttggaagttttctgggca

SEQ ID NO: 65041 - DNA, 85 bp, Mus musculus; identical to SEQ ID NO: 57439

SEQ ID NO: 65042 - DNA, 74 bp, Mus musculus
gtaggagcaacacctgagcagtaggaagccttgtggtgttaatggcttaaactctgttcagtgtgtgtcacagc

SEQ ID NO: 65043 - DNA, 102 bp, Mus musculus
tggtggactaggtgaggaagtataaaggaaatcaagaataaatgtgtatacaaaagagaatttcttgtaaactagaaatttctatatcatcctgtgttgcca

SEQ ID NO: 65044 - DNA, 111 bp, Mus musculus
ctgtcaatcaccctttgttctatttctgtttccctgatttcacagtcagctttggtggggagttagatttgggaatcatggtacagagtaagaagaaagtatatggaagga

SEQ ID NO: 65045 - DNA, 84 bp, Mus musculus
aagcatagccacatgcatgtgagtgctccagacgtgcctcgtgcctcacacacacaggctcacactcactgttgtctcatgttt

SEQ ID NO: 65046 - DNA, 85 bp, Mus musculus; identical to SEQ ID NO: 57439

SEQ ID NO: 65047 - DNA, 76 bp, Mus musculus
gtgtgtctggctgtctctgtgcattgatgtgagagcagggacttgtatgattgtatgtatgatagtgcaggcatgt

SEQ ID NO: 65048 - DNA, 97 bp, Mus musculus
gccttctctatactggggggtcagcaataatattaaatgtatttctttatgaaaaaggttctataatgtggattgccatctatatgtaggtgagggc

SEQ ID NO: 65049 - DNA, 128 bp, Mus musculus
tataaaagcatatccatcatatatatatataatatatatatatatatacatatatatatatatacatatgtgtgtgtatgtatatatgtgtatatatatgcacatatgttttgtatatacacacatga

SEQ ID NO: 65050 - DNA, 90 bp, Mus musculus
gtgtgtgaatattatgtatatatacataatgtatgtatatgtacatacacatgtatgtatttatatatgcatgcatatatgtatagatac

SEQ ID NO: 65051 - DNA, 101 bp, Mus musculus
ccctctccccccccccccgtcactctgtcactctgtcagcaaagtgggaaagtttgacatttggccacacatttggagattttggcagtttgacttgaggg

SEQ ID NO: 65052 - DNA, 116 bp, Mus musculus
gtcttctatagccagccttgtgacttgggtcattatgtgtgtgtttgcatttgtagctcaaaacacaaaccatacatctgtttaagatcttaagaatccttgttgattagatagac

SEQ ID NO: 65053 - DNA, 85 bp, Mus musculus; identical to SEQ ID NO: 57439

SEQ ID NO: 65054 - DNA, 73 bp, Mus musculus
gaggccagtccttggcagaggttcttaatactgacatggaaagtgttcctgtctgtctctgtctatgtgcctc

SEQ ID NO: 65055 - DNA, 153 bp, Mus musculus
tgtttaagtctgtttgtctatatgtatgtacatacctacgtatgtatgtatgtatgtacatacctacgtatgtatgtatgtttgtatgtatgtattaacacttgtggagttgaggcaggtattcaggcccaaccagagtgtggtgtgtgtgtg

SEQ ID NO: 65056 - DNA, 85 bp, Mus musculus; identical to SEQ ID NO: 57439

SEQ ID NO: 65057 - DNA, 68 bp, Mus musculus
aacagtccagtaaatcactgaagaggaaaggaggttgactctttctgtcactcccagtctgttctgtt

SEQ ID NO: 65058 - DNA, 85 bp, Mus musculus; identical to SEQ ID NO: 57439

SEQ ID NO: 65059 - DNA, 74 bp, Mus musculus
ggtgtagaggctcacatctgtaattcaagaactgagtttgaggccagcctgagctacagagtgagaccctacct

SEQ ID NO: 65060 - DNA, 78 bp, Mus musculus
gtttagtcctgagtgtgtcttcagagctgtaatccccacatagaatggagctttgactccagacacaatcagctgtgc

SEQ ID NO: 65061 - DNA, 76 bp, Mus musculus
atctatctatctatctatctatctatctatctatctatctatctagatatagatagatatagatatagttatagat

SEQ ID NO: 65062 - DNA, 76 bp, Mus musculus
ctatccgtgctcacttcagactgtggagtcttggtgtggccctctgggaactgtaggactgaggtttacaggacag

SEQ ID NO: 65063 - DNA, 84 bp, Mus musculus
gcttacaactttccaaagaattctccttttgggctttctcattttattttaagccctaaggtgaattttttgggaagtttgagc

SEQ ID NO: 65064 - DNA, 113 bp, Mus musculus
aaaaggcataggataggtggagggtacgcacaagtgcttgtgagcaggtagttaccacacacactgtctcagaaagctgactctgaccagacctctccacaaatggcttttcc

SEQ ID NO: 65065 - DNA, 88 bp, Mus musculus
catatgtttgtatgtgcatgtgcatctgtatgtctgttatatgtctatgtatgattataagtgtactagattgtaaatgcaatgtgtg

SEQ ID NO: 65066 - DNA, 100 bp, Mus musculus
tcagtggagtttctttgtgcagtggatggtggttaacacagaaactcacaactctgagtgcacagaatcagtgtctatggaatgctaagctacaaactgg

SEQ ID NO: 65067 - DNA, 74 bp, Mus musculus
gtgcatcatatatatatatatatgtgcacctaactatatatttgtgcatcatgtctgtgtatatgtgtgtgtat

SEQ ID NO: 65068 - DNA, 72 bp, Mus musculus
tgatgcacaaatatatagttaggtgcacatatatatatatatatgatgcacagacatatgcttaggtgcaca

SEQ ID NO: 65069 - DNA, 117 bp, Mus musculus
gggcagggcaaggaggtggagctggaagcatagttggtgtggtctctgatctgtgaacagacagaggtgtcagaggacagagctactgactttggctctcttctcttgatgttccct

SEQ ID NO: 65070 - DNA, 81 bp, Mus musculus
gagtatatgtacaggtgtgtgtgcatgtgcatgtttgtattgtgcatgcatgtgtgtgcttgcatgtttgtgtgtgtattc

SEQ ID NO: 65071 - DNA, 102 bp, Mus musculus
gctttatggttggtcttacaattggtttaaacctactgatcaatcccaccagggcagcaactcagtggaacttgttttatttggaggatcagcccttattgt

SEQ ID NO: 65072 - DNA, 85 bp, Mus musculus; identical to SEQ ID NO: 57470

SEQ ID NO: 65073 - DNA, 85 bp, Mus musculus; identical to SEQ ID NO: 57439

SEQ ID NO: 65074 - DNA, 80 bp, Mus musculus
tgttccagttatctgtctgtgtcaggcagtgttctgggaaactgtgagccaggttatcacgagaggacaggtgaggaata

SEQ ID NO: 65075 - DNA, 107 bp, Mus musculus
cttcctgagtgctgggattaaaagtgtgcaccatgcccatcttgaaatttatttcttttaaaaagcataataattatgaagcctttgggtcttggctatacagggag

SEQ ID NO: 65076 - DNA, 78 bp, Mus musculus
gagggcacacttgtgatttagatcatgaagctggaaggcacaggcttttgatgtagattttgaagcatagtggctttt

SEQ ID NO: 65077 - DNA, 81 bp, Mus musculus
gtgtaaatgatatgtatgtatgtatgtgtgtacttatgtatgtatgtatgtacacatgtgcatgtgtcaaattgttggagc

SEQ ID NO: 65078 - DNA, 79 bp, Mus musculus
tggcatctgtgacactgactctcagtgagcactgtcctttggctgtgcttattaaagtcaagtgtgtcctgtaatgcta

SEQ ID NO: 65079 - DNA, 83 bp, Mus musculus
cctctcattacaactaacaatagtgattttgctcaccatggtgctgcacacatccactcatgtatagaagtaagttttagagg

SEQ ID NO: 65080 - DNA, 131 bp, Mus musculus
tgcctcagtggatcacagtaacataagcagaggcctaggaaatgaaggatgaacatatcacagggattatgagtttggttttaaatgcatcatgttttgtgtctgtggggcatcgtgtacctatgctcagc

SEQ ID NO: 65081 - DNA, 92 bp, Mus musculus; identical to SEQ ID NO: 57641

SEQ ID NO: 65082 - DNA, 102 bp, Mus musculus
tatatgaatgaaaatgccatatgtgtgtatatatatatgtgtgtatatatacacacacacatacacacacatatatacatatatatatatatatatatatat

SEQ ID NO: 65083 - DNA, 89 bp, Mus musculus
tcactcagtatgcaacagaatcagcttgtaagaaaggcaaaatccagtccctcatactctcaggctgcattcatcagctctgacagtga

SEQ ID NO: 65084 - DNA, 84 bp, Mus musculus
atatgtatgtgtatatctatatctatatacatgtgtgtatgtatatctatgtatatacatacatatacatatacacatatatat

SEQ ID NO: 65085 - DNA, 93 bp, Mus musculus
ttgaccgtatctattggattaagtacttgtgcatgtgctatggtataaatgctacaacacttctgtatgtgtagttttgtgggcaaaggttgg

SEQ ID NO: 65086 - DNA, 105 bp, Mus musculus
acacactgatgcacacacacacacacacacacacacacacatacatattgtgtctgtgtgtgtatgtgtgtgtgcatgtgagtgtgcatgtgcatgtatgtgtgt

SEQ ID NO: 65087 - DNA, 118 bp, Mus musculus
ttcatcttggtttataaattatgcctctgaacaaccaatctggttttgaatagaatgttaagaaatatgtttaatgaaatcagtatgtggtgggctagtgatttgttcacctgcggaa

SEQ ID NO: 65088 - DNA, 90 bp, Mus musculus
gagacatggtctctctgtgtgtgtctctatggcctgaaacttactatatagaccagaatggcctcacattcacagaggtgcacttgtctc

SEQ ID NO: 65089 - DNA, 96 bp, Mus musculus
atatatggctggatcttaaatgaccctcaacatcccatatactaatgtatggcaccattgggaatggtagaactttcaggaggtaaggctaaatgt

SEQ ID NO: 65090 - DNA, 80 bp, Mus musculus
ctcagtactgggaattgagttggcacagggactcctcaataaccgagggtctctctcttcctctcagtgtccttgctggg

SEQ ID NO: 65091 - DNA, 98 bp, Mus musculus
gcaatttggcatatatatatatatatgcatgtgtgtgtacatatatatacatatatatacgtacatacatatgtgtgtgtgtctgtgtgtctgtgtgt

SEQ ID NO: 65092 - DNA, 112 bp, Mus musculus
aagacagtatgaccaaacagatcttccccacattaccaagactagagacagagcagtcttttttgaaccctcttttctactttgtccttaggcctttggtctagctagtttt

SEQ ID NO: 65093 - DNA, 74 bp, Mus musculus
agcctttgagacagttgcttggtaaccattcctcacagttggctgctgtgtctgagtcactcaatcttttggct

SEQ ID NO: 65094 - DNA, 115 bp, Mus musculus
tcatcaatggagaagacactggctgacatcccataataagcctgaccttgcttatcattgcttttcttggtcaatcttcctatgctggtctcattcacacttttctttcatggat

SEQ ID NO: 65095 - DNA, 94 bp, Mus musculus
gatagttacctatctatgtatatatatatatatatatatatatatatatatatatatatatatatatatatatgtatgtatctatgtgtctatc

SEQ ID NO: 65096 - DNA, 90 bp, Mus musculus
ttttctaaaatggcagtgtggcttcaggcatattctcactacttagaaagcagtgatgggacatagccagaggctttgcagaaggtgtca

SEQ ID NO: 65097 - DNA, 76 bp, Mus musculus
gagtgtttggctgggtatagtagcctgggctggcatttgtgttctctcagtgtctctataacatctgtccaagatc

SEQ ID NO: 65098 - DNA, 85 bp, Mus musculus; identical to SEQ ID NO: 57470

SEQ ID NO: 65099 - DNA, 85 bp, Mus musculus; identical to SEQ ID NO: 57470

SEQ ID NO: 65100 - DNA, 114 bp, Mus musculus
tggggagaagtcctaggaaatgcagtttttaggacataaaatggctgttgcactcacaaactcacagcaagtaagttgatctgaacaagaactgtacaagattgggaccaccta

SEQ ID NO: 65101 - DNA, 114 bp, Mus musculus
cagggttccggacaggtatgcaaagagttggagagaaatgacaaacaaatacgggacacaagagagtgtgctgtatctgaatgtactttgtcaaattgagcatgtagaatcttg

SEQ ID NO: 65102 - DNA, 93 bp, Mus musculus
tctctctgttgctctcaatctctgtctattgtgcacacacacacatacacacacacacacacacagagagagagagagagagagagagagaga

SEQ ID NO: 65103 - DNA, 103 bp, Mus musculus
cctagtccatgatggtctgataggatgcatgggacaatttcaatatttttgtatctgttgagtcctgttttgtgatcagttatatggtcaattttggacaagg

SEQ ID NO: 65104 - DNA, 93 bp, Mus musculus
gcagtgaaacaattgctatatttttttaaatgttgtctatgttttcttaaaggcattcctactcgaaaagatgtggttacttcattccactgc

SEQ ID NO: 65105 - DNA, 114 bp, Mus musculus
tgtttttcatattgaggtatttgaacaggtataatgtttgttttaaaaatatttaatttttaattagtatttgcgtgtacatgtgactataggtgccttcagagtccagaggca

SEQ ID NO: 65106 - DNA, 85 bp, Mus musculus
ggccatggtggtctgataggatacatgggacaatttcaatatttttgtatctgttgggccctgttttgtgaccaattatatggtc

SEQ ID NO: 65107 - DNA, 62 bp, Mus musculus
tacatgtgtgtatgtatgtatatgtatgtgtatgcatgcgtgtgtgtgtgtgtgtgtgtgtg

SEQ ID NO: 65108 - DNA, 85 bp, Mus musculus; identical to SEQ ID NO: 58391

SEQ ID NO: 65109 - DNA, 106 bp, Mus musculus
gccttaatccatgatgatctgataggatgcatgggacaatttcaatatttttgtatctgttgaggcttgttttgcgaccaattatgtggtcagttttggagaaggt

SEQ ID NO: 65110 - DNA, 106 bp, Mus musculus; identical to SEQ ID NO: 65109

SEQ ID NO: 65111 - DNA, 85 bp, Mus musculus; identical to SEQ ID NO: 57470

SEQ ID NO: 65112 - DNA, 120 bp, Mus musculus
tacaagagcacacacatgcaaacacactagtaataatataagataaaataaataaatgtaatttaatttgttaaaatttattttattattttatatgtatgaatgcattgcttgtatgta

SEQ ID NO: 65113 - DNA, 85 bp, Mus musculus; identical to SEQ ID NO: 57439

SEQ ID NO: 65114 - DNA, 85 bp, Mus musculus; identical to SEQ ID NO: 57439

SEQ ID NO: 65115 - DNA, 81 bp, Mus musculus
tggtggtctgataggatgcatggaacaatttcaatatttttgtatctgttggggcctgttttgtgaccaattatatggcca

SEQ ID NO: 65116 - DNA, 80 bp, Mus musculus
gcggctgtcccggggcttgagtgcttgagtgagggtctccctttgggggtctttcacacactctcaccggtgcagactac

SEQ ID NO: 65117 - DNA, 96 bp, Mus musculus
gaccagctttaatctatggtgatctgataggatgcatgagataatttcaatatttttgtatctgttgaggactgttttgtgaccaattgtatggtc

SEQ ID NO: 65118 - DNA, 65 bp, Mus musculus
gaagcagtgactgtcagtgagtcttaggaaggcatgtcctttctgaaatactattgcactgtttt

SEQ ID NO: 65119 - DNA, 104 bp, Mus musculus
aagatcagccttactccatggtgatctgataggatgcatgtgataatttcaatatttttgtatctatttaaccctgttttgttaccgattatatggtcaatttt

SEQ ID NO: 65120 - DNA, 110 bp, Mus musculus
tagattcacttccttgttggggtttcaacctctgagtgtcagttactcacttcttggaaacctgaagttagactaagagcacaggttgtcctaatggctgtggcatactg

SEQ ID NO: 65121 - DNA, 64 bp, Mus musculus
taggtgcatgtatatacacatatatgtatacatatatgtacatatatatatatacatgcattta

SEQ ID NO: 65122 - DNA, 143 bp, Mus musculus
cacatatacataatatatgtacatatatgtatatatgagtatatatgtatatgtacatatatgtacatttgcatatgtatacatgcatatatgtgtatatatttgaaattgtgtataaatatgtaaaaatgtatatataagca

SEQ ID NO: 65123 - DNA, 85 bp, Mus musculus; identical to SEQ ID NO: 57439

SEQ ID NO: 65124 - DNA, 115 bp, Mus musculus
ataaccaccaaaagctcatatatttgagtgcttagtcatcaggggctcactgaaaagatttgaatattagtatgtgtggcccttttggagtagatatgggtttgatggagagtgt

SEQ ID NO: 65125 - DNA, 92 bp, Mus musculus
atatatatatatatacatatatatatacatatacataaaaacacacacatatatatgtatgtatgtatatatatatgtgtgtgtatgtatat

SEQ ID NO: 65126 - DNA, 86 bp, Mus musculus
cttacctctactttctgaatcacacacacatacacagaattaggggtaggggtggaagtgggggagacagagaggaagagagaaag

SEQ ID NO: 65127 - DNA, 111 bp, Mus musculus
cagaatactgagtatgattattgagttgttaatgacaggagtgtgcacaaaggttagagaaacacaggggcatgaattgttagaagagcttgtattgcgttaaggattttg

SEQ ID NO: 65128 - DNA, 101 bp, Mus musculus
ggaacaaatgagcaactaaaagattgtagttgaattttgctgtgtttgtatatcaaggcgacaaggagacagctgcattggttagtagcttgttttgtttt

SEQ ID NO: 65129 - DNA, 85 bp, Mus musculus; identical to SEQ ID NO: 57439

SEQ ID NO: 65130 - DNA, 120 bp, Mus musculus
gtacatggtggacagaacaggtcactgcagaaggttctgggatgcactctcagtgtctgtgtctcaatgaacagtagatgtgatgtagtcagatgttctgagctctcattctagaagctc

SEQ ID NO: 65131 - DNA, 118 bp, Mus musculus
ttctagatcaagatcagagactctgctctccgtgttcacagcggaccttgatttaatgtcatacaattaaggcacgcggtgaatgccaagagcggagcctacggctgcacttgaagga

SEQ ID NO: 65132 - DNA, 220 bp, Mus musculus
tgtgtgtgtgtgtgtatagtgcatatgtgtgtctttgtgtgtacacatttctctgtgaatatatgtatgtatatgtgtgcacatatatgtctatatatatgtgtgtgtatatctctgtatgtatatgtgtatatatgtgtgcatgtgtatgtctctgtgtatatatatttgtatgtgtctgtaagtgtatatatgtgtatgtgtgtgcatgtgtgtctat

SEQ ID NO: 65133 - DNA, 85 bp, Mus musculus; identical to SEQ ID NO: 57470

SEQ ID NO: 65134 - DNA, 114 bp, Mus musculus
atggggctggtgacatcctgtccatattcagaaggcagagagatgaatgtgaacactcagcctgttcccctgccttttattgaggtccatggattgatgtcttcctatattccc

SEQ ID NO: 65135 - DNA, 86 bp, Mus musculus
ctcacacacacacacactctgtgcctacatgctatattattagcaatttacctgtaataatgtaaatgtgtgtgtgtgtctgtgag

SEQ ID NO: 65136 - DNA, 63 bp, Mus musculus
actgtgtatgtatgtatatatgtatgtatgtatgtacgtatgtatgtatgtatgtatgtatgt

SEQ ID NO: 65137 - DNA, 85 bp, Mus musculus
ggccatggtggtctgataggatacatggaacaatttcaatatttttgtatctgttgaggcctgttttgtgaccaattatatggtc

SEQ ID NO: 65138 - DNA, 85 bp, Mus musculus
gtccatggtgatctgataggatgcatggaacaatttcaatatttttgtatctgttgaggcctgttttgtgatcaattatatggtc

SEQ ID NO: 65139 - DNA, 85 bp, Mus musculus
ggccatggtggtctgataggatacatggtacaatttcaatatttttgtatctattgaggcctgttttgtgaccaattatatggtc

SEQ ID NO: 65140 - DNA, 85 bp, Mus musculus; identical to SEQ ID NO: 57470

SEQ ID NO: 65141 - DNA, 85 bp, Mus musculus; identical to SEQ ID NO: 57470

SEQ ID NO: 65142 - DNA, 66 bp, Mus musculus
ctgtgtgtgtctgtgtgtgcatgtatatgtgtggtgcacatgttcatgtatgtgagtgctgggcag

SEQ ID NO: 65143 - DNA, 106 bp, Mus musculus
gctaacaccattttactataaaggtataaaatattttatttatttgtgagaatatatggattagaccatatgcagatatatgaatgtggtagtcaaatggattggt

SEQ ID NO: 65144 - DNA, 98 bp, Mus musculus
tccctgtaattctttcagacaggaacaattatgggtcagagatgtgactgtggaatagcaaccccatctctcacttgatgtcctgtctttctgctgga

SEQ ID NO: 65145 - DNA, 119 bp, Mus musculus
ttgaaggtcagccttagttcacggtgatctgataggatacatgggacaatttcaatatttttgtatctgttgaggcctgttttgtgaccaactatatggtcaattttggagaaggtacc

SEQ ID NO: 65146 - DNA, 76 bp, Mus musculus
gcatgtgcttgcatacatgtgggcacacgtgtatatatgagtgtgtgtgtgtgtgtgtgtgtgtgtgtgtgtgtgt

SEQ ID NO: 65147 - DNA, 110 bp, Mus musculus
tgagtcttggttcagtttgcacagagcatcgttcagggacctcagaggacgctactgacacactgtctgcctgctggacttacttctggatgacattctgcaagctcagc

SEQ ID NO: 65148 - DNA, 87 bp, Mus musculus
gtgtcttggggctagagagatggctcagcggttaagagcactgactgctcttccaaagatcctgagttcaattcccagcaaccacat

SEQ ID NO: 65149 - DNA, 92 bp, Mus musculus
ctgtctgaaattaaacagtaatgtgtgtggacacttgagcagacctgtgcttaggtgtgtgtcctttcaatcgtcatgttttctttccagac

SEQ ID NO: 65150 - DNA, 78 bp, Mus musculus
tgtcatggaacatctgtggaagctagaggacaattctggggtttgttctctccttccatctttatgtgggttatagca

SEQ ID NO: 65151 - DNA, 59 bp, Mus musculus
gagacatgctttcgaaggacattgtgggaactttccctatgtctgtctctgtctgtctc

SEQ ID NO: 65152 - DNA, 72 bp, Mus musculus
ccaatgtcttctggactaaccgccagcattcacgcagtaagtgctaggtgagtgaacagagtttgaacttgg

SEQ ID NO: 65153 - DNA, 107 bp, Mus musculus
gttattcacattttgtaaatcatcctatgtatttatgtatgtatgtgtgtatgtatgtatgtatgcatgcatgtatgtgtgtatgtatgtatgacaaatgaagaaac

SEQ ID NO: 65154 - DNA, 85 bp, Mus musculus; identical to SEQ ID NO: 57439

SEQ ID NO: 65155 - DNA, 115 bp, Mus musculus
aaccagcaccttaatgtctgtctgattctgtacatagtctctatatgtttatgttttacatgtatacatatatatctctatatatgtaatattatgatctataataaggctagtt

SEQ ID NO: 65156 - DNA, 76 bp, Mus musculus
atatatacatacacacatatatatgtgtaaatgtatatataaatacacacatatatgtatgtatgtatgtatgtat

SEQ ID NO: 65157 - DNA, 102 bp, Mus musculus
ccatactcttcaaggttatggagttgcccagagaggtgtgcagagaaaaatgagagaaaagagcagaagggctgggtcactctctgtgacatttggaggtgg

SEQ ID NO: 65158 - DNA, 67 bp, Mus musculus
aggaagtgtttcagagattattatcgcgttgggaggggctttccagtgtgtcactgagacactcact

SEQ ID NO: 65159 - DNA, 91 bp, Mus musculus
ttcaaatgccactgtaaatggcaatggaagaagagtgagtttttgaattcttcatagatcctcagactgtggtgtggtggcatgaggtgaa

SEQ ID NO: 65160 - DNA, 67 bp, Mus musculus
tatgcatgtgcacttgtgtttttgatgtaacagatgtgttacatcacaatcagtgtgtgtgtgtgtg

SEQ ID NO: 65161 - DNA, 61 bp, Mus musculus
tcctggtcacagaagcataaggaaaagtcctcatgtcctgtactgtgtctgtgtctgagga

SEQ ID NO: 65162 - DNA, 85 bp, Mus musculus
ctaagtgtcttaagtatatttttatctgtttcctgtactttggcccagggtgaactaatgacgtgtgttatacttgtacatttag

SEQ ID NO: 65163 - DNA, 111 bp, Mus musculus
ctgccttttctagcctgaatacaagaggaagtgcttagtcttactgcaacttgatatgccatggctggcatatccatgagagtcgtgctctttttctgtagagaaatggag

SEQ ID NO: 65164 - DNA, 114 bp, Mus musculus
ttctcagtgaagtgaaggcaagagaagtgaaggcaaagggcagagttcagagaagactctgaggacccccaggcctgcctgctctagtccgtgtctgttatgccgctggtagaa

SEQ ID NO: 65165 - DNA, 56 bp, Mus musculus
gtgttcttttgtgtatgcatgtgtgtgtatatatatatgtatgcatgtgtgaacat

SEQ ID NO: 65166 - DNA, 86 bp, Mus musculus
tatttgttccctaagtgtttgaaaagtgagtgcctttaagcctaaagtgaatttgtttttcttacaaagagagggtattttaggta

SEQ ID NO: 65167 - DNA, 116 bp, Mus musculus
gtgtgtgtgtgtgtatgtggggggggggtggatcactaacatttgtttattagttttcatagacaatagatgacctttttcttgaccccctgttcctagcgtattcatgaggtcat

SEQ ID NO: 65168 - DNA, 85 bp, Mus musculus; identical to SEQ ID NO: 57439

SEQ ID NO: 65169 - DNA, 62 bp, Mus musculus
gtatgtatgtatgtatgtatgtatgtatgtgtgcgtgcatgcgtgcgtgcgtgtgtgcgtgc

SEQ ID NO: 65170 - DNA, 125 bp, Mus musculus
atgtgtatataaatatatgcatatttatttatgtatataaaagtttgtatatacaagtataggtaaatatgtgtctctctatgtgtgtgcatgtaatgcatgtttgtttgtgtgtgtatacatac

SEQ ID NO: 65171 - DNA, 75 bp, Mus musculus
aaaagccaggttttatcttcacaccttcaggcagtggcctctctcagtgtgactgtatatgagtctgcagctttt

SEQ ID NO: 65172 - DNA, 83 bp, Mus musculus; identical to SEQ ID NO: 57504

SEQ ID NO: 65173 - DNA, 139 bp, Mus musculus
tgcatatacaaatatatatataaacatacatacatacatatatatatatttatatatatatatgtgtgtgtgtggtatatcttatatatatgtatatacacatatatccatatgtgtatgtatattatgtataattata

SEQ ID NO: 65174 - DNA, 113 bp, Mus musculus
ataggaagctgaatgaagttcctggaggttcaacaaataattcaatgatttttatatttcctaagtctctacttgaataagtgaatttttaggtttttttctagaacttctgt

SEQ ID NO: 65175 - DNA, 78 bp, Mus musculus
tggtagtttcttcataggactgtagtcagagagcacatacaaagtgcttagaacatagtacttggaagtacttattac

SEQ ID NO: 65176 - DNA, 92 bp, Mus musculus
ttggattacttcagggtctattgtcatggctcccttttcatttctgattttgttaattaggatgctggccctgtgccctctagtgagtctag

SEQ ID NO: 65177 - DNA, 85 bp, Mus musculus
aaaagcatttccaattagtatgtataagaattatggatatacctctcatccatagtaatgaagtatgctggtaagagttgttttt

SEQ ID NO: 65178 - DNA, 93 bp, Mus musculus
tactcctattagctgcatggggtgagggtgggggagatagtgtagtggtgattctcattgactttcattttcaaggtctatcagattagggta

SEQ ID NO: 65179 - DNA, 72 bp, Mus musculus
gaacttctgctgtagggcccagagagaattaagcagggtgtcccctattctctctgtctctgggagagtttc

SEQ ID NO: 65180 - DNA, 67 bp, Mus musculus
ttctgtgtcagtttctgtctccaggtttttgctctgatttccctggatgattgactgagatgtagaa

SEQ ID NO: 65181 - DNA, 104 bp, Mus musculus
actttctgcaggtaccagaaatgtgaggcttgcagtcagagagcctggccttctctggctctttctgactctgggatttcaccatcggggtgctgctgtttagt

SEQ ID NO: 65182 - DNA, 84 bp, Mus musculus
gactttaatttgcacatggtatgtatgtatgtatgtatgtatgtatgtatgtatgtatttgtgtatatatgtatgtgtgtggtc

SEQ ID NO: 65183 - DNA, 64 bp, Mus musculus
gaaggcagaagcttgatgagagtgtgagcagacaccatgcgctcagaagagtggctcagccttc

SEQ ID NO: 65184 - DNA, 89 bp, Mus musculus
gtatggttttactcagtgaccttggaggttgtatagaatgaaattattctttagaaatttatccttttgtcttatgagctgaaatatgc

SEQ ID NO: 65185 - DNA, 111 bp, Mus musculus
cagcggagttctctgagctgtctgctgccattccactcatggtgtctctctcagaggctgtattctcctcgacttctggaaccagcagggccagctctccaactaggggtg

SEQ ID NO: 65186 - DNA, 85 bp, Mus musculus
tccacctcggatgtgtcgctccctgattggctgcagcccataggccgagttgtcgtcacggggaaggcagagcacatggagtgga

SEQ ID NO: 65187 - DNA, 69 bp, Mus musculus
gctctctgtcaccatcagtgcatggcccctctgactctgactgcctgagaagtgacagccttacagagc

SEQ ID NO: 65188 - DNA, 76 bp, Mus musculus
agtctctctctgtcactgcagttagcctctctcactgtgctctaagcagtggatctgagctgtgcacagggtgact

SEQ ID NO: 65189 - DNA, 119 bp, Mus musculus
tgtatatttatcaatatgtatgtatatatgtatgtatgtttacaactgtctgaatgtatgtttatatatatgtgcatatatatatatatgtgtacatatgtgtttatgtattgtgtata

SEQ ID NO: 65190 - DNA, 89 bp, Mus musculus
agcagtctgctgaaacagaaattagatgggcactgagctatctgtgtgtttttctcagtgtctaaataatgtcttgcactgtgattgtt

SEQ ID NO: 65191 - DNA, 104 bp, Mus musculus
ctctctgtctcatagggcctcagcctggctccagtctgtcttttttttttttttttttttcagttctggcctggaacctactatggtccttacaaacgagagag

SEQ ID NO: 65192 - DNA, 118 bp, Mus musculus
tatatatgtatatgcatatatatatgtgtgtatatgtatatatatacttgtatatatgtgtatatgagtatatatgcatatatgtatatgtattcatatatttgtatatgtgtatgta

SEQ ID NO: 65193 - DNA, 101 bp, Mus musculus
cagaagctattttaggaataatttttttttcccagtcagtctttttctcagtgatgaaatgggggtggagcagattctgatttctgaaagacagctggttg

SEQ ID NO: 65194 - DNA, 120 bp, Mus musculus
tgtgtgtgtgtgtgtatgtgtgtgcatatatcacatatatgtatgtatgtatatatatatgtatgtacacacacatatatacacacatatatgtatgtatatatatatatatgtatatat

SEQ ID NO: 65195 - DNA, 94 bp, Mus musculus
ccttgcaacaggagggtctgagctgaatccacacaatgcctgtaaatgccaggcatagcagtgatgattgtgtgcagtcccggcccggagaagg

SEQ ID NO: 65196 - DNA, 109 bp, Mus musculus
tagcacaccctgagtcaaagacaaaacgagcttttgaaactccgtacttttgatttttttttttcaatgtacttcatttgatttttctttaaattcagtggttttgtta

SEQ ID NO: 65197 - DNA, 118 bp, Mus musculus
tggtcttaaaaaatttgtgaggttgggctagagaggtggcttagcagttaagagcactgactgctcttccagaggtcctgagtttaattcccagcatccacaaggtggcttacaacca

SEQ ID NO: 65198 - DNA, 78 bp, Mus musculus
aggtcacaaagctgggaacctggagcacactgtgtgcagacagctcaacaggctaaagagtgtcctttctgtgtacct

SEQ ID NO: 65199 - DNA, 85 bp, Mus musculus
gataaattctacttacttgtctacagtgttagttattaggaaatctcatagccaatagcgacagtagagtgtgtagaaatttgtc

SEQ ID NO: 65200 - DNA, 85 bp, Mus musculus; identical to SEQ ID NO: 57470

SEQ ID NO: 65201 - DNA, 92 bp, Mus musculus
ttaggccatggtggtctgataggatacatgggacaatttcaatatttttgtatctgttgaggccctgttttgtgaccaattatatggttcaa

SEQ ID NO: 65202 - DNA, 85 bp, Mus musculus; identical to SEQ ID NO: 60314

SEQ ID NO: 65203 - DNA, 79 bp, Mus musculus
gccaacaagtgtttgctgacaggagcctgatatagctttctcttgagagactctgtctgtgcctgacaaatacagaggt

SEQ ID NO: 65204 - DNA, 85 bp, Mus musculus; identical to SEQ ID NO: 59663

SEQ ID NO: 65205 - DNA, 99 bp, Mus musculus
ctacctgtgctcattcctcaactgatggaaaataaaggtttcagtctcactgtcacttggcttttatcattgccatgggatggattgaggcttgtagac

SEQ ID NO: 65206 - DNA, 85 bp, Mus musculus; identical to SEQ ID NO: 57439

SEQ ID NO: 65207 - DNA, 98 bp, Mus musculus
gagaacagaaaaaggagggcagatgcagagaggggtgtggactcttgtgctacattaatttgtttttaatctactctctaaatggggtttactgtctc

SEQ ID NO: 65208 - DNA, 86 bp, Mus musculus
tgttcctcctgtgagtctgtaagtctctgtcagcagtcctgggagaccagctctttcctggaaagaccagtgtacagagggctgca

SEQ ID NO: 65209 - DNA, 85 bp, Mus musculus; identical to SEQ ID NO: 57470

SEQ ID NO: 65210 - DNA, 85 bp, Mus musculus
gatctacctgtctgccactgtcacagtaccatgcagtttttatcactattgctctgagtacagcttgaggtcagatatggtgatt

SEQ ID NO: 65211 - DNA, 85 bp, Mus musculus; identical to SEQ ID NO: 57439

SEQ ID NO: 65212 - DNA, 85 bp, Mus musculus; identical to SEQ ID NO: 57439

SEQ ID NO: 65213 - DNA, 71 bp, Mus musculus
agggtgacatatatatgtatatgtatgtgtgtgaatgtatgtgtatgcatgtatatatgtatgattgccct

SEQ ID NO: 65214 - DNA, 90 bp, Mus musculus
tgtgatgtgtgtgtgtatgctctttatgtatgaatatatatgacatatacatatatattcatatgctaaatataataccacacacacaca

SEQ ID NO: 65215 - DNA, 117 bp, Mus musculus
tatatatgtatgtatgtatatatgcatgtatacacacatattatatatatacacatatatatatataatgaaattcatgtgtgtattatacacacatatatagtatatatatatata

SEQ ID NO: 65216 - DNA, 94 bp, Mus musculus
tataaaaccttggatgttggatgtatagttttatgcaggggaagactatttcatgtattcctcattatattcctaggatgtagctggatttgta

SEQ ID NO: 65217 - DNA, 114 bp, Mus musculus
ctattggaatgcctcttctagcctcaataggaaaagatgcatttagtcttactgcaacttgatgtgccaagactgattgatgtccatttctgaagataaggggaggagtaatgg

SEQ ID NO: 65218 - DNA, 104 bp, Mus musculus
gtgtgtgtgtgtgtgtgtgtgtgtgtgtgtgtgtgtatgtctatgcatgtgacacatgtgtgtgtgcatgtgtatgtgtcagagagagagagacagaggcagat

SEQ ID NO: 65219 - DNA, 72 bp, Mus musculus
ggcatagatacacacaggtgtgcacacacatatacacaaatatatgtatgtatatatgtatgtatctgtact

SEQ ID NO: 65220 - DNA, 118 bp, Mus musculus
tggaccaggaagtgatgaaggagccagaagaccaggatgtggagaagtaacatacatactgtgtttattaatttttcttcagcctgggtgggctgataagcttccatgaccctgtcca

SEQ ID NO: 65221 - DNA, 85 bp, Mus musculus; identical to SEQ ID NO: 57470

SEQ ID NO: 65222 - DNA, 85 bp, Mus musculus; identical to SEQ ID NO: 57439

SEQ ID NO: 65223 - DNA, 94 bp, Mus musculus
tgatgattagagggcagtataagggaactaagtgcagacatgagcagattgtttactgactacacagtcaccacacagaccctctgagttatca

SEQ ID NO: 65224 - DNA, 115 bp, Mus musculus
gtgtatatatatgtgtgtgtttatgtgcatgtgtatatatatatatatatatatatatatatatatatatatatatatatatatatatggatttaaatagcattgaggtagtacc

SEQ ID NO: 65225 - DNA, 85 bp, Mus musculus; identical to SEQ ID NO: 57470

SEQ ID NO: 65226 - DNA, 89 bp, Mus musculus
ctgatgcgcgattcgaaaattacactcagattccacacaacctctcctgtgtgtgtctgtttgtcattcatccacgctttgcccaccag

SEQ ID NO: 65227 - DNA, 61 bp, Mus musculus
tgtgtgtgtgtgtgtgcatatttatacattatatatgtatgtgtgtatacatgtatgtaca

SEQ ID NO: 65228 - DNA, 116 bp, Mus musculus
ggtgatctcttctctgtctcaccctctttaatgtgcatgttttatttatcagagacttttttattttttataaccaagatcactgataagcatatgagaggcagggaaaagttatt

SEQ ID NO: 65229 - DNA, 73 bp, Mus musculus
attgccattcaatgttattctcagaagcgttctttattttatggtacacttgtgagattggaggaatggtaat

SEQ ID NO: 65230 - DNA, 88 bp, Mus musculus
gggaactcaaagggtctgattacttgatgttgttgttcttcctatgggcttacaattcccttcagctccttcagaccttctgtaaccc

SEQ ID NO: 65231 - DNA, 109 bp, Mus musculus
tacttgtatatacattttaagatacatacatgtatgtatatatttatgcatgattacctgttcaaatttatatatacagatttgtatatgtcatacaggtatatgtata

SEQ ID NO: 65232 - DNA, 67 bp, Mus musculus
gtgtctctagctgcatatgatatgctatcagaagatagcctagtcggccatcagtggaaagagaggc

SEQ ID NO: 65233 - DNA, 98 bp, Mus musculus
gctatttagtggttaaatgtcttctctctgtctctcattgggaagaaaaaagttctcccaaatacctgagaaagtgaaagacaactataaaattatgt

SEQ ID NO: 65234 - DNA, 119 bp, Mus musculus
ctatataaatgctttgagattttattgctgctaatactattatttctatgtttataagaaagtcacatactgggctggaaagatggctcagcagtaaagagcatttgctgcttgtatag

SEQ ID NO: 65235 - DNA, 81 bp, Mus musculus
gaggtggtctcttcagattctgtgtccccacagttgggtatttcggctaaggttacacacactgactcctggaggcctccc

SEQ ID NO: 65236 - DNA, 111 bp, Mus musculus
tgtggtaatggttcctagttgtaaatggttgtatgtttatgtgcatgtccatgtggggaaatatggtaaagtttgtgactgtacacatttaatatgagcttgtaggccaga

SEQ ID NO: 65237 - DNA, 111 bp, Mus musculus
tgttatattttaatttgattatatttaatatttcttttccattggatagtatttcattttaaatactatctagatcctgaaagcaataatgatcttctgagataatataca

SEQ ID NO: 65238 - DNA, 113 bp, Mus musculus
gatgttagttgtctttgaacacctgtcatattgttttggatgcagagtctctcactgtttctagagctcatctatccacaaccctttgtgtcaaaatgttgcagggattatct

SEQ ID NO: 65239 - DNA, 96 bp, Mus musculus
gtacttgtatgtatattcacacacatatatacatacatacatatatacatatgtttctatatatatgtgtgaatatacacatacatagacaagtac

SEQ ID NO: 65240 - DNA, 72 bp, Mus musculus
gtgtatattcacacatatatatagaaacatatgtatatatgtatgtatgtatatatgtgtgtgaatatacat

SEQ ID NO: 65241 - DNA, 104 bp, Mus musculus
cagtttggtctccctgtgggtccccaacagttagagtgagtctttatctgactcatactgtgctgtatgcctttggattcctttccactagttggactgccttg

SEQ ID NO: 65242 - DNA, 77 bp, Mus musculus
tacagaactggattaatgacaggagttggccacttagatgagccttgtctgtctgtctgtctgtctgtctgtctgta

SEQ ID NO: 65243 - DNA, 85 bp, Mus musculus; identical to SEQ ID NO: 57439

SEQ ID NO: 65244 - DNA, 87 bp, Mus musculus
ttagctttgaaatttttgtaagattctggagtaatctacattttgaatgagatgctaacagatctgacagaggagtctacaagctaa

SEQ ID NO: 65245 - DNA, 83 bp, Mus musculus
gataggcaggtctctcagtctgagcctctggtcccacatggaacctcataaagttctgggaactgacagatattctgactgtc

SEQ ID NO: 65246 - DNA, 115 bp, Mus musculus
atttatttgtgtgacacattatatctctatccatctatctatctatctatctatctatctatctatctatctaactatctggtgtgtagtgttatatatgtgtgcatttgtagat

SEQ ID NO: 65247 - DNA, 86 bp, Mus musculus
tatgtgtgtatatgtatgtatatatgtatcatatatatgtgtctgtatgtgtatatatatgtatatacgctcatatgctcaacata

SEQ ID NO: 65248 - DNA, 70 bp, Mus musculus
tttatatatgtatagatatgtttatatatgtacagatatgtatatatgtatgtgtgtatatatatataaa

SEQ ID NO: 65249 - DNA, 68 bp, Mus musculus
tatatatatatatatacacacacacatatatatatatatatatgtgtgtgtgtgtgtgtgtttatata

SEQ ID NO: 65250 - DNA, 104 bp, Mus musculus
caactaggcggtgaatgagattggtcatagaaaaactaagagattcttttttctttataaggtttatttattttatgaacattggcattttgtctgcctgtctg

SEQ ID NO: 65251 - DNA, 116 bp, Mus musculus
tagttaccattgttactatggcagccttgaaatgtcagagtgaagagacagaggccatactcagataactctttatgccagttagtgttaattgctcatgtgacagtttgtaagta

SEQ ID NO: 65252 - DNA, 66 bp, Mus musculus
tcctggtactacacatacatgtatatatgtctatataatgttacttgtatgtgtatgatatcagga

SEQ ID NO: 65253 - DNA, 85 bp, Mus musculus; identical to SEQ ID NO: 57439

SEQ ID NO: 65254 - DNA, 124 bp, Mus musculus
tgtgtgtatgatgttcatatgtacatacatatatgtatatatgtgtatatgatgtacatatacatgtatatatgtatatgtgtgtatacattatatatatatacatcacatatatatgtatatg

SEQ ID NO: 65255 - DNA, 98 bp, Mus musculus
aggcccacagtgaattgatcagtgagtagcttccagttctgtgtcacactcacagtgaaatcgtgctcagctccctcacaacactttctgatgtgctt

SEQ ID NO: 65256 - DNA, 85 bp, Mus musculus; identical to SEQ ID NO: 57439

SEQ ID NO: 65257 - DNA, 89 bp, Mus musculus
tactgcaacggtatggtgctgattcatacattgccaaatgagcagattcgacaatgttgcaatttatatttatgtatgtgcctgcagta

SEQ ID NO: 65258 - DNA, 70 bp, Mus musculus
gtgtgttgaatatatgtgtgtgcatatacatatgaacactgtcatacttgtgtgtacagactgtgcacat

SEQ ID NO: 65259 - DNA, 93 bp, Mus musculus
aaacatatccttgagccttgtggtaagatatgagagtgtgacttagggctgggcactctacagttgtctgcacatggactcagttagatgttt

SEQ ID NO: 65260 - DNA, 60 bp, Mus musculus
gaggctctgtagcaggctaagctggaaaggggaactcctgattcagtctgtcagtgtctc

SEQ ID NO: 65261 - DNA, 69 bp, Mus musculus
cacagttggtgctttgtaattctatgtaattttaattaaaggagaattctgaagcagcctccctctgtg

SEQ ID NO: 65262 - DNA, 84 bp, Mus musculus
gctgtaggaagtgtgtaactaggggtgggctttaaagttctaaaaacataggctaggcccactgtctatctctctgcctgctgc

SEQ ID NO: 65263 - DNA, 104 bp, Mus musculus
acacatactatgatatatatatgcaggcttattatatgtatatatacacacatgtatatatatacatacattgtgggggggttggtgtgtggtgtagtatctgt

SEQ ID NO: 65264 - DNA, 88 bp, Mus musculus
agctgggaacatcaaatcaacacttctggattagatgatctgtcttgcctcaaatcacatggccgtagtgtaggggaattcttaggct

SEQ ID NO: 65265 - DNA, 94 bp, Mus musculus
tctccattactcatgcagactgaagtcagacaggtgtgcacattctcaattcaacaccttgaccgtgcaggatcctcttctaacatgagtgaga

SEQ ID NO: 65266 - DNA, 87 bp, Mus musculus
gcattcaagaatcctcaatttagactggagagatggctcagtggttaagggcactgactgctcttccagaggtcctgagttcatttc

SEQ ID NO: 65267 - DNA, 85 bp, Mus musculus
ccaatgtctctgttagatcagtgtgctgtgtaactgtctctgtcagagtaacatggcataggaaagtcttgatagagaaccatgg

SEQ ID NO: 65268 - DNA, 116 bp, Mus musculus
ggggatcttgtttctcagtccaatagttggctgctagcatctgtctttgtatttgtcaggctcaggcagagcttctcaggagacagctatattaggctcctgtgagcaagcacttc

SEQ ID NO: 65269 - DNA, 85 bp, Mus musculus; identical to SEQ ID NO: 57439

SEQ ID NO: 65270 - DNA, 62 bp, Mus musculus
ctatttgtctgggtgtctctttgcctgtgtgttcacatgtggatagatagatagatagatag

SEQ ID NO: 65271 - DNA, 77 bp, Mus musculus
cccaggtggagcagtctccagatggcctttccttcagtctctgcttcacactttgtctctgtaacttcttccctggg

SEQ ID NO: 65272 - DNA, 88 bp, Mus musculus
gtttaaacaaaccatatatatgtatatatatacacatacatacatatatatatgaatatatatatacatacatatggttagtatatgc

SEQ ID NO: 65273 - DNA, 88 bp, Mus musculus
gtgctcatgtgtgtgtgtgtgtatgtatgtatgtacgtatgtatgtatgtatgtatgtatgtatgtgagtgcctgtgtgtgtgtgcat

SEQ ID NO: 65274 - DNA, 66 bp, Mus musculus
agagtgttgcagacactgggaggcagggtgtttattcttcactctctctcagtgttcttacagtct

SEQ ID NO: 65275 - DNA, 85 bp, Mus musculus; identical to SEQ ID NO: 57439

SEQ ID NO: 65276 - DNA, 86 bp, Mus musculus
ggagtccttcccttatgacctgacttcatctccacagcttgagtcacagaactgtgtcactacagtcagaacatcctggagacttc

SEQ ID NO: 65277 - DNA, 79 bp, Mus musculus
gatgggtttgtaggtggtggtgagcggccagatgctgggagcgaaatactctcactgtctctggcccctacaactggtt

SEQ ID NO: 65278 - DNA, 64 bp, Mus musculus
tctatctcactgaatgtctgtcagcccagggatgggaaagctgtagctcacttcatgaggtaga

SEQ ID NO: 65279 - DNA, 90 bp, Mus musculus
gcaaagcagaacaggctgtggtagagggatgaatggctttgcaagaatagatgcccgagcttgtgttctgcctgcctctccaagctgtgt

SEQ ID NO: 65280 - DNA, 135 bp, Mus musculus
gacttttgtttgtgtttgtatatatgcacatatatgtatatatgtatacatatataaattatatatatatattatatgtctatatacataagtgcatatgtatgtatgtatgtatgtatgtatgtatgtgtgtat

SEQ ID NO: 65281 - DNA, 145 bp, Mus musculus
atgtgtgcatatgtgcatgtatgtatgtatgcatgtgtgtatgtatgcatatatgtatgtatgtatgcatgtgtgaatttatttatgcatgtatgtatgtatgcatgtgtgaatttatttatgcatgtatgtatgtattcatgta

SEQ ID NO: 65282 - DNA, 97 bp, Mus musculus
cctgaggacccgaggttttaactaaagaacctactgactctcacagacttaacaccaagccatcagtacctcatagaaaagccagcgacttctcggg

SEQ ID NO: 65283 - DNA, 100 bp, Mus musculus
ctggcttttctatgaggtactgatggcttggtgttaagtctgtgagagtcagtaggttctttagttaaaacctcgggtcctcaggcttggttggaggcag

SEQ ID NO: 65284 - DNA, 87 bp, Mus musculus
atagatatatatgtatatgtgtgtgtattataatttataaacctgtatatatatttatatgtacacacacaaaaacgtattgtttat

SEQ ID NO: 65285 - DNA, 73 bp, Mus musculus
gctgggtggatctcatgcaaggcttgtgccagtaaccacactgctgtcagtctctgtgtgtgataccaatggc

SEQ ID NO: 65286 - DNA, 97 bp, Mus musculus
gccagttggcatgagacgacagacagacagacagacagacagacaatgctgcctgttagcaatcctttctctggtaacttctcaggtatagaatggc

SEQ ID NO: 65287 - DNA, 91 bp, Mus musculus
catatacacacacatatatacatatatatacagatatatgtgtgtatatatatgtgtgtgtgtgcatatatatatgtatacatatatatat

SEQ ID NO: 65288 - DNA, 94 bp, Mus musculus
gagaaatcccagtgggccatggggggtagggctgactatcaaagcatgcgactctctctctccctatctgtctctttgtctctctgtgtatctc

SEQ ID NO: 65289 - DNA, 121 bp, Mus musculus
tctcactccaatctatctctatctgtctatctatctatctaactatctatctatctatctatatcagaagaaagagagaaggaaagaaagaaagaaagaaagaaagagagagagagagaga

SEQ ID NO: 65290 - DNA, 89 bp, Mus musculus
agataaagccctggctgactgtacagtgtctcctgtaggttaacctatgcatttactctgggaatgctggcacaggcagggcttgtgct

SEQ ID NO: 65291 - DNA, 94 bp, Mus musculus
ctactctggtagatttaggaaagtggaagagttatgtagacagacagacagacagactttttcatctctgataataaggcactatagagagtag

SEQ ID NO: 65292 - DNA, 62 bp, Mus musculus
tgcttttcttgtttggagtggtacagggtggcctgctttgtgtctgtcagagtggaagagca

SEQ ID NO: 65293 - DNA, 78 bp, Mus musculus
ggagagcactggggctggagaggtggctcagtggttaagagcactggctgctcttccagaggacctgggttcaagtcc

SEQ ID NO: 65294 - DNA, 78 bp, Mus musculus
acctcaagtttttgagacagtgtctctcactgagccagcccacaagctccaaggagcacctgtctccatcaccaaggt

SEQ ID NO: 65295 - DNA, 69 bp, Mus musculus
gggaaactcagattgtctcattgtctctctggactataggggtgactgctgatttaaattgggttttcc

SEQ ID NO: 65296 - DNA, 74 bp, Mus musculus
tgactctgtatgtgtgtgcaagtgcatgtgtacatgtgactgtgtgtgtgtgtgtgtgtgtgtgtagagggtga

SEQ ID NO: 65297 - DNA, 83 bp, Mus musculus
gatgatattgagtacgggtcaccaacttctagttatcgaacgtttctgtgatcttcttagagaagatggtgtccactgtcgtt

SEQ ID NO: 65298 - DNA, 65 bp, Mus musculus
ctggagacaggacacaagagccagggggaactgacaccgtctgtctctgaggtctgggtctgcag

SEQ ID NO: 65299 - DNA, 63 bp, Mus musculus
gttcaatacagaccagcagaacagccgcttatgttataaagtctgtctgactgtctgtggtgc

SEQ ID NO: 65300 - DNA, 129 bp, Mus musculus
tacttctcccagatttttgatgtgtggttgattgaatatgagaattgcagctcatgtcagatgagggtcagctctattatttgtaagatcaatgggttgtcagtaatattttcagaactaaggtccaga

SEQ ID NO: 65301 - DNA, 64 bp, Mus musculus
gtgtatgtatatatgtgtgtatatgtatatgaatatgtatatgtatatgtatatgtgtgtgtgt

SEQ ID NO: 65302 - DNA, 74 bp, Mus musculus
ggacagaaatattatatttttcatttcatgcagtgccatgggcatggtaagacattatgtaactgggtctgtct

SEQ ID NO: 65303 - DNA, 97 bp, Mus musculus
caaaattagccttagagcttagagtacagctgccttctctttctgaaaagagtgacaggagagtctgtggtcactacagcaacaaggaggatgactg

SEQ ID NO: 65304 - DNA, 95 bp, Mus musculus
acttggagatggtttcccagttatagcactctttgtcagtttgtttatttctatttcaaccagagatatgttgtcactgtgtgtcattgccaggt

SEQ ID NO: 65305 - DNA, 91 bp, Mus musculus
cctgaggcctattctttgtcttgttttaatcaattaattaccttactaattttgtaattgttgttgagatagggttgagacaggcttggaa

SEQ ID NO: 65306 - DNA, 93 bp, Mus musculus
gaagaaacaagtggagagcatcagaaatgacagtccagatgcttaaaaactggtgtcatgggtactggcttctcagtgttaatttactccttc

SEQ ID NO: 65307 - DNA, 75 bp, Mus musculus
tcccataatagtaacttctgggtgatcagagagagctctgggatggggatggttctgtcatcatgaattatggga

SEQ ID NO: 65308 - DNA, 100 bp, Mus musculus
ccttgtgctaggggactgttctgtgtgtcgctgtctctctcttcactgctggggaatagatcctcaggtgtacagagcttgcacctgtgcccttgcatgg

SEQ ID NO: 65309 - DNA, 106 bp, Mus musculus
gccttagtccatggtgatctgataggatgcatgggacaatttcaatatttttgtatctgttgaggcctgttttgtgaccaactatatggtcaattttggagaaggt

SEQ ID NO: 65310 - DNA, 101 bp, Mus musculus
tggggaaggatttgatggcgatatcccatttagaactgagtgctccaaggtctctaactctctgcatgttgtctgactgtgtgtctctggatttgttccca

SEQ ID NO: 65311 - DNA, 79 bp, Mus musculus
gagcctctctgtgcaggagcctgaatgctgaatatatatttttaatgtgtccaatttgtgcagtgcaccaaaatggctc

SEQ ID NO: 65312 - DNA, 56 bp, Mus musculus
gtgtgtgcgtgtgtgtatgtatgtatgtatgtatgtatgtgtgcatatgtatgtgt

SEQ ID NO: 65313 - DNA, 101 bp, Mus musculus
tctgtgtgtatatatgcatgtgttttatgtgtatgtatgaatgtgcatgtatgtgtatgtatgtatgtatgtatgtatgtgtatgtgtatatgtgtgatac

SEQ ID NO: 65314 - DNA, 89 bp, Mus musculus
gccatgggcttggcaaacagggttagctatttatggacaagtgaatgtctcattgtaaatgtgatgtgattgaaaggactcgttaaggc

SEQ ID NO: 65315 - DNA, 90 bp, Mus musculus
tatataaacatatatatatatgcatgtttatatacatatagtgtatataaatgtatgtatgtatgtttatatacatatatgtgtatatac

SEQ ID NO: 65316 - DNA, 89 bp, Mus musculus
ctgaccccacacattgttctgtgacctccaacacacatgccgtggcatgcacttggccactctcactcactcactgtatgggcacacag

SEQ ID NO: 65317 - DNA, 76 bp, Mus musculus
gttccctctgagcctcagacgctctctgtgcttgttccccagagtttgtgaactgagaagctcagagaatggggac

SEQ ID NO: 65318 - DNA, 62 bp, Mus musculus
gtgtgtacatatgcctgtgtgcgcacatttgtgtctgtgtgtgcatatgcctgtgtgcacac

SEQ ID NO: 65319 - DNA, 111 bp, Mus musculus
tcagaataatgggaatcctgttgtgaccccacttgagagggaaaaggtaatagtttgtaaatcattaaatccactttctctttcacggagttagtagtaaccgttttctgg

SEQ ID NO: 65320 - DNA, 71 bp, Mus musculus
tcaggacacgttttgtctctgactttctcactctgtagtatataggtgtgatgagagtccctcaatcctga

SEQ ID NO: 65321 - DNA, 88 bp, Mus musculus
ctgggctcctgctggcatctctgtgtctctgagggcagactagccagggttcctagctcttccccactgttacttctgtcaagcctgg

SEQ ID NO: 65322 - DNA, 75 bp, Mus musculus
gtgcctgctgtgtgcggcagccttgcaagtctagttagtccctcgacccagtaagaacacaggcagctcaggaac

SEQ ID NO: 65323 - DNA, 107 bp, Mus musculus
tcatctgtctgtctatgtacctatgtatctatgcatctatgtatctatctatctatcgagagagatgtgaagttggaaggagctgtgggaggggtgggcccaggagg

SEQ ID NO: 65324 - DNA, 70 bp, Mus musculus
atatatatgaatatatacatatgtgtgtatatgtatgtatgtatatatgtatgtgtgtatgtatgtatat

SEQ ID NO: 65325 - DNA, 103 bp, Mus musculus
gaaagtcacaagatggactgaagagatggctcagaagttaagagcactcactgctcttccagaggtcctaagttcaattcccagcagtcacatggtgactcac

SEQ ID NO: 65326 - DNA, 114 bp, Mus musculus
ttcatgtcctctttttttccttaattgtctttaattgttactctaagtatatctatgtatgtatatatgatagaaccattgtaagaaccagaggaacaggaagtagactgtggg

SEQ ID NO: 65327 - DNA, 86 bp, Mus musculus
ggagatcacatgtaagctctcagattttgctccattgccatgcctgcctgctggctgcctgtctgcctgcctgctctcgtagctcc

SEQ ID NO: 65328 - DNA, 117 bp, Mus musculus
acaatgttatcaaaacttcactgagcattatatatctctgggcaaataagaagatacaaacttttttttttcagaatacatggtagctgaggggagaatatggactaggcatcaggt

SEQ ID NO: 65329 - DNA, 99 bp, Mus musculus
gtactggtattaaaggtgtgtgcctccatacccagcctgtatattactttttttaactagtaattgatggatgaaggcccatctcattgttagcagtac

SEQ ID NO: 65330 - DNA, 99 bp, Mus musculus
agaatccgcagcacagccttagaacaaaaagaacacggagtacatttgcaccgtcactctgtgtgactgcttcaaacttttatttgtgcttaaattttt

SEQ ID NO: 65331 - DNA, 70 bp, Mus musculus
cttcacagtgtagtgactgaggacagggaaggaaagctccatttgtacgtggtctggctatctgtgcagg

SEQ ID NO: 65332 - DNA, 79 bp, Mus musculus
tctcgctctctgtatgtctctgtctgtgtgtgtgcatgcccacgtgcatgtacattcacgtggatatgtgcaagtgggg

SEQ ID NO: 65333 - DNA, 88 bp, Mus musculus
atgcatctgcatgtgcatgtacatgtttgcatgtatgtatgtgtttagatgtatgtaaatgtgcatgtacatttgtaggcagatgcat

SEQ ID NO: 65334 - DNA, 88 bp, Mus musculus
atggttcccagttcctgggcagagtggagtgagtgaactaactagacttaagggagctggattcattccctcaggaccactatgggaa

SEQ ID NO: 65335 - DNA, 85 bp, Mus musculus; identical to SEQ ID NO: 57439

SEQ ID NO: 65336 - DNA, 74 bp, Mus musculus
tgtacaagcactattacagatattgttattcagtttaaatggttttgtacagtgtgtgtgtgtgtgtgtgtgca

SEQ ID NO: 65337 - DNA, 70 bp, Mus musculus
cacatgtgtgtgagtgcatgagcatatgcatgaacatgtgtgtggctatgtatgtatgagggtgtatgtg

SEQ ID NO: 65338 - DNA, 85 bp, Mus musculus
ggccatggtggtttgataggatacatgggacaatttcaatatttttgtatctgttgaggcctgttttgtgaccaattatatggtc

SEQ ID NO: 65339 - DNA, 85 bp, Mus musculus; identical to SEQ ID NO: 57439

SEQ ID NO: 65340 - DNA, 73 bp, Mus musculus
cagcatccacgagtgatctggctgcgtaataggtgagcacacatctatgtctctctgcttggctgtggatatg

SEQ ID NO: 65341 - DNA, 98 bp, Mus musculus
agcatgtgcatttgtatgcatatgtgtgtgtatgtgtgtctctctgtgtgtgcatgtaggtacatgtgcatttgcgtgtgtatgtgtgtgtgtgtgtt

SEQ ID NO: 65342 - DNA, 83 bp, Mus musculus
catgggacaatttcaatatttttgtatctgttgaggcctgttttgtgaccaattatatagtcaattttggagaaggtcccgtg

SEQ ID NO: 65343 - DNA, 77 bp, Mus musculus
gtccagttccccagagccagttgtctggttcacaccactgttgaaccagagaatgaatgaatgaatgaatgaatgac

SEQ ID NO: 65344 - DNA, 66 bp, Mus musculus
gtatgtctgtctgtctgtcttgtatagtgggaaaacacatgtgatatagtgcaagaatagaggtgc

SEQ ID NO: 65345 - DNA, 72 bp, Mus musculus
acagatgtgtgtgtgtatatgtataggcatatatgtgtgtgtgtgtgtatgtgtgtgtgtgtgtatgtgtgt

SEQ ID NO: 65346 - DNA, 123 bp, Mus musculus
actgcacagtggagcactgtgacaccaaagtgcagcactatgacacttcagtgcagaactgtcataacacagtgagcactctgacaccccagtgaagcactgtgataccccagtacagcactg

SEQ ID NO: 65347 - DNA, 70 bp, Mus musculus
tatatagatatatgtatatatatgtatgtatatgtgtgtatacatatatatgtatatgtatgtgtgtatg

SEQ ID NO: 65348 - DNA, 81 bp, Mus musculus
gcacagtggagtattgtgacaccacagtgagcactgtgacaaatccttgagcactgtgacaatatagttgaacactgtgac

SEQ ID NO: 65349 - DNA, 81 bp, Mus musculus
gttgagcacagtgagaccacagtgagcacagtgacacaacagttcagcactgagccagcacagtgagcattgtgacccaac

SEQ ID NO: 65350 - DNA, 117 bp, Mus musculus
tgtggaagccaagttgtagcagtatacatctgtatagtcccagctgaggcagacagggtcacaagtttgagagcagacagggcttcatagtgatatctcttgcaaaatggggcagca

SEQ ID NO: 65351 - DNA, 154 bp, Mus musculus
actgatatagcacagtggagcactgtgacaccacagtagagaactgtgacaccacagtacaaaattatgacagcacagtggaacatcgtgacatgacagtggagttctgtgacaccacagtgagcactgtgacatcagagtggagttctgtgac

SEQ ID NO: 65352 - DNA, 70 bp, Mus musculus
tgatgtcacagtgctcactgtggtgtcacagaactccactgtcatgtcacgatgttccactgtgctgtca

SEQ ID NO: 65353 - DNA, 81 bp, Mus musculus
catccttctagctgtgcatcaaccaaggttttggttactccaggatttttagtaaatgccactggatcaaaacacagggtg

SEQ ID NO: 65354 - DNA, 94 bp, Mus musculus
gccttgttggaagatgtgtgtcactagagagttcaaaagcccgtggcatttccagttagctctctttcagtgtctcattgttgaaccaacaggt

SEQ ID NO: 65355 - DNA, 87 bp, Mus musculus
tatgttatatatgacatagatgtgtatatatgtgtgtacatgaatgtatacataaatgtgtatatgcatatatgtgatatgtatatg

SEQ ID NO: 65356 - DNA, 118 bp, Mus musculus
tttaaagatccgttttgcaggtgggatgactcaagctctgaagcggtgagctttggatcacagagtactgtgtgcagagagatcttccctaaactctagcctaacttctccatttgaa

SEQ ID NO: 65357 - DNA, 92 bp, Mus musculus
tactgaggttgacgttcattgtctgaatgaaatagttgaatatgtttttaaagatttattcatgttttatttgtgggtgctttgcctgtgtg

SEQ ID NO: 65358 - DNA, 82 bp, Mus musculus
tatgtatgtatacatatgtgtatgtatacatgaatgaatgtatgtgcatgcatgtatatatacatgtatgtgtgcatgtgta

SEQ ID NO: 65359 - DNA, 131 bp, Mus musculus
ggcctgctctccagagtgctgcagcagtcaaggggctgagacagctctcctgctctcacactctcagtgtaggctgtctggtggccaaacaccagagccagctctactgtgctgcacaaggaaggggcagg

SEQ ID NO: 65360 - DNA, 107 bp, Mus musculus
gtgaaaaagtgagggaactggtggggggagcagcttcagagacccagacttgagattttgaatgggaaatctagccacactctcctcctgtattccatctagaccac

SEQ ID NO: 65361 - DNA, 114 bp, Mus musculus
gcttgacaccacagtgtagcactatgacatcagagttgagcactgtgtcaccactcagagaactatgacaccacagtagagcactgtgacaacacagtgctgcactgtaacagc

SEQ ID NO: 65362 - DNA, 106 bp, Mus musculus
aggcccatttgaagggtagtatggaaccctactacaatagaggactcataaactgtgtgtgtgtgtctgtatgtgtgtgtatctgtctgtctgtctgtgtgtgtct

SEQ ID NO: 65363 - DNA, 70 bp, Mus musculus
cataacttgtatgcagagaacctggggcagacccacatgcttgccacttcagtctctgtgagcccttgtg

SEQ ID NO: 65364 - DNA, 115 bp, Mus musculus
attccaatagacatgctggcaattaagtgtaaagaatgaatgaatgaatgaatgaatgaatgattgaacccttccttcttccattctccttatgtaaacctccagcagatgggat

SEQ ID NO: 65365 - DNA, 77 bp, Mus musculus
cacgtggtggctcacaaccatctgtaatgagatctgacgccctcttctggtgtgtctgaagacagacagctacagtg

SEQ ID NO: 65366 - DNA, 81 bp, Mus musculus
ggggtcagatgtgtactcagctcattggtcagaaacctgcatattaaggaggttgaagatggtgaatgtcgacaggaccct

SEQ ID NO: 65367 - DNA, 76 bp, Mus musculus
gttaagggctggagagacggctcagtagttaagagcactgactgctcttccagaggtaatgagttcaattcccagc

SEQ ID NO: 65368 - DNA, 112 bp, Mus musculus
ggagctgtccctgagtccctgtcagccactgtaagtatcactggcattgtgcttgtgtttatggagagttcttcatgcgagatatcacagagtacagagaagctagtgtggc

SEQ ID NO: 65369 - DNA, 111 bp, Mus musculus
agtatgtccagggagcaggtactgtctctaacaatcatgcttccttcacagcctagtaagaacagtgcaatgaagtatgggaaatatttagtatggcatctggcacatagt

SEQ ID NO: 65370 - DNA, 80 bp, Mus musculus
tctctcttcacacacacgtctgtactgtagctagccaatgggagggctgctctagacagaagtgactgaggtggatagga

SEQ ID NO: 65371 - DNA, 79 bp, Mus musculus
cataacaagacagtgagcacatgatgagtgggaatccaggtgatccctttattaagtgaagaatccctgactgttgatg

SEQ ID NO: 65372 - DNA, 85 bp, Mus musculus
gtccatggtggtctgataggatgcaaggggcagtttcaatatttttatatctgtcgaggcctgttttgtgaccaattatatgttc

SEQ ID NO: 65373 - DNA, 110 bp, Mus musculus
cagtccctgcagtttcctgattaatagttcatagtagtaggaatagtatctgcttcttgtttctttatacttatttgaaaactaggaggtcaagagacttacatgtgttg

SEQ ID NO: 65374 - DNA, 82 bp, Mus musculus
cgaggctcgaccttacattacattcagattctacacaacctctcctgtgtgcgtctgtctgtcaatttaatcctatgctttg

SEQ ID NO: 65375 - DNA, 78 bp, Mus musculus
tgatctgataggatgcatgggacaatttcaatatttttgtatctgttgaggcctgttttgtgacctattatgtggtca

SEQ ID NO: 65376 - DNA, 85 bp, Mus musculus
ggccatggtggtctgataggatacatgggacaatttcattatttttgtatctgttgaggcctgttttgtgaccaattatatggtc

SEQ ID NO: 65377 - DNA, 85 bp, Mus musculus; identical to SEQ ID NO: 57470

SEQ ID NO: 65378 - DNA, 102 bp, Mus musculus
acggagggaaccatgaaggttgaaattgggaccccaaagaaacagacaaggaagctctttgtcactgggtcttcttgttgaaacaaatgttattctctctgt

SEQ ID NO: 65379 - DNA, 59 bp, Mus musculus
gtcatgtgtgtgtactcgagtgtgtgtctgtcgatatgtgtgtgtgcatgtgcatgtgc

SEQ ID NO: 65380 - DNA, 83 bp, Mus musculus
ttcttcctatcatgaagatcacttgttttagagataggcaactatttttttttatagacaaagggatctagattcagagagaa

SEQ ID NO: 65381 - DNA, 96 bp, Mus musculus
ccatcccatgcagcagggtagcatagcagagggtagtgccctatcctgtctgctcccttggtctgtgtttatctctctgttataccattggtatgg

SEQ ID NO: 65382 - DNA, 115 bp, Mus musculus
gaaataagtaccaaatgccagccttggtattatggcttttatttgctctatggtaatttagcttcacgatgaaaatagagacaggataacatggtggcaaagtgttgcattcttc

SEQ ID NO: 65383 - DNA, 85 bp, Mus musculus; identical to SEQ ID NO: 58391

SEQ ID NO: 65384 - DNA, 97 bp, Mus musculus
ctttgtacgtctcatgttaccttggttatgggaaaacagttccgtggtgtttaactgggacgctgtatcccagaaggcaactagcatttgaacaaag

SEQ ID NO: 65385 - DNA, 85 bp, Mus musculus; identical to SEQ ID NO: 57439

SEQ ID NO: 65386 - DNA, 95 bp, Mus musculus
tcttggccttgacaggctggaagaggttagagggagatgctctctgaaaaacattctagggccccactctctcactgagtttgttgatgtctgga

SEQ ID NO: 65387 - DNA, 85 bp, Mus musculus; identical to SEQ ID NO: 58391

SEQ ID NO: 65388 - DNA, 71 bp, Mus musculus
tgcacataactaagtatgtatgtacatgcatacatacacatacatgcacatacatacatatattgtgtgta

SEQ ID NO: 65389 - DNA, 117 bp, Mus musculus
gatactagtcagttctgtacttcttaatttctgttctattaaaacattaacattttaatacttgagtgaagaatgagtggacagcaagtattaaggaaatagatttagatttctttc

SEQ ID NO: 65390 - DNA, 72 bp, Mus musculus
agtgatcacttctgatactgttgtagtgttttgcagtttaagagtaaaataatagtatcagaagttggccct

SEQ ID NO: 65391 - DNA, 86 bp, Mus musculus
gtcagttgtcactgggattggactctggactttgtgcacactaaacacactgtcactgagttattcgccagcccctaggtactgac

SEQ ID NO: 65392 - DNA, 73 bp, Mus musculus
agagtgtctggagaagtgagtctctgactgtgaaaataatgtgaatatagctgtgtctcatgatccacactct

SEQ ID NO: 65393 - DNA, 79 bp, Mus musculus
acttctgttagtttcactgtgtctctgtttagtttctgtttccaggatctgtccattgatgagggtggggtgttgaagt

SEQ ID NO: 65394 - DNA, 85 bp, Mus musculus; identical to SEQ ID NO: 57439

SEQ ID NO: 65395 - DNA, 115 bp, Mus musculus
taggagggaaggggcagtggggggcaagagtggaacaaagagaagtgggtccaggctagaaacctggtagacttcctctgccgactccatctcctaaaggttctacaatctccta

SEQ ID NO: 65396 - DNA, 75 bp, Mus musculus
ggcagcggaagtggtgtgtcactgggtctctgcatttgcacctttcccctgtgtggccacactgagtacattgcc

SEQ ID NO: 65397 - DNA, 115 bp, Mus musculus
gcaaaatatattctaaggacacagagtagtaaaggaatcctaagacttatgtgtgaaatattatttttaagatttatttttatttgtctgtgtgtctgtgtgtgtgtgtgagtgt

SEQ ID NO: 65398 - DNA, 64 bp, Mus musculus
gccacagtttcagtctagcatgtgacataagttaaaggtaacatgactgtgtctgtctgtgtgc

SEQ ID NO: 65399 - DNA, 108 bp, Mus musculus
ctcagtgctagggctatgggtcctccaggcatttttttaatgtgagtgttagaaatctgaggccctcacactgtcacagggaagacttccagccctttatccactgag

SEQ ID NO: 65400 - DNA, 89 bp, Mus musculus
tgaatccactgaaacatgggcttctctttagcttctcaagtcccaggtcattaaggacacagtagagggtgagcagacagtggaagtca

SEQ ID NO: 65401 - DNA, 65 bp, Mus musculus
aactctgtcagtttctctctcttcgccctggtgttccactagagaagggaggaaggacccgggtt

SEQ ID NO: 65402 - DNA, 110 bp, Mus musculus
ggcgactctgttgctgactgggggatgatagctcatactgagaggaatgccctccccctccctcttagtctctgtctctctcccctttttaaatggttatagtgtatgtc

SEQ ID NO: 65403 - DNA, 76 bp, Mus musculus
tccttgttctgttttagaaccatctgtaaaaacaagaggagcatctggcaatggatttctagcagtaatacaagga

SEQ ID NO: 65404 - DNA, 92 bp, Mus musculus; identical to SEQ ID NO: 57641

SEQ ID NO: 65405 - DNA, 84 bp, Mus musculus
atgtgcctaagtgtatacatgtgtgcatgtctatatttgtgtatatacatgtatgtatatgtacatatgtggatgcgggcacat

SEQ ID NO: 65406 - DNA, 74 bp, Mus musculus
gagtctaaactgtctgatgctctgaataaacttggctgttgtatgtgacttcagtctgtctcagttattggctc

SEQ ID NO: 65407 - DNA, 113 bp, Mus musculus
ctgacagggactgctgcctgtggcagccagtgattagagaagttactcagcagacttttttctgaggggaaaaaacaacttaatttactggggctggtattccctgtggccag

SEQ ID NO: 65408 - DNA, 96 bp, Mus musculus
gatggcttgagatatgtgctgtgcatatatgtatgcactatatgtatatgaatatgtgtgtacctgtatatgaacatatgtgtgctcatgcttatc

SEQ ID NO: 65409 - DNA, 68 bp, Mus musculus
tctactcacctagttattcatatatatatgtatatatatgcatatacatatatgactaggtatgtaga

SEQ ID NO: 65410 - DNA, 126 bp, Mus musculus
tgcatgtgtgcaggtacatgtgtgaacatgcaagtgtgtgtgtgtgtgtgtatatatgtatgtatgtgtgtgtgtatatgtatgtgtgtgcatgtgtgtgtgtgtatgtgtgtgtgtatgtgtgtg

SEQ ID NO: 65411 - DNA, 86 bp, Mus musculus
ggcacagtggggggctggagtgttctcattctctcagcttccatcctccgagcccagagacaggaaggcttgggttcctcaaggtc

SEQ ID NO: 65412 - DNA, 64 bp, Mus musculus
ttgctatatttcctgactctgggtcatagaatatagtctggatccagcagcagtaacctagcaa

SEQ ID NO: 65413 - DNA, 65 bp, Mus musculus
ggactgcggaacccggcttcccattttgtgaactggctgtgagcagagtggctctgttctgctcc

SEQ ID NO: 65414 - DNA, 80 bp, Mus musculus
gtgtatgtgcaaatatgtatgaatatgtacatatgtatgtatgtaagtatgtatttgtatatgcatgtttgcatgtacat

SEQ ID NO: 65415 - DNA, 137 bp, Mus musculus
tcctgagttcccaccttcagcattagttctcggtcttgttctatatgccctgttcctgtgttgagagaagaaagggagctcatgagcccatcatcaggccccttgggcagagaagatgctggtgagtcatttccttt

SEQ ID NO: 65416 - DNA, 115 bp, Mus musculus
ttctgtgtcttaggacattgttgctgatcttaggtaagccatgtgttagtgtttttttttctgtacttcatttgcctgtaatacatagtaactggttctcaaggtttcaatggaa

SEQ ID NO: 65417 - DNA, 72 bp, Mus musculus
ggactgggagttccacagtgtctcactgtctccaccttggtgagttatgggtctctgtgtcaattgccatct

SEQ ID NO: 65418 - DNA, 85 bp, Mus musculus; identical to SEQ ID NO: 57470

SEQ ID NO: 65419 - DNA, 85 bp, Mus musculus; identical to SEQ ID NO: 57470

SEQ ID NO: 65420 - DNA, 70 bp, Mus musculus
gggggataagaaaggctgattctaacacaggtcaggtaatattctctctgtatctgtctgtctgtctcct

SEQ ID NO: 65421 - DNA, 115 bp, Mus musculus
gcatttctctgttaagtttttgtctggatgacctgtccaatggtgagagtgaggtattgaagtctctcactatcagtctgtgaggggaaatatgggatttaagctgtagtagtgt

SEQ ID NO: 65422 - DNA, 80 bp, Mus musculus
agctaatgacagatcagaggctccagccttgtaacctcacacctgtcagaagtggctgcctactgacctgcaattacgct

SEQ ID NO: 65423 - DNA, 105 bp, Mus musculus
tgactgaacatcagccttagtccatggtgatctgataggctgtatgagattatttcaaaatttttgtatcttttgaggcctgttttgtgaccgattatgtagtca

SEQ ID NO: 65424 - DNA, 63 bp, Mus musculus
cggtggatattgtgtgattgtttgaaagtacgattctttcacacacacacacttaagacactg

SEQ ID NO: 65425 - DNA, 101 bp, Mus musculus
cccatccctcctcacctggcagcacataagtcatatgtaaagatgtaacttaaatgcaacatctttttataatatgtcatgaccaaagagttatcgctggg

SEQ ID NO: 65426 - DNA, 83 bp, Mus musculus
gaaacaaggccagtgaggtgactcagcacagaggctcttaactttgttggttgtgacccctttggcagtcaaatggccctttc

SEQ ID NO: 65427 - DNA, 90 bp, Mus musculus
cagtgtactgatggtgtgagcagtgtactgatggtgcgagaagtgtactgatggtgtgagcagtgtattgacagtctgagcagtgtactg

SEQ ID NO: 65428 - DNA, 102 bp, Mus musculus
ctgtgggtgcccgaggtcttctctactgagtggctctgtctcaggctgaagtgcttggatgaagctgtctatctctccagagcgtcacaacctcacccacgg

SEQ ID NO: 65429 - DNA, 89 bp, Mus musculus
acattcgttggtcatctattcctaatgacacacacactgagcctcttgtgggttctgtaggaatttaggagtagatttcctttgacagt

SEQ ID NO: 65430 - DNA, 107 bp, Mus musculus
gagaggcaatcccagctgtgaaggatcaacacagaagacagacagcaccactccccgtaactataggacctgccatcttctgtgtccacacacagaaatagactttc

SEQ ID NO: 65431 - DNA, 102 bp, Mus musculus
ggcaagcgttaatttacatgtctttatatgtctatttatatagatgtgtttcaagcatcactccatatagacatctaccttgactgtgtaagtttccttgtt

SEQ ID NO: 65432 - DNA, 65 bp, Mus musculus
gttgagtataggctttggtagtagagactcatgttttgaattgcctctgtgtctattatctctgc

SEQ ID NO: 65433 - DNA, 75 bp, Mus musculus
tggctggaggctctcctgttaaagttcaaagaatgggttctttcccacagcttaacagagtgagcactgtagcca

SEQ ID NO: 65434 - DNA, 75 bp, Mus musculus
atgtatatttgtacatgtgtgtattgtgtatttgtgtatggatacatgtgtatgcatgtatgtatagatgtatgt

SEQ ID NO: 65435 - DNA, 87 bp, Mus musculus
gaatgacaaaaacacctgaatttttttttatcttagccattttgacatgtatgaggtggaatttcagggttgttttgatttgcattt

SEQ ID NO: 65436 - DNA, 74 bp, Mus musculus
gcttagataaggatcaggccctctctgagtcactgggctgacctatgacattgaaagggcccaggctctttggc

SEQ ID NO: 65437 - DNA, 57 bp, Mus musculus
ctcaggctctcagacactcaggcaccactggatgccacaggctggatctagcctggg

SEQ ID NO: 65438 - DNA, 85 bp, Mus musculus
tgtgcctttgtgttcttaggggaggaacggtgtgcactgaagtgacagacctctcttgaccaagtaagaatgtctgtgatgcaca

SEQ ID NO: 65439 - DNA, 67 bp, Mus musculus
ccatctctctgtctctctgattcagcggcagaacaaactgtgggctgattatcagggtcatccttgg

SEQ ID NO: 65440 - DNA, 71 bp, Mus musculus
gcttcagagtagattgagaggtcagaggacaactctaggggtcacttctctccttctaccttttcttaggc

SEQ ID NO: 65441 - DNA, 89 bp, Mus musculus
tacccctgtctattctgtcttagctgagggcatttagacaaattattctatgtctcctactctcagtctcatttgtcttatggagggtg

SEQ ID NO: 65442 - DNA, 62 bp, Mus musculus
ggcactctgtcagactctgtctttggcaactttgctggaggactgaggaaacagcagagttc

SEQ ID NO: 65443 - DNA, 103 bp, Mus musculus
tggctggagcttattcctactttgattctgtcagtctctgttagtactccttggagtccacctctcacattagtcctagtggtcaaagcacttgctgcaggca

SEQ ID NO: 65444 - DNA, 115 bp, Mus musculus
atctcctttaccccctgagctgccatgctggtccctcttacgtgcttttaaaagcttatttatattttagggtcacattacacagggttgagggtgtggctcagtgagaggaggt

SEQ ID NO: 65445 - DNA, 61 bp, Mus musculus
gtgcatcacggctaatgacgtcagaagctgacatcggcgtctctgtatctctgtgatgccc

SEQ ID NO: 65446 - DNA, 102 bp, Mus musculus
gctcatccctgtcctctgcccaaaacagccttctctctgtgtgtgtgacccaggcagcttaactggggctgtttatagaagtctgggtgaggacctatttgc

SEQ ID NO: 65447 - DNA, 84 bp, Mus musculus
tgtatgtgaatgtctgtgtacagattcatacaggagtatgtgtgtatccatgtatctgtctgtctgtgagcctgcacacatata

SEQ ID NO: 65448 - DNA, 72 bp, Mus musculus
tatgtatgtatatgtgcatgtatgtgtatatatgtgtgtgtgtatgtgtgtatatgtatatgtatatgtgtg

SEQ ID NO: 65449 - DNA, 77 bp, Mus musculus
gtgcatgatttaaaggagtttattgtgcatgtgggaaggtgactctgtgtgtgtgtcctagaaatcactgtgtgcac

SEQ ID NO: 65450 - DNA, 160 bp, Mus musculus
ggcggatgcctgcgcggctctttccctctgccttccgtattgatggcggatgcctgcgtggctctttccctctgccttccatattgatggcagatgcctgcgtggctctttccctctgccttccatattgatggcggatgcctgcgtggctctttccctc

SEQ ID NO: 65451 - DNA, 67 bp, Mus musculus
gctttctgctcccctcttctacagtgttgcctgagccttcactgtggtagtgttgtgtagatgtagc

SEQ ID NO: 65452 - DNA, 85 bp, Mus musculus; identical to SEQ ID NO: 57470

SEQ ID NO: 65453 - DNA, 291 bp, Mus musculus
tacatatgtatgtatgtatatatatatgtatatgtatatgtgtatgtatacatatatacatacatatacaatgtatacaatgtatatatgtatatatgtgtatacaatgtatatatatgtatatgtgtgtatgtatacatgtgtttatgtatatgtatatatgtgtgtaagtatacatataaatgtgtatatatacatatatgtgtatatatgcatatatatactatgtttatatataatgtgtgtatatataaggatgtattatatatgtaggtatacaggaatatatgc

SEQ ID NO: 65454 - DNA, 85 bp, Mus musculus; identical to SEQ ID NO: 57470

SEQ ID NO: 65455 - DNA, 83 bp, Mus musculus
gaggaactgggagaaagagtggatacttgtcagggaggggttgtttatatctgaacaggtttccctcttagtccttgtttctt

SEQ ID NO: 65456 - DNA, 85 bp, Mus musculus; identical to SEQ ID NO: 57470

SEQ ID NO: 65457 - DNA, 85 bp, Mus musculus; identical to SEQ ID NO: 57439

SEQ ID NO: 65458 - DNA, 107 bp, Mus musculus
gggcccaaactgaggctacccccgtagtgcacgatcttgatgctgtctgttactctcacagacatgctttcctgtcagcacccttaggggcacagctccagggacac

SEQ ID NO: 65459 - DNA, 77 bp, Mus musculus
ggtgcatgtgtaaaatattcttagatatctaccaagcccacttggtgtataatgtcttgtgtttttctacatgtatt

SEQ ID NO: 65460 - DNA, 89 bp, Mus musculus
ggacttactcatagcaaaatatcttatctaggttgggcagatggctcagtatcagagcactgactgctcttccagaggacctgagttcc

SEQ ID NO: 65461 - DNA, 120 bp, Mus musculus
tccgctggtttgagtttcttctaggcatttcaacttgtcttaaagtgtccctcagcagtcttactgtttatatatatttggggtaggaggagcctagtgaaatctagttagtttcaggga

SEQ ID NO: 65462 - DNA, 102 bp, Mus musculus
cttcgtccgtggtgatctgatagaatgcatgggacaatttcaatatttttgtatctgttgaggcctgttttgtgaccaactatatggtcagttttggagaag

SEQ ID NO: 65463 - DNA, 114 bp, Mus musculus
tgtgagtgtaagagtatgtgtgtgcatgtgcgtgattatgtatcgctgtgtatcactctgtgtgtgcatgtgctgcatgagtgtgtgtgagtgcgtatgtgtgtttcagttatt

SEQ ID NO: 65464 - DNA, 59 bp, Mus musculus
tgtgtgcacagaggccagagaagggcatcaggtgtcctactctctcactccctgccata

SEQ ID NO: 65465 - DNA, 91 bp, Mus musculus
ctcgctaaggaactgtgagttaaagagagctgggaggaagagagtctgacactctctcttgtctcttgttaattctctaacttgttttgag

SEQ ID NO: 65466 - DNA, 71 bp, Mus musculus
aacagtagctgagtttgtcactcagtgacagcccttgctttgcacatgtgacaccctgggtttgatttgtt

SEQ ID NO: 65467 - DNA, 108 bp, Mus musculus
ccaaccccaatgaatctgtgtagcattgaaggtaagcataaggctgaagattgaagacttgtgattttattatttacaatgcattgaggagacccaatggcttagtgg

SEQ ID NO: 65468 - DNA, 96 bp, Mus musculus
tctgtgtgtccatgtgtctgtatgtctgtctgtctgtgtgttcagttagttctgttcttccagaggaccctgactaatgctgattgtggtaccaga

SEQ ID NO: 65469 - DNA, 114 bp, Mus musculus
cacacacacacatatatgtgtgtgtatacatatgtgtgcatgtatgtatatgtgtatatgtatgtatgtatgtatgtatacatatatgtatatgtgtgtgtgtgtgtgtgtgta

SEQ ID NO: 65470 - DNA, 89 bp, Mus musculus
aagccaaggcaggggcaggggcaggggcagaggcaggaactacagacgaatgctgcttactgtcttgctctctgtgacttactcagctt

SEQ ID NO: 65471 - DNA, 70 bp, Mus musculus
tgtggatatatatacatatatatatgcatatatacatatatatacaaacatgtgtgtgtatatacacaca

SEQ ID NO: 65472 - DNA, 118 bp, Mus musculus
gattagttatctggaactcattatttttaacagatttttcagagttaaactttcattaaaactttttttttaacttagattaactctagcactgttcagactgagcacagaacatgtc

SEQ ID NO: 65473 - DNA, 98 bp, Mus musculus
tttgtgtgtatgtgatgtgtgtatatacatatatatgtatatatatgcatatatatagcatattgtgtgcatatatacatgtgtgcaagcatgcatgc

SEQ ID NO: 65474 - DNA, 81 bp, Mus musculus
ctgcctaggatgtgtcgctccctgattggctgcagcccattggccgagttgtcgtcacggggaaggcagagcacgtggcgg

SEQ ID NO: 65475 - DNA, 126 bp, Mus musculus
ctgtagcatcctcctgtctccctgcctcacactgaagctgcctgcctgcctgcccacctgcctggctgcctgcctgcctttccagggcacagagtcaggttagttccagcctctcatctctaacag

SEQ ID NO: 65476 - DNA, 117 bp, Mus musculus
agagaaatagagacagaggcagagagatagtgagaagagtgagatagtggtggactacaactatctatctatctatctatctatctatctatctatctatctatctatctattacct

SEQ ID NO: 65477 - DNA, 100 bp, Mus musculus
gtggaggccatgcatgggtttgatacagagagagaaaagagtgatgtcagagatagagcctggagttgtttcgtctgtacagctgagaggtgtaattgac

SEQ ID NO: 65478 - DNA, 66 bp, Mus musculus
ccttgtgtgactctctgtatgtgtggagtggtgcagtcttcatatacactatgaagttgtacaggg

SEQ ID NO: 65479 - DNA, 69 bp, Mus musculus
gatgcctggatgcctggatgcctgtctgcctggatgcccagatgctaggcagagttaagtaagaggatc

SEQ ID NO: 65480 - DNA, 110 bp, Mus musculus
ggaggaaaagttttatttcagcttctaaatcttagaccacactccatcactgaagaaagtcagcaggaattcaaggcaggaacttagaagtaggaactaaatcagaggcc

SEQ ID NO: 65481 - DNA, 106 bp, Mus musculus
gccttagtccatggtgatctgataggatgcatgggacaatttcaatatttttgtatatgttgaggcttgttttgtgaccaattacgtggtcagttttggagaaggt

SEQ ID NO: 65482 - DNA, 85 bp, Mus musculus
acatccatctacttgtctgtctctatatctgtctacagaatgatggagcaatttaaaaaaagataactttgtagaatctgggtgt

SEQ ID NO: 65483 - DNA, 85 bp, Mus musculus; identical to SEQ ID NO: 57439

SEQ ID NO: 65484 - DNA, 86 bp, Mus musculus
cagtggatataagtggcagatagcttctggattcacctggcgttaacttgtgtggatcttcttgttcatgctgcttactgtctctg

SEQ ID NO: 65485 - DNA, 66 bp, Mus musculus
gtagagggcctaggactagccccggcactctctttggttggtggttcagtctctgtgagtctctat

SEQ ID NO: 65486 - DNA, 93 bp, Mus musculus
gatgaaaaggaatgcaaggacaagcagggctatcttgtctgggtcaacaccatctggccagaacctcccctctgtctattgccccttgacgcc

SEQ ID NO: 65487 - DNA, 98 bp, Mus musculus
ttgaaggatgttcagatataggaatgctttagaaatgaaataagggttttttgtagttaaaggtagcaaactatatctgtaaaaactcttaacttcag

SEQ ID NO: 65488 - DNA, 70 bp, Mus musculus
ctggcattagatgttctagcagtctctggctggagcttgttcctcatgtgagtctgttagtctgtgtcag

SEQ ID NO: 65489 - DNA, 74 bp, Mus musculus
tatgtatgtatgtatgtatgtatgtatgtatgtatgtatgtatgtatgtatgtatgtgtggaggtgcatgtgta

SEQ ID NO: 65490 - DNA, 105 bp, Mus musculus
tggaaggggaggcctgagttgcttgggctgggatgagatgctgaagatctgagaagagagacaagagcattgaggctgagagttattaggtagatgcccctcacg

SEQ ID NO: 65491 - DNA, 78 bp, Mus musculus
gaattagcttgggggctagagagatggctcagcggttaagagcactgactgctcttcaagaggtcctgagttcaattc

SEQ ID NO: 65492 - DNA, 119 bp, Mus musculus
actgacatgaacccccactgctgatgtcacagggaccttttctcttctaagtttatttttcaaaacataaaggtagagaagagattagttttgtagtcatcatgacatggtttctcagt

SEQ ID NO: 65493 - DNA, 88 bp, Mus musculus
ctgacacagctgtttgtgaaacctggagaaagttggcctctttacagttctcactttcttcatgtctacacaaaggagcttggtgtag

SEQ ID NO: 65494 - DNA, 76 bp, Mus musculus
cctggggggagatgcaggaagttgttctgtgctctgacacacggacacacaatctgcataatcgttgctctgctgg

SEQ ID NO: 65495 - DNA, 70 bp, Mus musculus
aaggctgtatacattctcttcttttcagtgacagtgtctcagtgacagtgtcaaaagtgagtcagctctt

SEQ ID NO: 65496 - DNA, 90 bp, Mus musculus
ttgtatatgctattagtgtctctcagttctttcttccagaatggccagccatagtaatgagagatgattgagaggactcagtgcttacaa

SEQ ID NO: 65497 - DNA, 82 bp, Mus musculus
caggcattggggaaccttttacttcataatgcgggaaactggatcttgaattaatgtttttcagaagagtttttgatgcttg

SEQ ID NO: 65498 - DNA, 69 bp, Mus musculus
gtcaggaaagaagtgcagagcaaaccagttgcttccttgcctgactgactggctcccactcactctgac

SEQ ID NO: 65499 - DNA, 76 bp, Mus musculus
gtctgcctgtctgtctctgtgtgggtatgaacatgtgcgtgtagttgcccaaggaggtcagaagagggaatcagat

SEQ ID NO: 65500 - DNA, 131 bp, Mus musculus
cagtgaaagcagcagttagttatgtttgaaacagggatgtgtgggccatcaaacactctcactgagacactagcactgcactgaaggaagtctataggagaggccctgtgagcacctgtgagttgacgtga

SEQ ID NO: 65501 - DNA, 106 bp, Mus musculus
gccttagtccatggtgaactgataggatgcatgggacaatttcaatatttttgtatctgttgaggcctgttttgcgacaaattatatggtcaattttggataaggt

SEQ ID NO: 65502 - DNA, 57 bp, Mus musculus
agtgaaatgtctgtctgtctgtcctactaaagcaggacaagggcatggggttttatt

SEQ ID NO: 65503 - DNA, 71 bp, Mus musculus
aggccacaggggcgcatgagcacgtgcgtgtgcatgtgtgtgtgtgtctgtgcatctgtgtgtctgtgtct

SEQ ID NO: 65504 - DNA, 87 bp, Mus musculus
agagcttcatggggaatttgatcctgggataggagttttattaatgaactgtcccactctcggtgacaaatgccatttgatggcttt

SEQ ID NO: 65505 - DNA, 85 bp, Mus musculus
ggttatcaaatgggaaactaactgtacactatcttagtggagttttgctcttacctgtctgtggctgttgtttattttgatgccc

SEQ ID NO: 65506 - DNA, 74 bp, Mus musculus
ggacacctgagactcattgactgactagcctaggctacttggcaagcctcaggtcacagtgactgagtctgtct

SEQ ID NO: 65507 - DNA, 105 bp, Mus musculus
atgtgggagaatgcatacgtgtatgtgcattcatatgtgtgtgcacacatgtgtgagtgtgcacacatatgagtacatgcatatgtgtatgtgtgtttcttgtgt

SEQ ID NO: 65508 - DNA, 69 bp, Mus musculus
gccccagctctgaataatgacacagagacttattatatttattataagctttgggcattgtagctgggc

SEQ ID NO: 65509 - DNA, 88 bp, Mus musculus
gaaacttgaaatttacttttccccaagactggagggatggctcagaggctaagagtcattgcttttcttgcagtagaaccaggtttca

SEQ ID NO: 65510 - DNA, 114 bp, Mus musculus
tttctgcaatccttgttaatattgatagtagaaattatttgactcagttgagtgcaaagttgactgttcccaaaacacattaatttttacttttcaagctaccggaatcaggag

SEQ ID NO: 65511 - DNA, 76 bp, Mus musculus
tgttacagaagtgtctgaggtgtgcatttgcagatgctggaatatagcacaaatgtaatgagagatctttggaaca

SEQ ID NO: 65512 - DNA, 98 bp, Mus musculus
ttcacatgtgtgtgagcacacgtggatagcagatactcagtcagttctgtgtgtcttcacatgtgtgtgagcacacgtggataccagaggctgctgtg

SEQ ID NO: 65513 - DNA, 85 bp, Mus musculus
gtccatggtggtctgataggatgcatgggaaaatttcaatatttttgtatctgttgatgcctgttttgtgaccaattatatggtc

SEQ ID NO: 65514 - DNA, 102 bp, Mus musculus
gatgtgttttcctggttttctttaaggacttgtaactctttatcagtgttctgtatttctttaagtgagttattaaagtccttctcgatgtcctctaccatc

SEQ ID NO: 65515 - DNA, 115 bp, Mus musculus
caggctggcaccaggattaatctgattgttttggcactggttagacagtgcaggaggagggctcttgtctgtctctgacaccaactctgcaatccagtggtcatggtgcaggctg

SEQ ID NO: 65516 - DNA, 111 bp, Mus musculus
taattgtaaggatgtcagtgtatgctcattgttttccacagaggtagtcataatctacatgtttctctgtctctcacagttcaagcatatcctgttctgcatatacagtta

SEQ ID NO: 65517 - DNA, 73 bp, Mus musculus
taaggcagaatttctctttgctccatgtttgggaactcatactccctcaagtgagagaggaaagtgtgctttg

SEQ ID NO: 65518 - DNA, 81 bp, Mus musculus
gtatctatatatgtgtgtgtgtctgtgtgcatgtgtatgtgatatatatatatatatatacacacacacatatatatatat

SEQ ID NO: 65519 - DNA, 77 bp, Mus musculus
gcattgcttaaggacttgagtgtctctcactggctgttcccagtatgagactgaaagccatcacctgatagcagagc

SEQ ID NO: 65520 - DNA, 81 bp, Mus musculus
gtgtgcttgcatattatgtgtgtgtgtgtgtctgtgattgtttgtaacatgtgtgtgtagcacatgcatatgggtgcatac

SEQ ID NO: 65521 - DNA, 79 bp, Mus musculus
gtgtgtgtgtacattacatgtgtgcttttgtattaatgtgtatgtgtgtgagtgcatgtgtatgtggaggcatgtgtgt

SEQ ID NO: 65522 - DNA, 68 bp, Mus musculus
ttagagttttgaagtcattggcacaggaaaagacttcctggacagaacattgacagcacaggctctaa

SEQ ID NO: 65523 - DNA, 109 bp, Mus musculus
tcctaacagatgagttttggttgtctatggaagagattcaaaaatatattttgttatttctgaactttttgactcagtgattatgggcacttgtaactaggtggcagga

SEQ ID NO: 65524 - DNA, 85 bp, Mus musculus; identical to SEQ ID NO: 57439

SEQ ID NO: 65525 - DNA, 86 bp, Mus musculus
tagtgccaacttgactagattaagaatcgccatggaaacagacctctctgaatgtctgtgagacgatttctagattgggtttattg

SEQ ID NO: 65526 - DNA, 104 bp, Mus musculus
ttacactggacatttgcccaagggacacattctctcactctgcctgtaagagctaaaggctggcaggggcaggaatgcctccaaagtaattctgtcttctgtaa

SEQ ID NO: 65527 - DNA, 85 bp, Mus musculus; identical to SEQ ID NO: 57470

SEQ ID NO: 65528 - DNA, 80 bp, Mus musculus
ttggtaaaagtttagcttgttatatgatttagaagtccagaagagggcatttgggtgcatttccttgcaaaactgatcaa

SEQ ID NO: 65529 - DNA, 138 bp, Mus musculus
catatatgaattagaaatgtatatatatgtgtgtgtatatgtgtgtgtacatatatatacatatatgtatgtgcatgtgcatgtgtgcatatacatgtatatgtatatgtatatgtatatgtatatgtatatgtatat

SEQ ID NO: 65530 - DNA, 116 bp, Mus musculus
tcttgctttagatttcaaagtcattgtttttactttaaaaacagattttatttttgtttgtacggttgtgttttttttggaggcctgaagctagtgttggatcctctagagctgga

SEQ ID NO: 65531 - DNA, 74 bp, Mus musculus
agtgtgttactgagggcagactctgaggtttcaaaacacctatgccaaccccagagtctcactctctgcctact

SEQ ID NO: 65532 - DNA, 63 bp, Mus musculus
tcctttttttcctgctgctcctgctctggagtcagagcacaaggtgtcagatgaaagtgagga

SEQ ID NO: 65533 - DNA, 105 bp, Mus musculus
gggtgaaactctagccgaggtatggagctggagttgactgtagtctcagcctatgtgtctttctcagtctggcttctttcttttagatctggtttcattttgctc

SEQ ID NO: 65534 - DNA, 95 bp, Mus musculus
ttgtccatatggattattagaaagtagggcagcctcaagtgttattaatactgtgggtgttctcttaggtaacctgatattttcaatatgggcaa

SEQ ID NO: 65535 - DNA, 120 bp, Mus musculus
acatttatttgagtgtatgtatgtgagtgtgcatatatgagtgtgtgcatatgcttgtgcatgtgtatgtgtgtgtgcatgtgcgtgtgtgtgtgtgtgtgtgtgtgtgtgtgtgtgtgt

SEQ ID NO: 65536 - DNA, 96 bp, Mus musculus
gtgtatgtgcagtgttttatgtttgtgcatgtatatgtgtgtacatgtgtatgtgcatgtacatgtgtatgtatttatgaatgcatgcatatatgt

SEQ ID NO: 65537 - DNA, 84 bp, Mus musculus
ttcgaccacaagcaacacagcaactagcttcctcaatcaaaggacttggcactaatctagttctgtcaggtagtgagggttgaa

SEQ ID NO: 65538 - DNA, 115 bp, Mus musculus
gtgtgtatttgtagtgtgtgaagcaggttgatgtgtgtgtagtgagtctatgtatgcatgtatgtatatatgtagtatatacatatattgtgatgtgtatagagtgtgtatgtac

SEQ ID NO: 65539 - DNA, 85 bp, Mus musculus; identical to SEQ ID NO: 57470

SEQ ID NO: 65540 - DNA, 83 bp, Mus musculus
ttgtatgtatatattgagaaatatgtgtgtctctgtgtgtgtgcatgtctaggtatgcatgtttctgagtctatagtatatgg

SEQ ID NO: 65541 - DNA, 75 bp, Mus musculus
tggtgaagactcaacaggtgggtgagcagacagggtccagatgggctcctggaaaccatctgaggatctgtacta

SEQ ID NO: 65542 - DNA, 85 bp, Mus musculus
gatgatggggtttcaggatggcctgtctgttcttgtaatactgaacccaaagagatgactcacactctgagacttttagaacatc

SEQ ID NO: 65543 - DNA, 64 bp, Mus musculus
acagacacatatgtatatacatccacatgtatatacacatgtgtgtatgtatatgtgtatatgt

SEQ ID NO: 65544 - DNA, 103 bp, Mus musculus
gtgtgtgtgtgtgtgtgtgtgtttgtgtgtgtttaaactgggttgacttaagtttttatatttataaccctaaattaaagctatcacacagcaactgatgggc

SEQ ID NO: 65545 - DNA, 87 bp, Mus musculus
aggatggggaagagtctgagcactgtggggtgggtcggagcaaaacaccaagtatccctaagctgcccattattttttttccatttt

SEQ ID NO: 65546 - DNA, 85 bp, Mus musculus; identical to SEQ ID NO: 60314

SEQ ID NO: 65547 - DNA, 97 bp, Mus musculus
ggggtttgcattcagttgctgcacaggtggtgatgttagtagaagctctaatagctctatgactctcactgtgtggggagacttggaaatatccccc

SEQ ID NO: 65548 - DNA, 111 bp, Mus musculus
taggaatttcttaatattttatatataatcacatgcatattctttgtgtatatttgcatgtacaaataactatatgtgcatagatgtattgtataattaagacagtaccta

SEQ ID NO: 65549 - DNA, 78 bp, Mus musculus
tccacactgcctgctgagggtgaagggaatgcagagaaatatttactctctctgacacactggagacaggggtttggg

SEQ ID NO: 65550 - DNA, 108 bp, Mus musculus
atacttactatattatagtatatacatttactacatatactatgtatatactatattatagtatatatttactatatgtactatgtatatactgtatatagtatatat

SEQ ID NO: 65551 - DNA, 137 bp, Mus musculus
tatgtatgtgtgtgtgtgtacacacacacacacacacacacacacacacacacacacacatacatatatatatatatatacatatatatatatatatatatacatatatatatatatatatatatatatcacatgta

SEQ ID NO: 65552 - DNA, 96 bp, Mus musculus
atgtgcctgcatgtgcatatatgtgtatacatgtacaaatgtgtttatagatgcgaataaatgtgtatatgtatatatgtgtgttttggggtatat

SEQ ID NO: 65553 - DNA, 84 bp, Mus musculus
aaacaccacattcttgtgtggagagagtgagcagtgaccaaggaaaccattgaaacagttttcatgctataggagatggtcttt

SEQ ID NO: 65554 - DNA, 86 bp, Mus musculus
ctcagatagtccccaggggaggtgacagggaagctcacagggactcagagctgagcatgccagcctccctgaatggctaagctggg

SEQ ID NO: 65555 - DNA, 85 bp, Mus musculus
aggggaccttttgtcatctgtatttttctatttgtatgaaacagttcatgcagtttggtttaggaaagaatgcaagagaaatcct

SEQ ID NO: 65556 - DNA, 72 bp, Mus musculus
agcagcagaggaaggctgttggtgtcttacccccatccctgagtcagtctcagtatctttctctgagctgtt

SEQ ID NO: 65557 - DNA, 126 bp, Mus musculus
acaatgtatgtatgtatgtatgtatgtatgtatgtatgtatgcatgtatgtatgtatgtatgtgtgtgtgtgtgtatgtgcatgtatgtatgtatgtatgtatgtatgtatgtatgtatttggata

SEQ ID NO: 65558 - DNA, 85 bp, Mus musculus
gtccatggtggtctgataggatgcatgggataatttcaatatttttgtatctgttgaggcctgttttgtgaccaattatatggtc

SEQ ID NO: 65559 - DNA, 110 bp, Mus musculus
gaaatagtaactaaaaaaccagggaaacagttgattaaactgataggagggtttgagttatgagtgaagttacagtgctgaaggattggttttagagttatagtggtttc

SEQ ID NO: 65560 - DNA, 66 bp, Mus musculus
gtgtatgtatgtatgtatgtatgtatatatacacatatatatacacatatacacacacacatatat

SEQ ID NO: 65561 - DNA, 114 bp, Mus musculus
gtttctttatttaaaaaaatcattatatgcatctatatgtgtgtggaatcatgtctggggcttcaatatgactccattgaccaaggtgtctgtttaaatgttttaaagtctggc

SEQ ID NO: 65562 - DNA, 80 bp, Mus musculus
ccattaagaatccaacatgtaacacatagaagtatggtttctttatttcattatgtacatatgtgttgggtttatactgg

SEQ ID NO: 65563 - DNA, 78 bp, Mus musculus
gtctgtgagatgggccttgtgggagactcacggcgtgggccacccttgctgggctctctcacttgctgactcaccgat

SEQ ID NO: 65564 - DNA, 111 bp, Mus musculus
aggatggtaagggtttggatagaaggtttatcaccagaattttaattttagtcttaaatagctttatatattttttcctaagaggtacaccttttattttcttgctgctct

SEQ ID NO: 65565 - DNA, 111 bp, Mus musculus
gctgtcttgtaagtgctgtcttgggatgcagtcctatgtatatattttttaacctagttaaaataatcctaataatcgagcactgcttccttcagtgcaaaacgctgcagc

SEQ ID NO: 65566 - DNA, 71 bp, Mus musculus
gcagaggaatgcaaaaagttgacagagccaatgagtcccaaagatctatgactgtcaggtgttgtctctgc

SEQ ID NO: 65567 - DNA, 86 bp, Mus musculus
tatgtgtatatatatgtgtgtatatatatatgtacatatatatgtgtgtgtgtatatatatatatatacatatacatatatatata

SEQ ID NO: 65568 - DNA, 133 bp, Mus musculus
gctcctcacacagcagtggatgtatgtatgtatgtatgtatgtatgcgtgtatatatatatatatatatatatatatatatatatatatatatatatgcgcgtgtgtgcgtgtgtatgtatatatatgtatat

SEQ ID NO: 65569 - DNA, 82 bp, Mus musculus
gggttctttaacaatacatgtttcttgttgcacattcttttttagaaaattgtaataagattagtgtgatataaaagaggct

SEQ ID NO: 65570 - DNA, 120 bp, Mus musculus
accttggctatcttggaacttgctctgtagaccaagctggccttgaactatatatatatagttatatacatacatatatatctccaccagcttctgcctcccaagtctgagattaaaggt

SEQ ID NO: 65571 - DNA, 120 bp, Mus musculus
acctttaatctcagacttgggaggcagaagctggtggagatatatatgtatgtatataactatatatatatagttcaaggccagcttggtctacagagcaagttccaagatagccaaggt

SEQ ID NO: 65572 - DNA, 113 bp, Mus musculus
atgtaaattttatgtgctgtgtattttacattaaaaactttccctgaaatgaattgtgattttcatgtggatgaataattttaaaaatacatacaccaagcacatctgtatgt

SEQ ID NO: 65573 - DNA, 115 bp, Mus musculus
cagttaagtacataagcagggctggagaaatggctcagtggttaagaggagcactgactgctcttccagaggtcctgagttcaaatcccagtaaccacatggtgactcactactg

SEQ ID NO: 65574 - DNA, 117 bp, Mus musculus
ttttgcagtgctgggttaaataacaaaggagtggacaatttggtatgtaatgaatattgttcattgcaaaataattgaaatttcattgtcattaggtactttattacacatgcagaa

SEQ ID NO: 65575 - DNA, 115 bp, Mus musculus
gcacatttctgctagtaagaggaatatacaggactggagagatggctcagtgattaagagcactgactgctcttccacaggtcctgagttcaattcccagcaacgacatgatggc

SEQ ID NO: 65576 - DNA, 122 bp, Mus musculus
gtttcatcaccatagattctggtttgtcatgcaggactgtgtggctcacttgtgtgtgtgtgatagaaacagtttacaaatcagcaagctatatgcacaaggccaaagtctgctctcatcag

SEQ ID NO: 65577 - DNA, 81 bp, Mus musculus
aggcatcgaggctcaggtagaatgttgattagcacttgagaaatttctcctctagaaagcaaagctgccacaagccagcct

SEQ ID NO: 65578 - DNA, 69 bp, Mus musculus
tggtgaataccgaacactcagtcacttactgtcagcactttgaccaggtgtgagtctctgtattagcca

SEQ ID NO: 65579 - DNA, 71 bp, Mus musculus
tcattctttatatatgtgtgtgtgtatgcacaaacgcacacacacacatacacacacacgtgatgatatga

SEQ ID NO: 65580 - DNA, 145 bp, Mus musculus
tgtgtgcatgtatgcttgggtatatgtgtatgtatatatgtgtgaacatctgtgtgtgcttctgcatatatatgtatatatgtatatgtgtgtatgtatatatatatatgagagagagagagagagagagaaagaaaatatatat

SEQ ID NO: 65581 - DNA, 89 bp, Mus musculus
atacatacatacatacacacacacacacacatatatatacatatatgtatgtatgtatgtatatatatatgtgtgtgtgtataatgtat

SEQ ID NO: 65582 - DNA, 63 bp, Mus musculus
gttaatgagggatttctaggtgagcctgaggacactctgtctctatctgtgtctctctctgat

SEQ ID NO: 65583 - DNA, 74 bp, Mus musculus
tatggatctggctggtgacaaaacacttcagggacaggaagcaatgtgaagtactgtcactctgtctgtctgtg

SEQ ID NO: 65584 - DNA, 117 bp, Mus musculus
tatctatctatctatctatctatctatctatctatctatctatcatctatgtctatatctatatttgtatctatatagagagaaatacatagatagataaagatagagatagagata

SEQ ID NO: 65585 - DNA, 68 bp, Mus musculus
ttcaacaagaacaagagtaaaggctgccagctgtgtcctcatactggcacagttctgctcttgttgaa

SEQ ID NO: 65586 - DNA, 132 bp, Mus musculus
gtcttctgtcgagcgtccagcttctggccatgctgctttcccgatgcagatagtgtctcagaagtctgtgacgactggagcaaggagtgactttgatttgaggtgaggcacatctgcacagacacctagcat

SEQ ID NO: 65587 - DNA, 102 bp, Mus musculus
ttgtttctctggcttccactaggacagtgctgcagagttggttttttttttttttttgtgacttagcattgctagtgatagttggctctgatcaagggacaa

SEQ ID NO: 65588 - DNA, 75 bp, Mus musculus
tatctgtctgtctgtgtgaatgctggaggaagtgaaagttggatcccctcagctgggcatataggttgtgagata

SEQ ID NO: 65589 - DNA, 87 bp, Mus musculus
ttcatgattttcgtggtaactgctacaccaaatgattttttattaaaatcattatgtgtacacacagaccacacatacacacatgag

SEQ ID NO: 65590 - DNA, 82 bp, Mus musculus
tgggctcctgatgccagtgctctctctgcatgctgagatacgcccagcagatactctcagtctcagagctgattagagccca

SEQ ID NO: 65591 - DNA, 75 bp, Mus musculus
ttaagaattgtcttatgccagagccaaacagagatttttcaacagaggaatcttgaatggctgacaaacacttaa

SEQ ID NO: 65592 - DNA, 116 bp, Mus musculus
cctgcttggggataaagacgtgcactctcagttactactccagtaccatgcctgcctgcctgcttgccatcacactggtggttataacctgaaatcataaactgccttggtcatgg

SEQ ID NO: 65593 - DNA, 70 bp, Mus musculus
tcagctagctatctgaatgtatatgtatatatgtgtatatgtgtgtatgcatattagaagttacatttga

SEQ ID NO: 65594 - DNA, 85 bp, Mus musculus; identical to SEQ ID NO: 57439

SEQ ID NO: 65595 - DNA, 82 bp, Mus musculus
gggaataaaactatagtgtatagtttgctttgcttttaccatagtagagttagtatgactatataattatatgattattctc

SEQ ID NO: 65596 - DNA, 85 bp, Mus musculus; identical to SEQ ID NO: 57439

SEQ ID NO: 65597 - DNA, 110 bp, Mus musculus
gggtctataggtcagggccttcaaagcatgtagaggatctcttgtgaatttgttggaagtgcaatattccaagccccaaccatgactttgtggtttagaactcgaggtcc

SEQ ID NO: 65598 - DNA, 112 bp, Mus musculus
catgtttcagtttgcaaaacttgtggcagttcaacaataccagcagcaattgtgtatgggctctgtgtctgtgtctgtgtctgtgactgctttcaacactgcagtgctcatg

SEQ ID NO: 65599 - DNA, 113 bp, Mus musculus
tccgagagagccatcttgtttccaggactctgcagaaagtaacctacacaagtgagtgtggactactgaaacaatgccttctgtcacaggccaaagcaacacagctcctggga

SEQ ID NO: 65600 - DNA, 95 bp, Mus musculus
gtatgtatgtatgtatgtatgtatgtatgtatgtatctatcacgtatccatgtatgtatctatgtatctatctatatatctatgtatctacgtat

SEQ ID NO: 65601 - DNA, 68 bp, Mus musculus
gtatctatgtacctatgtacgtatgtacgtatgaatgtatgtatgtatgtatgtatgtatgtatgtat

SEQ ID NO: 65602 - DNA, 115 bp, Mus musculus
tgtgggtggtgccatccctaagctgggattctgactaagtgaagggagagagctcagaagcagcatgtagtcatggataactctgcttagggttctgatgtgctacttcaaaccc

SEQ ID NO: 65603 - DNA, 80 bp, Mus musculus
ggcagcctccctgtatttgactctctaacactgtcttatgaatggtgttgggggcagctaatgagcagaggcagactgcc

SEQ ID NO: 65604 - DNA, 106 bp, Mus musculus
gcatgatccatcttctgggtgtggatatgttgtctttgtttatcatactggtaccccactatcacatatagacttaccacatctctggcatatgatagatatatgc

SEQ ID NO: 65605 - DNA, 87 bp, Mus musculus
agtctcctactctatatattttttaatccaagtcatgttgacatatgacagtgagcatgaaagtggttttgattcttttgagggact

SEQ ID NO: 65606 - DNA, 102 bp, Mus musculus
tttgtatagattatgctaagaaatcactcatatatatatatatatatatatatatatatatatatatatatatatatgagtgatttcttatatatatataag

SEQ ID NO: 65607 - DNA, 83 bp, Mus musculus
tatataagaaatcactcatatatatatatatatatatatatatatatatatatatatatatatatgagtgatttcttagcata

SEQ ID NO: 65608 - DNA, 112 bp, Mus musculus
tagtgaagtaaaagggactgccacgattgagtctatgtgagagtatatatctttatttttgagctctcacactagactcaaaatattttttggttatctaggtttgttgttg

SEQ ID NO: 65609 - DNA, 83 bp, Mus musculus
gataaccaaaaaatattttgagtctagtgtgagagctcaaaaataaagatatatactctcacatagactcaatcgtggcagtc

SEQ ID NO: 65610 - DNA, 95 bp, Mus musculus
tatatatttacatacattatatatatatacatacatacatgcatatatatatgtgtgtgtgtgtatgtatatatatatgtgtgtgtatatatata

SEQ ID NO: 65611 - DNA, 70 bp, Mus musculus
atgcctagatatatctagatatagatatgtgtgtgtgcacatgtttatgtctctgtgtgtgtctgtgtgt

SEQ ID NO: 65612 - DNA, 73 bp, Mus musculus
ttcatttggaaactgtaccatgtactccctgcctgcacaggcagcgagtccactgaacactgtgactagagaa

SEQ ID NO: 65613 - DNA, 79 bp, Mus musculus
tggggttactgagtagagagacagcagtcaagagtgagaagtttgatagcatttgtctactgctcattaaaataagcca

SEQ ID NO: 65614 - DNA, 87 bp, Mus musculus
gtacctgtgggagatcagtttgcctgcttcccactgccttgaccacctccccaaagccctgagtgtctgcctgtctgtctgcaggac

SEQ ID NO: 65615 - DNA, 101 bp, Mus musculus
atgtgcatgcatgtgtacgtgtatgtatatgtgtatgtgtatatgtatatacacatatatgtatacatatttatttatagatatacatgtaatatgcatat

SEQ ID NO: 65616 - DNA, 117 bp, Mus musculus
tgtcttttacctgaagttttgatctcagctattcagataggtgtaaggtagaatcttgttttgatttccatttctctgatcactaaggactttgaacatttctttaggtttttctca

SEQ ID NO: 65617 - DNA, 85 bp, Mus musculus; identical to SEQ ID NO: 57439

SEQ ID NO: 65618 - DNA, 85 bp, Mus musculus
ggctgtggtggtctgataggatgcatgggacaatttcaatatttttgtatctgttgaggcctgttttgtgaccaattatatggtc

SEQ ID NO: 65619 - DNA, 109 bp, Mus musculus
tcctacctgactgcacaattcatgataggatcatatgtgttcattatatttttaatagagaaggcaggtagagttgtgaggcttgtgtggaacttcattcagaagagga

SEQ ID NO: 65620 - DNA, 85 bp, Mus musculus; identical to SEQ ID NO: 57439

SEQ ID NO: 65621 - DNA, 83 bp, Mus musculus
attatcctcactaaattgctttagaatatcaagacagttatattaggattagaactgtagtgagatttttgaagcaagataat

SEQ ID NO: 65622 - DNA, 108 bp, Mus musculus
aggtatagatataatattatatgtgtgtgtatatatatatatatatatatatatatatatatatatatatatatatatatatgcgcaatggtattcatatgtacttcc

SEQ ID NO: 65623 - DNA, 108 bp, Mus musculus
ttgctctgtagtacagcttgaattcagggatggtgatacttccagaagttattttattataaaatgattgttttagctatcctggtatttttgtttttacatatgcaa

SEQ ID NO: 65624 - DNA, 85 bp, Mus musculus; identical to SEQ ID NO: 57439

SEQ ID NO: 65625 - DNA, 85 bp, Mus musculus
ggccatggtggtctgataggatatatgggacaatttctatatttttgtatctgttgaggcctgttttgtgaccaattatatggtc

SEQ ID NO: 65626 - DNA, 106 bp, Mus musculus
gccttagtgcatggtgatctgataggatacatgggacaatttcaatatttttgaatatgttgaggcctgttttgcgacctattatgtggtcaattttggagaaggt

SEQ ID NO: 65627 - DNA, 120 bp, Mus musculus
atcttaaatgtctatttgttgttgtcagatgaaggagcgtccttggaatctatatttatatctttttagaaatggattgtggaaagccattggaagtatgtaatatcagatagaatagat

SEQ ID NO: 65628 - DNA, 120 bp, Mus musculus; identical to SEQ ID NO: 65627

SEQ ID NO: 65629 - DNA, 95 bp, Mus musculus
gtgtttgagtgatatatatatatatatatgtatatatatatatatatatatatatatatatatatatgaatgtatgcatgtgagtgtgtgtgtgt

SEQ ID NO: 65630 - DNA, 102 bp, Mus musculus
tagaaggatctgatggtgttttgaatttcttcaggatctgttgctatgtctcccatttcatttctgattttgttaattaggatgctgtccctgtgccctcta

SEQ ID NO: 65631 - DNA, 85 bp, Mus musculus; identical to SEQ ID NO: 57439

SEQ ID NO: 65632 - DNA, 85 bp, Mus musculus
ggccatggtggtctgatagggtacatatgacaatttcaatatttttgtatctattgaggcctattttgtgaccaattttatggtc

SEQ ID NO: 65633 - DNA, 61 bp, Mus musculus
gagcgtttaccagtgtcacctctgtttctgaccagcagaaaagagtgacaacactacgctc

SEQ ID NO: 65634 - DNA, 102 bp, Mus musculus
cttagtccatgttgatctgataggatgcatgtgacaatttcaatatttttgtatctgttgaggcctgttttgtgaacaactatatggtcaattttggagaag

SEQ ID NO: 65635 - DNA, 85 bp, Mus musculus; identical to SEQ ID NO: 57439

SEQ ID NO: 65636 - DNA, 86 bp, Mus musculus
tgtttaatgtaagactgtatggtattgtggtaatagcccatagatacttaccaatgcaccacaaagtcatcagtctgtagtagaca

SEQ ID NO: 65637 - DNA, 62 bp, Mus musculus
gataaacaattttatatatacatagacatatacatatatgtgtatgtatatatgtatgtatc

SEQ ID NO: 65638 - DNA, 102 bp, Mus musculus
gttgatcagccttattccatggtcatctgataggatgcattggagaatttcaatatttttgtatccattgaggcctattttgtgactaagtatatggtcaat

SEQ ID NO: 65639 - DNA, 76 bp, Mus musculus
gactgtgtctggaatggatccccatgtgggacgtctctggatgacctttacttcagtttttgttctacacattgtc

SEQ ID NO: 65640 - DNA, 116 bp, Mus musculus
tgctgcattctcatagaatgtggatgcttatggttagatgtgatgacttttgtaaatgtatgtattgaagaaagtcaagtttaaagtattgtccctatgtcaagtggaagtcagca

SEQ ID NO: 65641 - DNA, 112 bp, Mus musculus
gtgtcttctaggaacagtgtcaagtggggagaatagcaggcagaagagaaagatttgtttttgttttgttttcttcttatcatgccttctcagtttattttttataagaaac

SEQ ID NO: 65642 - DNA, 79 bp, Mus musculus
gcttctgttagtttcactgtgtctctgtttagtttctgtttccaggatctgaccatggatgagagtgaggtgttgaagt

SEQ ID NO: 65643 - DNA, 82 bp, Mus musculus
gggggtgtaaacaagctgatgtgtttttacttcaatatacatatatgaagtaaaatagtgtcaaggctatgttaatattttt

SEQ ID NO: 65644 - DNA, 118 bp, Mus musculus
atatacacatatatgatattatatatatatgtgtgtgtatgtgtgtgtacatatgtgtgtatatttaaatatgtgtgtcatatctaagtgtttatgacatataaacacatgcatgcat

SEQ ID NO: 65645 - DNA, 85 bp, Mus musculus
ggccatggtggtctgataggatacatgggacaatttcaatatttttgtatcgattgaggcctgttttgtgaccaattatatggtc

SEQ ID NO: 65646 - DNA, 81 bp, Mus musculus
tgaaacagttgagagtgtgcagttacaactccatttagacttgcagtttgactgtcatgtatttcactattggctgttaca

SEQ ID NO: 65647 - DNA, 117 bp, Mus musculus
tgggcttcccaaaagctgaccatcttatgttgtaaggagacagttgtctgagtccagctcaaggacaacttcttcatcttgctggcagggtcaaaccaagtttagttcccaggccca

SEQ ID NO: 65648 - DNA, 116 bp, Mus musculus
agggagggggatgagtgtatgacatgaaattcacagagtcaataagaagtaaatatttttcttaataatgagcagtttacttcttatggatttcatgttcagtgatttcttaaact

SEQ ID NO: 65649 - DNA, 70 bp, Mus musculus
gtatgtatgtatatgtatatatgtatgtatatatatatatatgtatatgtatatatgtatgtatatatca

SEQ ID NO: 65650 - DNA, 115 bp, Mus musculus
gtctgtctgtctatatatatatatatatatatatatatatatatatatatatatatgtatatgtatatgtatatgtatatgtatatacatatatatatatctggcttgaattggc

SEQ ID NO: 65651 - DNA, 116 bp, Mus musculus
ggtggacgatgcttctatgtgagtggatgtgtcacaaaatttagtcttgaaaagagagcatagatgtctggttatgattagttgttgacgtcaatgacttaaagctataattgatc

SEQ ID NO: 65652 - DNA, 119 bp, Mus musculus
atattgcagctctctgtatttttagtatatcagatgctaggctctttgtatatttttattgactaaaatataatatactgctgatttagtagatttataagaaacagagaattgaatat

SEQ ID NO: 65653 - DNA, 58 bp, Mus musculus
atatatatgtatgtacatatatatacattgatgtatatgtatgtgtatgtgtatgtat

SEQ ID NO: 65654 - DNA, 56 bp, Mus musculus
gtatgcatgtatgtgtgtgtgcatatatatatatgtatatacatatacatacacac

SEQ ID NO: 65655 - DNA, 81 bp, Mus musculus
tttgtctgcgggtgtctgtatctgtctgcattagtttctgtttggaggctctcagagagacaatacgctcctgtctgcaag

SEQ ID NO: 65656 - DNA, 102 bp, Mus musculus
tcctgtgattctgttagcctctgtcagcagacctgggagtgtagctctcttgagtttcagtgatcagagtactgtcagtaggcaagctctactcttgcaggg

SEQ ID NO: 65657 - DNA, 81 bp, Mus musculus
tctatggtgatctgataggattcatgggataatttcaatatatttgtatctgttgaggcctattatatggtcagttttgga

SEQ ID NO: 65658 - DNA, 117 bp, Mus musculus
tttgtaaactgtcttcctttgtccttttcaattcttttcctacaatgtaaatttaaatttctattgattaagattgagaaatgagaacattggccagttagacggttgtttctcaaa

SEQ ID NO: 65659 - DNA, 73 bp, Mus musculus
caccaagtgcagtgttgtttggcaggaggagataggtgcctgacaattttctcctggctacatttcttggctg

SEQ ID NO: 65660 - DNA, 60 bp, Mus musculus
tgcgtgtgtgtgtatgtgcatgtgtatgtatttgtacatatgtgtatatttctatatgta

SEQ ID NO: 65661 - DNA, 112 bp, Mus musculus
agaaatggaaatagagggagggtggaactaggagagagagaaggtggtagcaatgttctctctctccctccctctctctctctctctctctccctccctctcttctctctct

SEQ ID NO: 65662 - DNA, 139 bp, Mus musculus
tatatgcagtatatatatatatatgtatgtatacacccacacatactgtatatacagtgtatatatatatatagcatgtgtgaaatatttaaattgattaatatgaatattaatattatgtatacatatatatgtacac

SEQ ID NO: 65663 - DNA, 114 bp, Mus musculus
catgttgacctgcagttatcttactttatctctgggccagagtgacatatatatatatatatgtcagcacgatcaatgagaaaagcaagttaagacataggtaaaaatttcatg

SEQ ID NO: 65664 - DNA, 85 bp, Mus musculus; identical to SEQ ID NO: 57470

SEQ ID NO: 65665 - DNA, 115 bp, Mus musculus
tggattggtttttgcctatgggatgggtcttaagatggcacagtcactagtttcccagtctctcagtctctgttctgtctttatccctgtagttcttgtagttagaacaaattta

SEQ ID NO: 65666 - DNA, 91 bp, Mus musculus
tactggtatggatgttttcaggagtgacatttggtattagaaaatcaactagtgttctcttctctgtggaagacttctccaactctcagta

SEQ ID NO: 65667 - DNA, 98 bp, Mus musculus
tttgtggtagaataggctacacatttttttcagagcttttctgtgttctctttacagtgtttttatatttgaaaaacttggtgctctactactatgaa

SEQ ID NO: 65668 - DNA, 111 bp, Mus musculus
ccttagtccatggtgatctgataggatacatgggacaatttcaatatttttgtatctgttgaggcttgttttgggtccagttatgtggtcaattttggagaaggtcccatg

SEQ ID NO: 65669 - DNA, 85 bp, Mus musculus; identical to SEQ ID NO: 57470

SEQ ID NO: 65670 - DNA, 92 bp, Mus musculus
tacaatatatattataatatgtaatatatatatatacatatatatatgtgtgtgtatgtgtatacagattatatatatatgatatgtgtgta

SEQ ID NO: 65671 - DNA, 114 bp, Mus musculus
gagaaatttaggcttgcagtattctgatagtagagtctgtaaaggcaacaatattattattttctcagttggccttggaagaactcataccagcagaaaagcaaatctacactc

SEQ ID NO: 65672 - DNA, 131 bp, Mus musculus
gtgtgtgtgtaagtgtgtgtgaaagtgtgtgtgtgtgtgctcgcgtgcatgagtatgtgtatttctacatgtcattttccagaagggatggtcagtacatttggtaatgggcatggaagatacaatactta

SEQ ID NO: 65673 - DNA, 106 bp, Mus musculus
gccttagtgcatggtgatctgataggatacatgggacaatttcaatatttttgaatctattgaggcctgttttgtgacctattatgtggtcaattttggagaaggt

SEQ ID NO: 65674 - DNA, 85 bp, Mus musculus; identical to SEQ ID NO: 57439

SEQ ID NO: 65675 - DNA, 62 bp, Mus musculus
acatgcatgtggatggtagaggacaattctgtggggttcgttgtctccttccacaatcatgt

SEQ ID NO: 65676 - DNA, 112 bp, Mus musculus
tgttgcagatatttaatatggtggcatcggagtatgtgcattttatgaacagaatttgaaaagtgtatttgatgaacataagccaaagtgctgctctgttttcttttgaata

SEQ ID NO: 65677 - DNA, 81 bp, Mus musculus
tgatggctgacactgcagagccttcagaattttcttagtcatacagagtatcctagtatggagactctctgtctctcatca

SEQ ID NO: 65678 - DNA, 118 bp, Mus musculus
atcagccttagtctctggggatctgatatgatgcatgggataatttcaatatttttgtatctgttgaggtctgttttgtgaccgattatatagtgagttttggagaaggtaccatgat

SEQ ID NO: 65679 - DNA, 84 bp, Mus musculus
ccactattttgctatgagtctctgtatctgtttttgtcagctgttggctgaaacctctcagaggaggtttatgctaggttctgg

SEQ ID NO: 65680 - DNA, 85 bp, Mus musculus; identical to SEQ ID NO: 57439

SEQ ID NO: 65681 - DNA, 141 bp, Mus musculus
tagatatagatatagatatgcatatatttatatatatgtacacacatatgcacatatcaatgtatatatatatatatacatacacatatatgcatatatatatatatatttaaaggtatacaacatacatataagtagata

SEQ ID NO: 65682 - DNA, 106 bp, Mus musculus
atatatatatatatatgcatatatgtgtatgtatatatatatatatacattgatatgtgcatatgtgtgtacatatatataaatatatgcatatctatatctatat

SEQ ID NO: 65683 - DNA, 111 bp, Mus musculus
gcgctatctgtgtgtctgtctatctatctatctatctatctatctatctatctatctatcagtataatatagattatatagagagacatagacatggatatagataagtgt

SEQ ID NO: 65684 - DNA, 118 bp, Mus musculus
gcttgtctatgttacagtagagatccatcctctcaagtaagacaatgagtgttcctaaatttttgtgaatttcttcttgtctagaaaacttatggtttttattaaaacataagaggca

SEQ ID NO: 65685 - DNA, 116 bp, Mus musculus
tttcacatatttgagagcaaactctcttataaaatgtgcagctgatctggtgagaaagtgctatgactgctggtagaattttttgtgggggttcgttttcatatagacatctgaaa

SEQ ID NO: 65686 - DNA, 113 bp, Mus musculus
gatatatgctcaggagtgtatagttggttccttaggtagtactttgtataattttctgagaaacagccagactgatttccagagtgattatatcagcttacaataccaccaac

SEQ ID NO: 65687 - DNA, 78 bp, Mus musculus
atacatacctgtatgtatatgtaagtatatgtttgtatatatagatatagatagatacagatgcatatatttatgtat

SEQ ID NO: 65688 - DNA, 97 bp, Mus musculus
tccataagagtctccaagctccatccaatgattggctgtagttctctgtattctgtttcagtcagctattgtgtggagtcactcaaggcacttagga

SEQ ID NO: 65689 - DNA, 106 bp, Mus musculus
gccttagtccatggtgatctgataggatgcatgggacaatttcaatatttttgtatctgttgaggcttgttttgtgaactattatgtagtcagttttggagaaggt

SEQ ID NO: 65690 - DNA, 166 bp, Mus musculus
aaatgtatacatgctgatttgatatacaatgaataatttctattgtatatcattgtttatgtttgcatttaagttatatgtatatgtacatatatatgtatatttagacaaacagaatctatatctatacatatatatcatgcttatcataacttatatatatgta

SEQ ID NO: 65691 - DNA, 109 bp, Mus musculus
acatatatatatatatatatatatatatacacacacacacgcatacatgcatatatatgtatatatatgcgtgtgtatgatgtattatgtatatataacatatatgtgt

SEQ ID NO: 65692 - DNA, 68 bp, Mus musculus
agacatacatgcttgtgtatgtatgtatgtatgtatgtatgtatgtatgtatgtatgtatgtgtgtgt

SEQ ID NO: 65693 - DNA, 92 bp, Mus musculus
ttatttattatagttacacgtatatatgtatatgtatatgtgtgtataggtatatacatatacatccctagtataactatgggttcaaataa

SEQ ID NO: 65694 - DNA, 109 bp, Mus musculus
agtgtttcctttaaatatgaaatacagagtaagttgtatcactccattcttggtattttgagatgaatgtgaggacttaggtccctatttgatgttcccaagacatgct

SEQ ID NO: 65695 - DNA, 99 bp, Mus musculus
gatgacctagttaacacccatgcagactccataattgccacatcagtctctgtgagcctccatgagccctgcttaattggttctgttggctgtgttctc

SEQ ID NO: 65696 - DNA, 73 bp, Mus musculus
cagagttctgggtctcagatctacctcctggctgaggatgaaggatctatgggaccctgtccaagaaactctg

SEQ ID NO: 65697 - DNA, 96 bp, Mus musculus
tcaaactaccagtcactagtaaccatcactttattgattcattcttatatatctttgaatataattatgtgatgaatggttatggggagagtatga

SEQ ID NO: 65698 - DNA, 97 bp, Mus musculus
tatgtatgtatgtatgcatgcatgtatgtattacatatgcgtatgaacatgagtgtttgtgtatatttatatatatgtatatatatatacatatata

SEQ ID NO: 65699 - DNA, 82 bp, Mus musculus
gtatatatatatatgtgtgtatatgtatatgtgtgtatttgtatatgtatatgtgtatgtgtatatatgtatatgtgtgtat

SEQ ID NO: 65700 - DNA, 131 bp, Mus musculus
gttttacagactcctctctcccagattcttctagccttttcctatctttatgtgtgtgactcactgtgattgatgtgactcttgctagagattgagtgaaagtttatgtattacagcaagggaaacataca

SEQ ID NO: 65701 - DNA, 77 bp, Mus musculus
cctgtgtgtgttagagcacctggaactggtaccttctctggggaccattgggctctctgatgaattcaaaaccaagg

SEQ ID NO: 65702 - DNA, 70 bp, Mus musculus
ggctttttactgtagtgattttgtagtaatgttgttggagagcaattgactgcatgttattgcatatgtc

SEQ ID NO: 65703 - DNA, 111 bp, Mus musculus
taatgtcctattaaatataattttgctgtttttgatgaatgttgtatagttttaataatgcttgtagctttatcacacttcatgtaaaattgaatatcactgtggatattg

SEQ ID NO: 65704 - DNA, 92 bp, Mus musculus
acatgataatctgtctctgactgctatgtgtgcacacatgttgaagcatattaatatatattcatcccacatatgtatagagacatatatgt

SEQ ID NO: 65705 - DNA, 85 bp, Mus musculus; identical to SEQ ID NO: 57470

SEQ ID NO: 65706 - DNA, 85 bp, Mus musculus; identical to SEQ ID NO: 57470

SEQ ID NO: 65707 - DNA, 85 bp, Mus musculus; identical to SEQ ID NO: 57470

SEQ ID NO: 65708 - DNA, 105 bp, Mus musculus
tctatctacctacctatctattgtgtggatcagcatgtgaatgtgtgtgtgtttattgcacaagtgtgctataataccaatgtgaatgtcagaggtcctgctaga

SEQ ID NO: 65709 - DNA, 64 bp, Mus musculus
acatatataaacatatacatatgtacatatacatatatgtatatatgtatgtatatatgtatgt

SEQ ID NO: 65710 - DNA, 60 bp, Mus musculus
gtgcatgtgtgtgtgcagggatgcatatatatatatatgcatgtgtgtgcaggtgtgtat

SEQ ID NO: 65711 - DNA, 115 bp, Mus musculus
acactttgagctggcagcagaacttggcattgccattcatatagtactgattttgatgaacagtgtaaaattggagtggtgccttatgcaaagcagatgaagccagaacatatgt

SEQ ID NO: 65712 - DNA, 149 bp, Mus musculus
atatatacacatatatatgtgtgtgtgtgtgtgtatacgtgtgtatatatatgcatatatatgtatgtatatgtgtatatatatgtgtgtgtatatatgtgtatatatatgcgtatatatatgtgtgtatatgtgtgatggtagggaac

SEQ ID NO: 65713 - DNA, 90 bp, Mus musculus
gccttagtccgtggtgatctgataggattcatgggataatttcaatatttttgtatctgttgaggcctgttctgtgaccaattatagggt

SEQ ID NO: 65714 - DNA, 103 bp, Mus musculus
gagaaaatgtgaatatttagtaagtacaggaaggatgcacaggccacagacacagtcagtcaggcatggatctttgtacttagaaaatgtttctgatattctc

SEQ ID NO: 65715 - DNA, 123 bp, Mus musculus
tgccagttggaacatcttctggatatatgcccaggagaggtattgagggaccctctggtagtactatgttcaattttctgacgaaccactagactgatttccagagtggttgtacaagcttgc

SEQ ID NO: 65716 - DNA, 110 bp, Mus musculus
cttttgggctagaaggccagatataaaatggtctgagaaacaggttggcctgactactttgtctccctgtctctgagccagtgtgattttctcttctagtgacaatgtag

SEQ ID NO: 65717 - DNA, 92 bp, Mus musculus
gggagaaagtgggcagccttgtctagtcactgattttagtgggattgcttctagcttctcactagttactttgatgttgtctactggtttgc

SEQ ID NO: 65718 - DNA, 109 bp, Mus musculus
ggagtaggtgcctgagagtgcatataatgtttggaaagaatataaatgtaacacaacagactgtggactatactctgccattggatcatcttgctctccttttctgcct

SEQ ID NO: 65719 - DNA, 68 bp, Mus musculus
gatcatagctcactgtaaatctctctccttgaaattccacagggtttgattttgcagagtatttgatc

SEQ ID NO: 65720 - DNA, 91 bp, Mus musculus
gtgtatgtgtgtatatatgtgtgtatatatatatatatacatatatatatgtgtgtgtgtgtgtgtgtcatatatatatatatatatatat

SEQ ID NO: 65721 - DNA, 110 bp, Mus musculus
gagtgttgttaattcagtaatatatatttgtaatgaccttagactgtgtggttttcaattccacaattttgtcatcttttatgctgcaagtgtttggattatttatcctc

SEQ ID NO: 65722 - DNA, 78 bp, Mus musculus
gtggtcctcggcattgctcatagtagacttatattttctttctccaaatacgtctctgtctgagtctctgggagccat

SEQ ID NO: 65723 - DNA, 110 bp, Mus musculus
tgtgtctctgtgtctctgtgtgtatgtatatatgtgtgtatatatacatatacatatatatgtatatatatatatatatatatatattaatgtacatatataatcttaca

SEQ ID NO: 65724 - DNA, 69 bp, Mus musculus
gaaagattgtcaacataagctggtatgcatgacactatatgcacacaagtgtgtgtgtacacatctttt

SEQ ID NO: 65725 - DNA, 68 bp, Mus musculus
tgtcacaggactagggagactgaaaactgccacagactggcccagtcagcctctctcaatctgtggca

SEQ ID NO: 65726 - DNA, 78 bp, Mus musculus
agataagccttagtctgtagtgatctgatagggtgcatagaatgatttcaatgtttttttatctgctgaggcctgttt

SEQ ID NO: 65727 - DNA, 85 bp, Mus musculus; identical to SEQ ID NO: 57439

SEQ ID NO: 65728 - DNA, 85 bp, Mus musculus; identical to SEQ ID NO: 57439

SEQ ID NO: 65729 - DNA, 63 bp, Mus musculus
cagaggacccactcctgtaggtagctgtgtggctcttactctgtccctcagtgagttcctttg

SEQ ID NO: 65730 - DNA, 77 bp, Mus musculus
gctctcctctctgactcagtctgagatcggtttcagatgtactggagcagagcttagaactccgggggaggaagggc

SEQ ID NO: 65731 - DNA, 105 bp, Mus musculus
ttccccaggtggtgtattcagagcaagccattgctggagcaaagtgagaagtctttctgtctcacagaatgatcagcaatagcgtttagaaacatttctgtggaa

SEQ ID NO: 65732 - DNA, 111 bp, Mus musculus
tagaaaatagaatatatatacatatacagtcctatgtgtgcatgtttgtatatatgtatgtatgtatgcacacaaagagacatatatttattcctgtacttccaacctctg

SEQ ID NO: 65733 - DNA, 114 bp, Mus musculus
ctgggcagtagcttattggtaggtatggttaggtagcagatactcccctgagagcctctcacagtctctgattctatctgagataatatggatccaataataaataattccttg

SEQ ID NO: 65734 - DNA, 81 bp, Mus musculus
tgcactactctgttgagattgactgggaattgaggggatctctccaacactcagtatctgagtcttctcatgtacaatgca

SEQ ID NO: 65735 - DNA, 81 bp, Mus musculus
aaacatatacattactaagctataaatgtatgttactatatatgtgtatattatactagtaacaagcgtgtgtgtgtgttt

SEQ ID NO: 65736 - DNA, 61 bp, Mus musculus
ggctctgttactctctgtgtcctttggctgttgtcctgagatgccggggagctgatgagtt

SEQ ID NO: 65737 - DNA, 108 bp, Mus musculus
tggcacagtctgttatatatgtatatatatgtgtgtgttatttatacatatattatatatatgtaatattatatatatatatatactattaacctattgatttttcca

SEQ ID NO: 65738 - DNA, 115 bp, Mus musculus
atggtctgagcatgcccaaatccataatgtgcttgctgcatgaacactgtcagctctgaggcatcgcctagccgtggctgtgaagctggcacagatgcagggagtgcctccccat

SEQ ID NO: 65739 - DNA, 70 bp, Mus musculus
tgtgtgtacatagtatatatgcataatacatgtgtaaacatgtttgtatatgaacacctgtgtgtacata

SEQ ID NO: 65740 - DNA, 117 bp, Mus musculus
cttaactgggcagccttgtagctaatcttgctgtacctctttaaccccctttgttaagctttgtaagtataacagtaagttgtttataagtatctccctatccgactgccctttggg

SEQ ID NO: 65741 - DNA, 124 bp, Mus musculus
gtgtgtgtgtgtgtgtgtgcacctgcctgtgtgtgagcatgcatgtgtatatgtctctctgtgtgtggttatgcatgtgtgtgggcatgcatgtgtatgtgtgcctctgtgtttggttatgcat

SEQ ID NO: 65742 - DNA, 67 bp, Mus musculus
gagctgataggtctgactggaaacagcagtatttgccagacactctgcctcagtcttgcctttcctc

SEQ ID NO: 65743 - DNA, 71 bp, Mus musculus
gaatgtgtgtctactgagagtccacactggccagtcttctgtttggggactctcagtaaggttttgcattt

SEQ ID NO: 65744 - DNA, 71 bp, Mus musculus
cggtctctgcatctgtgtctgtctgctactggataaatcctcaggagacggttaagctaggctgctgtctg

SEQ ID NO: 65745 - DNA, 103 bp, Mus musculus
tgtgtgtgtatgtatgtatgtatatatatatatatatacatatatatatatgtgtgtgtgtgtgtatacatatatatgtatatatatgacacacacattttta

SEQ ID NO: 65746 - DNA, 85 bp, Mus musculus; identical to SEQ ID NO: 57439

SEQ ID NO: 65747 - DNA, 65 bp, Mus musculus
gatcttgccacagttatttctgattggtgaataaagatgctgtcagaagagacataggtaggatt

SEQ ID NO: 65748 - DNA, 89 bp, Mus musculus
gcttgagagagtgtgtagggagagaccccaggatgtcatgcattctggataaattctctccactgatctacacccccagtctcctaagc

SEQ ID NO: 65749 - DNA, 85 bp, Mus musculus; identical to SEQ ID NO: 57439

SEQ ID NO: 65750 - DNA, 130 bp, Mus musculus
acaacaggtatagcatgtatatatgtatatatatgtgtatgtatgtgtgtgtatgtgatgtatctatgtgtgtgtgtgtatatatatatatatatatataatatgtttatataatacatatatatacata

SEQ ID NO: 65751 - DNA, 85 bp, Mus musculus; identical to SEQ ID NO: 57439

SEQ ID NO: 65752 - DNA, 85 bp, Mus musculus; identical to SEQ ID NO: 57470

SEQ ID NO: 65753 - DNA, 171 bp, Mus musculus
atatatatatatatatatatatatatatatatatatatgtgtgtgtgtgtgtgtgtgtgtgtgtgtgtgtgtgtgtatatgtgtgtgtacatatatatgtctatatgtatatatatacatatgtatgtatatatacacgtacatatacatatatatatttgtttgaatata

SEQ ID NO: 65754 - DNA, 101 bp, Mus musculus
gttatattcaaacaaatatatatatgtatatgtacgtgtatatatacatacatatgtatatatatacatatagacatatatatgtacacacacatatacac

SEQ ID NO: 65755 - DNA, 98 bp, Mus musculus
agctgtgagctggggctggagagatggctcagctgttaagagcactgactgctcttccagaggtcctgagttcaattcccagcaaccacgtggtggct

SEQ ID NO: 65756 - DNA, 78 bp, Mus musculus
tgaacactgtgagcactgtgagcactgtgagcactgtaagcactgtgagcaccatgagcaccatgagcaccgtgagca

SEQ ID NO: 65757 - DNA, 85 bp, Mus musculus
catgagcaccatgagcaccgtgagcactatgagcactgtgagcactgtgagcactgtgagcactgtgagcaccatgagtaccatg

SEQ ID NO: 65758 - DNA, 111 bp, Mus musculus
tgccagtctttacttggaataaatgaagctatgatcatggaagagtgtcactaaatttttatgtttctttcgattacaccttgaatgttttattgcggggagagacaggca

SEQ ID NO: 65759 - DNA, 108 bp, Mus musculus
ctctgagtcttctgggaccttccttagcaagcagttgtccgtgccatgggctctcactgtctgtgcgtgacagtctgctctttaagaaagccaagcttgttttcaggg

SEQ ID NO: 65760 - DNA, 114 bp, Mus musculus
tacaaacagggggctggagagtttgctcagtggttaggagagttggctcagtagttaagagcactgactgctcttccagaggtcctgagttcaattcccagcaaccacatggtg

SEQ ID NO: 65761 - DNA, 88 bp, Mus musculus
ggaaaatgtgcttgagaaagaaagaaaaagggctggctcagtgtttcagagcactgactgctcttccagaggtcctcagttcaattcc

SEQ ID NO: 65762 - DNA, 90 bp, Mus musculus
ctggcacgatgtgcttgctctttcccacgtgggcagcctctgtgtctgtgtctgcctccgaggaaggatgcaaatgcatattcagcatag

SEQ ID NO: 65763 - DNA, 92 bp, Mus musculus
tgttaggaatgttctcttccgggctggcaagatggctcagcgggtaaaaacactgactgctcttccagaggtcctgagttcaaatcccagca

SEQ ID NO: 65764 - DNA, 80 bp, Mus musculus
gtgtggggaggccagagaacagcttcagtgtccttccccaaggattctcgatatctgtctgtctgtctgcctgactatcc

SEQ ID NO: 65765 - DNA, 76 bp, Mus musculus
gttaagattgctgactgctcttgctgaggtcctgggttctattcccagcacccacttggcagctcccaactataac

SEQ ID NO: 65766 - DNA, 82 bp, Mus musculus
gggagggagggaggggctggaaaaataggctcagtggttgagacccctgactgctcttccagaggtcctcagtttgattccc

SEQ ID NO: 65767 - DNA, 65 bp, Mus musculus
atacatacatgctaatattctacgtatgtatgtatgtatgtatgtatgatataatatgtgtgtgt

SEQ ID NO: 65768 - DNA, 97 bp, Mus musculus
atttcctctgtgtgtgtgagggtgggatatgaatatgtgtgtctgtgcatgtatgtgtgtctgtgtgtctatgtccttcagctgctattgggtgaat

SEQ ID NO: 65769 - DNA, 79 bp, Mus musculus
gagactatctgtggatctgaggttatctcaaagttagtattgctttatttttttttatatagtctcactaagtagtctc

SEQ ID NO: 65770 - DNA, 91 bp, Mus musculus
ggatgaaggttagggaagtgctgtggagtcaggtggcagcatcagtaattttcagctgcctccgtgtttgccagtgtctctctcaccctcc

SEQ ID NO: 65771 - DNA, 72 bp, Mus musculus
caggtcagaagtgtgagcatcgtacagagagatacgctcatctcgtgctcactcacaccgtcactgaccctg

SEQ ID NO: 65772 - DNA, 86 bp, Mus musculus
agagtcagtctgatctggaaaatctctcagttgagagtcacctcaggtgactctaggctgtgttatagacaatttggactgtctct

SEQ ID NO: 65773 - DNA, 83 bp, Mus musculus
ttgtgtgtgtgagatgtgtctgtctgtctgtctgtctgtaggaaggaggcatgtgaacaagggcaggtgccctcagaggccag

SEQ ID NO: 65774 - DNA, 82 bp, Mus musculus
gactttccctgttctctgctttttatcacatgcagagtgaaattgaaaacactatgagacagaaattagagagcagtcagtt

SEQ ID NO: 65775 - DNA, 72 bp, Mus musculus
gcagcccgtcattgtgggtccagatgaaagtggccatctctcactgtttctgtctacagtgtatggagcagc

SEQ ID NO: 65776 - DNA, 119 bp, Mus musculus
gcacagattcatgtgtgtgtgtgtgtgtgtgtgtgtgtatctggaactatatgtgaatatatatatgtgtgtgtgtgtgaatataatacatatataatataaatatataacatatatac

SEQ ID NO: 65777 - DNA, 110 bp, Mus musculus
aggctcagaacctgctctacctgcggatccatcctgtctttcttgaattcagagtatctgagaagagtgtgaggacacagtctcccgtaaagagcatgaggttatgacct

SEQ ID NO: 65778 - DNA, 99 bp, Mus musculus
ggtgcttgcattcagataatggctgtgccatgactcagtgctatgttgtctgggttcctgtatatagctgcagccttctcattaccatgctgtgggtcc

SEQ ID NO: 65779 - DNA, 70 bp, Mus musculus
ctgtctgtctgtatgtctgtacacacgtatgagcaagcataacaggaagtgtgtggaggccagaggatag

SEQ ID NO: 65780 - DNA, 113 bp, Mus musculus
ccagctaaaacacttgtttggttttgagacaaggtctcactagacaaccttagctggcatgagactcactgtgtgaaacaggctggccgtggaactcaaagagctctgcctgc

SEQ ID NO: 65781 - DNA, 80 bp, Mus musculus
aggaagattcagaaagtggggacggcagagacttcagctctctgaccctctgtggcagtctacccttcatggctctgtct

SEQ ID NO: 65782 - DNA, 77 bp, Mus musculus
cattggagaagcagctggcactgctgtgatgtcataaggctgtcacagtgagtcagtgccatgcgtgtgctccggtg

SEQ ID NO: 65783 - DNA, 81 bp, Mus musculus
gagagagagatgtgatgtgtgagtgtagagatcagaggacacaggagtggctgacttccttccacactcactctgtgtttc

SEQ ID NO: 65784 - DNA, 65 bp, Mus musculus
gcaaatgacaccctctgtctgtcatttgtgagtaacaatgaaaagactctgggatgtctgcaggc

SEQ ID NO: 65785 - DNA, 68 bp, Mus musculus
cttggtctgtctctcatgatgctaaggacaccctgtgcgcagggactctggctctgacagtcaccaag

SEQ ID NO: 65786 - DNA, 90 bp, Mus musculus
agttacaggtaggacaattactgttctgtggttgctggagttgaatccaggtcctctgaaagaacagtcagtgctcttaaccactgagct

SEQ ID NO: 65787 - DNA, 71 bp, Mus musculus
gccactcacctctgagtgccaggaaaggaagaaggcagagcccacactctcactctcactcacaggcaggc

SEQ ID NO: 65788 - DNA, 118 bp, Mus musculus
ctcattaaaagtgattggactggggcatgaggatgggatggtacaggagggggaacacaagtctttctctctctctctgattatcgccattatctcttcctggagcacggggcgtggg

SEQ ID NO: 65789 - DNA, 91 bp, Mus musculus
cgagatgagcccagagcttccacactccctgagtcacaccctggagtggtgatttagtacgggtgtgggagggaggcacgttgtcaactcg

SEQ ID NO: 65790 - DNA, 64 bp, Mus musculus
gcggggaaaggtcactgcctgtctgggactctcccagacctggcctcagtctctctgtctctgt

SEQ ID NO: 65791 - DNA, 102 bp, Mus musculus
aatattgtataaccaaatgtacacaagtattgttatgcatatgatattgatatgtatacaagtattgataggcatagctgttatctgtgacatgatgatgtt

SEQ ID NO: 65792 - DNA, 75 bp, Mus musculus
gtgcaggcatagaataataaggacaatatgggcagatgtaagccacatctgtccttcattctgtctctctgacac

SEQ ID NO: 65793 - DNA, 86 bp, Mus musculus
ggtgtgatgatggtcaatctctgagtctctgtgaaatgagaaaactatttcctcataggggtgcgtttcagtgttgtcagtacact

SEQ ID NO: 65794 - DNA, 108 bp, Mus musculus
tgtccactacaggtggcagtgagaagttctgtcaagtctgcagactgccttacttcagtggctgctctttcttcctaaaacttaaaacaccatcgtgtggtgttgaca

SEQ ID NO: 65795 - DNA, 120 bp, Mus musculus
gtgtgtctctgtgtgtgtatatgtgtatgtatatgtgtgtctctgtgtgtgtctgtgtgtgatatacatgtgtgtcacttgtatgtgcagtatgctactgtgagcacatgtgtggaggcc

SEQ ID NO: 65796 - DNA, 85 bp, Mus musculus
ggccatggtggtctgataggatacatgggacaatttcaatatttttgtatctatttaggcctgttttgtgaccaattatatggtc

SEQ ID NO: 65797 - DNA, 65 bp, Mus musculus
cagtactctccctctctctgccaagaggatgcggttaattggattggcagatgtgggaggaactg

SEQ ID NO: 65798 - DNA, 84 bp, Mus musculus
gctgcttctgtgacatgtgggactgctgagtgtgtgtgccgtgcacaccacccactctctcacttgctctgtccagcacttcac

SEQ ID NO: 65799 - DNA, 66 bp, Mus musculus
gtgtatgtatgtatgtgtatgtatatatatgtgtgtatagatgtacatatctatacatagatatat

SEQ ID NO: 65800 - DNA, 67 bp, Mus musculus
ttcatcagaagcaggaggtgtgggcaaattaaaatttatttgctatccctctgtcagtctctgtgga

SEQ ID NO: 65801 - DNA, 71 bp, Mus musculus
atgttggttctatggttaagagcactgactggtcttaaagaggacccaggttcagatcccagcactgacat

SEQ ID NO: 65802 - DNA, 107 bp, Mus musculus
agtgggagtattgcttcatatgatagggctcatcagaaatgtaatgaaatttctacaatttctttgctttctggatgtattctgttcatttatggaatactctagct

SEQ ID NO: 65803 - DNA, 66 bp, Mus musculus
aacccactcacagtgtgtcagaccaggtatccgtgtacgagctggatcatgcatttgtgggttggg

SEQ ID NO: 65804 - DNA, 114 bp, Mus musculus
gctgccatcaatctgtcacctcaaaatattttccccagccttccccacatttggcagcctcactgccactgactgaatgtgggtgaggttgtgatgacagggcttttgagaagc

SEQ ID NO: 65805 - DNA, 72 bp, Mus musculus
ggcctgttgatgtctgagtctgtgtctgacctgtcagtggggggctcagcatatgctacagtgagttatgcc

SEQ ID NO: 65806 - DNA, 93 bp, Mus musculus
tttgacaatcccttgattttctgtccatttgtaaagtggaaatagggtatatatacacacacacacagagagacagagaccgagagagacaga

SEQ ID NO: 65807 - DNA, 73 bp, Mus musculus
ctagtgagtgcacgagctagcgcacacctcacccactgatgtgagagcagcctcacagcctctgactcactgg

SEQ ID NO: 65808 - DNA, 112 bp, Mus musculus
gttagttcttattgttgttccaaggcagatctattttaggtatcacaggacagagtgatatttatttcattaagttgtatgtgcagtggcatcattaaagagagaagctgat

SEQ ID NO: 65809 - DNA, 62 bp, Mus musculus
tgtgagcatagaggccctggtgctgatggggcagcgagcactgcctcagtctctgtgagcca

SEQ ID NO: 65810 - DNA, 111 bp, Mus musculus
gggaagcaagatgagagtgtctctggaggtgggggatcctttgtgacactgccactgtgtgtccgtgagagttgctttccttcaggagtatgtgtatgaggtgtgtgtgtc

SEQ ID NO: 65811 - DNA, 91 bp, Mus musculus
ggagggaaatctgtatcaatagtgaatccatttatttgtttatataacctatgtagattggtttgttgataattgataattattcatctcc

SEQ ID NO: 65812 - DNA, 119 bp, Mus musculus
tgggctgcctggctgggcctcagtgggagaggatgagcttagtcttactgcatcttgatgtcccaggtggggtggtactcaaggggccttcctcttacctggggagacaggggcttagt

SEQ ID NO: 65813 - DNA, 83 bp, Mus musculus
ttctcgaagcctccccaagagtcagaatgaagacactgaggaatctcccagagtattcatgttctgggttaggtctcagagag

SEQ ID NO: 65814 - DNA, 124 bp, Mus musculus
ggccagattgtccatgtttgtggcagaagtcccaggtgcaggccttgggtctctgtgtttgtgtctcatgttaccactaagggccatatctgggtccagggttgtgcttcagccaggatctatg

SEQ ID NO: 65815 - DNA, 68 bp, Mus musculus
tgtgatttttgttgttttgagacagggtctctctctatgtggccttggatctcctataacttgttaca

SEQ ID NO: 65816 - DNA, 76 bp, Mus musculus
gtatgtatgtatatagttatacattatataatgtgtagttactaactataatatatatgtatttatgcatatgtac

SEQ ID NO: 65817 - DNA, 74 bp, Mus musculus
tgtatttatatacatatgtatatacataagtatatgtacatatatgtaagtatatatatgtgtgtgtgtgtaca

SEQ ID NO: 65818 - DNA, 121 bp, Mus musculus
ttcaggatgatgctctgcagaactctgtttgtgggatcggagagtgaacagttactgcagacattcactcagtctgaaaaagttcttgcctagagatggatgcttctataaggagctgctc

SEQ ID NO: 65819 - DNA, 66 bp, Mus musculus
gcctgaagcagaggatgctgaggaccatgctttctggttcactctctgactccttctctcacaggc

SEQ ID NO: 65820 - DNA, 92 bp, Mus musculus
catatatatctgtttatgtctatatatatacataaatatgtatgtaggcatacatgtatatgtatgtatgtatgtatgtatgtatgtatgta

SEQ ID NO: 65821 - DNA, 85 bp, Mus musculus
tgtgactctctccatatctattcagtatggtatttgaagttttagctagaatactaaggcagctaaaggagatcatggggataca

SEQ ID NO: 65822 - DNA, 132 bp, Mus musculus
gaatacagtaacatcaaagcaagcacctaaggaggccacagtagttggtaagatgtgaggtcacagaacacactgaggtccataacatagggccttgcagaatgttatttgaattcacagtggttagtgctg

SEQ ID NO: 65823 - DNA, 112 bp, Mus musculus
agaatagatgtggataagttgaagaatattacaggatgactagtgagattattttttaatcaaatcagtttgtgtgcttgtaagttttaagcgcctttcattaatcttagct

SEQ ID NO: 65824 - DNA, 69 bp, Mus musculus
ggaacttactggtagaccagggtaacctcaaactcacaagagtctgcctgtctctgcctctcaagttct

SEQ ID NO: 65825 - DNA, 72 bp, Mus musculus
gtgtgtatgtatgtatgtatgtgtgtgtatatttgagtgtgtatgcgtgcatgtacgtgtgtatatgtatat

SEQ ID NO: 65826 - DNA, 80 bp, Mus musculus
tatgtatatatgtattatatattccatatatgtatgtgtatgtatgtacatatatgtgtatatatatgtgtgtgtgtgtg

SEQ ID NO: 65827 - DNA, 106 bp, Mus musculus
tggggttcagagctaaactgagaattttcaacagaggaatcttgaatggccaagaaacacttaaaggaatgttcactgtcctttgttgtcagggagatgcaaatca

SEQ ID NO: 65828 - DNA, 60 bp, Mus musculus
atatgtcactgtcactctgtccatccttcttcagggaaacagagattgacagttgtatat

SEQ ID NO: 65829 - DNA, 118 bp, Mus musculus
tagactattgtgtaagcttcataatattatacacacatatgtatgtttatatatacacatacatacatagagagagggtggaggagagttaaagtgaggttaccatacatgggagcta

SEQ ID NO: 65830 - DNA, 141 bp, Mus musculus
gcaatttcattttacttagggcgtgtgtgtgtgtgtgtgtgtgtatgtgtgtgtctgtttgtgtgcatgtgcatgaatatatgcatgtttgtgtgtgtatgtacgtgtgttcatatgtgtgcatgtatatatgtatgtata

SEQ ID NO: 65831 - DNA, 100 bp, Mus musculus
gtgcatgctattttcaaacatctcaaagtgacagattattttttttcttactgagtacaaggaagtctgaccgctttcagaatgagcttcagatatgcat

SEQ ID NO: 65832 - DNA, 103 bp, Mus musculus
gaatgacggggggggggggggggtgggggttgtggctggtgagatggctcagcggttaagagcactgactgctcttgcaaaggtcctgagttcaattcccagc

SEQ ID NO: 65833 - DNA, 84 bp, Mus musculus
ttcaaaactaatctcggtacatttagacattggaaaatagaatatatatcttttggtgtctgaacacagagtcctgagtttgaa

SEQ ID NO: 65834 - DNA, 111 bp, Mus musculus
caggctcatctgtatgacgtcacatggtcctttggagaaaggggaagtctgccagtgcctttgttcagatggacagccacgtacagaggtcatgctcctgtgtaagctctg

SEQ ID NO: 65835 - DNA, 112 bp, Mus musculus
ggtagaatctgatgatgctttggattgtctcaggttctgttgttatgtctccattttcagttctgattttgttaattaggatactgtccatgtgccccctagttagtctgcc

SEQ ID NO: 65836 - DNA, 133 bp, Mus musculus
cagtcatccttcaatgaagtgaatcaacaggctagttggaagaacagtagtccggagggaacacagataattgtgaggacagactggtatctcatttttgctgatgccttcagcctttctgtatgttaactag

SEQ ID NO: 65837 - DNA, 95 bp, Mus musculus
ggaacctagttcctttcctcaacagtggctccatctgcaagtgacatctttaaattgataacttcagattttgttgtaggaatcctggtggttcc

SEQ ID NO: 65838 - DNA, 73 bp, Mus musculus
ctgatgtaagaaggtgagcttggggctgcagagatggctcagcagttaagagcacatactgctcttacagaag

SEQ ID NO: 65839 - DNA, 76 bp, Mus musculus
gtatgtatgtatgtgtgtgtgtgtctgtgtgccatgaacaaggcactgaggagaggcaatgtgcagtacaacatat

SEQ ID NO: 65840 - DNA, 60 bp, Mus musculus
tctgtcacactgtctttctggtcggaaagggggaaagaactgaaagacacgtgtgacaga

SEQ ID NO: 65841 - DNA, 73 bp, Mus musculus
gcttgctgctggagactagagaatgagacccccagcttcaccttatgtttctctctgtgtctgtagtttctgc

SEQ ID NO: 65842 - DNA, 120 bp, Mus musculus
gtcatatatatgtatatgtgtatatgtatatatgtgagtatatgtgtgtatgtgtatatgtatacatgtatatatgaatatatgtatagatgaatatatgtatatatgaatatatgtata

SEQ ID NO: 65843 - DNA, 80 bp, Mus musculus
gcaattcactctcaggctctgacactgaacggacatctacaacttcccaggagtcttcagggtgaccgtaagagctgtgc

SEQ ID NO: 65844 - DNA, 57 bp, Mus musculus
gctctaaagtatggggggacgggacactcacccagtctctgcaatgatttctggagc

SEQ ID NO: 65845 - DNA, 88 bp, Mus musculus
gttcctcacgatggccagctagactgatttttcagactggatcactcactgagactgggagcttatcagttaggctgggtagagggcc

SEQ ID NO: 65846 - DNA, 72 bp, Mus musculus
gttttatgtcagttcagagcttagcactcatttgtctggcgtgagtgagcttaaagcttctactgattggac

SEQ ID NO: 65847 - DNA, 95 bp, Mus musculus
gggagggagaatagctgtatgagtatggccagttctaagttaaagagaagtcagagaggagataactcagggaagaggttggtgtctccattctc

SEQ ID NO: 65848 - DNA, 93 bp, Mus musculus
taagaagtaaagatgtaaagggacatgtcaccaagtgtggctacacccatggctgccactctgagtgtcaccctcctgcatttctccatcttg

SEQ ID NO: 65849 - DNA, 112 bp, Mus musculus
ttgtttggttttttttttgtgattaacttcttgagttattcatatattttgtatattagcaaaagtacagaatacagaagatacagtccacagaactcaaaaaggtcaacaa

SEQ ID NO: 65850 - DNA, 82 bp, Mus musculus
tgtgcatacagatagagcacacatatacataaaacaaatctttaaaaaaatgcatttgtgtgtgtctctgtgagtatatgca

SEQ ID NO: 65851 - DNA, 95 bp, Mus musculus
tctgtctgtctgtctgtctgtctatctatctatttatttattgttgcttgagtttctttaaaggggtaggtttcataaactagactgaagactga

SEQ ID NO: 65852 - DNA, 76 bp, Mus musculus
ttgttaggtatgtcactaggggagacactgagaagcttcaaaagccaccaggcagtgtcaccctctctgcctgcaa

SEQ ID NO: 65853 - DNA, 85 bp, Mus musculus; identical to SEQ ID NO: 57439

SEQ ID NO: 65854 - DNA, 118 bp, Mus musculus
aggtatgtcagttgggacaattttgagatgtcaaagggaagaggccaagagtgtgcctctctctggctcttaacttgacaatacagatgacaactctcagttgttcctgctgagtcct

SEQ ID NO: 65855 - DNA, 116 bp, Mus musculus
ttgaagatcagccttagtgcatggtgatctgataggatacatgggacaatttcaatatttttgaatcttttgaggcctgttttgtgacctattatgtggtcaattttggagaaggt

SEQ ID NO: 65856 - DNA, 68 bp, Mus musculus
gagtttacatgaaggaataggtaggaaaggacctcacaaagtcactctctgacctccattatgggctc

SEQ ID NO: 65857 - DNA, 92 bp, Mus musculus
cagactaagaatggctttcaacctgggactggcagagcagggctgacagtcactgtcacagtaaccagaggagaaaagcacagatggtcctg

SEQ ID NO: 65858 - DNA, 93 bp, Mus musculus
aactcgcattaagaagcagaaggcagggctagagagatggctcagcggttaagagctctgactgctcttccagaggtgctgagttcaataccc

SEQ ID NO: 65859 - DNA, 100 bp, Mus musculus
gctgttgaaaactcatataatattttaacactttatgtatgtatgtatgtatgtatgtatgtatgtatgtgtataaacatgtatctgtggaggtcagagt

SEQ ID NO: 65860 - DNA, 85 bp, Mus musculus; identical to SEQ ID NO: 57439

SEQ ID NO: 65861 - DNA, 72 bp, Mus musculus
caaaaactgacttacaggccaatatgatggaggtgacatgtctgtctgtctgtctgtctgtgtcggtgtgta

SEQ ID NO: 65862 - DNA, 105 bp, Mus musculus
gcataaatgttatggttgagcagtttggtttcctttagggactcctaataatgggacagtggctgtctctgactcttgtgcctacttttagaacctgttttcacc

SEQ ID NO: 65863 - DNA, 169 bp, Mus musculus
atatgtgtgtatgcatatatatatatattatatatgtatataagtgtatatatgtatatatatgcatatatgtgtgggtgtgtatatatatattgtgtgtatatatatacatatatgtgtatatatatatatatatatatatatatatatatatatatatatgttttgt

SEQ ID NO: 65864 - DNA, 79 bp, Mus musculus
agtaatattcaagggggctggaaagattgctcagtggtcaaaatcactgactgctcttccagaggtcctgagttttatt

SEQ ID NO: 65865 - DNA, 96 bp, Mus musculus
gatgaagttacactgtttatagttgtgtagtgatgttgtacagcagtgaaatatcacagtgaacatggctcatccattataaaatcccattttatc

SEQ ID NO: 65866 - DNA, 63 bp, Mus musculus
agcaactaaagccagtcgctgaaatgatgtgtttgtttatgatgacccgtggttttggttgtt

SEQ ID NO: 65867 - DNA, 111 bp, Mus musculus
cttctatgcaaacatgtttgtcaaattccaaggtcattgttgacttaagcattgtaaagaataatgtgccaagttacaaatgatgacttaggtgcaaatatagctcagagg

SEQ ID NO: 65868 - DNA, 90 bp, Mus musculus
ggtgattttgtgttgatagaaagtgtttaagtgtgctgtttggcacatactaaggattcaataaatgtctgtcgttaagatacagttacc

SEQ ID NO: 65869 - DNA, 84 bp, Mus musculus
gtgtgaatatatgtatgtacttatatgtgtatatgtatttgtatgtatgtgtatatatgtctgtatgtgtgaatatgtctgtgt

SEQ ID NO: 65870 - DNA, 70 bp, Mus musculus
cacatattcacataaatatgatacatgtatgtatgtacgtatatatatgtatatgtatatgtatatgctg

SEQ ID NO: 65871 - DNA, 68 bp, Mus musculus
agggtgctgcctcagtccctctgtgcttctgcctgttccagaggctgtcaggttctctggtgcaccct

SEQ ID NO: 65872 - DNA, 93 bp, Mus musculus
aatcaactaatcaagactcacagagacagagcatagacagagcagagcctccatgggtctatgctaggtctctttatatatgttaagtttgtt

SEQ ID NO: 65873 - DNA, 122 bp, Mus musculus
caagctcttgttatcctggaatcctggaatcctggaatcctaaaatcctgggtgtgttacagcacctggaagtggtgtctcctctggggaccatgggtctctctgatgtgtttgaaaccaag

SEQ ID NO: 65874 - DNA, 114 bp, Mus musculus
ctccatatactctgattgtttactgggtctaggagtcaggactggcatatgtggttccttggaatctatagaatagttgtctagaccattcttcatttaaaagtttccattgag

SEQ ID NO: 65875 - DNA, 105 bp, Mus musculus
ttgcaagtgtaatgactgtgatcacaacaggctgtggtgtgtcacttgagagtgagcacatttgcaaaatgcaggtcactgatgagagaggcaggaacagcagcc

SEQ ID NO: 65876 - DNA, 76 bp, Mus musculus
gttggaggaagtgtgtcactgtgtgggtgggatttgagaacctctgtcctagctgcctgggaagcagtcttctggc

SEQ ID NO: 65877 - DNA, 85 bp, Mus musculus
ggccatagtggtctgataggatacatgggacgatttcaatatttttgtatctattgaggcctgttttgtgaccaattatatggtc

SEQ ID NO: 65878 - DNA, 63 bp, Mus musculus
accaggatatcagggtctcagaggaagcttgactgccaagaactctgacactgagtctcaggt

SEQ ID NO: 65879 - DNA, 81 bp, Mus musculus
tcctgcatgtgtgtctgtctgtcattcatccacgctttgcccacccgcatcgagagaccccgttccacgcagacacaggga

SEQ ID NO: 65880 - DNA, 76 bp, Mus musculus
gtgtatatacacatacacatatatattcacacatatatatgtatatatgtatatatgtgtgtatgtgtatatatat

SEQ ID NO: 65881 - DNA, 155 bp, Mus musculus
gtatgtaatatatatatatgtatatatataattacatatatatacatatatatggtaagtatatatatttacatatttgtatacatatgtatatggaatatgtaatatatatgaatatatatgtttccatattcatatatatgtatatatatatg

SEQ ID NO: 65882 - DNA, 111 bp, Mus musculus
caggattcattctgataggtctgacaaagaattctttctttgttctctatgtttattgttttattacatgcagagggagtgtttttgttgttcagtctatttggtgtcttg

SEQ ID NO: 65883 - DNA, 84 bp, Mus musculus
aagggaccaaacccaagttcttatgtatacatgttagtatatcattgagcaacatgtaactctagaacataaaaattgtccttt

SEQ ID NO: 65884 - DNA, 92 bp, Mus musculus
cagtaatatatacatacatacatatataaacacacatgtatacagatatcccatataaacatgtatgtatatatgtatgacatcatattctg

SEQ ID NO: 65885 - DNA, 109 bp, Mus musculus
agatgacctatctattggcaagagtggagtattggagtctctatcactgtgtgggattaatgtgtgctttacatctggtggcatttgttttgtgtagttaggtaaatct

SEQ ID NO: 65886 - DNA, 79 bp, Mus musculus
tcatagagaacacagttaccagacagtggggagacaaagactcaactcaggatggatgctgcttgtgttcttttcatga

SEQ ID NO: 65887 - DNA, 78 bp, Mus musculus
gatgtttctatatgcatatttatatatttgttggtggataaacacacacatatgtatatatatgagcatgcagatgtc

SEQ ID NO: 65888 - DNA, 105 bp, Mus musculus
ccctcacaacacatgtcatctagtggcagagaagtgaattacatgacaacttagaagcttcatattttatttttacttacgtatctgtgtgaatgtttgtgtggg

SEQ ID NO: 65889 - DNA, 104 bp, Mus musculus
ggctgtgtgagagcacacggaaatcagacctcagcctgaatgctcactctgaacagtctctgtgtttgagaagcggccagagctctctattctgttttgtttgc

SEQ ID NO: 65890 - DNA, 77 bp, Mus musculus
gctcatgcatggaaattccagaaaggtgtcaagtgtctcccgagacagggtctctctctctggccctccagccaggc

SEQ ID NO: 65891 - DNA, 98 bp, Mus musculus
actagcttgttaaaaggggtttggcgatatactttccttttctagctgatagaatagttggggaagcatttttattagttctaccttgaatgactggt

SEQ ID NO: 65892 - DNA, 83 bp, Mus musculus
gagacttaaggcaaattggtatgtgttctagggactcagggtttccatctgggaatagacattatgtacttgacttgtgtgtc

SEQ ID NO: 65893 - DNA, 97 bp, Mus musculus
gaacttaggctattaattggcagggtacttatctggatggagtctatttggtctataagagagagagctgagtgggtttcctgtagcttataagttt

SEQ ID NO: 65894 - DNA, 179 bp, Mus musculus
atatttgttttgtgatttaaaattgtttataatatatatacatatacatatatatgtatatatactctgagctcatgtctcatacatatatatgtatatatatactctgtatagctcatatatatatatatatatatatatatactctgagctctgtattttatatatatgtatatata

SEQ ID NO: 65895 - DNA, 85 bp, Mus musculus; identical to SEQ ID NO: 57470

SEQ ID NO: 65896 - DNA, 76 bp, Mus musculus
gaggatctgcagtctgggaggtgttgtaaatcaggtgctctgccagcctgcctctcagtgactcagcagcagcctc

SEQ ID NO: 65897 - DNA, 85 bp, Mus musculus; identical to SEQ ID NO: 57470

SEQ ID NO: 65898 - DNA, 99 bp, Mus musculus
acacatacatatatatacacacacatatatacacactcactcacacatacacatatatacacacacatgtgtatatatatgtgtgtgtgtatatatgta

SEQ ID NO: 65899 - DNA, 77 bp, Mus musculus
gtgtgtatatatgtgtgtgtatatatatgtatgtgtatgtattatatgtgtgtatatgcatatgtatatgtatatac

SEQ ID NO: 65900 - DNA, 109 bp, Mus musculus
atatatatatatatatatatatatatatatatatatatatatgtgtgtgtgtgtgtgagatgtgtgtgtatgcacatatatgtatacacattatatatatatgtgtatg

SEQ ID NO: 65901 - DNA, 73 bp, Mus musculus
tctctggcctagtctatttgatgttctgtatgctttttgtacctttatagacatttctggtagaagttaggga

SEQ ID NO: 65902 - DNA, 90 bp, Mus musculus
gttaagaattatactggaggggctggagagatgactcagtggttaagagcactgactgctcttccagaggtcccgagttcaaattccagc

SEQ ID NO: 65903 - DNA, 89 bp, Mus musculus
tgatgtttagttctgatgcttctctatttaatttttgcccagatggcctgtctgaggagagagtggagtccagaaatcacctaatatca

SEQ ID NO: 65904 - DNA, 71 bp, Mus musculus
gtctgaagagttgtgagaagagagacagcagctaggtagttcgctgattgtcagctgaccgttcctcacac

SEQ ID NO: 65905 - DNA, 106 bp, Mus musculus
agctggtgatggcagtgcgaagccgatccaggttacttgtgtggttacttgtgtggtaaaggcaggtccagtcaagacagatggtgtgcggtgccccttgttcagc

SEQ ID NO: 65906 - DNA, 99 bp, Mus musculus
gtggccagaagtctgtgctagacatctctaaattattctccactgtatgtcagtctctcactgaatctagagctcactgtttctgctagactggctcac

SEQ ID NO: 65907 - DNA, 103 bp, Mus musculus
tgtttctatttagaccctgagtgtgtctgtgtgtttatgtgtgtgagagcgagagacagagtcagagacagacagacaaacacgggggtgggggggaggggca

SEQ ID NO: 65908 - DNA, 85 bp, Mus musculus
gatagggatcaggggctgaaagagtggaaggctattggactggctaagaggccagtggtcagtcatactctgtctttgtttcatc

SEQ ID NO: 65909 - DNA, 115 bp, Mus musculus
ctcgcagtggaaacagagttgatggagtgttaaggaagtcccagaagtagagagaattgatttttctttaaaaaatgaatttggacttactcccattatgtggcccagatgttag

SEQ ID NO: 65910 - DNA, 79 bp, Mus musculus
ttggaacacagacacactctgggtttctgtactgtgagcatttttgcacacgctagcaggattgaagagtggtgaccga

SEQ ID NO: 65911 - DNA, 109 bp, Mus musculus
agacaacaaagttggttgtggtcaaacccagagtccagagagaagttacagaccactctgttagcccatatactctgttctcgtgatcttgacagatgagctactgtct

SEQ ID NO: 65912 - DNA, 85 bp, Mus musculus; identical to SEQ ID NO: 57439

SEQ ID NO: 65913 - DNA, 106 bp, Mus musculus
cagacacacacacacacagagagagagagagagagagagagagagaataagatgtgactattggcctttattcttacactcacctcttactctatggaaatgtttg

SEQ ID NO: 65914 - DNA, 112 bp, Mus musculus
ttccagttttagaagcgtgaggggtggggaggtttggggtgagttcaaaacatttttttttgaattacagctgggtttcttcataaaacatattagctaggtggtgttggaa

SEQ ID NO: 65915 - DNA, 87 bp, Mus musculus
ctttgcctgcagatctgactgtctgtgtgccacatgcatccttggtgcttgaggaggccggagaaggaagaagatcccatggtatag

SEQ ID NO: 65916 - DNA, 84 bp, Mus musculus
tggatcaacattgtcatgactgtttcactctcagtgagaaagcaaaagtcctcattatgagcttagttttcccagtgacatcca

SEQ ID NO: 65917 - DNA, 76 bp, Mus musculus
cacacacacactcattcacagacacacctggagtaccctgactttgaatggttcatctgaggatggtgtgtgtgtg

SEQ ID NO: 65918 - DNA, 83 bp, Mus musculus
tgaatccgggacacaatgatgattataaaatattgtggtagactgacccagtcactcacagtgatcacgagtcttggcattta

SEQ ID NO: 65919 - DNA, 72 bp, Mus musculus
ataaggagagactgcacacactgtccagtgtagaactgggtccagagggggaggggatctcaaagtccttgt

SEQ ID NO: 65920 - DNA, 104 bp, Mus musculus
gtgtatctatccttggggctggagagatggctcagcggttaagagcactgactgctcttccagaggtcctgagctcaattctcagcaaccatatggtggttcac

SEQ ID NO: 65921 - DNA, 83 bp, Mus musculus
attggacctgtagctcttcatttaggggtggggctttatggggttcccttgactacacttgagtgtcagctgacagcgccaat

SEQ ID NO: 65922 - DNA, 119 bp, Mus musculus
gaagaaggagtgttagtaaatgggctgaaattcacctagcatggtgttatttccactctgactgtgtctgtttgccctgttgtggacttcagtggctgtgagcatagcatctgtctttc

SEQ ID NO: 65923 - DNA, 78 bp, Mus musculus
tgaagtctcactgtatctctgtctggctggaacttgctgtatgtaggctaggctagactcagagatctgttcctttca

SEQ ID NO: 65924 - DNA, 61 bp, Mus musculus
tcctctgcgcagggaggtccacgtgtctttccttgttactcagcctctctgggtctgtgga

SEQ ID NO: 65925 - DNA, 85 bp, Mus musculus; identical to SEQ ID NO: 57439

SEQ ID NO: 65926 - DNA, 86 bp, Mus musculus
gggtgagtccatgaccatcatggtggagagcatggcagtaggcaggcaggcagtggtagtagcatggtggctgagtggttacatct

SEQ ID NO: 65927 - DNA, 80 bp, Mus musculus
cattattgtagatgccaaaaagttcttgctgataggtccctcatatagcaggttcctgagaggctctgtcagtgactgac

SEQ ID NO: 65928 - DNA, 65 bp, Mus musculus
gatagagacatctcatttagagctatggcttctaaggtctctctctgtgtgtttctgtctctgtc

SEQ ID NO: 65929 - DNA, 88 bp, Mus musculus
ttgcagtaagtatatttctgatatgtgtgttgttcatatatatatatatacacacacatatattcaaaaaagtgctgtgtattgacag

SEQ ID NO: 65930 - DNA, 86 bp, Mus musculus
atgtataatttatgtatgtatgtatgtatgcatgcatatatatatatatatatatatatatgcatatgtgcatgcacatatggatt

SEQ ID NO: 65931 - DNA, 73 bp, Mus musculus
tggaatactcctattgtagaagcttcttaaggttatatatatatatgtgagaaaattctagatggagttacca

SEQ ID NO: 65932 - DNA, 105 bp, Mus musculus
cttcctgttcttccttgtgtgtgcttgttatctttgaatttttagataaatgtgtttaaattggtgtgcaaatagcaatcacaaaactagtagggccatgagagg

SEQ ID NO: 65933 - DNA, 85 bp, Mus musculus; identical to SEQ ID NO: 57439

SEQ ID NO: 65934 - DNA, 95 bp, Mus musculus
cttgaactggactcaccccattttttgtagaatatgacattgaaagaggaatgttgtgtggtaggatctgaagattttggttcgggatattcaag

SEQ ID NO: 65935 - DNA, 117 bp, Mus musculus
ggaaaagaaggtccagtgaccgacccaaagtgtgatccagctcaaggggacgtcccaaggtctgacactatcactgaggctatggagtattcacaaaaaaagggacctatcatgacc

SEQ ID NO: 65936 - DNA, 118 bp, Mus musculus
ttctgtaactctttgtcattttatgacatgaactattgtcttgaacttgctatgaacttatggaatgtaaagatgtttggaaaatcatgtgatcaattattccgagagagtataagaa

SEQ ID NO: 65937 - DNA, 115 bp, Mus musculus
gtatccactgtcttcttgtgtttctccacttaaatttcctttaggtgacattttgttgttgttatggctaaagagaatgaagtcaaggttagaaggattggtcgcaagaatcagt

SEQ ID NO: 65938 - DNA, 85 bp, Mus musculus; identical to SEQ ID NO: 57439

SEQ ID NO: 65939 - DNA, 74 bp, Mus musculus
cactcacacacacacatatatccacacagaggcatatatatatatgtgtgtgtgtgtgtgtgtgtgtgtgtgtg

SEQ ID NO: 65940 - DNA, 70 bp, Mus musculus
gcatgtatgtgtgcgtgtgcattttcacctgagtgtccttgtttgtgtctgtccatgtggatgtgcttgc

SEQ ID NO: 65941 - DNA, 87 bp, Mus musculus
agcttcatatggtctgtgagttgtcttgaagctgtaatttaattatttttcaaagttatagcttctggtccaacatagataggagct

SEQ ID NO: 65942 - DNA, 106 bp, Mus musculus
gctcacccatcagtgatctaccatacctccgtgactgcactgaaaatatgggactttctctctctctgccagatggttggtgtgggacagaacatggatatacagc

SEQ ID NO: 65943 - DNA, 85 bp, Mus musculus; identical to SEQ ID NO: 57439

SEQ ID NO: 65944 - DNA, 80 bp, Mus musculus
gtgaactaagactattggcatgtttcttgggtgttttacatcaacacagcaaggtgaatgctacatgtaagaagtgtcac

SEQ ID NO: 65945 - DNA, 107 bp, Mus musculus
agggcttgtgtgtacagaggaatggcatcagtgtctcatggcataatagggtgtgtgtagagactgagcgccattcaagatctaaaaatatgaaaaatacatttcct

SEQ ID NO: 65946 - DNA, 83 bp, Mus musculus
caactgaccatacacttacaggtgtgctgagagcagagacagctctgagaggttcaccaggtgggtttgtgagttcactgttg

SEQ ID NO: 65947 - DNA, 103 bp, Mus musculus
agtgtgtgactgggtatatgtctgtctttggatctttatgcatgtatatatgcatatatttgtatgtaggaagtattaaaatatgcctttttcttcatctact

SEQ ID NO: 65948 - DNA, 87 bp, Mus musculus
tcacatctgtagtaaatgtgcagcttggtcctcatattgctctcttaacaattagagtgggactgtctctgactctattgcctgtga

SEQ ID NO: 65949 - DNA, 86 bp, Mus musculus
tccagtttcagagaatttgatatgtcttctgatctttgcaagccccagaatacatatggtatgtatatatattctcagaaacagga

SEQ ID NO: 65950 - DNA, 112 bp, Mus musculus
aatagtgaaccaggatattttagaaactgagtcacagtctcattgtgttaggttatctacgtgtctgtttcctaagactgtgttttgtctctgtactttttcctctactgtt

SEQ ID NO: 65951 - DNA, 99 bp, Mus musculus
atgtaaaagggaacactgaataacatgaagaatctattgcttagtgcctgaatcttcctaatggcattgcttgatttgacggtgttttagttcatacat

SEQ ID NO: 65952 - DNA, 96 bp, Mus musculus
gatcagctttagtccatggtgatctgataggatgcatgcgacaatttcaatatttttgtatatgttgaggcctgttttgttaccaattatatggtc

SEQ ID NO: 65953 - DNA, 87 bp, Mus musculus
ggaggctgaaggtcacagggaggtaagagagctatgaatgatgtggtcgctgtctgcctgagtgactctaggaaaatcaatgtttct

SEQ ID NO: 65954 - DNA, 106 bp, Mus musculus
gctttagtccatagtgatctgataggatgcatgggacaatttcaatatttttgtatctgttgaggcttgttttgtgaccaattatgtgatcaaatttggagaaggt

SEQ ID NO: 65955 - DNA, 125 bp, Mus musculus
ctagcattggagaccagagtagccttgaactcagaaatctgcctattttgtcatagtctctgtctccctggtgctgggattaaaagccgcctgggccacccagcctggcactggccttcaggatt

SEQ ID NO: 65956 - DNA, 87 bp, Mus musculus
gaataggaacattcaggcagtaagaatttttatgctataggaaggctgtatttcatatgatctctctctgtctctctgtctctcttt

SEQ ID NO: 65957 - DNA, 112 bp, Mus musculus
gagtgagatgttgcagagattcgttttgaatatgaaggcatcacaggtgtgagagtacagacactgcagatgttgtcatggtgagaatgcttcatgcagttaaaaattgctt

SEQ ID NO: 65958 - DNA, 104 bp, Mus musculus
ccttagtccatggtggtctaataggatgcatgggacaatttcaatatttttgtatctgttgaggcctgttatgtgaccaattatattgtcaattttggagaagg

SEQ ID NO: 65959 - DNA, 118 bp, Mus musculus
ttgtttaatgtcatgggcagctaccaaattgtaaaatttctgaatatttttataaagattctccttttttatgcttgaaatatttggtgaaaagatggtagttgaccataatttgcaa

SEQ ID NO: 65960 - DNA, 85 bp, Mus musculus; identical to SEQ ID NO: 57470

SEQ ID NO: 65961 - DNA, 96 bp, Mus musculus
gatcaggctttgttcatggtggtctgataggatgcatgggacaatttcaatatttttgtatctgttgaggcctattttgtgaccaattatatggtc

SEQ ID NO: 65962 - DNA, 74 bp, Mus musculus
tatgtatgtgtatgtatgtgtatgggcatgtgtatgtatgtatacatgtgtgtgcatgtatgtatgtatgtatg

SEQ ID NO: 65963 - DNA, 69 bp, Mus musculus
tttctggaatttcaggatagttgagagccaccagacatggtggtaagaactgaaaccaaattttgggaa

SEQ ID NO: 65964 - DNA, 103 bp, Mus musculus
tcatcagcctggggcttgctgatgatgctggagaagcaggctactactgatcctcagaactctgtctgtctctcttattgcagtcctgtccagtgcgtcatga

SEQ ID NO: 65965 - DNA, 85 bp, Mus musculus; identical to SEQ ID NO: 57439

SEQ ID NO: 65966 - DNA, 85 bp, Mus musculus; identical to SEQ ID NO: 57470

SEQ ID NO: 65967 - DNA, 111 bp, Mus musculus
ttatttctgcatcttcaatgctactccactgatcaatgtgtctgtctctgtatcaatagcatgcaggttttatcactattgctctgtagtaaagcttgaggtcagggatgg

SEQ ID NO: 65968 - DNA, 85 bp, Mus musculus; identical to SEQ ID NO: 57470

SEQ ID NO: 65969 - DNA, 112 bp, Mus musculus
tctgttggagttcccatcaataaattctcaggctattactttatttattcaagttaaaaaaaccattagataattaaggagacctgtcttgaggctggggaaatttctcaga

SEQ ID NO: 65970 - DNA, 63 bp, Mus musculus
cataagacttgtgtgtgcatgtgcatgtgcatttgtgcatgcacgtgtgtgtgtgtgtgtgtg

SEQ ID NO: 65971 - DNA, 79 bp, Mus musculus
gatctgctgttttgtttgtttcttagggcattacagttaagaaactgcatgaatctcagaagagactgaactgtgggtt

SEQ ID NO: 65972 - DNA, 78 bp, Mus musculus
tagggatgcttctatcagacagaagggatgtagggaagggttggacctgcttacttctgtctgtgtcttcttgtattt

SEQ ID NO: 65973 - DNA, 115 bp, Mus musculus
atggttacatttggaaggctatatgtatttctaattatttacatctgtatatttatgtcactggtagacaactgtatatagtctgtagtatctatagtactaatgttactatcca

SEQ ID NO: 65974 - DNA, 112 bp, Mus musculus
gtcagaagccacttaactaacaaggttcagatttgtttttatcaatattaagtaatcatagtggttgtttcggaagtaaagttgtagctgagttggtagagggccttcctac

SEQ ID NO: 65975 - DNA, 115 bp, Mus musculus
attgttttaggattcagtgtctctgggttggttattttgtcagtgtcctctctctctctgagtctttgctgtacctatggccacttgcttatagaaataactgagttcaggtggt

SEQ ID NO: 65976 - DNA, 86 bp, Mus musculus
gtgggtggggagagcatagggagtacttttgcttatgaggtcaatctggagaccagaggtgtctgtctgtctatctatctatctat

SEQ ID NO: 65977 - DNA, 106 bp, Mus musculus
gccttagtgcatggtgatctgataggatacatgggacaatttcaatatttttgtatctgttgaggcctgttttgtgacctattatgtggtcaattttggagaaggt

SEQ ID NO: 65978 - DNA, 106 bp, Mus musculus; identical to SEQ ID NO: 65977

SEQ ID NO: 65979 - DNA, 118 bp, Mus musculus
gggactacttggacattcagctttgtggactgagcagttactgggctctctgactttctgtgtgttgtcagtagtgttagactatcctgtttgtatcatagaagccaatttaataccc

SEQ ID NO: 65980 - DNA, 102 bp, Mus musculus
gatcaggatttcttgagcaggtcaggaaaccatggagtttaactctctgtcacactttgtcctccactaggtttactgccacacctctcactgaatctgatt

SEQ ID NO: 65981 - DNA, 116 bp, Mus musculus
ggctcagagggatcgtgtgaaggtacttcaaggacattaatacagatattactctatttgataatctgaagtctcttgggtgaaaaaaaaaatctttgtaggatttaaaagaagcc

SEQ ID NO: 65982 - DNA, 100 bp, Mus musculus
ctaatgctgctttgaatagctaatctaattagtttctttttataaatcacatagactcagataaaaatgattaaatagatagcatttgaaaaggtgtgag

SEQ ID NO: 65983 - DNA, 95 bp, Mus musculus
cacaagaggaaagtaattatatatatatacatatacatatacatatacatatatatatgtgtatatatatatgtatatatatataatatctagtg

SEQ ID NO: 65984 - DNA, 85 bp, Mus musculus; identical to SEQ ID NO: 57470

SEQ ID NO: 65985 - DNA, 85 bp, Mus musculus; identical to SEQ ID NO: 57439

SEQ ID NO: 65986 - DNA, 67 bp, Mus musculus
agcaggcgtgggagactagctctctcctctgagtttcagtggtcagaagagtctctgcaggcaagct

SEQ ID NO: 65987 - DNA, 119 bp, Mus musculus
tgatctatagattctgctatacattccatgcatgctgatctaaatactgagaagacactgagtgcagcttagagctcttatttcagttccatgtacaggagccagcatttctgccttca

SEQ ID NO: 65988 - DNA, 102 bp, Mus musculus
tacccatgaggagctgtcaccagtactgtgcaacaagtacttgtagaattttacttgtagaaattctgtgaggtatagaatgaagaaaagtattttggggta

SEQ ID NO: 65989 - DNA, 85 bp, Mus musculus; identical to SEQ ID NO: 57470

SEQ ID NO: 65990 - DNA, 116 bp, Mus musculus
gtttcctcaattcagtatatatatatgtgtgtgtgtgtatatgtatgtatatgtaatatatacatatatatacatatatatatatatatatatatatgagcctgctagttggattc

SEQ ID NO: 65991 - DNA, 90 bp, Mus musculus
ctctctctctctctctctcacacacacacacacacacgcttacatgtgtatctgtgtatttgtgtgtgtgtgggggggggggcatcagag

SEQ ID NO: 65992 - DNA, 90 bp, Mus musculus
ggatttcattgtccagtaaagtatttttatttgatagtcattgcttatgccatgtaatcaggaggaaaaactgcttgagactttgtatcc

SEQ ID NO: 65993 - DNA, 87 bp, Mus musculus
ttaggagaatattagtctctggaaacccaaccaagcagttcaagtttttcaggattgggtactggaagcatggtggtcatctcctga

SEQ ID NO: 65994 - DNA, 104 bp, Mus musculus
gagtctgagaaatttgtgttccttgggccacccagactgtgatattttattcttgctccctggtgagagaacacagtctgctttataggagattttctcaattc

SEQ ID NO: 65995 - DNA, 94 bp, Mus musculus
gctgtcctgtttatctttaaggtttatatatatatgcatgaatttatgatactgcctgtgtgccttgtactagtagaggtgagaagagggcttc

SEQ ID NO: 65996 - DNA, 73 bp, Mus musculus
ggaccagatgtgatacagaatgctgcaggtacagtgcacactgccacagtctctgtgcattcatatgtgtgcc

SEQ ID NO: 65997 - DNA, 85 bp, Mus musculus; identical to SEQ ID NO: 57439

SEQ ID NO: 65998 - DNA, 86 bp, Mus musculus
tgatagctgccccaggaaaacgtagtggtttgttgtgtggctagatcataaattcgaagagacttgttctcctaagcagtctaaca

SEQ ID NO: 65999 - DNA, 104 bp, Mus musculus
ttaaggcagctccatggggctaggtgtcaggaagtcatgacattgcaacaggcactatttatttttatactacctgatattgtgaacaacctagagtttcttag

SEQ ID NO: 66000 - DNA, 67 bp, Mus musculus
ccatcaaatatgtatgtatgtatgtatgtatgtatgtatgtatgtatgtatgtatgtatgtgtgagg

SEQ ID NO: 66001 - DNA, 105 bp, Mus musculus
tgctgccatgatgataatggactaacgctcctaaactataagccagtcccaatgaaatgtttttctttataagtgttgccacggtcatggtatctttttacagca

SEQ ID NO: 66002 - DNA, 63 bp, Mus musculus
gctgtgcacagagcctggggccgctggtctgtgagaagacacagaggctagacactgtgcagc

SEQ ID NO: 66003 - DNA, 109 bp, Mus musculus
tgggaaaatgagaagtgtttgtttgcttttattattatcatgatgtatgtatgtatgtatgtatgtatgtatgtatgtatgaaagacattcctagatctctcataacta

SEQ ID NO: 66004 - DNA, 75 bp, Mus musculus
gagacagaagagacagatgacatttggaggctgttcactgcaacagcctcagccatttgcctcagagcctgtctc

SEQ ID NO: 66005 - DNA, 91 bp, Mus musculus
catatactgtgacacacacatagacacatgcatgtgcgtgcgcgcacatgtgtgtatgtgtgtgtgtgtgtgtgtgtgtgtgtgtgtgtgt

SEQ ID NO: 66006 - DNA, 86 bp, Mus musculus
aggacacctgaccggatgttaattaaagcacaacaaatgggaagtctctcagtgtttgtcacagattaacctcaggtcaaattcct

SEQ ID NO: 66007 - DNA, 63 bp, Mus musculus
atatgtgtgtatatgtgtatatatatatgtatacatatatatatatataatacacaaaaatat

SEQ ID NO: 66008 - DNA, 114 bp, Mus musculus
taccacattttctatcatatgtgacagctagatttgtgtgtatcactgacagacagacagacagacagacagacagacaggtgaatttcgagaaatatgagagtagagcaggta

SEQ ID NO: 66009 - DNA, 63 bp, Mus musculus
cctctagcaaacaggtcagtggtggagtggaagcccactctgtcactctgtctcagaggctag

SEQ ID NO: 66010 - DNA, 125 bp, Mus musculus
aagctctaagcactgaaagtacgtgctttgcagagttgctgcagaatgaaatgctatgacagcctgctctgaaggtgaggtaggcaggcttggttttgtgtacagcttcggaccatgtttattta

SEQ ID NO: 66011 - DNA, 92 bp, Mus musculus
atgtacaggcataaccacagaggaattctgcttattggcttaatctttggcatgtataataagttatatttctttaaaaattcctgtcacat

SEQ ID NO: 66012 - DNA, 92 bp, Mus musculus
tttatgaatttggctttttttcacaaagggaaatgaagcaattttattgatttttaaagcttctttcattttgtttggagtaatttcatgag

SEQ ID NO: 66013 - DNA, 75 bp, Mus musculus
gaacttctgctgcaggggccagagagaataaagcagggcatcccctgattttctctctgtctctgggagagtttc

SEQ ID NO: 66014 - DNA, 67 bp, Mus musculus
tgttgagttttttggaagaacaagttcatattttgatcttgtgaatttgtattctccaaccttgaca

SEQ ID NO: 66015 - DNA, 96 bp, Mus musculus
gtgtaattgctctggctaggacttctagtacaaggttgaataggtagggagaaagtggacagccttgtctagtccctgattttagtgggattgcat

SEQ ID NO: 66016 - DNA, 85 bp, Mus musculus
gtccatggtgatctgataggatgcatgggacaatttcaatatttttgtatgtgttgaggcctgttttgtgaccaattatatggac

SEQ ID NO: 66017 - DNA, 116 bp, Mus musculus
gccttagtctatgatgatctgataggatgcatgggacaatttcaatatttttgtatatgttgaggcttgttttgtgaccaattatgtggtcaattttggagaaggtaccctgaggt

SEQ ID NO: 66018 - DNA, 98 bp, Mus musculus
gatgataacatcttcatgatactcacaatggttcttgaaattcatggcaatgctagtatacaaagaacactttgtggatgaagtaaggagttttagtt

SEQ ID NO: 66019 - DNA, 85 bp, Mus musculus; identical to SEQ ID NO: 57439

SEQ ID NO: 66020 - DNA, 73 bp, Mus musculus
acacactgtgacatactacagcttccacaatgagatttatgctttgtgtaagtgtgtgtgtgtgtgtgtgtgt

SEQ ID NO: 66021 - DNA, 96 bp, Mus musculus
acagttgcaggtgctgtgtgtgcatatgcatgtgtacatgtatatgagtgtgtgcgtgtgcactgtgtgtgtgcatgtgtgtgtgcgtgtgagtgt

SEQ ID NO: 66022 - DNA, 80 bp, Mus musculus
cttctctcagacagtctgtcttgtttattaggcgttctgtaatgtcccggttacaagaagtaccaatactctgagcgaag

SEQ ID NO: 66023 - DNA, 110 bp, Mus musculus
gtgctgggcatttgggaaagttactccagagagggtttcctgtgttctctgtctgagtccttaggtacttatttttctctgtcacattctgccaagtagctcctttgcac

SEQ ID NO: 66024 - DNA, 99 bp, Mus musculus
tttctgagatgatcatttgttttacatcattgagcttgtttaagtgttgataacatttatttatatatgttcagctgaacaatgcctttatctctgaag

SEQ ID NO: 66025 - DNA, 104 bp, Mus musculus
ggataacattgttcagtgacaacaggtggcatgctgacatcaaagagaagaatgaaagctctttgttgaactatctagatggcctgttgccaatacatgtttct

SEQ ID NO: 66026 - DNA, 72 bp, Mus musculus
tgtgtgtgtgtgtgtgtgtgtgtgtatttgtctgtctctgtctctctcacaaacacacatactcacagtaca

SEQ ID NO: 66027 - DNA, 97 bp, Mus musculus
ctaatgtttgactgtgagtctctatatctgtctccatcaattgctagatgaagtctctctaatgatagagactacctgtatagcagactatcattag

SEQ ID NO: 66028 - DNA, 98 bp, Mus musculus
ctgtcttgaaactatagtctgatctcagagatggaaatttttaattttacatgtcttaaatttctttgatttactatagtttttagtagcctaagaca

SEQ ID NO: 66029 - DNA, 76 bp, Mus musculus
acacacatgtgtgtatgtatacatgcacatatgtatgtatgtatgtatgtatgtgtacatatgtatacatgtatgt

SEQ ID NO: 66030 - DNA, 69 bp, Mus musculus
acatatatgtatatgtgtatatgtgtatatatgtatacatatgtatgtatatatacatatatattctgt

SEQ ID NO: 66031 - DNA, 103 bp, Mus musculus
gttgcctgtacgtgggatatgttcttctagctgggttgtctttctctctcagtgggagaggatgcacctagcctccagacttgaagtgccagggtggggagac

SEQ ID NO: 66032 - DNA, 67 bp, Mus musculus
gaacatatatgcagaggccagaggaggacatctggtgtcctgttctgtcactctccctgtgttgttc

SEQ ID NO: 66033 - DNA, 116 bp, Mus musculus
agaggcaacaattcttctatattattgacagatctagtcattttctgttctttggatagtgactattcaaataggtgtggatggtgtctaattgtggttttgatttgtttttctct

SEQ ID NO: 66034 - DNA, 103 bp, Mus musculus
tcgaaccgtggccacgggagacactgagagagcagagtcagggcataagtctctatttcccccagctaagtctcacttcccaataaatgtcatcacgttatga

SEQ ID NO: 66035 - DNA, 60 bp, Mus musculus
gctcatgcgcgtgtgtgcgcgcgtgcacacagacacacacacatacatgcacatacaggc

SEQ ID NO: 66036 - DNA, 74 bp, Mus musculus
tactcccagaagccagccctcagcaaagagtctcctggacctccatgcaatctctctgtctgtctctggggata

SEQ ID NO: 66037 - DNA, 77 bp, Mus musculus
ggacgacagatgagagtcacttcaggccaaatgcagaacaggttgggctgagggatactgctgcatgccgccgctcc

SEQ ID NO: 66038 - DNA, 73 bp, Mus musculus
gggggaggggtgttacattatacaatggcaatgaggattaaatcccatgtccctctgtgtgtctctctctccc

SEQ ID NO: 66039 - DNA, 72 bp, Mus musculus
gcgtgtgtgtatatgtatgtatgtgtgcatgtgtgtgaatacgtgtgcatgtttgtgtgtgtgtgtgtgtgt

SEQ ID NO: 66040 - DNA, 85 bp, Mus musculus; identical to SEQ ID NO: 57439

SEQ ID NO: 66041 - DNA, 77 bp, Mus musculus
gcctctctcactgtgtgagcctgtgacactctccaagcttgtttgttagcgtctcacctgtgacacataagtaaggc

SEQ ID NO: 66042 - DNA, 106 bp, Mus musculus
catggcaggaggactttctgttctggtcctatctaattggtgtttataagcttcttgtatgtttatacacatctctttctttaggtttgtaaggttttcttctatg

SEQ ID NO: 66043 - DNA, 74 bp, Mus musculus
tctgtctgtctgtctgtctgtctgtctgtctgcttataaaagccagaagagattgtctgatagtctgaagcaga

SEQ ID NO: 66044 - DNA, 84 bp, Mus musculus
gaggacccatgtcactgtggggtgggctttgaggtctcacatgctcaaacatggtcagtgtgtctctctccctgctgcctgcgg

SEQ ID NO: 66045 - DNA, 85 bp, Mus musculus; identical to SEQ ID NO: 57439

SEQ ID NO: 66046 - DNA, 71 bp, Mus musculus
gcagccgctgacatgactcacaaactgcttagtcacccacctatctgtcagtgtgtgtcacacacggctgt

SEQ ID NO: 66047 - DNA, 85 bp, Mus musculus; identical to SEQ ID NO: 57439

SEQ ID NO: 66048 - DNA, 85 bp, Mus musculus
gtgacaggtgcttgggtgtccatctctccgtcacacactcatcgtggtgccgtgacaggtgcttgggtgtccatctctccgtcac

SEQ ID NO: 66049 - DNA, 90 bp, Mus musculus
gtatatgtttacgtgtgtgtatgtatgtgtatatgtatatgtatatgtgtgtgtatgtatgtgtatatatatgcatatgtatgcatatac

SEQ ID NO: 66050 - DNA, 85 bp, Mus musculus; identical to SEQ ID NO: 57439

SEQ ID NO: 66051 - DNA, 85 bp, Mus musculus
ggccatggtggtctgataggatgtatgggacaatttcaatatttttgtatctgttgaggcctgttttgtgaccaattatatggtc

SEQ ID NO: 66052 - DNA, 85 bp, Mus musculus; identical to SEQ ID NO: 57470

SEQ ID NO: 66053 - DNA, 105 bp, Mus musculus
ggttacttgctgtccacctcaaattcaaatgtaatgaagtatgcagaattttgatttattaagtctggcaatacattttttatgtctggggtgggggaaggagct

SEQ ID NO: 66054 - DNA, 73 bp, Mus musculus
tacctatcatatatatatgcatatatatacacatatgtgatatatatatatatgcatatatatttaatcagta

SEQ ID NO: 66055 - DNA, 93 bp, Mus musculus
gtatgtgtgtatatgtatatatatgtatgtgtatatatatacatatatatatatatatgtatacacatacatatatatatatatatatatatg

SEQ ID NO: 66056 - DNA, 90 bp, Mus musculus
gtttccctcgcaggttcatgaacatcctgagacagcaagaggatctgattcttgtgctagttctctgaagttctgttcctgtaggctaat

SEQ ID NO: 66057 - DNA, 83 bp, Mus musculus
gactatcattgtaactattttttaaaaaatagcagtcataatactataagctgtttttggaaagaagtaggatatgaatagtt

SEQ ID NO: 66058 - DNA, 88 bp, Mus musculus
gtaaacttggaggctcctgaagccctttgttttcactcttccctgtgtggctacactgcatggctctctctttgcctgtcacccttgc

SEQ ID NO: 66059 - DNA, 60 bp, Mus musculus
tgcatatgtgtgtatgtgcacatgcatatgtatatatgtatatacatacacacatgagta

SEQ ID NO: 66060 - DNA, 78 bp, Mus musculus
tctgttctctctgtgtctgaattcatcgcgtccataggtagtgatgctcaagatgagtagtgggcagaggggcgagag

SEQ ID NO: 66061 - DNA, 83 bp, Mus musculus
catttatgtgatgtgtgtgtgcatgtgcatgtttgtacatgtttgtataggtatgtacatacatatatgtatacaggtacatg

SEQ ID NO: 66062 - DNA, 101 bp, Mus musculus
ccttgctcttcctgcacaattagtggagtcgagtgtcattttataaatgagcgttcttcctgtctgacacactgaatgttgcagcaccaaatgaggaaggc

SEQ ID NO: 66063 - DNA, 94 bp, Mus musculus
agagcagacaatgtatgtgcaggtgcacacatgtataaatttgtatatacatatagacttcttacacttgtgtctggtagatttattgttatct

SEQ ID NO: 66064 - DNA, 85 bp, Mus musculus
ggccatggtggtctgataggatacattggacaatttcaatatttttgtatctgttgaggcctgttttgtgaccaattatatggtc

SEQ ID NO: 66065 - DNA, 64 bp, Mus musculus
atatatacatatgtatgtacgcatgtatgtatgtacatctgtatgtatgtatatatgtatgtat

SEQ ID NO: 66066 - DNA, 98 bp, Mus musculus
agaacgaagtgcattcctctgtgtgaggtagaatgttctatgggtgcctgctatgtccgttgtatttatgacattattttacttcagcattttcctct

SEQ ID NO: 66067 - DNA, 114 bp, Mus musculus
gaaaaagtgaccactggtatctgaagattagcacattccggctcagcttgttcatacttttcagaagaatgactgctctagccaatgctccctctctcaaagcctctctttatc

SEQ ID NO: 66068 - DNA, 89 bp, Mus musculus
tataattggtgtgtgtttctgggtgtgtttagatgtgtgcagcattgtgcaaaatcttttttattttatggtacacacacttttttgta

SEQ ID NO: 66069 - DNA, 110 bp, Mus musculus
ggacctaggtcaaacccatgcaggttccttgataaaacagttcagtctctgtgagctcctttgagcccagattaattgattttgtggttttcttgtggtgaccttgaccc

SEQ ID NO: 66070 - DNA, 93 bp, Mus musculus
ctcactcgctcactcactcactcactcactcatgcacagaagggcaggaaggaaggagggaggaaaatagggagagagggaaagggggaggag

SEQ ID NO: 66071 - DNA, 85 bp, Mus musculus
ggctatggtggtctgataggatacatgggacaatttcaatatttttgtatctattgaggcctgttttgtgaccaattatatggtc

SEQ ID NO: 66072 - DNA, 85 bp, Mus musculus; identical to SEQ ID NO: 57470

SEQ ID NO: 66073 - DNA, 60 bp, Mus musculus
tgtcgggagcggactgaccaatgaaggccatggctacagtggctctctgcccctctgaca

SEQ ID NO: 66074 - DNA, 63 bp, Mus musculus
gccagcagtgtgactccaggctagtctttgcccttcagcatgcctgcctgcctgcctgcctgc

SEQ ID NO: 66075 - DNA, 85 bp, Mus musculus; identical to SEQ ID NO: 57470

SEQ ID NO: 66076 - DNA, 105 bp, Mus musculus
cttgacagagtagtgatctctaagcagctcccctgccacctctgtgtttctctcagagacaaggagaaaaatgcaggagccagaggccatgctggagctgtcaag

SEQ ID NO: 66077 - DNA, 96 bp, Mus musculus
ggagcaaaaatatggggataaagtgtagagcagagacggaagaaaaggtcactcagacactgtctcacctggagatttatcccatatacagttacc

SEQ ID NO: 66078 - DNA, 87 bp, Mus musculus
ttttagataattttgaagcatacactctctctctctgggtttgaactataatatcggggcgtgtgtgtattctttgagaatctgaag

SEQ ID NO: 66079 - DNA, 124 bp, Mus musculus
gcgtgttctggagtgtctctctcatggtctaggcctcagcttcctcacgtagcagaaggatgacaaaacagagtgagcataaaggaccatgtgaaggaggtttgaagggagtcttctgagtacc

SEQ ID NO: 66080 - DNA, 94 bp, Mus musculus
agggctggagagatgtcttaggggttaagagcactcactgctctttcagaggagccacatatgaaatctcacaaccttctataactccagtgcc

SEQ ID NO: 66081 - DNA, 110 bp, Mus musculus
ctgtcagcatctgcatctgtattggtcaggcttcattcatcttttatatattccatgcaaatttatatttttcttatgagttagttggacccactgatgcacttgttcag

SEQ ID NO: 66082 - DNA, 74 bp, Mus musculus
gtagaaaagagtcagagaagagtctttgcaccctgctctggatgcccttcagccccttcccctgatatttctac

SEQ ID NO: 66083 - DNA, 118 bp, Mus musculus
aatacatcatcagcaagtctcattctcatgtattacactaataaatcaccagaatgacaactgattctgatgatctattaatgcaatacatcagacggaggtgttggaatggggtatt

SEQ ID NO: 66084 - DNA, 119 bp, Mus musculus
cgcagctttgtgtgtgcactatggttaccaagcaaaaagaaggcagctgagaagagagtgttcacacacagagaatgtgattacaagcccatccctgtacaggctgctgattgggctgg

SEQ ID NO: 66085 - DNA, 102 bp, Mus musculus
gggtgaatgtgatgcgattttgagtttcttctttgaaatagtatatttatattacaggaatttttatgaggaaggagaaagctagaatctatctatttatct

SEQ ID NO: 66086 - DNA, 96 bp, Mus musculus
acatatatgtatgtatatacatatatgtatatgtatatatcacatatacacacatatatatatgtatatatatgtatatatgtatacacatatgtg

SEQ ID NO: 66087 - DNA, 161 bp, Mus musculus
gcacatgcacgtgtatttatatatgtatacacatatgtgtgtgtatttatatatgcaaacacgtatgtgcatgtctttatatacatgtatatatgtatatgtgtatatatgcacacatgtatctatgtatatatatgcatatacacatacatacttctggc

SEQ ID NO: 66088 - DNA, 72 bp, Mus musculus
gaattgaactgccaggatgagggagggggttgctgcctctgcctgactcactccctgtcggcgaatcccttc

SEQ ID NO: 66089 - DNA, 86 bp, Mus musculus
gctttggagactacactcccacatggttccttggtgaatacagaattagagccaatgagaagtgacagtttgtggttgtccacagc

SEQ ID NO: 66090 - DNA, 76 bp, Mus musculus
gggcaggaaggatgctgccgcagattaggaatgcccaactgcaatattgatttgtgtctgtcactctctctctccc

SEQ ID NO: 66091 - DNA, 67 bp, Mus musculus
atgtatatagttatgtgtatacatatatatgcatgtgcatatatatgtatatgtatgtgtatatatg

SEQ ID NO: 66092 - DNA, 95 bp, Mus musculus
aagactggactgtaacagtgaactgtctctctgtcgcacatgatgatgatagtcttctagggagggtgaggcctaacatctggaactaccatctt

SEQ ID NO: 66093 - DNA, 120 bp, Mus musculus
cctgtcttttggaaccttaaagtactgtagcagcacatcatggtttacatactacagtcaagatgcgaatcattatttgctgctctagaaatttaaggaaattcattcaagattatatgg

SEQ ID NO: 66094 - DNA, 160 bp, Mus musculus
gtttggatatctgacatgcttgttccactctagcagcacgtaaatattggcgtagtgaaataaatattaaacaccaatattattgtgctgctttagtgtgacagggatatagcaactcatttctgtttgttatttccctttaagataacagtttagataa

SEQ ID NO: 66095 - DNA, 85 bp, Mus musculus
taccctgttctcactgaagagagttagctgctgtgtgtatacaaagtgtatgaatgtgactctcttaaagggtgaagttgaacag

SEQ ID NO: 66096 - DNA, 74 bp, Mus musculus
agggttaaagacatggaccagattgcagaggtttgtttgcctgcctgcctgtctgtctgtctgtctgtttccct

SEQ ID NO: 66097 - DNA, 90 bp, Mus musculus
gaattagcatgctgaatatccatggagaggcatagaaagcatgtataatttcataatatatgtatacatggatactgtgcaagtaggttt

SEQ ID NO: 66098 - DNA, 101 bp, Mus musculus
gggggaagatctagaggcatcaactcgcttttcactaatggagaacaaaggtggagagaagacaatgagctgagaagccaggcggagaggatctgactccc

SEQ ID NO: 66099 - DNA, 119 bp, Mus musculus
gaaacaatgcacagagatggcactactctcgggctgctctgtctcccaccctgtcttcctccaccatggccaagggacacccccaccccacctgaagtgttagccctgtgtgtggtttt

SEQ ID NO: 66100 - DNA, 70 bp, Mus musculus
gtcactctctggctgtatgtctgtggacacaagtttctctgaagtcccagtttactggctatagagtgat

SEQ ID NO: 66101 - DNA, 90 bp, Mus musculus
gagtcacgaagaagattctgagagcttctgagaaagcttcaggaaaacaagagaagagtctgaggtctcagtttcttcttttcatgcctc

SEQ ID NO: 66102 - DNA, 68 bp, Mus musculus
ggtcatgacggtagaaatgagtgctccaagctgactcagaaggggctcactctgtgcctgtgaggact

SEQ ID NO: 66103 - DNA, 60 bp, Mus musculus
gcacgtatgtatgtatgtatgtatgtatgtatgtatgcatgtatgtatatatgtatgtgt

SEQ ID NO: 66104 - DNA, 137 bp, Mus musculus
tatattcatgtatttataattgtgtatatgagtgtgtctgtatatatatgtatatatatttatgtgtatctatgagtatgtgtatacatgtatatatatttatgcatgtgtatgagtgtgtacatacatgtatatat

SEQ ID NO: 66105 - DNA, 131 bp, Mus musculus
atatatgtttatatgtgtatgagtatatatacatgtttatatgtgtgtatatataagtgtgtatataaatatatgtttgtgtatgtatgagtgtgtgtacacacatacatacatacatacatacatacata

SEQ ID NO: 66106 - DNA, 76 bp, Mus musculus
tttatttatttactctgtctgttcattcatatgcatgcatggggggggggggcagagacagagacacagagataga

SEQ ID NO: 66107 - DNA, 109 bp, Mus musculus
cttcagtctaggctgtgtttggcaaggcagcttgtctgggggagctcacctctgtgtgtctttgcttttcctgtggctgttaagggaggctattcacatctgacaaagg

SEQ ID NO: 66108 - DNA, 68 bp, Mus musculus
gtccaaaccagcaaggcagtaggagatctcaccacaaggtggggctcacagactgtctctcagtgtcc

SEQ ID NO: 66109 - DNA, 86 bp, Mus musculus
ggccatgggtggtctgataggatacatgggacaatttcaatatttttgtatctgttgaggcctgttttgtgaccaattatatggtc

SEQ ID NO: 66110 - DNA, 85 bp, Mus musculus; identical to SEQ ID NO: 57470

SEQ ID NO: 66111 - DNA, 89 bp, Mus musculus
agcttgtgagctgaaactgtgtgaaaagtgtgtgcagatacccaaactttaaggttctgcatgacactaggtacctactagttcctgct

SEQ ID NO: 66112 - DNA, 85 bp, Mus musculus
aggtagtggttctattcttgagtaaaatattgattatcaatatttgttgggcataagaaagcatattagaaaatgtcactaacct

SEQ ID NO: 66113 - DNA, 82 bp, Mus musculus
ctaagaacatcacattcagttgtcatattcatgttttcagtaataggaattgctggtgtgtgacactttctgaaactcttgg

SEQ ID NO: 66114 - DNA, 66 bp, Mus musculus
gtatatgtatatgtatatgtatatgtatatgatgtatatgtatatacatgtccatacaatatatat

SEQ ID NO: 66115 - DNA, 85 bp, Mus musculus; identical to SEQ ID NO: 57439

SEQ ID NO: 66116 - DNA, 109 bp, Mus musculus
gggctggggcaacatttggtttgggcctgtgcatgccctgtgcatagtgccacagtctctgtgtgtttttgtgcaatggttctgttgtctcaaagatgttgttttccca

SEQ ID NO: 66117 - DNA, 85 bp, Mus musculus; identical to SEQ ID NO: 58391

SEQ ID NO: 66118 - DNA, 118 bp, Mus musculus
gtgtgtgtgtacatatatatgtatacatatacacatatgcatttccaaatattcatatttattgatatatatgtgcctgtgtatatgcatttgtgtgtatgtgtatatacacacatac

SEQ ID NO: 66119 - DNA, 118 bp, Mus musculus
gctcttttacccaggtttcatttctaaagtagtattttatttctaaaaaaagtttggaaatgttatttgtttctattttttaagtagtttaagaaccattgcttggagttctttgagt

SEQ ID NO: 66120 - DNA, 101 bp, Mus musculus
ctatgaaaaccaggccataaagagtgtgtgtgcatgtggaagtgtaaagaagtgcatgaaataatgtgtggaacaccctagttgtaattggttgaatttag

SEQ ID NO: 66121 - DNA, 111 bp, Mus musculus
gataaaattggttatattgaaattaaggtttcataggctgaatttaaacactgatgagacagtgcaatgcaatcaatgtgtgtgaaatattaaagcagttcaaattctatc

SEQ ID NO: 66122 - DNA, 109 bp, Mus musculus
tcaatatggatactgtagtttgccttcttaaggttctttaaatagtctaggtccattttaattctcccactctgtctaaagtgcttggtataaatgcaaaatatattga

SEQ ID NO: 66123 - DNA, 68 bp, Mus musculus
tgatctgagaatttcagcctgactctaagctattattcagcagatgatctcaggctgtctctctgtta

SEQ ID NO: 66124 - DNA, 67 bp, Mus musculus
ttgaaatggaaaggcagatggatagtgtgtgaaacaaatttatctgtctatctgtctgtcttgtcag

SEQ ID NO: 66125 - DNA, 85 bp, Mus musculus
aaatgagaaggaaagctcagccacaaaaagtacagctatctctcattctgactgtggctgtgtgtggaaagcatcaccctcattt

SEQ ID NO: 66126 - DNA, 123 bp, Mus musculus
tatacacacacacacacacacacacacacacaaatacagagaaagagtgagagaagagagagtactctcttcttcaatttataccatatgtatgtatgtatgtatgtatgtatgtatgtatgt

SEQ ID NO: 66127 - DNA, 103 bp, Mus musculus
ggatttcttcaggatctgttgttatgtctcccttttcatttctgattttgttaattaggatttagtgagtctagctaagggtttatctatcttgttgattttc

SEQ ID NO: 66128 - DNA, 85 bp, Mus musculus; identical to SEQ ID NO: 57439

SEQ ID NO: 66129 - DNA, 70 bp, Mus musculus
tgaaaatttgtatgaatgtatgtgtgtgcatgtatgtatgcatatattatatttcacatataatctttta

SEQ ID NO: 66130 - DNA, 115 bp, Mus musculus
atgacaaaatgagaaattgagaccttttcaacaacaaacacttcatgttattatatatactaatatagaaagacagggggattttgatgggactgtctccattgtacagggttat

SEQ ID NO: 66131 - DNA, 91 bp, Mus musculus
atttgaagagtcagaaaaagtatcagcttgtcttagatctgtcagaagtgtctgaggaacaagcaggcagtttataatctgaaaattaaat

SEQ ID NO: 66132 - DNA, 115 bp, Mus musculus
ggttgcacatcacatattgtcttaaataattccttttatgggataagagtagaaaaatggtttatttctatatataaaagaagaaggtagctaagaaataataatgagggcaggt

SEQ ID NO: 66133 - DNA, 85 bp, Mus musculus; identical to SEQ ID NO: 57439

SEQ ID NO: 66134 - DNA, 72 bp, Mus musculus
acatatatgtatatatatgtacatatatgtgtagatatatacatacatacatatatatgtatatatatttgt

SEQ ID NO: 66135 - DNA, 75 bp, Mus musculus
atatgtatatgtatacacatacatatttctcttggtgagtctagttctagtgtgtgtgtgtgtgtgtgtgtgtgt

SEQ ID NO: 66136 - DNA, 85 bp, Mus musculus; identical to SEQ ID NO: 57470

SEQ ID NO: 66137 - DNA, 86 bp, Mus musculus
ttttggggggttgaggtgtctgctcattggttaaagttattgcagcattcgaatgaggagcagaattaaaacctcaccacctaaga

SEQ ID NO: 66138 - DNA, 78 bp, Mus musculus
acataaatgtatatatttatacatatgtacacacatatatatgtatttatacatatgtatacttgtgtatatgtatgt

SEQ ID NO: 66139 - DNA, 76 bp, Mus musculus
gagcagaaatgttggtactaggatgcattgttctgacaaagacctcaggctatcagtgtgtgtgtcaaagttgctc

SEQ ID NO: 66140 - DNA, 83 bp, Mus musculus
caagtacaagagtttattctttgcttatggaatgtatacataattcaacttacttcctcatagtcaagttagcgctgtgcttg

SEQ ID NO: 66141 - DNA, 109 bp, Mus musculus
gtaaaataggatactttcagcctagtgatgattagagtgttagatcttgttagatacatgaaaaggatcatcctctgttttactttttccctgattatctgataaatac

SEQ ID NO: 66142 - DNA, 116 bp, Mus musculus
atgctacctggtatgattatgaaacagtaagtaacatatatgaatatttatatctacatctatctatctatctatctatataatatatatgttaatgtagtcatgcatgtgtgtat

SEQ ID NO: 66143 - DNA, 104 bp, Mus musculus
cagagttttcctattgcaaattgcagactcctttgtgatgaccagacattttttttttttatcagcggtttgcacaaagcaattctcaccaatagttagctttg

SEQ ID NO: 66144 - DNA, 95 bp, Mus musculus
tgcaatgggcaagtacaatttatttgataatatgcttgtgtgaaatttccatatacattgtataaaactggaatataagtacttttcttattgca

SEQ ID NO: 66145 - DNA, 85 bp, Mus musculus; identical to SEQ ID NO: 57439

SEQ ID NO: 66146 - DNA, 113 bp, Mus musculus
catgaggagaagaggaaagagtgaatggacacagttatgaacgagtctataaagctaattgtttgtatagttctaactctgtcatggattttatttttagtagtagctacatg

SEQ ID NO: 66147 - DNA, 114 bp, Mus musculus
ttctaaggaaccagtctagtttatctaatttattaaatttactggtatatctatgtatataatttattacgtctttagtgtatggatggtctctggtttctggtgcctacagaa

SEQ ID NO: 66148 - DNA, 85 bp, Mus musculus; identical to SEQ ID NO: 57439

SEQ ID NO: 66149 - DNA, 81 bp, Mus musculus
ttgtctctgcgtctctgtgagtgtgggacataacggacctaaggcttttcgggtcttacagacgcatggagggagagccaa

SEQ ID NO: 66150 - DNA, 100 bp, Mus musculus
ggctttggcaccaaaattctagattttatttttgcattggggtaggcaaatatatttgatttttcttcagtgcatgaaaggagatagttggcctcagatc

SEQ ID NO: 66151 - DNA, 82 bp, Mus musculus
ttggttggccactctcactatctctgagccattattatctcagtgatggggcatctttcaggtaggacatgttgctagtcaa

SEQ ID NO: 66152 - DNA, 108 bp, Mus musculus
gagaagctacatgctgtgggactgaatcatagggaattcatggtgtctctagagatttcattatgtatattaatgatttccctacattaagatgtatgtttgccactt

SEQ ID NO: 66153 - DNA, 78 bp, Mus musculus
acagatggacagacagacagacagacagagagagaaagcatggtgtgtctgtgtgtgagtgtgtgtgtgtgtgtgtgt

SEQ ID NO: 66154 - DNA, 89 bp, Mus musculus
ttggccatggtggtctgataggatacatgggacaatttcaatatttttgtatctattgaggcctgttttgtgaccaattatatggtcaa

SEQ ID NO: 66155 - DNA, 102 bp, Mus musculus
ttgtgagaactgcaaatcaaaactactttgttattatatttatcacccatcagggagctggagaaatggttcagtggttaagagcatttgctgctcttccaa

SEQ ID NO: 66156 - DNA, 90 bp, Mus musculus
agactgtagtttattccgaggaaaactctcctggatgggcatactagcaacattttatttatatcaagattcctcggactactacagttt

SEQ ID NO: 66157 - DNA, 102 bp, Mus musculus
tgtgatatcagcctcttatctcctcacagtgttcaccacttcaaataattaggaagttggatatattgttcactgttagaagaattccaggggcatattagg

SEQ ID NO: 66158 - DNA, 106 bp, Mus musculus; identical to SEQ ID NO: 58252

SEQ ID NO: 66159 - DNA, 87 bp, Mus musculus
ggcagagaacttctcttggtgtcctggctagtcctagtcactcccactgactcttgccaatttggtggaggcctggtagtttctgct

SEQ ID NO: 66160 - DNA, 110 bp, Mus musculus
ggtaggtgggttggcttcgtgaaaagtgtgtctgagagcacagagaggtctaatggtgggaggttagacgtgtgtatcctcagaggaccctgaaccaactccagtgttcc

SEQ ID NO: 66161 - DNA, 77 bp, Mus musculus
tgtgatatgttatgatatgatatgatattatatgatatgatatggtgtgatatgatatggtatgatatgaagtcaca

SEQ ID NO: 66162 - DNA, 138 bp, Mus musculus
ggttttcagataggatccagggtgttctttcaatgttcttgtaaatatctcatatttattgagaatttctttatgtctgcttatgaggtcatttttggagcaatgtctgggaggtgctgagaaatttttgattagaac

SEQ ID NO: 66163 - DNA, 85 bp, Mus musculus; identical to SEQ ID NO: 57470

SEQ ID NO: 66164 - DNA, 86 bp, Mus musculus
acgagagggcttttgaaaggttctgacacctagagaagtatatttttctataaacagtcatggatattctgctaggtcctaagtgt

SEQ ID NO: 66165 - DNA, 115 bp, Mus musculus
tcttttaattaatcatatattctggtttctacctaactggaaaaacatggattttttttatataaagagctaaacattttgggtttggtcttcagtctgtaggagttttgtggga

SEQ ID NO: 66166 - DNA, 85 bp, Mus musculus; identical to SEQ ID NO: 57439

SEQ ID NO: 66167 - DNA, 82 bp, Mus musculus
gtctggagctgaagatggcgccgcccagaagctctgcgactctcgcctgtcccagaaatggctggcactctgtattccacac

SEQ ID NO: 66168 - DNA, 86 bp, Mus musculus
ttttgagtgtttggggacagtgtctctgtgtggctggccctggctgcactgactgtgcacagagaggctactgcaggcacccaaag

SEQ ID NO: 66169 - DNA, 115 bp, Mus musculus
ttatttcactgagttctaatctggattatatatatatatatatatatatatatatatatatatatatatatatatatatatatacactcataaagattctgacccattatgatga

SEQ ID NO: 66170 - DNA, 107 bp, Mus musculus
tcataatgggtcagaatctttatgagtgtatatatatatatatatatatatatatatatatatatatatatatatatatatatataatccagattagaactcagtga

SEQ ID NO: 66171 - DNA, 73 bp, Mus musculus
gcacaggatgttgctgtgttactgctgtgttactgtgttactccggtattactgtgtgactgtgtgactgtgt

SEQ ID NO: 66172 - DNA, 111 bp, Mus musculus
atatgtgtatgtcaaggtagctatattgttactctgtgtctgtctcttattttgccataggcatgctaggcttataaacacatcctttttcatggtagcctttatatgtat

SEQ ID NO: 66173 - DNA, 68 bp, Mus musculus
agggtgatgcctcagtggctctgtggctctgcctgtcccagaagctgtccggttctgtggtgcaccct

SEQ ID NO: 66174 - DNA, 88 bp, Mus musculus
tccgtgccttcttcactctctgtcagcatctctttttcgttcataagaaggaagtacagtggataatagatagagatagaaggatgga

SEQ ID NO: 66175 - DNA, 112 bp, Mus musculus
gccttaggccatggtggtctgataggatacatgggacaatttcaatatttttgtatctgttgaggcctgttttgtggccaattatattgtcaattttggagaaggtcccgtg

SEQ ID NO: 66176 - DNA, 105 bp, Mus musculus
tatgtccggggcctcatatcagctggtgtatgctgcctggttggtgtctcagtgtctgagagatctcgggtttccaggttagttgaaactgttggtcctcctata

SEQ ID NO: 66177 - DNA, 98 bp, Mus musculus
gttgttccctgtgtttgtaggaaagtcaaatttagagcaggagagatggctccatggttaagagcactgactgctcttccaccggacacaggttcaat

SEQ ID NO: 66178 - DNA, 97 bp, Mus musculus
gtgtgtgtgtgtgtgtgtgtgtatactgttccaaattcctttattattttatttctataggagagagagacagagacagagagagagacagagagac

SEQ ID NO: 66179 - DNA, 82 bp, Mus musculus
caggaaattagaagacagtgtcagatcacctggaactggagttccagacatttgtgtactgacatgtgggtgctgggaactg

SEQ ID NO: 66180 - DNA, 85 bp, Mus musculus
agacccattaacagtaagtatgtcctgggttacagctttcaatggactcgtctattggtctgtctgtctgtctgtctgttggtct

SEQ ID NO: 66181 - DNA, 85 bp, Mus musculus
gatatatagatgtgtgtgagtaacacatatacatatatataatgtgtgtgtatgtgtgtgtgtgtgtgtgtgtgtgtatcaaata

SEQ ID NO: 66182 - DNA, 83 bp, Mus musculus
gtaccccccggagctcgtgtctctagctgcatatgaattggcctagttggccatcagtggaaagagaggcccattggtcgtgc

SEQ ID NO: 66183 - DNA, 95 bp, Mus musculus
gatcagcttagtccatggtgatctgataggatgcatgggataatttcaatatttttgtatctgttgaggcctgttttgtgaccaattatatggtc

SEQ ID NO: 66184 - DNA, 82 bp, Mus musculus
tctatctatctgtgtgtgtatatatatatatatgtacatatatatatgtgaaaaatatatgtatacatatgcaatccatgga

SEQ ID NO: 66185 - DNA, 103 bp, Mus musculus
gtttcatttagaatacaagcattggcatccactcaaaatcactcactgtatctatagtctgagaaataagctgatcagtggtggcatgcattttaattctagc

SEQ ID NO: 66186 - DNA, 116 bp, Mus musculus
aataccagagacagaaatcatggaggaacatcttagcattttctcacaagtagctttgatgtggtgactagtgatgcaaagaagctgatggatctttgagataattaaaaagtatt

SEQ ID NO: 66187 - DNA, 78 bp, Mus musculus
ctcatagatgtggaagatggtagtttagtggtagatctgcccaatctaggcacacagcatctattcatattaattgag

SEQ ID NO: 66188 - DNA, 59 bp, Mus musculus
gcggtcagttgctgtgctcagtctaatggttggctgtgagcatctgcatctgtatttgt

SEQ ID NO: 66189 - DNA, 84 bp, Mus musculus
tctctctctctctctctctgtatgtatatatatatatatatatatatatatatatatatatatatagatagatagatagataga

SEQ ID NO: 66190 - DNA, 85 bp, Mus musculus; identical to SEQ ID NO: 57439

SEQ ID NO: 66191 - DNA, 105 bp, Mus musculus
aattgctgtggaaaacttgactgtcttgattttgagtctttgctttctgaaaagaatgtggatgacttctgaactttaaactgcaaaagccattcatgagcaatt

SEQ ID NO: 66192 - DNA, 96 bp, Mus musculus
agacagattgtcaacctaccaacagaaccatgtcattatatttaatatttaggagttctggtattttgtttggttcctggaaacttgactatgttt

SEQ ID NO: 66193 - DNA, 91 bp, Mus musculus
tccctgggggtttccagactctaagtattcttttgtacctgggctgaaaggggtagagtagagtatttgttgagtatgtaaactgggaaac

SEQ ID NO: 66194 - DNA, 104 bp, Mus musculus
ggtctttagttctattccattgatctatctgtctgtcactctaccagtgcaatttttatcgcaattgctttgtagtacagcttgaggtcagggttggtgattcc

SEQ ID NO: 66195 - DNA, 88 bp, Mus musculus
gagtgaggtgctttgtgttagttctgagtgagcacagaaatgtaatctttcattaattactcagttgtaaccaatatcagcattgctc

SEQ ID NO: 66196 - DNA, 89 bp, Mus musculus
ggtgtctgtatacggatgggcttatttctgagtctgtgactcagttccattgatcaacctgtttgtttctattaatatcatgcagtgtc

SEQ ID NO: 66197 - DNA, 69 bp, Mus musculus
atatgtgtgtgtgtgtatgtacatgtatatgtatattatgtatatgtatatgcatttgtatatgtatat

SEQ ID NO: 66198 - DNA, 72 bp, Mus musculus
acatacatatctacaatcacacacatatatatatgtatgtatgtatgtatgtatgtatgtatgtatgtatgt

SEQ ID NO: 66199 - DNA, 103 bp, Mus musculus
tattttattttgccagaatgtatgtatgtatgtatgtatgtatgtatgtatgtatgtatgtgtgtatgtatgtacatacatatgtatgtatgcatgtgtaata

SEQ ID NO: 66200 - DNA, 108 bp, Mus musculus
ggtcctgggctttttttggttgagacactattaatgactttttctatttctttaggggatataggactgtttagatcattaaactgatcttgatttaactttgctacc

SEQ ID NO: 66201 - DNA, 65 bp, Mus musculus
gtactagttggcaggagcctgatatagctgtctcctgagaggctctgtcagtgcctgacaaatac

SEQ ID NO: 66202 - DNA, 85 bp, Mus musculus; identical to SEQ ID NO: 57439

SEQ ID NO: 66203 - DNA, 116 bp, Mus musculus
ggatctgatggtgttttggatttcttcagggtttgttgttatgtctccttttcatttctgattttgttaattaggatgctgtccttgtaccctctagtgagtctagctaaggattt

SEQ ID NO: 66204 - DNA, 86 bp, Mus musculus
gaaagtccagcaaaaggcccaagttcggattcagttcaaagggaggccccaatgtctgacactatcactgaggctatggaacactc

SEQ ID NO: 66205 - DNA, 87 bp, Mus musculus
gctctattcaagtaaattggaatgcctgagttctttcactgtctctcccacaatactagaggtaattttcaatgttactgaataggt

SEQ ID NO: 66206 - DNA, 85 bp, Mus musculus; identical to SEQ ID NO: 57439

SEQ ID NO: 66207 - DNA, 105 bp, Mus musculus
gagaaatgtctgaccgtgtatactgctagtacataatattctttgggctccagacagaagacacaatgctcacatagctcttacactctggtcagttgtaaactt

SEQ ID NO: 66208 - DNA, 100 bp, Mus musculus
cagacacacagacagacacacacacacacagacacacatatatatgtatacatatgtatatgtgtatgtgtgtgtatatgtatatgtatatgtgtgtgtg

SEQ ID NO: 66209 - DNA, 106 bp, Mus musculus
agcagtatgtgctgtagcctggagcacctatttgatgcatttacttattttcatgttcatatttgcaatgaagccagggagatgcttctgcacagctggatctgtt

SEQ ID NO: 66210 - DNA, 85 bp, Mus musculus; identical to SEQ ID NO: 57470

SEQ ID NO: 66211 - DNA, 112 bp, Mus musculus
tggtaagtataaaatcataaattggttccagaacactgagttttgagtgaaagcatattaaatttttcttattgaaattaactctggaactcagtcatcatttatgaggcta

SEQ ID NO: 66212 - DNA, 108 bp, Mus musculus
tatttgtatttgtatttgactcagcagactatatttttatatttgtgcatgtacatgcacacacatattcaaaaaaagagactgttaatttgataacagggataaatg

SEQ ID NO: 66213 - DNA, 79 bp, Mus musculus
tgagtttcatgtcatatcaagttgcagtctcgcactactctgcacctagtcttactgcaacttgatatgacaaagctgg

SEQ ID NO: 66214 - DNA, 85 bp, Mus musculus; identical to SEQ ID NO: 57439

SEQ ID NO: 66215 - DNA, 107 bp, Mus musculus
tgtgctcgggaataatgacatcatcccattaaggactgaatgctccaaagtctctcactctctgtatattgtccagtcgtggatcactgtgtgcgttatctagtaca

SEQ ID NO: 66216 - DNA, 85 bp, Mus musculus; identical to SEQ ID NO: 57439

SEQ ID NO: 66217 - DNA, 90 bp, Mus musculus
ttcagtttcccacctgtgaaagaacagagttttttttccatccagggctgtgggaggattaagcttgttaagcatttagggaaccttgaa

SEQ ID NO: 66218 - DNA, 70 bp, Mus musculus
ctgtgtgtctgtgtgtctgtgtgtctgtctcctacttggggatcaggatgtaaactgttagctactacag

SEQ ID NO: 66219 - DNA, 85 bp, Mus musculus; identical to SEQ ID NO: 57439

SEQ ID NO: 66220 - DNA, 83 bp, Mus musculus
acacactgtgacacactgcagcttccataatgagatattttctatgaatttttttgttagtgtgtgtgtgtgtgtgtgtgtgt

SEQ ID NO: 66221 - DNA, 112 bp, Mus musculus
ggagcctgatcaatacagcttagggtaagcgtctgttccttgcgatctttcctgtctctctctgtgggtctgtgagtaagtgccgtgctatttttgttgtgcagtctgcttt

SEQ ID NO: 66222 - DNA, 88 bp, Mus musculus
tatgtatgtatgtatgtatgtatgtatgtatacatgcatagtatttatatgtatgtgtgcatgcgtgtgcgtgtgtgtgtgtgtgtgt

SEQ ID NO: 66223 - DNA, 81 bp, Mus musculus
gctgtgagtatctgcatctgtattggtcaggcctctcaggggacagctataccaggctccagtcagcaggtgcttcgtggc

SEQ ID NO: 66224 - DNA, 76 bp, Mus musculus
gagaagagtgagcactgccgtggtgggtctgttcctttggttagttagatccactcactcactcactcactcactc

SEQ ID NO: 66225 - DNA, 104 bp, Mus musculus
gatttggcccttgaaccttcttcacactgtactgtcattgctgtgggtttcctcctctagttaggacatgttagtgaccagtgcagaaggaaacctcccaagtc

SEQ ID NO: 66226 - DNA, 114 bp, Mus musculus
gaagaaataaactctaggctgttttctgatgtatttgctcctctgtgtgctttctctctctgtttgagctagcaggctttcaccacagcgtctgacttctgaggcttcacttag

SEQ ID NO: 66227 - DNA, 111 bp, Mus musculus
ttgaagatcagccttagtccgtggtgatcagataggatgcatgggataatttcaatatttttgtatctatggaggcctgttttgtgaccaactatatggtcaattcttgga

SEQ ID NO: 66228 - DNA, 94 bp, Mus musculus
ggcagctatccactagacccatggacctctcaaagagtgcgagcacacagggcccacacactggtgatggaagggtgggtgcagtggtggcccc

SEQ ID NO: 66229 - DNA, 86 bp, Mus musculus
gtgtacacctcgggattaaatgtaagggaactatcggaaaatcagaatacttctgtgtctcatagtctctcagggagggtgaacac

SEQ ID NO: 66230 - DNA, 105 bp, Mus musculus
ggtgtctgtctatctgtgtctctttccctgtataatatatatatatataaaacgtgtatgtgtgtgtgtttgcaatgttgcctttggaagccagaagagggcgct

SEQ ID NO: 66231 - DNA, 80 bp, Mus musculus
gcatcactggactaatctcttcagtacttgcatcagtcaggggacctttgtgcacactgagagaggagacacaggggtgt

SEQ ID NO: 66232 - DNA, 61 bp, Mus musculus
ttcaggctggagagatggttcagctgttaagagcactgactgctcttccagaggtactgag

SEQ ID NO: 66233 - DNA, 95 bp, Mus musculus
ggctcaatgcagtaatctctggtggtttgtacagatggtcacacccaggtgggtacctcttgacagaacagtgtgaggatgctcatgagtgagcc

SEQ ID NO: 66234 - DNA, 80 bp, Mus musculus
accatgagtgtaatagatgtgtgtgtgtctgtgagtccacgggtgccccagagaacaccggaccccttgcagctggtggt

SEQ ID NO: 66235 - DNA, 118 bp, Mus musculus
tccttgagatgatgatgtggtctctgtctctgagtctgtttatggaagaagtatatttaattttacacatgttgaaccattttgcattgctgggatgaagccaacttggtcatgagga

SEQ ID NO: 66236 - DNA, 71 bp, Mus musculus
cagttcccaggcatactcagttcatcatggccaggaagtcctgtcagcagactgtctgtgtgacagagctg

SEQ ID NO: 66237 - DNA, 126 bp, Mus musculus
gtgtgtgtgtgtgtatgtatgtataatgtgtgtatatacatgtgtgtatatatgtatatatatagtgtatgtatatatacataagtattacatatatatacttatatacactatatatagtatata

SEQ ID NO: 66238 - DNA, 112 bp, Mus musculus
tgttttcgctaggaggaaaaagtactgatgtgtcactgagcattgctgtatttatttttaaatggaagctaaaattctgatatttaacagattttcttgtttggtttgaaca

SEQ ID NO: 66239 - DNA, 134 bp, Mus musculus
ctacctcactgagagctttgaagtttcacatcctggctctccattctcttcatgtttcctgggtgtggtagtagatacagtgacagtgacgtcagccagcttcctgctctgactgccataccttccctgcttga

SEQ ID NO: 66240 - DNA, 85 bp, Mus musculus; identical to SEQ ID NO: 57470

SEQ ID NO: 66241 - DNA, 70 bp, Mus musculus
acggtcactcactggcccacaggagcttgctgtggtcacacgttctctgtggttctctctgagtcactgt

SEQ ID NO: 66242 - DNA, 82 bp, Mus musculus
aattatgtgtatgtatatgtatgtgtatgtgtatgtgtatgtgtatatgtatatgtgtgtatacatatacatatatattttt

SEQ ID NO: 66243 - DNA, 157 bp, Mus musculus
gctggcacacctggctctgtggccctgtggccctgtggccctgtggctctgtgtccctgtgtccctgtgtccctgtgtccctgtgtccctgtgtccctgtggtcctgtggccctgtggccctgtggccctgtggccctgtgatgtagttcagctgac

SEQ ID NO: 66244 - DNA, 158 bp, Mus musculus
gtatatatgtatgtatgtatgtatatgtgtgtatttgtgtgtatgtatgtgtgtgtatgtatgcatgtatgtatgtatatgtattatatgtgtgtatgtgtgtgtacatagtatatatgtgtgtatacatgtgtgtacatatgtctatgcatgtgtgt

SEQ ID NO: 66245 - DNA, 72 bp, Mus musculus
catgaatcaggcacagagctgcagccaggtctttcagactatctgagacactgactcacgtgtgatatcatg

SEQ ID NO: 66246 - DNA, 79 bp, Mus musculus
tgatgtatgcaattgatgtatatgatatatgtgatgtataaatatatatatgtctatatatgcaaatatatatatcaat

SEQ ID NO: 66247 - DNA, 131 bp, Mus musculus
tatatgtatatatgtacaaattgcagatatacacatatgtctatatacttgtatatatgtatatatgcatatgtatttatgtatatatgtacacaaatatgcatatatacacacatatatataaaacatat

SEQ ID NO: 66248 - DNA, 120 bp, Mus musculus
cgatggttgtgagccaccatgtagttgctgggatttgaactcaggacctttgaaagaacattcagtgctcttaacaactgagccatttccccaggccctctcaggagttctaacacatgg

SEQ ID NO: 66249 - DNA, 85 bp, Mus musculus; identical to SEQ ID NO: 57439

SEQ ID NO: 66250 - DNA, 79 bp, Mus musculus
gtttcaggcacctccataagtgcacaacagaaaagaatgtgtgaatatatttttctgattgtcatacaggtgatgttac

SEQ ID NO: 66251 - DNA, 103 bp, Mus musculus
ctctgttttattatatgagttatgaatgccctacaggaacttggttgatatgttatgaatttgtttcttctggacatttttgtaaaacatcattgaaatggag

SEQ ID NO: 66252 - DNA, 112 bp, Mus musculus
gggatgccataaagagaatccactgtgaatatgaagttaagatttttctttttaaaagatctacatagttcagttaatttttctttatatgtgatttttgtaatgcagtacc

SEQ ID NO: 66253 - DNA, 75 bp, Mus musculus
ttattatatatatatgtgcatttatatatttatgtgtgtgtatatatatatatgtgtgcgtgtgtgtatttgtaa

SEQ ID NO: 66254 - DNA, 92 bp, Mus musculus
tctattttcactcttgttatgtgcttgtaatggaaggctgtggtagaactgagttcaatcaatagaagcaaatgagcagagagagataaaga

SEQ ID NO: 66255 - DNA, 117 bp, Mus musculus
gagagacagagacagacacagacacagagatagacacaaagacataccctgagagatttattaattttttaatgcattttgtgttatatcacattctggttgtcattatcttctttt

SEQ ID NO: 66256 - DNA, 119 bp, Mus musculus
tcacttttgcaattgttgtgactcagttcatatcctaaatagagcctccccaaagtcagtagaaagtgaacactctcaaggaattgaggctcagctacattacaacaatttcttgatga

SEQ ID NO: 66257 - DNA, 103 bp, Mus musculus
catacatgtgtgtatatatatgtatgtgtgtatatgtatatgtatgtatatatacatacatatatactatatataaaacatctattatatatacatatatatg

SEQ ID NO: 66258 - DNA, 85 bp, Mus musculus; identical to SEQ ID NO: 57439

SEQ ID NO: 66259 - DNA, 85 bp, Mus musculus; identical to SEQ ID NO: 57439

SEQ ID NO: 66260 - DNA, 109 bp, Mus musculus
taaatgaacatagcattacattgattcctaatgatatatatatatatatatatatatatatgaatgaaatgctatacatttatatatatatgctatatatacatttcat

SEQ ID NO: 66261 - DNA, 105 bp, Mus musculus
tatgtatgtatgtatgtatgtatgtatgtatgtatgtatgcatgtatgtatgtatgtattatgtgtgtagatatatgaatgtgcatgtatattggtatgtatatg

SEQ ID NO: 66262 - DNA, 90 bp, Mus musculus
ccttgaatttagatctgtctgtctctgtctcctggaattaaaggcctgtctgtattccaggaggagaagacagatctagaagatctttgg

SEQ ID NO: 66263 - DNA, 106 bp, Mus musculus
ctcctacttcctgggactgcagcaagcccagcagctgagaactctgcctcactctatcagagctccatctgctttctgatctgcacagctacctatgatctaggag

SEQ ID NO: 66264 - DNA, 105 bp, Mus musculus
attgaccatcagccttagtccatggtgacctgataggatgcatgggataatttcaatatttttgtatctgttgaggcctgttttgtgaccgattgtatggtcaat

SEQ ID NO: 66265 - DNA, 85 bp, Mus musculus; identical to SEQ ID NO: 57470

SEQ ID NO: 66266 - DNA, 105 bp, Mus musculus
gaaaggtgtggtacaaataatagtgagtgctttgttttagtataaataactatgtgatcctatagtcaaaagttaaaggtaagtaaggttttgtccatacttttc

SEQ ID NO: 66267 - DNA, 109 bp, Mus musculus
tttatctcctatatacagcttagaaataaggtaatgcttactgtgtctggttaactagacagctatgtactcattccttgtgcagctacactgaccaggtgttgatgaa

SEQ ID NO: 66268 - DNA, 89 bp, Mus musculus
ctggatgtgcattgtcaatttgttaatctgagagttagaatctcttcctgaaagtgatctcagaatgaattagttttgtattgagccag

SEQ ID NO: 66269 - DNA, 68 bp, Mus musculus
gcatgtatgtatgtatgtgtgtgtatatatatatatgtatacacacacacatatatatgcataactgc

SEQ ID NO: 66270 - DNA, 109 bp, Mus musculus
gcacggcttcctccaagttaaaccctgtggcctgtgctatctgtgtccctcagtcagtcccagatgaactacattgctgagagccggcgtagatttccatgtggttaca

SEQ ID NO: 66271 - DNA, 94 bp, Mus musculus
acaaaaatccacccccaagttacagaggctcagttctgaaccagtacgaaatgagatccgggctaagagtgtaagctgggtgctgattggctgt

SEQ ID NO: 66272 - DNA, 79 bp, Mus musculus
ccaaaataaaagtttctttttataagttgctttggctatgctgttttgtcacagcaactgaaaagtgactaagagttgg

SEQ ID NO: 66273 - DNA, 91 bp, Mus musculus
acaatcattgaagaacacatttgaattttaaataaggcctgggctttatttagagagaagagagagtccagtggttctctaatgcatttgt

SEQ ID NO: 66274 - DNA, 64 bp, Mus musculus
agacaaatcaaagtagagggacagtcacccaaaccagtctctctctctctattctatgttgtct

SEQ ID NO: 66275 - DNA, 75 bp, Mus musculus
ctaccccttctctttgtctgtcagtcagacctgttacttatgtctaatgaataagacaaggtaaaggagatggtg

SEQ ID NO: 66276 - DNA, 76 bp, Mus musculus
gtatgtatgtatgtatgtgtgtatgtatgtatgtgtctgtgtgtatgagtgtgtgtgcatgtatgtatgtgtgtat

SEQ ID NO: 66277 - DNA, 83 bp, Mus musculus
gctccatcactgtttggctgtgggtctctgcctccctctgagtcaggtgcttggtggagcctctcataggacagccatgttag

SEQ ID NO: 66278 - DNA, 95 bp, Mus musculus
acatttccctggccaattgttgagcacacaacgtttttttttatttcaacagcgtgaacttgtgcaacggcagcagataacctccagggggcagt

SEQ ID NO: 66279 - DNA, 98 bp, Mus musculus
tgtatgtatgtatgtatgtatgtatgtatgtatgtatgtattttacatcccagtcacagcatacacacacacacacacacacacacacacacaccaca

SEQ ID NO: 66280 - DNA, 113 bp, Mus musculus
tcttctctcagcagtgctgtgatgtcatctggtacagatccatgcatgccctatgcacactgcctctgtctctatgaattcacatgggcatcagtcttggtgaatcaagaaga

SEQ ID NO: 66281 - DNA, 63 bp, Mus musculus
tctcaaagatatacatatatatgtatatcttatatatacaagtatatctgtatatctttgaga

SEQ ID NO: 66282 - DNA, 85 bp, Mus musculus
tatatatatatacatatatgatatagtgtgtatatgtaatatatagtgatatatgtatgtatgtgtatatacatatatacatgtg

SEQ ID NO: 66283 - DNA, 79 bp, Mus musculus
ccttcccaaacactgcctctgtctcaggctccccgggtgcaagaattctgagaagggaaaagctgctgtgctgggaagg

SEQ ID NO: 66284 - DNA, 114 bp, Mus musculus
tgctagtttgttttatcattgaagaattgagatcactaacattgagagttatgaagtatgtattaattcatgacattttgttgggtttttttttaaatgtttgatagatttcca

SEQ ID NO: 66285 - DNA, 70 bp, Mus musculus
tgtgtgtctctgtgtgtgtagtgcagggctatttaaatgctaaccaagtgctctaccactgagccacata

SEQ ID NO: 66286 - DNA, 70 bp, Mus musculus
ggactgtctaagagagaagggagtgagctaagtactagaagcatccgattttctctgctcttgactgtgc

SEQ ID NO: 66287 - DNA, 66 bp, Mus musculus
gggagttcaacaacaaacagactcttcccaggaccctgcacaggtgtctgtctgtctgtatctccc

SEQ ID NO: 66288 - DNA, 73 bp, Mus musculus
actctctcagactctctcatggggagtgggttaaagcagcgctttaagtctatgaagagggtaagattggagt

SEQ ID NO: 66289 - DNA, 68 bp, Mus musculus
cattaatacagaggatagtgagcacactcttgggggtccccaaggctcactcttatgtgtgtgtggtg

SEQ ID NO: 66290 - DNA, 85 bp, Mus musculus; identical to SEQ ID NO: 57439

SEQ ID NO: 66291 - DNA, 90 bp, Mus musculus
gagattccaagcttcctcataccacccagtacttgttactgtgtgtctctcaatatgtcttaggtgcgaggtggcagtgtgttttgtctt

SEQ ID NO: 66292 - DNA, 116 bp, Mus musculus
tcttcctactgggttgccttgtgtaggaaaggaggtgcctagtcttactgcaacttgatatggctggttaataactgtgggaggcctgtcctttcctaaagagaaactgaggaaga

SEQ ID NO: 66293 - DNA, 114 bp, Mus musculus
gctatgctgcagaagaacccgtgtgtgtcctgtgtgtgtgtccttgctggcgagactccatatcatatcacagacacaattggcaaaaatgggttgttttattcgaatcttagc

SEQ ID NO: 66294 - DNA, 72 bp, Mus musculus
tatgtgtgcctgtgtctctgtgtgttcatgttgtgtgccatgctatacatgtggagatcagagggcaacata

SEQ ID NO: 66295 - DNA, 75 bp, Mus musculus
ggtctacctggctcacagtttgcgaatgcagtcagtcatggccaggaagtcatgcaagcaggagccacgatagcc

SEQ ID NO: 66296 - DNA, 66 bp, Mus musculus
tgggtagtgctttatgacatgagcctgatatagctgtctcctgagaggctctgtcagtgcctgaca

SEQ ID NO: 66297 - DNA, 89 bp, Mus musculus
ccagatgtgcatgcagcaggttatggtatcttaagatctgtctccggtcctgtcagaaaatgagattcatgcctgctgaaggacactgg

SEQ ID NO: 66298 - DNA, 75 bp, Mus musculus
tcataggtgcttctgtgttcaggagaatcctaagcttaagataatggacatctctctgacactgcctgtctgtga

SEQ ID NO: 66299 - DNA, 97 bp, Mus musculus
gccttgaatttgcaaacctcctgcctgttcactcgagtagctgaaatcaagagacctgtgtgagcacagccagctaaaggtgttcattttcatttgc

SEQ ID NO: 66300 - DNA, 150 bp, Mus musculus
ggggatagtcaaaggcaggtgggaggaaatttttactgtgatcattccaggtagagggcagtcttgtgtgtgagtctgtttgtctgtccctgtggcactgaagatcaaacccagagcctacggatgataagaaccactaggatacacccc

SEQ ID NO: 66301 - DNA, 113 bp, Mus musculus
agaggtagacagcaggtgcctgtcctgtcaccccaccttattcctctgagacagtcacacactgtatctagagctatgccggctgtcagcaagccatctgcctgtctccatct

SEQ ID NO: 66302 - DNA, 79 bp, Mus musculus
tactgggaggaaggtgaccatgggacacagcagagtgagaagagaaagcactaaagtcccagggccatcaatatcagtg

SEQ ID NO: 66303 - DNA, 90 bp, Mus musculus
gtatgagtgaggtcctataactcggctgatgaaggagctcccaggctcactctatgccagcctccagagctaagtgaccatctacttgac

SEQ ID NO: 66304 - DNA, 114 bp, Mus musculus
tctgcatcccacagtgtgcacagtggcctggtcatggagattggaactttatttctatatttcacacaaaacagtccccttatcatcagtctacaaagtcacttctgtcaaaga

SEQ ID NO: 66305 - DNA, 72 bp, Mus musculus
gctggagggatgatggctcagtggttaggagcactgactgctcttccagaggtcctgagttcaattcccagc

SEQ ID NO: 66306 - DNA, 81 bp, Mus musculus
gagctagtctgttcctggaggctttctcggtcttataattgtttgaaatgaagtaagtctctggtaaaacctgattgggtt

SEQ ID NO: 66307 - DNA, 85 bp, Mus musculus; identical to SEQ ID NO: 57439

SEQ ID NO: 66308 - DNA, 75 bp, Mus musculus
actctgaagatctgtcactgtgtcacagccactgtgttacattataaatgcacgtgatggcttggaaatcagagt

SEQ ID NO: 66309 - DNA, 104 bp, Mus musculus
tgtgggtggctgtggggctggagagatggctcagcggttaagagcactgactgctcttccaaaggtcctgagttcaaatcccagcaaccatatggtggctcaca

SEQ ID NO: 66310 - DNA, 99 bp, Mus musculus
tctatctatctatctatctatccgtctgtccgtctgtccgtgtgtgtgtgtgtgtataagagagagagagagagagagagagagagagagagagagaga

SEQ ID NO: 66311 - DNA, 113 bp, Mus musculus
tctccagtgcttgcccatataatggctgtccctgaaagtactgagacagtcccggtcggtcggtcggtcggtcagcagctttctcagaccagcagggagccattcactggagg

SEQ ID NO: 66312 - DNA, 115 bp, Mus musculus
tcagtctcagaggtattaatcagttacattgtttagtattttgatggatagtattgtatcaatatttacatatttgttgacattatcactgatagagtacttagaagagccctgg

SEQ ID NO: 66313 - DNA, 84 bp, Mus musculus
accagtgtgtgtgtgcatgtgcatgtgtgtatgtacatgagtgctcatgtgtatgtatgtgtgtgtgtgtgcacatgtgtgtgt

SEQ ID NO: 66314 - DNA, 105 bp, Mus musculus
ggtgttgtaggttaatcagaaaacacactgctgtgcttgttggttgtatgccatctgtcagcagcattctcgaagcagttctttttgatatgaaggtaggaagct

SEQ ID NO: 66315 - DNA, 97 bp, Mus musculus
gcctttgccaggattacaggtgtgtgccatctctgcctggctgattctatccaacatttaaatgagcacttgagcttgtagtcctgtttcataagca

SEQ ID NO: 66316 - DNA, 118 bp, Mus musculus
cctaggtctttgagcacgatagacaagtagccctgctacttttttagattgtatttcaaggtagtatctaagttacacagggtttccttgagtttgtgacccttttcttggcctctgg

SEQ ID NO: 66317 - DNA, 77 bp, Mus musculus
tgacaactgatgctagagagacagctctgtggtcagggcacttcctgcttttgcagagcacctcagttcagttccca

SEQ ID NO: 66318 - DNA, 59 bp, Mus musculus
gccatgcatctcttagagcatgtccttgtttagaagtgacatgtgactgtgatcatggt

SEQ ID NO: 66319 - DNA, 107 bp, Mus musculus
ggctgtgcagcactgaacctccatttgttctatctccattctctctcacagtgactgtgggaggtgctggtatgaacacgcaaagatgagactgtatgtgcactgct

SEQ ID NO: 66320 - DNA, 80 bp, Mus musculus
agccacaccaaggcagcatggggacagacctcagggtgtgagctcatctgaggactctggaactctgtgtcactgtggct

SEQ ID NO: 66321 - DNA, 125 bp, Mus musculus
tttcctgcggcttcccttctgttaaactattgattctttgtctgggcagctgacaggcagctttgatgtggggatctgttgtggtttctagaggaaggagatattggtgggaggatttacagctg

SEQ ID NO: 66322 - DNA, 87 bp, Mus musculus
ggttaggcctttctgcgtccacacggttcttcctcctgggttgattctggagcttctggaggtgaactggaccggagtcaacaaacc

SEQ ID NO: 66323 - DNA, 76 bp, Mus musculus
ctgggttcatcacatgggatcttgttccttacaaaggagcacagagagacaagagagtgagtagatatgaggctag

SEQ ID NO: 66324 - DNA, 108 bp, Mus musculus
gagccttcatctgtcgccacttctgtctctagcccacctctccctctctctgacccatgagacactaagaaaagggtgaggtggaacaacagtgtgcagacagtgctc

SEQ ID NO: 66325 - DNA, 62 bp, Mus musculus
ggcagtggtactaggctgtattcttgcttagggagggacacactgtagtgaaagacagtgcc

SEQ ID NO: 66326 - DNA, 69 bp, Mus musculus
gacctgaggccactgccaggtgtgacaggtgtgtgctgccactctatctctctgtgtgtccttggtgtt

SEQ ID NO: 66327 - DNA, 74 bp, Mus musculus
ggctgtggccacagtgggcagaggtagaaggcatgtgctttaagtcctctctcactgactctgaggccatagct

SEQ ID NO: 66328 - DNA, 71 bp, Mus musculus
caggagtcagggctgggttctatagctccaaggcctgctgtccatgagtgactctcagactctgcctcctg

SEQ ID NO: 66329 - DNA, 80 bp, Mus musculus
gcacatacatagtaaatataataaatgaatgtgcacacacgtgtgtctgcccgtctgtctgtctgtatgtatgtctgtgt

SEQ ID NO: 66330 - DNA, 68 bp, Mus musculus
ttctgaaggttctcatggcccataagaaccattgctcctcacttgtgagtctgagaacactctgagaa

SEQ ID NO: 66331 - DNA, 66 bp, Mus musculus
ttactgaatatatatatatatacatatacatatacatatgtgtgtttatgtatatatattcagtag

SEQ ID NO: 66332 - DNA, 87 bp, Mus musculus
ttctgttcctgtctgccacaagagcccccatgccttcaggagataacgcctctctctctgtctcagctctttgccctctgaatagaa

SEQ ID NO: 66333 - DNA, 106 bp, Mus musculus
ggtcctcctcagctacttagtgagcttgatacataaatgtatcactgtatacgaactgtgtatcactgtgtatcactgtgtatcactgcccaggagtcataagacc

SEQ ID NO: 66334 - DNA, 87 bp, Mus musculus
gaggcagatctctgagtttaagacagtctggtttacatagtttttatttctagtgaaacccagagttatatagtgagaccatgtctc

SEQ ID NO: 66335 - DNA, 125 bp, Mus musculus
gtgggctcctgggttgctggaagtccgtggcactttttaacaccgctctacgtcagtcactctggctgtccatgtcgggaccccatgtcaacttgtgtgctgggctctcgtgggaccgacctgga

SEQ ID NO: 66336 - DNA, 85 bp, Mus musculus; identical to SEQ ID NO: 57439

SEQ ID NO: 66337 - DNA, 112 bp, Mus musculus
tttcatgcagctggtagtagctttcttaagttactctatatttgttactttgaaaatatttcattttctgtattctaagtcttaagttactttctgctacctagatttgaaa

SEQ ID NO: 66338 - DNA, 68 bp, Mus musculus
ggatggggggctggagagacagctcagcagttaaaagcactgactgctcttccagaggtcctgagttc

SEQ ID NO: 66339 - DNA, 73 bp, Mus musculus
atatatatatatgcatgcatatgtgtgtaaatacatgtggggtttgcatatacatgtatttatgtttgtatgt

SEQ ID NO: 66340 - DNA, 106 bp, Mus musculus
agcgtagataaagtggggaatctttgatctgtgactctgactgtttctaagtgatgtgcttgctgggagcagacactgtccatgccctttcactgtgctatcagct

SEQ ID NO: 66341 - DNA, 72 bp, Mus musculus
tgttgtatgtatgtatgtatgtatgtatgtatgtatgtatgtatgtgtgtgtgtatgtagtatttaacaaca

SEQ ID NO: 66342 - DNA, 105 bp, Mus musculus
tgagagtacacactgctgagtgactgtcagtatataggctctcagaacactgagaggtcgaatattaccctgaaactgtcactggtgccctgcccccctttctca

SEQ ID NO: 66343 - DNA, 132 bp, Mus musculus
acttgagaagttcctgtggctctcagtaactgtcagggagcctcgggagcggtattcttctgtccctctctgggcctcatttccctgtcctcattgccaggccctgtgcagggtgagcagtctctaccgctc

SEQ ID NO: 66344 - DNA, 98 bp, Mus musculus
gctcgttttaatggcaacggcctctccactgaacacactacctcagtgttgcccgtgctgagtgatgtgggtgaggactgctcagacgtaaaatgctc

SEQ ID NO: 66345 - DNA, 68 bp, Mus musculus
gtgtatgtatatatgtatgtatgcatgtatgtattgtatatgtgtgtgtgtattatgtatgtatatat

SEQ ID NO: 66346 - DNA, 108 bp, Mus musculus
atgtgtgtatactagctacatacacacatatatacatatttatatatgtgtgtatgcatatatgtgtatgtacacatatgtgtgtatgtagatatatatatatacaca

SEQ ID NO: 66347 - DNA, 101 bp, Mus musculus
tgtatatatatatatctacatacacacatatgtgtacatacacatatatgcatacacacatatataaatatgtatatatgtgtgtatgtagctagtataca

SEQ ID NO: 66348 - DNA, 89 bp, Mus musculus
gaggggaggaatttgatggagacactccactaaagacagaatattccaatgtatgtcactctctgtgtctctctggttttcttcccatc

SEQ ID NO: 66349 - DNA, 79 bp, Mus musculus
gagctgtagcttgttgacacagttattttgggttcaagtacacacatgttgggcccagtgcacacagactcacagtctc

SEQ ID NO: 66350 - DNA, 72 bp, Mus musculus
ggggagagaggtggctggtcagagtctcaggtgcctgagaatcatcagctctgactggctgtctctcttcct

SEQ ID NO: 66351 - DNA, 84 bp, Mus musculus
gctctagacatattttctagtggaacttctttagatggacactacagatcagagagagtacacactgggataggtttacagagc

SEQ ID NO: 66352 - DNA, 67 bp, Mus musculus
acagtgtggaagacatagcctttctccaaacgcctccgagcagaggcagctgtctctctctcactgt

SEQ ID NO: 66353 - DNA, 86 bp, Mus musculus
tcatatatggcaagaaaggcaaaacttgtggagtagagctagatccttagctctgtcactgtgtggctctcactggccaccaatga

SEQ ID NO: 66354 - DNA, 105 bp, Mus musculus
ccaagtcagtgcctttttttttttttttttttttggcttctttcagttagaaacaacacagcctggagagattaagtaaattatgtaggagcacacaggaattgg

SEQ ID NO: 66355 - DNA, 170 bp, Mus musculus
tatatatgtgttatatgtgtgtgtatatatatgtgtatatatatatatacacatacatatatgtgtatatatatgtatatacatacatatatatacatacatgtatatatatatatacatatagtatgtttgtgtgtgtgtgtgcgcacacgcgcacatatgtatatatg

SEQ ID NO: 66356 - DNA, 74 bp, Mus musculus
ctatttctttatttgcatatatatagatgttttgtctgttttgactgtatatcatgtatgtgcagtccccgtgg

SEQ ID NO: 66357 - DNA, 82 bp, Mus musculus
tctatgagggtctatgagggaaggaggcagcggagcatctcggggaggggccctcttgaccacttctctctgtgtctctagg

SEQ ID NO: 66358 - DNA, 73 bp, Mus musculus
cctgactggtagactagtgatcatctcaggctagctccctgaccaggtcatctcaagcttactttttttcagg

SEQ ID NO: 66359 - DNA, 73 bp, Mus musculus
gaggggagggatttgatagagacgtcccatttagaactgtgagttccaaggtctctgtctgtctgtgggcctc

SEQ ID NO: 66360 - DNA, 115 bp, Mus musculus
gaggagaacaaccaaccgcctcctgtgtggcattttctagaaagtgcatctagatctgtagctacttactgagatgcttttctgaggataatgaagggaggaacgtatgttcctc

SEQ ID NO: 66361 - DNA, 112 bp, Mus musculus
ggggatgctatagctgtcccagttgggatgatacgtcaccattactaattctctgcactttggttacatgtttctgcgttcacccatgcctgctgctatatgaagcttccct

SEQ ID NO: 66362 - DNA, 95 bp, Mus musculus
gtgtctatgtgtgtccatgtgtgtcagtgtgtctgtgtgcatgttcatgcatatgtatctgtgtctgtgtgtgtctatgtatgtcagtgtgtctg

SEQ ID NO: 66363 - DNA, 70 bp, Mus musculus
atgtttgatatatgtatgtatatacatatacatttatgtgtgtgatatgtatacaaatatatatatatat

SEQ ID NO: 66364 - DNA, 70 bp, Mus musculus
aggcacacatgatgcatatatacatatatgtacatatgtatacatatattgtatatgtatatgtgtgtgt

SEQ ID NO: 66365 - DNA, 108 bp, Mus musculus
taagtgctgggattaaaggcctccagtaccaggaaagttttatgtatatgtatatgtgtatatataaaacttatgtgtgtctgagtatggtgtgggtttgagcccttg

SEQ ID NO: 66366 - DNA, 85 bp, Mus musculus
cttctcattgtggagtgttaagaagtaagaccaaggccgggcgtggtggcacaagcttttaatcccagcactccagaggcagagg

SEQ ID NO: 66367 - DNA, 61 bp, Mus musculus
taatagaatgtatatatgtatgcaggtacatatgcacatgtatgtgtgtgcattcctattg

SEQ ID NO: 66368 - DNA, 89 bp, Mus musculus
tctccacccctggcctgtgcagtcctccatgctggagaagatgtcctcctccccgctctggagacagaacagtgacaggaaggttgaga

SEQ ID NO: 66369 - DNA, 71 bp, Mus musculus
gaactcctttctgacttccccagtgctgtgttacagatgtgtgtcactgtgcctgagtctaaccggtgttc

SEQ ID NO: 66370 - DNA, 108 bp, Mus musculus
tcacaggtgtgctcagctgcttgggtttagttaaccttgcatgtcactaagctgacaaccaagagtgtgagctgtcatgcccattgcgtccgcccttcaccactgtga

SEQ ID NO: 66371 - DNA, 88 bp, Mus musculus
tatatgtatgtatatgtgtatacatatgtatatgtatgttttatatacatatatatatatatacatatatgtatatatatatacacac

SEQ ID NO: 66372 - DNA, 81 bp, Mus musculus
tgtgtgtgtgtgtgtgtatatatatatacatatatgtatatatatatatatgtatataaaacatacatatacatatgtata

SEQ ID NO: 66373 - DNA, 121 bp, Mus musculus
gaacagtgcatgctgtggacgggccacaggtgctctgcgtggaagagtgaagtgtgggagcaccgagctcgagtgtctgtggccgtgagaggtggtccatcgctgacctgctctttcctgc

SEQ ID NO: 66374 - DNA, 111 bp, Mus musculus
gcggccaggaggcggggttggttgttatctttggttatctagctgtatgagtggtgtggagtcttcataaagctagataaccgaaagtaaaaataaccccatacactgcgc

SEQ ID NO: 66375 - DNA, 103 bp, Mus musculus
cagtgtatggggttatttttactttcggttatctagctttatgaagactccacaccactcatacagctagataaccaaagataacaaccaaccccgcctcctg

SEQ ID NO: 66376 - DNA, 114 bp, Mus musculus
ctgaagacagctacagtgtgctaacatataaataaaataaaatatttttataaaataaaatattttttaaaaaagatttgtttttattattttgtgtatcagtgtgctggttag

SEQ ID NO: 66377 - DNA, 115 bp, Mus musculus
acagtgtatacactatctcatagaggtgtctggttttaaatgtaaaatttttaagttttaattatgtgaatatgtacatatatgagtagatctcccttgagtgagaggtgactgt

SEQ ID NO: 66378 - DNA, 107 bp, Mus musculus
actgggtttcagcttcagtcaccctaaagaggctctcactactgaaattctactactgatttggtgtgaactttaatgttggttacctgaacagctagaaaccttgt

SEQ ID NO: 66379 - DNA, 101 bp, Mus musculus
gaagaaaatataaagggatgaggaaagattgagtccatgtagcttatgaaatataaggataagtgtttttctagttctaattctgtcctgagatttttttt

SEQ ID NO: 66380 - DNA, 102 bp, Mus musculus
ctgacatcaagttttgccagcccatggtgccttatttttgttaagattttttttaaaagtatatgcatatacatgaaagggttgtgcatgtatgagtctcag

SEQ ID NO: 66381 - DNA, 91 bp, Mus musculus
cctggaggcagagtttaaaaagggaaacaggtgagagagtgcagacgtggctgggatcttgtgcagcctgtgtccactatctgtgctcagg

SEQ ID NO: 66382 - DNA, 84 bp, Mus musculus
gttctgggacccagagtggttgtcggtgatcctggggaaacacacaaacagactctctctcccaaaccaacactgggtcagggc

SEQ ID NO: 66383 - DNA, 113 bp, Mus musculus
gtgtgcatgtatatatacatgtgtacatgtgtatgcatgtatgtgtccatgtgcatgcatatgtgtattacatgcatgtgtgtacatgtgtgtatgtgtgtgtacatgcatgt

SEQ ID NO: 66384 - DNA, 79 bp, Mus musculus
gggtgccacccactctctcacagtgcctttcaggcccagctaagagaagagaggcagggggagaaagggacatggcccc

SEQ ID NO: 66385 - DNA, 117 bp, Mus musculus
catgtctcatatatatatatatcttcatgtctcatatatatatatatatatatatatatatatatatatatataaaatgacatgcaatatgatgttttaagatatgtaatcagtgta

SEQ ID NO: 66386 - DNA, 109 bp, Mus musculus
tggatgtcttcttctggctctcatgttgtgcgtatgtggacgagagttctctctctctctctcacacacacacacacacacacacagccaaaggatagatacttgttca

SEQ ID NO: 66387 - DNA, 127 bp, Mus musculus
ggaatctggtggggctgtggccatggtatagtaactcccgtttgttgaggccctactgggtgccactctcacacactcatcttacagccctggtgtgagctatcaccgtgagtggttgcatggcctc

SEQ ID NO: 66388 - DNA, 62 bp, Mus musculus
tcacactcagtgtctgtgtgggcaaaacacgggccctttaagaaccgggctctgatttgtga

SEQ ID NO: 66389 - DNA, 69 bp, Mus musculus
aggtcaatgagatggttcaacatgtaaagtgcctgcaactgggcatgactgactgactgtctcaggctt

SEQ ID NO: 66390 - DNA, 87 bp, Mus musculus
ctagagagatggctctgactgctcttccagaggtcctgagttcaaatcccagcaaccacatggtggctcacagccatctgtaatgag

SEQ ID NO: 66391 - DNA, 82 bp, Mus musculus
gttcctatagcacagtctgagtctctgcaacagtgtactaaggttgctatggcagagctgggatgcagtgcagtggtatagc

SEQ ID NO: 66392 - DNA, 80 bp, Mus musculus
tcactgacagctgagagggaaaggaggcagagggagttttcacacacactcactcactcactttaatcacgttgttagga

SEQ ID NO: 66393 - DNA, 120 bp, Mus musculus
ccactagggaccttatgcaaattgaatgaaataggttgtatgtatgtatgtatgtatgtgtgtatgtatgtatgtatgtatgggttgaatatgtattgtttagggagtggtgccatggtg

SEQ ID NO: 66394 - DNA, 69 bp, Mus musculus
aagcatgcaggttgaagagctccttgcagaaccgtctgtgactttggttctctctcagtctgttagctt

SEQ ID NO: 66395 - DNA, 80 bp, Mus musculus; identical to SEQ ID NO: 66392

SEQ ID NO: 66396 - DNA, 70 bp, Mus musculus
tacacacacacactcactcactcactacatatctgtgtttatgtgaaatgtgtgtgatgtatgtgtgtgt

SEQ ID NO: 66397 - DNA, 120 bp, Mus musculus
agtgcctgcagagtccagaggaggacttcagagcccctagacttggagttgccagatgattgtgagctgccatgtgggtgctgagaattgaactctgacccttggatgaccttaaccact

SEQ ID NO: 66398 - DNA, 77 bp, Mus musculus
tatgtgtatgtgtgtcactgtgtgtctgtgtgtgtctatgaaggcacacatgataccacagtataaatgtggaggta

SEQ ID NO: 66399 - DNA, 110 bp, Mus musculus
tgcataccttcaggaagagggacagagaagtcataattactgaggagttattgaggtagaaggatcttgagtttgagactagtctggacaacttagtgaggaaagtgaca

SEQ ID NO: 66400 - DNA, 123 bp, Mus musculus
accacacacatgcatctggatatgtgtacttccacacttatctaggggagacactagacagaggcctgaggatggtggggagctgggaagtggataggaagatgctccctcttagagcccagg

SEQ ID NO: 66401 - DNA, 107 bp, Mus musculus
gagttaaaaacagtgaagtagggctggagaaatggctcagaggttaagagcactgactgctcttccagaggtcctgagttcaaatcccagcaaccacatggtggctc

SEQ ID NO: 66402 - DNA, 116 bp, Mus musculus
catgagaacatggtctgaacatgagggtgctgcctcaccagctgggctccagtggaagtgagctgagtgccagcacagtgtctctgcatcctgcctgaggatacaatgtgatggtg

SEQ ID NO: 66403 - DNA, 87 bp, Mus musculus
ctgtttttgtctatatatgtatatgttcaaggaaaaattttattttgtattttaggcatatatatagataaatagatagatagatag

SEQ ID NO: 66404 - DNA, 79 bp, Mus musculus
gccctaggggcatgtgtgtaaagtgagaggacacatttgttggaggcttgttcctattgtgccacgctcatcttggggc

SEQ ID NO: 66405 - DNA, 88 bp, Mus musculus
gcttaagcaatgacagggtggctctatatttttaattcaagtgtccagatatttggggaaatattggagtgcttctgtctgctactgc

SEQ ID NO: 66406 - DNA, 80 bp, Mus musculus
gggggcagctgttctctcagacaacagtagtctgtgggcacttccaattttagatctgtctgtctgtctgcctgcctgcc

SEQ ID NO: 66407 - DNA, 116 bp, Mus musculus
gtgtctgtctgtctgcttacctatttatctagcatccaattacttattgattttttactttatgtgtatgagtagcttgcctgcatgtgtaactttgtaccataggcatgcagtgc

SEQ ID NO: 66408 - DNA, 86 bp, Mus musculus
tctctgtatgtgtgtctgtcagtctttcaatcctgtgttgcctcagtcaggtttcaaggaccaagttgtgcaacacacagcaggga

SEQ ID NO: 66409 - DNA, 71 bp, Mus musculus
tctccaagtttgaggctagtgaggccttgtatgtcacttatactgccctcacagacagacagacaggcaga

SEQ ID NO: 66410 - DNA, 60 bp, Mus musculus
actgagggggtgggacttgaggttttaaaagcccatgccagtcccactgtttctctctgt

SEQ ID NO: 66411 - DNA, 68 bp, Mus musculus
cagtaagtgcttccccagctgaggcatcccactggcttctgccacctcactgtgacagtgtctcactg

SEQ ID NO: 66412 - DNA, 60 bp, Mus musculus
ggttctgaggattgatctctgtctcccacaggaagatagagtaacaccaatctgtgaacc

SEQ ID NO: 66413 - DNA, 112 bp, Mus musculus
tggcttctgtgcctgctgcctttgcctgtgggtctgactgtctctcagagtatcccagcactcctaaggacagaaagaatgccaggtggtgtcagctgtacaggcagggtga

SEQ ID NO: 66414 - DNA, 122 bp, Mus musculus
gagagagggaggggctgtgatcatcaagggaccagagagctgaggggtgctctgggaacactgtgactctgtttctctgtttcaggcccatgccttggaggctgatatggagctagagtttc

SEQ ID NO: 66415 - DNA, 78 bp, Mus musculus
ccaggaaggagaagctgggagtctgctagtctggagcccagactgaagcctgtgagtgcaatagcttttctgttctgg

SEQ ID NO: 66416 - DNA, 67 bp, Mus musculus
ccgggtctgttcacaggtcaatacctatttgaaatgccacagtagagtgtgaccactccagacaagg

SEQ ID NO: 66417 - DNA, 70 bp, Mus musculus
tatgactgtgagttcatatgtatatgtatatgtgtatatatatgtatatatgcagctagacacagaaata

SEQ ID NO: 66418 - DNA, 66 bp, Mus musculus
gtgtgtgtgtctgacccactgtgagtctgaagatcagagaaccgtgtgggctgtcaggtgtgccat

SEQ ID NO: 66419 - DNA, 101 bp, Mus musculus
agaattgtcctagaagggggctggagagatggctcgggttaagagtactgactgctcttccagaggactcatgttcaattccagcacccacaaggctgtct

SEQ ID NO: 66420 - DNA, 101 bp, Mus musculus
ccattgtcctccagttgtcctcatgagagccagctttctagagagaagggaatgcttttaatctataagacatgttggctgcttgtacctggagatctcgg

SEQ ID NO: 66421 - DNA, 146 bp, Mus musculus
ggcctgggtgtgggggaggtgatcacattatcccattagctcagccacagacccagcagcccctcacccactcacagtctcacttccaaaagctcttctgtttttactgggacaatggattggagtcactggggtcaggaggctgc

SEQ ID NO: 66422 - DNA, 75 bp, Mus musculus
cgttgtcttgactctttatctctctcctctgcccagtattcagggtccagggatgtggggttctttgggacaatg

SEQ ID NO: 66423 - DNA, 88 bp, Mus musculus
ctcaaggtgggttgactcctgtgagtctgtctctttcacctgatcactatgatagtcctcaccaggatccagccaatgtctgcatgag

SEQ ID NO: 66424 - DNA, 97 bp, Mus musculus
gagcccaaagacctaagtttgagtctcactgggtctcagcatctatgttgaaagctgggagtgctggggaggtggatgcaggcaaatcccagggctc

SEQ ID NO: 66425 - DNA, 65 bp, Mus musculus
cgtggttgtcacttcagtctctgtgagcccctatgagctctgcttagttgattctgtgagccatg

SEQ ID NO: 66426 - DNA, 80 bp, Mus musculus
gacggtaagtaagtcagtcagtcagtcagtcaatcaatcaatcaatcaatccctggctccctggctgcactggctctgtc

SEQ ID NO: 66427 - DNA, 85 bp, Mus musculus; identical to SEQ ID NO: 59254

SEQ ID NO: 66428 - DNA, 81 bp, Mus musculus
agtgcccacgactatcagaggatggcatcagattccctggaattggaattacagatgattgtgagctgtcatgtgaacact

SEQ ID NO: 66429 - DNA, 195 bp, Mus musculus
agaaagaatgagtgtgtgtgtatatatatgtatatatatgtatatatatatgtatatacatatgtgtgtgtctatatatgtgtctatatatgtgtatgtgtgtttatatctatgtatatatgtgtatatatatatgtgtgtgtgtgtgtgtgtatgtgtgtgtgtgtgtgtgtattgctatcagaaaggatctca

SEQ ID NO: 66430 - DNA, 72 bp, Mus musculus
cttggtgttctgataggatgcataggataatttcaatatttttgtacctgtttagtcctgttttgtgttggg

SEQ ID NO: 66431 - DNA, 76 bp, Mus musculus
gtgttctactgaccttctttctctgcagaatcttttttatttttcaagagaaagctggtccactattagtggggac

SEQ ID NO: 66432 - DNA, 142 bp, Mus musculus
agaatttgtatatgtatacatatatatatatatatatatatatatatatatatatatatacacatatatatatatatatatgtgcgtgtgtatgtctatatatatgtgtgtgtgtatatatatatatatgtgtgtgtgtgtg

SEQ ID NO: 66433 - DNA, 74 bp, Mus musculus
tccatggtcacctgataggatgcataggataatttctatatttttgtacctgtttaggcctgttttgtgatgga

SEQ ID NO: 66434 - DNA, 78 bp, Mus musculus
ttagtccatggagatctgataggatgcatgggataatttcaatatttttgtatctcttcaggcctgttttgtgactga

SEQ ID NO: 66435 - DNA, 104 bp, Mus musculus
catatatagaatggcacatagtcccatcaagaaaggtacagcaacctgtattttttattttgatcagagtatttgtgctatctcttaaaatattacctcatatg

SEQ ID NO: 66436 - DNA, 74 bp, Mus musculus
gaagttctgctgtaggggccagagagaatatagcagggcatctgctgatttctctctgtctctgggagattttc

SEQ ID NO: 66437 - DNA, 107 bp, Mus musculus
ccaaagtatcactgagtagagtgttcttcagctgccacgtgaatgtaggctttctattatttatattgttattgaagatcagtcttagtccatggtgatctgatagg

SEQ ID NO: 66438 - DNA, 68 bp, Mus musculus
cctgtctgcctgtctgtctgtcttgtgtgtaagtgtgtgtgtgtgtgagtcagaggatagcttttagg

SEQ ID NO: 66439 - DNA, 80 bp, Mus musculus
atgacacctatctgccaggaaaaagacctctggtgacacactctcattcagacttaatgtggcattttgaagagtgtcat

SEQ ID NO: 66440 - DNA, 113 bp, Mus musculus
acttctggggctgttattattgggagccgggatgtaattagacagaagagactcaggtatatgcagaacattgtttttcctccattcccatcaaataacaatctcctttgagt

SEQ ID NO: 66441 - DNA, 118 bp, Mus musculus
tataagttgctgtagcatctactttttgcatttgcgcatagtcagacacactgtgtttcatgtagtcacaggcctatcaagcaaagaaccaggaaaggatgctgtttacctgctaata

SEQ ID NO: 66442 - DNA, 73 bp, Mus musculus
cttaagagaggcagatagatctctgaattcttttggaatgttaagaaaaaatgtgtgcttgcagtctcttaag

SEQ ID NO: 66443 - DNA, 81 bp, Mus musculus
ctctgagcatgttcttgtttaggtgggtagcatgaagatactcaatcactcacaggctcacttatgtgaagaactgtggag

SEQ ID NO: 66444 - DNA, 108 bp, Mus musculus
cctaagtagggtggtaacacaatcatattgccttggatttaatcatatgtcagccattatggtaagctatttaaatatcaagataactcttgttacatttaccctagg

SEQ ID NO: 66445 - DNA, 63 bp, Mus musculus
gtttgtctgtctgtctgtctgtctgtgcatactactaagtactgagcccagacctagacaagc

SEQ ID NO: 66446 - DNA, 194 bp, Mus musculus
gtgtgtgtgtgtataaaaatgcttataagtgtaactaggtaatatatatatatatatatatatatatatatatatatgtatgcatgtatgtatatgtatatgcatatgcatatgcatatgtatatgtatatgtatatgtatatgtatatgtatatgtatatgcatatgcatatgtatacgtatatacatatata

SEQ ID NO: 66447 - DNA, 101 bp, Mus musculus
gcagtgacagactccttaacagtgcaggggcagacagtatacacagtgcagagggcttataacagattatctatccctcactagctatagatgtcgactgt

SEQ ID NO: 66448 - DNA, 91 bp, Mus musculus
tactgtgagctttgggataattggcttctctctgtggctcagacttttgactcctacagaacatgagaatcttcaccaagaggatatagta

SEQ ID NO: 66449 - DNA, 85 bp, Mus musculus; identical to SEQ ID NO: 57439

SEQ ID NO: 66450 - DNA, 64 bp, Mus musculus
gcctgaagcaaggacaaggggtctgcagcagtttccagactccctcagtcacttcctcagcagc

SEQ ID NO: 66451 - DNA, 110 bp, Mus musculus
ggctagagttcagatgcatccaaattaccacctggtcaatctaagagaggcaaggtcagtgtgcatcttggttgtatccttttgatcagagaagtatgtgagcagatccc

SEQ ID NO: 66452 - DNA, 81 bp, Mus musculus
acctgggcaagagaataaacagtgaataactcttcaaggtaatgtgaccacacatacctcactctgtctcagagcctaagt

SEQ ID NO: 66453 - DNA, 190 bp, Mus musculus
acacatacttatgtacacacatgtgtgtatatatatatatatgaatatatgcgtatatatgaatatgtgtgtatatatgaatatgtgtgtatatatgaatatgtgtgtatatatgaatatgtgtatctatatataatgtatatgtttatgtgtatatatgtatatgtgtatatgtgtgtatgtaacaaca

SEQ ID NO: 66454 - DNA, 97 bp, Mus musculus
ttgaatgggaaagaagaaagctccagacttgactctctttcagacttggaatgtctcaagggaaagtcctgagtttctttaatatagtgatgttcaa

SEQ ID NO: 66455 - DNA, 119 bp, Mus musculus
aagttgagaaccactggcctagtacagatagctgagtactctctgatgcatagcagacatatttatatatgtattcaaggatacttagttggtggaacaaattgtggaatgtgaaactt

SEQ ID NO: 66456 - DNA, 102 bp, Mus musculus
tacatatatgtgtgtatgtacatatatgcatatatttgtatatatacatatatatgtatatatgtgtgtgcatatatatatatatgtatatatatgtataca

SEQ ID NO: 66457 - DNA, 82 bp, Mus musculus
actgccacttagtctgtaatctacaaggtcagatttagttgttcagtatgccatctgtccttctgagaggctaagagctagt

SEQ ID NO: 66458 - DNA, 100 bp, Mus musculus
gactacagatctggggctggagagatggctcagtagttaagagcacagactgctcttccagaggtcctgagttcaattcccagcaaccacatggtggctc

SEQ ID NO: 66459 - DNA, 74 bp, Mus musculus
tccgtgtccgtgtccgtgtctgtgtctgtgcatgccatagaaaatgtatagaagtcagaaggcagcttacagga

SEQ ID NO: 66460 - DNA, 56 bp, Mus musculus
tgtatgtgtgtatatatgtgtgtatatatatattcacacatacacacacacacaca

SEQ ID NO: 66461 - DNA, 109 bp, Mus musculus
aactgcttaattaaaatacttgggagctggagagatgtctcattggttaagagcattcactgctcttgcagaaaacttgagctcatttctcaggacccatttggcagtt

SEQ ID NO: 66462 - DNA, 80 bp, Mus musculus
ggtgaacatcaggtttcttcttgagttcctctctatattactttctgggataaggtctctcactgagtctgaaactcacc

SEQ ID NO: 66463 - DNA, 103 bp, Mus musculus
gtcttttgttgtagcatctctcttactcaagggtagctagcaacttttgttattatatatatccttgacttcagatccgcaagatgatcgactaggtaaagac

SEQ ID NO: 66464 - DNA, 93 bp, Mus musculus
tggaggaggaccaggtaggattttgttttgatgtgttacagggctggacaaacccagcaggtgccaggctgcctgtctgagtgtctgcctcca

SEQ ID NO: 66465 - DNA, 103 bp, Mus musculus
gaagcacattttgtttatccattcaccttttcataggcatttggggtggctaggcttttggattgttatgaataatggtgctaagaacatttttgtgtggttc

SEQ ID NO: 66466 - DNA, 66 bp, Mus musculus
gggagaggtcaagctggattgaactgggctgagctgggttgagcccagaatgattcaggccctacc

SEQ ID NO: 66467 - DNA, 114 bp, Mus musculus
ggatgaaataaaatgaaaggtaccaaaactcagagttcagagacacagtcagtcactggtcatcatattgctctagtcaactgcctagaagaaatatttcagtgcaattcttcc

SEQ ID NO: 66468 - DNA, 111 bp, Mus musculus
agggtctgctctacaggttcctcttaccccagctctgactggctgttctttattatgtaaatagtcacattccttattcaacctgttggctttggggggctctgtgacctt

SEQ ID NO: 66469 - DNA, 119 bp, Mus musculus
tctgatgccctcttctggcatgtctgaagtcagctacagtgtacttatttataataataaatatttggaccagagtgagcagagactgagcagtgagtggggcctaccagagtgaacgg

SEQ ID NO: 66470 - DNA, 95 bp, Mus musculus
gctctgcctcttgacctatagttgactttatttaattctgtttacaatattcaagcggaaagatcttgaattaaaggtaggtgctaaggttgagc

SEQ ID NO: 66471 - DNA, 65 bp, Mus musculus
tgaagggagggctcgaagaaggtgtgccatttcagacagtcttccacagtctctcactcttttca

SEQ ID NO: 66472 - DNA, 85 bp, Mus musculus; identical to SEQ ID NO: 57439

SEQ ID NO: 66473 - DNA, 75 bp, Mus musculus
gaactcagatccacctgcctctgcctccctagtgctgggattaaaggtgtgagccactgtgtctgtctgagtgtc

SEQ ID NO: 66474 - DNA, 75 bp, Mus musculus; identical to SEQ ID NO: 66473

SEQ ID NO: 66475 - DNA, 75 bp, Mus musculus; identical to SEQ ID NO: 66473

SEQ ID NO: 66476 - DNA, 87 bp, Mus musculus
ctccagaggtgacagagcagttgaatttctaaggtgtttattggaaaagtaactattattcatgtgcatttcttttcatctctgtgg

SEQ ID NO: 66477 - DNA, 101 bp, Mus musculus
tgtgacaggctgacctgtgacctgtgagtgtcctgacagtggtgaccagaaagctgtgttgagtgcacaaaagaggagaaatcggagagcagccacttaca

SEQ ID NO: 66478 - DNA, 86 bp, Mus musculus
gctggctgtctctgtcactgattctaaaggttgtcatacccttctgggtacaaggccttgactttgtttctgtggccagttgcggt

SEQ ID NO: 66479 - DNA, 96 bp, Mus musculus
ggatgaaaggcagtgtggcaaggtctgggtggaagaggatgtaggttgctaactaggtgaaatctcaataagcaggagctacagaaatagtcatct

SEQ ID NO: 66480 - DNA, 79 bp, Mus musculus
gggcactggctggattgggtaccgggtagcagaaaagaacgggagcctgcctgcctgcctgcctgcctgcctgcctgcc

SEQ ID NO: 66481 - DNA, 96 bp, Mus musculus
tagacttgtagctagtgtgtctggcacagtctctcagttcccaaatgcttgaaatgcggctatgttagatatgccagacatttaacatgcactctg

SEQ ID NO: 66482 - DNA, 76 bp, Mus musculus
gtcttatgcaagacccactcactgaatcacagccattaaagagtgtagctgcaagtctgtgtttctggtttaggac

SEQ ID NO: 66483 - DNA, 62 bp, Mus musculus
ctgtctgtctgtctgtctgtgcaccacttgcttgtctggtgcccttgcaagtcagaagaggg

SEQ ID NO: 66484 - DNA, 96 bp, Mus musculus
ttttttccctgcttttttgagacaggatttctctgtaactctgactgtcctagaaatcagagattgtgtgcctgtctcccgagtgctgggattaaa

SEQ ID NO: 66485 - DNA, 70 bp, Mus musculus
aacaaagatctggctggagagatggttcagcggttaagagcactgactcctcttccagaggacctgagtt

SEQ ID NO: 66486 - DNA, 85 bp, Mus musculus; identical to SEQ ID NO: 57470

SEQ ID NO: 66487 - DNA, 106 bp, Mus musculus
tgcttttttttttcctgcttttttgagacaggatttctctgtaactctgactgtcctagaaatcagagattgtgtgcctgtctcccaagtgctgggattaaaggca

SEQ ID NO: 66488 - DNA, 74 bp, Mus musculus
ggctgacagggtgatggggtcaaggtagaagggcctgcttttactctcagcatctcactcactctccttcagct

SEQ ID NO: 66489 - DNA, 58 bp, Mus musculus
tctccatggctctgcttcccaggctgagctgagaagacctgagaaatgagtgaggaga

SEQ ID NO: 66490 - DNA, 72 bp, Mus musculus
ctgtctgtgtgtctgtctgtgccccaggtgcaagcagtgccactggatcccgggaagtagagttacagatgg

SEQ ID NO: 66491 - DNA, 70 bp, Mus musculus
aacatagatccggctggagagatggttcagcggttaagagcactgactcctcttccagaggtcctgagtt

SEQ ID NO: 66492 - DNA, 78 bp, Mus musculus
gggagaaggggagctggagagatggctcagcgtttaagagcactgactgctcttcctgaggtcctgagttcaaatccc

SEQ ID NO: 66493 - DNA, 82 bp, Mus musculus
tgtgggtcctctggaagagcaggcagtgttctgagtagctgtggctagactggaacttgctatgtaaatcagattgccctca

SEQ ID NO: 66494 - DNA, 103 bp, Mus musculus
tgatccttaaaacatgaaaaggggggctggagagatgactgagagcaccgactgctcttccaaaggtcctgagttcaaatcccagcaaccacatggtggctca

SEQ ID NO: 66495 - DNA, 88 bp, Mus musculus
gttgaaataatatatcctgaagtgtctgtctgtctgtctgatggcctggaaggcaggcaagaagagggtttaggggggaaaaaaaaac

SEQ ID NO: 66496 - DNA, 91 bp, Mus musculus
gtcacagcctgagctggctgtagggggcagagtcagagcagaacacagtctgactcagtctttgacctctgccgccgctctccagctggac

SEQ ID NO: 66497 - DNA, 67 bp, Mus musculus
tagtatgtatgtatgtatgtatgtatgtatgtatgtatatatgtatgtatgtatgtagtatgtgctg

SEQ ID NO: 66498 - DNA, 105 bp, Mus musculus
tgaacagcgtggtacaggggctggacagatggttcaatggttaagagcactgactgctcttccagaggtcctgagttcaatttccagcaactacatggtggctca

SEQ ID NO: 66499 - DNA, 108 bp, Mus musculus
ttgaaagtagtaatgagggcctggagagatggctcagcggttaagagcactgactgctcttccgaaggtcctgagttcaattcccggcaaccacatgatggctcacaa

SEQ ID NO: 66500 - DNA, 110 bp, Mus musculus
gctgaaagatggctcagtggttaagagcactgactgctcttgcagaggtcctgagttcaattcccagcaaccacatggtggctcacaaccatctgtaataggatccagtg

SEQ ID NO: 66501 - DNA, 79 bp, Mus musculus
tttttctagcagcttgtgaaatctctgcttgcagcttctccaattgagcctaagagcaagatcaaacaagataggaagg

SEQ ID NO: 66502 - DNA, 60 bp, Mus musculus
tcactgcccatcggaagtcaagaggcaaaaataacttgtgtttgaaaatgatggtggtga

SEQ ID NO: 66503 - DNA, 63 bp, Mus musculus
gagctgcagaggatggggtgctgtacgtgtgtgcgagtgcctgtgaccctgtgaccctgactc

SEQ ID NO: 66504 - DNA, 76 bp, Mus musculus
gaggagctctgtgtatctgtgtatgtggtcctgaagactcaacccaggccttacacacgtcagcaagtgttctatc

SEQ ID NO: 66505 - DNA, 92 bp, Mus musculus
gctggaagttgtctagggtgaaaagacaggggaggggccgagcacaagtgtctctgaccctccctctctgctccagccctaaacaaactggt

SEQ ID NO: 66506 - DNA, 68 bp, Mus musculus
gtgaagtagagcggcagcaatggatcgatccatcaatctatcgatcggccctgtggtctgtgcctcat

SEQ ID NO: 66507 - DNA, 94 bp, Mus musculus
cctgggtgaggaagcatatctgtgggtctgtctgcccgtcattgattctctcttggacttgcatgatggatacagacgcatttctttcccctgg

SEQ ID NO: 66508 - DNA, 75 bp, Mus musculus
gaggaggaagttgagagttaacacagtggtgtgctgaggtcacatcaaactggtgctttccccaacaccttattc

SEQ ID NO: 66509 - DNA, 77 bp, Mus musculus
gtgggtccctggggggcgagggggggtaggtgctgaggcccatgccaagcctggattgtctctctctctctgcctat

SEQ ID NO: 66510 - DNA, 127 bp, Mus musculus
gttaggacggaagagggcgtgtgaagctgcactagagcagattctctttgttcttctcattgctgacagtgaggacacacaggggctctggggggaaccagtgctcacttgtgaatcagaagacagt

SEQ ID NO: 66511 - DNA, 114 bp, Mus musculus
ttgctgttgctaggtaattgggaggagtctagcctgaaagtcagaagcttgggacattgtctgcctgactgttagccacatgcttctcctgtggtggctgtgggggggcggtaa

SEQ ID NO: 66512 - DNA, 106 bp, Mus musculus
cagagttggttttgatcagtttctacccatgcaggtgagttttattttaacttgacacaagctagagtcctcagaggtgggagcctcagtagaagagatgcctctg

SEQ ID NO: 66513 - DNA, 114 bp, Mus musculus
gtaccctggctcagaccttgctgccactgagaatgagaccacttggggtggagccttcccacctagatggttctattgttctgtcaccagcactgttcttctctgagatactgc

SEQ ID NO: 66514 - DNA, 105 bp, Mus musculus
gtatatatatatacatacatacatacatatacatatatatatgtgtgtgtgtgtatacatatatatgtatatatacatatgtgtgtgtgtaatatatatatatat

SEQ ID NO: 66515 - DNA, 89 bp, Mus musculus
ggcagacacttgagaggaggcatgatgtttggaaagggtataaaactgaacccaacagacagtcagtgactctctcgcattgctttgct

SEQ ID NO: 66516 - DNA, 79 bp, Mus musculus
aggtgagggatggagagagactccatgggcgcttgtccggtccagtccgagaggctctgagtcgctctgtccctctcct

SEQ ID NO: 66517 - DNA, 111 bp, Mus musculus
ggctggggggggggagatctagaagggggggcatagagacagacagagagagactactcatgtcagatggttggtatgctcatccttctcatgggcttcaggtccttggct

SEQ ID NO: 66518 - DNA, 98 bp, Mus musculus
ggctttatttggtcaggcagcgcccgactacaccctggaaaggtaaagaaatgcttaacaacctacagtctgtgttaattacctgacttggtatttcc

SEQ ID NO: 66519 - DNA, 121 bp, Mus musculus
gggatggatttgaacatgtgctatgactggattatggtggtgatgtcacaactctgtgaacacacagaaagcaagaatataaccacaaactggattctggagtttatgggtgcattttgtt

SEQ ID NO: 66520 - DNA, 73 bp, Mus musculus
tggtgagatctggaataatctaaaactcaaacaggcttgggcatgcctgtaagagattttcttgatctgatca

SEQ ID NO: 66521 - DNA, 68 bp, Mus musculus
gtatgtgtgtgtgtgtgtgtgcacatgcatgcctctgtgtgcaagtgcatgtatttgtgcatgtgtgc

SEQ ID NO: 66522 - DNA, 84 bp, Mus musculus
tcagaaagatacaaagtgaaagatcagtcttgattttatgacaacacattatctgtctgtctgtctgtctgtctgtctgtctga

SEQ ID NO: 66523 - DNA, 92 bp, Mus musculus
tctgtgtatcattaacatttctggtgcttgaatgtgtctttttttttttaagttagggacgtagataaagttaccaattgttatgacatgga

SEQ ID NO: 66524 - DNA, 84 bp, Mus musculus
cagtcccagcattggaagctttggtgatgagacagccaactgggactctgtctccctcattattcgaagacgtcattaggattg

SEQ ID NO: 66525 - DNA, 60 bp, Mus musculus
ggttgggactcaggttgggaatttttctctcagacagtctttcacagccagggcttgacc

SEQ ID NO: 66526 - DNA, 74 bp, Mus musculus
gtctgtctgtgtctgtgtgtgcacttgctagtgtgtgtttgtatgagttcatgtgcacagcaagcatgcagtac

SEQ ID NO: 66527 - DNA, 78 bp, Mus musculus
ctgtgagctctgtgtgaccacacaggcaggtatgggaccttttagtgcccttgcctcctgtatggcttggagtcatag

SEQ ID NO: 66528 - DNA, 73 bp, Mus musculus
ggcagtttcctgtactctccagtaactgttgctgttgtccacagatcttacagagcagtcagtgactgctgcc

SEQ ID NO: 66529 - DNA, 71 bp, Mus musculus
tcagagtctctgtccctgagacccagaggggacagtggttacctctctgctcagcaattcctggactctgg

SEQ ID NO: 66530 - DNA, 100 bp, Mus musculus
ggctgtataaccctcgggtaagcagaacttgatggggtcaagccagcgggccttctgagaactgagagagcagccaagggcacggttagggactgaagcc

SEQ ID NO: 66531 - DNA, 57 bp, Mus musculus
gcatctctgcctgtctctctcttggcttctatgggttgggagctgcaggcatgttgc

SEQ ID NO: 66532 - DNA, 98 bp, Mus musculus
ggagggtgtggggctggagatgtggctgagtgtagtgtgagtgcaggcttggtgtgttctcacgctgcaaagccctcggtttgattcgcaggctgtgc

SEQ ID NO: 66533 - DNA, 76 bp, Mus musculus
tagtgaaaagagagcacacagagtgcattggccttaacctggcttcctaaaatgcaacttggatgttactgcactg

SEQ ID NO: 66534 - DNA, 70 bp, Mus musculus
tagaaataggaatgatctctggctcttgggctaacctggtgtgttagtcagactttctttcttatcgctg

SEQ ID NO: 66535 - DNA, 101 bp, Mus musculus
gcaggggatagagtgattcaaggtgagaccaagcagtcatgggcaaaatcactgtgagctttgaggtttcctgggcaaagattactatgggaagcctctgc

SEQ ID NO: 66536 - DNA, 120 bp, Mus musculus
tacatatgggtatatataagtgtgtgtgtatgtatgtgtgcatatatgtgtgtgtatatatgtatgtatatatgtatatgtatatgtgtgtgtatgtatatacatttgtgtgtgtgtatg

SEQ ID NO: 66537 - DNA, 96 bp, Mus musculus
gggcataggaagcttattctaagtatatcattatggaggctgagaaagtcagtcactctgataatcctgtatcacccatctgcttacccatcaccc

SEQ ID NO: 66538 - DNA, 73 bp, Mus musculus
ccgggtcctcagctctgaatctgtctggtactcacctaaggccagtgccgtcctagccccaagggctgcccgg

SEQ ID NO: 66539 - DNA, 107 bp, Mus musculus
acttgtgcctacagtttggtgagtttttcctggctcacgactatttatttcattttgttgaagtggaattcatggggggattaggattcacactcggggtctctggt

SEQ ID NO: 66540 - DNA, 114 bp, Mus musculus
gtttcaagcctttgacaattattttatttaatactatagaaaaccatacgggctatatttttttttataagccccattttcaagtggagtaaactaagagtaagacacttgagc

SEQ ID NO: 66541 - DNA, 74 bp, Mus musculus
gggaagcttccatgtgccagtgtctacatggaaaagtgattcacaatagacagtgagcactgggtgatggtccc

SEQ ID NO: 66542 - DNA, 82 bp, Mus musculus
gtggtcattttacatacatgaggctttgttttttggggttttttaaaataagtctttatttatttcatgtatgtaagtacac

SEQ ID NO: 66543 - DNA, 84 bp, Mus musculus
agagaaagccatttctaatttctcagagaatctcacacgttatcaaaaatgagcagacggtcagttctgagagtgctgatctct

SEQ ID NO: 66544 - DNA, 181 bp, Mus musculus
atgtatatatatatacatacatacatatacatacacatatatagttacacacatatgtgtgtatatatatgtatgtatatatatgtatatatgtatatatgtatgtatatatgtatatatgtatgcgtatatatatatatatatatatatatatatatatatatatatatatatgatttgc

SEQ ID NO: 66545 - DNA, 80 bp, Mus musculus
atatatacatatatatacatacatatatatacacacatatgtgtgtaactatatatgtgtatgtatatgtatgtatgtat

SEQ ID NO: 66546 - DNA, 97 bp, Mus musculus
gagctcagaggctgctttcgtcgaggactcacctgaattagctgctctttgtgactcagactgtgacttaggtgttggatgttttgtccctgggttc

SEQ ID NO: 66547 - DNA, 135 bp, Mus musculus
atatatatacacacacacacacaatgtatgtatatataatgtgtatgtatatataatgtatgtgtatgtgtgtatatatatacatatatgtgtatatgtatgtgtgtgtatgtatatatatatcatttgtgtgca

SEQ ID NO: 66548 - DNA, 64 bp, Mus musculus
gtctctgactgcctgtctctcagagctgcaaaacaggttaaaccagtgggaggcttccagtgac

SEQ ID NO: 66549 - DNA, 108 bp, Mus musculus
tagatgttttttacttttacagtgtgtgtgtgtgtgcatgtgtgtgtgcatgtgcatatatgtatgtgtgtgtgcacatgtgcatgtatgcatactatggtacatttg

SEQ ID NO: 66550 - DNA, 80 bp, Mus musculus
gcttggggactttgtctcagtcactgcttccctgccttagtcccacaaactagatcagggtacactgctggcccccacgc

SEQ ID NO: 66551 - DNA, 117 bp, Mus musculus
gttataatgttattcatttgagaaaatgtttttgtgtcaatgtatgtatgtatgtatgtggatattatatcaattcatacattaaacattaccttataataactattaccttataac

SEQ ID NO: 66552 - DNA, 81 bp, Mus musculus
gccactggtggggggcagggggggcggagaaatggcgacatggttaagatcactgactgctcttgcagtccacatagtggt

SEQ ID NO: 66553 - DNA, 158 bp, Mus musculus
gtgtgtggcctttgctctaatctagtactctgtagacagtagtgtgtgtgtggtggcctatgctctaatctagtactctgtagacagtagtgtgtgtggtggcctatgctctaatctagtactctgtagacagtagtgtgtgtgtggcctatgctcta

SEQ ID NO: 66554 - DNA, 130 bp, Mus musculus
tactctgtagacagtagtgtgtgtgtggcctatgctctaatctagtactctgtagacagtagtgtgtgtggtggcctatgctctaatctagtactctgtagacagtagtgtgtgtgtggcctatgctcta

SEQ ID NO: 66555 - DNA, 94 bp, Mus musculus
ggagtggtaagttcagcgtgtctgttggatgtttagtttctgtagtatgaaaggccacagaccactataaagtctcagataagttttactccca

SEQ ID NO: 66556 - DNA, 65 bp, Mus musculus
tctgtgcatgccaggtaaggagggctggtcagctgctgacaggactcactgactccatgcactga

SEQ ID NO: 66557 - DNA, 119 bp, Mus musculus
gaacctgctatgtgggtgctgagaaccaagcccaggtcctctgcgtgagcagcaaatgctcttgctccagccctctctccctatagcttctatctcagaatcacataaggaagaggttt

SEQ ID NO: 66558 - DNA, 100 bp, Mus musculus
acattgtaggccaaaggtcttgtggctgggttgggatatacatttctctttcagttgtctgcagagtactttcccacacagagactgaggaccacaaagt

SEQ ID NO: 66559 - DNA, 108 bp, Mus musculus
gtcctctgggaacagggaatgtcagctgagagaatgctgacagacagacagacagcctgtaagcaagtctgtgagacattatcttgattaatgatgatattggaggac

SEQ ID NO: 66560 - DNA, 82 bp, Mus musculus
ctggcctgttacatggaagagagagagcacagtgacgccgattaacctgctgggattcttagtgtttggtgaggcaggacag

SEQ ID NO: 66561 - DNA, 89 bp, Mus musculus
gtcaacacctactctcaactgcttgaagagctggtattaaaaggttataccagtaatcacagtgctcatggaggctgagggaggaagac

SEQ ID NO: 66562 - DNA, 89 bp, Mus musculus
ttgctgtgagtttgaggtctaagtttggctacttgttgagtgccaggacagcctgagctacagacagacagacagacagacagatagac

SEQ ID NO: 66563 - DNA, 85 bp, Mus musculus; identical to SEQ ID NO: 57439

SEQ ID NO: 66564 - DNA, 92 bp, Mus musculus
atgggaacccaggaagtccagctgcagcctctgtattcttcacacccagagtgtagcagaggttctctctgtctctttctgaaatagctcat

SEQ ID NO: 66565 - DNA, 80 bp, Mus musculus
cacataaaagagctacagaaaagagagagagaacttctcagtccaaactctgtctctcccaaactgtgtttttctatgtg

SEQ ID NO: 66566 - DNA, 73 bp, Mus musculus
gatcctgaaggcaggcacaattgagagctcccttcttgattaggacacagagagcagagtgtgctgcaggatt

SEQ ID NO: 66567 - DNA, 71 bp, Mus musculus
ccagaaactttatttaccaataagaaccaactgggggcagagaccctcagtgtcttacatatggattctgg

SEQ ID NO: 66568 - DNA, 82 bp, Mus musculus
gtgctatgggaggtttgagggagaaactgggtttggggaaatcaccagatctctctctctctctagccatctccagggtcac

SEQ ID NO: 66569 - DNA, 75 bp, Mus musculus
gggatggatccataggtagggcagtctctggatggttactccttcagtctctgtttcacactttgtctctgtaac

SEQ ID NO: 66570 - DNA, 159 bp, Mus musculus
ttgcctgtaatggaatatatatgtatacatatacacataacatacatatatatctatttatgagtatatatatgtatgcatgtgtatatatacatgtgtgtatacacatatatacaaatatgcatatatgtatatacatatatatgtatgtataaacac

SEQ ID NO: 66571 - DNA, 96 bp, Mus musculus
actgagccattctagaagtgacattttgtatttctgtctcattcttttaaggtgttcttagagataagactgaaagcaagtacccatgggctttgt

SEQ ID NO: 66572 - DNA, 85 bp, Mus musculus; identical to SEQ ID NO: 57439

SEQ ID NO: 66573 - DNA, 79 bp, Mus musculus
tgcctttacacactgtcctttattcaggctccgcatccccagactctgtcagcctcacaaaggcagcggtgtcaagcca

SEQ ID NO: 66574 - DNA, 71 bp, Mus musculus
tggatttttacaaaggatgtatgtatgtatgtatgtatgtatgtatgtatgtatatgcctgtgtgagttca

SEQ ID NO: 66575 - DNA, 90 bp, Mus musculus
gactatagtgggcattttaggtctgaggacaacctatgggactctgttctctccctccaccatgtgtgtcctgggaactgaactcaggtc

SEQ ID NO: 66576 - DNA, 93 bp, Mus musculus
cacacacttcctgttctgtctgaggctgtctcatggaccagcagtctgctcctctgtctctcagtgtcttcagttcttcagggtttcaccgtg

SEQ ID NO: 66577 - DNA, 113 bp, Mus musculus
aaaagatataactgtcatctcctggttccctaagacatttctacttagggagtcaaatgattttgttgcttttcaaggaaacacttcagattccttacctagaacttaaagcc

SEQ ID NO: 66578 - DNA, 91 bp, Mus musculus
tgggatgtgcatcccttcactttcctgtctccgtttctcactgactcattggtgagctggctgctgggagagtgcagccctgagtgtctca

SEQ ID NO: 66579 - DNA, 144 bp, Mus musculus
atatatatatatacacaaaaaaatggatatatattcaaaataaatatatatagaagaacttatctatacattttgaagagcttatatattcatatatatgtatatcaattcatgtaggaatatatatgcatatgaatgcttagg

SEQ ID NO: 66580 - DNA, 68 bp, Mus musculus
gcgtgtgtgtgtgtgtgcatgtgtgtgtgtgcgtgtgcatgtgtgtgtgtgcgtgtgcatgtgcatgt

SEQ ID NO: 66581 - DNA, 85 bp, Mus musculus
aaggtcctaaagatatatgcacataaacatatgtatatatattcatatacattgtatgtgtgcgttataatgttttattcatctt

SEQ ID NO: 66582 - DNA, 71 bp, Mus musculus
gtggggtacaagaaggatcagatacacagtccgcaccgcatactgagtgtgtgtgtctttcagtgactcac

SEQ ID NO: 66583 - DNA, 102 bp, Mus musculus
acatagaaggcactctgcactagctctgaatggccctcgtgagtcactgaaagacacacacactcagtatgcggtgcggactgtgtatctgatccttcttgt

SEQ ID NO: 66584 - DNA, 82 bp, Mus musculus
ctgtcagtggctcagatgtggcagggatccctgggtgtttcctgctggcttcttctctgtcacagtctccctccaacatcag

SEQ ID NO: 66585 - DNA, 112 bp, Mus musculus
ggtatccccgcgagtggagggaggccctgcctgctgactccctgcctcactccgacgggggttcctttttcttggcataaataccttgagcctccctaaattcgccggaacc

SEQ ID NO: 66586 - DNA, 76 bp, Mus musculus
gggcactcgctctcgcactctctgtctttcggataagtctctaggacttggaggccaccggcgggagagagtctcc

SEQ ID NO: 66587 - DNA, 93 bp, Mus musculus
ataaaaatgcaatgacattcatagcccaatccaaatgacaacaaatagtaacgttctttggatatgtaactgtatcagtcattgtgttgatat

SEQ ID NO: 66588 - DNA, 63 bp, Mus musculus
tgtatgtatatatgtatgtatgtatatggaatatatgtatatacatacacatgtatgcatgca

SEQ ID NO: 66589 - DNA, 75 bp, Mus musculus
aactccaatggctcatattctaagatcaagaattttttttttcatgaatcatgaataacttgaccttttggagtt

SEQ ID NO: 66590 - DNA, 85 bp, Mus musculus; identical to SEQ ID NO: 57439

SEQ ID NO: 66591 - DNA, 80 bp, Mus musculus
ttatcctttcccattcattgtactgtgtttgctttgtccggattgaattgtaaatagagagttgggataggagaggatag

SEQ ID NO: 66592 - DNA, 84 bp, Mus musculus
ctgttgctcctgagcaagtgtaacattctgagatcctgcttaaatttccatgtgtagcatccctgtttgccagtcaggtgtcag

SEQ ID NO: 66593 - DNA, 85 bp, Mus musculus; identical to SEQ ID NO: 57470

SEQ ID NO: 66594 - DNA, 85 bp, Mus musculus
gtccatggtggtctgataggatgcatgggacaatttcaatatttttgtatctgctgaggcctattttgtgaccaattatatggtc

SEQ ID NO: 66595 - DNA, 85 bp, Mus musculus; identical to SEQ ID NO: 57439

SEQ ID NO: 66596 - DNA, 83 bp, Mus musculus
gctttatgtgcatatgtatatgtttatatgtatatattatacatttatacatgtatacatgtatgtatgtatgtatgtatgta

SEQ ID NO: 66597 - DNA, 97 bp, Mus musculus
gagagaaccaggtttggagagatggctcagtggttaagagcattgactgctcttgcagaggtcctgagttcaattcccagcaaccacatggtggctc

SEQ ID NO: 66598 - DNA, 80 bp, Mus musculus
tggtcattcagaggctgtagctagatggtttcaaagtaatcaaattaaaatgaggtcattgggtacacctctgcacatca

SEQ ID NO: 66599 - DNA, 97 bp, Mus musculus
gacaagtgctaaaggaagcaagagagacttaggagagcagagtctttttttttaaagattttatttttcattttctctctgtgtctgtctgtctgtc

SEQ ID NO: 66600 - DNA, 57 bp, Mus musculus
ctatgctgctgaaccacaggcttcgtggggacactgactctgtgtttgttagtctgg

SEQ ID NO: 66601 - DNA, 111 bp, Mus musculus
ttcaaaagggcctgagttcgagtctgcataaaccatgaatgtcagagtggacagtgtgcactgggttgtcacatcagtctgactggcctggcctcttgctatggctatgaa

SEQ ID NO: 66602 - DNA, 111 bp, Mus musculus
ggagggagggagaaaagagccaagtaaaggagactttcctctctctgcctgactcttttagaactggggtagagctagtcttcctttggacttggattcaactgaactgac

SEQ ID NO: 66603 - DNA, 85 bp, Mus musculus; identical to SEQ ID NO: 57439

SEQ ID NO: 66604 - DNA, 91 bp, Mus musculus
ggatgtgactctagctgaggtggctttgggaatggtgttgcctctccctgtccagtgactctctccctgtccttctatgttgtgttcctcc

SEQ ID NO: 66605 - DNA, 82 bp, Mus musculus
tagacctcactctctctctcaggctagtcttgacctcaaatatctgcttggctttatctcctgggattgaatgtgtgttcta

SEQ ID NO: 66606 - DNA, 85 bp, Mus musculus; identical to SEQ ID NO: 57439

SEQ ID NO: 66607 - DNA, 69 bp, Mus musculus
aagtttcatttggtgtcaagagatgaccagttgggagggactgtgtgtctctgtcattatttgatgctt

SEQ ID NO: 66608 - DNA, 87 bp, Mus musculus
ttggcctcaggacagaatgaacagagagtacagagaaagacaagggcccattcacgattctctgaacccagctactcaggaggttga

SEQ ID NO: 66609 - DNA, 85 bp, Mus musculus; identical to SEQ ID NO: 57439

SEQ ID NO: 66610 - DNA, 72 bp, Mus musculus
atagatagatagatagatagatagatagatagatagatatatctatatttgtatatctatatgtttatctat

SEQ ID NO: 66611 - DNA, 77 bp, Mus musculus
ttagatagaaatgatctgagctcagcccaagccacgtatttgtaattcttggctgaggctctcatcagttcatctga

SEQ ID NO: 66612 - DNA, 84 bp, Mus musculus
gcttgcagttttagaggtttcagtctcactgtcacgtggttgtattactttgagactacagtatcttaggacatcatggcaggc

SEQ ID NO: 66613 - DNA, 99 bp, Mus musculus
tgtgtccatgtatttgtgtatctgtttgtgtttggctgggtggctgtctatcacacacacacacacacacacacacacacacacacacacacacacaca

SEQ ID NO: 66614 - DNA, 93 bp, Mus musculus
gggtcgtccagctgtataaatctctctatatgtctgtcacacactaaaaatgtgctgaagattagagggctaaataacggcagaacatcgcct

SEQ ID NO: 66615 - DNA, 120 bp, Mus musculus
gtgatggagcctgtaagacactctgcctgctcacgtgcccagtgatggagcctgtaagacactctgcctctgttcaggtgcccagtgatggagcctgtaagacactctgcctgctcacgt

SEQ ID NO: 66616 - DNA, 80 bp, Mus musculus
attacttgaaatactatgctagacactggtgaataagagactcactgtctctctatgcagctcagaatctattaagtgat

SEQ ID NO: 66617 - DNA, 63 bp, Mus musculus
ccctatttcttgttcatcatgatggtctttgacagattaacctgatgttataggaatataggg

SEQ ID NO: 66618 - DNA, 69 bp, Mus musculus
ggatgcacttagtcttactgctagttgatatgctagggctggttgatatgctagggctggttgatatcc

SEQ ID NO: 66619 - DNA, 81 bp, Mus musculus
gattaagagtacaagggactagagagatggctcagcagttaagggcactgactgctcttccagaggtcctggattcaaatc

SEQ ID NO: 66620 - DNA, 60 bp, Mus musculus
tgcttagccctggcaaggggtggggccagctgtctggctctcacaccctcaggtccagca

SEQ ID NO: 66621 - DNA, 115 bp, Mus musculus
accagaacgaaatttctttggagggagaaaggccaggaaaaccactgctgagatacaaaattttgtttttcttaaagtctggagctgtgttcagtgaagtgacgttgcttacggt

SEQ ID NO: 66622 - DNA, 126 bp, Mus musculus
agagagatttaaaataaaaccctgggggtggctgggcctaagggctcacttttagctctctttctctctctgaagaaatctctcagtccttagcatcccactccctctcctccctctcccacctcc

SEQ ID NO: 66623 - DNA, 103 bp, Mus musculus
actcacagattcttggcaggaatcctttgtgagcagctgcacaggtctcacagaagagagagatcttgctgaatgtggagtcttgctgaagcattgcttaagg

SEQ ID NO: 66624 - DNA, 72 bp, Mus musculus
ggtaggttggggagggtttgcaggtgccaagacaaatcagggtacatatgctcactcactcactcactcact

SEQ ID NO: 66625 - DNA, 87 bp, Mus musculus
gagatgtcttcctgcaggtaagatgagtctatagagtgagcagacattcttgccacttcttgtctttcatgagtccctgtagttctc

SEQ ID NO: 66626 - DNA, 108 bp, Mus musculus
ttgtttttctgggaagacatgggcagttattccctagaagggcttctggctttgtctagctccttctcaaatgagtgattctgtgatgtgctcttccagaagtagcag

SEQ ID NO: 66627 - DNA, 116 bp, Mus musculus
gactttgagtactatatttaatatgtagggagagagtgggcaatcttgtctagtccctgattttagtgggattgcttcaagttactctgcatttattttgatgttggctagtggtt

SEQ ID NO: 66628 - DNA, 113 bp, Mus musculus
acaaaggaacaggctaggaaaaaggccatctagaatcttggtttctgaacagagtcaggagctagttttctttcacaagcacagccattgatttttagcagaagagcatttgt

SEQ ID NO: 66629 - DNA, 100 bp, Mus musculus
tgattgtgataagcagggcaggtttaggttgggtatagagttgtcttagtttacttattatagtgattatgtactttacatgtcttgattattgctgtca

SEQ ID NO: 66630 - DNA, 113 bp, Mus musculus
tatatatacatacatacatatatatacacacacacatatatatatgtacatgtatatatgtatatatatatatgcacatatgtgggtatatatatgtgtgtgtgtatgtgtat

SEQ ID NO: 66631 - DNA, 68 bp, Mus musculus
ctgtgttgtgctgtcaatctctgtgaatctgactattctgtatatcacacagatgagcaatcgcacag

SEQ ID NO: 66632 - DNA, 98 bp, Mus musculus
tggccgagaagctgattgttcactgacatctgagaaagttagctgagagaaacagacagactgacagacagatgcaagcctttgatcgcatcttgaca

SEQ ID NO: 66633 - DNA, 108 bp, Mus musculus
gtatgagcaggagacagctggtcacattgattcctcagaaacagtcagatgaatgctgctactctgtcctggaacttgctctgtagaccaggttggccttgaattgac

SEQ ID NO: 66634 - DNA, 110 bp, Mus musculus
ggtgggctgctggaaactctgtatgaattcagatgagcccactgcctgctgtgtgtgagcacagtcctgggcatgtagctcagcatgcaggcccccagccagactgcacc

SEQ ID NO: 66635 - DNA, 83 bp, Mus musculus
ggacagttctagtcccagttgtgactctctgtggctctgcttcttggggtcaggagtgataatctatgggtgtggctatgtct

SEQ ID NO: 66636 - DNA, 64 bp, Mus musculus
gcctctcatcctgtgtcactgtcactgggatgatcttggaggttgacaaaggcagagttgaggc

SEQ ID NO: 66637 - DNA, 94 bp, Mus musculus
agggagatgggaaatagattaggaaggagaagggaaactggagtgttctccttactgtgtctctgtctctcttgtgtgtctcttccctctccct

SEQ ID NO: 66638 - DNA, 162 bp, Mus musculus
atatatatgtgatatatatatatacatacatacatatatatgaatacaagtatacattatatatatgtgtatatatgtgtgtgtgtgtgtgtgtgtgtgtgtgtgtgtgtgtattccaggtaatagatatgtgtgtatgtgtatatatgcgcatatatatat

SEQ ID NO: 66639 - DNA, 79 bp, Mus musculus
aggtgggtcctctctgggagagagaaagcaggggtcaggtctgcaattttctctggctccagatacaaatactccacct

SEQ ID NO: 66640 - DNA, 118 bp, Mus musculus
tgaagattaaggactttactctttggcaatagacatcaactacggggtctaaaataaggactgactccctcagagtctcttgtcagaaagattgagttgagctaggcctgatgactca

SEQ ID NO: 66641 - DNA, 74 bp, Mus musculus
ggaagcagatgacagagaggtgacactgttcacctgggttctgcttaccttctttgatcaacttctgtagttcc

SEQ ID NO: 66642 - DNA, 66 bp, Mus musculus
atatatatatatacacacatatatatacacatatatatgtatatatctgtgtgtgtatatatatat

SEQ ID NO: 66643 - DNA, 119 bp, Mus musculus
catttctgcagagtgcttgctacatgggcagaactgtgtctgcatctcttgaggggttcttatgttttaatttttgcaacactcttttgtcctggacaccatctaactattcacagatg

SEQ ID NO: 66644 - DNA, 75 bp, Mus musculus
gatgccagtggaagagttcagggaccatgccaccattcccagtgacttgaaatggccccaacttgtctacctatc

SEQ ID NO: 66645 - DNA, 79 bp, Mus musculus
aaggaaaacaacatcaatatgggccactacaagacttccggccaatgcctggaacagttctggccattgatgtctcctt

SEQ ID NO: 66646 - DNA, 88 bp, Mus musculus
ccccagctgacagcagagagtgaggtgtgggctggggtctgaagaatggcatagccccagtgttatctactctactgtgctaatgggg

SEQ ID NO: 66647 - DNA, 98 bp, Mus musculus
tctcagaggtagacaatatgcaaaatgttttcctggtatgtatacatgtatgttgtatgagtacatatttgtggatgactacatgtttgttttaaaga

SEQ ID NO: 66648 - DNA, 152 bp, Mus musculus
atgtatgtacatacatgacagagacagtatatatatgtatacatgtttgtgtgtgtatatatatgtatatatgtgagtatttttaaatttatgtgtacatatgtgtgtctctgtgtgtgtgcacatgtgtgctcagcttccagtgaaaaaac

SEQ ID NO: 66649 - DNA, 106 bp, Mus musculus; identical to SEQ ID NO: 58252

SEQ ID NO: 66650 - DNA, 94 bp, Mus musculus
aactctcagttcccagttgagaaagtatgtgacagctgactctgaccacaccgtggactctgggttagagcacagctttaagattgtgttagtt

SEQ ID NO: 66651 - DNA, 100 bp, Mus musculus
atatatatgtatgtgtatgtatatgtatacacacatatatatatacatatatatgtgtgtgtgtatgtgtatatatatatatatatatatatatatatgt

SEQ ID NO: 66652 - DNA, 78 bp, Mus musculus
tatatgtatatgtatgtatgtgtgtgtatatatgcatatatatacatacacacacacacacacacacacacacatata

SEQ ID NO: 66653 - DNA, 117 bp, Mus musculus
ctcacattgaagaagaaggggtggagacatcataagagacatatcaaggagtttgctgtgagactgtgtctctcagtaatgtcaaaaacaataccaataaacccttaccaacatgag

SEQ ID NO: 66654 - DNA, 70 bp, Mus musculus
gtgagtgagtgagtgagtgagtgagtgagtggctggctagctgactgactgactgactgactgactgact

SEQ ID NO: 66655 - DNA, 72 bp, Mus musculus
gatgaaacatcaacgtaatcagcttctaaagaagagaggcttcttttggcttatggttgtaatgttttgatc

SEQ ID NO: 66656 - DNA, 84 bp, Mus musculus
agagctaagttggttgggtggagtagtgagtagatctggaaaaccatccagagcctgtgctacacttgagataatgagctttgg

SEQ ID NO: 66657 - DNA, 90 bp, Mus musculus
tttgtgtgcatgtatgtgtgtgtgtgtgtgtgtgtatgtgtgtgtgtgcgcacacatgagtgtatatatatatatgtccctgtacatgaa

SEQ ID NO: 66658 - DNA, 85 bp, Mus musculus; identical to SEQ ID NO: 57439

SEQ ID NO: 66659 - DNA, 82 bp, Mus musculus
tgggctaatctgactctgtctctcgctccacacagcctggcttatgagtggggagaaagtcaaattatagactgatagccca

SEQ ID NO: 66660 - DNA, 95 bp, Mus musculus
cgtgtgtaggtatttttgtctgcctgtctgtctctgtaccacatgtacagagtcccctggaactggagttacagataattgtgagccaccatatg

SEQ ID NO: 66661 - DNA, 85 bp, Mus musculus; identical to SEQ ID NO: 57439

SEQ ID NO: 66662 - DNA, 66 bp, Mus musculus
aggccctgagaccagaccagctgcctgggagaagcaggaaccagtcaagctgcctggaagaggttt

SEQ ID NO: 66663 - DNA, 57 bp, Mus musculus
gcaggtaggaagaacaagggtctgtgcagcagcatttggctctgtctgtctgtctgt

SEQ ID NO: 66664 - DNA, 83 bp, Mus musculus
ggtgtagggggtagggatatctgtgggggagtaagagggtgggggggctctctgtatatgtgtctttctctgtattacctatc

SEQ ID NO: 66665 - DNA, 118 bp, Mus musculus
agggactattgccgggcctttagacaggagtatgaaagcctgtacatctctgtctatctgtttgtctgtccctctgagtgtgtgggttgtctggacttatgcaaggacagacaagaca

SEQ ID NO: 66666 - DNA, 85 bp, Mus musculus
ctttagagccctgcacctgtagttaggaatctagtgtggctggagaagccctgctaggcgctgattataaatgctgctcttatag

SEQ ID NO: 66667 - DNA, 99 bp, Mus musculus
tgaaactacaggggctggagagatggctcagcagttaagagcactgactgctcttccagaggtcctgagttcaatttccagcaaccacatggtggctca

SEQ ID NO: 66668 - DNA, 106 bp, Mus musculus
tgacgttaagtgtgtgagttgagtccaagcagccaaggggaggtcagagtagagagagaaggcttttcgatgcctgtgtgaaacaaagtgctgagatttaatgaca

SEQ ID NO: 66669 - DNA, 76 bp, Mus musculus
tttcttggtgtgtactatgtgcacttgtgtgtgctctgtgtgtgctgtgagtgtgtgtgtgtgtgcgtgagagaga

SEQ ID NO: 66670 - DNA, 82 bp, Mus musculus
gcaagtatggatgtgggtggctggaagcaggtatctttcaaagtttttgttatttgtacctgcctgtagttcctggatttgc

SEQ ID NO: 66671 - DNA, 110 bp, Mus musculus
aattgtttttagaaaagtcttaagatgccagtgttataagcatgcaacatatttattgtttctttaaagttagtaaacacttttactttaggatttttttagtcttagtt

SEQ ID NO: 66672 - DNA, 80 bp, Mus musculus
ctgtgctcacaagtgtgtcagcactcctgggagaacatctctctcctggtggtattttggtatggaactctgtggtacag

SEQ ID NO: 66673 - DNA, 79 bp, Mus musculus
cactgtctccatcaatgtctctatctctctcaagggggttgcctatgtgggtgagtagaagccaaagtctatgtcagtg

SEQ ID NO: 66674 - DNA, 77 bp, Mus musculus
ctgggtggctgcatctaggcacatcatgtttatatataaatattgctgccaacacttagacacatgtgctagcccgg

SEQ ID NO: 66675 - DNA, 89 bp, Mus musculus
ctccacacttgtctctccctctgtgactcctggctgctctcacaaccatccagcaggaagttttctatgcttttggggttaggtggggg

SEQ ID NO: 66676 - DNA, 95 bp, Mus musculus
tacctttttactatcttgtgtgtgtgcatgtgcatgtgtgtgaattcttacttgtttgaatgtatagcttgcacatacacaagtgagcgagtgta

SEQ ID NO: 66677 - DNA, 71 bp, Mus musculus
gccatgggtggaagactcatggctttctggctgacctctagctagaggctctcagtctctctttccaaggc

SEQ ID NO: 66678 - DNA, 103 bp, Mus musculus
tggtagaagcaggtcactaagggtggcttaaaggttagagcaactgctgactcactgactttctctgcctcttggctcctctattggcatgctccaactgcca

SEQ ID NO: 66679 - DNA, 113 bp, Mus musculus
gttggggaatatgagggatccaggtcttacacagcagtgattggcgtctcaattgcctcatgtctgtctgtctgtctgtctgtctatctactctccctctcgctctctccctc

SEQ ID NO: 66680 - DNA, 82 bp, Mus musculus
gagtgaccagagagtggaattttgtgtggcttctcatgaccgtcagagagctgagttgggtaagcactctttaggggaattc

SEQ ID NO: 66681 - DNA, 85 bp, Mus musculus; identical to SEQ ID NO: 57439

SEQ ID NO: 66682 - DNA, 70 bp, Mus musculus
gcgggtagctttctgccacatggagagtctgggactaaatctcctactgtcttgtgtatctgtcacctgt

SEQ ID NO: 66683 - DNA, 159 bp, Mus musculus
catatatatatatgtgtgtgtgtgtgtgtgtgtatgatttgtatatgtatatatacaaatatatgtatatctttatgtgtgtatacctatattatatatttatgtgtatatgcatagatatacatacatacatatacacacacattacatatacatata

SEQ ID NO: 66684 - DNA, 138 bp, Mus musculus
gctagctcaccgaccattttatatgaagtgcacaaatgttttctactgctacattctcccagtacatagtgtgcagacatcaagtaaagtgctgttgaggatgaaattctagtttaaaaggtgcttgtatttgtgtat

SEQ ID NO: 66685 - DNA, 117 bp, Mus musculus
gtgggttgactttagtgaggaaataaggggaacctacgaatatatgaatatgtatatgtatatatacatacatacattttctttgaatactttgtcttctcatatgatgaaatcctc

SEQ ID NO: 66686 - DNA, 106 bp, Mus musculus
tctatgctacaacctgtgagaaaaaaggtggctaagttcagacacagtataggcactatacagtcactgactgtgtttgactgtgcactacacagggttagataga

SEQ ID NO: 66687 - DNA, 89 bp, Mus musculus
ccagaatggacactcgtggtgggccaagcaggcacctccgcccagccaggagccagcctctctgggtgcctgtgctcactgatacagtg

SEQ ID NO: 66688 - DNA, 78 bp, Mus musculus
agaggggcatttgagggaaaactcttgcatttctgcatggagcaatgcagagagcacagagaggtcagtgcagactct

SEQ ID NO: 66689 - DNA, 101 bp, Mus musculus
ccagattcttctctgtcccctcacagtccctctgtgtccctttctgcctccccagaatctccaggaaacaagagggctgtcgaggtctgagaaggaattgg

SEQ ID NO: 66690 - DNA, 72 bp, Mus musculus
gtggcagagactgatcactatcactatggccctggtccaccaagcaggtgtggtctgtgtctctgtgtgtac

SEQ ID NO: 66691 - DNA, 79 bp, Mus musculus
agatggctttccaggttggggaccagggacaagtgaagtagatgtctgtcagtcagtcagccagttggtcagttaatct

SEQ ID NO: 66692 - DNA, 117 bp, Mus musculus
cctggctgtgctgaagggcctccgtgactttgggtgactccctgcccttttctgagtctctgactcaaaagcaggacaggattttaagatgtccccttgcctttcctccaccccagg

SEQ ID NO: 66693 - DNA, 62 bp, Mus musculus
gaggttagcctggactacccagtgcgctccaggtcagcctgagctagtaggtaggtaacctt

SEQ ID NO: 66694 - DNA, 107 bp, Mus musculus
ccccgctcagtggtatactgtggtcgctctatcagctgtgactctgtgactgccaggcctggagccattagtccagctttccatttaaataccaactgtggtgtggg

SEQ ID NO: 66695 - DNA, 88 bp, Mus musculus
gtggccagaagctgcgtctcttgtctggctccacctggggtctcccctttactggccccggagtacagagattcaaggcatctgccac

SEQ ID NO: 66696 - DNA, 115 bp, Mus musculus
tttagtcctgaccagagtgtgtctctagtcgtctgcctcgaacctcttgcagaagtgacagaggacagggaaagtcctggagaactttcactcgttgatggccatgggtgctgag

SEQ ID NO: 66697 - DNA, 79 bp, Mus musculus
tgtgtgtgtacatacgtgtatgaacatatggtgtgtatgtaaatgtgtgcatatgtaggtgtatgtgtgtgcacatgta

SEQ ID NO: 66698 - DNA, 61 bp, Mus musculus
gtggttggtgctctgtctctgtccctcacagctttgggcttacagacatgtctacctccac

SEQ ID NO: 66699 - DNA, 99 bp, Mus musculus
gtgtctcagactcaacacatttaggatctcatgagtgtcacactgataaaggatacatacactctgagtgactctggtggtatgagtcccctccctcac

SEQ ID NO: 66700 - DNA, 58 bp, Mus musculus
caggccaggtacccaggcaggcatcagaactctgcctgcctgcctgcctgcctgcctg

SEQ ID NO: 66701 - DNA, 111 bp, Mus musculus
cagagctggcaatgtttatgacgtgttcaatgcctatgactgtctgtctgtctactttgagatagtgtcaggctagtctaggctggcttgaaactatgtaacccagctttg

SEQ ID NO: 66702 - DNA, 81 bp, Mus musculus
caatctaagtatatttgtatatgtgtgtgcacatgcttgtatatgtgtgtgcacacacatgcttgagtattttctcctttg

SEQ ID NO: 66703 - DNA, 63 bp, Mus musculus
ctgcctcacaagctgtcacctcttggcaacccactttgcagacaggagtgagagtcgagtcag

SEQ ID NO: 66704 - DNA, 70 bp, Mus musculus
ttggggtagcagttccatcttagtcacacatggacctagaccatgactcagtggctcactgtgtccctgg

SEQ ID NO: 66705 - DNA, 108 bp, Mus musculus
tactttggagtggatttgtgataggtcttatagctatcgcgtgggaaaactggaccctgagtacagattttcttattctaaaagcctgttctttgcatttcaatagtg

SEQ ID NO: 66706 - DNA, 58 bp, Mus musculus
ttgcagtgaatctgagagtgattcaacatggtatctgtcactcttggtgtctctgtaa

SEQ ID NO: 66707 - DNA, 95 bp, Mus musculus
ttctatcctaagtgtatattgctcaatggcatgcgtatagtgttgtaaatctatataatttttagggaagctgttgggctgagtactggttggag

SEQ ID NO: 66708 - DNA, 80 bp, Mus musculus
tcctggatccactgctcatgcgccacgctcacttacccagggacagtctctgtgagcctcagtttctgcacctgccagga

SEQ ID NO: 66709 - DNA, 58 bp, Mus musculus
agtggggcacggtggtacctcagaggcaagcatctctgagaagacactgagtccagct

SEQ ID NO: 66710 - DNA, 90 bp, Mus musculus
cacttaggggctggagaggtggctcaaaagttaagagctctgactgctcttccagaggtcttgagttcaattctcagcaaccacatggtg

SEQ ID NO: 66711 - DNA, 72 bp, Mus musculus
ggccctatctcgattctctaggttttcttgtatgtgtatttctttattttcaagagttttgaggttggggtc

SEQ ID NO: 66712 - DNA, 77 bp, Mus musculus
ccttggcactgtgtgacacactcagtcggttctaactagggcaggggcctgaccatgaatgtggcagtgcactaagg

SEQ ID NO: 66713 - DNA, 81 bp, Mus musculus
ccaggaggatggaaggtgtgtgtcacacaaactggctcacaagtactaagggtcgttgtgcccaccatagccactctatgg

SEQ ID NO: 66714 - DNA, 127 bp, Mus musculus
gggattggtctgtgaccaggacagtgcgtgagcttctgctctgctgggtgtgggggcctctctcagtgagtgagtatcctgggaagtacagggtgagtaggtcacagtgggaccaatgcaggctctc

SEQ ID NO: 66715 - DNA, 80 bp, Mus musculus
cccagtgttggaggctgagttggggtagggcctcctcagcaactgagggcatctctctttctctcagagtccttgctggg

SEQ ID NO: 66716 - DNA, 67 bp, Mus musculus
tttgtaacatgatctggtgccttcttctggtgtgtcagaagagagtgacagggtactcatatacaaa

SEQ ID NO: 66717 - DNA, 70 bp, Mus musculus
ggaagtaagtcactggtggtaaggttttgagtttcaaaagctcaagccaggctcactgtcactctcttcc

SEQ ID NO: 66718 - DNA, 116 bp, Mus musculus
caggtactccctgggcaagtcagtttgatttctcttggaagtttacagtgatgctctctgcctctgtggctgtgaggagagagtgactggacagggccaggcaacagtgtgcactg

SEQ ID NO: 66719 - DNA, 111 bp, Mus musculus
gtctgagcaggtggcccggaatggtgtgtcctcagtgtgtgtctctgtgtgcccacagaggccacaagagggagtcagatcagttgtgagatgctgggcgtgggtgtagat

SEQ ID NO: 66720 - DNA, 109 bp, Mus musculus
gcgctgctgtccccttgctctgatgtgcttgaaaatgtcctgaggcctgtgaggacactctgagctctgcccccgatgagaggaaatggaatttcacctcagcaaatgc

SEQ ID NO: 66721 - DNA, 64 bp, Mus musculus
cacttcagaggcagagtggagtagacctctgtgagtttaagcctagactgctctttgcatagtg

SEQ ID NO: 66722 - DNA, 79 bp, Mus musculus
cctgtctctatcactgagtattggcacctcattcaaaactgaaaaactcccgtgtcacatgacagtgatggtctggcag

SEQ ID NO: 66723 - DNA, 134 bp, Mus musculus
ggacacatctggccagaggaggagggtgaggagcaaggcagaggctggtggagagtattctgtgacacgctgtctctcacccttccctcagaggctcaattttgtcttgggggatttagggggtggggagaagc

SEQ ID NO: 66724 - DNA, 82 bp, Mus musculus
cagggggacacagacacagcacattggaggtaaagtggaatcccttcctgtctgtctgtgtgtctgtctgtgtgtctgtctg

SEQ ID NO: 66725 - DNA, 62 bp, Mus musculus
gacagacacacagacagacaggaagggattccactttacctccaatgtgctgtgtctgtgtc

SEQ ID NO: 66726 - DNA, 59 bp, Mus musculus
caggggctggagagatggctcagcgggtaagaacactgactgctcttccagaggtcctg

SEQ ID NO: 66727 - DNA, 114 bp, Mus musculus
agacagagtttcattgtgtagcactggctgtcctagaactcactgtgtagactggctgaactctgcacctcaagtggtaggattaaaggcagtgctgctatgtccagcctttct

SEQ ID NO: 66728 - DNA, 92 bp, Mus musculus
tgtgttaccggtatgatgtgtatgagcatgtggaagtcagaggtacactggtaatcttccactattattcttcacattgagtcaaagtcaca

SEQ ID NO: 66729 - DNA, 88 bp, Mus musculus
gagacaggcagatctctgtgagctcaaggccagccttatctacacagccagctccaggacagccagaactatatagagaccctgtctc

SEQ ID NO: 66730 - DNA, 78 bp, Mus musculus
gctactgttaagtgccatgcctgccgcctgctgctacatcccaccatggtggtcatggactcactgtctgacactagc

SEQ ID NO: 66731 - DNA, 116 bp, Mus musculus
cacctcggtctgctagtctcggcccctcacatctgcacagcattccacggtgtcatgttctcactttctgtgtctcattgttttgtggccgccttcctggcacacagcccagtgtg

SEQ ID NO: 66732 - DNA, 94 bp, Mus musculus
tgggggacaaaggcagggactgctcagtctgcctgtgtgcctgcttacatacagaggccagacaagggcactgggagtcttcctcaatctccta

SEQ ID NO: 66733 - DNA, 89 bp, Mus musculus
ctgaccctggggtgagtgtgcatatgcatgtgaatatgttcttgcaagtgtatgtacatgtttatgtatatattcacaaacatggacag

SEQ ID NO: 66734 - DNA, 66 bp, Mus musculus
gtgtgtgtgtgtgtgtacatagatatatatatatacatatgtgtgtgtgtatatatatatgtatat

SEQ ID NO: 66735 - DNA, 75 bp, Mus musculus
gcacagaacattgtaaggctgagtacatagtgaggacttcaccttaaattactcagtacagagagtgctgattgc

SEQ ID NO: 66736 - DNA, 70 bp, Mus musculus
ccttgcctctctaatagttcagctatatctatggagggctgtgattatttatttatttgggggggggggg

SEQ ID NO: 66737 - DNA, 109 bp, Mus musculus
agtagaaataagttttaagggatggagagatggctcagcagttaagagcactgactgctcttccagaggtcctgagttcaattccatctgtaatgggatgcaattcact

SEQ ID NO: 66738 - DNA, 60 bp, Mus musculus
cagggggctggagagatggcttggtggttaggagcactgactgctcttccagaggtcctg

SEQ ID NO: 66739 - DNA, 74 bp, Mus musculus
taggaacaattatgggtcagagatgtgactgtggactggccccccactcactcatctgataccttgtcttcctg

SEQ ID NO: 66740 - DNA, 112 bp, Mus musculus
tagagggttctcttgagctagtgagatggctcagcagttaagagcactgactgctcttccagaggtcctgagttcaatccccagcatctatatggtggctcacaaccatcta

SEQ ID NO: 66741 - DNA, 99 bp, Mus musculus
actgccttgtgggcttacacttagagctagactgcagacagtgaggtcttccattgtgtgatcctctcgttgtttaaataagtaagttcatccggtagt

SEQ ID NO: 66742 - DNA, 73 bp, Mus musculus
tgtcatcctctctttcacactgagactctggctggagtcagccttgataatttcgaatgagagggaagtgaca

SEQ ID NO: 66743 - DNA, 110 bp, Mus musculus
ccatcatgtgaggctgggattcagacccaagtcctctgcaaaatgagtaagtagttctctgactgctcttccagaggtcctgagttaaattcccagcagccacatggtgg

SEQ ID NO: 66744 - DNA, 68 bp, Mus musculus
gcttgtatgagtaacacagactcagtttttaggagaccgagaaactagtcttttagtagttttcaggc

SEQ ID NO: 66745 - DNA, 95 bp, Mus musculus
ttgggtgttggctttctgagtctagatagtgacctgccttaaacatgatctctgttggcaggcacttgtattctgactctgttggctaattctgg

SEQ ID NO: 66746 - DNA, 93 bp, Mus musculus
ttaccacatgggctggagagatggctcaatggttaagagcactgactgctcttccagaggtcctgagttcaattcccagcaaccacatggtga

SEQ ID NO: 66747 - DNA, 93 bp, Mus musculus
gcagttggaattacagccatgtaataccctgcccagcttgatacctttttttttttttttcgagacagggtttctctgtgtatctctggctgt

SEQ ID NO: 66748 - DNA, 83 bp, Mus musculus
caggctacttgtgattggttttgtagcagtgacatcagtgctgatcatccctgctatttcccaaggtcatatatatgtgtctg

SEQ ID NO: 66749 - DNA, 91 bp, Mus musculus
atgtataacaggttgtatttatatatgacacatatagatatgtctatatctatatagatacatgtatatattatataatctctctatatat

SEQ ID NO: 66750 - DNA, 141 bp, Mus musculus
ctctttattattggtaaatatatatacatatatagatatatgtgtgtatatatgtatatgtgtgtatgtatatatagagagattatataatatatacatgtatctatatagatatagacatatctatatgtgtcatatata

SEQ ID NO: 66751 - DNA, 85 bp, Mus musculus; identical to SEQ ID NO: 57439

SEQ ID NO: 66752 - DNA, 85 bp, Mus musculus; identical to SEQ ID NO: 57470

SEQ ID NO: 66753 - DNA, 91 bp, Mus musculus
tgcggctttcatgaactcagggtgattggcagagtgatgtcagctgagacagacaaagcctgtggatgacttgtgatgtttggagggagta

SEQ ID NO: 66754 - DNA, 119 bp, Mus musculus
gatctgccaatggtgatgagtgactgtttcgtgactgataggtaaggatgtaaagatgtatatagatttgtcaaggtcctgtaatgccagtcatgtttctttttggtcttttcttgcca

SEQ ID NO: 66755 - DNA, 59 bp, Mus musculus
tcagcttgaacagtagctgagcctaggaagcatcactctctcagtgcctggatggctga

SEQ ID NO: 66756 - DNA, 72 bp, Mus musculus
agagaagatgtctagagatgcacagtccctaccctggggtgtgtaactgtgtctgtctttctgggcagctct

SEQ ID NO: 66757 - DNA, 104 bp, Mus musculus
ggcaattaatacaaacctgtcaatagttcaattttatttttaaatcgccattgaacaatagtgctttaaaagtatcactgtcaggttttctttatccatttgtc

SEQ ID NO: 66758 - DNA, 79 bp, Mus musculus
ttctgactttgctgtctgtgccttagtgagagtcacagccactctctttgaatgcatctccagaacggctgggatagaa

SEQ ID NO: 66759 - DNA, 133 bp, Mus musculus
tatatatgtatatgtgtatgtatatgtatatatgtgtgtgtatgtatatatactatatttatatatataaaagcttacatatatatatgtgtgtatgtatatatatatatatatatatatatatatatatata

SEQ ID NO: 66760 - DNA, 85 bp, Mus musculus
ggccatggtggtctgataggatacatgggacaaattcaatatttttgtatctattgaggcctgttttgtgaccaattatatggtc

SEQ ID NO: 66761 - DNA, 85 bp, Mus musculus; identical to SEQ ID NO: 57439

SEQ ID NO: 66762 - DNA, 85 bp, Mus musculus; identical to SEQ ID NO: 57470

SEQ ID NO: 66763 - DNA, 72 bp, Mus musculus
atatatatgtgtatatgtatatttatacatatatatatatatatatatatatatatatatatatatatatac

SEQ ID NO: 66764 - DNA, 79 bp, Mus musculus
atatatataatgtgtatatgtatatataatatatatataatgtgtgtatatgtatatatacatatatgtatgtatatat

SEQ ID NO: 66765 - DNA, 117 bp, Mus musculus
tcactaagaccagctgcatgtggaattcagaaacaaacttaagtacactgtctccttcactgcgtcagtcccaggaacttggtttgtcatgcttgccagcaactgccatctcggtga

SEQ ID NO: 66766 - DNA, 85 bp, Mus musculus; identical to SEQ ID NO: 57439

SEQ ID NO: 66767 - DNA, 140 bp, Mus musculus
caagtatatataaatatattcaagtaatatatatatatatatatatgtgtgtgtgtgtgtgtttgtacatatatatgtctgtgtacatatatctatatatatgcatatatatgtgtgtgtgtggagagagagagcgagcg

SEQ ID NO: 66768 - DNA, 78 bp, Mus musculus
acaaaggcccattgcttgccacttcagtctctgtgagcccatatgtcctgcttagttgtttcaatggggccaagttgt

SEQ ID NO: 66769 - DNA, 160 bp, Mus musculus
ataaacatatatagtatgtgtgtatacatatatgcgtatatatgcatatatgtatatatacatatatgtgtgtttatatatacatatacatgtgtgtacgtatgtatgtgtatatatatatatatatatatatatatatacacacacacatatgtatata

SEQ ID NO: 66770 - DNA, 68 bp, Mus musculus
ggtgcatagtctgtgccttctctgaattgcaaaacctgattatcagtgaagacacactctgtgactcc

SEQ ID NO: 66771 - DNA, 101 bp, Mus musculus
aatacctatgtgatcagaatgatcacaggtcagctcttagccctgagactgtctctgtgtgttctctgctgtctctgtgttctctggtgtctgtgtgtgtt

SEQ ID NO: 66772 - DNA, 85 bp, Mus musculus; identical to SEQ ID NO: 57439

SEQ ID NO: 66773 - DNA, 149 bp, Mus musculus
cctgcatgtctatatgtatatgtgtctgcatgtgtgtatacatgtgtgtgtgtgtgtctgtgctggggtgtatgtatatgtgtatgtatatatatgtatgtctgtatgtaatgtgtgtgtatgtgtgtgtatgtatgtatgtatgcgtc

SEQ ID NO: 66774 - DNA, 90 bp, Mus musculus
gtgatagagccttcagaggaacacaggcttcccagcctccagaattgagagagaagactgtggttgtcaagtcttgtggctttcggtcac

SEQ ID NO: 66775 - DNA, 85 bp, Mus musculus; identical to SEQ ID NO: 57470

SEQ ID NO: 66776 - DNA, 131 bp, Mus musculus
acacagagctgcctgattaacacatggagtattgctttgctgaaaaagcagtctgtctgtctgtctgtctgtgttctcacaaggtctgctggatagcagcatcgaagcagatctaccataatagaaaagac

SEQ ID NO: 66777 - DNA, 106 bp, Mus musculus
gtaatatggcagaggcttcttagaggacatgaagtaagatggggtgtgcaggactagagacagactctcagtgacttacagtctccagctgggcctcaccttgtac

SEQ ID NO: 66778 - DNA, 85 bp, Mus musculus; identical to SEQ ID NO: 57439

SEQ ID NO: 66779 - DNA, 94 bp, Mus musculus
tcttcttgagtttcatgtgttttgcaaattgtatcttgggtattccacagaaggagttacagagacaacattcagagcagagactgaaggaagg

SEQ ID NO: 66780 - DNA, 80 bp, Mus musculus
gtggttgctgggaattgaactcaggtcctatgagagagcagtcagtgctcttagcctctgagccatctctccagctccac

SEQ ID NO: 66781 - DNA, 78 bp, Mus musculus
tatgcatatatgtgtgcatgtgtatatatgaatatatgtgtttatgtgcatatgtacatatgaatgtatgtgtgtgtg

SEQ ID NO: 66782 - DNA, 56 bp, Mus musculus
gaggtttctgtttggttttgcagctgtcctgcctaccagaccaagacaagaacttc

SEQ ID NO: 66783 - DNA, 77 bp, Mus musculus
gggtaagagaagatagtgcggggaggaagactatgatctaagtacgttgtctctctctgtctgtctgtctgtcattc

SEQ ID NO: 66784 - DNA, 80 bp, Mus musculus
tatgtatctgtgtatctatctgtctgtctgtctatcatatctatatatagagagatagattatatatgcatatatatata

SEQ ID NO: 66785 - DNA, 64 bp, Mus musculus
ggggacctggggctggagaggtggctcagcacttaagagtgctcacttctcttacagaggacct

SEQ ID NO: 66786 - DNA, 85 bp, Mus musculus; identical to SEQ ID NO: 57470

SEQ ID NO: 66787 - DNA, 102 bp, Mus musculus
tgagaggagaagtagggactagtcaaagttcacatcacaagtgattatcatgttctcttcagtgtcatgtgatgtgaaggtttcttctctgcgatgttctca

SEQ ID NO: 66788 - DNA, 82 bp, Mus musculus
gctttattccatccacccaatgtgtatatatgtatatgtgtatatgagtgtatgtgcatatgtatataaagatggttagggc

SEQ ID NO: 66789 - DNA, 80 bp, Mus musculus
ggccaactgctgacaaggggtttagttactggtcattccaaacagcctgactcactctaagaccccacagcatgactgtc

SEQ ID NO: 66790 - DNA, 85 bp, Mus musculus; identical to SEQ ID NO: 57470

SEQ ID NO: 66791 - DNA, 85 bp, Mus musculus; identical to SEQ ID NO: 57470

SEQ ID NO: 66792 - DNA, 64 bp, Mus musculus
gaacgtatagaatgtatatatgtaaatatgtatgtatgtttgcatatatatatcctattgagtc

SEQ ID NO: 66793 - DNA, 91 bp, Mus musculus
cagggattgttgcttgctcataggatggatttcaagttgggccacttattggtttgtcattctctcagtctctgctcaatacttgtccctg

SEQ ID NO: 66794 - DNA, 83 bp, Mus musculus
catgggacaatttcaatatttttgtatctgttgaggcctgttttgtgtccaattatatggtcaattttggagaaggtcccgtg

SEQ ID NO: 66795 - DNA, 79 bp, Mus musculus
gaagactctcctgtatgcagagaagcaaaaagaaatcctgaacaggtatcgatgcaaacatgtatatattttagttttc

SEQ ID NO: 66796 - DNA, 106 bp, Mus musculus
tatggtcaattttatatatatatacgtatatatatatatgatctatctatatatacatatatatatatatatatatatatatgtatatatatatatattatcatat

SEQ ID NO: 66797 - DNA, 62 bp, Mus musculus
atatatgtatatcatatgtatcatatacatatatgtatataagtatgtatatatacatatat

SEQ ID NO: 66798 - DNA, 96 bp, Mus musculus
gaccagtcttaggccatggtggtctggtaggatacatgggataatttcaatatttttgtatctgttgaggcctgttttgtgacctattttatggtc

SEQ ID NO: 66799 - DNA, 95 bp, Mus musculus
cattttggcttaggtcttcccattctctcagagactctcaccttccaggtatctgatactttctagagggtcccccatcctattcccccatgatg

SEQ ID NO: 66800 - DNA, 84 bp, Mus musculus
tatctatatctatctatctatctatctatctatctatctatctatctatcgatcgatcaatagatatagatgtagatatagata

SEQ ID NO: 66801 - DNA, 92 bp, Mus musculus
gtctcagttactaaaagatgggcaactctatatctatatctatatattcctctgcatcatgggtatggacacgcatgtttcagtatagagat

SEQ ID NO: 66802 - DNA, 80 bp, Mus musculus
acaacacaagctcaacagaatatatttatatgtgtgtacatacatatatatgattgtatgatgtgtgatcgcatgattgt

SEQ ID NO: 66803 - DNA, 87 bp, Mus musculus
accagtgtgtggatgtttagtgattcagttgcaggaaacaggatcttatgcaaagttactgtgaacaggccactctattcctctggt

SEQ ID NO: 66804 - DNA, 79 bp, Mus musculus
acttctgttagtttcactctgtctctgtttagtttctgtttccaggatctgtccattggtgagagtggggtgttgaagt

SEQ ID NO: 66805 - DNA, 101 bp, Mus musculus
tctgtgggtattgtacctttgactgttctcaatctgtggtatgatgtgtggctcattcccacacatgcttaaagagaaaaaaagttgttgtagcctgctga

SEQ ID NO: 66806 - DNA, 69 bp, Mus musculus
gtctgtaataattggctaagttttggaagctctgttgggcttcctatatatttttagttaaaatcagtc

SEQ ID NO: 66807 - DNA, 102 bp, Mus musculus
aggtcagccttagtctgtggtgacctgataggttggatgggataatttcaatatttttatgccttttgaggcctgttttgagaccaattatatggttgattt

SEQ ID NO: 66808 - DNA, 116 bp, Mus musculus
tttctctgtctattgggttgctttgactcctagataatcttagtttatatattaacatcacacatatatcacaccttacttttatctatgttaagtttgcactccaaaaggagaaa

SEQ ID NO: 66809 - DNA, 82 bp, Mus musculus
ggcaaaagaccatacattgaattagtttctctttttgcatcattgaggtttgggaggattgagtcagatgttttctgttgcc

SEQ ID NO: 66810 - DNA, 106 bp, Mus musculus
gccttagtccatgataatctgataggatgcatggaataatatcaatatttttgtatctgttgaggcctgttttatgaccaattatatagtcaattttggaggaggt

SEQ ID NO: 66811 - DNA, 60 bp, Mus musculus
acatacacacaaacatatatatatatgtatgtatgtatgtatgtatgtatgtatgtatgt

SEQ ID NO: 66812 - DNA, 85 bp, Mus musculus
gtccatggtggtctgataggatgcatgggacaatttcaatatttttgtatctcttgaggcctgttttgtgaccaattatatggtc

SEQ ID NO: 66813 - DNA, 112 bp, Mus musculus
agggaaaagatgtgatcaggttggaagcataggccagtgaggtcctcaggcattctctcctgtcagtgacactcatagacattgtgctgcagtggtagccatcataatctct

SEQ ID NO: 66814 - DNA, 117 bp, Mus musculus
agctttgggaactcactgtcctttgatggaggtgcctaagctgtcctgtgtttctgcttctgcatctgccacctgattctcaggcccccattcagataagacatagatatcaaggtt

SEQ ID NO: 66815 - DNA, 67 bp, Mus musculus
gaactggggctggagagatggcttagaggttgaaagcactgactgctcttccagaggtcctgagttc

SEQ ID NO: 66816 - DNA, 64 bp, Mus musculus
tgtctgtctgtctgtctgtctgtctatctgtctgagtatgcaggcacttgcagatacacatgca

SEQ ID NO: 66817 - DNA, 124 bp, Mus musculus
ttgtcagcctctcctatggcttagtgcactgccacaggccctgctctgagcaagaagggacagaggtgtcagagtggacacttagaggcaggctctcccctgactcctgaggatctccatgggc

SEQ ID NO: 66818 - DNA, 112 bp, Mus musculus
gatttggtgaggacagctgtgattcttgtaagcgatgacttttctgctctgctatttcaagagagaagtcagtcagggcaaacgcttccatagctgcttttcttactgtgtt

SEQ ID NO: 66819 - DNA, 84 bp, Mus musculus
ggctgtctgccactgacttacattctttagcgtgactgttttgagacagtctctgtgtgtaactacggctggctgtgggctccc

SEQ ID NO: 66820 - DNA, 67 bp, Mus musculus
gaggaactcagttactttagctctgtgacaggacaatgggcagagtagactgtgaggtgaggtcctc

SEQ ID NO: 66821 - DNA, 83 bp, Mus musculus
agatgctctggggcattgctttatcttgcctccttccccaacaaagtgagactactgagtgtggagtgttcccccaggcacct

SEQ ID NO: 66822 - DNA, 82 bp, Mus musculus
cagagaacagctttcacgagtcagttctttcgttgcagcctggtttttgactcagactctgtctcatgtctgctttactctg

SEQ ID NO: 66823 - DNA, 114 bp, Mus musculus
gagtggtttgaagccctggatctcagaagggtaagcgacagatctaagtgtgcagagatgaaagctctaggcatcagaatgttccctttattccttccctttcttccctttctc

SEQ ID NO: 66824 - DNA, 82 bp, Mus musculus
gtgtgcctgtgtgcatatgcatgtgtctctctgtgtgtgtatgtgtgtgtgcgtgcatatgtgtatgtgtgtgtctgtccat

SEQ ID NO: 66825 - DNA, 111 bp, Mus musculus
gtgcggtgctgagatgcagtattcatggggttagaaagcttttctttacttaattatgaagttggttgtaaagttttgttggttctgcacactgcagtcaggactctgcac

SEQ ID NO: 66826 - DNA, 78 bp, Mus musculus
gcccttgactgagtctcagtctgtgaccgggttcagagctactggaaggtcaatgcagtttgggatgcttagtggggt

SEQ ID NO: 66827 - DNA, 76 bp, Mus musculus
accggtccttcctgacagtctgtctcacaggggacccctttcccactagcgggagggttgcgggagagactctggt

SEQ ID NO: 66828 - DNA, 110 bp, Mus musculus
taggtataggtgcaggtataggtgcaggtgtaggtgcagatgtaggtgtaagtgcaggtgtaagtgcatgtgcaggtgcaggtacaggtgcaggtacaggtgtagacgta

SEQ ID NO: 66829 - DNA, 118 bp, Mus musculus
tctcttttaggataagatgttctgtagatatctgtaagatccatttgtttcataacttctgttagtgtcactgtgtctctgtttagtttctgtttccaggatctgtccattgatgaga

SEQ ID NO: 66830 - DNA, 97 bp, Mus musculus
gatcctgggtgtgttagagctcctgggagtcaagctgcctctgagaccctgagaccctgggatcctgggtgtgttagagtgcctgagagtggagctt

SEQ ID NO: 66831 - DNA, 68 bp, Mus musculus; identical to SEQ ID NO: 59726

SEQ ID NO: 66832 - DNA, 114 bp, Mus musculus
gtatatggattttcaatgtattgaaatatagcatattacctaacatgttaaatacatatattttatatgtattatatgtgtgtgtgtgtgtgtgtgcactcataagttcattac

SEQ ID NO: 66833 - DNA, 117 bp, Mus musculus
tctagttgcaggtggacaaggagtcagcgaatgaatgacagacagatgaaacacaggagattgtgtagaatctgaatgtattgtcacaaagtgaacaccagtcttatataatacaga

SEQ ID NO: 66834 - DNA, 88 bp, Mus musculus
ttaagatcttgtgttacaaaagaagacactgagctcagggaagtaaagttgctgtctgcgtatttagtgaagctgacattggttttaa

SEQ ID NO: 66835 - DNA, 85 bp, Mus musculus
ggccatggtggtctgataggatgcaggggacaatttcaatatttttgtatctgttgaggcctgttttgtgaccaattatatggtc

SEQ ID NO: 66836 - DNA, 77 bp, Mus musculus
ggagagacatgctgggtctgtgggtctgtggctcgggagtaggtgaactcttctccagagagctcagcccggtctcc

SEQ ID NO: 66837 - DNA, 85 bp, Mus musculus
ggccatggtggtctgataggatacatgggacaatttcaatatttttgtatctgttgaggcctgttttctgaccaattatatggtt

SEQ ID NO: 66838 - DNA, 70 bp, Mus musculus
cactgctgggggcttccttcaggcgtcactttccatgctgctgctgtgggttcagtctcagtcagcagtg

SEQ ID NO: 66839 - DNA, 111 bp, Mus musculus
gccctccatgtagcttttcctttcccttgtcttagctgagtgcacttgaggttctgcttgctacagagaagagagtgtgctggttaaagcagtagagctgggcgtggtggc

SEQ ID NO: 66840 - DNA, 100 bp, Mus musculus
cacaagtgatgaaggtgaagggtcgtgctgatctaggagcatccaacaggtagtccattatctttggttatcttgctgtgcataccttgtctcctgggtg

SEQ ID NO: 66841 - DNA, 105 bp, Mus musculus
gtatagcctcacaagagacagctatatcagggttcacatttttctactgtaaatacttgaatataaatttttacaagactatgatgtaattggtttgggctatgc

SEQ ID NO: 66842 - DNA, 64 bp, Mus musculus
tctctgtgtctctctggctgtcctggaactcagttatagacaaagctagcttcaggctcagaga

SEQ ID NO: 66843 - DNA, 89 bp, Mus musculus
gggataagaaaatgtgactctggggctggagagatggcttagtggtacagggcactgactgctcttccagaggtcctgagttcaattcc

SEQ ID NO: 66844 - DNA, 84 bp, Mus musculus
tgaatttctctggattaagtacctagaactgcttggccaatcaagttaaaagcactgactgctcttccagaggtcctgagttca

SEQ ID NO: 66845 - DNA, 71 bp, Mus musculus
atttgctcgcttattctttcattggcagttgaggttgtttcgtaagtgagtgagtgagtgagtgagtgagt

SEQ ID NO: 66846 - DNA, 107 bp, Mus musculus
ttttaaaaagaagttcatgtctagttgaggctttgtaaataacagtggatgagagacaagacacagtgcacagacttggaggtaacagacctgggtttcagttagag

SEQ ID NO: 66847 - DNA, 91 bp, Mus musculus
tgtctctgcatagtttgattctactagaaatatatatatatgtacatataaatgtttttttggttgggggttgcagccagcagtaaagata

SEQ ID NO: 66848 - DNA, 81 bp, Mus musculus
tgagcctagagcagcaaaagatggacgtgaccactctgggcttcagaccctcactgcctctgattctgcggctacgcctca

SEQ ID NO: 66849 - DNA, 105 bp, Mus musculus
gccttagtccatgtgatctgataggatgcatgggacaatttcaatatttttgtatatgttggggcttgttttgtgaccaattatgtggtcaattttggagaaggt

SEQ ID NO: 66850 - DNA, 83 bp, Mus musculus
gtggaggattcatgggggctcaagagacagcttagtggttaaaagtactgactgctcttccagaggtcctgaattcaattccc

SEQ ID NO: 66851 - DNA, 113 bp, Mus musculus
acatgaatatcatatgtacatcaatgacatatatagagattcaaatgtctattgcatgtatgtatgtatgtatgtacacatgtatatgtgtccatgccacagtgcgtgtgtgc

SEQ ID NO: 66852 - DNA, 81 bp, Mus musculus
tcatgtctatgtacatgtctatatatatctttgatacacgtgtgtgacatgtgtgagtaatgtgaatgtcttagggcatga

SEQ ID NO: 66853 - DNA, 74 bp, Mus musculus
ggatgctgcttttgccgggtcggtggggcgcaatgaattttattatatactcactaccaggtttacagtaatct

SEQ ID NO: 66854 - DNA, 118 bp, Mus musculus
ggtgttgtaggtaagtttgggtgctcaggactcttctcacagtggcctctgcctctctcacaggcagtccctcgagaggagctgtttgtgacatccaagctgtggaatactaagcacc

SEQ ID NO: 66855 - DNA, 73 bp, Mus musculus
agcgaatacttgttcagtgtttttctgtgtctgatgagagtgcacatgtaagaaatacagatgagtgctcgct

SEQ ID NO: 66856 - DNA, 117 bp, Mus musculus
ggctggtcacatggctctgtgggtagatgttctcgccacaagagtctctcacacttggtctctgggacccacttggaaggagagagagaacagattcccataggttgtcctccggcc

SEQ ID NO: 66857 - DNA, 77 bp, Mus musculus
gatttgaaaaggggctggagggatggctcagcggttaagaacactgactgctcttccagaggtcctgagttcaattc

SEQ ID NO: 66858 - DNA, 75 bp, Mus musculus
ggcccagggagtggcaaaattagaagatgtggccctgttggagtaggtgtgtcactgtgtgtcactgcctctgcc

SEQ ID NO: 66859 - DNA, 63 bp, Mus musculus
atgtgagctgtcactgtctcacaggctgacctagacctggggctttagctgacaagttggcat

SEQ ID NO: 66860 - DNA, 75 bp, Mus musculus
tcttctgccacagcctcatcagtgtcaattataaggtcaatatcgtgtgactgaggacactgtggtcccagagga

SEQ ID NO: 66861 - DNA, 70 bp, Mus musculus
gagggctgtgagatctgtgttggagggtgggatccgactgcactcacacacacggacccacgcagaaatc

SEQ ID NO: 66862 - DNA, 65 bp, Mus musculus
agacaaagaaaggctagttagcacagccttgccaggctcagtgtctgtctgcttgctcagtgtct

SEQ ID NO: 66863 - DNA, 77 bp, Mus musculus
gagcactgactgctcttccagaggtcctgagttcaattcccagtgaccacatggtctaagagagcaacagtgtactc

SEQ ID NO: 66864 - DNA, 87 bp, Mus musculus
gggtgagggtagatggtaattgtatatttagaattgagaagctggcaagttgcagggtctgtctgtctgtctgtctgtctcctaccc

SEQ ID NO: 66865 - DNA, 82 bp, Mus musculus
tctgtgtgtctgcaagtgtatctgtatatggaaacacatgtgctatggctcatgtggaggtcagaaaataatttgtaggttc

SEQ ID NO: 66866 - DNA, 109 bp, Mus musculus
ggtcaattaagaatgcaactgagaaggctggagaggtggcttagcagttaagagcactgactgctcttccagaggtactgagttcaattctcagcaacacatggtggct

SEQ ID NO: 66867 - DNA, 65 bp, Mus musculus
aagacagggctgaagagatggctcagggttaagagcactgactgctcttccagaggtcctgtgtt

SEQ ID NO: 66868 - DNA, 67 bp, Mus musculus
ctagagctacaggtagttggttgtaagctgccatcttggtgctgggaatcaaacctgggtcctctgg

SEQ ID NO: 66869 - DNA, 83 bp, Mus musculus
tatgtgtctgtgtgtgcctctgtgtgtgctgtacccatggcaggggcagggttggggtaggggcatatagaggtcagaggaca

SEQ ID NO: 66870 - DNA, 79 bp, Mus musculus
ccagtcttccctccctcctaacttgtttctctgtctctgtgacaaaacacttgaccaaaagcaaccagagggaggctgg

SEQ ID NO: 66871 - DNA, 89 bp, Mus musculus
tgtgtgtgtgtgtgtgtgtgtgtgcgcgcgctcatgcacaattgtgtataaaagagagggagagacacacacagacatgcaggcagaca

SEQ ID NO: 66872 - DNA, 91 bp, Mus musculus
gtggccttttggagaaaatgtatcactgggggtgggctttgaggaccaaattctcaagtcctctgtcccagtgtctctctcttcctgctac

SEQ ID NO: 66873 - DNA, 61 bp, Mus musculus
gacagttatgagtgtgtgcacacacagctgcatagcttggtctgcatatacgtgaactgtt

SEQ ID NO: 66874 - DNA, 81 bp, Mus musculus
agttgtgctgtctgtctgtgagacttgctctgctcttcctttagtgagtatgctggatcttagggatgtagggatgtggct

SEQ ID NO: 66875 - DNA, 87 bp, Mus musculus; identical to SEQ ID NO: 60417

SEQ ID NO: 66876 - DNA, 105 bp, Mus musculus
cagtagaaatctgtctttgtccttatctatcccacctcccacttctgagacggtgtctcagtgtctcatggtctcacgtagccgaggctggtctcaagtttcctg

SEQ ID NO: 66877 - DNA, 82 bp, Mus musculus
atctgagacaggaagatggcgagttccagaccagggctatcatagccaaacctggtctctctctctctgacctttacgagat

SEQ ID NO: 66878 - DNA, 67 bp, Mus musculus
atctcttaggtatgtcacaggcatatgtgccacttggcaagacagtgttgacagaacctctgtagat

SEQ ID NO: 66879 - DNA, 95 bp, Mus musculus
gcagtctctcaggcagcacacagcagtggcgggagagtggtaactctgtgtggcactctctgtgggcagccttcaagcagcccctcccattcccc

SEQ ID NO: 66880 - DNA, 115 bp, Mus musculus
gccttgccaaggcctcactggccctcgggtctcttggcactgtccctctctgggtgggaaggctcctgtgcaggtggcagctgcttggtcctggcgtgagcctctctggcctggt

SEQ ID NO: 66881 - DNA, 118 bp, Mus musculus
atctatatttatttagtgtgtgtgtctgtgtgtgtgtatgtgtgtgtgtctatgtctgtgtgaggtgggtaggagagacagacagacacacatacacacttgtatacatgtgtggatg

SEQ ID NO: 66882 - DNA, 86 bp, Mus musculus
tgtatacaagtgtgtatgtgtgtctgtctgtctctcctacccacctcacacagacatagacacacacacatacacacacacagaca

SEQ ID NO: 66883 - DNA, 74 bp, Mus musculus
ctcccggatacaggacaggacagggctgagtgagggcccgagcctgcctcacactgcctctgtcttcctgggag

SEQ ID NO: 66884 - DNA, 82 bp, Mus musculus
tggctgaccgcactcaggaagttgcccactttccctgttcatctgctcccagagaaggctgtcactgtgtgactgtcctcca

SEQ ID NO: 66885 - DNA, 64 bp, Mus musculus
attgagatagggtctgtagtcctggttttcttagaactcactgtgcagaccagagtatctcagt

SEQ ID NO: 66886 - DNA, 68 bp, Mus musculus
gacatctctcatcttgaaacaggcatgctgtgacttcactgtgcctgtcacagtgactggcatttgtt

SEQ ID NO: 66887 - DNA, 94 bp, Mus musculus
gggtctagagatacaaacggttgtcagtcactctgtgggtcctgggaattgaacccagatgccctggaagagcagccagtgctctcaacctttg

SEQ ID NO: 66888 - DNA, 80 bp, Mus musculus
tccaaagaggagtttgtgaatactgagagcacacacttccagcccaggtgtgaattgttgtctgagtatgtctttttgga

SEQ ID NO: 66889 - DNA, 86 bp, Mus musculus
cttttattttatgtatgtgagtccactgtcgctctcttcagatataccagaagagggcatctgatcccattacagatggttatgag

SEQ ID NO: 66890 - DNA, 88 bp, Mus musculus
aatagaaaccctgactaagacagtatagttgtgtaagtgatgaaacacatttaaattttttatctgtctgtctgtctgtctttctatt

SEQ ID NO: 66891 - DNA, 71 bp, Mus musculus
gagctctttgcatcatatgttgatttgtgtccccgtgcacagtgaacactgtatgcatgaactgtgagctc

SEQ ID NO: 66892 - DNA, 75 bp, Mus musculus
gtctgcctgtcttggtctgtctgtgtctgggtgtgtgctgagtgcacctgccaaggatctaccctgcggctttgc

SEQ ID NO: 66893 - DNA, 123 bp, Mus musculus
tcagaccatgaccctgggcagagcagattccatgtctgtcctgtcttctgccctgtcccactgtctgacccagttcctgacacccaggtgtgcagaacaggaagaagaggacagaggaaggag

SEQ ID NO: 66894 - DNA, 66 bp, Mus musculus
gtagcctggctttgcctgcctgcctgcctggcaccccagctggcagtggggtgtgggccaggcttc

SEQ ID NO: 66895 - DNA, 74 bp, Mus musculus
gtgtctgcctgcctgtgtgtctgtgtaccatgtatgtgtctggtgcccacagagggcagaggagggcgttgcat

SEQ ID NO: 66896 - DNA, 75 bp, Mus musculus
tttgttctgcttttgcctccagggtccagatgcaccaaatctctgtctctgggtctctgggtctgagagctcaag

SEQ ID NO: 66897 - DNA, 71 bp, Mus musculus
tctcctcatcccatctgtgtctctgtctccttcacgaagtttgcaggactgacgaccaattgggcaggaga

SEQ ID NO: 66898 - DNA, 254 bp, Mus musculus
tacatgtgtatatatgtatatatgcatgtgtgtatatttgtatgcatgtatgtgtgtatatatgtatgtacatgtgtgtatatatgcatgcatgcatgtgtctatatttatgtatatgcatgtctgtatgtttgtatatatacatgtctctatgtttgtatgcatgcatgtgtgtatgtttgcatatatacatatgtatatatatgtatatatgcatgtgtgtatatatgtatgtatgcatgtgtgcatatatg

SEQ ID NO: 66899 - DNA, 82 bp, Mus musculus
gtgtgtgtatgcatatgtgtatatatgtatgtgtgggtatatttctatttatgtatatgtgtatgtatgtgcatgtatatat

SEQ ID NO: 66900 - DNA, 93 bp, Mus musculus
ggcaggacacagcagacagggcacattacggggtcaggattcagccttcttgactgactgtctcagtgccttcgaaagctggtgtctgtcagc

SEQ ID NO: 66901 - DNA, 103 bp, Mus musculus
agtgagttccaagccaactagggtacagagtgaagagtgtgtcttccctgcagcaccgcttccattccgtctccaccatagtctcacttttattactttgtac

SEQ ID NO: 66902 - DNA, 82 bp, Mus musculus
ggaatgagggccagacagaagcagacatcaagagcttttgagaagcactgagaagagagtcagcttactctgccacaggacc

SEQ ID NO: 66903 - DNA, 59 bp, Mus musculus
agtaacagctggagttcaaacccaggcttccgactctgactctgactccggcttctgct

SEQ ID NO: 66904 - DNA, 57 bp, Mus musculus
cctgcatccgagtcttttaggaggcagatgtctctctgagtctctgatgtcttcagg

SEQ ID NO: 66905 - DNA, 94 bp, Mus musculus
atccccttgcccagctcctgacctctcacacaggctgtctcggtggcctgttccatccaggctgtcggaggaagctggtggtgccacagtggat

SEQ ID NO: 66906 - DNA, 114 bp, Mus musculus
ggcctccataagaactggttgtagggggctggagagatgcctcagaggttaagagcactgactgctcttccagaggtcctgagttcaaatcccagcaactacattgtggctcac

SEQ ID NO: 66907 - DNA, 73 bp, Mus musculus
gcagagacacatcacagtgggcaagccggctcagacacggaaccgatggggctcattgacacagtggctcagc

SEQ ID NO: 66908 - DNA, 74 bp, Mus musculus
agcttggcatgaaagaagtaggtggaagttgaggtggtccaacctcagagtctggctctcagtcactgcctgct

SEQ ID NO: 66909 - DNA, 107 bp, Mus musculus
agaccttgtgttttggatgattccagggcaaaaccaaagttggatttctgagttcatcctgcttggtttctcctgtgaccccacaaccaagaacatgcattaagtct

SEQ ID NO: 66910 - DNA, 74 bp, Mus musculus
cactgacttttattttatacatatagattttgcctgcatgcatgtcagtgcaccatgtatgtgtgtggtctgtg

SEQ ID NO: 66911 - DNA, 76 bp, Mus musculus
gtccttgcttagagcctctgtgtgtctctcatgctcaccagagctgttgtgtgattgtgcaggttccagcagctac

SEQ ID NO: 66912 - DNA, 107 bp, Mus musculus
ctggagagaggtttgttccagattacagctagaagtggaaatggatggtctggcctcagagcctggctctcagtcactgcctgctctgctctgacccacaggctctc

SEQ ID NO: 66913 - DNA, 87 bp, Mus musculus
tgttgagtataggcttttgtagtaggatctgatgatttttttttttttttgatctcctcagattctgttgtcatgtctcccttttca

SEQ ID NO: 66914 - DNA, 116 bp, Mus musculus
gtgtgtccatgtgtatgtctgtatatgtctgtgtgcgtgtgcatatgcatgtgcatatgtacccatgtacatgtatatacacgtgtgtgtgtgtgtatgtgcatgtgcatatgtac

SEQ ID NO: 66915 - DNA, 83 bp, Mus musculus
gcctgcatgtatgtgcaccaggtatgtatctgttggatcccctggaactggcgtgacagatggttgtgagctgacatggaggt

SEQ ID NO: 66916 - DNA, 77 bp, Mus musculus
acaactcattttttattttagaacaggtaaccccattttccaaaaagcaaagggaaacctgggtctgcatgagttgt

SEQ ID NO: 66917 - DNA, 72 bp, Mus musculus
ctctctgtgtctgtgtgagaagcccctccaggctgtagagcagggaagggacccactagccagggcagagag

SEQ ID NO: 66918 - DNA, 64 bp, Mus musculus
cttactgtgtctgcatgtgtgtgcgcgcacacacacacacacacacacacacacacacagttgg

SEQ ID NO: 66919 - DNA, 106 bp, Mus musculus
ctggcctctggagacacattcagacctgctttttagtctctctgtcacccttactcctagcactccagagggaaaggcaaatgggtccctgtgtgtccaagaccag

SEQ ID NO: 66920 - DNA, 65 bp, Mus musculus
gcctctgatctctctttgagtgtctgagtctctttgactcagaggctatgttgaggaccaggtgt

SEQ ID NO: 66921 - DNA, 108 bp, Mus musculus
ctacgtggaagatttcatttctgcctttagagagaggtttgttgactggtgaattcttacaacttggtcagaaatctttgtcctaaggcttttcttttgtttttttgg

SEQ ID NO: 66922 - DNA, 137 bp, Mus musculus
gtgtgtatgtgtgttacatttgtgtgtgtgcctgtgtgtatatatatgttacatttgtatgtgtgcctgtgtgtgtgccagtgtgtatattacatttgtgtgtgcctgtgtgcatgtatgtgttacatttgtgtgtg

SEQ ID NO: 66923 - DNA, 112 bp, Mus musculus
ctccttcctcgttggctgcatgggtctgacagagcctgccgtgagctctctgtgagcctctctacagatgctaaggattagcccgtgttagcattagacaaagagaaagtgg

SEQ ID NO: 66924 - DNA, 71 bp, Mus musculus
gatgcttgacagatgaaagtgttcaatgctccatgaaggaatggaaggatggtttcacactgtcttagctc

SEQ ID NO: 66925 - DNA, 114 bp, Mus musculus
agttgctagaattggtctgagatgcttgtgcctgttagtaagacctcattcttatttgagtggttaggtgattgctttttagaaaatatgcttttcatttttactcttgtcatt

SEQ ID NO: 66926 - DNA, 79 bp, Mus musculus
tcattactgagactctgtgtgtgtgctgcattgacgtcttttggtagatttatgttgtgaaaatattgtctcagactga

SEQ ID NO: 66927 - DNA, 107 bp, Mus musculus
cttgtcctcagggtgctttcctcttctttcacccatatggtagttattctgtatacattctgtgtgcctgtgtgcctgtgaatccatggctaactctgatttccaag

SEQ ID NO: 66928 - DNA, 94 bp, Mus musculus
tctatctatctatctatctatctatctatctatctatcgagagtttgtaagccttgaagaaaaggatcaagatgataagagatatatagatagg

SEQ ID NO: 66929 - DNA, 116 bp, Mus musculus
gcttgtctgggctaaagcacagcagggctccaacagtaccaagcttgggaatttgtctgatgacagtgagaagcagtttaggaccttgagagagccactgtgcatgaggacattgc

SEQ ID NO: 66930 - DNA, 144 bp, Mus musculus
ggtcgctcggtcaagggcagggctgggtactgactctgccaccctcgatctgggggcttgagtgtcactggcacactctgtcactgtgcaagactcagcatgtacgagtacacgctgtctaagaggaggaagtgtgctcagtga

SEQ ID NO: 66931 - DNA, 94 bp, Mus musculus
tgtattagccagtaactacagagcacaggctagtttatctgtatcaacagggcacagagaaaagagactgtggaaggttatttagtggccaaca

SEQ ID NO: 66932 - DNA, 88 bp, Mus musculus
gggagcaggaggcatgtcatgtcagagctggaggatgggacgagtgctctgagtgctgtcttctggctctgacagagccactgcaact

SEQ ID NO: 66933 - DNA, 62 bp, Mus musculus
tacacaggcatgtgtgtatatgtatgtatgtatgtatatatgtgtatatatatgtgtgtgtg

SEQ ID NO: 66934 - DNA, 84 bp, Mus musculus
gtgtatgtatatatgtatgtttctgtgtatgcacacttgcacacgtgtgtgtgcatttttgtatgactatatgtgtatatgcat

SEQ ID NO: 66935 - DNA, 63 bp, Mus musculus
tctgaatcactcactgagtcagggcaggacatggtgccaatgcctgtccttgagcaattcagg

SEQ ID NO: 66936 - DNA, 120 bp, Mus musculus
gtgaggacatgtgtatgtgtgcatgtgcatatacacctatgtgtatgtgtacggatgtgcatgtctgcatgtgtatatctatatatgtatgtaagtgtatgtgtgtgtgtagactctaac

SEQ ID NO: 66937 - DNA, 90 bp, Mus musculus
agatccgtagtgagatcagactcagtctctgtagctttccagaatggggcttcagtggagggctgtgcttttgtttcaaataaaggattt

SEQ ID NO: 66938 - DNA, 58 bp, Mus musculus
gctttagtcatttgctctccttaggtatgtgcctgagtgcgtgtgagtggctgtgtgt

SEQ ID NO: 66939 - DNA, 106 bp, Mus musculus
tgtgtattagaagaattaggaagtggctttggggaagtaagaacagactgaggaaacgaacattgcagctagcccctgtctgtacctgaaagtctctaatatcaca

SEQ ID NO: 66940 - DNA, 69 bp, Mus musculus
tcacactccctaatgcaacactgtgtgtgtatctgtgtatatacatgtgggcatgcatgtcatctgtga

SEQ ID NO: 66941 - DNA, 68 bp, Mus musculus
gggcaccaggtacaatgctagactctggggaggctccagtgagcatggttgactggtaggaggggcct

SEQ ID NO: 66942 - DNA, 65 bp, Mus musculus
ctcctgccctctgcctgaaaagagaagcgagcttaactcagtttctctctgtggctcagcataag

SEQ ID NO: 66943 - DNA, 102 bp, Mus musculus
agtgcaatatgatataaaggagtcaccagtgtataagacaaggacagatagactgtctctgacactgtaggatagactggaaagacgttgtagtttggcact

SEQ ID NO: 66944 - DNA, 78 bp, Mus musculus
atggtgactctgtctgtgtgtgaggatgcaatgaatgtttgtggccccactgtatgtcacacacacataaatggctgt

SEQ ID NO: 66945 - DNA, 73 bp, Mus musculus
gcccacatgtatgtgcaagtacatgtgtgtgtatatgcatgtatgtatgtatgtatgtatgtgtgtgcatatg

SEQ ID NO: 66946 - DNA, 111 bp, Mus musculus
ggaacagtgtctctacaagagctggagagatggctcagtggttaagagcacagactgctcttccaaaggtcctgagttcaaatcccagcaactacatggtggctcacaacc

SEQ ID NO: 66947 - DNA, 81 bp, Mus musculus
agcccatggtcagctgcctggctccctgtatgattacctgtctgtagtgtgcaaaggatcctgttcaggcagcatatggct

SEQ ID NO: 66948 - DNA, 121 bp, Mus musculus
gagtaaagctgattaagagtagcctgatggtgaggtcactccctatgggtatatactcactctctctggctatatactcacttcctctggctatatactcactccctctggctatatactc

SEQ ID NO: 66949 - DNA, 65 bp, Mus musculus
tgtggtggtcacaggtgtgagtgtctgtactcatggaggccagaggaggacatttgtgccctacg

SEQ ID NO: 66950 - DNA, 120 bp, Mus musculus
cggagaaacccaagctcagatgtttacagcttaggagacagaggaagtctgggtgtgtctgccgcactggcttgtgacttcattataggactgataggattgctcaagggttgtctctga

SEQ ID NO: 66951 - DNA, 74 bp, Mus musculus
gttccaccctgtcagctcttgccagcttgctcactctcgctctctgaaagtactgaaaaccaagtggctgggac

SEQ ID NO: 66952 - DNA, 117 bp, Mus musculus
cccctgggctgtaaccatgttgtagtgtgtgtaaacatcctacactctcagctgtgagctcaaggtggctgggagagggttgtttactccttctgccatggaaaacgtcagctgaag

SEQ ID NO: 66953 - DNA, 97 bp, Mus musculus
ctgggcagtctttgctactgtaaacatccttgactggaagctgtaaggtgttgagaggagctttcagtcggatgtttacagcggcaggctgccacag

SEQ ID NO: 66954 - DNA, 93 bp, Mus musculus
gtggaggagaaaccagaaaatggcgaaagggaggtgttggctttgatggctttatttttagtctctctctgtatctgtctgtctgtctgccac

SEQ ID NO: 66955 - DNA, 67 bp, Mus musculus
tcatgaggaagtacaaggtactaggtctgaggctcagtctctctaagtgctcactgtgcaagcatga

SEQ ID NO: 66956 - DNA, 108 bp, Mus musculus
accagcaggagatgtccccatttcttccaagtgactcaagtaagtgagctgaagcatccaccggtctggcctatgagcagtcaggattttcagggagatgttctgggt

SEQ ID NO: 66957 - DNA, 74 bp, Mus musculus
actcacagacacctaaggtgtcttctgactctgtgacagaacgcatcagacagaagtgcctggatgtggtgagt

SEQ ID NO: 66958 - DNA, 59 bp, Mus musculus
agtgtggggctgagggatgaagcccaaacctgggaagtgtcttgagtctgtctcactct

SEQ ID NO: 66959 - DNA, 97 bp, Mus musculus
gagccccaggaagctggagagatggctcagaggttaagagcactgactgctcttccagaggtcttgagttcaattctcagcaaccacatggtggctc

SEQ ID NO: 66960 - DNA, 81 bp, Mus musculus
ctatcagatatatatgtatatatatgtgtgtgtatatatatatgtgtgtgtgtgtgtaaatgtatatatctatatctcaag

SEQ ID NO: 66961 - DNA, 92 bp, Mus musculus; identical to SEQ ID NO: 57641

SEQ ID NO: 66962 - DNA, 116 bp, Mus musculus
agcaggctggttcagaccttgctgccactgtgaatgaaaccacctggggtggagccttctgacctaggtggttctattgttctgtcatcagcactgttcatctccaagaccctgct

SEQ ID NO: 66963 - DNA, 92 bp, Mus musculus
cagggctgggagtatatgccagtggtagaattcttgtttagcatgcagcaagctctgtgttcatctctagcactgcacactcctgtaatctg

SEQ ID NO: 66964 - DNA, 106 bp, Mus musculus
gccttactgcatggtgatctgataggatgcatgggacaatttcaatatttttgtatctgttgaggcctgttttgtgacctattatgtggtcaattttggagaaggt

SEQ ID NO: 66965 - DNA, 106 bp, Mus musculus
gatctcagaggtcctggttagtggaatctgtttgttttcctatgtggtcaccctcctcatcatcatcatcatcttctagcctttctctaattcaaccacaggggtc

SEQ ID NO: 66966 - DNA, 86 bp, Mus musculus
gttctttttatataaatatatgtgtgtgtgtgtgtgtatatatatatatacatatatatatagtgtgtgtatgtatatgtatgaat

SEQ ID NO: 66967 - DNA, 74 bp, Mus musculus
gaggacagagagagaacactgggaacggcaaggagtcctgaaacctcagtgtactcccagtgacacacttcctc

SEQ ID NO: 66968 - DNA, 62 bp, Mus musculus
gtgctaagtcagcttgtataagaaggtatctaatatacttcttcagtgtcagctgagagcat

SEQ ID NO: 66969 - DNA, 138 bp, Mus musculus
tatatatatgcatatatatgtatgtatacacacacacacacacatatatatatgtttgtgcgtgtatgtatatatgtatatgtatatgtatatgcatatgcatatgtatatgcatatgcatatgcatatgtatacaca

SEQ ID NO: 66970 - DNA, 108 bp, Mus musculus
attcttttttatagtgagtagtactccattgtgtaaatataccacatcttttaaggaggccagagagatgactgagtggttatgagtatagatgctcttggaaagaat

SEQ ID NO: 66971 - DNA, 85 bp, Mus musculus; identical to SEQ ID NO: 57439

SEQ ID NO: 66972 - DNA, 85 bp, Mus musculus
cattgagtagagtgtcattcagcttccacatgaatgttggctctctactatttatgttgatattgaagatcagccttactccatg

SEQ ID NO: 66973 - DNA, 103 bp, Mus musculus
gattatacaagggccccaagagtcctatgcgcagttcgttgccagattgcacgaagcagctgagagaatttagagacctgaggaaagtgagggtctgttagtc

SEQ ID NO: 66974 - DNA, 97 bp, Mus musculus
ctagagtgttcatggggggagagaatgacatggttcttgctgctgggataaggctctggtgtgagactgcaagagcatctgtggcttcaatggacat

SEQ ID NO: 66975 - DNA, 98 bp, Mus musculus
gactcactgtgtcccaggctgaccttgaacttagaaatcagtctgcattttttatgcctgtatttctatctttatatcaagctggatcttagtgttgc

SEQ ID NO: 66976 - DNA, 138 bp, Mus musculus; identical to SEQ ID NO: 66969

SEQ ID NO: 66977 - DNA, 108 bp, Mus musculus; identical to SEQ ID NO: 66970

SEQ ID NO: 66978 - DNA, 97 bp, Mus musculus; identical to SEQ ID NO: 66974

SEQ ID NO: 66979 - DNA, 98 bp, Mus musculus; identical to SEQ ID NO: 66975

SEQ ID NO: 66980 - DNA, 140 bp, Mus musculus
atatgcatatatatgtatgtatacacacacacacacacacatatatatatgtttgtgcgtgtatgtatatatgtatatgtatatgtatatgtatatgcatatgcatatgcatatgcatatgcatatgcatatgtatacac

SEQ ID NO: 66981 - DNA, 91 bp, Mus musculus
gtgattaagcagggggtggagatatggctcagtggttaagagcactgactgctcttccagagatcatgagttcaattcccagaacccacac

SEQ ID NO: 66982 - DNA, 90 bp, Mus musculus
acttgcagccaaggacacagtctctgactctgaatcaaaagatagctctaagtaagcagggactgtagagactctttctggcatgatagt

SEQ ID NO: 66983 - DNA, 78 bp, Mus musculus
acttctgttagtttcactgtgtctctgtttagtttctgtttccagatctgtccattgatgaaagtgggatgttgaagt

SEQ ID NO: 66984 - DNA, 121 bp, Mus musculus
agccctgaggggaaggatttgatggagacatccaatttagggctaagtattctgaggtctctctcactctctgtatatcatctgtttgtgggtctctgcatttgttcccatctgctgtagg

SEQ ID NO: 66985 - DNA, 69 bp, Mus musculus
ctgagctacatattgagatctgattttgttttttaaacgaagagcacaggggctggagggatggttcag

SEQ ID NO: 66986 - DNA, 58 bp, Mus musculus
gtatgtatatgtgtatgtatgtatatatatgcctatatgtgcgtgcacatgtgtgtgc

SEQ ID NO: 66987 - DNA, 60 bp, Mus musculus
gaagtatgtatgtatgtatttgtgtatatgtatgtacacatatatgtatgtgtgtatagc

SEQ ID NO: 66988 - DNA, 57 bp, Mus musculus
atacagacacacatacagacacacacacactatgtgtgtatctgtgtgtgtgtgtat

SEQ ID NO: 66989 - DNA, 85 bp, Mus musculus; identical to SEQ ID NO: 57439

SEQ ID NO: 66990 - DNA, 119 bp, Mus musculus
gggataaagctacatactgaggagctggagagatggctcagcggttaagagcactgactgctcttccaaaggtcctgagttcaaatcccagcaaccacaaggtggcttacaatcatccc

SEQ ID NO: 66991 - DNA, 79 bp, Mus musculus
cagagctaactgaagaggcttgtccagccagtcagtgaatctatctatctgtctgtctgtctgcctgtctgtctgtctg

SEQ ID NO: 66992 - DNA, 111 bp, Mus musculus
agttgtgagctgttatgtgggtgctggggactgaacctaggtcgattggaagaacagacagtgctctcaattactgagccttctctcccgcccagggatagattcttaact

SEQ ID NO: 66993 - DNA, 58 bp, Mus musculus
tacactcatgtatgtatgtatgtatgtatgtatgtatgtatgtatgtatgtgtgtgta

SEQ ID NO: 66994 - DNA, 82 bp, Mus musculus
ctgctgatgactctgtgtgcaagtgtgtctgtctcagtgtatcacgcacgcacacttgcaagcttggagtatgtacagacag

SEQ ID NO: 66995 - DNA, 103 bp, Mus musculus
gctggtggggatgagagtgagaccatctgtctttgtctgtctgtctgtctgtaacatatacacatgaacaaagatacacacacacactctgtttcttgtctgt

SEQ ID NO: 66996 - DNA, 76 bp, Mus musculus
ggaggaagtgtgacacaaggggtggactttggggtttcaaatgctcaagtcaggcccagtgtcactcactgtctct

SEQ ID NO: 66997 - DNA, 99 bp, Mus musculus
gagcagagttgggggctggagaaatggctcagtggttaagagcactgactgctcttccaaaggtcctgagttcaaatctcagcaaccacatggtggctc

SEQ ID NO: 66998 - DNA, 72 bp, Mus musculus
aagtttgtggaacaagccgtggagcatctgagatctcctgctcagtcagtctcacaaacttctaccacatac

SEQ ID NO: 66999 - DNA, 106 bp, Mus musculus
gacctttgctcactctggtcaactctggttgctcaagcctaaagatttttttattattatacctaagtacactgtagctgtcttcagatgtaccagagagggtgtc

SEQ ID NO: 67000 - DNA, 59 bp, Mus musculus
ctgatgcagaggccatggaggggtgctgtttactggctttctctctatgtctcactcag

SEQ ID NO: 67001 - DNA, 65 bp, Mus musculus
gcgaagataagtgattatgaagaacaggggaacctcctggactaggcgtggtcattcctcactgc

SEQ ID NO: 67002 - DNA, 113 bp, Mus musculus
ggagatcaaacacagggcctcgtgtgttagaaaattttgcctttaaaaaagtctctaaaattcattttatatgtatgagtgctttgcttgaatgtctgatgcctgaagtggcc

SEQ ID NO: 67003 - DNA, 82 bp, Mus musculus
gacatgtcatgcacacagtcactgtgtctggtggggctgggacttgacctggctagggacagtgagggaatgaagaaaagtc

SEQ ID NO: 67004 - DNA, 74 bp, Mus musculus
tgaatctgggtcctctgtaagagtagccgaggcttggggctggagagactgctcttccagaggtcctgagttca

SEQ ID NO: 67005 - DNA, 114 bp, Mus musculus
tgtgtgtgttcatgcttatatgtgcatgtgttcatgcgtgtgcctgtgtgtatgtctctgtatatgtgtatatgtgtatggacatgcgagtgtgagataaagtgagcttatgga

SEQ ID NO: 67006 - DNA, 75 bp, Mus musculus
tgtatatatgtatgtatgtgtgtatgtgcatatattatatgtgtgtgtatatacgtatttgtgtgtgtgtatata

SEQ ID NO: 67007 - DNA, 96 bp, Mus musculus
gttcttaagttgggctagagagatggctcagtggttaagagcattgactgctcttccagaggtgctgagttcaattctcagcaacaacatggtggc

SEQ ID NO: 67008 - DNA, 76 bp, Mus musculus
tgctggaagcctgtataaaggacatgaaagaaggaagcctctctctctgtctgcttgtccttgccccttgctagca

SEQ ID NO: 67009 - DNA, 84 bp, Mus musculus
gtctatgtgtgtgcctgtctctgtgtgtagttgcttgtgtgtgacatgctacagtgtgcatgcagaggctgggggacaaccgtg

SEQ ID NO: 67010 - DNA, 111 bp, Mus musculus
cattctataaatgaatgtttatatgtaggtctgtatacatgtatgtatgcatatatgtatttatgtatgaatgaatgtatgcatgtatgtatttttgtatttgtattatga

SEQ ID NO: 67011 - DNA, 69 bp, Mus musculus
gcctttataagagttgtcattttcatgctgtctcttcacagcaatggaaataccaaccaagacacaggc

SEQ ID NO: 67012 - DNA, 75 bp, Mus musculus
tctctatatatatatatatatatgtatgtatgtatacatgtatatgtatatgtatatgtatatgtatatgtaaga

SEQ ID NO: 67013 - DNA, 72 bp, Mus musculus
cctgaggcacagaagtgacttagctcaaggacaacctattcaacaagacaggctcacctctttgcctccagg

SEQ ID NO: 67014 - DNA, 86 bp, Mus musculus
ttttagactcttcagggacagttataaatttgattatatctgaaatagcagatttcaagttgaagtcccctttgtccactctggaa

SEQ ID NO: 67015 - DNA, 78 bp, Mus musculus
ttctgtttgctgggtttttgcttcagtcattctagaattaagttccccgaaccagagcacagaaaacagtgaccagaa

SEQ ID NO: 67016 - DNA, 75 bp, Mus musculus
gacatacgcatgtggtgcacgtgcatgtgtgtggccacagatgtgtgtgtgcacccaatgtggacgtgcgatgtc

SEQ ID NO: 67017 - DNA, 81 bp, Mus musculus
gcattgaacagggctggagagatggctcagcggttaaaagcgctcactgctcttccagaggtcctgagttcaattcccagc

SEQ ID NO: 67018 - DNA, 118 bp, Mus musculus
ggccattcctatccaaaccagcactgatggatggatgatgagccacatggttgtatagttgtatatgtgtggatgtgtgcttaggtggtccttagccttggaagttggtggccaggga

SEQ ID NO: 67019 - DNA, 88 bp, Mus musculus
cataaaagggacagtgctgtgaagagaacagctgtatggagacctggctctcggtgcagccttccttctctgagaaatgtttgtgatg

SEQ ID NO: 67020 - DNA, 78 bp, Mus musculus
ttgaagagttctgagaagcaatcatatggtctccaggtgatagtcacaggccaatgagctctctctctctctcctcag

SEQ ID NO: 67021 - DNA, 60 bp, Mus musculus
tacatatacatatacatatacgtatatgtatacgtatatgtatatgtatatgtatatgta

SEQ ID NO: 67022 - DNA, 82 bp, Mus musculus
gatgctcagaggacagattaacctaagctggaattgtgttgggaaaatgagaagcttgtggctgtctgtctgtctgtctgtc

SEQ ID NO: 67023 - DNA, 79 bp, Mus musculus
aaagatggaggctgtcactcactgccactcgccgttgtagaggcttttggaaagggagctgaactggcctctagtcttt

SEQ ID NO: 67024 - DNA, 102 bp, Mus musculus
tgctctattgtactttttgagatgggggtctctcactggctctagagctcaccaatgctgtcaatgaggtccagagacctcagtcctcacctctttggagca

SEQ ID NO: 67025 - DNA, 118 bp, Mus musculus
tcctcaaagtctgtccacttcagtgtgcctcagagatgatgtctttctctctccctcagttctctgtgtaaagctatcgtcctgtaggtgcactgctcctgatgctagcaaaggagga

SEQ ID NO: 67026 - DNA, 114 bp, Mus musculus
cacaagggtcttcttggggtctagcatttcttttcgtttcagacaacaggtgccatgccagctttgtgtgtgtgtgtcactgaaagatagctccaagtttttgtgtcaaccttt

SEQ ID NO: 67027 - DNA, 87 bp, Mus musculus
gtttttctgtgggtctctctgtgtgtgtggatagatgtgtgagtgtgatatataattctttaatagcaccgaagtcggcaggctgac

SEQ ID NO: 67028 - DNA, 118 bp, Mus musculus
ccaggtgaagtgacaagggctggagactggggagaggcaatggtcctgtctctctctgagccagtgccgagccagggccagaagggccatcccctcttctcagcctgtgtccttctgg

SEQ ID NO: 67029 - DNA, 70 bp, Mus musculus
tcagtgtctgtctctctccatctccacccccctcccctccagtgctgggattacaagggcagaccactga

SEQ ID NO: 67030 - DNA, 60 bp, Mus musculus
ggggggaggtgccagggggaagagcgggaagagcgcttctctctctgtgtgtgacttctc

SEQ ID NO: 67031 - DNA, 78 bp, Mus musculus
acttctgttagtttcactgtgtctctgtttagtttctgtttccagatctgtccattgatgaaagtggggtgttgaagt

SEQ ID NO: 67032 - DNA, 95 bp, Mus musculus
cagcctcaaacagatgttgtctccagtccaggcagatgctagcttaaattcagacagatgtctgccaccagagatacataaagatgctgagaggt

SEQ ID NO: 67033 - DNA, 60 bp, Mus musculus
ggctctctctcactctctccttgtaaccctcagcattggtgagaatgagcccagaaggcc

SEQ ID NO: 67034 - DNA, 57 bp, Mus musculus
gggctcaccctcagactgtctgatagtaggtgcctggcagggagtggcagggggtcc

SEQ ID NO: 67035 - DNA, 81 bp, Mus musculus
gcaagagcagcaggtgctctaaccactgagccgtctctctctcttaaatcctgagcccctgtcagtctctgtccatcttgc

SEQ ID NO: 67036 - DNA, 61 bp, Mus musculus
attggcagagtaggcaaggtggggggtggggtggaaaggtcactgtgtctgtctgtccagt

SEQ ID NO: 67037 - DNA, 90 bp, Mus musculus
agggtatgtgtgtgtgcgtgtgtgtatgtacacacatacatgcacatgtatgtatgtatgtatgtatgtatgtttacacacacactcttt

SEQ ID NO: 67038 - DNA, 69 bp, Mus musculus
gagcgctgtctgtctgtctgtctggcactcccgcagcagagactgcagatggataggtaggaggcgctt

SEQ ID NO: 67039 - DNA, 85 bp, Mus musculus
gctatggggagtgtcttgagggatgaacctggggaagagtggtcatgaagtctctctctgtctcattcaaggccaagttccaggc

SEQ ID NO: 67040 - DNA, 78 bp, Mus musculus
gggccccacatgatggagggagagaaaggactcctaagacttgctctctgactgacacacatcatgcaacactggccc

SEQ ID NO: 67041 - DNA, 63 bp, Mus musculus
agaagcttccttcccggcttcacatcctggcacctgtgtgcctgagtgcctggatccgtttct

SEQ ID NO: 67042 - DNA, 78 bp, Mus musculus
gcaaaccagtgagagaactgactcacagaagactgagagcaagttttcctgagtcaggctttctgcctccctgcctgc

SEQ ID NO: 67043 - DNA, 79 bp, Mus musculus
gtgagagatcatcattggatagggacatcgttgaggcctgagccggccctgtgagcctccctgtctcagcatcactcac

SEQ ID NO: 67044 - DNA, 111 bp, Mus musculus
ggagacatgcaaggactagcggtgcagacacagtggagagtactgagctcataggaaagcccaataggggtcacagactcagtccctggggccctgaaagtcttccattcc

SEQ ID NO: 67045 - DNA, 58 bp, Mus musculus
gggacatggaaacaggacatccaggggctccgtgctggcatctctgtctctctgtctc

SEQ ID NO: 67046 - DNA, 69 bp, Mus musculus
gggtcctgctgacagaactcagtgtggttccagatgggggtgtcctctgagacctggggcaagggctcc

SEQ ID NO: 67047 - DNA, 94 bp, Mus musculus
gttataatatgtgtatagtgtgtatgctgtatgtatttaagtgtggtttgtaaatatgtatgcatgtggtatgtgtagtatatgtatgttttgc

SEQ ID NO: 67048 - DNA, 95 bp, Mus musculus
gcctgtatctgtgcatgtacatatgtataaatatatgtacatatatatgtatgtttatgggtgcacatgtttgtacatgtgtgtatgcatgggtg

SEQ ID NO: 67049 - DNA, 88 bp, Mus musculus
tgtgtgtgtgtgtgtgcgcgtgcatctgtctgtctgtttgtctgtctgcataagccagcatgcacgcatgcacgcacgaacgcatgca

SEQ ID NO: 67050 - DNA, 79 bp, Mus musculus
gtgtgcatgtgtgagagaggccagaagaggaatgacttcctgtgttctgcagtcagtctctgactcattcccgagatac

SEQ ID NO: 67051 - DNA, 115 bp, Mus musculus
gcacgtagaatccttggtgttaaaaggtgtttcattgcaatatatatatatatatatatatatatatatatatatatatatatattgttcatgtttttaagtgagtgatttttgc

SEQ ID NO: 67052 - DNA, 75 bp, Mus musculus
tccatagagtgcaatgttctcagggcagcagtgaaggtgtaactcagccctgtgtgattgcaatgtttaagtgga

SEQ ID NO: 67053 - DNA, 78 bp, Mus musculus
ctcacactggctgactgaaaccctgtttgtggactctgctcccttcatccttgtgggttggtggccagtgactctggg

SEQ ID NO: 67054 - DNA, 79 bp, Mus musculus
cagactgagggaagtggtcaagaaattcatgtgggagccaacaggcacctgtctgtctgtctgtctgtctgtctgtctg

SEQ ID NO: 67055 - DNA, 70 bp, Mus musculus
tgcccttgtttgggtcagccttgtagtttgggtggactagcagtctgcctctgactcagtagccggggca

SEQ ID NO: 67056 - DNA, 117 bp, Mus musculus
gtgtgacacactgtgacccactgcagcttccacactgaagtggcttatttatttatttatttatttattttattttggtggggaggttgcaagggtggaggaggagatgagtgagac

SEQ ID NO: 67057 - DNA, 74 bp, Mus musculus
agtgtgtgacagtcactgtctgccccaagtacccccatcctggttattggagccagctgtgattttcacatgtt

SEQ ID NO: 67058 - DNA, 73 bp, Mus musculus
aggacacacagtctgacagtcagagagtgatctcggaacacacaaccgagcccagactggcagactgcctcct

SEQ ID NO: 67059 - DNA, 114 bp, Mus musculus
gcgttgtaagaaaacatcctggggctggagagatggctcagcaggtaagagcactgactgctcttccagaggtcctgagttcaaatcccagtgaccacatggtggctcacaacc

SEQ ID NO: 67060 - DNA, 72 bp, Mus musculus
ggatggaagagagagaggggctaaaagaaaaggtgatggtaagattctgtgtgtctgtctgtctgtctgtct

SEQ ID NO: 67061 - DNA, 77 bp, Mus musculus
gctatgcaggtctggaactcaaggatgtgactggctccttgtgggtcagtccatctcacagtctcgggaatgcaggc

SEQ ID NO: 67062 - DNA, 100 bp, Mus musculus
gccacacacatacacactggactggctgtgtggtgacagtgcacagatggcaccagaagatggcctctgaatctccacacacagccaccctgccaatggc

SEQ ID NO: 67063 - DNA, 102 bp, Mus musculus
gggcattcattatgggggctggagagatggctcagtggttaagagcactgactgctcttccgaaggtcctgagttcaaatttcagcaaccacatggtggctc

SEQ ID NO: 67064 - DNA, 104 bp, Mus musculus
ttcccttttctacacctgtgaccgaaatgatgttgtagacagtactctgtgtgtgtcccctgccttctaagtcactttttggtaatgtgaaggaaagaaaggag

SEQ ID NO: 67065 - DNA, 62 bp, Mus musculus
ggaacattacagggacagtgcatggtggagccagctctctatgtctgtctgtttatctatct

SEQ ID NO: 67066 - DNA, 81 bp, Mus musculus
ggtgtcatttgtgagtgaccacacggagaaggagtggttagcttctatgaaagaaaagtgggcaaactcaagagtggtggt

SEQ ID NO: 67067 - DNA, 134 bp, Mus musculus
gaaaagcagtcagtgctcttaactgctgagccatctctccagcccaataaattatatttttaaaaaaccaccttggactggagagatggctcagtggttaagagcactgactgctcttccagaggtcctgaggt

SEQ ID NO: 67068 - DNA, 126 bp, Mus musculus
ctgttacagcagggctgtgattaaacatgtaaggatcggtgccagcagctctctgtgtcagtggatctcatgtgtgagcacacacgtgtccatgtattttattgcagagagatgtacagaacgctc

SEQ ID NO: 67069 - DNA, 89 bp, Mus musculus
cagagatcaaactcaggcggttagtctggctgcagttgcatttgcttgctgagtgtacctccctgtctctgtctctgtctctgtctctg

SEQ ID NO: 67070 - DNA, 104 bp, Mus musculus
cttatgcgatattccgagtgtatatggaggtccctttcagtgctgaccactctgtcacttggtctcagcacttggaccagttacgagtcttgcattagctgctg

SEQ ID NO: 67071 - DNA, 96 bp, Mus musculus
tgactgaccttgcagaagcagctacatcctcaggaaggatttttatttgtttttaatcggagctgaggtgaaagaagttgagtctcaaagcagtta

SEQ ID NO: 67072 - DNA, 138 bp, Mus musculus
ctaggctggagctttgtcctctgtgctggggccctcatctgcatcacaaagtggccgtctgtccctgtctgggtctgaggggaagtgtcttcctttctcagactaaaagctgggggcagggcgaggttggggagtaga

SEQ ID NO: 67073 - DNA, 116 bp, Mus musculus
tatagatagatagataggtatatatatatatatatatacctatatatatctatatatgtatatagatagatatagatatataagtatatctatctatatctatatatacatacata

SEQ ID NO: 67074 - DNA, 99 bp, Mus musculus
cactctctattgtttccgttttgtttgaatgttttactattctcaagtgacacttgagaatataatgatataatgataagtgatataatatctcgagtg

SEQ ID NO: 67075 - DNA, 68 bp, Mus musculus
ctcaccttattctcacgcagcagaggctcaccctttgggcctgactgactgactgactggtcagtgag

SEQ ID NO: 67076 - DNA, 91 bp, Mus musculus
cattcagcaaactaaacagaactctgtatgtagacataagagcccaagccacttgtgtttgtgcatgcgtgtgtgtgtgtgtgtgtgtgtg

SEQ ID NO: 67077 - DNA, 141 bp, Mus musculus
atggatatatatatatatgtgtgtgtgtatatatatatatatatatacatacacatatatatgtgtgtgtatatgtatatatatgcatatatgtgcacatatatgcacacatatatacatacacacatgtatgtatgtgta

SEQ ID NO: 67078 - DNA, 85 bp, Mus musculus
tttgactctagagaaccctgactaatacacacacctttaatcctagtactctggaggcagaggtagaaggatctcttgagttgga

SEQ ID NO: 67079 - DNA, 74 bp, Mus musculus
ggcagggagacactaaaatgtgtttttttgtctttaaaaaaccctcactctaaacacttggtgcgattcttgcc

SEQ ID NO: 67080 - DNA, 84 bp, Mus musculus
tgtgtatctgtgtgtgtgtgtatatatatatatatgtgtgtgtgtatgtatgtatgtatatatatgcaaatactcatacacata

SEQ ID NO: 67081 - DNA, 68 bp, Mus musculus
tgtatgtatgtatgtatgtgtatatgtgtatatgattatatgtatatacacacacatacacacacaca

SEQ ID NO: 67082 - DNA, 79 bp, Mus musculus
gttgttttttgatcttgtgtgtatgtgcatggtatttgcataaacacatgtatacacagagagagacagacagacagac

SEQ ID NO: 67083 - DNA, 95 bp, Mus musculus
ccatgtttattttgcccagtgtattatttctgctgtgtcattctgtgtcttgcacacaggaagaattcagtttcagatgagtgaacgaaatctgg

SEQ ID NO: 67084 - DNA, 115 bp, Mus musculus
ttatcatgttgctttctcatgatagtaagaaagagttctttctctctgtctgactgccttgtggtagggactttgtctcctgatttgggtctcagattgaaacgaggtcatcagc

SEQ ID NO: 67085 - DNA, 85 bp, Mus musculus
caggagcaagtatcaggaagctgggggtctgactcagtcagtgtggcgcttgccttgcaagcatgaaagtctgagagcaggtccc

SEQ ID NO: 67086 - DNA, 82 bp, Mus musculus
agtgttctagcagttgcttctcttccaggaggtgtccgcagtttgcctctctgtccctgtgtggctcctgtttagaaacact

SEQ ID NO: 67087 - DNA, 78 bp, Mus musculus
ctgaccttagttttgctgtggtatctctgccagcatctctgttgctgggtgggtgcctcagtccctagcttctctcag

SEQ ID NO: 67088 - DNA, 84 bp, Mus musculus
agtatgaggttccagtttgatatgtgccccttttgtctgtgactgtgtcacagacaaagctccgggttaatcaaagcctcgtct

SEQ ID NO: 67089 - DNA, 120 bp, Mus musculus
tagacagtctctggagctctgcacatatgtgtatgtatgtccatacatacatatgcatgtatgtatgtaagtatgcatttgtatgtgtgtgtagctccatctccttgtgctactatgtgc

SEQ ID NO: 67090 - DNA, 71 bp, Mus musculus
gccaggtgactaatgacagtgtactcagggcccacaaggagtcctgtcacgctgtcactgcccactgaggc

SEQ ID NO: 67091 - DNA, 70 bp, Mus musculus
ccagactcaacctgggatttgtggatgctgcttcacctagactcattctgtcagactctctatagtctgg

SEQ ID NO: 67092 - DNA, 130 bp, Mus musculus
gtgcatgtgtgtgtgcatgcttgtatgtacgtatctgtgtatatacatatgcatgaatgtaatgtatgtatgtatgtatgtatgtatgcatacatgtgtgtatgtagatgtgtctatgtatgtggcatag

SEQ ID NO: 67093 - DNA, 96 bp, Mus musculus
cactagactggttctccatgcaaatgttgtcttaggagggctctggggtggtagatcctaggacagagaattgagtgtgggaaatgctggggagtg

SEQ ID NO: 67094 - DNA, 94 bp, Mus musculus
cctctgacaaggttacccataaagaaaaattgtatttctcatagctctggagtatatgggaagtccaacatcaaggtggtagcatatggtgagg

SEQ ID NO: 67095 - DNA, 82 bp, Mus musculus
tcatgtacagatctctctctctctttgtatggtaccttagtattgttaattaatagcgggggtggggggtgggttacactga

SEQ ID NO: 67096 - DNA, 116 bp, Mus musculus
gtgtatatgtgtgtgtgtgcatatatatgtatatatgcatgtattgtgtgtatctatgcttatgtgtatatatatatgtgtgtatatatgtgtatgtgtatatatggtatgtatat

SEQ ID NO: 67097 - DNA, 72 bp, Mus musculus
cgggacaaagcagagagtgagcagagagacagatctaacgggagtttccctgtgtccattcaaagtttcctg

SEQ ID NO: 67098 - DNA, 126 bp, Mus musculus
tcaagtgtgtgcagggggcccacaggggtctgtccaaaaagagagggtgtgagagctactcgatctggagttgactacagttgtgagcctttgtgcacgttctgggaacccagcacgggtcctttg

SEQ ID NO: 67099 - DNA, 85 bp, Mus musculus
tattcacaaacacagaaacactatgtatatatgtatgtatgtatgtatgtatgcatgtacatatgtgtgtgtattaatgtgtgta

SEQ ID NO: 67100 - DNA, 86 bp, Mus musculus
gtgctaccaggcttgtttcctgtgtttggatgctctgtttttaaacacagacacacagacacacagacacacagacacacagacac

SEQ ID NO: 67101 - DNA, 79 bp, Mus musculus
cctgcctgtagctctctgtctcatgcatttcctctagtcatcagctaacaagaaatggacagagaagagacagggcagg

SEQ ID NO: 67102 - DNA, 62 bp, Mus musculus
ctggtgatttgggcagttttgggtactcagcttcgactcatctgaccctgcctctctgccag

SEQ ID NO: 67103 - DNA, 61 bp, Mus musculus
tatgtatgaatgtatgtatgtatgtatgcatgtatgcatgcatgcatgcatgtatgtatat

SEQ ID NO: 67104 - DNA, 93 bp, Mus musculus
cgcactttgggagtgtttcagagatccctttagtttctgcactgggatggtctgtggtgtgggagagaagacagagatcactgagaaggtggg

SEQ ID NO: 67105 - DNA, 95 bp, Mus musculus
atccggtagacatggaccccaggtgagagagtccacagtgaccctccaggcgtctggttcttcggggtctacgtgggtgtggacaatgtttcctg

SEQ ID NO: 67106 - DNA, 94 bp, Mus musculus
gtggtttgtgcaacgatttcctctcaagatctcgggggtttgggtcctggcttggttcctcctgaggtctccatggcttgttgatacaaatgac

SEQ ID NO: 67107 - DNA, 85 bp, Mus musculus; identical to SEQ ID NO: 57439

SEQ ID NO: 67108 - DNA, 109 bp, Mus musculus
gagttctagggagtactgggtagttcatattgttgtttcatgagtttctagatcttatttcacagagctcacaagcacccataactccagctccagctccagaggaccc

SEQ ID NO: 67109 - DNA, 61 bp, Mus musculus
tctgtctgtctctctctctctttgacacacacacatacagagagagagagagagagagaga

SEQ ID NO: 67110 - DNA, 59 bp, Mus musculus
ctctctctgtatgtgtgtgtgtcaaagagagagagagacagacagacaaacagatagag

SEQ ID NO: 67111 - DNA, 73 bp, Mus musculus
gagttattcctgtctctcccacactgggtgctacagttactcctgtcccccacactgggtgttacagttactc

SEQ ID NO: 67112 - DNA, 56 bp, Mus musculus
ggtaggtggcaagtggggtgtgggacatcaccctggcaccctctctgcctctcagc

SEQ ID NO: 67113 - DNA, 66 bp, Mus musculus
tgtatgtatgtatgtatgtatgtatacacatatatatgtgtgtatatacacacacacatacataca

SEQ ID NO: 67114 - DNA, 86 bp, Mus musculus
tggggtggctcaggtcatccaggagggacactgaatccatggcagcctttgtgtgtcctcctgtctgtctatctgtcttagcccca

SEQ ID NO: 67115 - DNA, 60 bp, Mus musculus
cagactctgtgtctgtcagctgtcagagtgcggcatgctgagaacagacagaatgtcttg

SEQ ID NO: 67116 - DNA, 105 bp, Mus musculus
ttgttctttccccttatatgactattgctagctcttttaaaatctttatttattttgtaggggtgcttacgttaaccatggtgtatgtgtagagacagaggacaa

SEQ ID NO: 67117 - DNA, 106 bp, Mus musculus
ggcttggtcttctgaggagttcccccaacatctggagcagaggtggggggcggtctgcccctgactctgtggctcttgtggatcctgttctcccaactgggctgcc

SEQ ID NO: 67118 - DNA, 96 bp, Mus musculus
ggaaatactgctgagaccatgtgtatgtatgtgtgtgtgcatgtgcatgtgcgcgtgtgtgcgtgtgtgcatgtgtgtgtgtgtgtgtgtatgtct

SEQ ID NO: 67119 - DNA, 96 bp, Mus musculus
gagtagggcgcatctgcctgagtgactgccttcagcttgtctgaggctctgactggctcaagagggcatgcgttttgggatggggatggtcttctc

SEQ ID NO: 67120 - DNA, 113 bp, Mus musculus
tctctggctgagcatctgcgatcgtgtgaatgtatatgtcactgtatttctgtgtgcgtttacctagaaatcacgtcagctcattggctagttcgcacaggcttgtctgatga

SEQ ID NO: 67121 - DNA, 101 bp, Mus musculus; identical to SEQ ID NO: 59975

SEQ ID NO: 67122 - DNA, 103 bp, Mus musculus
gctgtgtcttcaagcttgggactaaagtttaagtgggtggctgtcctctctgagtctttgtgttcagccaccaaagcacttggtcccttgctactacatttgt

SEQ ID NO: 67123 - DNA, 93 bp, Mus musculus
gtatatatgcaagtatgtatgaatgcatgtatgtatatatgtatgtatgtatatatgcatgtatgtatgcctatatatgcatgtatgcttgta

SEQ ID NO: 67124 - DNA, 70 bp, Mus musculus
tatgtacatgtgtctgtgtgtctgtgtccctgtttgtgtgtgagtgcatgtgtacaagcatgtgtgtgtg

SEQ ID NO: 67125 - DNA, 68 bp, Mus musculus
gtgtgtgtatatatgtatgtatatgtatatacatatgcatgtatgtatatatatgtatatacatacac

SEQ ID NO: 67126 - DNA, 68 bp, Mus musculus
gtgtgcacagtggcagagcattaattacccaccaacccccatgtgtgtgtgtgtgtcagtgtgtgtgc

SEQ ID NO: 67127 - DNA, 80 bp, Mus musculus
ggttcaagctggagagatggcttagtggttaagagcactgactgctcttccagagatcctgagttcaattctcagtaacc

SEQ ID NO: 67128 - DNA, 72 bp, Mus musculus
catccgtgatctctcggtctgactgagactccgcccgcctcaatgagtaaggtagaagagtgattaaagatg

SEQ ID NO: 67129 - DNA, 87 bp, Mus musculus
gctatttgggcttccaggggatggctgtggttggacgatggaatcccttcttattttcagcttcctgttcccaatgccttcactagc

SEQ ID NO: 67130 - DNA, 69 bp, Mus musculus
ggcaccttgacctctgtgtggctctgtctctgcatgcatgtggataagctggtgtcggggcagggggcc

SEQ ID NO: 67131 - DNA, 77 bp, Mus musculus
agacagactgactgagtctcaggtcaagccaggcacagaggggtttgggtatgagaagagagctgagtgtgtttgct

SEQ ID NO: 67132 - DNA, 128 bp, Mus musculus
catatttttttttttgtgtatatatatatatatatatatgtgtgtgtgtgtgtgtgtatatatacatatatatatacacacagatatatatatgtatatatgcatacatatgtatgtatgtatatatg

SEQ ID NO: 67133 - DNA, 86 bp, Mus musculus
tttctgcatctcctcagtggctgtgtgtctgtgttacatgtatgtgttcatgtgtatacagattcatgcatgtggaagtgtggaag

SEQ ID NO: 67134 - DNA, 60 bp, Mus musculus
gactctctcagtctctgcctggcgacctctcttgagtggcagccagggacagggtatgtt

SEQ ID NO: 67135 - DNA, 93 bp, Mus musculus
gttgtcaggggctggagagatggctcaacggttaagagcactgactgctctttcagaggtcctgagttcaattcccagcaaccacatggtggc

SEQ ID NO: 67136 - DNA, 63 bp, Mus musculus
gctcccagaagcactcatgagtgtttgctctccagaggccaacacactcactgtttctgttgc

SEQ ID NO: 67137 - DNA, 65 bp, Mus musculus
gcactcaaacgctctctgcctcagttttgtcctctgtaaaatgggggtggcgagagtatgtgtgc

SEQ ID NO: 67138 - DNA, 101 bp, Mus musculus
ctgggaattgaggctctcttgctccagccttgcttgctccaccccaaagatttatttattattatatgtaagtacactgtagctgtcttcagacaccccag

SEQ ID NO: 67139 - DNA, 117 bp, Mus musculus
atatgtgtgtgtgtgtgtacatgtacatatatgtatatagaatgcatgaatgtatgtatatatacatgtatgtctgtgtatatgatgtatatgtatacatacatgtatcatacatat

SEQ ID NO: 67140 - DNA, 82 bp, Mus musculus
ccctcccactcctgtctgcagtctcactctccctggcccagaccagtgaggcaggagggaggagtttccaggcaggaaagag

SEQ ID NO: 67141 - DNA, 85 bp, Mus musculus; identical to SEQ ID NO: 57470

SEQ ID NO: 67142 - DNA, 107 bp, Mus musculus
aggctgttactgtcgttagtgtttccatgatgcaagggtgaccgtgtaggtacacaggtgacagtgcggagagtgtgggtacacaggtgatggtgtgggtgcagtgt

SEQ ID NO: 67143 - DNA, 136 bp, Mus musculus
ggaggaaggttgtcactggggctgggttccaaggtttcaaaagcccatatcaggcccagtctgtctgtctctgtctgtctggggctgggttccaaggtttcaaaagcccatatcaggcccagtctgtctgtctctg

SEQ ID NO: 67144 - DNA, 83 bp, Mus musculus
gagcttaatcctggctgaaagagaacagcacagagagacctgcctgctctctgtgtgtgtgtgtgtcccccagacagggtctc

SEQ ID NO: 67145 - DNA, 85 bp, Mus musculus; identical to SEQ ID NO: 57439

SEQ ID NO: 67146 - DNA, 97 bp, Mus musculus
tcaccaagatatattgaaaaaagaaagaaagccacaagatccaaaacaaattatagtgtgtgtgtctgtgtgtgtatgtttattcattatatggtga

SEQ ID NO: 67147 - DNA, 74 bp, Mus musculus
tgggacacagacaccgtacatctgaggtaaagtggaatccctccctgcctgtctgtctgtatgtctgtgtgtcg

SEQ ID NO: 67148 - DNA, 120 bp, Mus musculus
tctttggccaatttgatgcagctggggtcagggtcatctagaagaaggaaccacagtgaagacactgtccctctctctcagcctggccactctgtgggtgttttcttgtttggtgcggga

SEQ ID NO: 67149 - DNA, 71 bp, Mus musculus
ggatattgaaaatgttctagggctggagagatggtactgactgctcttccagaggtcctgagttcaaatcc

SEQ ID NO: 67150 - DNA, 103 bp, Mus musculus
aagagctacatgtgcggctggtgagatggctcagtggttaagagcactgactgctcttccagaagtcctgagttcaaatcccagcaaccacatgggagttttt

SEQ ID NO: 67151 - DNA, 94 bp, Mus musculus
ggaatatggtcaaaaatacctttggaggagctggagagatggctcagcagttaagagcactgactgctcttccagaggtcctgagttcaattcc

SEQ ID NO: 67152 - DNA, 75 bp, Mus musculus
ggctgcgtctggtgacacagacaatgtttctgcctggctttttggttgtctgacacactgtttcactatgtagcc

SEQ ID NO: 67153 - DNA, 57 bp, Mus musculus
gtgtatgtatgtatgtatgaatgtatttagtatatgtgtatacatgcatatgtggac

SEQ ID NO: 67154 - DNA, 110 bp, Mus musculus
gtgtgtgtgtgtgcgcgtgcgtgtgtgtgtgtgtgtgcatgtgcaggtatgtgcatgtgcatgtgcatgtgtgtatgcctgtgtgtatgcctgtgtgtgtccgtgtgtgt

SEQ ID NO: 67155 - DNA, 117 bp, Mus musculus
ctctcctctcagagctgggtggtcctcaggctgagtggatgctctctctctttcacagaggaggcaattacaactcagagaggaaaagctctgcctggtgtctctgtgtaccgagag

SEQ ID NO: 67156 - DNA, 89 bp, Mus musculus
ttggccgtctctgcagttccaggagttgttttaaatttcagaagcaataatttttttcttttggataggtcaggcagggattggcacaa

SEQ ID NO: 67157 - DNA, 81 bp, Mus musculus
ggttcacaccctctgtcactccgagatcctctgggctccagagcgaggaaccctgggtctttgtacacgtgtctgtgcgcc

SEQ ID NO: 67158 - DNA, 92 bp, Mus musculus
gggggagactggagagatagctcagtggttaagagcactgatgctggctgcttgctcttccagaggtcctgagttcaagttccagcaaccac

SEQ ID NO: 67159 - DNA, 89 bp, Mus musculus
ggtttttatatatctcaaggagttcagagaacctgttctggggacctctggtccccagtagaggctcatgggggctgtggatgaggacc

SEQ ID NO: 67160 - DNA, 84 bp, Mus musculus
ggaggaagagagggagctgaagagatagcacagcccttaagagcactgactgctcttccagaggtcctgagttcaaatcccagc

SEQ ID NO: 67161 - DNA, 106 bp, Mus musculus
gagcctcctctaggctcctcctgttgtcctggcttggactcctgagtctctgggagtctgagagctttggctcctgatgggagaggaaagagctggaggctcccag

SEQ ID NO: 67162 - DNA, 74 bp, Mus musculus
gggcactgtctgtctgtctgaacgtcgtcgtaaccagctccgtctgcatcctctttcggcgcgcagtctggccc

SEQ ID NO: 67163 - DNA, 70 bp, Mus musculus
catgtatgtctatatacatctatgtatatatgtatatacatgtatatgtacgtgtatatgtatgtatatg

SEQ ID NO: 67164 - DNA, 104 bp, Mus musculus
tagcaatcataataatgtaaaacgacttagtgtctctgtgtgtctgtgggtgcatgtaccacacagcacacgtgtggaggtcagaggacaccttgtgggagttg

SEQ ID NO: 67165 - DNA, 75 bp, Mus musculus
ggtgtgagtgtgagtgagtgtagtgagtgtgagtgtgtctgccaagctctcgagcactcacacactaacacactt

SEQ ID NO: 67166 - DNA, 73 bp, Mus musculus
tgaagtgtgttagtgtgtgagtgctcgagagcttggcagacacactcacactcactacactcactcacactca

SEQ ID NO: 67167 - DNA, 95 bp, Mus musculus
ctttgtggcgtttgagactgggtctcactgtgtgtcttgggctaccatggggatgacctggaacccacagagatccacctcctctgccttcagag

SEQ ID NO: 67168 - DNA, 101 bp, Mus musculus
ggagttgtctccatgagggctggagagatagctcagcggttaagagcactgactgctcttccagaggtcctgagatcaattcccagcaaccacttggtggc

SEQ ID NO: 67169 - DNA, 76 bp, Mus musculus
gcatgtatgtatgtatgtatgtatgtatgcatgtgtttatgcactgtgtgtgtggtatatgtatatgtgtgtatgc

SEQ ID NO: 67170 - DNA, 88 bp, Mus musculus
ctttttaaaaagtttttgtgtgttttgcctgcatgtaaatgaaccacaagcatgtagtactcagagtgctcacagaggccagaagagg

SEQ ID NO: 67171 - DNA, 103 bp, Mus musculus
accatttttgtttaaggagagtttatctgggactggttcagcggttaagagcactgactgctcttcctgaggtcctgagttcaattcccagcaacctcatggt

SEQ ID NO: 67172 - DNA, 125 bp, Mus musculus
gtgagaaggtgagctttgcttcattggtctctctttgcctcaggacttaaagtggacagagtgctcatcctgctttcacaatagtctttggctttgttctgaatgcctgtgtatttgagccgctt

SEQ ID NO: 67173 - DNA, 63 bp, Mus musculus
agcctctctttggctctgcatgaattctagaagggtctgtgaatggcaggggtgtgagatgct

SEQ ID NO: 67174 - DNA, 116 bp, Mus musculus
gtatgtatctatcatgtatgtgtgtatgtatctatatttgtctatgtatctatataactatctataatgtgtgtgtcaatcatgtatatatgtatatatatatctaccatatatat

SEQ ID NO: 67175 - DNA, 68 bp, Mus musculus
gggtcctgtcttcctgttgctatcccatgccagtacacagtcaaggactcagaacagtgacaggaccc

SEQ ID NO: 67176 - DNA, 79 bp, Mus musculus
ttctgaaagccacttgtctctcacttgcacgggtgttccaggagcaccatggccaggtgactgatgacagtgatcagaa

SEQ ID NO: 67177 - DNA, 71 bp, Mus musculus
gggtgcctgggtgcctgtaatggtagtctcccttcatgtgttggctagagagccttgcctcccagaagccc

SEQ ID NO: 67178 - DNA, 128 bp, Mus musculus
gtatatatgtgcatgagtgcatgtgtagtatcatttgtgtgtacatgagtgcataggtatgtatgcatgtgtgttatgcatgagtgtgttgcatgtgtgtgtgcatgaatgcatgtatatgtatgcat

SEQ ID NO: 67179 - DNA, 103 bp, Mus musculus
ccaggaaatagatcccaggagccagggagactatcggcttcttctgacagagggagttgagggctaagatgtctcccaactctggtctctgaggctgtactgg

SEQ ID NO: 67180 - DNA, 76 bp, Mus musculus
gcgcgcgcgcgcgcgcgcgcgcgtgtctatgtatatgcctatgtgtgcatgtctgtgtgtgagtgtgtgcgtgtgt

SEQ ID NO: 67181 - DNA, 89 bp, Mus musculus
gcctgagggtctggacagagcacaaatggagagaaaaggtgagggcaggcttactatctcactgtctctgcttcctggcagccataggc

SEQ ID NO: 67182 - DNA, 90 bp, Mus musculus
atggctggatatataggtatgtacgtgtacgtgtatatatgtatatattcatatgtatagatgatatgtatagattatatgtgtatatat

SEQ ID NO: 67183 - DNA, 111 bp, Mus musculus
cacccaacaggtgctcgtggaagtttgttgattgactgaaggagatgctcagctttggagactctcactgcctctcatgagagacaaggtgcccaatagcacacctgggtg

SEQ ID NO: 67184 - DNA, 117 bp, Mus musculus
ccagcttctatggcttccccgtgggttctgtctttctcttgtttcgctttgtgatgactgtgtggatagctggatgaatgaatggaggaacacttagccatgtctcccctgctctgg

SEQ ID NO: 67185 - DNA, 69 bp, Mus musculus
gctggagaaatggctcagtggttaggagcactgactgctcttgcagaggtcctgagttcaattcccagc

SEQ ID NO: 67186 - DNA, 108 bp, Mus musculus
gcacatggcatggtctggtgaccttcgagctgtcctgattccgactggcccactgtccctctgtgccttgcatcctagtggtgggagttatttctgacccagtaccat

SEQ ID NO: 67187 - DNA, 115 bp, Mus musculus
tgtgcatgagtgttttttagatttgtatgttcatgtagtatgtgtaaatatatgtatatatacacatatacatacatatgcatgtgtatataggttagtgcatttgatatgtata

SEQ ID NO: 67188 - DNA, 90 bp, Mus musculus
aggccaaacaccagagtaagctggcttttaaacttggagtatgtgtgagtgtgtctgtgtgaaagagtgtgtctgtgtgtgagtgtgtct

SEQ ID NO: 67189 - DNA, 74 bp, Mus musculus
gccatgcccagtctctccatgtgtgcacacttgtgtatgtgagtgtgcctgcttgagagagagttggaattggt
